United States Patent 9,061,059 (MODIFIED POLYNUCLEOTIDES FOR TREATING PROTEIN DEFICIENCY) - sequence listing, part 114

SEQ ID NO: 221507 - DNA, 15516 bp, Artificial Sequence
  Description of Artificial Sequence: Synthetic coding sequence
atgcactccagctcctactcctaccggtcttcagattccgtttttagcaacactacatccacgagaacctccttggactctaacgagaacttgctgcttgttcactgtggaccaactctcattaactcctgcatctccttcggctcggaatcctttgacggccaccgcctggagatgcttcagcaaatagctaatcgggtgcaaagagacagcgtgatctgcgaagacaaactgatactggccggaaatgcactgcagtccgattctaaacgccttgaaagcggggtgcagtttcagaatgaagctgaaattgccggatacattctggaatgtgaaaacttgcttcgccagcacgtcatcgacgtgcagatactgattgacggaaagtactaccaggcagaccagctagtgcagcgcgtcgccaaactgcgagacgaaattatggcactgaggaacgagtgttcaagtgtgtactccaaggggcgtattctgaccacagagcagaccaagttaatgatcagcggcatcacgcaaagccttaatagcggttttgcgcagactctgcatcctagtctaacctcaggtcttacccagtctctcacaccctccctgactagctcttcaatgacctccggcctgagttctgggatgacttctaggcttacaccctcagtgacccccgcttacaccccgggttttcccagcggcctggttcctaacttctcgagtggggtagagccgaacagccttcagacccttaagctgatgcagattaggaagcccctgcttaagtcgagccttctcgaccagaaccttaccgaggaggaaatcaatatgaagtttgtccaggatctcttgaactgggtggatgaaatgcaggtccagttggaccgtacggagtgggggagtgatttgcctagcgttgaaagccacctggaaaatcacaagaatgtacatcgtgcaattgaagaatttgagtcctccctaaaagaggccaaaatatctgagattcaaatgacagccccattaaaattgacctacgctgaaaagctgcacaggttggagtcccagtatgctaagctccttaatacttccagaaaccaggagaggcacttggacactctgcacaactttgtctcacgggcaaccaatgagctgatatggctcaatgaaaaggaagaggaggaggtggcctatgattggagtgaaagaaataccaacattgccaggaaaaaggactaccacgccgagctcatgcgggagttggaccagaaagaggaaaatatcaagagcgttcaggaaattgccgagcagctgctcttggagaatcacccagcacgtctcactattgaagcttaccgagctgctatgcaaacccagtggagctggattctccaattatgtcaatgcgtggaacagcatatcaaggagaataccgcatatttcgaattctttaacgatgctaaagaggctacagattacctcagaaaccttaaggacgccatacagcggaagtactcttgtgatagatcctctagtattcacaagctggaggatctggttcaagagtccatggaggaaaaggaggagcttctccagtataagagcaccatcgccaacctgatggggaaggccaagaccattatccagcttaaacctcgtaattctgattgtccactaaagacctcaatcccgattaaggccatctgcgactaccggcagattgagattacaatttataaagacgatgaatgtgtcctggcaaacaacagccaccgcgcaaagtggaaggtgattagtcctactggaaatgaggctatggtgccctccgtatgttttaccgtacctcctccaaataaagaggcagtggatctggcaaaccggatcgagcagcagtatcaaaatgtcctcaccctctggcatgagagccatatcaacatgaaatctgttgtgtcgtggcactacctcattaatgaaatcgataggatccgagcaagtaatgttgcgtctattaagactatgcttccaggcgagcatcagcaggtccttagcaatctacagtcccggtttgaggactttctcgaggacagtcaggaaagtcaggtgttctccggcagcgacattacgcaactggagaaagaagttaacgtctgcaaacagtactaccaggaattgctgaaaagcgctgagcgggaggaacaggaggaatcagtctataatctgtacatctccgaggttcggaatattagactccggctggagaattgtgaagaccggcttatacggcagatccgtactccactggagagagacgatcttcacgagagtgtgttccggatcacagaacaggaaaaactgaaaaaggagctcgagcgtctcaaagacgacttaggtaccatcaccaataagtgtgaagagtttttcagccaggccgcagcgagcagctccgttccaaccctgaggagcgagctgaatgtggtgctccagaacatgaaccaggtctacagtatgtcctctacttacatagacaagctgaagaccgtcaatctggtgctgaagaatacgcaggccgctgaggccctcgtgaagctttacgagaccaagctctgtgaggaggaggctgtgatcgctgacaagaacaacatcgaaaatctgatttccacattaaagcaatggcgatcagaggtcgacgagaaacggcaagtgttccatgcactagaggacgaactgcagaaggccaaagcgatcagtgacgagatgttcaaaacatacaaggagcgggatcttgactttgattggcataaggaaaaggccgatcaactggtcgaaaggtggcagaacgtgcacgtccagatcgataatcgattgcgtgacctggagggcatcggaaaatcactaaaatattacagagacacctaccatcccctcgatgactggattcagcaggttgaaacaacccagcgtaagatccaagagaatcagcccgaaaactctaagaccctggccacccagttaaaccagcaaaaaatgctcgtgagcgagatcgagatgaagcagtccaagatggatgagtgtcagaaatacgctgagcagtatagcgctaccgtgaaagattacgaactgcagacgatgacctatagggccatggtggacagtcagcaaaaatctccagttaaacgcagacgcatgcagtccagcgcagacctgattatccaggagtttatggatctgcggacaaggtatactgcactggtgaccctgatgacacagtacataaagttcgcaggagactctctaaagagattggaggaagaggaaaagagcctcgaggaggagaagaaggagcacgtcgaaaaggcgaaagaattacagaagtgggtgtctaatatctcaaagactttaaaagacgcagaaaaagccggaaagccccctttcagtaaacagaagatttccagtgaggaaatcagcaccaaaaaggagcagctaagtgaggctttgcagaccatccagctcttcctggctaagcacggagataaaatgaccgacgaagagaggaacgaacttgagaaacaagtcaagacccttcaggagtcttacaacttattgttcagcgagagcttgaaacagctccaggaaagccagacttcaggagatgtcaaggtagaagagaaaatcgtcgcagaacggcagcaagagtacaaagagaagctgcaaggaatatgcgatctcctgacacagactgaaaatcggttgattggccatcaggaagcttttatgattggggacgggacagtggagctcaaaaaataccagagcaagcaagaggagcttcaaaaggatatgcaagggtccgcccaggccctggccgaggtcgtgaagaatacggagaattttctgaaagagaacggcgaaaagctgtcacaggaagataaagccttgattgaacagaagctcaatgaagcaaaaatcaaatgcgagcaactgaacctgaaagctgagcaaagcaagaaggagcttgataaggtcgttacaacggcaatcaaggaggaaaccgaaaaggtggctgccgtgaaacagctggaagaaagtaaaaccaaaatcgagaatctattagattggctatctaatgttgataaagatagcgagagggcgggaactaaacacaagcaggtgattgagcaaaacggcacccacttccaggagggggacggcaagagcgctataggggaggaagacgaagtaaacggaaatctcctggaaacagatgtggatggccaagtaggcactacccaggagaatctgaatcaacagtaccagaaagtgaaagctcaacatgaaaaaataattagccagcatcaggcagtgatcattgcgacccaaagtgcccaggtgcttttagaaaagcagggtcagtacttaagccccgaagaaaaagaaaagctgcagaagaatatgaaagagttgaaagtccattacgagacagccctggcagagtcagagaaaaagatgaaactgacgcactctctgcaggaggaactcgaaaaattcgatgcagactataccgagtttgaacactggctgcaacagagcgagcaggaactggaaaacctggaggccggagcggatgatatcaacggactgatgacaaagctgaaacgacaaaagagtttctctgaggacgtgattagtcacaaaggcgacttacgttatattacaattagcggcaaccgggtcctggaagccgcaaaatcttgctctaagagggatgggggaaaggtggacacatctgccacacaccgggaggttcagaggaaacttgatcacgccacagaccgattccggagtctttattccaagtgtaatgtcctaggcaataatctgaaggacctggtggacaaataccagcactacgaggacgcctcttgcggcctcctggcaggtcttcaagcatgtgaggctaccgcttcaaagcacctgagcgaacctatcgcagtcgatcccaaaaacttgcagcgccagctcgaggagactaaggccctgcagggtcagatcagtagccagcaggtagctgttgagaagctgaagaaaacagccgaggtgctgctggatgcccgagggagtctactcccagctaagaacgacattcagaaaaccctggacgacatcgtgggacgctatgaagacctgtctaagagcgtcaatgagcggaacgaaaagctccagatcaccttgacgaggtctctgtccgttcaagatggcctcgacgaaatgctcgattggatgggcaacgttgaatccagccttaaagaacaggggcaggtacccctgaacagcactgcgctgcaagacatcatctctaaaaacattatgctcgagcaggatatcgcagggaggcaatcatctatcaatgccatgaacgagaaggtaaagaagttcatggagaccacagatcccagcacggcctctagtttgcaagctaaaatgaaagacctgagtgctagattcagcgaagccagccataagcacaaggagacgctcgccaagatggaagagcttaagactaaggtcgagctgtttgaaaacctcagcgagaaactccagacatttctcgagacaaaaacccaggcccttacagaggtggatgtgcccggaaaggatgttaccgagttaagtcaatacatgcaggagtccaccagtgaattcctggagcacaaaaagcaccttgaagtcctgcacagcctgctgaaagagatcagcagccacggtctgccctccgataaggctctggtcctagagaaaacaaataatctgtcgaaaaagtttaaggagatggaggacactatcaaggaaaagaaagaagcagtaacaagctgtcaggagcagctcgatgcttttcaagttctggtgaaaagcctaaagagttggattaaggagacaactaaaaaggttccaatcgtacagccgagctttggcgcagaggaccttggtaaatctttagaggatacaaagaagttgcaggaaaagtggtcattaaagactcccgaaatccaaaaggtgaataactccggaatatctttgtgcaaccttattagtgcggtcactacacccgctaaggcaattgctgctgtgaaaagtggtggagcagtgctgaatggcgaagggacagcaaccaataccgaagaattttgggccaataaaggactaactagtattaagaaggacatgaccgatatttcacacggctacgaggaccttggtctcttgctgaaggacaagattgccgagttgaataccaaactgagtaaactccaaaaggcccaggaagaatcttccgccatgatgcagtggctgcagaaaatgaacaaaacagccacgaaatggcagcagacccccgctcctaccgataccgaggccgtgaagacccaggtggagcaaaataagagttttgaggcagaactgaagcagaacgtcaacaaggtgcaggagctcaaagacaaactgacggagctgctcgaggagaaccccgacactcccgaagcacctcgctggaagcagatgctgacggaaatagacagcaagtggcaggagctgaatcagctcaccatcgacaggcaacagaagcttgaggagtcttctaacaatctgacccagttccagacagttgaggcacagttaaagcaatggcttgtggaaaaggaacttatggtgtccgtcctgggccctctgtccattgatcccaacatgttaaacacccagagacagcaggtccagattctgctgcaggagttcgctactaggaaacctcagtacgaacagctgaccgccgctggccagggaatcctctcacgccctggagaagacccctcactccgcggtatcgtgaaggaacaattggctgccgttacccagaagtgggatagcctgacaggacagctgtcagaccgatgcgattggattgaccaagcaatagtgaagtcaacgcaataccagagcctgttgcggagcctgtctgataaactgagcgatctggacaataagctgtccagctccttggccgtttccacccacccggacgctatgaatcaacaactcgagacagcacagaaaatgaaacaagaaatacaacaggaaaagaagcagattaaggtggcccaggccttgtgtgaggacttaagcgcactcgtcaaggaggagtatctgaaagccgagctgagtagacaactcgaggggatactgaagtctttcaaagatgttgaacagaaggctgaaaatcacgttcagcacctccagagtgcctgcgccagttctcaccagttccaacagatgagccgtgactttcaggcatggttagacaccaagaaagaggaacagaacaagagtcatccaatatcagctaaactggatgtgctggagtccttaattaaggaccacaaggatttttcaaagactctgaccgcccaaagccacatgtatgaaaagaccatcgcagagggagagaaccttttgttgaaaactcaaggatccgagaaagccgctctccagctacagctcaacaccatcaagaccaattgggacacattcaacaaacaggtcaaagagagagagaataagttaaaagagtcactggaaaaggcattgaaatacaaggagcaggtcgaaacattatggccttggatagacaagtgtcagaataacctggaggaaatcaagttctgcttggaccccgctgagggagaaaattcaatagctaagttaaagtccctacagaaagagatggaccagcacttcggtatggtggagctgctgaacaacacagctaactccttgctgagtgtgtgcgaaatcgataaggaagttgtgactgacgagaacaaatccctcatccaaaaggtcgatatggttaccgaacagctccactccaaaaagttctgccttgagaatatgacccaaaagttcaaggagttccaggaggtcagcaaggagtcaaaacgtcagctgcagtgtgcaaaagaacagctcgacatacacgacagtttgggttctcaggcttattctaataagtatcttactatgctgcagacacagcagaagtctctgcaggctctgaagcaccaagtcgacctggcaaagcgactggcacaagatctcgttgtggaggcatcggactctaaggggacctccgacgtgctgctgcaggtggagaccatcgcccaagagcattcaacactgtcccaacaagtggacgagaaatgcagctttttggagactaagcttcagggcataggacactttcagaacacaattcgggaaatgttttctcagttcgccgagttcgatgatgagctggactctatggcacccgtaggtcgggacgccgaaacccttcagaaacagaaggagaccattaaagcgtttctaaaaaaattagaagctctgatggcctcgaatgataacgcaaataagacatgtaagatgatgttagccaccgaggagacctcccctgatctggtggggataaagagagacctggaggctctcagcaagcagtgcaacaagttgctggatagagctcaggctagggaggaacaggtggaggggaccattaagcgtctggaggagttttatagcaagctaaaagagttcagcatcctcctacaaaaggcagaggagcacgaagagagtcaaggcccagtcggcatggagaccgagaccatcaaccagcaactcaacatgttcaaagttttccagaaggaagaaatcgagccactccaaggtaaacagcaggacgtcaactggctcgggcagggattgatccagtctgcagctaaatctacttctacccaaggacttgagcacgatttggacgatgtgaacgcccgttggaaaaccctgaataaaaaagtggcccagcgggcagcacagttgcaggaagctttactgcattgtggaaggtttcaggatgcacttgagtcactactttcttggatggtggataccgaggagctggtggcaaaccagaagcctccatctgcagagttcaaagttgtgaaagcccagattcaggaacaaaaactgctccagcggctgctcgacgaccgaaaatcaacagtggaggttatcaaaagggaaggtgagaaaatcgcaacgaccgccgaacctgccgataaggtgaagattctcaaacaactgagcctgctggactctcggtgggaagccctgttgaataaggccgaaacacggaacaggcaactcgagggaatttccgtggtggcgcagcagtttcatgagacactggagcccttgaatgaatggctgactaccatcgagaagaggctcgttaactgtgaacctatcgggacacaggcctctaagctggaagagcagatcgcgcagcacaaagccttagaggatgacattattaaccacaacaaacaccttcaccaagctgtgagcataggtcagagcctcaaggttctcagctccagggaagacaaagatatggtgcagtctaaactagactttagtcaggtatggtacatcgaaatccaagaaaaaagtcactcccgaagcgaattgttacagcaggccctgtgtaacgcgaagatttttggagaagacgaagtggaactaatgaactggttgaacgaggtgcatgacaagctgtctaaactgagcgttcaggactactctaccgagggcctatggaaacaacagtcagagctccgggtgctccaggaggacattctccttcgcaagcagaacgttgatcaggccctgctaaatggactggagttgctgaagcaaacaaccggtgacgaagtgctgataattcaggacaagttggaggccatcaaggccagatacaaagacataacgaagctgagcacagacgtcgcaaaaacattggaacaagccctccagctggctcgaaggcttcatagcactcacgaggagttgtgcacatggctggacaaggtggaagtcgagcttctgtcttacgaaacacaagtgctgaagggcgaggaagcgagccaagctcaaatgcgcccaaaggagctcaagaaggaagcaaaaaacaacaaagccctgcttgattccctcaatgaggtttcatccgccctactcgaattagtcccatggagagccagggagggactggagaagatggtcgcagaagacaatgagcggtatcgcctggtgagcgacacaatcacgcagaaagtggaagagatcgacgctgcgatactcagaagccaacaatttgatcaggctgcagatgccgaattgtcctggatcacagaaactgagaaaaaactgatgtctctgggcgatatccgactggaacaggatcagaccagcgcgcagctccaggtgcagaagacctttacaatggagatcctacggcacaaggacataatcgacgacctggtgaaaagtggtcacaagattatgaccgcctgcagtgaagaggagaagcagtccatgaagaagaagttggacaaggtgttaaagaattacgacaccatctgccagatcaatagcgagcgctacttgcagctggaacgggcacagagccttgtgaatcagttctgggaaacttacgaggagctctggccttggctcacagagacacagagcataataagccagctgccagcaccagcccttgagtatgaaactctgaggcagcagcaggaggagcacagacaattgagagagctgatcgcggaacacaagccacacattgacaaaatgaataagacaggaccgcagttgcttgaacttagccctggcgaaggtttctccattcaggaaaaatatgtggccgcagatacactctactcacagataaaggaagatgtgaaaaaaagggccgttgcccttgatgaggctatatcacaatctactcagttccatgataaaatcgaccagatccttgaatctctggaacggatcgtcgagagactgcgtcagcctcctagtatcagcgccgaggtagaaaaaataaaagagcagatctctgaaaacaagaatgtcagcgtggacatggagaagctgcagccactgtatgagacactcaagcagcgaggtgaggagatgatcgccagatctggtgggacggacaaggacatttctgcaaaagctgtgcaggataaactcgaccaaatggtgttcatttgggagaatattcacaccctggtcgaagagagagaagcaaaactcctcgacgtaatggaactggcggaaaagttttggtgcgatcatatgtctctgatcgtgaccatcaaagacacccaggacttcatacgagaccttgaagaccctgggatcgacccatccgtggtgaagcagcagcaggaagccgcagaaacgattcgcgaagagatcgatggactccaagaggaactcgatattgtcatcaatctggggagcgaattaattgcggcatgtggagagccagataaacctatcgtgaagaagtcaattgatgagctgaatagcgcatgggattccctgaataaagcatggaaagaccgaatcgacaaactcgaagaggccatgcaagccgctgtccagtatcaggatggtttgcaggccgtgtttgattgggtggatattgctgggggaaaactggcatcaatgagcccaatcgggaccgacctggagaccgtgaaacagcagatcgaagagctgaagcagttcaaatccgaagcctatcagcaacaaatagaaatggaaagactgaaccatcaggctgagctgctcttaaagaaggtcaccgaagagtctgacaaacacaccgtgcaggacccactgatggaactcaagctcatctgggactctctcgaagagagaatcattaataggcagcacaaactcgaaggagcactactggccctgggccagtttcagcatgcactggacgagctcttggcctggctcactcatactgaggggctcctgtcagagcagaagccagtcggtggggatcccaaagccatcgaaatcgagctggcaaaacatcatgttctccagaatgacgtactggcccaccagagcaccgttgaggccgtcaataaagccggaaacgacttgattgagtccagtgctggtgaggaagcatccaacctgcagaacaagttagaggtgcttaaccagagatggcagaacgtgcttgaaaagacggaacagaggaagcaacaactcgacggcgcattgaggcaggctaaaggattccatggtgagatcgaggatttacagcagtggttgaccgataccgaacgccatctgctggcttctaagccgctcggtggcttacccgagactgccaaggaacaacttaacgtccacatggaggtctgcgccgcattcgaagccaaggaagaaacttacaagtccctcatgcaaaagggccagcagatgctggcgagatgtcctaagtcagccgagacgaacattgatcaagatataaataaccttaaggagaagtgggagagtgtggaaaccaaactgaacgaacgcaagacaaagctggaggaagctctcaacctggcaatggagtttcataattctctccaggatttcatcaattggctgacacaagccgagcagaccctcaatgttgcttcacgcccatccctgattctggacacggtgctcttccagattgatgaacataaggtctttgccaatgaggtcaattcacatcgcgagcagatcatcgagcttgataagactggcacccacctgaaatacttttctcagaagcaggacgtcgtgttaatcaagaatctcctgattagcgttcaatcccggtgggaaaaagtcgttcagcgacttgtggaacggggtcggtccttggatgacgccaggaagagagcaaagcagttccatgaagcgtggagcaagctaatggaatggctcgaggagtcagagaagtcgctggacagcgaactggagattgcaaacgaccccgataagattaagactcaactggcgcagcataaagagttccagaagtcacttggggctaagcacagtgtgtacgatacaaccaaccggacgggcagatctttaaaggagaagacgagcctggccgatgacaacctgaaactggacgatatgctgtccgagctgagggataagtgggataccatttgcggtaaaagcgttgaacgccagaacaagctggaagaggcactgttgtttagtggtcagtttaccgatgcactgcaggctcttatcgactggttatacagggtggagcctcaattggccgaagatcagcctgtgcacggtgacattgacctagtcatgaacctgattgacaatcacaaggcatttcagaaggagctgggaaaaagaacgagcagcgtgcaagccctgaagagaagcgccagagagcttattgaaggctctagagatgattccagttgggtcaaggtgcagatgcaggagctttctacccggtgggaaactgtgtgtgcgttatccatctccaagcagactcggttggaggcggctctccgtcaagctgaagaatttcattctgttgtgcacgcactgttggagtggttagccgaagccgaacagactctaaggtttcacggagtcctaccggatgacgaggacgcattgagaacactgattgaccaacacaaggagttcatgaaaaaattggaggaaaagcgggctgagctaaataaagccactactatgggcgacacagtcctggctatctgtcaccctgactctataaccaccattaagcactggattaccattatcagggctcgtttcgaagaggtattagcctgggcgaagcagcatcaacagaggctggctagcgcacttgctggattaattgctaagcaggagctcctggaagccttacttgcctggctgcagtgggccgagaccactctcacagataaagacaaggaggtgatccctcaggaaatcgaggaagtcaaggccctgattgccgagcaccagactttcatggaagaaatgacccgcaagcaacctgatgtggacaaagttaccaaaacttacaagaggcgcgctgccgaccctagttcacttcaaagtcatatccctgtcctggataagggccgagccggaagaaagagatttccagcaagctccctctaccccagcggctcccaaactcagatcgagacaaagaaccctagggtgaatctgctggtatcgaagtggcagcaggtgtggctcctggctctggagcggaggcggaagctcaatgatgcactggataggctggaggagctacgggaatttgcgaacttcgactttgacatttggagaaagaagtatatgaggtggatgaatcacaaaaagtcccgtgttatggacttcttcagaaggatagacaaagatcaagatgggaaaatcacacgccaggagtttattgacggtatcctcagttccaaatttccgacaagcaggttggagatgagcgccgtggcagatatttttgaccgcgacggagacgggtatatcgactattacgaatttgtcgccgcattacaccctaataaagatgcgtacaaaccaatcacggacgctgacaagattgaggacgaggtcacccgccaggtcgccaaatgtaaatgtgcgaagaggttccaagtggaacaaattggtgataacaaatacagattttttcttgggaaccaatttggggattctcagcagcttcggttggtccggatcctgcgtagtacagtgatggtccgtgtcgggggaggctggatggccctggacgagtttttagtgaaaaatgacccttgtagggctaagggacggaccaacatggagctgcgcgaaaaatttatcctggccgacggagcatctcaagggatggcagcttttcggccacggggaaggaggagtcgacccagttcaagaggtgcttctccaaaccgctcaacctcagtcagctcacaggccgcacaggcagcctcgccacaggtccccgctaccactactcctaagatactccacccactgacccggaactacggtaaaccttggcttaccaacagcaagatgtcaaccccttgtaaagcagcagagtgcagcgacttccctgtcccatccgctgaaggcacccccatccagggttccaagctgagactgcctgggtacctcagcggcaagggatttcactccggtgaggactccgggctcatcacaactgcagctgccagggtgaggacacaatttgccgattcgaaaaaaacacccagccgccctgggagtagggccggatccaaagctggctcccgggcttcatcaaggagaggcagcgatgcttctgatttcgatatctcggagattcagagtgtgtgctctgatgttgagacggtgccgcagacacaccgcccaaccccacgagctggctcacgcccatctacagctaagccaagcaagatccctacaccccagcgaaaatctcccgctagcaagcttgataaaagctctaagagatag

SEQ ID NO: 221508 - DNA, 12603 bp, Artificial Sequence
  Description of Artificial Sequence: Synthetic coding sequence
atggctggctacttgtcacccgcagcatatctgtatgtggaggagcaggagtatctgcaggcttacgaggacgtcctggagaggtataaggatgaacgcgacaaagtgcaaaaaaagacgttcaccaaatggatcaaccagcatctcatgaaagtgaggaaacatgtgaacgacctgtatgaagaccttcgagacggtcataatctgattagcttgctggaagtcctctctggggacacactccctcgggaaaagggcagaatgcggttccataggcttcagaacgttcaaatcgctctcgactatctgaaacgcagacaggtgaaactggtaaacattagaaatgacgacatcactgacggaaacccgaagttaaccctgggtctcatctggaccatcatccttcactttcagatttcagatatccacgttactggagaatcagaagatatgagtgcgaaggagcgcctgctactctggacccaacaggccacagaaggttacgctgggatccggtgcgaaaatttcactacgtgctggagagatggcaagctttttaatgctataatccacaaatatcgtcctgacctgattgatatgaacactgtggcggtgcagtctaacctggccaatttggagcacgcgttctacgtcgcagaaaagattggtgtgatccgacttctggatcccgaggatgtggatgtgagttccccagacgagaaaagcgtgattacatatgtcagtagcctctacgacgcttttcccaaggtgccagaaggcggagaaggcattggggctaacgatgtagaggttaagtggattgaataccaaaacatggtgaattatctgatccagtggattaggcaccacgtcaccaccatgtccgaaaggacctttccaaacaacccagtcgagctgaaggcgctgtataatcaatacctccagttcaaagagacggagatccccccaaaagagaccgaaaagtcaaagatcaaacggctgtataaattgctggagatctggatcgaattcgggaggatcaagctgctgcagggttaccatccaaatgatatcgagaaggagtggggcaaactgatcatcgctatgctagagcgcgaaaaagcactgaggcccgaggtggaaagacttgaaatgctgcaacagattgctaatcgcgttcaacgcgactccgtaatttgcgaagataagttgatactcgcgggtaacgctctgcagagcgacagtaaacgactggagagcggggtccagttccaaaatgaggctgagatcgcaggctacatcctggagtgcgagaacctcctgaggcagcacgtcatcgacgtgcaaatattgatcgacggcaaatactatcaggccgaccagcttgttcagagagtggcaaaactgagggatgagatcatggcacttcgcaatgagtgttcatctgtgtactctaaggggcgtatcttgacaaccgagcagaccaagttgatgatcagtggcatcacacagtctctgaatagcggattcgcgcagactctccatccttcactgaccagcggcttgacacaaagccttactccttcattaacctcctccagtatgacttccggattatcctccggaatgaccagccgcttgacaccttcggtgacccccgcttacaccccaggttttccctctggcctggtacccaacttctcttccggggttgaacctaatagcctgcagacactcaaactcatgcagatacggaagcccttactgaagagctcccttcttgaccaaaatcttaccgaggaggaaatcaacatgaagtttgtacaggatctgctgaattgggttgacgagatgcaagtacagctggaccggaccgagtgggggagtgatctgccgtcagtagaatcccacctggagaaccataagaatgtgcatcgggcaatcgaagaatttgagagctcattgaaggaggccaagattagtgagattcagatgacagcaccactgaagctgacctacgccgaaaaactccatagattggaaagtcagtatgcgaagcttcttaatacatcacgtaatcaggagcggcacctggacacccttcataattttgtcagccgagctacgaatgagctgatctggctcaacgagaaagaggaggaggaggtggcgtatgattggagtgagcggaatacaaacatagctcgtaagaaagactaccatgccgagctgatgagagaacttgaccaaaaggaggaaaatatcaaatccgtgcaggagatcgctgaacagttgctgttggagaaccaccctgcgagactcaccattgaggcataccgcgcagccatgcagacacaatggagttggatacttcagctctgccagtgcgtggaacagcacattaaggaaaatacagcctactttgagttctttaatgatgccaaagaagctaccgattatttgaggaacctgaaggatgcaatccagagaaagtactcatgtgatagaagctcaagcatacacaaactcgaggatttagtgcaggagtctatggaagaaaaggaagagctgctgcagtataagagtaccatcgctaatctaatgggcaaggcaaagacaattattcagcttaaaccacggaattccgattgtcctttgaaaacaagcatccccattaaggccatttgtgattaccgtcagatagagataaccatctataaggacgatgagtgtgtgctagccaacaacagccacagggctaaatggaaggtgatctctcctactggaaatgaggcgatggtgccttcagtctgttttaccgtgccaccacctaataaggaagccgtcgacctggccaatcggattgagcagcagtaccaaaatgtcctaaccttgtggcacgaatcacacataaacatgaaatccgttgtgtcttggcactacttgataaacgagatagaccggatccgggctagcaatgtcgcctcaattaagaccatgcttccaggagagcatcagcaggtgctgtctaacctacaatcgcgctttgaggatttcctcgaggatagccaggagtcccaggtgttctctggatccgatatcactcaactggaaaaggaagtgaacgtttgcaagcaatattaccaggaactgcttaagtctgctgaacgggaggaacaagaagagagtgtctacaacctgtatatctctgaagtaagaaacattaggctcagactcgaaaactgcgaagaccggctcatacggcaaatcagaaccccgctggagcgcgatgatctccacgagagcgtgttcaggatcactgagcaggaaaagcttaagaaggaactggagcggctgaaggacgatctggggacaattacaaacaaatgcgaagaatttttttcacaggctgctgcttcatcctcagttcctaccttgagatctgaacttaatgtggtgctccagaacatgaaccaggtttactcaatgagctctacttatatcgacaaattgaagactgttaatctggtgttaaagaatacccaggccgcagaggcccttgtgaagctatacgaaaccaagttgtgtgaggaggaggcagttatcgccgacaagaataacatcgagaatctgatttctaccctaaagcagtggcgctccgaggtggatgaaaagcggcaggtcttccacgcactggaagatgagctccagaaggctaaagccatctccgatgagatgtttaagacgtacaaagaacgcgatctggacttcgattggcataaggagaaggcagaccagttagtggaaagatggcaaaatgtccacgtacaaatcgataaccgtctgcgcgacctggaaggcatcggaaagagcctcaagtactaccgcgatacataccatccactggatgattggattcagcaggttgaaacgacccagcggaagatccaggaaaatcagcccgagaatagcaagactctggccactcagttgaatcaacaaaagatgttggttagcgagatcgagatgaaacagtctaaaatggacgagtgccagaaatatgcagaacagtacagtgccactgtgaaggattatgagctgcagaccatgacctatcgcgctatggtggattcgcagcagaaaagcccggttaaaaggagacgaatgcaaagcagtgccgatttgatcatccaagaattcatggacttacgtacccgatacacagcacttgtgaccttgatgacgcagtatatcaaattcgccggagactcattgaagagattggaggaggaagaaaaaagccttgaagaggagaagaaagagcatgtggaaaaggccaaggagttgcagaagtgggtgagcaatataagcaagacactcaaggatgccgagaaggctggcaagcccccattttctaagcagaaaatttctagcgaggagatttccacgaaaaaagaacagttgtcagaggcactccagaccattcagcttttcttggctaagcacggcgacaaaatgaccgacgaagagcgcaatgagctggaaaaacaggtgaaaaccctccaggaaagctacaatttgttattctccgagtccttgaaacagttgcaggagagtcagacatccggagatgtaaaggtggaggagaaattggacaaagtcatagccggaactattgaccagaccacaggggaggtgctatccgtgttccaggctgtcctgcggggtctcatcgactatgataccggcatcagacttctagagacccagctgatgatttcggggctgatttctcccgaactcagaaagtgcttcgacctaaaggatgctaagtcacatgggctcattgacgagcagatcctgtgccagttgaaagagctgagtaaggctaaggaaattatctccgctgcctcgcctacgactattccagtcctggacgctctggctcagtctatgatcacagaatccatggcaattaaggtcctggagatcttactgtcaaccggaagcttggttatacccgctaccggtgaacaactgaccctgcagaaggccttccagcagaacctagtgagtagtgccctgttttcgaaggtcctcgagcggcagaacatgtgcaaagatctgattgacccttgtactagcgagaaagttagcctgattgatatggtgcagagatcgacactgcaagagaataccggcatgtggctcctgcccgtacgacctcaggaggggggtaggatcaccctgaagtgcggccgtaatatttctattctgcgtgctgcccacgagggattaatcgaccgcgagacaatgtttagactccttagcgcccagctcctgagcggagggcttattaacagcaactccggtcagcggatgaccgtggaggaggcagtgcgggagggcgtcattgaccgcgacacagcctcctccatcctcacctaccaggtccagacaggcggaattatccagtcaaacccagcaaaacgccttactgtggatgaagctgtgcagtgtgatttgattacgtcgtcttcggctcttttggtccttgaggcccagagggggtacgtgggtctgatctggcctcacagtggcgagatctttccaacctcttcctccctgcagcaagagctcattacaaacgagctcgcttataagatcctgaacggcagacagaagattgccgctttgtacattccagaaagtagtcaagtgatagggcttgacgccgcaaaacagctcgggattattgataacaatacggcctcgatcctgaagaatattacattgccggacaaaatgcctgacctgggtgatctggaggcttgcaagaacgctcgccgatggctcagcttttgcaaattccaacccagtacagtgcatgattacagacaggaggaagacgtatttgacggggaggaaccagtgaccactcagactagcgaggagactaagaaactgttccttagctatctgatgattaacagctatatggatgctaatactggccagaggcttcttctttacgacggcgacctggatgaagctgtcggcatgctcctggaaggttgtcacgccgaattcgacggaaacactgctattaaggaatgtttggacgtgctgagtagctctggagtgtttctgaacaatgcctctgggcgtgagaaagacgaatgtacagcaaccccaagcagtttcaacaagtgtcactgtggcgagcccgaacatgaggagactccagagaataggaagtgcgcgattgacgaggaattcaatgagatgcgaaataccgttatcaactcagagttctcccaatccggaaaattggctagcactatctcaatcgaccccaaggtgaatagttccccgtccgtctgcgtgcctagcttgatttcctacctgacccagacagaactggctgacattagcatgctcaggtccgatagcgaaaacatcttaactaactatgagaatcagtccagggtcgaaaccaatgagcgcgctaacgagtgcagtcactccaaaaatatccagaatttcccttctgatttaatcgagaatcccataatgaagtcaaagatgtcgaagttctgcggtgttaacgagactgaaaatgaagataataccaatagagactccccaatctttgactatagccctaggctgtccgctctgctgtcccatgataaactgatgcacagccagggctccttcaacgacacccatacccctgagtccaacggaaataaatgtgaggctccagcgctgagtttcagtgataaaactatgctttccggccagcgaatcggagagaagttccaggaccaattcctgggcatagcagccatcaacatctcactgccaggagagcagtacgggcagaagagtttgaatatgatatcctccaaccctcaagtgcagtatcataacgataagtacatatccaacaccagcggagaggatgagaagacccatcccggattccagcaaatgccagaggataaggaggatgagagtgagattgaggaatatagctgcgctgtaaccccaggcggtgatactgacaacgcaatcgttagcttaacgtgtgctacgcctctcctggacgagaccatctctgcaagtgattatgagacatccctactaaacgatcaacagaataacaccggtaccgacactgattccgatgatgacttctatgatacccccctctttgaggatgacgatcatgatagtctcctgctggatggtgatgatagggactgtcttcaccctgaggattacgatacactgcaggaagagaatgacgagactgcgtctcctgcagacgtcttctacgatgtctccaaagaaaatgagaatagtatggtgccgcagggagcacctgtggggagcctatctgtcaagaacaaggcccactgtttacaggacttcctgatggacgtggagaaagatgaacttgactctggggaaaagattcatctgaacccagtcggcagcgacaaagtaaatggacagtcccttgaaactggcagcgaaagggagtgcaccaatatcctcgaaggcgatgagagcgactctctcacggattatgacatcgtggggggaaaggagagtttcaccgctagccttaagtttgacgatagcggctcttggcggggaagaaaagaggagtatgttacaggtcaagagttccattctgatactgaccacctggattcaatgcagagcgaggagtcctacggtgactatatatatgactccaatgatcaggacgacgatgacgacgatggaatcgacgaggagggcggaggcatacgggatgagaacggaaaacccagatgccagaacgttgccgaagacatggatatccagctgtgtgcttcaatccttaatgaaaactccgacgaaaatgagaatatcaacacaatgatactgctcgacaaaatgcactcatgctcatctttggagaaacagcaacgagtgaatgtggttcagctcgctagcccctccgaaaataacctcgtaactgagaaatccaatctgcccgaatacacaactgaaattgcgggaaagtctaaagagaatttgctgaatcacgaaatggtcctcaaggatgtgctgccacctatcataaaggacaccgaatccgaaaagacctttgggccagcaagtatcagccacgacaataataatatttctagcacaagtgaactaggcaccgaccttgcaaacactaaagtaaaactcatccagggctcagagcttcccgagctgaccgatagtgtcaagggaaaggacgaatatttcaagaacatgacgcctaaagtagattctagtctcgaccatattatctgtacagaacctgacttaattggcaagccagctgaggagtctcatctgtcccttatcgcttctgtcactgataaagaccctcagggaaatggcagcgacctgatcaaaggcagagacggaaaaagcgacatactaatcgaggacgaaacctccattcagaagatgtatctgggggagggtgaggtactcgtggaggggcttgtggaagaagagaatagacatctgaaactactcccgggaaaaaatactcgggacagcttcaagctcataaactcgcagtttcccttccctcagattacaaacaacgaggaattaaaccagaaaggcagcctgaaaaaggccacagtcactctgaaggacgagccaaacaacctgcagatcatcgtgagcaaatcgcctgttcagttcgaaaatttggaagagattttcgataccagcgtaagtaaggaaattagtgacgacatcaccagtgatattacatcgtgggagggcaacacccactttgaggaatctttcacggacgggcctgagaaggagctcgacctctttacttatttgaaacactgtgcaaaaaatattaaggccaaagacgttgccaagcccaacgaggacgtaccttctcacgtcctaattactgctcccccaatgaaggagcacctgcaactcggggtgaataacactaaggagaagagcacgtctacacagaaagattcacccctgaacgacatgattcagtctaatgatttgtgttctaaagagtctatctcaggaggaggcaccgagatcagccagttcacccctgagagtatcgaggcgacactgtccatcctgtcgcgcaagcacgtggaggatgtgggcaagaatgattttctacagtcagaacgatgcgctaacggtctgggcaatgacaacagctctaacacactaaatacagactattctttccttgagattaataataagaaagaacgaatagagcagcagctcccaaaggagcaggctctcagccccaggagtcaggagaaggaggttcagatccccgaactgagtcaagtgttcgttgaggacgtgaaagacattctgaagagccgcctgaaggaaggccacatgaatcctcaggaagtggaggaaccttccgcttgtgcagatacaaagattctgatccagaacctcattaaacggatcactacatcccagcttgtcaatgaggcgagcacggtgcccagtgactctcagatgtccgatagtagcggggtctctcccatgacgaactcgtctgaattaaagcccgagtctcgggacgatcccttttgcatcggaaacctcaaaagcgaattgctcctgaatatcctgaagcaggatcagcacagtcagaagattacaggggtgttcgagctgatgagagagttgactcacatggagtacgacctggaaaaacgcggaataacatcgaaagtcctgcccttgcagttggagaatatcttctacaaactgctggctgacggctacagcgagaagattgagcatgtgggggactttaaccagaaagcgtgttccacaagcgaaatgatggaggagaagccacacatcctgggtgacattaagagcaaggaggggaactactatagtcccaatctggagaccgttaaggaaattggcctggaatcatcaacggtgtgggcctctacactgcctcgcgacgagaaactcaaggacctctgcaatgattttccctctcacctggagtgcacaagcggtagcaaggagatggcgtccggtgattcatctacagagcagttctctagcgagctgcagcagtgcctgcagcacactgagaaaatgcacgagtatttaacccttttgcaggatatgaagcccccactggacaatcaggaatccttggataacaatctggaggccctgaagaatcagctgagacagctggagacatttgaactgggactagcacccatcgctgtgatccttagaaaggatatgaaactggctgaagaattcctgaaatctcttccttcagacttcccccgtggccatgtggaagaactgtctatctcccatcagagcctgaaaacagctttcagctcactgtctaatgtgtcatccgagaggacaaagcagatcatgttagcaatcgactctgagatgtccaagttggccgtgtcccacgaagaattcctgcataaactcaaatccttctccgactgggtctctgagaaatccaagagcgtcaaggatatagaaatcgtgaatgtccaagacagcgaatacgtaaaaaagcgtttggaattcctcaagaatgtattgaaagacttgggacacaccaagatgcagctggagaccacagcgttcgacgtgcagttttttatctccgaatacgctcaggacttgtccccaaaccagtccaaacagttgctgcgtcttctgaatactactcagaagtgcttcctggatgtccaggagagcgtgaccactcaggtcgaacgcctggagactcagctgcaccttgaacaagatctggacgaccagaagatcgtcgcagagcggcaacaagaatacaaagaaaaactgcaggggatatgcgatctgctgacccagaccgagaaccgtttgatcgggcatcaggaggcctttatgattggggacggtaccgtggaactgaagaagtaccaatccaaacaggaggagctgcaaaaggacatgcagggcagcgcacaggccctggccgaagtcgtgaagaacacagagaacttcctcaaggaaaacggggaaaaactttcccaggaagataaagccttaattgagcaaaaactaaacgaggccaaaattaagtgcgagcagctgaatctgaaagctgaacagagcaaaaaagagctagacaaggttgtcacgacagctatcaaagaagaaactgagaaggtggcagctgttaaacaactcgaggagagtaagactaaaatcgaaaacctgcttgattggctttcaaacgtagataaagacagcgagcgtgctggcaccaaacataaacaggttattgaacagaacgggacacacttccaagaaggggatggtaagagcgcgattggcgaggaggacgaagtgaatgggaatctgctggagacagatgtggacggtcaagtgggaacgacccaagagaaccttaaccagcagtaccaaaaggtcaaagcccaacatgagaaaatcatttcacagcaccaggccgtgattatcgccactcagagcgctcaggtcctgctggagaaacaggggcagtacttgtctccagaagagaaggaaaaactgcagaagaatatgaaggaacttaaggtgcattacgagacggctcttgctgaaagcgaaaagaaaatgaaattaacgcattccctgcaagaagaactagagaagtttgacgctgattataccgagtttgaacactggttacagcaatccgaacaggagctggagaacctcgaggccggagctgatgacatcaatggtctcatgaccaaactaaagagacagaagagttttagcgaggatgtgatcagccacaaaggcgatctccggtatatcaccatatctgggaatagggtcctcgaagccgctaagagctgtagtaaaagagatgggggaaaggtggacacatcagcaacccatcgagaggtccaaagaaaactggaccacgccaccgaccgcttcaggagcttgtactctaagtgcaatgtgcttggtaataatctgaaagatttggtggacaagtaccagcattatgaggacgccagctgcggactgctagctggcctgcaggcatgtgaagccactgctagcaagcatctgtctgaaccgatcgccgttgatcccaaaaatctgcagagacagctggaagagactaaggcgttgcagggtcagatttccagccagcaggttgctgtcgaaaagctgaagaaaaccgcagaagttctattggatgctcgagggtctctgcttccagccaagaacgacattcagaaaacccttgacgacattgttggcagatacgaagacctgtcaaagagtgtgaacgagaggaatgagaagctgcagataactttaacgaggtccctgagtgtgcaggatggactcgatgagatgctagattggatgggcaacgtggaatctagccttaaggaacaagacgtgggtactggctactgtcgcagcagcgaacagtataaatgccacgaatac

SEQ ID NO: 221509 - DNA, 22386 bp, Artificial Sequence
  Description of Artificial Sequence: Synthetic coding sequence
atggccggttatctatcccctgctgcttacctgtatgtagaggagcaggaatatctgcaggcgtacgaagatgttttagagcgctacaaagatgaacgcgataaggtacagaaaaagacgtttactaaatggatcaatcaacatctgatgaaagtccgaaagcatgtgaatgacctttatgaggatctgcgggatgggcataacctgatcagcctgctggaagtcctaagtggcgatacgctccccagagaaaagggacggatgcggtttcacaggctgcaaaacgtccaaatcgcactggactacttaaagaggcgccaggtaaaactcgtaaacattcggaatgacgacattacagacggaaatcctaagctgacactcggccttatctggaccatcattctgcacttccagatttctgatattcatgtcactggtgaaagcgaagacatgtctgcaaaggagcgactgctgctctggactcagcaggctactgagggatacgcaggcattagatgtgaaaatttcaccacatgttggcgggacggcaagctgtttaacgccataatccataagtatagacccgatctaatcgatatgaacaccgtggctgtgcaatctaacctggcaaatctcgaacacgcgttttatgttgccgagaagatcggcgtgatccgattattggaccctgaggacgtggatgtaagtagtccggacgagaagagcgtcattacttatgtgagcagcctgtatgatgcattccccaaggtccccgagggcggagagggcattggcgctaacgatgttgaggtgaagtggattgaataccaaaatatggtgaactacttaattcagtggattcgccatcacgtgacaaccatgtcagagcggacctttccgaataatccggtggagctgaaagctctgtataatcagtacctccagtttaaagagacagagattccacctaaagagacagagaaatcgaaaataaagagactctacaagctcctcgagatttggatcgagttcgggagaatcaagttgctgcagggctatcaccctaacgacatcgagaaggagtggggcaagctgattattgccatgctggagagagaaaaagccctgagacccgaggtcgaaagactagagatgctgcaacagatcgcgaatcgggttcagagggacagtgtgatctgtgaagacaagctgattcttgctgggaatgctctgcagtctgatagcaagaggctcgaaagcggcgtgcagtttcagaacgaggccgaaatcgctggttacattttggagtgcgagaacctgctacgacagcatgtgatcgatgtgcagatcctcatcgatggcaaatactatcaggccgatcaactggtgcagagagttgctaagttgcgcgacgagatcatggccctgagaaatgagtgctctagcgtatacagcaaggggagaattcttactacggagcagacaaagctcatgatcagtggtatcacacagtctctcaattcgggtttcgcgcagactctgcatcctagtctaacatcaggtcttacccagagtctgaccccatcccttacatcaagctccatgacctcgggtctcagttcgggcatgacgagcaggctcaccccaagtgtcaccccggcttatactccaggattcccctcgggacttgtgcctaacttcagttcaggagttgaacctaattcgcttcagaccttaaaacttatgcaaattaggaaacccctgctcaaaagctcactcctcgatcagaacctcaccgaggaagagattaacatgaagttcgtgcaagacctgttgaattgggtggacgagatgcaggtacaactagaccgcactgaatggggctccgatctgcctagcgtcgaatcccatttagaaaaccacaagaacgtgcatcgggctattgaagaatttgagtcctcactgaaggaggccaaaattagcgagattcagatgacggctccacttaaactgacctacgccgagaaactgcataggctggagagccagtatgctaaactgctcaataccagccggaaccaagagaggcacttggacacacttcacaattttgtctcccgggcaacaaacgagctgatttggctgaacgaaaaagaagaggaggaggtggcctacgattggtctgagcggaatactaatatcgccagaaagaaagattatcatgctgagttgatgagggagttggaccagaaagaggagaacatcaaatcagtccaggaaatcgccgaacaactcctgcttgagaaccatcccgcaaggcttactatcgaagcctaccgcgctgcaatgcaaactcagtggtcctggattctccagctatgccagtgcgtcgaacagcacatcaaagagaataccgcgtactttgaattttttaatgacgctaaggaggctactgattacctgcggaatctcaaagacgcaattcaacgaaaatacagttgtgaccggtccagcagtatccataagttagaagacttggtgcaggaatctatggaagaaaaggaggagctactgcaatataagtctaccattgcaaacctcatggggaaggccaagactatcattcagcttaagcccagaaattcagactgccctctgaagaccagcatccctattaaggccatatgcgattacaggcagatagagattacgatttataaagatgatgaatgcgtccttgctaacaacagtcaccgagcaaagtggaaggtaatttcaccaaccggtaatgaggcaatggtcccctccgtgtgcttcacggttccccctccgaacaaggaggccgttgatctcgcaaatcgaatagagcaacagtaccagaacgtcctgacactgtggcatgagtctcacatcaatatgaagtcagtggtcagttggcattacctgatcaacgagatcgatcgtattcgcgcaagtaacgtggcgtccattaaaacgatgcttcctggcgaacatcagcaggtattatccaacttacagagtcgcttcgaagactttctggaggattcacaagagtcacaagttttctcgggctcagacatcactcaactagagaaggaggtcaacgtctgcaagcagtactatcaggagctgctgaaaagtgccgagcgcgaagagcaggaagaaagtgtatacaatctctatatctccgaggtgagaaatattcggctgcggctggagaattgcgaggacaggctcatacgccagatcagaacccccctggaacgtgatgatttgcatgagtccgtgtttagaatcactgaacaggagaaactaaaaaaagagctggagagattgaaggacgacctcgggaccatcactaataagtgtgaggaattcttttcccaggcagccgcatcttcgtccgtcccaactcttagaagtgaactcaacgtggttctgcaaaacatgaatcaggtgtactctatgtcgtctacctatattgacaagcttaaaaccgtgaacctcgttctgaaaaacacacaggctgctgaagccctggttaagctctatgagacgaaactgtgtgaagaggaggctgtaattgccgataaaaataatatcgaaaatttgatcagcaccctgaagcagtggcgaagtgaggttgacgagaaaaggcaagtcttccacgcattagaggacgagcttcagaaggccaaggcaatttctgacgaaatgttcaaaacctataaggaaagggatctggacttcgattggcacaaggaaaaagcagatcagctggtggagcggtggcagaacgtccacgtgcagatcgataataggctcagagatctagagggcatagggaaatcactaaaatactacagggatacttaccacccactggacgattggatacagcaggtggagacaacacagcgcaagatccaggagaatcaacccgagaattcaaagactctggctactcagttgaatcagcagaaaatgttagtgagtgaaatagagatgaaacagagcaaaatggatgaatgccaaaagtacgcagagcagtactctgccaccgtaaaagactacgagttgcagactatgacctacagggcaatggtcgacagccaacagaaatcaccggtgaaacgacggagaatgcagtcctccgccgacctgatcatccaggagttcatggatctaaggacccggtacacagcattagtaactctgatgactcagtatattaaattcgccggtgactcccttaaacgactcgaagaagaagagaagagtctggaagaagaaaagaaggaacacgtcgagaaggcgaaggagttacaaaagtgggtgtccaatatttccaagacactcaaggacgcggaaaaagccggtaagccaccattcagcaaacaaaaaattagcagtgaggaaatcagcaccaaaaaggagcagctctctgaagcactacagactatacaactgtttctggccaagcatggggataaaatgactgatgaggagaggaacgaacttgagaagcaggtgaagacactgcaggagtcgtataatctcctgttcagtgaaagtctgaagcagctacaggagtcccagaccagtggcgacgtcaaggtggaagagaaactggacaaagtgatcgccggtacgatcgatcaaaccactggcgaagttctgagcgtgtttcaggccgttcttagagggctgatcgactatgacactgggattcgcctgctcgaaacccagttaatgatctccggcttgatctccccagagctgaggaaatgctttgatttgaaagacgcgaagagtcatggtctcatcgatgaacaaatactgtgtcagctgaaagaattgagcaaggcaaaggaaattataagcgctgcaagtccaacgacgattcccgtgcttgacgctctcgcccagagcatgattacggaaagcatggcgattaaggtgctcgaaatactcctttctacgggctcattagtgatacccgcaacgggcgagcaactcactttgcagaaggcattccaacagaatctcgtgtcgtcagcgctcttttctaaggttctggagcgccaaaacatgtgcaaagacctcattgatccctgcacatctgaaaaggtctccctgattgacatggtacaaaggtccacactgcaagagaatacgggcatgtggctgctgcctgttcgacctcaggaggggggaagaattacactgaagtgcggacggaacatatcgatcttgagagcggcacacgaaggtctgatagaccgtgagaccatgtttagactcctgtccgcacagctgttatccggaggactgataaatagcaatagcggccagcgcatgaccgtggaggaagctgtgcgggagggggtcattgatagagacaccgcgtcatctattctgacctaccaagtacagactggtggcattattcagtccaaccccgcaaaacgcttgactgttgacgaggcagtacagtgcgacttgattacatcttctagcgccctgctggtcctggaggctcagcgcggatacgtagggctgatttggccgcattccggtgaaatcttccccacatcttcctccctccagcaggaactgataaccaacgagttggcatacaagatcctgaacggcaggcagaagatagccgcactgtatattccagaatcctctcaggtaatcgggctagacgctgccaagcagttaggaatcattgacaacaatactgccagtatcttaaagaacatcacactgcccgacaagatgcccgacttaggtgatctggaggcctgcaagaacgcaaggcggtggctgtctttctgcaagtttcagccctctacggttcacgattaccgccaagaggaggacgtgtttgacggggaggagcccgtcacaacccaaacatctgaggagaccaaaaagctgttcctatcctacctgatgataaactcttatatggatgccaataccgggcaacgtctgctgctgtacgacggggaccttgatgaggctgttggaatgctcttagaggggtgccatgcggagtttgacggcaataccgccatcaaagagtgcctggatgtgctaagtagttccggggttttcctgaataacgcctctggacgggagaaagacgagtgcacagctaccccaagctctttcaacaaatgtcactgcggggaacccgaacatgaggaaaccccagaaaaccgcaaatgcgccattgatgaagaatttaacgagatgaggaatactgtgatcaactcagagttcagccaatcaggcaaattggcaagcaccatctcaattgatcctaaggtgaactctagtccatctgtatgcgtcccctccctgatctcataccttacacagaccgaactggcagacatctccatgctgcgatctgatagtgaaaatatactcacaaattacgaaaatcagagccgggttgagacaaatgaaagggcaaatgagtgcagccatagtaagaacatccaaaatttcccctcagacctgattgagaaccccatcatgaagtcgaagatgtctaaattttgcggggtgaacgagactgagaatgaggacaatactaatcgtgattccccgatctttgactattccccacggctttccgcattactaagccacgacaagctgatgcacagccagggctccttcaacgacacccacacgcctgaaagtaacggtaacaagtgcgaagcccctgcattgtcatttagcgataagactatgctgtcagggcaacgcattggtgagaagttccaagatcagtttctcggtatcgcggctattaacatcagtctgcctggggagcagtatggacagaagtcgctgaatatgatttcgtccaatccacaggttcagtaccataacgataagtacatcagcaatacctctggggaggacgagaaaacgcacccaggtttccagcaaatgcccgaggacaaagaggacgaatcagagatcgaggagtatagctgtgccgtgactcctggtggcgatacggataacgcgatcgtcagcctcacctgtgcaactcctctcttggacgagacaatctccgcatccgattatgaaacctcactgctaaacgaccaacagaacaatactggcacagatacagatagtgatgatgatttctacgacaccccactgttcgaagatgatgaccatgacagtctgcttctggacggggatgatcgcgactgcttacaccctgaggattatgataccctgcaggaggaaaatgatgaaactgcatcgcccgctgatgtcttttacgatgtgagtaaggagaacgagaacagcatggtcccacagggtgcccctgtcggcagtctgtccgttaaaaataaggcgcattgcctccaggacttcctgatggacgtcgagaaagatgaattggattctggggaaaagattcatctcaatcccgtgggttccgataaagtgaatgggcaatccttggaaaccgggagcgagcgggagtgcaccaacatactcgagggagacgaatccgactccctgaccgactatgacattgtgggtggaaaggaaagctttactgcgagtctcaaatttgacgactcggggagttggagaggacgaaaggaggagtatgttaccgggcaggaatttcacagtgacaccgaccacctcgactcaatgcagtcagaggagtcatatggagattatatctacgactcgaacgaccaagacgacgacgacgatgacggcattgatgaagagggtgggggtattagggacgagaatggaaagcccagatgtcagaatgtcgccgaggatatggatattcagctctgtgcctctatcctgaacgagaattcagatgagaacgagaatatcaacacaatgatcctcctggataaaatgcacagttgttcttctctagagaagcagcagagagtaaacgtggtgcagttggctagcccgtctgagaacaacctagtcaccgaaaagtccaatctccctgaatatacaacagagatcgcgggtaaaagtaaagagaatttgctcaatcacgaaatggtgctcaaggatgtactccctccgattattaaggatactgagtctgagaagacctttgggccagccagtatctcccacgacaacaacaatatatcaagtacttccgaactgggaaccgatctcgcaaataccaaagttaagcttattcagggcagtgaactgcctgaactgacagactccgttaagggcaaagacgagtacttcaaaaatatgacccctaaggtcgactcttccctcgaccacatcatttgcaccgaacctgacctgatcgggaagccagctgaggaatctcacctatctttaattgcgtctgttaccgataaggacccacagggcaacggcagtgatctgatcaagggtcgggacgggaaatcagacattcttatcgaagatgagaccagcatccagaagatgtatctgggagagggcgaagtcctcgttgaaggcttagtggaagaggagaacaggcacctcaaattgctgcccggaaaaaatacccgtgacagtttcaaactcattaacagccagttccctttcccccagataactaacaacgaagaactgaaccaaaagggttcacttaagaaagcaactgttaccctgaaagatgaaccaaacaatctgcagatcattgtgtcgaagagtcccgttcagtttgaaaatctggaagaaatatttgacacttcggtctccaaggagattagtgacgacatcactagcgatatcacgtcctgggaagggaacacgcattttgaggagtctttcaccgatggcccagagaaggaactggacctgttcacctacctgaaacattgtgcaaaaaacattaaagcaaaagatgtggccaagcccaacgaagatgtcccaagccatgttttgatcaccgcgcctcctatgaaggagcatctgcagctgggcgtcaacaacacaaaagaaaagtccacaagcacacagaaggattctcctctgaatgacatgattcagtccaacgatctttgttccaaggaatcgattagcggcggtgggaccgaaataagccaatttacaccagagtccatcgaggcgactctgtcaattctgtcccgcaaacatgtcgaagacgtgggaaaaaacgacttcctccaatccgaaaggtgcgcgaatggccttggcaacgataactcatccaatacgcttaatacagactatagcttcctcgagatcaacaacaagaaggagcgcattgaacagcagctgccgaaagaacaggctttgagcccaaggagccaagaaaaggaagttcaaatcccggaactaagccaagtttttgtcgaggatgtcaaggacattcttaaatccaggctgaaagagggccacatgaacccccaagaagttgaggagcccagtgcctgtgcagacaccaagattcttatccagaatctaatcaagagaataacaacgtctcagctggtgaacgaggcaagcaccgtgccgtcggattctcagatgagtgactcatcaggagttagtccaatgaccaattctagtgaattaaaacctgaatcaagagatgatcccttttgtatcggaaacctgaagagtgagcttctgctgaacattctgaagcaggatcagcactctcagaaaataacaggcgttttcgagctgatgcgcgagttgacccatatggagtacgacctggagaagcgcggaatcacttccaaggtattgccgctccagttggaaaatattttttacaagttactcgcagatgggtactccgagaagattgaacatgttggggatttcaaccaaaaggcttgcagcacttcagaaatgatggaggaaaaacctcacattttgggggatatcaaaagtaaggaagggaactactattctcctaatcttgagactgtaaaagaaattggactcgagtcttccaccgtctgggcgagcactctgcctcgcgacgagaaattgaaggatctttgcaacgattttccatcacacttagagtgtacctctggctccaaggagatggcaagcggggactcatcaaccgaacagttctcctcagaattgcaacagtgtctgcagcacaccgagaaaatgcatgagtacttgactctgttgcaggacatgaagccccctctagacaaccaggaatcacttgacaacaaccttgaggctcttaaaaatcagcttcgacaactcgagacctttgagctaggcctggcccctatcgccgtaatcctgaggaaggacatgaagctggcagaggaattccttaaaagcctgccttccgatttcccaagggggcatgtggaggaactgtccatttctcatcagtctcttaagaccgcctttagtagtctttctaatgtgagtagtgaacgtacaaagcagatcatgctagcaatcgactctgagatgtccaaattagctgtgagccatgaagaatttctgcacaagctcaagtcattcagtgactgggtgtcagagaaatcaaagagcgtgaaggatattgagatcgtcaacgtgcaggattccgagtatgtcaagaaacgattggaattcctgaagaacgtgctgaaagacttgggtcacacaaagatgcagctagagacaacagcattcgatgtgcaatttttcatcagcgagtacgcccaggacctcagtcccaatcaaagcaaacagctgcttcgcctcttgaacacaactcaaaagtgctttctagatgttcaggagtcagtgacaacccaggtagagcggctggaaacacagcttcacttggaacaagacctcgatgatcagaaaattgtggctgagcgccagcaagaatataaggagaaactgcagggcatctgcgaccttttgacccagacggagaaccgtctgattgggcaccaggaggccttcatgatcggcgacgggacagtggaactgaagaagtatcagtcaaagcaagaggagctacaaaaggacatgcagggctccgctcaagcgctggcggaggtggtgaaaaacactgagaactttctgaaagagaatggggaaaagctgagtcaggaggacaaggcactcatcgagcagaagctcaatgaggcgaaaattaaatgcgagcaattgaatctgaaggcagagcagtccaaaaaagagctggacaaagtagtcacaactgccatcaaggaggagaccgagaaggtggcggctgttaagcagctggaggaatccaagactaagatcgaaaacctgttggactggctctccaacgtggataaggactctgagcgcgcaggcacaaagcacaagcaggtgatcgagcagaacggaacccactttcaggagggtgatggcaaatcagccatcggggaagaggatgaggtgaatggaaatttgctggagaccgatgttgacgggcaggtggggacaactcaggaaaacctcaaccagcaataccaaaaggtgaaggcccagcacgagaaaattatctcccagcatcaggccgtgattatcgccacgcaatcagcccaagtccttctggagaagcagggccagtacttaagccctgaagaaaaagagaagttgcaaaaaaacatgaaagaacttaaagtgcactacgaaaccgcgttagctgaatcagaaaagaaaatgaaattgacgcactcccttcaggaggagctggaaaagttcgatgcggactatacagagtttgaacactggctgcagcagagcgagcaagaactggaaaaccttgaggccggagctgacgatatcaacgggctcatgactaaattgaagcgtcaaaagagctttagcgaagacgtgatctcacataagggggacttacgctacatcactatctccggtaaccgggtgttggaagccgcaaaaagctgcagtaaaagggacggtggcaaagtagacacatccgcgactcatagagaagtgcagcgaaaactcgaccacgcgaccgatagattccgctcgctgtactctaaatgtaacgttctgggaaacaacctgaaggatctggttgacaaatatcagcactacgaagacgccagctgtggattgctcgcaggcctacaggcttgtgaagcgacagccagcaaacatctctcggaacccatcgccgttgaccctaaaaacctgcagcgacagctcgaagaaacaaaggccctgcagggccagatatcctctcagcaagttgctgtggagaaactgaaaaaaactgccgaggtgctgcttgacgcaaggggctcactgctgccagctaagaacgatattcagaagacgctagacgacattgtcggtcgttacgaggatctgtcaaagtctgtcaatgagcggaacgagaagctgcagataaccctgacccggtcactgagcgtgcaggatgggcttgatgagatgctcgactggatggggaacgtcgagtcttccttgaaggagcaagggcaagtgccgcttaacagtacagccctgcaagacattatcagcaaaaatattatgcttgagcaagacatcgctggtaggcaatcatcgatcaatgcaatgaatgagaaggtgaagaaattcatggagacaactgaccctagcacagcctcctcgctacaggctaaaatgaaagacttaagtgccaggttttctgaggccagtcacaaacacaaggagaccctggctaagatggaggaactcaagacaaaggtggagctgtttgagaacctgagcgaaaaactccagacctttttagagacaaagactcaggccctcaccgaagtggacgtgcctgggaaagatgtcacagaattatctcagtacatgcaggaaagtacctccgagttcctggagcacaagaagcacctggaggtgctgcattcattgctgaaagagatatcctcacacggcctgcctagcgacaaagcccttgtcctggagaaaacgaataatctcagcaagaagttcaaggaaatggaagacaccataaaagagaagaaggaggctgtcacatcatgccaagaacagctcgacgcattccaggtccttgtcaaatctctgaaatcatggatcaaggaaaccacgaagaaggtgcccatcgtccagcccagttttggggctgaggacttaggaaaaagccttgaggacaccaaaaagctccaggagaagtggagcctgaaaactcccgagatccagaaggtgaacaattcagggatcagtctgtgtaatctcatatccgcggtcaccactcctgctaaagccatcgcagcagtaaagtcggggggagcagtcttgaatggcgaaggaaccgccacaaacaccgaagagttctgggccaataaagggttgacatcgattaaaaaggacatgactgatatctctcatggctacgaggacctgggcttactcctgaaagacaagatcgctgaactgaacaccaagctgagcaagctgcagaaggcccaggaggagagcagcgcaatgatgcagtggttgcagaagatgaataagacagccaccaagtggcagcaaacaccggcaccaactgacactgaggccgtgaaaacacaggttgagcagaacaaatcttttgaggcagagcttaagcagaacgttaataaggtccaggagctgaaggataagttgaccgagcttctggaggaaaatcctgataccccagaggctcccagatggaagcagatgctcaccgagatcgactccaagtggcaagagctgaaccagcttacgatcgatagacagcaaaaacttgaagagtcctccaataatctgacccagtttcaaactgtagaggcacagctcaaacaatggctggtcgagaaggagctcatggtttcagtgttaggcccactctctattgacccaaacatgctgaacactcagcggcagcaggtccagatcctgctgcaggaatttgccacacgcaaaccgcaatacgagcagcttacagctgcaggacagggtattttaagcagacctggtgaagatccttcacttcggggaatcgttaaggagcagctggccgctgtcacgcagaagtgggactccctcaccggtcaactgtcagatagatgtgactggatagatcaggccatcgttaaaagcacccagtatcaaagtttactcagatcactgagcgacaagcttagcgacctagacaacaagctgagttccagtctggcggtttcgacccaccctgatgctatgaaccagcagctcgaaactgctcaaaagatgaagcaggaaatccagcaagaaaaaaagcaaatcaaagtagcacaggccctctgcgaggatctgagcgccctcgtgaaggaggagtatctgaaggcggaattatcccgacagttagagggcatcctcaagtccttcaaagatgttgagcaaaaggctgagaatcacgtgcagcacctgcagtccgcttgcgcatcctcacaccagtttcagcagatgagtcgagacttccaagcatggctggacacgaagaaagaggagcagaacaagtctcaccctatttctgccaaacttgatgtgctggaatcactgattaaggaccataaggatttctctaaaactctgaccgcccagtctcacatgtatgaaaaaaccatcgccgagggcgagaatctcttgctcaagactcagggatcagagaaagccgcactgcagctccaattgaacaccattaaaacgaattgggatactttcaacaaacaggtaaaagaaagggaaaataagctcaaggagtcactggagaaggcactcaagtataaggaacaggtcgagactctttggccctggattgacaagtgccagaataaccttgaagagatcaagttctgtctcgatccggctgaaggagaaaatagcatcgcaaaactgaaaagcctgcagaaagaaatggatcagcactttggcatggtggaacttcttaataacacggcgaactctctgctcagtgtctgtgagatcgacaaggaggtcgtcacagacgaaaataaaagccttatccagaaagtggacatggtgacggagcagctgcatagcaagaaattttgtctggagaatatgacccagaaatttaaggagttccaggaggtcagcaaggaaagcaagaggcaactgcagtgcgccaaggaacagctcgacatacacgattctctggggtctcaagcttattcaaataaatacctgacaatgttgcaaacccagcagaagtctttacaggcgttaaagcaccaagtggaccttgctaagagactggcccaggacttagtggtggaggcaagcgattcaaaaggaacgagcgacgtcctgcttcaagtcgaaaccattgctcaggaacacagcacactcagccagcaggtggacgagaagtgcagcttcttggagaccaaattgcaaggaataggtcacttccagaacaccatccgagagatgttcagccaatttgctgagtttgacgatgaactggatagtatggcacctgttggaagggatgccgagacactacagaaacagaaggagaccattaaggcctttttaaagaaactcgaagcactgatggcatctaacgacaatgctaacaaaacatgcaaaatgatgctcgcaacggaggagacttctcctgatttggtgggcattaaacgcgatctggaggccttgtccaaacagtgtaacaaactcctagatcgggcacaggccagagaagaacaagtagagggcacaattaagaggctggaagagttttactccaagctgaaggagttcagtatccttctccaaaaggctgaagaacacgaagagtcccagggccctgtagggatggagacggagactatcaaccaacagcttaacatgtttaaggtctttcagaaagaggaaatcgagccactgcagggcaaacagcaggacgtgaactggcttggccagggcctcattcagagcgcagccaagtccacaagtacccagggtctagagcacgacttggacgatgtaaacgcccgttggaagacattaaataagaaggtggctcagcgtgccgcacaactgcaggaggccctgctacactgcgggcgttttcaagatgctttggagtcactcttatcttggatggtagacaccgaggagctggtggctaaccagaaacctcctagtgctgaatttaaagtcgtgaaggcccaaatccaggagcagaagctcttacagcgactactcgacgatcgaaaatccacagtggaagtcattaaacgagagggcgagaagatcgccaccaccgctgaacccgcagataaggtgaagatcctgaaacagctctccctgctcgactcaagatgggaggcattgttgaacaaggctgagacacgaaaccgccaactcgaagggattagcgttgtcgcccagcaatttcacgaaactctggagcctttgaacgagtggctaacaacaatcgaaaaacgcctggtgaattgcgaacctattggaacacaggcttccaagctggaagagcagatagcccagcacaaggttctccaggaggatattctgctccgcaaacagaatgtggatcaggctctgcttaacggactcgaattgctgaaacaaaccacgggagacgaggtgctgataatacaggataagttagaagccattaaagctcgctacaaggatattactaagctgagcaccgatgtcgccaagaccctcgagcaggcccttcaactggccagacgactgcactcgacacacgaagaactctgtacatggctcgataaagttgaggtggaattgctgtcctatgaaacacaggtactgaagggcgaagaagcctctcaggcccagatgcgacctaaagagctcaaaaaggaggccaagaacaacaaagccctcctggattccctcaacgaggtgtcatcggcactgttggaactggtcccctggagggccagagagggacttgagaagatggtggctgaagacaatgagaggtaccggcttgtctcagataccatcacccaaaaagtggaagaaatcgatgcagccattctacgcagtcagcagttcgaccaggcagcagatgcagagctgtcatggatcactgagaccgagaaaaaattaatgtctctgggggatatacgcttagaacaggaccagacctcagcacaactccaggtacagaaaaccttcacaatggaaattctcagacataaggatatcattgatgaccttgtcaagtcaggacataaaattatgacagcttgtagcgaagaagagaagcaatctatgaagaaaaagctagacaaggtcttgaagaactatgacactatctgccagataaattctgagagatacctgcaactggagcgcgctcaaagcttggtgaatcagttctgggagacatacgaagaactgtggccctggctgacagaaacccagtcaattatcagccagctgccggcaccggcactggagtatgaaacactgagacagcagcaagaagaacatcgacaactccgcgagttgattgccgaacataaaccccatattgataagatgaataagacaggccctcagctgctcgagctttccccaggcgaaggattttcgatccaggaaaaatacgtggcggctgatactctgtactcccagattaaggaggacgttaagaaaagagccgtggctctggatgaggcaatttcccagtctacccagttccatgacaagatcgatcagattctggagtcactggaacgaattgtggagcggctaaggcagcccccaagcatttctgcagaggtcgaaaaaatcaaagagcagatctccgagaacaaaaatgtgtctgtcgatatggagaaacttcaaccactgtacgagacattaaaacagcgcggagaagagatgatcgcaagatcaggcggtaccgacaaagatatctcggcaaaggcggttcaggataagttggatcaaatggtgttcatctgggagaatatccacacgctggtggaagagagggaggccaagctgctggacgtcatggagctagccgagaaattttggtgcgatcatatgagtctgattgtaaccatcaaagacacacaggactttattagggacttggaggatcccggtatagatccctcagtggttaagcaacagcaagaggcagcggagactatcagggaagaaatagacgggctgcaggaagagctggatattgttattaacctgggctctgaactgattgctgcttgcggcgagcctgataagcccatcgtcaagaaaagtattgatgaactcaattctgcctgggactccctgaacaaagcttggaaggacaggattgataagctcgaagaggcaatgcaggccgctgttcagtatcaggatggcttgcaggccgtcttcgactgggtcgacatcgcgggaggcaaattggccagcatgtctccgatcggcactgatctggagacagtaaagcagcaaattgaggaactcaagcagtttaaatctgaggcttaccagcagcagattgagatggagcgtttgaaccaccaagccgagctcttgctgaaaaaagtgacagaagagagtgataagcataccgtccaggatcccctgatggagttgaagctaatctgggattcattggaagagaggatcatcaatcggcagcacaagctggaaggtgctttgttagcactgggccaattccagcatgccctggacgaactgcttgcctggctgactcacaccgaaggtctactcagcgagcagaagcctgttggaggcgatcccaaagctatagagatcgagctagctaaacatcacgtgctccaaaatgacgtattagctcaccaatcaacagtggaggctgtcaataaggcagggaacgatctcatcgaaagcagcgcaggagaggaagcgagcaatctccagaataagctggaggtccttaaccagagatggcaaaatgtcctggaaaaaacagaacagaggaaacagcagctggacggtgccttgcgccaagccaagggttttcacggagaaatcgaagatcttcagcagtggcttaccgataccgagcgacatctcctcgcttctaagccgctgggcggattaccggaaacagcaaaggagcagctgaatgttcacatggaagtgtgcgccgcattcgaagccaaggaagagacctataagtcactgatgcagaagggtcaacagatgcttgccaggtgtccaaagtctgcagaaaccaatatcgatcaagatataaacaatctgaaagagaagtgggagtccgtggagaccaagctgaacgagcggaaaactaaattggaagaggccctcaatttggctatggaatttcataatagtctacaggacttcataaattggctgacacaggcagaacagaccctcaatgttgcaagtagaccctctctgattctggacactgttctcttccagatcgatgaacacaaagtgtttgcgaacgaagtgaattctcacagggaacagataatcgagctcgacaaaaccgggacgcacctcaagtatttctcccagaaacaggacgtcgtattaatcaaaaatttactgatcagcgtgcagtctcgctgggagaaggtggttcagcgactggtggagcgcggtcgatccctggacgatgccaggaagcgcgcaaaacaattccatgaggcctggagcaaactgatggagtggctggaagaaagcgaaaaatcgctggactcagaactggagatcgccaacgaccccgataaaatcaaaacacagctggcgcaacacaaagagtttcagaagtctcttggggcaaagcatagtgtgtacgatactaccaacagaaccggcagaagcctgaaggagaaaacgagccttgccgacgacaatctcaagctggacgatatgttatccgaactcagagataagtgggacacaatctgtggcaaatccgtagaacggcagaataagctggaggaagcgctgctgttctctggacagttcacagatgctctgcaggccctgatcgattggctatatcgggttgagccccaactcgctgaggaccagcccgtgcacggggacatcgacctggtgatgaatcttatagataatcacaaagcttttcaaaaagagctggggaagcgaacatcttctgtccaagcccttaaaaggtctgctcgcgagcttatcgaaggcagccgggatgactctagttgggtcaaagtgcaaatgcaggagctctccacgcgctgggaaactgtgtgtgcactatccatctccaagcaaacacgcttagaggctgccctgcgtcaggcagaggagtttcactcagtggttcacgcgttgcttgaatggttggcagaggcggagcaaacactgcggttccatggggtgcttccggatgatgaggacgccctgcggaccctgattgaccagcataaagaatttatgaagaaactggaggaaaagagggctgagctgaataaagcaactaccatgggggacaccgtcctagcgatctgtcacccggactccattacgactattaaacattggatcacaataattagggccaggttcgaggaggtcctcgcgtgggccaagcaacatcagcaaaggcttgcctctgcactggccggtctgatcgcaaagcaggaactgctcgaagccctgctggcctggctgcagtgggccgaaaccacgctgacagacaaagataaggaggttatcccacaagaaatagaagaggttaaagccctgatcgccgagcatcaaactttcatggaggagatgacgagaaagcagcccgatgtggataaagtaacaaaaacttataagcgacgtgctgcagacccatcgagtcttcaaagccacattcccgtcttggataaggggagggctggcagaaagcgctttcccgcttcctcactgtatcctagtggatctcagactcaaatagaaactaagaacccccgagttaacctgctggtgtcgaaatggcagcaggtttggcttcttgccctcgaacgtagacgaaagctaaatgacgcacttgaccgtctcgaagagctgcgcgagttcgccaactttgacttcgacatctggcgaaaaaagtatatgaggtggatgaatcacaaaaaaagccgggtcatggactttttcaggcggatagacaaggaccaggacgggaaaattacgagacaggaattcattgacggcatcctgtcatcaaagttccccacatcacgcctcgagatgtcggctgtggctgatatctttgaccgcgacggggatggatatatagactactatgagttcgtggccgcactccatcctaataaggatgcgtataagcctataacagacgccgataaaattgaagatgaggttacgcggcaagtcgcgaagtgcaaatgcgcaaagcgttttcaggtggagcagatcggtgataataagtacagattcttcttaggaaaccagttcggcgattcgcagcagctgagactggttcgcatcctgagaagcacggtgatggtccgcgtcggcggaggatggatggcacttgatgaattcctagtaaagaatgatccttgccgcgtccaccaccatggaagcaagatgttacgttctgagtccaacagtagtattacaacaacccagccaaccatcgctaaaggccgtaccaacatggagctgcgcgagaaatttatattggctgatggtgcttcgcagggcatggccgctttccgcccacggggaaggcgcagccgaccttccagtaggggggcatctccaaataggtccacaagcgtgagcagccaggcagcccaggcggcttccccgcaggtcccagccaccactactcctaaaggaacccccattcagggtagtaagttgcggctgcccggttatttgagcgggaaagggttccactctggagaagattctggactcatcactaccgcagcggctagagtacgcacacagttcgccgattccaaaaaaacgccaagccggccaggctcccgagccggaagcaaagcaggaagccgtgcctcttcacgtagaggttctgacgccagcgactttgatataagcgagattcagtcggtgtgctcagacgtggaaacagtccctcagacccaccgaccaactcccagggcaggctctcgcccttctaccgcaaagccaagcaaaattcctacgcctcagcgtaaaagccctgcatccaaactcgataaaagttctaagaggtat

SEQ ID NO: 221510 - DNA, 23253 bp, Artificial Sequence
  Description of Artificial Sequence: Synthetic coding sequence
atgattgccgctgctttcttagtgcttctgaggccctacagtatccagtgtgcactgttccttctcctgctcctgttaggcacgatagctactatcgtttttttttgctgctggcaccggaaactacagaaggggcgacacccaatgaaaagcgtgttcagtggacggtcgagatcacgtgacgctgtgttgcgctctcaccatttcagatccgagggcttcagggcaagtcccagacatcttcgtagaagagtggcagccgcagccgctgccagactggaagaagtgaaacctgtggtggaggtccaccaccagtccgaacaggaaacaagcgtcagaaagaggaggattaagaagagcagcagagtacagcccgaattttaccactctgtgcaaggcgcttcaattcggaggcccagctccggtaacgcgagttataggtgcagcatgtcgtcctctgctgattttagcgacgaggacgatttttcccagaagagtggcagcgcctccccagcaccaggcgacaccctgccctggaacctgcccaagcacgagcggtctaagcgcaaaatccagggcggttctgtgttggatcctgctgaacgagccgttttgaggattgccgatgaacgcgacaaagttcagaaaaagaccttcacaaaatggattaatcagcacctgatgaaagtgcgcaagcacgtgaacgatctctatgaagacctgagagacggtcacaacctaatctcacttctggaagtcctgtctggagacaccttgccgcgtgaaaaagggagaatgaggttccaccggctccagaacgtgcaaatcgctctagattacctgaaaaggagacaagtgaaacttgtgaatattcgcaatgacgatattacggacggcaatccaaagctgactttggggctgatctggacaattattcttcactttcagatcagcgatatccatgtcaccggggaatctgaggacatgagcgccaaggagcgcctgttgttgtggacacagcaggcaaccgaaggatatgccggtatccgatgtgagaacttcacaacatgttggagagatggaaagctttttaatgcgattattcacaaatataggcccgacttgatagacatgaacaccgttgccgtgcagagcaacctggctaatctcgagcacgccttttatgtcgctgaaaagatcggtgttatacgactgctggaccctgaagacgttgacgtgtcaagccccgatgagaaaagcgtgataacttatgtgtcaagcctgtatgatgctttccccaaggtccccgagggcggagagggtataggagctaacgacgtggaggtaaaatggatagaatatcagaatatggtaaattatctcattcaatggatccggcaccacgtgactactatgtctgagagaacttttccgaacaaccctgtggagttgaaggctctgtataaccaatacttacaattcaaagagacagagatccccccaaaagagaccgagaagagtaaaatcaaaagattgtacaaattactggagatatggatcgagtttggacggataaaactccttcaggggtaccacccaaatgacattgaaaaagaatgggggaagcttattattgcgatgttggaaagggagaaagctttacggcctgaagttgagcggctggaaatgctccaacaaattgcaaacagagtgcagcgcgacagtgtgatctgtgaggacaaactaattttagccggtaatgctctgcagagtgattcaaagcggctggagagcggggttcagttccagaacgaggccgagatcgccggttacatcctggagtgtgaaaacctgctgagacaacacgtcattgatgtacaaatactgatcgacggaaagtactaccaggccgaccagctagtccagagggttgccaagttacgtgacgagatcatggcacttagaaacgagtgctcgagcgtgtactccaagggacggattctgacgacggaacagacgaaattgatgataagtggcattacgcagagtcttaactcgggattcgcgcagacactgcacccaagtctaacaagtggactgacccagtcattgacaccgtcactgacttcctccagtatgacttcagggctgtctagtggcatgacctctcggctgactccctctgtgactcccgcttacacacctggcttcccaagcgggctggtgcctaacttttcgtctggggtggagcccaatagcctgcagacactgaaactgatgcaaattcggaagcccttgctgaaatcttctctgttggatcagaacctgacagaggaggagattaatatgaaatttgttcaggaccttttgaactgggtggacgaaatgcaggttcagttggaccgtacagagtggggatctgatctgccatcagtcgaatctcatcttgaaaaccacaagaacgtccatagagctattgaagagttcgagtcatccttgaaggaggcaaaaataagtgaaatccagatgaccgcccctctgaaactgacgtatgcggaaaaattgcaccggctggagtcacagtatgccaagctactgaatacctcacgaaaccaggagcgtcatttggacaccctgcacaacttcgtttctcgcgcaactaacgaacttatttggctgaatgaaaaagaggaggaggaagtggcctatgactggtccgaaaggaacactaacattgctcgaaaaaaggactatcacgctgagctcatgagagaactggaccaaaaggaagagaacatcaagtctgtgcaagagatcgcagaacagcttctgctcgagaatcacccagccagactgacaatagaggcctacagagctgccatgcaaacacagtggtcttggatacttcagctgtgccagtgcgtggagcagcacatcaaggagaataccgcatactttgagttcttcaatgacgctaaagaggcaaccgattacctgcgaaacctcaaggatgccatccagagaaaatactcctgtgatcgctcctcaagtatccacaagttagaggatctggtccaggagagcatggaggagaaggaagagttactgcagtacaagtccactatcgctaaccttatggggaaggctaaaacgatcatccagctgaaacccagaaattcagattgccctctgaagacgtccatcccaatcaaggccatatgcgattacaggcagatagagatcactatctacaaagatgatgaatgcgtgttggccaataactcccaccgtgccaagtggaaggtgattagcccaacgggtaatgaggccatggtcccaagcgtgtgtttcacggtgccacccccaaacaaggaggccgttgacctagccaaccgcattgaacaacagtaccagaatgtgttgaccctatggcacgagagccacatcaacatgaagtctgtagtgagctggcactaccttatcaacgagatcgatagaatccgggcttctaatgtggcttctattaagaccatgttgcccggagagcaccagcaggtgctgtctaacctgcagagccggtttgaagactttctggaagactctcaggagtcccaagtcttctccggatccgatattactcagctggagaaagaggtaaatgtgtgtaagcaatactaccaggaattgctcaaaagtgctgaacgagaggagcaggaagagtccgtttataacctttatataagtgaggtcaggaacatccgcctacgcctcgagaactgcgaagacaggctgatcaggcagataagaacaccactcgagagagatgatctgcacgagtcagtctttaggataacagagcaagagaagttgaaaaaagaactcgagagactcaaggacgacctaggaaccataactaacaaatgcgaggaattcttcagccaggcagccgcatcatctagcgtcccgaccctgaggtctgaactaaatgtcgtgctgcagaatatgaatcaagtgtactccatgtcctcgacctacattgacaagctcaagaccgtcaacctggtgctcaagaacacacaagccgcagaggcgctcgtcaagctgtacgaaactaaactgtgtgaagaggaggctgtgatcgccgacaagaacaacattgaaaacctgatctctaccctgaaacagtggcggagtgaagtagacgagaagcgccaagtcttccatgctctggaggacgaattgcagaaagcaaaggccatcagtgatgaaatgtttaagacttacaaagaaagggatctggacttcgattggcacaaggagaaagctgatcagctggtggagcgctggcagaacgtgcacgtccaaatcgacaaccggcttcgggatctggagggaatcggtaaaagcttaaagtattatagggatacctatcacccgttagatgattggatccagcaggtggaaaccacccagcgcaagatccaggaaaaccagccagagaactccaaaactctggccacccagctcaaccagcaaaagatgctggtgtcagagatcgagatgaagcagtcgaagatggatgaatgccagaagtatgccgagcagtattcggctactgtaaaagattacgaacttcagaccatgacttaccgagccatggtcgattcccagcagaaatctcccgtcaagaggcgtaggatgcaaagctcggctgatctgattatccaggagttcatggacctgcgcacacggtacactgcactggttaccttgatgactcagtacatcaagttcgccggagacagccttaagcgactggaggaggaggagaagtcgctggaggaagagaaaaaagaacacgttgagaaggcaaaagaactgcaaaagtgggtctccaatataagcaaaactctgaaggacgccgaaaaggctggaaagcccccattcagcaagcagaaaatctcatctgaagagataagcacgaagaaggaacagctgagtgaagcactgcagacgatccaactgtttctggctaaacatggcgacaagatgaccgatgaggaaaggaatgagctggaaaaacaagtcaaaaccttgcaggagtcctataatctgctgttcagcgagtccctgaaacagctgcaagagagccagacaagtggggatgtgaaggtggaggagaagctggataaagtgattgctgggaccatagaccagactaccggggaggtcctttctgtctttcaggctgtacttcgcggtctgatagactatgacacggggatccgactgctggagacacagctgatgatttcaggcctaattagccctgagcttcgcaaatgcttcgacctgaaggacgcgaagagccacggactgatagatgagcaaatcctgtgtcagctcaaggagctatctaaggccaaggaaattattagcgcagcctcccccaccactattcccgttttggacgccctcgcgcagagcatgatcacggagagtatggcaattaaagttttagagatattactgtccaccggatcactcgttatccccgctactggcgagcagctgactttgcagaaggcattccagcagaatctggtcagtagtgccctgttttctaaggtcttggaacggcaaaatatgtgtaaggatctgatcgatccctgtacctctgaaaaagtatcacttatagatatggtgcagcgctcaacgctgcaggaaaacactggcatgtggttgcttccagtgcggcctcaggaggggggtaggatcactctgaagtgtgggaggaacatctctattctcagagcagcccacgagggacttattgaccgggaaactatgtttcggctgttgtcagctcagctgctgtctggcggactgatcaattctaacagcggacaacgcatgaccgtggaagaggcggttcgagagggcgtcatcgacagggatactgccagctcaatccttacttatcaagtccagactggaggcataatacagagcaacccagccaagcgcctcaccgtggacgaagctgtccagtgcgatctaatcaccagttcgtccgctctgctggttttagaggcgcagcgcggttatgtcggccttatttggccccatagcggtgagatctttccaacatcctcctccctgcaacaagagcttattacaaatgagctagcctacaagatactgaacgggcgtcaaaaaatcgccgctctctatattccagagagctcccaggttattggactggatgcagcaaagcagctgggcataatcgacaataacactgcttctatcttgaagaacattaccctgcctgacaagatgccggacctcggcgaccttgaggcctgcaagaatgcccgacgctggttaagcttctgcaagttccaaccttcaacggtgcatgactaccgccaagaggaagatgtgttcgatggggaggaaccggtgacaacgcagacctcagaagaaacgaaaaagctgtttctctcctatctcatgatcaattcctacatggacgctaacactggacaaaggctgctgctctacgacggggatctggatgaggctgtaggtatgcttttagagggctgtcatgcagagttcgacggcaatactgctattaaggagtgtctggacgtcctgagcagcagtggggtgtttcttaacaacgcttcagggagagaaaaggacgagtgcactgcaacacctagttctttcaacaaatgtcattgcggcgagcctgagcatgaggaaaccccagaaaatagaaaatgtgctattgacgaagagttcaacgaaatgcggaacacggtaataaacagcgagttttcacagtctggtaagctcgccagtacaatcagcatcgacccgaaagtgaatagctcacccagtgtctgtgttccgtccctgatttcctatctgactcaaaccgagctggcggacatctcaatgctaaggtcggattctgagaatattctgacaaattacgagaaccaaagcagagtggagactaacgaaagagcaaacgaatgttcacactcaaagaatatccaaaattttcccagcgatctcatagaaaaccctatcatgaagtccaaaatgagcaagttctgcggagtaaatgaaaccgaaaacgaagataatactaatagggactcgcccatttttgactactcacctcgccttagtgctctgttatcccatgataaactgatgcactctcaaggaagcttcaacgatacccatactccagaatctaacggaaacaaatgtgaggcccctgccctgtctttttcagataaaaccatgctctccggacaacgtataggcgaaaagtttcaggaccaattcctgggcattgctgcaatcaacatttccctgccgggagagcagtatggccagaaaagtctgaacatgatctcgagtaatccacaggttcagtaccataatgataaatatatctcaaacacatctggcgaggacgaaaagacacacccaggtttccagcagatgccagaagataaggaggacgagtccgagatagaggagtacagctgtgccgtaaccccaggcggagatacagacaacgcaattgtgtctctgacctgcgcaactccacttctggacgaaactatctcagcaagcgactatgaaacctccctgttgaacgatcagcagaataataccggcaccgacacagattcagacgacgacttctacgatacaccactgttcgaagatgatgaccacgattccctgttactggacggagacgaccgagactgcttacatccggaggactacgacaccctgcaggaggaaaatgacgagacagcatccccagccgatgtgttttacgacgtgtcgaaagagaatgagaacagcatggtgcctcagggcgctccagtaggatcactgagcgtcaaaaataaagcccattgccttcaggacttccttatggacgtggagaaagatgagttggatagtggcgagaaaatccacctgaacccggtcggctccgataaggtgaatggtcagtcgctcgagaccggatctgaacgcgagtgcacaaatatattagaaggggatgagagcgattcactcacagattatgacattgtcggagggaaagaatcattcactgcgtccctcaaattcgacgactcaggaagctggagggggcgtaaggaggagtacgtcaccggccaggaatttcattccgatactgaccacctagactcaatgcagtcagaagaatcttacggggactatatttatgatagcaacgatcaggatgacgatgacgacgacggtattgatgaggagggtggcggtatccgcgacgaaaatggtaagcccaggtgtcagaatgtggcggaggatatggatattcaactgtgtgcaagcatcctaaatgagaactcagacgaaaacgaaaacatcaacaccatgatcctgttggataaaatgcattcctgctctagcttggagaagcagcaacgggtgaacgtagtccagctcgcctccccaagcgagaataatctcgtgacagagaaatccaacctccccgaatataccacagaaatcgcaggaaagagtaaggaaaatctgctaaaccacgaaatggttctgaaggacgtacttcccccaatcatcaaggacacagaaagtgaaaagaccttcggacctgccagtatcagccatgacaataacaacatcagtagtacaagtgagttgggcacagatctcgccaatacgaaggttaaactgatacaaggaagcgaactcccagaactgaccgactctgtcaagggtaaagatgaatacttcaaaaatatgacaccaaaagtggatagttcccttgatcatataatttgtacggagcccgatcttattggtaagccggctgaggaatcgcatctgtcactcatcgcctcagtcacagataaggacccccaggggaatggcagcgacctgattaaaggccgtgatggcaaatctgatatcctcatcgaggatgaaacaagcatccagaagatgtatctgggtgaaggcgaggtcttagtggagggcctagtggaagaggagaatcgacatttgaagctgctgcctggaaagaatacacgagactcctttaagctcatcaactcccagtttcctttcccgcagattactaacaacgaggagttgaaccagaaaggatctctgaagaaagctaccgtgaccctcaaagacgaacccaacaatcttcaaatcatagtgtccaagagtccggtccagtttgagaatctcgaagagatcttcgacacgagcgtttctaaggaaatttctgacgacatcacttctgatatcactagttgggaggggaacacacatttcgaagaatcctttactgatggacctgaaaaagagctggacctgttcacgtaccttaagcattgtgccaaaaacattaaggctaaggatgttgcaaaacctaatgaagacgtcccgagccatgtcctcattacggcgccacctatgaaggagcaccttcagctcggagtaaacaacaccaaggagaagagtaccagtactcagaaggacagccccctgaacgatatgattcaaagcaatgatctgtgtagtaaggaaagtataagcggaggtggtaccgagattagtcagtttacacccgagtctatcgaggcgacgctctccattctgtcaagaaaacacgttgaggacgtggggaagaatgattttcttcaatctgagcggtgcgcgaatggccttggaaatgataatagttcaaacacactgaacactgattacagcttcttagaaataaacaacaagaaagagcgcattgaacagcagctcccgaaagaacaggcattaagtccaaggtcgcaggagaaagaagtacaaattccagaattaagtcaggtgtttgtcgaggatgtaaaagacattcttaaatcacgtctgaaagagggccacatgaacccgcaggaggtggaagagccttccgcgtgtgccgatacaaaaattttgatccagaaccttattaagaggatcactacttcccaactggttaatgaggccagcactgtgccaagcgacagtcagatgtcggatagctcaggtgttagccctatgaccaatagctccgagttgaaacctgagtctcgtgatgatcctttctgcataggaaacctcaagagtgagcttctgcttaacatactaaagcaagaccagcacagtcagaaaataactggggttttcgaactcatgagggaattgacgcacatggaatatgatctagagaaacgcggaataaccagcaaggtgttgccactgcaactggagaacattttttataaactgctggctgacggctacagtgagaagatcgaacacgtaggcgattttaatcagaaggcatgtagcacatcagaaatgatggaagaaaagccacatatcttgggcgacattaagagtaaggaaggtaactactatagcccgaaccttgaaaccgtgaaggaaatcggactggaatctagtacagtttgggcctccaccttacccagggacgagaaattaaaagatctgtgcaatgactttcctagccaccttgaatgcacaagtggctccaaggaaatggcctctggagacagttctactgagcagtttagttccgagcttcaacagtgccttcagcacacagagaagatgcacgagtacttaacccttctgcaggatatgaaacccccactcgacaatcaggaatccctagacaacaatctcgaggcgctcaagaatcaactcaggcagctggagacctttgagttgggactcgctcccattgcagttatcctgcggaaagacatgaagctagccgaggaattcctcaagagtctgcccagtgattttcctagagggcacgtagaagaactgagcatatctcaccagtcactgaagacagccttttcctccttgtctaacgtttcctccgaaaggaccaagcagattatgctggccatagattcggaaatgtctaaactggccgttagccacgaggaattccttcacaaactgaaatctttctccgattgggtcagcgaaaagtcaaagagtgtgaaagacatcgagattgtaaatgtgcaggattcagagtatgtgaaaaaaagactggagttccttaaggcgaacaatgtcttaaaagacctcggacacaccaagatgcagttggagaccactgcttttgacgttcaattctttatttccgaatatgcccaagatctgtccccaaatcagtcaaagcagctgcttcgattgctaaacactactcagaaatgtttcctcgatgtgcaggaatcagtcacaactcaggttgagcgtctggagacccagctgcaccttgagcaggatctcgacgaccagaaaatcgttgcagagagacagcaggagtacaaggagaagctgcagggtatctgcgacttgctgacacaaacagagaaccgcttaatcggccaccaggaagcctttatgatcggggacggcacggtggaactcaaaaagtaccagtctaagcaggaggagctgcagaaagatatgcagggttctgcacaggctctcgcggaggtggttaagaacactgaaaactttctgaaggaaaacggagaaaagctgtctcaagaggacaaggccttaatcgaacagaaactgaacgaagcgaagattaaatgtgagcagttaaatctgaaagccgagcagagcaagaaagaattggataaggtggtgactactgctatcaaagaagaaaccgagaaagtggccgcagttaagcaactcgaggagagcaagaccaaaatcgagaacctcctcgactggctgtcaaacgttgacaaagatagcgagagagccggaactaaacacaagcaggtgatagagcagaatgggacccattttcaggaaggtgacggcaaatccgccatcggcgaagaggatgaggtgaatggaaacctgctggagacagatgtagatggtcaggtcggaacgactcaggagaacctcaatcagcagtatcagaaagtaaaagcccagcacgaaaaaattatttcccagcatcaggcggtgattatcgcaactcagtctgcccaggtactgctcgagaagcagggccagtatttgagccccgaagagaaagaaaagctccagaagaatatgaaggagctgaaagtgcactacgaaacggccctggctgaaagcgaaaagaaaatgaagctgacccacagcctgcaggaggaactggagaagttcgacgcggactatacagagtttgagcattggctgcaacagtccgagcaggagctggaaaacctggaggccggagcagatgatatcaatggactcatgactaagttaaagcgtcagaaatcattctcagaagatgtcatttcccacaagggggacctgcgatatattaccatttcaggaaatcgtgtgctggaggctgccaaatcttgttcaaagcgggacggcggaaaagtggataccagcgcaacccatagagaggtgcaacgaaagctggaccatgccaccgacagatttcgcagtctttactctaaatgtaatgtcctcgggaacaatctgaaggatctagtcgataaatatcagcactatgaggacgcgtcttgcggccttctggccggactgcaggcctgtgaagctacagccagcaaacacctcagtgaaccaatcgccgtcgatccaaaaaatctccagagacaactggaggaaaccaaggctcttcagggtcagatatccagtcagcaagtggccgtcgaaaagctcaaaaagacagccgaggtcctcctggatgccagaggtagcctgttacctgcaaaaaatgatatacaaaaaaccctggacgacatagttgggagatatgaggatctgtccaaatccgtgaatgagcgaaatgaaaagctacagattactttaactcggtctctatccgtacaagatggcctcgacgagatgctggactggatgggtaacgtcgagtcctctctcaaagaacaggggcaagtgcctctgaattccaccgctctccaggatattataagcaagaacattatgctggaacaagacatagcgggtcgtcaatcatcgattaatgcgatgaacgaaaaagtaaagaagttcatggagacaacagatccctccaccgcttcgtcacttcaagcaaagatgaaggacctctccgcccgttttagtgaagcttcccacaaacataaagagacacttgcgaagatggaggagctgaagaccaaggttgagcttttcgaaaacctgtccgaaaaattgcagaccttcctcgaaacaaaaacccaagctcttacggaggtggacgtgcctggcaaagacgtgaccgaattgtctcaatacatgcaagaatccaccagcgaatttttagaacataagaagcatctcgaggtcctgcactccctcttgaaagagatatcatcacacgggctgccatccgacaaggctctggtactggagaagaccaataatctcagtaaaaagtttaaggaaatggaggacactattaaggaaaaaaaagaggccgtcacctcatgccaagaacagctggatgcattccaggtcctggtcaaatcgcttaaatcgtggattaaggagactaccaagaaagtccccatagtgcagccaagctttggagccgaggaccttggcaagtccctcgaggacaccaaaaagcttcaagaaaagtggagtttgaagactccagagatccagaaggtgaacaactctggcatttctctgtgcaatctgatatctgcggtcacaacccctgctaaggcaattgctgcagtgaagagtggcggagccgtgctgaacggggaaggcaccgctacaaacacggaagaattctgggccaataagggacttacctccattaaaaaagatatgactgatataagccatggatacgaggacctgggtctgctactcaaggacaagatcgcagagttaaatacaaagctttccaagctgcagaaggcccaggaggagagtagtgccatgatgcagtggttgcagaagatgaacaagactgcgacgaaatggcagcagactcccgcacctactgataccgaagccgtgaaaacacaggtcgaacagaataagagttttgaagcagaactgaagcagaacgtgaacaaggttcaggagctgaaagataagctgacggaactgctggaagagaatcccgatacacctgaggcaccaaggtggaagcaaatgttgacggagattgatagtaagtggcaggaacttaaccagctgactattgatagacagcagaaattggaggaaagctccaataatctcacccagttccaaacagtcgaagcccagctgaaacagtggcttgttgagaaggagttgatggtgtctgtgttgggtccattatctatcgaccctaatatgctgaacactcaaaggcaacaggtacagattcttcttcaggaattcgctacacggaaaccacaatacgagcagctcacggcagcagggcaagggattctgagtaggccaggggaggacccctccctgagaggtatagtaaaggaacagcttgcagccgtgacacaaaaatgggactccctcactggccagctatccgatcggtgtgattggatcgaccaggcaatcgttaagtctactcagtatcaatcccttctgcgaagtctgtccgataaacttagcgatctcgacaacaagctcagttcgtccctcgcagtgagcacacaccccgatgccatgaaccaacaattagagacagcccagaaaatgaagcaagaaatacagcaggagaaaaagcagatcaaggtggctcaggccctctgcgaggacctgagcgcgctggtgaaggaggaatacctgaaggcagagctctccaggcaacttgaagggattttgaaaagcttcaaagacgtagagcaaaaggccgaaaatcatgttcagcacctgcagtcagcctgtgcttccagccatcagtttcagcagatgagtcgcgacttccaggcctggctcgacactaaaaaggaggagcaaaataaatctcatccgatcagcgccaaactcgatgtgttggagtccctcatcaaggatcacaaagatttttccaaaaccttgactgctcagagccatatgtacgaaaagaccatcgcggagggtgaaaacttgctcctgaagacgcagggcagtgagaaagccgcattgcagctgcagctgaatactatcaaaacaaactgggacaccttcaacaaacaggttaaagagcgcgagaacaagctcaaggagtccttagaaaaagcactaaagtacaaagaacaggtggaaaccctgtggccatggatcgacaaatgtcagaataatctggaagaaatcaaattctgccttgatcccgctgaaggggaaaacagcatcgcaaagcttaagtcgctgcaaaaggagatggaccagcatttcgggatggtcgaactactcaataataccgctaactccctgttgagtgtgtgcgaaatagataaggaagtagtaacagatgaaaacaagtctctgattcagaaggtggatatggtaacagagcaattacattccaagaaattctgtcttgaaaatatgactcaaaaatttaaggagttccaagaagtgagtaaggagtcgaagcgccaactgcagtgtgctaaggagcagctggacattcatgacagtctgggcagtcaagcctacagcaacaagtatctcaccatgctccaaacacagcagaaaagcctccaggctctgaaacaccaggtcgatctcgcgaagagactcgcacaggacttggtcgtcgaagcgagcgacagtaaagggacctcagatgtgctcttgcaggtcgagaccatcgcacaggagcattctacgctgtcccagcaggttgatgagaaatgttcgtttctggaaactaaattgcagggaataggccacttccagaacactatacgcgaaatgttttcccaatttgccgaatttgacgatgaactggacagcatggcaccagtaggacgcgacgccgagacactccagaagcaaaaggagaccattaaagcattcctgaaaaagttagaagcacttatggcctccaatgataatgccaataaaacctgtaaaatgatgcttgccacagaagaaaccagtcctgatctggtggggattaaacgcgatttagaagcactgtcgaagcagtgcaacaagctcctcgacagggcccaggctagggaggaacaggtagaaggtacaatcaagaggcttgaggagttttactccaagctgaaggagttctccatcctcctccagaaggcggaggaacatgaggagagtcagggccctgttggtatggagacagagactatcaaccaacaattgaacatgtttaaagtgttccaaaaagaagaaatcgagcctctacaaggaaagcagcaggacgttaactggcttggccaaggcctgatacaatccgcagcaaaatctaccagcactcaggggctggagcacgatctcgatgacgtaaacgctcgatggaaaaccttaaacaagaaggtagctcagcgcgctgctcagctgcaggaagcgcttcttcactgcggacgattccaggatgccttagaatcactcttatcgtggatggttgacacagaggagctggtggccaatcagaaaccccctagtgcagagtttaaagttgtcaaagcacagattcaggaacagaaactgctgcagagacttctggatgaccggaagtctaccgtcgaagtgataaaacgcgagggggaaaaaatcgctacaaccgcagagccggctgataaagtcaagatcctcaagcaactttctcttctcgattccagatgggaggctctactgaacaaagctgaaactcgcaacaggcagttagaaggaatcagcgtcgtcgcccagcagttccatgaaaccctggagcctttgaatgagtggttgaccacgatcgagaagcgcctagtaaactgtgagcccattggcacacaggcttctaagctggaggagcagattgcacaacacaaagccttagaggatgacatcataaaccacaacaagcacttacatcaggccgtctcaataggacagtcacttaaggtactctcttctagggaagacaaagatatggtgcagagcaagctggatttttctcaagtctggtacattgagattcaggagaagagccatagcagatccgagctcctccaacaggcactgtgcaacgctaagatattcggtgaggatgaagtagagctgatgaattggttgaatgaggtccacgataagctctcaaagctcagtgttcaggactacagtacagaaggcttgtggaagcagcaatccgaattacgtgttctccaagaggacatcctgttgcgcaagcaaaacgtggaccaggctttgctcaacgggctggagttattgaaacagaccactggagacgaggtactcataattcaggacaagctcgaggccattaaggccagatacaaggatattaccaagctcagcactgatgtagccaaaaccctggaacaggccctgcagcttgctcggagactccattccacacacgaggagttgtgcacatggcttgataaggtggaggtggaactcctctcctatgaaactcaggtcctgaaaggggaagaagcgagtcaagctcaaatgaggcccaaagagctgaagaaggaggccaagaacaacaaggcactacttgatagtctcaacgaagtcagttccgcgcttctcgagttggtgccttggcgtgcccgagaagggctcgaaaagatggtggcggaggacaatgaaaggtatcgtcttgtgtctgatactattactcagaaggtggaagagatcgatgcagcaatcctccgctcacaacagttcgaccaggctgctgacgcagagctcagctggataactgagaccgaaaaaaaacttatgagcctgggagatattagactagagcaggatcaaacatcggcccagttgcaagtgcagaagacattcacaatggaaattctcagacacaaagacattatcgatgatctggtgaaatcaggtcataagatcatgacagcctgctctgaagaagagaaacagtccatgaaaaagaagctagacaaggtactcaaaaactatgataccatctgtcagattaacagcgagagatatcttcaacttgaaagggcacaatctttggtaaaccagttttgggagacatacgaggagttatggccttggctcactgaaactcagagcatcattagccagctccctgcaccagccctcgaatatgaaacgctgagacagcagcaggaagagcacagacagctccgagaactaattgcagaacataaaccacacattgataaaatgaacaagacgggacctcaactgctagagctgagtccaggcgagggattttccatccaagagaaatatgtcgctgccgatacactctactcccaaatcaaagaggatgtaaagaagcgagcggtcgcacttgacgaagctatctcccaaagtacacagttccatgacaaaatagatcagatactcgaaagcttagaacgaatcgtagagcgtttgcgacagcccccatccatcagtgctgaggtagaaaagatcaaggagcaaatctccgagaataagaatgttagtgtggacatggagaaactgcaaccgctgtatgaaacattaaaacaacggggtgaagagatgattgctcggagtggaggaacagacaaagatatcagcgctaaagcagtgcaagataaacttgatcaaatggtgtttatctgggagaatattcacactctggtggaggagcgcgaggccaaactactggacgtcatggagctagctgagaaattttggtgcgaccacatgagtcttattgtaaccatcaaagatactcaggacttcatcagagacttggaggaccccggaatagaccctagtgtggtaaaacagcagcaggaggccgctgaaacgattagggaggagatcgatgggctgcaggaggagctcgatatcgtaatcaatcttggtagtgaactgattgctgcttgcggtgagcccgacaagcctatagtcaagaaatcaattgacgagctcaacagtgcctgggattctcttaataaggcatggaaggacaggatagataagctggaggaggccatgcaagctgctgtgcaataccaggatgggctgcaggccgtcttcgactgggtggacattgcgggtggcaaattggcgagtatgtccccgattggaacagatcttgagactgtgaagcagcagatagaagaactcaaacaattcaagtccgaggcctaccagcaacagatcgaaatggagaggttaaatcaccaggccgagttgctcttaaagaaggtgaccgaagaaagcgataagcacactgtgcaggacccgctgatggagctaaaactcatttgggacagcctggaggagcgcatcatcaaccggcaacataagctggagggggcactgctcgctttggggcagtttcagcacgcgttggatgaactgctagcatggctgactcacactgaaggtctcctctctgaacagaagcccgtggggggagaccctaaggccattgaaatcgaactcgccaagcaccacgtgcttcaaaacgacgtcctcgcccatcaatctacagtcgaagctgtgaataaagctgggaacgatctgatcgaaagcagcgctggagaagaagcaagtaatctgcagaataagttggaggtcctaaatcaacgctggcagaatgtgttggagaaaacggagcagagaaaacagcagctggacggcgctttgcgccaggctaaaggcttccacggggagattgaggacctgcaacagtggttgacagatactgagcggcatctcttagcaagtaagcccctcggtggtctgcccgagaccgctaaagagcagctgaacgtccatatggaagtgtgcgcagccttcgaggccaaggaagagacctataagagtctgatgcagaaggggcaacaaatgcttgctcgttgccctaagtccgccgagactaacatcgaccaagatatcaacaatctcaaagagaaatgggagagcgtggagacgaagttgaacgagcgcaaaacgaaattggaggaggctttgaaccttgcaatggagttccacaattccttgcaggactttatcaattggctgactcaagccgagcaaacccttaacgttgcgagtcggccttccctgatacttgatacagttctgtttcagattgacgaacacaaagttttcgctaacgaggtgaatagccatagagaacaaatcattgagctcgataaaaccggaacacaccttaagtattttagtcagaagcaggacgtggtccttataaaaaaccttctgatctcagtgcaaagtcggtgggaaaaagtggtgcaacgcctggtggaaaggggaagatctctggacgacgccaggaaacgggctaaacaatttcacgaagcctggtcgaaattaatggagtggctggaagagagcgagaagagcttagattcggaattggagattgcaaacgatccggataaaatcaaaactcagctggcccagcacaaggagtttcagaaaagcttgggcgctaagcattctgtgtacgacaccaccaatcgcactgggaggagcctgaaggagaagacatctttagcggacgataatttaaaactcgatgacatgctctccgagttgagggacaaatgggacaccatatgtgggaaatctgtggaacggcagaataagttggaggaggccttgctgttttctggacaattcacagatgcactgcaagccctgattgactggctataccgtgttgaacctcagctagcggaggaccaacccgtccacggcgacatcgatctggtgatgaatctgatcgataaccacaaggcctttcagaaagaattgggcaaaaggacatcctccgtgcaggctctcaagcgctcggctcgcgaactgatcgaaggctccagggatgactcgagttgggtgaaggtgcagatgcaagaactgtcaacaaggtgggagactgtgtgtgccctttctatctctaaacagacccgcctggaggcagccctccggcaggccgaggagtttcacagtgtcgtgcacgctctgctggagtggctcgctgaggccgaacagacattacgatttcatggcgtgcttcccgacgacgaagatgccttacgcactctcatcgaccagcacaaggagttcatgaagaagcttgaggagaaacgtgccgagctaaacaaggccaccacgatgggtgatactgttctggcaatttgtcaccccgatagtatcaccactatcaagcactggattactatcattcgagcgcgatttgaagaggtgttagcttgggcaaagcagcaccagcagcgcctcgcctctgcccttgcgggtttaatcgccaagcaggaattgctggaggcgctgctggcctggcttcagtgggcagagactacactaactgataaggacaaagaagtcatcccacaggagatcgaggaggtgaaagcattgatagctgaacatcaaacattcatggaagagatgactcggaagcagccagacgtcgacaaagtgaccaaaacatataaacgacgggcagctgaccccagttcacttcagtcccatatacctgttcttgacaaagggagggccggacgtaagcggtttccagccagttcattgtaccccagcggtagccagacacagatcgaaaccaaaaatcccagagtgaatctgctggtgtctaaatggcagcaggtgtggcttctggcgctcgaaaggcggcgaaagctgaatgatgccctggaccgcctggaagagctgagggaattcgccaattttgatttcgatatctggaggaagaaatacatgcgatggatgaaccacaaaaagagtcgcgtgatggactttttcagaaggatagataaggatcaagatggaaagattacccggcaggagtttatcgacgggatcttgtccagcaagtttccaactagcagactcgaaatgtccgctgtcgctgatatcttcgatagggacggcgacggctacattgattattatgaatttgtcgctgcgctgcaccctaataaggacgcttacaaacccattaccgatgccgacaaaattgaggacgaggtgaccaggcaggtagccaagtgcaagtgcgccaagagattccaagtcgagcagattggagataataagtatcgtgtatctttccagtccaactttggcgactctcaacagctgcgcttggtccgcattctaaggtcaactgtgatggtgagagtgggaggcggatggatggccctggacgaatttctggtcaagaatgacccctgtcgtgtgcaccatcatgggagcaagatgctgagaagtgagtccaattccagcatcacaacaacacagccaacaattgcaaaaggcagaaccaatatggagctgcgcgagaagttcatactggcggatggggctagccagggcatggctgccttccgacctcggggacgcaggtcacggccatcctcccggggagcaagccccaatcgttccacatccgttagctctcaggcagcacaggccgcatcgccgcaggtgcccgctactaccaccccaaaggggactcccatacagggctccaagctgcgcctgcccggttatctcagtggtaaaggctttcactcaggcgaggattcaggcctcattacaactgcggcagcgagggtgagaacccagtttgccgactccaaaaagactccatcaaggcctggcagtagagcaggtagcaaggctggctcaagagcttcttctaggcggggttccgacgcgtcggatttcgatatcagcgagatacagtccgtctgtagtgacgtcgagacggtgccacagacccacaggcctacaccacgagcgggttcaaggccttctaccgccaaaccctctaaaatccccactcctcagaggaagagccctgcgagcaaattggacaagagcagcaaaaggtag

SEQ ID NO: 221511 - DNA, 7949 bp, Artificial Sequence
  Description of Artificial Sequence: Synthetic coding sequence
atgcattcctctagttactcgtatagaagctccgactccgtgtttagcaataccaccagcactcggaccagtcttgattctaacgaaaacctgcttctggttcactgcggacctaccctaatcaacagctgtatctcatttggcagcgaatcttttgatggccacaggctggagatgcttcagcagatagctaaccgggtgcagcgggatagtgtgatctgcgaagacaagttgatcctcgctggaaacgccttacagtcagatagtaaaaggctggaatctggcgtgcagttccagaacgaggcagagattgcgggatatatcctggaatgcgagaatttactgagacagcatgtcattgatgtgcagatactcattgatggcaaatattatcaggccgaccaactggtccagcgagtggccaagctgcgagatgagattatggctctgaggaatgagtgttcttctgtctacagcaagggccgaattctgaccaccgagcaaaccaagctcatgattagcggtatcacccagtccctgaactcagggttcgcccagactctgcatccatccctaactagcggattgacccaatcattgaccccatccttgacaagcagtagcatgacctcgggcctgtcctcgggaatgacgtcccgtctgaccccgtctgtcacacctgcttacacaccaggattcccatccggtctcgtacctaatttcagctccggcgtggagcccaactcgctgcagacactgaagctcatgcagatacgtaagccactgttaaagtctagcttgttagaccagaacttgactgaggaagaaattaacatgaaatttgtccaggatctattaaactgggtcgacgagatgcaggttcaattggaccgaaccgagtgggggagcgatctgccctccgtggaaagtcacctggagaaccataaaaatgtccatcgcgcaatcgaggaatttgagtcatcactgaaggaagccaagatttccgaaattcaaatgacagctcccctcaaattaacgtacgccgagaagttacatcggctggaaagccagtatgctaaattacttaacacctccaggaatcaagaaaggcacctggacacactgcataacttcgtctcacgggcaactaatgagctgatatggttaaatgaaaaggaagaggaagaggtagcttacgactggagtgagagaaacaccaacattgctcgtaagaaggactaccacgcggaactcatgagggagcttgaccagaaggaggagaacatcaagtctgtgcaggaaatcgcggaacagctgctcttagagaatcaccctgctcggctgaccattgaagcatacagggctgccatgcagacccagtggtcatggatacttcagttgtgccagtgcgtggaacaacatatcaaagaaaacacagcctactttgagttcttcaatgatgccaaggaggctacggactacttgcgaaatctgaaagatgccatccagaggaagtacagctgcgataggagttcaagcatccacaagctggaagacttggtgcaggagagcatggaagagaaagaggaattgttgcagtataaatctacaattgccaacctcatgggcaaagcaaagactattatacagttaaaaccccgaaactctgactgccccctaaaaactagtattcccatcaaggccatctgtgactataggcagattgaaatcactatttacaaggacgacgaatgcgttttagcgaataattcacaccgagccaagtggaaggtaatcagtcctaccggcaacgaagccatggttccttctgtttgcttcaccgtgccacccccaaacaaggaagcggtggacctcgcaaacagaattgaacagcagtatcagaacgtcttgacgctttggcacgaatcccacatcaatatgaagtccgtagtcagttggcactatcttatcaatgaaatcgacaggataagggcctcgaatgtggcctccattaaaaccatgctcccaggagagcaccaacaagtgttgtctaatctgcagtcgcggtttgaggattttctcgaagactcccaggagtctcaagtgttttccgggagcgatatcacccagctggagaaggaggtgaatgtttgcaagcaatactatcaggagctgctgaaaagtgccgagcgggaagaacaggaagagtccgtctacaatctgtatatcagtgaagttcggaacattcgcctgagactggaaaactgtgaggacagactaattcgccagatccggactccactggagcgcgatgatttgcacgagtcagtgttcaggataacggagcaggaaaaactgaagaaggaactggagcgactgaaggatgatctcggcacgattacaaataagtgcgaggaattcttctcccaggccgcagcaagcagttccgtgccgaccctaagaagcgagctgaatgtggtgttgcagaatatgaaccaggtctacagcatgtcatcaacttacatagacaagctaaaaacagttaacctcgtgctcaagaatactcaggcggctgaagcgctcgttaagttgtacgagacaaagctctgtgaggaggaagccgttatcgctgataaaaacaatatcgagaatctgatcagtactttgaagcagtggcggtcagaggtggacgaaaaacgtcaggtcttccacgccttggaggacgagcttcagaaggccaaggccatcagtgacgaaatgtttaaaacctacaaagagcgagacctggatttcgattggcataaagagaaggctgatcaactcgtggagaggtggcagaacgttcatgttcagatcgacaatcggcttagagatctcgagggaattggcaagagcctgaagtattatagagacacatatcatcccctggatgactggattcagcaggtggagactactcaacgcaaaatccaagaaaatcaacccgagaattcaaagacacttgccacacagctcaaccagcagaaaatgctcgtcagcgagatcgagatgaagcaaagcaagatggacgagtgtcagaaatatgccgaacagtacagtgccacagttaaggattacgagcttcagactatgacctacagagctatggtcgacagccagcaaaaaagtccagtgaagagacggcgaatgcaatcgtccgcggatttgattatccaggagtttatggacctccggaccagatatactgccctcgtgactctaatgacacagtacatcaagtttgcgggagattcgttaaaacgtcttgaggaggaagaaatcaaaagatgtaaggagaccagcgagcacggtgcctatagcgacctcctccagcgccagaaggctactgtactggagaactccaaacttactggtaaaatcagtgaactcgagcggatggtggccgaacttaaaaaacagaagtcccgggtggaagaagagttgcctaaggtgagagaagcggcagagaatgagcttcgaaagcagcagaggaacgtggaggacatctcgctgcagaagataagggcagagtccgaagccaagcagtacaggcgggagttagagaccatcgtgcgggaaaaggaggctgccgagcgggagcttgagagggtgaggcaactgactattgaagctgaagctaagcgcgctgctgtcgaggaaaacttacttaatttcagaaaccaattggaggagaacactttcacccggcgtactttagaagatcatttaaaacggaaagacttatcattgaatgacttagagcagcagaaaaataaattgatggaagaactgcgcaggaagagagacaacgaagaagaactcctgaagctcattaaacagatggaaaaagaccttgctttccaaaagcaagtggcagagaagcagctgaaggaaaaacagaagattgagctcgaggcgagaaggaaaataactgaaattcagtatacctgcagagaaaatgctttacctgtgtgccccattacacaggctacgagctgcagggctgtaacaggccttcaacaggagcacgataaacagaaggccgaggagctgaagcaacaagtggacgagttgaccgcagcaaatagaaaggccgaacaggatatgcgcgagctgacctatgagttaaacgcactacagctggagaaaaccagttcggaagagaaggccagactgcttaaggataaactggatgagactaataacactctgcggtgcttaaagctggaactagagcgcaaagaccaggcggagaaaggttattcacaacagctgcgcgagcttggtcgccaacttaatcagacaacgggaaaagcagaagaggcgatgcaagaagcaagcgacctaaagaagatcaaaaggaattaccaactggaactggagtcactcaaccatgaaaagggcaaactgcagagggaagtagataggataaccagagcacatgcggtcgcagaaaaaaacatccagcatctgaacagtcagatccactccttcagggacgagaaggaattggagcgacttcagatatgtcagcgaaaaagcgaccatttgaaagaacaattcgaaaaatctcacgagcagctactgcagaatatcaaggctgagaaagagaacaacgataagatccagaggcttaatgaggagcttgaaaaaagtaacgagtgcgccgaaatgttgaaacagaaagtggaggaactaacacgccagaataacgagacaaaactgatgatgcagcgcattcaggcggagagtgagaatatcgttctggagaaacagacaatccagcaacgttgtgaagctctcaagatacaggctgacgggtttaaggatcagctgaggtctaccaatgaacatctgcacaaacaaactaaaactgagcaggattttcagcgtaagattaagtgcctggaagaagacttagctaaaagtcaaaatttggttagcgaattcaaacagaagtgcgatcaacagaacatcattattcagaacacgaaaaaggaggtgagaaatctgaacgcggaactgaacgcttccaaggaagaaaaacgacgaggcgagcagaaggtgcagcttcagcaagcacaggtgcaggagctgaataaccggctgaagaaagtgcaggacgagctgcatctaaaaactatagaggagcagatgacgcatagaaaaatggtgctgttccaggaagagagcggtaaattcaagcagtcggctgaagagtttcgcaagaaaatggagaaactcatggagtctaaagtaataaccgagaatgatatctcggggattcgcctggattttgtgagcttacaacaggagaattcgcgcgctcaagagaacgccaagctatgcgaaaccaacattaaggagctggaacgccaactgcagcaataccgcgaacagatgcaacaggggcagcacatggaggctaaccattatcagaagtgccaaaagttggaagacgagctcatagcacagaaacgcgaggttgagaacttgaaacagaagatggaccaacagattaaagaacacgagcaccaactggtcctactgcaatgtgaaatccagaagaaaagcaccgccaaagactgtacttttaagcccgattttgagatgaccgtgaaagagtgtcagcacagcggggagctctctagccgaaatactggccaccttcacccaacccccaggtctcctctcttacgctggacccaggagcctcagccactcgaagaaaagtggcaacatagagtggttgaacagattccaaaagaggtgcagttccagccgccaggcgctccactggagaaggagaaatcgcaacagtgctacagtgaatactttagtcaaacatcgacggagctgcagatcaccttcgatgagacaaatcctattaccagactgtccgagatagagaagatccgggatcaggcattgaataactctaggcccccagtgcgctatcaggataacgcttgtgaaatggagctggtaaaagtattgaccccgctggagatagccaagaacaagcagtatgatatgcatactgaggtcacaaccctaaagcaagaaaaaaaccccgtgccaagcgcagaggagtggatgttagaaggctgcagagcctctggcggactcaaaaagggcgactttctaaaaaaaggactagagcccgaaacctttcaaaattttgacggagaccacgcttgcagcgtgagggacgacgagtttaagttccagggtctccggcatactgtgactgcgcgacaacttgttgaagcgaagttgctggatatgcgcactattgagcagctgcgattggggctgaagacagtcgaggaggtccaaaagacgctgaataagttcctcaccaaagcaacaagcattgcgggtctatacctggagagcacgaaagaaaaaatttccttcgcaagtgccgctgagaggatcataatcgataaaatggtagctcttgctttcttggaagctcaggctgccacaggattcatcatcgatccaatctctggacagacatatagcgtggaagacgccgttttaaagggtgtggttgaccccgaattcagaattcggctcttggaggctgagaaagccgctgtcgggtattcatactcatctaagaccctatcagtctttcaagctatggagaaccggatgctggacaggcagaaaggtaaacacatcttagaggcccagatcgcctcaggaggggtgatagatccagtgcgaggcattagagtgccccctgagatcgccttgcagcaaggtctgttgaataatgctatcctccaattcctgcatgaaccaagctctaatactagggtatttcccaaccctaataacaaacaagcattgtactattcagaactcctccgaatgtgtgtcttcgacgtggagagccaatgttttctatttcctttcggcgaacgtaatatctccaacctcaatgttaagaagacccaccgtatttcggtcgtggataccaagaccggatcagagctcactgtgtatgaggcctttcagcgcaaccttattgagaaatctatttacctcgaactgtctgggcaacagtatcagtggaaggaagccatgttctttgagtcttatggccatagcagccacatgctgacggacacaaaaacgggtttgcactttaacataaacgaagcaatcgaacagggaacgatcgacaaggcactggtgaagaagtatcaggaaggccttatcacgctgaccgaattggccgacagcctgctgtctaggctcgttcccaagaaggatctgcattccccagtggcgggatattggttgacagcttcaggtgagaggatcagcgttctgaaggcctccagacgcaaccttgttgacagaatcacagcgcttcggtgcctggaggcccaggtgtccacgggcggtattattgatcctcttactggcaagaaataccgagtagctgaggcactgcataggggactagttgatgagggcttcgcacaacagctgaggcagtgcgagcttgtaattaccggtattggccacccgatcactaataagatgatgagcgtagttgaggcagttaatgcaaacatcatcaacaaagaaatggggatcagatgtctggagttccagtatttaaccggtggtcttatcgagcctcaggtgcattcaaggctgtccatagaggaggcacttcaggtgggtatcattgatgtcctgatcgcaactaagctcaaagaccaaaagtcatatgtacggaatattatttgtccccagaccaagcggaaactgacgtacaaagaggctctggagaaagctgacttcgatttccacacgggcctcaagttattggaggtaagcgaaccactgatgaccggcataagttcactctattactcctctta

SEQ ID NO: 221512 - DNA, 22719 bp, Artificial Sequence
  Description of Artificial Sequence: Synthetic coding sequence
atggccggatatctttcaccagcggcatacctgtacgtcgaggaacaggagtacctccaagcatacgaggacgtgcttgagagatataaggatgagagagacaaagtgcagaagaaaactttcacgaaatggatcaaccaacacctgatgaaggtaagaaaacatgtgaatgatctgtacgaggatctcagggatggacacaatttaatcagcctgctggaagtgctgtcaggagataccctgccccgagagaagggtaggatgcgcttccatcgcctgcaaaacgtgcagattgccttagactacttgaagaggaggcaggtcaaactggtgaatatcagaaatgacgatattaccgatgggaacccgaagctcaccctaggactgatttggaccatcatcctgcactttcagattagtgatatacacgtgacaggcgagtccgaagatatgtcggctaaggagcgactgctgctgtggacccagcaggcaacagagggatacgccggaatacgatgcgagaatttcactacatgttggagagacggtaaactctttaacgcgattatccataagtaccggccagatctcatcgatatgaacactgtcgcagtgcaatcaaacctcgcgaatctcgaacatgcattttatgttgccgaaaagataggagttatccgattgctggatcctgaagacgtggacgtcagctctcccgacgagaagtcagtgataacatatgtatcatccctgtacgatgcttttccaaaggtgcccgaagggggtgagggcataggcgctaatgatgtcgaggtgaagtggatcgagtaccagaatatggtgaactatctgatccagtggatccgccaccacgtgacaacaatgtcagagcggacattccctaataaccccgtcgaacttaaagccctgtacaaccaatatctccagttcaaggagactgagatccccccaaaagagacagagaaatcaaaaatcaagcgactgtataaactgctggaaatatggatagagttcggtagaatcaaattactgcagggctaccaccccaatgatattgaaaaggagtgggggaaactgattattgctatgctagaacgggagaaggccctcaggcccgaagtggaacgccttgagatgctgcaacagattgcaaaccgtgtccagagagactcagtcatctgcgaagataagctcatcctggctgggaatgctctccagtccgattcaaagcggctagagtccggagtacagttccagaacgaagccgagatcgccggatatatcctggaatgtgagaatctgcttagacagcacgtcattgatgtccaaatcctgattgatggaaaatactaccaagctgatcaactagtacaacgcgtcgccaaactgcgcgacgaaataatggcgctccgaaacgagtgttcctcagtttacagtaagggacggattctaactaccgagcagactaagcttatgatcagcggaattactcagtctctgaactccggcttcgcccaaaccctgcacccgagcctgacttccggcctgacacagagcctgacaccaagcctgacctccagctctatgacgtccggattaagtagcggaatgacatctcgccttactccctccgtcaccccagcttacacacccggttttccctctggtctggtgcccaacttttctagtggggttgaaccgaatagcctacagacattaaaattaatgcagattcgcaagcccctgctgaaaagttctctgctggaccagaatctgacggaggaagagattaacatgaaattcgtgcaggacttgttgaattgggtcgacgaaatgcaggttcagctcgatagaacagaatgggggtcagacctcccctcagtggagtcccatctcgaaaatcacaagaacgtgcaccgcgctatagaagaattcgaaagcagcctcaaagaagccaagattagcgagatacagatgaccgcccctctgaagctcacttatgcagagaagctgcatagacttgaatcccagtacgccaaactgctcaataccagtagaaatcaggaacggcatctcgacactctgcacaacttcgtgagtcgcgcaacgaatgaattaatctggctcaatgaaaaggaagaggaggaggtagcatacgattggtctgagaggaacacgaacatcgctcgcaaaaaagactatcacgcggaactgatgagggagctggatcagaaagaagaaaatataaaaagtgtgcaggagatcgccgagcagctcttattggaaaatcacccagccagactgacaattgaggcctacagggctgccatgcagacccagtggtcttggattctgcagttatgtcaatgcgttgagcagcacatcaaagaaaacaccgcctatttcgagttcttcaatgatgctaaggaggccacggattaccttagaaacctgaaggacgccatccagcgcaagtactcatgtgataggtcaagcagtatccacaaactggaggacctggtgcaggaatctatggaggagaaggaggagctgctgcaatacaaaagcacgattgccaatctgatgggcaaggcgaaaaccataattcagctgaagcctagaaactccgattgccctttgaaaacctccatacccatcaaagctatttgtgattacagacagatcgagataacgatttacaaggacgacgagtgtgttcttgccaacaacagtcaccgtgccaagtggaaagtgataagccccaccgggaacgaagctatggttccttcagtctgctttaccgtccccccacccaataaagaggctgtcgacctcgcgaaccgaatcgaacagcagtatcagaatgtgttaaccctgtggcacgagtcccatatcaatatgaaaagcgtcgttagctggcactaccttattaacgagatagaccgaattcgcgcaagtaatgttgcctctattaagaccatgttgccaggggagcatcagcaagtgctcagcaatcttcagagcagattcgaagattttttggaagacagccaggagtctcaggttttttcaggcagtgacattactcagctcgagaaggaagttaatgtgtgcaaacaatactatcaggaacttttaaaaagtgcagaaagagaggagcaggaagagagcgtgtacaacttgtatatttctgaagttcggaatatccgcctgaggctggagaactgcgaggatagactgataagacagattcgtacccccctcgagagggatgatttgcatgagagcgtcttccggatcaccgaacaggagaaactgaaaaaggaactcgaaagattgaaggatgatcttggaactataacaaataagtgcgaagaattcttctcgcaagctgcggcatcctcctctgtacccaccctaagatccgagcttaatgtggtgcttcagaacatgaatcaggtgtacagcatgtccagcacctacatagataaactgaaaaccgtcaacctggttctcaagaacacccaggctgcagaagccctggtaaagctatatgagactaagctgtgcgaggaggaggctgtaatcgccgataagaacaatatcgaaaatttgattagcaccttaaaacagtggcggtccgaagtcgatgagaagcggcaggtgtttcacgcattggaggatgagttacaaaaggctaaggcaattagtgatgaaatgtttaagacttacaaagagagagaccttgattttgactggcacaaagagaaagccgatcagctcgttgaacgatggcagaatgtgcatgtccagattgacaacaggcttagagatctcgaagggatcgggaagtctttgaagtattacagggatacataccaccctctggatgattggattcagcaggtggagacgacccagcgcaagattcaggaaaatcagcctgagaactctaagacgctggccacccaactgaaccagcaaaaaatgcttgtcagcgaaattgagatgaaacagtccaagatggatgagtgtcagaagtatgctgagcagtacagtgccactgtgaaggactacgaacttcagacaatgacctaccgcgctatggtagactcacagcagaagagtccggtgaagcgtaggcggatgcagtcaagcgcagatttgattattcaggaatttatggacctgcggactcgatacaccgccttagtgacgctgatgactcagtacatcaagttcgccggagacagccttaaaaggctggaggaagaagagaagagcttagaagaggagaagaaagagcacgtggaaaaagccaaggaactgcagaaatgggtctcaaacatctccaaaactctgaaagacgccgagaaagcgggaaagccgccatttagtaagcagaagattagcagcgaggagatcagtaccaagaaggagcagctctccgaggcacttcagacaatacaactgttcctggctaagcacggagacaaaatgaccgacgaggagcggaacgagttagagaagcaggttaaaactctccaggagtcatataatctgcttttctcagaatccttgaaacagcttcaggagtctcaaactagcggcgacgtgaaagtcgaagaaaaactcgacaaggtcattgctggcacgattgaccagactacgggcgaggtgctatccgtgttccaggccgttctgaggggcctgattgattacgatacagggattagactgcttgagacacaattaatgatctctggcctcatttctccagagctgcgcaaatgttttgatttgaaggatgcaaaatctcatggtctgatcgatgagcagattctctgtcaactgaaggagctcagcaaagccaaagaaatcataagcgccgcttcacccactacaatacccgtcctggacgccctagctcagagcatgatcaccgaatcaatggctattaaggtgctcgaaatcctcctgtcaacaggcagcttggtgatcccagcgactggggagcagctgaccctccagaaagcctttcagcagaacctcgtcagctccgcactcttcagtaaggtgctggagaggcagaatatgtgcaaagatttaatagacccgtgcacgtccgaaaaggttagcttaatagatatggtgcagaggtccacactccaagaaaatactggaatgtggctgctcccagtccgtccccaagagggcggtaggattaccctcaaatgtggtcggaatataagcattctgagagctgcccacgaggggctcatcgaccgggagaccatgtttcggctgctttctgctcaactgctttcaggaggtctaataaactcaaacagcggccagaggatgactgtggaggaggctgtgagagaaggagttatcgatagggataccgcttcttccatactcacttaccaggtacaaacaggtggaataattcagagtaatcccgctaaacgcctgaccgttgatgaggccgtgcagtgcgatttaatcacttcctcttctgcattgcttgttctggaagcccagagagggtacgtgggcctgatctggcctcactcaggcgaaattttccctacaagttccagtttacaacaagagcttataacgaacgagctggcgtacaagattttaaatggcagacagaagattgcggcactgtatatacctgagtccagccaggtgatcggcctggacgccgcaaaacagctcggaattattgacaataatactgcgagcatcctcaaaaatattaccctcccggataagatgccagaccttggcgatctcgaggcttgtaaaaatgcgcgtcggtggcttagcttctgtaagtttcagcctagtacggtccacgattaccggcaggaggaagatgttttcgatggcgaggagcctgtgaccacccagacctccgaagaaactaaaaagttattcctgtcataccttatgattaatagctacatggacgccaacacaggccagcgtctcttattgtacgatggagacctcgatgaggctgtggggatgctcctggagggatgccatgcagagttcgatggtaacacagcgatcaaagagtgtctagatgtgctaagttcttcgggggtttttctaaataacgcttcgggcagagagaaggacgagtgtactgctacacctagcagcttcaacaagtgtcactgtggcgagcccgaacacgaggaaacacccgagaatcgaaagtgcgccatcgacgaggagttcaacgagatgcgcaacacggtcatcaattctgaattttctcaatcgggaaagctggcaagtacaattagtatcgaccctaaagttaactctagtccttccgtctgtgtgccgtctctgatttcctacctgacacagactgagctggccgatatatccatgttgcggtccgatagcgaaaatattctgacaaattacgaaaaccagtcacgggttgaaactaacgaacgggctaatgagtgctctcattcaaaaaacatacagaatttcccttctgacctcatcgaaaacccgattatgaaaagtaaaatgtcaaagttttgcggcgttaatgagaccgagaacgaggacaataccaatcgggacagcccaatatttgactattcacccaggctgtccgcgcttctaagccacgataagctgatgcactcacaaggaagctttaacgacactcacacacccgaatctaatggaaacaaatgcgaggcaccggcactatcgtttagcgataaaacaatgctgtctgggcaaagaattggcgaaaagttccaggatcaatttctggggattgccgctataaacatcagtcttcccggtgagcaatatgggcagaagagtctgaatatgattagtagcaatcctcaggtccagtatcacaacgataaatacatcagtaatacatccggagaagatgaaaaaacccatccaggtttccaacagatgcccgaagacaaggaggatgagtccgagatcgaagaatacagctgcgctgtgacacctggcggagataccgataacgccattgtatccttaacttgtgctactcccctcctagacgaaacgatctcagcaagtgactacgagacaagccttctcaatgatcaacagaacaacaccggtacagacaccgactcagacgacgatttctacgatacgccactgtttgaagacgatgatcatgatagtctattactcgatggtgacgatagagactgcctgcaccccgaggactacgacaccctgcaggaggaaaatgatgagacagcctcgccagccgacgtattctacgatgtgagtaaagaaaacgagaacagtatggtacctcagggtgccccagtgggctcattgagtgtgaagaacaaagcgcactgcttgcaggactttttaatggacgttgaaaaggacgagctcgatagcggagagaagatacatttaaaccctgtcggcagcgacaaagtgaatggacagagtctcgagaccgggtctgaaagggaatgcaccaacattctggagggggacgagtctgattccctgactgactacgatatagtgggtggcaaagaaagcttcaccgcatcactgaagtttgatgatagcggcagctggcggggacgcaaagaggagtatgttacggggcaggaattccattctgatacggatcaccttgattcaatgcagagcgaagagtcctatggcgactacatctacgactccaatgatcaagacgatgatgatgacgatgggatcgacgaggaaggaggtggcattcgcgacgagaatggaaaacctagatgccagaatgtagcagaggatatggatatccagttgtgtgcctccatactgaacgagaacagcgatgagaacgaaaacatcaataccatgatcctgttggataagatgcactcctgttcctccctcgaaaagcagcaaagggttaatgtggtacagctcgcttcgccatccgagaacaacctcgtcactgaaaagtcaaacctgcccgaatacaccacagagatcgcgggtaagagtaaggaaaatctgctgaatcacgagatggtgttgaaagacgtcttgcctccaattattaaagatacagagtcagaaaaaaccttcggaccagcctcaatcagccacgacaacaacaacattagcagcacatccgaactgggtaccgaccttgctaacactaaagtaaagttgattcaggggtctgaactgcccgagttgactgacagcgttaagggcaaggatgaatacttcaagaacatgactcctaaggtggattcttccttggatcatattatctgcacggagccagacctgattggaaagccagcggaagagtcacacttatccttgatagcttccgttactgataaggacccacaaggtaatggttccgacctgatcaaaggcagagatggcaaatccgacatcctcatcgaagatgagacctcaattcaaaaaatgtacttaggagagggggaagtgctggtcgaggggttggtggaggaggagaatcgtcacctcaaactgctacccggaaagaacacaagggactcatttaaactgattaattcccagttcccttttcctcagatcaccaataatgaggagctgaaccagaaagggtctctcaagaaggccaccgtgacactgaaagacgagcctaataatctacagattattgtctcaaagtcccctgtgcagtttgagaatcttgaggagatttttgacacgagcgtcagcaaagaaatttctgatgacattacttcagacattaccagctgggaaggcaacacccattttgaagaatctttcaccgacggaccagagaaagaactggatctcttcacctacctcaagcactgtgctaaaaacatcaaagccaaagatgtggccaaacctaatgaggacgtgccatcacatgtattaatcacagcccctcctatgaaagaacatctgcagttaggagtcaacaatacaaaggaaaaaagtacgtctacccagaaggacagccccttaaacgacatgattcagtcaaatgacttatgcagtaaagagagcatcagcggcggagggacagagattagtcaatttactccggagtccatagaagcaacactgagcattttgtccagaaaacatgtggaggacgtaggtaagaacgatttcctacagtctgagcgctgcgcgaacgggctggggaacgacaactcgtcaaacactctaaatactgattactcctttctagagataaataacaagaaggagagaatcgagcagcagctgccaaaggaacaggctctgtctccaaggtcacaggagaaggaggtgcaaatccctgagctgtcccaggtgtttgtggaagatgtaaaggatatcctgaagagtcggctgaaagaaggccacatgaacccacaggaggtcgaagagccatcagcatgtgcggacacgaaaattctcattcaaaatctcattaaaaggataaccacctctcagcttgtgaatgaggcttccaccgtgccatccgatagtcagatgtccgattcaagtggggtttcacccatgaccaactcctctgagctcaagcccgagagtagggatgatccattttgcatcggcaacctgaagagcgagctcctcctaaatatcctgaagcaagaccaacactctcagaagatcacaggggtctttgaactgatgcgtgagctgacacacatggaatatgatctcgaaaagcggggaatcacctctaaggtgctgccactgcagttggagaacattttctacaagcttttagccgacggatattcagaaaaaatcgaacacgtgggcgatttcaaccagaaggcatgttcaacgagcgaaatgatggaggagaagccccatatccttggcgatataaagtctaaggagggaaactattattcacccaacctcgaaacagtgaaagaaattggcctggagagttctactgtgtgggcctccactctccccagggatgagaaattgaaggatttgtgcaatgacttcccctcccatctggaatgtacttctgggagcaaggagatggcatcaggcgatagctccacagagcaattctcatctgaactccagcaatgtctgcagcatactgagaaaatgcatgagtatctgactctgctgcaggatatgaaacctccactggataatcaagaatccctggataataatctggaagcccttaagaaccaattacggcaactcgagacttttgagctggggttagcccctatcgccgtgatccttaggaaagacatgaagctggccgaggaatttctcaagagcctgcctagcgacttccctaggggccacgtggaggaactcagcatatcccatcaatccttaaagacagcattcagtagccttagtaacgtgagttcagaaaggactaaacagattatgctagccatcgattctgaaatgagcaagctggctgtgagccacgaggagtttctacataagctgaagagcttcagtgactgggtgagcgagaaaagcaagtccgtgaaggacatcgagatcgtcaacgtgcaggattccgagtacgtgaaaaagcgactagagtttttaaaagccaacaatgtgctcaaagatctgggacacaccaaaatgcaacttgaaaccaccgccttcgatgtccagttctttatatccgaatacgcccaggatctctctccaaatcagagcaagcagctcctgaggctgttgaacaccactcagaagtgttttctggatgtgcaagagtcagtcactacccaggttgagaggctcgagacccagctccacttggagcaggatctggacgatcagaagattgtcgccgagcgccaacaggagtataaggaaaaattacagggcatctgcgaccttttgacgcagacagagaaccggttaatcgggcaccaggaagcatttatgattggagatggcactgtagagttgaaaaagtaccagtccaagcaggaggagctccaaaaagacatgcaaggctcggcacaggccctggctgaagtagtgaagaataccgagaattttctgaaggaaaatggggagaaactgtcacaggaggacaaagccctaatcgagcagaagctcaatgaggctaaaatcaagtgtgagcaactgaacttgaaggccgaacagtcaaaaaaggagctcgacaaagtggtgaccactgctatcaaggaggagaccgaaaaggtggcagccgtcaagcagcttgaggagagtaagacgaaaattgagaatttactggattggctctctaatgtggataaggatagtgaaagagcgggaaccaagcataaacaggtcatcgagcagaacggtactcactttcaggaaggtgatgggaagtccgcgatcggcgaggaggatgaggtgaacgggaatctgcttgagacagacgttgatggtcaagtcgggacaacccaagagaatctgaatcagcaataccagaaggtaaaggcccagcacgaaaagattatatcccagcatcaggcggtgattatcgctacccagtctgcgcaggtcctccttgagaagcagggccagtacttaagccctgaggaaaaagagaaacttcagaaaaacatgaaggagttgaaagttcactatgagaccgcgttggcggagtcggaaaagaagatgaagctgacgcactctctacaagaggaactggaaaagttcgacgcggactacacagagttcgagcactggctgcagcagagcgaacaggagcttgagaatttagaggctggagccgacgatatcaacggtctcatgaccaagctcaaaaggcagaagtccttcagcgaagacgtcatctctcacaagggcgatctgcgctatattaccatttctggaaatagggtgctcgaggccgctaagtcgtgttcaaaacgcgatggaggtaaagtagacactagcgcaacacacagggaggtccagaggaagctggatcacgcaacggacaggtttagaagtctatacagcaaatgtaatgtgctcggaaataacctgaaggatctcgtagacaaataccaacattacgaggatgcgagttgcgggttgttggccggtctacaagcgtgcgaagcgactgcatccaagcatctgagcgaacctatagcagtggatcccaaaaacctgcaacggcaattagaagaaactaaggccttgcagggacaaatctcgagccagcaagtagcagttgaaaaattaaaaaaaacagccgaggtcctgctcgacgccaggggtagcctgttaccagccaaaaacgatatccaaaagactttggatgacattgtcggtcggtacgaagatctgtctaagagtgttaatgaacgcaacgagaaacttcagataaccctcacgaggagcctcagcgtccaggacggcctcgatgagatgcttgattggatgggcaacgtggaatctagtctcaaggagcagggacaggtgccactcaactccacagccttgcaggatatcatatcgaagaacatcatgcttgaacaggacatagccggtaggcaatccagtatcaatgcaatgaacgagaaagtcaaaaagttcatggagactacagacccatctacagcctccagccttcaggcaaagatgaaggatttgtccgctaggttttcagaggcttctcacaagcataaagaaacgttggcgaagatggaggaattaaaaacaaaagttgaactctttgaaaacctgtctgaaaagttgcagacatttctggaaacaaaaacccaggcgctgaccgaagtagatgtgcccggaaaggacgtaacagagctctctcagtacatgcaggagagcacttcagagttcttagagcacaagaaacacctggaagttctgcacagcctgctcaaggagataagcagtcacggcttacccagcgacaaggccttggttctagagaagaccaacaaccttagtaaaaagtttaaggagatggaagacactatcaaggagaagaaggaagctgtcacaagttgtcaggaacaacttgacgcgttccaggtgctagtcaagtcgctcaaaagttggatcaaggagacgacgaagaaggtgccaattgtccagcccagcttcggcgctgaggatctgggcaaatccctggaggacacaaagaaactgcaggaaaagtggtcactgaagacacccgaaatacagaaggtgaacaactccggaatctccctctgtaacttgattagtgccgtcaccaccccagcaaaggccatcgcggctgtgaagagcggaggagccgtcttgaacggcgaggggacagcaaccaacactgaagagttttgggcaaacaagggccttacctctatcaagaaagatatgactgatatttcccatggctatgaggatctcgggctgctgctcaaagataagattgctgaacttaacacaaagctgtccaaactgcagaaggcccaagaggagtcctccgccatgatgcagtggctgcagaaaatgaacaaaacagccactaagtggcaacagacccctgcacctacggacaccgaagccgtgaagacacaggtggagcagaacaagagcttcgaggcagagctgaaacagaatgtgaacaaggtgcaggaactcaaagacaagttgacagaactattagaagagaaccccgatacccccgaggccccacggtggaaacagatgttgaccgaaattgattcaaagtggcaggagttgaaccaattgaccatcgatcgacagcaaaagttggaggagagttctaacaacctcactcaatttcagacggtcgaggcacagctgaaacagtggttagtcgagaaagagctaatggtcagcgtgcttggccctctaagtattgaccctaatatgcttaacacccaacggcagcaggtgcagattctgcttcaagagtttgccacaaggaagccccagtacgaacaattgactgcagccggacagggcatattatcaagaccgggtgaggatcctagtctgcggggaatcgtgaaagagcagcttgccgctgttacgcagaagtgggattccctgaccggacagttgtcagacagatgtgactggattgatcaagctatcgtcaaaagcacccagtaccagtcactgctccgttcactgtccgataagctaagtgacctggataataagctttccagcagcctggccgtgtccactcacccagacgctatgaatcagcagcttgaaaccgcacagaaaatgaagcaggaaattcaacaggagaaaaagcagattaaagtggcccaagccctctgtgaagatctgtccgcacttgtgaaagaggagtacttgaaggcagaactgtcacggcagctggaggggatactgaagagttttaaggatgtggagcagaaggcagaaaatcacgtgcaacacttacaaagtgcatgtgccagctcacaccaattccaacagatgtctcgtgattttcaggcatggctagatacaaaaaaagaggagcagaacaaatctcatccaatatcagccaagttagacgttctagagagtctcataaaagatcataaggacttctctaagactcttaccgcccagtcacacatgtacgagaagaccatagctgagggagagaacctgctgctcaaaacgcaaggaagcgagaaagcagcactccaactccagctgaatactatcaaaaccaactgggatacgtttaacaaacaggtgaaggagcgggagaacaagctcaaggagtcgctggagaaagcgctcaaatacaaagaacaggtagaaaccctctggccctggattgacaagtgccaaaataatctcgaggaaatcaagttttgtctggacccagccgagggggaaaactccatagcaaaactgaaatctctgcagaaggaaatggaccagcattttggcatggtggagcttctgaacaataccgcaaacagcctgttgtcagtttgcgagattgacaaagaggttgtgacggacgaaaacaagtctcttatccagaaggtggatatggtgaccgaacagctgcacagcaaaaagttttgtttagaaaatatgacccagaaattcaaggaatttcaggaggtatcaaaagaatccaagcggcagttgcagtgcgcaaaggagcagttggatatccacgattctctaggatcacaggcgtattctaataaatatttaaccatgctccagacccagcagaaatctctccaagcattaaagcaccaggtggacctggcaaagagactggctcaggaccttgtggtagaagccagcgacagcaaagggaccagtgacgtcctgctccaagtggagacaattgcccaggagcatagcacactttcccagcaggtagatgaaaagtgctcgttcctggaaactaagctgcaggggatagggcatttccagaacacaatcagggaaatgttctcacaatttgccgagtttgacgatgagctggactcgatggctcctgtcggcagggatgctgaaacactccagaagcagaaggagactatcaaggccttcttaaaaaaattggaggcgctcatggcctctaacgataacgcgaataaaacctgtaagatgatgctggctaccgaagaaacttctcccgacctggtgggcatcaagcgtgaccttgaagcactgagcaaacagtgtaataaactcctggatcgcgcacaggccagagaggagcaggtggaagggacaataaagaggctagaggagttttactccaagctgaaagaattttctattctgctgcaaaaggctgaggaacatgaggaatcccagggccctgtgggcatggaaaccgaaactatcaaccaacagttaaatatgtttaaggtttttcagaaggaagagatcgaacccctgcaggggaagcaacaggatgtcaactggttgggccagggccttatccagagcgctgcgaaatctacatctacccaagggctggaacatgacctagatgacgtcaatgctaggtggaaaacacttaacaaaaaagtggcacagcgggctgcccagctgcaggaggcacttctgcactgcggtcggttccaggatgccttggagtcgttactcagctggatggtggatacagaggagctagtggcaaatcagaagccacccagcgctgaatttaaggtcgtcaaggcccaaatccaggagcaaaagcttctccagagactcttggacgaccggaaatctactgttgaggtgataaagagggaaggtgagaagatcgccacaactgccgaaccggcagacaaggtgaagatactgaagcaactgtctctgctcgattcccgttgggaagctttgctgaacaaagctgagactagaaaccggcagctcgagggcatttccgtggtggcccagcaatttcacgagacactcgaaccattgaacgagtggctgacaactattgaaaagcggttggttaactgtgaacccattgggacccaggcatctaagctggaagagcagatagcccagcataaagcgctggaagacgacattatcaatcataacaagcaccttcatcaggccgtgagtatcggacaatcgctcaaggtgctgtcgtctagagaggacaaggacatggttcagtccaaactggactttagtcaggtctggtatatcgaaatccaggagaagagccattcgcgcagtgagctgttgcagcaggcactgtgtaacgccaagatttttggagaggacgaggtggaactaatgaactggttgaatgaagttcatgacaaactgtctaaattatcagtgcaagattacagcactgaaggcctttggaaacagcagtcggaactgcgcgtgttgcaggaagatatactgttaagaaagcagaacgtggaccaagccctgctcaacggtctggagctgctcaagcagacaactggcgacgaggtgttgatcatccaagataagttggaggccatcaaggcccgttataaggatataaccaaactgtctaccgatgtcgccaagacgcttgagcaggccttgcagctagccagacgcctacatagcacacatgaggaactgtgcacttggctagataaggtggaggtagaacttctgagttacgaaactcaggtgctgaagggagaggaagcttcgcaagctcagatgagacccaaggagctgaaaaaagaagctaagaacaacaaggccttacttgacagcttgaatgaggtgtcaagcgcattgctcgagctggtgccctggcgggcacgcgaaggactggagaaaatggtggcggaggataacgaacggtaccgactcgtttcagatacgattacacagaaggtagaggaaatcgacgccgcaattttacggtcacaacagtttgaccaagcagccgacgccgagttaagttggattacggaaaccgagaaaaagttgatgtccttgggggatatccgcctggaacaggatcagactagcgcacagctccaggtgcaaaagacctttacaatggagatactccggcacaaagatataatcgatgatctcgtgaagagcggccataaaataatgacagcatgctctgaagaggagaaacagtctatgaaaaagaagctggacaaggtgctcaaaaactacgacaccatctgccagatcaatagcgaacggtacctgcagcttgagcgcgctcagtctcttgtgaatcaattctgggaaacctatgaagagctgtggccctggcttaccgagacccagtctataatctcccagctcccagccccagccctggagtacgagacactgaggcagcagcaagaggagcatcgccaactacgtgagctcattgccgagcataaaccccacattgacaagatgaataagactggaccacagcttcttgaactcagtccaggcgagggattctcaatccaagaaaaatacgttgccgcagacacactgtactcgcaaatcaaagaagacgtgaagaagagggcggtagctctcgatgaagcgatctcacagtcaacccagttccacgataagattgatcaaattctcgagtctctggaaagaatcgtggaaagactcagacagccaccttccatttcggctgaagtggaaaagattaaggagcagatcagtgaaaacaagaatgtgtccgtcgacatggaaaagctgcagccattgtacgaaaccctcaagcagcggggtgaggagatgattgcaaggtcgggaggcacagacaaggatatcagcgccaaagccgtccaggacaagctcgatcaaatggtgttcatctgggagaatattcacaccctggtggaggaacgagaagctaagttactggacgttatggaactggccgagaagttctggtgcgaccatatgtcattaattgtgacaatcaaggacacccaggactttattcgtgacctggaggaccccggaatcgacccctccgtggttaaacagcagcaagaagcagcagagacgatccgcgaggaaattgatgggctgcaggaagaactggacattgtaatcaatctgggaagtgaactcattgctgcatgtggagagcctgataaacccatagtgaaaaagtccattgatgagttgaattctgcatgggacagtctcaataaagcctggaaagatcgcattgataagctcgaagaggcaatgcaggctgcagtgcagtaccaggacgggttgcaagccgtgttcgattgggtggatatcgctggaggtaagttagccagcatgtccccgatcggcacagatctcgaaaccgtaaagcagcagattgaggagctcaagcaatttaaaagcgaggcctaccaacagcagatcgagatggaacgcctcaaccaccaggccgaactgttactcaagaaagtcacagaggagtctgacaaacacaccgtccaagatcccctaatggaactgaaattgatctgggatagtctggaggagaggataatcaatcgccagcacaaattggagggagcactcctcgctctcgggcaattccagcacgccctggatgagctactagcctggctgacacacacagaaggtttgcttagtgaacagaagcccgtgggtggggaccctaaggccatcgagatcgaattggctaaacaccatgtgctgcagaatgacgtgctcgctcatcagagcacagtcgaggctgtgaacaaagcaggtaacgatttgatcgaatcctcggcgggtgaggaggctagtaacctccagaataaactcgaggtcttgaaccaacgctggcagaacgttctggagaagacagagcagcggaaacaacagctggatggtgccctgcgccaagctaagggttttcacggcgaaatagaagatctgcagcagtggctgacggatacagaacggcacctcttggcatcaaagcctctaggaggccttccagagacagccaaagaacagttgaatgtgcatatggaggtgtgcgccgcatttgaagccaaggaagaaacctacaagagcttgatgcagaaaggacagcaaatgttggcaaggtgccctaagagcgccgagacgaatattgaccaggacatcaacaatcttaaggaaaaatgggaaagcgtcgagacaaagctgaatgagcggaaaacaaagttggaggaggcactaaacttagctatggagttccacaattcactgcaagactttatcaattggttaactcaggccgagcaaacccttaacgtggcctccaggccttctctgatcctggatacagtgcttttccaaatcgacgaacacaaagtgtttgcaaacgaggtcaacagccatcgcgaacagatcatcgaactggacaagactgggacccatctcaagtatttctcacaaaagcaggatgtggtcctaatcaaaaacttgctgatttcagtccagtccagatgggaaaaggtggtgcagagactggtcgaacgaggacgctcgctcgacgatgcgcgtaagcgggctaaacaatttcacgaggcctggtccaaactcatggaatggctcgaagagtcagagaaatctctggacagcgaactggaaatcgcaaatgatcccgacaagattaagacacagctggcccagcacaaggagttccagaaaagcctgggggctaaacactctgtttatgacacaacaaacagaacgggcagatcgctcaaggagaagacaagcttggctgacgataacttaaagctcgacgacatgctgagtgagcttagagataaatgggataccatatgtggtaagagcgtggaacggcagaacaagcttgaggaagctctgctgttcagcgggcagtttaccgatgctttgcaagctctgatagattggctctacagggttgagccacaactcgctgaggatcagccagtgcacggggacatagatctggtgatgaaccttattgataaccacaaggctttccaaaaggaattgggcaaacgtacctcttccgtgcaggcgctcaaaaggagcgctcgagaactgatagaggggtctcgtgatgactccagttgggtgaaggtgcaaatgcaggaactgtccactagatgggagacagtatgtgctttgagtatcagtaaacagactaggcttgaagccgcactgcgtcaggctgaagagttccacagcgtagtgcacgccctgttggaatggctggctgaggccgagcagaccctacgatttcacggggtgctgccagacgacgaggacgccctacgaacacttatcgaccagcacaaagaattcatgaagaagctcgaggaaaaacgggcagaactgaataaggcaaccaccatgggggacacagtgctggctatatgtcaccctgattctattaccaccataaaacattggatcactatcattagagctaggttcgaagaggtgctggcttgggcaaagcagcaccagcagcgattggccagcgccctcgccggactgattgctaagcaggagctccttgaagccctgctggcctggctgcaatgggcagaaactacactgactgataaggataaagaggtcatccctcaggagatcgaggaagtaaaggccctaatcgctgagcaccagacatttatggaggaaatgacaagaaagcagcccgatgtggacaaggttactaaaacctataagcgccgagcagccgacccttctagcttgcagtcccatatacctgtgttagataaaggcagagccggacgcaagcggttccccgcatcaagcctgtacccatcgggcagccagacccagatagagaccaagaatcccagggtaaacctgctggtttccaaatggcagcaggtgtggctactcgctctggagcgcaggaggaagctgaatgacgcgctggaccggttggaggaacttagagaatttgccaattttgacttcgacatctggcgcaagaagtatatgagatggatgaaccacaagaagtctagagtgatggacttcttccggaggatagacaaggatcaggacggaaagattacgagacaagaattcatcgacggaatccttagctcgaagttccccacatcacgccttgaaatgtccgccgtggccgacatctttgaccgcgatggagatggatatattgattattacgagttcgtggccgctcttcatccaaataaagacgcttacaagccaatcacagatgccgataagattgaggatgaagtgacgaggcaggtagcaaaatgcaagtgtgccaagcgattccaagtggaacaaatcggggacaataaatatcgggtgtcttttcagagtaattttggcgattctcagcagttgaggcttgtccgcatcctgaggagtactgtcatggtacgagttggtggcggatggatggcccttgatgagtttttggtcaagaacgatccttgtagagtgcatcaccatgggtcgaagatgcttcgctccgagagcaatagcagtataactactacccagccaacgatcgccaagggaagaacaaatatggagttgagagaaaagttcatactcgcggacggcgcttcacagggcatggccgcatttcggcctagaggccgaagatctaggccaagttctagaggggcatctcctaaccgttctacatcagtgtcttcccaagctgcccaagctgcatccccgcaagtgcccgctacaacgactcccaaggggacacccatccagggtagcaagcttaggctcccaggatatctgtctggaaagggttttcactccggtgaagactctgggctgattacaactgccgctgccagagtgcggacacaattcgcggacagcaaaaagactccgtctcggcctggctcccgggctgggtccaaagctggatcacgcgcatccagccggagggggtcagacgcctcagacttcgacattagtgagatccaaagtgtttgtagcgacgtcgaaactgtgccgcaaacccatcgacctaccccacgggcaggatctcgtcccagcacagcgaagcctagcaagatccctaccccacagcggaaatctccagcctcaaagctcgacaaatctagtaagagatat

SEQ ID NO: 221513 - DNA, 16374 bp, Artificial Sequence
  Description of Artificial Sequence: Synthetic coding sequence
atggcagggtacttgtcaccagcagcctatctgtatgtggaagagcaggagtatctgcaggcatatgaagacgtgctggagaggtacaaggacgagagggataaggtccaaaagaagaccttcactaagtggattaaccagcacctaatgaaagtgcggaagcatgttaatgacctttacgaagatctgcgggacggtcacaacttgatcagtttgctggaggtgcttagtggagacacactccctcgagaaaagggaaggatgaggttccaccgtctccaaaatgtgcaaatcgccttggactatctgaaacggaggcaggtcaagctggtaaatatacggaatgacgacattactgacgggaatcccaagctgaccctagggctgatctggacaattatcttacactttcagattagtgacattcacgttactggcgagtccgaggacatgtctgctaaggaaagactcttgctttggacacagcaagcaactgagggttatgcgggaatcaggtgcgagaatttcacgacatgttggcgcgacggaaaactattcaacgccataatccacaaatatcggccagacctaatagacatgaataccgttgctgttcagtccaatcttgcaaatcttgaacacgccttttatgtcgcagagaaaatcggcgtgataagactgctggatcccgaggacgtggatgtgtcttcaccagatgagaagagcgtgataacctacgtaagctccctgtatgacgcttttccgaaggtgccagaggggggagaaggcattggcgcaaatgatgtggaggtgaagtggatcgagtaccagaacatggtgaactacctgatacagtggatcagacaccatgtcactacaatgagcgaacgcacattcccgaacaatccagtggagctgaaagccctctataatcagtacttacagttcaaggaaactgagataccccctaaggagacagaaaaaagcaaaataaaaagactgtacaaattgctggaaatatggatagaatttggaagaatcaagctgcttcagggttaccatcctaatgacattgagaaggagtgggggaaacttatcatagctatgttagaaagagagaaggccctcaggccagaggtggaacggttggagatgttgcagcagatcgcgaaccgggttcagagagactccgttatctgcgaagacaagttgatactcgccggtaacgcccttcagtctgactcaaaacgcttagaatccggcgtgcagttccaaaacgaagcggagatcgccggttacatcctcgagtgtgaaaatctgcttcggcagcatgtgattgacgtgcaaattctcatcgacggtaaatattatcaggcagatcagttggtacaaagggtcgcaaaacttagggacgagatcatggcattaagaaatgaatgctctagcgtgtacagtaaaggccgtattttaacgaccgaacagacgaaactgatgatcagcggcattactcaaagcttgaatagcgggttcgcccaaacactgcatcccagtctgacaagtggcctgacccagagcctgacccctagcctcacttctagcagcatgactagcgggctgtcttcaggaatgacaagtagactcaccccttccgtcacccctgcctatacccctggatttccatcaggactagttcctaacttttcttctggtgtggagccaaatagccttcaaaccctgaagctaatgcaaataagaaagccactgctcaaatcaagcctcctggaccagaaccttacagaggaggagattaatatgaaatttgtgcaggatttgttgaactgggtggatgaaatgcaggtccagctggatcgaaccgagtggggctcagatttacctagtgtcgagtcccatctagaaaaccacaagaatgtgcatagggccatcgaagagtttgagtcttcccttaaagaagccaaaatcagcgaaatccagatgacggctcccttgaagctgacatatgccgagaaactgcatcgcttagaatctcaatacgcaaagctactgaacactagtcggaaccaggagcgccacctggacacactccacaactttgtttcccgagctacaaacgagttgatctggctcaacgagaaagaggaagaagaagtagcatacgattggagcgagaggaatacaaatatagccaggaaaaaggattatcatgccgaactcatgagggaactcgatcaaaaagaagagaatattaaatctgtgcaagagatcgcagaacagctcctgctcgaaaatcatcccgctcggctgacaatcgaggcttaccgggcagctatgcagacacaatggtcatggatcttgcaactttgtcagtgtgtcgagcaacatattaaggagaacacagcctattttgagttttttaacgacgcaaaggaagctaccgattacctgcgaaatctcaaggacgcaatccagaggaaatactcctgtgatcgctccagctctattcacaaacttgaagacttggtgcaggagagcatggaggagaaggaggagttgctccaatataaaagcacaattgccaacctgatgggtaaagcgaagactataattcagttgaagcccagaaactcagactgtcctctaaagacaagtattcctatcaaggctatctgtgattataggcagatagaaataacaatctataaagatgacgagtgtgtccttgctaataattcgcatcgagccaagtggaaggtgatctcccccactggtaacgaagccatggtgcccagcgtttgcttcaccgtcccaccacctaataaggaagccgtggacctcgctaaccgcatcgagcaacagtaccagaacgtgctcaccctgtggcatgagtcccacattaacatgaagtcagtggtatcctggcattacctcatcaacgaaatcgatcgcatccgtgcttctaacgtggcatctatcaagactatgcttccaggcgagcaccagcaggttctgtccaatttgcagagccgctttgaggactttctcgaggattcacaagaatcccaggttttttctgggtccgacatcactcagctcgagaaagaagtcaatgtgtgcaaacaatattatcaggaattactaaaatcagccgaacgcgaagaacaggaggagtccgtctacaacctgtacatctcagaagttagaaacatccggctccgcttggagaattgtgaggacagactgattcggcagatccgcacccccctggagcgagacgatctgcacgagtccgtgtttcgtattacagagcaggagaagctgaaaaaagaacttgagcggttaaaagacgatttggggacgatcacaaataagtgcgaggagttcttctcccaagccgctgcctcttcgagcgtccccactttacgctctgagctaaatgtggtgctgcaaaatatgaaccaggtttactcaatgagctcaacctatatagataaacttaagacagtgaacctcgtcctcaaaaatacccaggccgcagaggctttggtgaaactgtacgagaccaaactgtgcgaggaagaggctgtgatcgctgacaagaataacattgaaaatttaatctcaaccctcaaacagtggcggtcagaagtcgacgagaagaggcaggtatttcatgctctggaggatgagctgcagaaggccaaagccattagtgatgagatgttcaagacatataaggagcgtgaccttgactttgactggcacaaggagaaggctgaccagctagtggagagatggcaaaatgtgcacgtacaaatagataaccgactaagagatcttgaggggatcggaaagtcccttaagtactaccgcgacacctaccatcccctggatgattggattcagcaggtggagaccacacagcggaaaatacaagaaaaccagcctgagaattccaaaacacttgcgacccagctcaatcagcaaaagatgctggtgtctgaaattgaaatgaaacagtccaaaatggatgaatgccagaaatacgcagagcagtattctgcaaccgtcaaagactatgagttgcagactatgacatatcgggcaatggtggacagccaacagaaatctcccgtcaaacggagacgcatgcaaagttctgcagatttgattatccaggagtttatggatctacggacgagatataccgccctggtgaccttgatgacgcagtacataaaatttgccggtgacagcctgaagagattagaagaggaggaaaagagcctggaagaagagaaaaaagaacacgtggagaaagccaaggagctgcaaaagtgggtctccaacatctccaaaacactcaaagacgctgaaaaggcgggtaagccccctttttctaagcagaagatctcgtcagaggagatcagcactaaaaaggagcagctttcagaagctttgcaaacaattcagttgttcctcgcaaaacacggagataaaatgaccgatgaagagcggaatgagctcgaaaagcaggttaaaaccctccaggagagctacaatctgctgttctctgagtcacttaagcaactccaagaaagtcagacatctggagatgtcaaagtggaggaaaaaattgtggctgagaggcaacaggaatacaaggagaagctgcaagggatttgcgatttgctcactcaaacagagaacaggctcatcggacatcaggaggcctttatgattggggatggaacagtggagctgaaaaagtatcagagcaaacaagaggagctacagaaagatatgcagggctccgcccaggctctggccgaggtcgtgaaaaatactgaaaatttcctgaaagaaaatggcgaaaagctgagccaggaagacaaggcgctgatcgaacagaagttgaacgaagccaaaatcaaatgtgagcaactcaacctgaaggccgaacagtctaaaaaggaactggacaaggtcgtaaccaccgctatcaaggaggagaccgaaaaggtggctgccgtgaagcagttggaggagtctaagaccaagattgaaaatctgttggattggctgtctaatgtagacaaggactccgagagggcgggtacaaaacataagcaagttattgagcaaaatggtactcactttcaggaaggggatggtaaatcggctataggagaggaggacgaagttaacggaaatctgcttgaaaccgatgtagacggacaagtggggactacacaggagaatctgaatcagcagtaccagaaagtcaaagcccagcacgagaagattatcagccaacatcaggctgtgatcattgccactcaatcggcccaagtcctactagaaaaacagggccagtatttgtcaccagaggagaaagagaagctacagaagaatatgaaagagctaaaggtacattacgagaccgctttagctgagtcagagaaaaagatgaaattaacgcattcattgcaggaggaactagaaaagttcgacgccgattatacagaattcgaacactggctccagcagagcgaacaggagcttgagaatctggaggccggagccgacgatataaatggcttgatgactaagctaaagcgtcagaagagcttcagcgaagacgtgatctcacacaagggcgaccttcgttacattaccatctcggggaaccgcgtcctcgaagccgctaagtcctgctcaaagcgggacggcggaaaagttgatacctccgcgacccatcgtgaggttcaaagaaaactggaccatgctacagataggttccggagcctgtactccaagtgcaacgtgctgggtaataacttgaaagacctggtggacaagtaccaacactacgaggatgcatcttgcgggctactggcaggccttcaagcttgtgaagccaccgcatccaagcacctgagcgaacccatagccgtggacccgaagaatcttcagcgccagttggaagagactaaagctctgcagggccagatttcatcacagcaagtggcggtcgagaagcttaagaagacagctgaagtgctcttagacgccagggggagccttcttccagcaaaaaacgacatccagaaaacgctggatgatatcgtaggcaggtatgaggacctgagcaagagtgtgaacgagagaaacgaaaagctgcagatcactctgacccggagtctgagcgtccaggacggacttgacgagatgcttgattggatggggaatgtggaatcttccctgaaagagcagggccaggtgcccttaaattccaccgcgctgcaggatatcatcagtaaaaacattatgcttgagcaggatatcgcgggaagacagagcagcattaacgctatgaatgaaaaggtgaagaagttcatggagaccacagatccatccacagcttccagcctgcaggctaagatgaaagacctctcagcaaggttctcggaggctagccataagcataaggagaccctcgccaagatggaagaattaaaaaccaaagtggagctgttcgagaatttgtctgagaaactgcagacttttctggaaacaaaaacacaggcactcaccgaagtcgacgtgcccggtaaggacgtcacagagctgagtcagtatatgcaggagagtacaagtgaattcctggaacataagaaacatcttgaggttctccattcactccttaaagaaatcagctcacatggcctcccgtccgataaggctctggtgctggagaagacgaacaatctgtccaaaaaattcaaggaaatggaggatacaatcaaggaaaagaaagaagctgtcacgagttgccaggaacagctcgacgcgtttcaagtgctcgtaaaatccctcaagtcctggattaaggaaacgaccaagaaagtgcctatagtgcaacctagcttcggggctgaggaccttggaaaatccctggaagatactaagaaactacaggagaagtggagcctgaagactccagagatccaaaaggtaaacaactccggtatatccttgtgtaatctaatttccgccgttaccacaccagccaaagctatcgctgccgtcaaatccggcggagctgtcctgaatggcgaagggaccgccaccaataccgaagagttctgggctaacaaagggctaacctcaatcaagaaagacatgacagacatttcccatggctacgaggacctgggtctgttgctgaaggataagatcgctgaacttaatactaaattatccaagttgcagaaagcccaagaggagagctcagccatgatgcaatggcttcagaagatgaacaagactgccacaaagtggcaacaaactcccgctccaaccgatactgaggcagtaaagacccaagtggagcaaaacaaatccttcgaagcagaactgaagcaaaatgtcaataaggtgcaggaactgaaagacaagcttacggagctcctggaggagaacccggatacgccggaagccccaaggtggaaacagatgctgactgaaatcgactctaaatggcaggagctcaaccagctcactattgaccgccagcagaagcttgaggaatcttccaataacctgacccagtttcaaacagtggaagcccagctgaaacagtggttggtagagaaagagctaatggtctcagtgcttgggcctttaagtattgatccaaatatgctcaacacccagcgtcagcaagttcagattcttcttcaggaattcgccacaaggaaaccacagtacgagcagttaactgccgctggacaaggtatcctctctcgcccaggcgaagatccatctttacggggaatcgtcaaggagcagctggctgctgtgactcagaagtgggacagtctgactggacagctgagcgacagatgtgactggattgatcaggccattgtgaaaagcacacagtatcaatccctgttgagatctttatcagacaaactgtctgatctggataataagctgtcgtccagtttggcagtaagcacccatcccgacgcgatgaaccagcagctggagacggcccaaaaaatgaagcaagagatacagcaggagaaaaaacagatcaaggtagctcaggctctgtgcgaggatttatccgcactggtcaaggaggaatatttgaaagcagagctgtcacggcagctagaggggattttgaaatccttcaaagacgtcgaacaaaaggccgaaaaccacgtacagcatcttcagagcgcgtgcgcaagctcccatcagttccagcagatgtcccgtgatttccaggcttggttggatacaaaaaaggaagagcagaacaagagtcatcccattagcgctaagctggatgtgctcgagtctttgataaaagaccacaaggactttagcaaaaccctcacagcgcaaagccatatgtatgagaagaccatcgccgagggcgaaaatttgctcctgaagactcaaggctctgagaaggccgctctgcagctccagctgaataccatcaaaacaaactgggatacctttaataagcaagtgaaggagcgggaaaacaagcttaaagagagcttggaaaaggcactgaaatacaaggagcaggtggagacactctggccttggatagataaatgccaaaacaatttagaagagataaagttttgtttggatccagctgagggcgaaaactccatagccaaactgaaatccctacagaaggaaatggaccaacattttggcatggttgaacttttaaacaatactgccaacagtcttctatctgtgtgtgagatcgataaggaagtggtcaccgatgaaaacaaatctcttattcaaaaagtagatatggtcacggaacagctacattcaaaaaagttttgtttagagaatatgacgcagaaatttaaggaatttcaggaggtgtccaaggagagcaagcggcagctgcagtgtgctaaggaacagctcgacatccatgactcattgggtagtcaggcttactccaataaatacctaacgatgctgcagacccagcaaaaatccctgcaggcactgaaacaccaagtggacctcgctaagagactagcccaagacctagtagttgaagcaagtgatagcaagggtacaagtgacgtactgcttcaggtggaaaccatcgcacaggaacactcaacactgtcccagcaagtggatgaaaagtgctccttcctggaaaccaaattgcaaggcatcggacattttcagaacacaatacgggagatgtttagccaattcgctgagttcgacgacgaactagatagtatggcacctgttggcagggacgcagagacactccagaagcagaaggaaacaattaaagcctttcttaagaaactagaggcccttatggcaagcaatgataatgcaaacaagacgtgcaagatgatgctggccaccgaggaaaccagccccgacctggtcggaatcaaacgcgatcttgaggcactctctaagcaatgtaacaaacttctcgaccgcgctcaggccagggaagagcaagtggagggtaccattaagcgccttgaggaattctactccaagctcaaggaatttagtatacttctccagaaagcagaggagcacgaagagtcccagggtcctgtgggaatggagactgaaacgatcaaccagcaactgaacatgttcaaagttttccagaaagaggaaattgaacctttacaggggaaacagcaggatgtcaactggctgggacaaggcctaatacagagtgcagccaagagcacctcaacacagggacttgagcatgacctggatgatgtcaatgcgcgttggaagacactgaacaagaaggtagcacaacgcgcagcacagctgcaggaggctctgctccattgcgggaggtttcaggacgccctggaaagccttctctcctggatggtcgacaccgaggaactggttgccaatcagaaaccaccttcagcagaatttaaggtggtgaaggcacaaattcaggagcagaaacttttgcagaggctgctggatgataggaaatcaaccgtggaggtgatcaaacgagagggagaaaaaatcgccacaacagctgaacctgctgataaggtgaaaatcctcaaacagttgtccctgctggattcgagatgggaggctttgcttaataaggcggagacaaggaaccgccagttagaggggatctctgtggtggcccaacagtttcacgaaaccctagaacctcttaatgagtggctgacaaccatcgaaaagcgattggtgaattgtgagcccatcggcacacaggcttccaagctcgaggaacagatagcccagcataaggcactggaagatgatattattaaccataataaacacctgcatcaggcagttagcataggccaaagtttaaaggtcctatcctcaagagaggacaaagatatggtccagtcgaagctcgacttcagtcaagtgtggtatatagaaatccaggaaaagagccactctagatcagagttgcttcagcaggcgttatgcaatgccaagatctttggcgaggacgaggtagagctcatgaattggctgaatgaggtgcatgacaagctttcgaagttgtcagttcaggactacagtaccgaaggactgtggaagcagcaatcggaactcagggttctccaggaagacattctgctgagaaaacagaacgtggatcaggcgcttctcaatgggctggagctgctgaaacagactactggagatgaggtactgatcattcaggataagttagaagctatcaaggccaggtacaaagacatcacaaagctttccactgacgtggcaaaaacccttgaacaggcattacagctggctcgcaggctgcactctacccacgaagaactgtgcacatggctggacaaggtcgaggtggagcttttgtcttatgagacccaggtattgaaaggggaggaggccagccaggcacagatgaggcccaaggagctgaaaaaggaggctaagaacaataaggcgcttctggactctctgaatgaggtctcctcagcattactcgagcttgttccctggagggccagggagggtctggaaaagatggttgccgaagacaacgagagatataggctagtctcggacaccatcacacagaaggtcgaggagatcgacgcagcaattctccgatcacagcagtttgaccaagctgcagatgctgagctgagctggatcaccgaaacagagaaaaaactgatgagtttgggagacatcagactggaacaggaccagacctccgcccagctccaggtgcagaagacatttaccatggaaatattacggcataaagatattatcgacgatctcgtgaagtctggacacaagatcatgaccgcctgcagcgaggaggagaagcagtcaatgaagaaaaagctggataaagtcctaaagaattatgacactatctgtcagataaactcggagcgctatctccagcttgagcgcgctcaatctttggtgaaccaattttgggagacctacgaagagctttggccctggctcactgagacacagagcataattagtcagctgccagctcccgctttggagtatgagactctgaggcagcaacaggaggaacatcggcagctcagggagttgatagctgaacataagccacacatcgacaaaatgaacaagaccggaccccagttgctcgagctgagtccgggagaaggatttagcattcaggagaagtatgtcgccgcagacaccttatatagtcagatcaaagaggatgtgaaaaagcgggcagttgcgctggacgaggctatttctcagagcacacagttccacgataaaatcgatcagatcctcgaatcactggaacggatcgttgagcgtctgcgccagcccccaagcatttccgctgaggtggagaaaatcaaggagcagattagcgaaaataagaatgtatccgtggacatggaaaaactacagccactctacgagacactgaaacagcgaggcgaggagatgattgcacgcagcggaggaaccgataaggacatcagcgccaaggccgtccaggacaaactagatcagatggttttcatctgggaaaatatacacacactggtggaggaaagggaagctaaacttctagacgttatggaacttgcagagaaattttggtgtgaccatatgagcttgatcgttacaattaaagatacccaagactttatacgtgacttggaagatccaggcatagacccctccgtggtgaaacagcagcaagaagcagccgaaaccattcgggaggaaatcgatgggctacaggaagagctagacattgtgatcaacttgggatctgaattgattgcggcatgtggcgagcccgataagccaatagtaaagaagtctatcgacgagctgaattctgcatgggactccctcaataaagcgtggaaagatcgtatcgacaagctggaagaggcgatgcaggccgcagtgcagtaccaagacggactgcaggccgtcttcgactgggttgacatcgctggtggaaaacttgcctcaatgagccctatcggcaccgatcttgaaacagtcaagcagcagattgaagagttgaaacagtttaagtctgaggcatatcagcagcagatcgaaatggagagactaaaccaccaggccgagttactccttaaaaaagtcaccgaggaaagtgacaaacacaccgtgcaggatccactgatggagttgaagctgatttgggacagcctcgaagagcgcataattaataggcagcacaagctggagggagctctgctcgctctggggcagttccagcatgccctggatgagctgctagcatggttgacgcacactgagggactcctgtctgaacagaaaccagtcgggggtgatccaaaggctatcgagattgagttggccaagcatcatgtcctgcagaacgatgtgctggcccatcagagcacagtcgaagccgtgaataaggccggaaacgatctgattgaatcttctgccggagaggaggcaagtaatttgcagaacaagctggaggtcctcaatcagcgatggcagaatgtgctcgaaaagacagagcagcggaagcaacagcttgatggagccctgagacaggctaagggttttcacggagagatcgaggacctacagcagtggctgacggacactgagcggcatttgttggcgagcaagcccctgggtgggctgcctgagacagcaaaggagcaactgaacgttcatatggaggtgtgcgctgcttttgaagcaaaagaagaaacctataagagcctgatgcagaaagggcagcagatgctggctcgatgcccaaaatccgccgagaccaacattgatcaagatataaataacctgaaagagaagtgggagtcagtcgagacaaagctcaatgaaaggaagacgaaactcgaagaggctctgaaccttgccatggagtttcataacagcctccaggattttatcaattggctgactcaggcagaacagaccctgaacgtggcctccaggccgtctctcatccttgataccgttctgttccagattgacgagcacaaagtgtttgctaacgaagtcaacagccacagggaacaaatcattgaacttgacaaaactggcacccatctgaagtacttcagccagaaacaggatgtcgtcctgatcaaaaatctgctgatcagcgtccagagtaggtgggagaaagtagtgcagcgattggttgagcgtgggcgttccctggatgatgcgaggaaaagggctaagcagtttcacgaggcttggagtaagctcatggagtggttggaggagtcggagaagtctctggactccgaactcgaaatcgccaatgacccagacaaaattaagacccagctggcccagcataaggagtttcagaagtctctgggtgccaagcattcagtgtacgacactaccaaccggacgggaaggtccttgaaagaaaagacatcactagccgatgacaacctcaagcttgatgacatgttgtcggaacttcgagataagtgggacacgatctgtggtaaatccgtcgagcgccagaataaactggaggaggcgttgttattcagcggccagtttacagatgcactgcaggctctcattgactggctgtatcgggtggagccacaattagctgaagatcagccggtgcatggtgatatagatctggtgatgaatttaattgacaaccataaagccttccaaaaggaactgggtaagaggaccagcagcgttcaagctttaaaaaggtctgcgagggaactgattgagggttctcgggacgacagtagctgggttaaggtgcagatgcaggagttgagcaccaggtgggagacagtgtgcgccttgtcgatctccaaacagacccgcctcgaagcagctcttcgccaggccgaagagttccacagtgttgtccatgcgctgctggagtggctggcagaggccgaacagacgctgcgcttccacggcgtcctcccagacgatgaagatgccctaagaacccttattgaccaacataaggagttcatgaagaaactggaggagaaacgtgcggaactgaataaggcaactaccatgggagacaccgtgctggccatctgccatccagattctatcactaccatcaagcattggattactatcatcagggcccgattcgaagaagtactggcttgggcaaaacagcatcagcaacgtcttgccagcgccctggccggactaatcgccaaacaagagcttcttgaagccctgctggcttggttacagtgggcagaaaccacgctgaccgacaaagataaggaggtgatcccacaggagatcgaagaggtcaaggctttgatagctgagcaccagaccttcatggaggagatgacacgcaaacagcccgatgttgataaggtcacgaaaacgtacaagcggagagctgctgatcccagtagcctccagtcacacatccccgtactggacaagggcagagccggtaggaaacgattccccgcttccagtttgtatccctcaggatcccagactcagatcgagaccaaaaatccacgagtgaatttgttgcttcgtgagtttgccaactttgacttcgatatctggcggaagaaatatatgcgttggatgaatcataagaaaagcagggtgatggacttcttccggagaatcgacaaagaccaagacggcaaaatcacaagacaagagttcatcgatggcatcctgagcagcaaatttccgacttctcgcctggagatgagcgctgtcgccgacattttcgatcgtgacggcgatggttatatcgactattacgagttcgtggctgctctccaccctaacaaggatgcatacaagcccatcaccgatgcggataaaatcgaagacgaagtgacccggcaggttgccaagtgcaagtgcgctaaacgattccaggttgagcagatcggcgacaataagtaccgggtatcctttcaaagcaactttggcgattcccaacagctgcgtcttgtacgcatcctgcggtcgacggtaatggtgcgcgtggggggaggctggatggccctcgacgagttcctagttaaaaacgatccctgtcgggtgcatcatcatggctctaaaatgctgcgttctgagtcaaattcctccattactaccactcaacccaccattgctaaagggagaacaaatatggagctgagggaaaaattcatcttggcggatggtgcctcgcagggaatggcggcattcaggcccagagggagacgcagcagaccctcctctaggggcgctagcccgaatagaagcacctccgtgtcaagccaggctgcccaggctgctagcccacaagtccccgctacaaccactcctaaaggaacccctattcagggctccaagcttcgcctgccgggttacctctcagggaagggctttcatagtggtgaagatagcggtctgataacaactgcagcagcccgtgtgagaactcaatttgccgattcaaaaaagactccctctcggccaggatcgcgggctggtagcaaggcaggtagccgcgcaagtagcaggaggggttctgatgcatctgattttgatatcagtgaaatacagtccgtctgttcagatgttgagacggtccctcagacacacaggccaacacccagggctggcagcagacctagcacagccaagccaagcaaaataccgactccacagcggaagtctcctgcatccaagctggacaagagcagcaaaagatac

SEQ ID NO: 221514 - DNA, 9182 bp, Artificial Sequence
  Description of Artificial Sequence: Synthetic coding sequence
atgcactcctcatcttattcttatcggtcatctgattcggtcttctctaacaccactagcactagaacgagcctggactctaatgagaacctcttactggtgcactgcggaccaaccctgatcaattcctgtatcagctttggctccgaatcctttgatggccacagactggagatgctgcagcagatagccaatcgcgtccaaagagattctgtaatctgcgaggacaaattaatcctcgctggcaatgctcttcagtcagacagtaagcgcttggagagcggagtccagttccagaatgaggccgagattgctggatatatcctggagtgtgaaaacctgttgcggcagcacgtgatcgacgtccaaatcctcatcgatggaaagtactatcaggccgatcaactggtccagcgagtcgctaagctccgtgacgagatcatggcacttcgaaacgagtgttcaagcgtctactctaaagggcgtatattgactacggaacagacgaaactgatgatttctggcataacccaatccctcaattccgggttcgcccagacactccacccgagtctgaccagtgggcttacccaaagcctgacccccagcctgaccagctcatctatgacatcaggactgtcctccggaatgacaagtcgccttaccccgtctgtgacccctgcttacactcctggcttcccctccggactagtccctaacttttcctctggcgtggagccaaattccctgcaaaccctgaagctaatgcaaatcagaaagccactgctgaagagtagtttactggatcagaatctgacagaggaggagatcaatatgaaatttgtgcaagatctcctcaattgggtcgacgaaatgcaggtgcagctggacaggaccgaatgggggtcagatctgccctcggtcgaaagccaccttgaaaatcataagaatgtgcatcgtgcgattgaagagttcgaaagtagcctgaaagaagccaagatctcagagattcagatgaccgcacccctgaaacttacctacgccgagaaattgcataggttggaatcccagtacgctaagctgttgaacacatcgcggaatcaggagcggcatctggataccctgcacaactttgtctccagagctaccaacgagctgatctggttgaacgaaaaagaggaagaggaagtcgcttacgactggtcagagcggaatacaaatattgctcgtaagaaagactatcacgccgaattaatgagagagctggaccaaaaagaggagaacatcaaatcggttcaggagatcgcggaacaattgctgctagaaaaccaccccgctagactgacgatagaagcgtacagagctgctatgcaaacccagtggagctggatcctgcagttgtgccagtgcgtggaacaacatatcaaggagaacaccgcatatttcgagttttttaatgatgcaaaggaggctaccgattatcttcggaacctgaaggatgcgatacagcgaaaatactcttgtgatcgcagctcctcaatccataagcttgaggatctggtgcaagagagcatggaagagaaggaggagctcctccaatacaagagcacaatagctaacctaatgggcaaagcaaaaacgatcatccagctgaagccacgtaactctgattgcccactgaaaaccagcatccccatcaaggcgatctgtgactacaggcaaatcgagataactatctataaggatgatgagtgcgtcctggctaacaactctcatagggccaaatggaaggtgatttctcctacagggaacgaagcaatggtgccgtcagtatgtttcaccgttcccccacccaacaaggaggcggtcgatctggctaatcgcatagagcagcagtatcagaatgtgttaactttatggcacgagtcccacattaatatgaagtcagtggtaagttggcactatctgattaatgagatcgatcggatccgtgcttctaacgttgcgtccataaagacaatgttgccaggggaacaccaacaggtgttgtcaaatctgcagagtagatttgaggactttctcgaggactctcaggagtcccaggttttcagcggtagtgacataactcaattggagaaggaagtcaatgtgtgcaaacagtactatcaggagctcctgaagtcagccgaaagagaagaacaagaagagtccgtgtacaacctttatatatccgaggtccgcaacatccggcttagactggaaaattgtgaggaccggctgatcaggcagattcgaacccctttggagcgagatgacctacacgaatccgtattccgcatcacggagcaggagaagcttaaaaaagagctggagagactgaaagatgatctcgggacgattacaaataaatgcgaggaatttttttcacaggcggctgccagttcctccgtaccgaccctgaggagtgagttaaatgttgttttgcaaaacatgaaccaggtgtactcaatgagcagtacttatattgataagctgaagaccgtgaatcttgtacttaagaacacccaggcggctgaggcgctggtgaagctctatgaaaccaaactctgtgaggaggaagctgtcatcgccgataaaaacaatatcgagaatctgatctcaactctgaagcaatggcgttcagaggtggatgagaagagacaggtgtttcacgcactggaggacgagcttcaaaaagcgaaggccatttcggatgagatgttcaagacatacaaagaaagggacctcgattttgactggcacaaggagaaggccgaccagctggtagagcgttggcagaatgtacatgttcagatcgataatcggttaagggatctggagggtattggaaagtcacttaagtattatagagacacataccaccccttggacgactggattcagcaggtcgaaaccactcaacggaaaattcaggagaaccagccagagaactcaaaaacacttgcaacacagctcaaccagcaaaagatgctggtcagcgagattgaaatgaagcagtctaagatggacgagtgtcagaaatacgcagagcagtactctgccaccgtgaaggattacgaactacagactatgacttacagggcgatggtggactctcagcagaagagcccggtcaaaagaagaaggatgcagagctccgccgacctgatcatccaggagttcatggatcttcgaacccgttatactgctctggtgactctcatgactcagtatatcaagttcgcaggcgattctctcaagaggctggaggaggaagaaaaaagcctggaagaggaaaagaaggaacacgtggagaaggcaaaggaactccagaaatgggtgtctaatataagtaagacactgaaagatgccgagaaggcaggcaaaccacccttcagcaagcagaagatcagcagcgaagaaatttccactaaaaaagaacagctaagcgaagccttacagactatacaactcttccttgctaagcacggcgacaaaatgacggatgaagagcgtaatgagctggagaaacaagtgaaaacactccaggagagttacaacctgctgttctccgagtcccttaaacagttacaagaatcccagaccagcggagatgtgaaggtggaagagaagctggataaagttatcgccggaactatcgaccagacgacaggggaagtgctcagcgtctttcaggccgtgttgagggggcttatcgattatgatactgggatcaggctactcgagacacaactcatgatcagtggactgatctcccctgaactgaggaaatgtttcgatctgaaggacgccaagagtcatgggttgattgatgagcagatcctgtgtcagttgaaagaacttagcaaggctaaagaaatcatctcagcggcatcacctactacaatccccgttctggacgcactggcacagagcatgatcactgagtccatggctatcaaggtcttagagattctcctgagcacggggtctctagtgattcccgcaacgggtgagcagctaactctacagaaggccttccagcaaaatctggtatcatccgctctcttctcgaaagttctggaaaggcagaatatgtgcaaggatctgattgacccatgcaccagcgaaaaagtgtctttgatagacatggtgcagcgttcaaccctccaggagaacacgggcatgtggttactgcccgttcgcccacaggaagggggacgaatcacgttgaagtgcggcaggaacatcagcatcctgcgcgctgcgcatgagggactcattgatcgagagaccatgtttcggctgttaagcgctcagcttttgagcggcggtctgataaactccaattctggccagcgcatgaccgtggaggaggcagtcagggagggagtaatcgaccgcgataccgccagttccatactgacctatcaggttcagaccggagggataattcagagcaatcccgcaaagaggttaactgtcgacgaggccgtacagtgcgacctgattactagttccagtgccctgttggttctggaggctcagaggggttacgttggactgatatggccccactcgggagaaatctttccaactagcagcagtttacagcaggaacttatcacaaacgagttggcatacaagatcctgaatggaaggcagaaaattgccgcactctatattcccgagagttctcaagtaatcggactggatgccgctaagcaactcggaatcatagacaataacaccgcctcaatactgaagaacattaccctgccggataaaatgcccgatctcggcgacctggaagcctgtaaaaacgctcgtcgatggctgtccttctgcaaattccagccatccaccgtacatgattacagacaggaggaggacgtgtttgatggggaggagcccgttacgacacagacatccgaggagaccaaaaaacttttcttaagttacctgatgattaatagctacatggacgcgaatacaggacagagactgttgctgtatgatggtgatcttgacgaggcagtcggcatgctattggagggttgtcacgccgagtttgatggcaacaccgccatcaaggagtgtctggatgtactttcttcatcaggggtgtttctgaataatgcaagcggacgggaaaaggacgagtgtacagccactccctcgtcctttaacaagtgtcattgcggagagcccgaacatgaagaaacccctgagaatcgcaagtgcgccatcgatgaggaatttaatgagatgaggaacacagttatcaacagtgaatttagccagtctggcaagctggcgagtactatatctatcgatccaaaggttaacagcagcccctcggtatgtgtaccttctctgattagctatctgacacaaaccgaacttgctgatatctctatgctgaggtcagactccgagaatatcttgacgaactacgaaaaccagagtagagtcgaaaccaacgagcgcgcaaatgagtgctcgcattctaagaatatccagaacttcccctccgacttaatagagaaccctataatgaagtctaagatgagcaagttctgtggggtaaatgagaccgaaaacgaagacaacacaaatagagactcacctatctttgattatagcccccgtctctctgccctgctatcacatgacaaactcatgcatagtcagggctcgttcaacgatacacatacacctgagagcaacgggaacaaatgtgaagctccagccctttcattctctgacaagacgatgctgtccggtcagcgaatcggagagaaatttcaagatcagtttttgggaatcgctgcgataaatatttccctgccaggcgagcaatacggtcaaaagtccttgaacatgattagttccaacccacaggtgcagtaccataatgacaaatatatttctaatacttccggggaagatgagaaaacccacccaggatttcagcagatgcccgaggacaaggaggacgaatctgagattgaagagtattcttgcgccgttactcctggcggagacactgataacgccatagtgagcctgacatgtgcaacaccgcttttagacgaaaccatctctgcaagtgactatgaaacttcattactaaatgaccagcagaataacaccggcacagataccgacagcgatgatgacttctatgatactccactttttgaagatgatgatcatgacagcctcttgttggatggggatgaccgggattgtctccatcccgaggactacgacacattgcaggaggagaatgatgagactgcaagccctgcagatgtgttttacgatgtcagcaaggaaaatgagaacagcatggtcccccagggcgcaccggttgggtccctttctgtgaagaataaagcccactgtcttcaggattttctgatggatgtggaaaaggatgagctggattctggggagaagattcacctgaacccagtgggcagcgataaggtgaacggtcagagtctggaaactggatcagaaagagaatgcacaaacatcctcgaaggtgacgagagtgattccctcaccgattacgacatagtcggcggaaaggagagctttaccgcctctttaaagtttgacgacagtggaagttggaggggcagaaaagaggagtatgtaaccggacaagaatttcattcggacacagaccatctggactcaatgcagtcagaagaatcatatggggactacatctacgattccaacgaccaggacgatgatgacgatgatggtatcgatgaggaaggaggcggaatacgtgatgaaaacgggaagcctcggtgtcagaacgtggccgaggatatggacatccaactgtgcgcatccattctgaatgaaaattccgacgagaacgagaacatcaacacgatgattcttctggacaaaatgcatagctgttctagccttgaaaagcaacagcgcgttaacgtcgtccaactggcttccccaagtgagaacaacctggtgacagaaaagagcaatctccctgaatataccacagaaattgccggaaaaagtaaggagaatctgctgaatcatgaaatggtcctgaaggatgttcttcctccaataattaaggataccgagtcggagaagaccttcggacctgccagtatcagccatgacaacaacaatataagctctacttctgagctgggaaccgacctcgccaatacaaaagtaaaattgattcagggatcagaactgccagaactgaccgatagtgttaaaggcaaagacgaatatttcaagaacatgacacctaaggtcgactcatctctggaccacatcatctgcaccgaacccgatctcatcggaaagccggctgaagagtcgcaccttagcctgattgcatccgtgacagacaaggatccgcagggtaacggttcagacctgattaaaggccgtgacggcaaatctgatatcctgatcgaggatgagacatccatccagaagatgtatcttggggagggagaagtattagtggaaggcttggttgaagaggaaaatcggcacctgaagctcctgcctggaaagaatacacgcgatagcttcaagttaattaactctcaattcccatttccacagatcacgaataatgaggagctcaaccagaagggtagcttaaaaaaggccactgtcacgttaaaggacgagccaaacaatctacaaattattgtgagcaaatcccctgtgcagtttgagaacctggaggagattttcgacactagcgtgtcaaaggagattagcgatgatattactagcgacatcaccagttgggaaggtaatacccattttgaagagtcttttactgatggccctgagaaagaactggacctgttcacctaccttaaacactgtgcaaagaacatcaaagctaaggatgtcgcaaaacctaacgaagatgtgccgtcccatgtgctaattacagctccccctatgaaggagcatctgcaattgggagtgaataataccaaggagaaatctacaagtactcagaaggattcccctttgaatgacatgatacaatccaacgatctgtgttcaaaggagtccatttcggggggtggaacggaaatatcccagtttacaccggaatccattgaagctactctgtccattctgtctcggaaacatgttgaagatgtcggcaagaatgactttctgcaaagcgagcggtgcgcgaacggcctcggcaatgacaacagctccaacaccctgaacaccgattattccttcctcgagatcaataacaagaaagagagaatcgaacagcagctgcccaaggagcaggctttgagcccaagatcccaagaaaaagaggtccagatacccgagttatcgcaggtttttgtggaagatgtgaaagatattctgaagtccaggctaaaagagggtcacatgaacccccaggaagtggaggagccgtccgcgtgcgcagatacaaaaattttgattcagaatctcattaaacggatcacaacatcacagcttgtgaatgaggcgtctacagtccccagcgactcccagatgagcgactcctccggtgtgtccccaatgaccaattctagcgagctgaagccagaatctagagacgatcccttctgtattggtaatttgaagagcgagctactgctcaacatcttgaagcaggaccagcacagccagaaaatcactggggtcttcgagctgatgagagagctcactcatatggagtatgacttagagaagcgcggtattacttccaaggtgctgcccctgcagttggaaaacatcttctacaaactgctggccgatgggtattctgaaaaaatcgagcacgtcggagatttcaatcaaaaggcgtgcagtacatcagagatgatggaggaaaaaccacacatcctgggggatataaaatccaaagaaggcaactactacagtcccaatctcgagactgttaaggagattggtctggaatccagtactgtttgggcaagcacactccccagagatgagaaactgaaggacttgtgtaacgattttccatcacatttagagtgcacaagtgggtccaaggagatggcctcaggggacagcagcacagaacagta

SEQ ID NO: 221515 - DNA, 21741 bp, Artificial Sequence
  Description of Artificial Sequence: Synthetic coding sequence
atgcattcttcttcttactcttaccgcagttctgattccgtgttcagcaatacgaccagtacgcggacttcactggactctaacgaaaatctattgctggtgcactgcggccctactctgattaatagctgtatttcttttggttcagagtcattcgacggccacagactggagatgctccagcagatagccaatcgcgtccaacgcgatagtgtgatttgtgaagacaagctgattctagccggaaacgccttgcaatcagacagcaaaagactggagtccggcgtgcaattccagaatgaggcggagattgctgggtacatccttgagtgcgaaaacctgctccgacaacatgtaattgacgtgcagatcctaattgatggcaagtattatcaggccgaccaactagttcagagagtagctaagcttagggatgaaattatggctctgaggaatgagtgtagttccgtgtatagcaaaggcaggatactgaccacagagcagaccaaactcatgatctccggtattacccagagcctgaactctggatttgcccaaacacttcatccctccttaacgagcgggctcacccagtcactgactccatcactaacaagctcgtctatgacgtccggactgagtagcggtatgacttcaaggctgacgccttccgtcacccccgcttataccccgggattcccgagcggtctcgtgcctaactttagcagcggtgtcgaacctaacagtctccagactctaaaactgatgcaaatcaggaagccgctgctgaagtctagcctcctggaccagaacctaaccgaagaggagatcaacatgaaatttgttcaggacttgcttaattgggtagatgagatgcaggtgcagctggaccggacagagtgggggtcggatctgccctctgtggaatcccatctcgaaaaccataagaatgttcatcgtgctatcgaggaattcgagagttctcttaaagaggcaaagatatccgaaattcagatgaccgctccactaaaactgacatacgccgagaagctccaccgactggagtcacagtatgccaaactgctcaacacgagtagaaatcaggagaggcatctcgataccctgcataactttgtgagtagagcgacaaatgagctgatctggctgaacgagaaggaagaagaggaagttgcttatgactggtctgagaggaacacaaatatcgcccgaaaaaaagattaccatgctgagctgatgcgcgagttagatcagaaggaggaaaacattaaatcggtgcaggaaattgccgagcaactgctgttggaaaatcatccagcacgccttacaattgaagcctaccgggctgcgatgcagactcagtggagctggatattgcagctgtgtcagtgtgtggaacagcatatcaaggagaacacagcttatttcgagttcttcaatgatgcgaaggaagctaccgactacctacggaaccttaaggatgccatacagcgtaagtattcatgtgaccgaagcagcagtatccataaactcgaagacttggtgcaggagtctatggaagagaaggaagaactcttgcagtataaaagcaccatcgccaatctgatgggcaaggctaagactattatccaactgaaacctcggaacagtgattgccccctgaagaccagcattcctatcaaggcaatttgcgattatagacagattgagatcacaatttataaagatgacgagtgcgtcctggccaataatagccaccgagccaaatggaaagtgatctcccccactggcaatgaggctatggttccaagcgtctgttttaccgtgccaccacctaataaggaagcagtggacctggcgaaccgtattgaacagcagtaccagaacgtcttgaccttgtggcatgagagtcacattaacatgaagtccgtcgtgagctggcactacttgatcaatgaaatcgaccgaataagggcctctaacgtggctagtatcaagacgatgcttcctggtgagcaccaacaggtcttaagcaacctgcagtcaagattcgaagatttcttggaagacagtcaggagagtcaggtcttctcgggcagtgacatcacgcagttggagaaagaagtgaacgtgtgcaagcagtattaccaagagctgctcaagtccgccgagagggaggagcaggaggaatctgtctacaatctttacatttcggaggttcgaaacatacgactgagactcgaaaattgtgaagatagacttatcagacagattcgtacacctctcgaacgggacgacctgcatgaatccgtgttcagaataacagaacaagaaaagctcaagaaggaactggaacgattaaaagacgatcttggcacaataacaaacaaatgtgaagagttttttagtcaggccgctgctagcagttcagtccctacattacggtcagagctgaacgttgtcctccagaacatgaaccaggtgtatagtatgagttccacgtatatcgataagctgaagaccgtgaacttggttctgaagaacacacaggcggctgaggccctcgtaaaattatatgagaccaaactgtgtgaggaggaagctgttatagcagacaaaaacaatattgagaacttaatttcaacattgaagcagtggcgttcagaggtggacgagaagcgccaggtttttcatgccctcgaggacgagttgcagaaggctaaggccatctcggatgagatgtttaagacttacaaggagagagatctggacttcgattggcataaagaaaaggctgatcagcttgtggaaagatggcagaatgttcacgtacagatcgacaaccgtctgcgggatttagaggggattggaaaatctctgaaatattatcgagatacctatcatccattggatgattggatccaacaggtcgagactacccaacgcaagatccaggagaaccagcctgagaactctaaaactctcgctacgcagcttaatcagcaaaaaatgctggtatccgaaattgagatgaagcagagtaagatggatgaatgtcagaagtacgctgaacaatattccgcaaccgtaaaagactacgagcttcagacaatgacctatcgagcgatggttgattcacagcaaaaatctccggtgaaaaggcggagaatgcagtcttccgccgacctgataatccaggaattcatggacctgaggacaagatacacagctctcgtgacattgatgacacagtacatcaagttcgccggagactctctgaaacgtctggaggaagaggagaaatcattggaggaagagaaaaaggagcatgtggaaaaagctaaagagctgcaaaaatgggtgtccaatatctctaagacgctcaaggacgccgaaaaggctggaaaacctccctttagtaagcagaaaatctccagtgaggaaatttctacgaagaaggaacagctttccgaagccctgcaaactatccaactattcctcgccaaacatggggacaagatgaccgatgaggagagaaatgagctcgagaaacaggttaaaactctgcaggagtcctacaacctgttgttttcagaaagcctcaagcagctccaagagtcacaaactagcggtgatgtgaaagtggaggaaaagctggacaaggttatcgcaggcaccattgatcagaccacaggagaggtgctgagcgtctttcaggcagtgctgcggggactcatcgactatgacacaggcatccgacttttagagactcagctgatgatatcagggctgatttctcccgagcttagaaaatgctttgatttaaaagacgcaaagagtcatggcctgatcgacgagcagattctatgccaactcaaagagctctcaaaagcaaaagaaataatctctgccgcttctcccacgaccattccagtgttggatgccctggctcagtccatgattactgagagcatggctatcaaagtgctggagatacttcttagcaccggctcactggtgatcccggctacgggtgaacagttaaccttgcagaaagccttccagcaaaatctggtttcatctgcgctgttcagtaaggtgctagagcgccagaatatgtgtaaggaccttattgatccttgcacatctgaaaaggtcagcctaattgacatggtacagcgcagcaccttgcaggaaaacaccggcatgtggcttcttcccgtgaggccgcaggaagggggacgcataacgttgaagtgcggcagaaacataagtattttgcgagcggctcacgagggccttattgaccgtgaaacgatgtttcgtctgctctctgcccagctgctgtctggtggcctcatcaattcaaattcaggacagagaatgaccgtagaggaggctgtgcgtgagggagtgatagatagagataccgcctctagtatcctcacataccaggtccaaacaggaggcattatccagagcaacccagcgaagaggctaactgtcgacgaggcagttcaatgtgacctgattacaagctcctccgctttattggtgctcgaggcacagcgcggttatgtaggcctgatctggccacattctggtgagatctttccaacctcgtcctcattgcagcaggaattgataacgaacgagttggcttacaaaattctcaacggtcgccagaaaattgctgccctctatatcccggagagcagccaggtgattgggctagacgccgctaagcagctaggtattatcgataataatactgcgtcaattttgaaaaatatcaccttgcctgacaagatgccagatctcggggatcttgaggcctgcaaaaatgcccgtcggtggctgagtttctgtaaattccagcccagcactgtgcacgactaccgccaagaagaagacgtgtttgacggtgaggagccggttaccactcagacatccgaagaaacgaaaaagctgttcctgtcctacctcatgattaattcatacatggacgcaaacaccgggcaaaggctcttgctgtacgatggagacctggacgaagccgtgggcatgctccttgaaggctgccacgccgagttcgatggcaatactgctattaaggagtgtttagacgttctatcctcctcaggcgtgttccttaacaacgcctctggaagggagaaggatgagtgcacggccacaccttcaagttttaataagtgccattgtggtgaaccagagcatgaggagactcctgaaaaccgcaagtgtgcaatcgacgaggagtttaacgagatgcgaaatacagtgataaattccgaattttcccagtcagggaagctcgcaagcacgatttcaattgacccgaaggtcaacagtagcccttcagtgtgcgtccccagcctgatctcttatctgacccaaactgagctggcagatatctcaatgctcagatcagattcagagaatatcctcactaactacgagaatcagtcaagggtggagacaaatgaaagagcgaatgaatgctctcactccaagaatattcagaacttcccctctgatttgattgagaaccctatcatgaagagtaaaatgtctaaattttgtggagttaacgaaaccgagaacgaagataatactaatcgcgactcaccaatcttcgactactcaccgaggctgtctgctctgctgtcccatgacaagctgatgcactctcagggctcctttaatgacacgcacactccggaaagcaacggtaataagtgcgaagcccctgctttatcttttagtgacaaaactatgctcagtggacagcgcattggcgagaagtttcaagaccagttcttagggattgccgctatcaacatatccctccctggcgagcagtacggccagaaatctctcaacatgatcagttccaaccctcaagttcagtatcacaatgacaagtatatttccaatacttcgggggaggatgagaagacccaccctggtttccaacagatgccagaagacaaggaagacgagtcagaaatcgaagagtacagttgtgctgtcacacctggcggagatacggataatgctatagtcagcctaacctgtgccacccccctcctggacgaaactatctccgcgtcagactacgagacctccctccttaatgaccagcagaacaataccggaacagatactgactccgacgatgatttctatgatactcccctgtttgaggacgacgatcacgattccctgctcctggatggagatgatcgagactgtctgcacccagaagattacgacacactgcaagaagagaacgatgagacagcctctcctgctgacgtgttttatgatgtgtccaaggaaaacgagaactccatggtccctcaaggcgctcccgtagggtccctgtctgtcaagaacaaggcccactgtctgcaggacttcctgatggacgtggaaaaagacgagctggatagcggggaaaaaatccatctgaatccggtgggcagcgataaggtcaatggtcagagtctggagacgggatctgaacgagaatgcacaaacatactggaaggcgatgaaagcgacagtctgacggattacgatattgtgggtggaaaagagtcctttacggctagtctgaagttcgatgactccggcagttggcggggaaggaaggaagaatacgtaacaggccaagagttccactctgacaccgatcaccttgactccatgcaaagtgaagaaagctacggcgattatatttatgactcaaatgaccaggacgacgatgacgatgacgggatagatgaagagggagggggtattcgagatgagaatggaaagccccgatgccagaatgtggccgaggacatggacatacagctctgtgcatctatattgaacgaaaacagcgatgagaacgagaacatcaacaccatgatccttctggacaagatgcactcctgcagcagcctcgaaaaacagcagcgcgtgaatgtagtgcagctcgcctcacccagtgagaacaatctcgtgactgaaaagagcaatttgccagaatacacaacggaaattgctggtaaatcaaaggaaaatctgctgaaccacgaaatggtgctgaaagacgttctgccgcctatcattaaagacactgagtcagaaaaaaccttcggtccagcgagtattagccatgataataacaacattagttccacatctgaactgggcacagacctggccaacaccaaggtcaaattgattcaaggaagtgagctgccagaattaactgacagtgtcaaggggaaggacgaatactttaaaaacatgactccaaaagtggacagtagtttagatcacatcatttgcaccgaaccagatctaattggcaagcccgcagaggagagtcacctctcactcatcgcttccgtgactgacaaggatccccagggcaacggctctgacctgataaagggcagagacgggaagagtgacattctgatagaggacgaaacttcaatacagaaaatgtatctcggcgagggtgaggtgctggtcgaggggctcgtggaggaggagaatcgtcacctgaaacttttaccgggaaaaaatacccgggactcgttcaaacttatcaacagccagttccccttccctcaaatcaccaacaacgaggaactaaaccagaaagggtctctaaagaaggccacagtcacattaaaagacgagcctaataacctgcagattattgtatctaaatccccagtacaatttgagaacctggaggagatttttgatacatcagtaagcaaggagatctctgacgacatcacatcagacatcacttcttgggaggggaacacccactttgaggaatcattcacagatgggccagagaaggagctcgacttatttacatacctgaaacactgtgccaaaaatattaaggctaaggacgttgcgaagccaaatgaggacgtgccatctcatgtactgataacagctcctcctatgaaggagcatctccagcttggcgtgaacaataccaaggaaaagagtacaagtacacagaaagattcccctctgaatgacatgatccagtctaacgacctgtgttcaaaagagagcatctcaggaggtgggacagagatctctcaattcaccccagaatcaatcgaggccacgctatccatcctgagtcgcaaacacgtagaggatgtgggcaaaaatgatttcttacagagtgaaaggtgtgcgaacggtctcgggaacgacaattcgtctaacacattgaatacagactatagcttccttgaaattaataataaaaaggagcgcatcgaacagcagctcccaaaggagcaggccctgagtccgagaagccaggagaaagaggtccagatcccagagctgtcacaggtgtttgtggaggacgtcaaggatatcctaaaatctcggttaaaggagggacacatgaaccctcaggaggtggaggagcctagtgcttgtgcagatactaaaatcttgatccagaatcttataaaacgaatcaccacctctcagcttgtcaatgaagcctctacagtcccatcagattcccagatgtctgactcctcaggggtctctcccatgactaattcatccgagctcaagcctgagagccgggacgatcctttttgcattgggaacctcaagagcgagctgctgctgaatatcctgaaacaggatcaacatagccaaaaaattaccggggtgttcgagctgatgcgtgaattgacacacatggagtacgatctcgaaaagcgcggaatcacctccaaggtgctcccactccagctggagaacatattctataagctcttggcagatggttactctgaaaaaattgagcacgttggagacttcaaccagaaggcttgctccacctccgagatgatggaggaaaagccgcacattttgggcgatattaaatcaaaggaggggaattattatagccctaatctcgagacggttaaggaaatcgggctggagtcctctactgtctgggcttcaaccttacctagggatgaaaagttgaaagatctgtgtaatgactttccttcccaccttgaatgtacatccggctccaaggagatggccagcggtgactccagtactgaacagtttagctcagaattgcaacagtgccttcagcacaccgagaagatgcatgagtatctgactctgctccaagacatgaagccccctctggacaatcaggaatcgttagataacaatctggaggcactgaagaatcagctgagacaactggaaacctttgagctgggtctagcccctattgcggttatcctgaggaaagatatgaagctagctgaggagttcctgaaatccctgcccagtgactttccgcgagggcatgtggaagaattgagtatcagccatcagagcctgaagacagcttttagttccttatccaatgtttcctctgaacggaccaaacagataatgctggccatcgattctgaaatgtccaagctcgcagtgtctcacgaggagtttctccacaaactgaagtctttctcggattgggttagcgagaagtccaagtctgtgaaggacattgagattgtcaatgtccaagactccgagtatgtaaaaaagcggcttgagtttctcaaggcgaataacgtgctcaaggacctgggacataccaagatgcagcttgaaaccactgctttcgacgttcagtttttcatatcagagtatgcccaggatctgtcccccaaccagagcaagcaactgcttagattgctcaatacaactcagaagtgcttcttggatgtccaggagtcggtaaccactcaagtggaacgactcgagacccagctgcatctagaacaagacctggatgaccaaaagattgtggccgagaggcagcaagagtacaaggagaaactccaagggatctgcgatctcctaacccagactgaaaacagattaattggtcaccaagaggccttcatgatcggtgacggaactgttgagctcaaaaagtaccagtcaaagcaagaggaattacaaaaagacatgcagggcagtgcgcaggcacttgcagaggtggttaaaaatacagagaactttctgaaagagaacggggaaaagctttctcaggaggacaaggccctgatagagcaaaagctgaatgaggcgaagatcaaatgtgagcagctgaaccttaaagccgaacagagtaagaaagaattggataaggtcgtgacaaccgccatcaaagaggaaacagaaaaggtcgctgctgtgaagcagctggaagaaagcaagaccaagatcgaaaatcttttagactggttgtcaaatgtggataaggatagtgagcgggcaggtaccaagcataagcaggtcatcgagcagaatggtactcactttcaggagggtgacggtaaaagtgctattggagaagaggacgaggttaatggaaatctgctggagactgatgtagatggccaggtgggtactacacaggagaacctcaatcagcagtaccagaaggtgaaagcgcagcacgagaagatcattagccaacaccaagccgttattattgctactcagtccgcgcaggtcctgttagagaagcaagggcaatatctgagccccgaggaaaaggagaagctgcagaagaacatgaaggagttgaaagtccattacgagaccgcactggccgaaagcgaaaaaaagatgaagttaactcacagcctgcaggaggaactggaaaagtttgacgctgattataccgagttcgaacactggcttcagcagagtgaacaggagctcgagaacttggaggccggagcagatgacattaatggactcatgacaaagttaaagcgtcagaaaagcttctcggaggacgtgatttcccacaaaggcgatctgcggtatatcacgatatcgggtaatcgcgtcctcgaagccgctaaaagttgttccaagagagatggagggaaggtggatacatcagccacccacagagaggtgcagagaaagctggatcacgctactgaccgcttcaggtccctttattcaaaatgcaatgtcctcgggaataatctcaaagatttggtagacaagtatcagcattacgaggatgcaagttgtggactcctcgccggattacaggcctgcgaggccactgcttctaaacacctttccgaacctatagccgtggaccccaagaacctccagcgacagctcgaggagacaaaggccctgcagggacagatatcctctcaacaggtggccgtcgaaaagttgaagaagacggcagaggtcctgctggatgcccgaggatcattgctccccgcaaagaacgacattcagaaaacactcgacgacattgtggggcgatacgaagatctgagtaaaagtgtcaatgagagaaacgaaaaactacaaattacactcacgcgctctctgagcgtgcaggatggcctggacgagatgctggattggatgggcaatgttgagtcaagtctgaaggagcagggacaagtacctttgaatagcacggccctccaggatatcatctcgaagaacataatgctcgagcaggacattgcgggaagacaatcctccataaatgccatgaacgagaaggttaaaaagttcatggaaacaaccgaccccagtacagcaagctctctgcaggccaaaatgaaagatctttctgcacgtttctcggaggctagccataagcacaaggaaacgctggcaaaaatggaggaactgaaaacaaaagtggaactattcgagaatctgagcgaaaagctccagacgttcttagaaactaaaacgcaagcactgaccgaggtggacgtccccggtaaggacgtcaccgaactctcccagtacatgcaggagtcgacctctgaatttctggagcacaaaaaacatctcgaggttctccactctctgttaaaagagatctcatcacatggtcttccaagtgacaaagccctggtgttggaaaagaccaacaacctctccaaaaagttcaaagagatggaggacaccatcaaggaaaaaaaggaggctgttacgagctgccaagaacagctcgacgcatttcaagtgctcgtgaaaagcctcaagagctggatcaaggagaccactaaaaaggttcctattgtgcagccatcctttggggcagaggacctggggaaatcactggaggacactaaaaagttgcaagagaagtggagcctgaaaacaccagaaattcagaaggtaaacaactccggaatatccctctgtaacctaatctcagcggtgactacacctgcaaaagctattgcggcagtgaaatccggtggcgctgtgctaaatggcgagggcacggccaccaacactgaggaattctgggcaaacaaaggtctgacatccatcaagaaggatatgacagacatttctcatggatacgaggacttgggcctgcttttgaaagataaaatcgcagaactgaacactaaacttagcaaattgcagaaggcccaggaggaatctagcgccatgatgcagtggctgcaaaaaatgaacaagaccgccaccaaatggcagcaaacacccgctccaacggacaccgaggctgtcaagacgcaggtggaacagaataaatctttcgaggcagaacttaaacagaacgttaataaagtacaggagttgaaggacaagcttactgaattactggaagaaaacccagacacacctgaagcgccacgctggaaacagatgctgactgaaattgactctaaatggcaagaactcaaccagctgacgatcgaccgacagcagaaactggaggagagttccaataatcttacacagtttcagaccgtcgaagcccagttaaagcagtggctcgtggaaaaagaacttatggtaagtgtgctgggccctttaagcattgatcctaatatgctcaatacacagcgtcagcaggttcagatccttctccaggagttcgctacgaggaagccgcagtacgagcaattaactgcagccggtcagggcatactctctcgtccaggcgaggatccctcgctgcggggaatcgtgaaagagcaactggctgcggtcacccagaaatgggacagcctgaccggccagctctcagaccgatgcgattggatagaccaggcaatagtgaagagcacacaatatcagagcttactgcggagcctctccgacaagctcagtgacttggacaacaagctgagtagctcactagctgtgtccacacaccctgacgccatgaatcagcaactagagacagcacagaagatgaaacaggagatccagcaagaaaagaagcaaatcaaagtcgcacaggccctctgcgaagaccttagcgccctcgtaaaagaggaatacctcaaggcagagctgtctcgacaactggagggtattctaaagagctttaaggacgtcgagcagaaagctgaaaaccacgtccagcacctccagagtgcctgtgcatcttcacaccaatttcaacagatgtcccgggactttcaagcttggctggataccaagaaggaggagcagaacaaaagccaccccatcagtgccaagctggatgtcttagagagtctcattaaagatcataaagacttttcaaaaacactcactgcccagagccatatgtacgagaaaacaatagcggaaggagaaaatctgctgctgaagactcagggatcagaaaaggcagctctccagctgcagctcaatacaatcaaaaccaattgggacacatttaataagcaagtgaaagaacgggaaaacaaactcaaggagtcgctggagaaggctcttaagtacaaagaacaggtggagactctgtggccttggatagacaagtgtcagaacaatctggaggagattaaattctgtctggatcctgcggagggcgaaaatagtatcgccaaacttaaaagtctgcagaaggagatggatcaacactttgggatggtggaacttttgaataataccgccaactctctcctgagcgtctgtgagatcgataaggaagtggtcaccgacgagaacaagagtctgatccagaaggtggacatggtaaccgagcagttgcacagcaaaaagttctgtctggagaatatgacccagaaatttaaggagtttcaggaggtgtctaaggaatcaaaaagacagctgcagtgtgccaaggagcagcttgacatacacgacagcttgggcagccaggcctattctaacaaatacctcactatgctgcagacccaacagaaaagtctgcaagcactgaaacaccaggtggatctggccaaacgcttagctcaggacctggtcgtggaggcaagtgattccaaaggtacatccgacgtgcttctccaggtggaaacaattgcacaggagcactcgacattgtcccaacaggttgatgagaaatgtagttttctggagacaaagctccaggggatcgggcattttcaaaacacaatcagagagatgttttcccagttcgcagaattcgatgacgaacttgattctatggcacctgttggaagggatgcagaaacactgcaaaagcagaaagagaccatcaaagccttcttgaagaagctggaggcattaatggccagcaatgataatgctaataagacctgcaagatgatgcttgctaccgaggagactagccccgaccttgtaggcattaagcgtgatctggaagctttatcaaaacagtgcaataaattgctggacagagcccaggccagggaagagcaggtagagggcaccatcaagcggctcgaagagttttactcaaagttgaaggagttcagcatcctcttgcagaaggccgaggagcacgaagagtctcagggccctgtgggaatggaaactgagacaatcaaccagcagcttaacatgttcaaagtgtttcagaaagaagaaattgaacccctgcaggggaagcaacaggacgttaattggctgggccagggacttatccagtcagcagcaaagtctacatctacacagggtttggagcatgacctggacgacgtgaatgcacggtggaagactttgaacaagaaggtggcccaacgggcagctcagttacaggaggccctgctccactgtggtcggttccaagacgccctggaaagcctgctgagctggatggtcgacacagaagagctcgtggctaaccagaagcctcccagcgcggaatttaaggtggtcaaggctcagattcaggagcagaagttgctgcagcgcctgctagacgaccgaaagtccactgtggaagtcatcaagcgtgaaggcgagaaaattgctaccacagccgaacccgctgacaaagttaagatccttaaacaactgtctttgctggactcgcgttgggaggctctactaaataaagcagagacgagaaaccgccaactggagggcatatctgtggtggcacagcagttccacgaaactctggagccactcaacgaatggctgaccaccattgagaagcggcttgttaattgtgaacccattggaacccaggctagtaagctggaagagcaaatagcccaacacaaggcgctcgaagatgacatcattaatcacaacaagcatctgcaccaggcagtttcaatcggacagagtttaaaagtgctctctagcagggaggataaggatatggtacaatctaaattggatttcagtcaggtctggtatatcgaaattcaggagaagagtcactcaaggagcgaactcctccagcaggcgctctgcaacgctaagatcttcggagaagacgaagtggagttgatgaactggctgaatgaagtgcacgacaagctgtcaaaactgtccgtccaagattacagcacagagggcctgtggaaacagcagtccgagctgcgggttctgcaggaggatatccttctccggaagcaaaatgtagatcaggcactcttgaatgggctggagctcctcaagcagaccaccggggatgaggttctgatcattcaggataaactcgaagccataaaagcaaggtataaagatatcactaagctgtcgacggatgtcgccaaaactctggaacaggcattgcagctagcgagacgccttcattcaacccatgaggaactctgtacatggctcgacaaagtggaggttgaactgttaagctacgaaacccaggtactcaagggagaggaagcctctcaggcgcagatgcgacctaaggagctaaagaaagaagccaagaacaacaaagcccttctcgactctcttaatgaagtatccagcgccttgctggagcttgtcccgtggcgggctagagaggggctggaaaagatggtggctgaggacaatgagaggtacaggctggtgtcagacacaatcacacagaaggtggaggagatcgacgcagccatcctcaggtctcagcagttcgaccaggccgctgatgccgaactcagctggatcaccgagaccgagaagaaactcatgtcgctgggcgatatcagactggaacaagatcagacgtcagcgcaactccaggtccaaaaaacctttacaatggagatactgaggcacaaggacattattgacgacctggtcaaatccggccacaaaattatgacagcttgttcagaagaagaaaaacagtccatgaagaagaagctggataaggttctgaagaactatgacaccatctgccagataaactcagagaggtacttgcagctggaacgcgctcagagcctggtgaaccagttctgggaaacatacgaagaactgtggccctggttgacagagacccagagtatcataagccagctgcccgctccggctctcgagtacgagacactgcggcaacagcaggaggaacatcggcagctcagagaactcatagctgagcataagccacacatcgacaagatgaacaagacgggtccacagttgttggaactgtcacccggagagggcttcagtatacaggaaaaatacgttgctgccgacaccctttattcccagatcaaagaggatgttaaaaaacgcgcagtcgcacttgatgaagccatctcccaaagtacacaattccatgataagatcgaccagatcctggaaagtctggaaaggattgtggagcggctccgccagcctccctcaatttccgctgaggtggagaaaatcaaggagcagataagcgagaataaaaacgtgtctgttgacatggagaagcttcaacccttgtacgaaacattaaaacagcgcggtgaagagatgattgctagatctggagggacagataaagatatctccgccaaggcggttcaggacaaactagaccagatggtatttatctgggaaaacatccacaccctcgttgaagaacgggaggccaagctccttgatgtgatggagttagcggagaagttctggtgcgatcatatgagcttgattgtaacaatcaaggacacccaagacttcatcagagacctggaggaccctgggattgacccttccgtggtcaagcaacagcaggaagccgcagagaccatcagagaggaaatcgatgggctccaggaagagttagacatcgtaattaacctcggaagcgagctgatcgccgcttgcggagaacccgataaacctatcgttaagaagtctattgatgaattgaattcagcctgggattcactaaataaagcgtggaaagaccggattgacaaacttgaagaagcaatgcaagcagccgtgcagtaccaggatggccttcaggctgtgttcgactgggtagatattgctggtggaaaattagcgtccatgtcgcccatcggcaccgatctagagactgttaaacaacagattgaggaactgaagcaattcaagagcgaggcttaccagcagcagatcgagatggagcggctaaatcaccaggcggagcttctattgaagaaagtgacagaagaatctgacaaacacacagtgcaggaccccctgatggaattgaagctcatctgggattctctcgaagaaaggatcatcaatcgccaacataagcttgaaggcgctctcctggctctgggccagttccagcatgcattggatgaattactcgcctggctcactcatacggagggactgctgagtgagcagaaaccagtgggaggcgaccctaaggcaatcgaaatcgaactcgcaaagcaccatgttctgcagaatgacgtgctcgcccatcagagcacagtcgaggctgttaataaggccggtaacgatctcatcgagtcgtccgcgggagaggaggcgtccaatttgcagaataagctggaagtgctgaatcagcggtggcagaatgtactggagaagaccgaacaacggaagcagcagctggacggagccctgagacaggctaagggctttcacggcgagattgaggacctccagcagtggttgaccgacactgaaagacacttgctggcctccaagccactcggcggattgcccgagaccgctaaagagcaactgaacgtccatatggaagtgtgtgctgccttcgaggctaaagaagagacctacaaaagccttatgcagaaaggccaacaaatgctggcacggtgcccaaagagcgccgagactaatatcgatcaggacatcaacaatctgaaagagaagtgggagagtgtcgaaaccaagcttaatgagcggaagacgaagctggaggaagccttgaacttagccatggagttccataattcccttcaggatttcataaactggctgacccaagccgagcaaaccctgaatgtcgccagccgcccttccctgatactggacaccgtgttgtttcagattgatgaacacaaagtgttcgcaaatgaggtgaacagccatagggagcagatcattgagttggacaagacgggcactcacctgaagtacttttcccagaagcaggatgttgtccttattaagaatcttctgatatccgtgcagtcacgctgggagaaagtggtacagagactcgtagagcggggaaggtccctggacgacgcaagaaagcgagccaaacagtttcacgaggcatggtcgaaattgatggagtggctggaggagtccgaaaagtccctggattcagagctggaaatagcaaatgacccagataaaattaaaacccagctcgcccagcacaaggagtttcagaaaagccttggtgccaagcatagcgtttacgacacgactaatcgcactggccgaagtctgaaggagaagacatccctggcggacgataacctaaagctggacgacatgctgtctgaattgagagacaagtgggacacaatttgtggcaaatccgtggagcggcagaacaaactggaagaggctctgctcttctccgggcaattcaccgacgccctgcaggcccttatagactggctctacagggtggagccccagcttgccgaggaccagcccgttcatggggacatcgatttggtcatgaacctcatagataatcacaaggcctttcagaaagaactgggcaaaaggacatctagtgtgcaggcactaaagcgctccgcccgtgagcttatagagggctcgagagatgacagctcttgggtgaaagttcagatgcaggagctctctaccagatgggaaacagtatgcgcattaagcattagtaaacagacccggctggaggccgctctgagacaggcggaagaatttcattctgtcgtgcatgccctgctagagtggctggctgaagccgaacagactttgagatttcatggcgtgttacccgacgacgaggacgctcttcggacacttatcgatcaacataaggagttcatgaagaaactcgaagagaagagggccgagctcaacaaggcgactactatgggcgatacagtactggctatctgccaccccgattcaatcacaacaatcaaacattggatcaccattatcagagcccgtttcgaagaggtgttggcctgggccaagcagcaccagcaaaggcttgcgagtgcccttgccggactgatagctaagcaggagttgctggaggcacttttggcctggctccagtgggctgaaacaacactgacagataaggacaaggaggtgatcccccaggagatcgaggaggtgaaagccctcattgccgaacaccagacatttatggaagagatgactcgcaagcagcccgatgtggataaggtaaccaagacatacaaaaggcgggctgccgacccttctagtcttcaaagccatatacccgtgcttgataaggggcgagccggaaggaagagattcccagccagcagcctgtaccctagcggcagtcaaactcagattgagactaaaaaccccagagtcaacctgctcgtcagtaaatggcaacaggtttggctcctagctcttgagagacggcgaaaactgaatgacgctctcgaccggctggaagagctgagggagttcgccaatttcgacttcgatatttggcgcaagaaatatatgagatggatgaaccataagaagagtagagtaatggactttttccgcaggatcgacaaagatcaggacggcaagataacgagacaagagttcatcgatggcattctgtcgagtaagttccctacaagtagactggaaatgagcgcggtcgcagacatatttgatcgcgacggggacggatacatcgactactacgagtttgttgctgctctgcaccccaacaaggatgcgtataagcccattactgatgccgacaagattgaagacgaagtgacgagacaggtggctaagtgtaagtgcgctaagagatttcaggtggagcaaattggggataacaagtatagagtgtcgttccagagcaatttcggcgactctcaacagttgcgcctggttcgtattctgagatcaaccgtcatggtccgcgtgggagggggttggatggcgttagacgaattcctggtcaaaaacgatccttgccgtgtgcaccatcacggctctaagatgctgcgttctgagtcaaactcaagcataaccactactcagcccacaatcgccaaaggccgaactaacatggagttgcgagaaaagttcatattggctgatggtgcctctcaaggcatggcagccttccgtccacgcggtaggcggtcacggccatcctcccggggagcctcaccaaatagaagcacttccgtgagcagtcaagcggctcaggccgctagtccacaagtacccgctacaaccaccccaaagggcacaccaatccagggtagcaaactgcggctgcccggttatctgagcggcaagggtttccacagtggggaagactctggcctcataaccaccgccgctgccagagttaggacacagtttgcggattccaaaaagaccccttcgaggcctggcagcagggctgggtccaaggctgggtcaagggcctcatcccggagaggcagtgatgctagtgacttcgatattagcgaaatccagagtgtgtgttctgatgtagagactgtgcctcagactcacagaccaacacctcgtgccggtagccgacccagtacagcaaaacctagtaagatcccaactccacagagaaagtcacccgcttctaagctggataaatcttcaaagcgctac

SEQ ID NO: 221516 - DNA, 768 bp, Artificial Sequence
  Description of Artificial Sequence: Synthetic coding sequence
atgaataaaaccggacctcagttgcttgagttgagcccaggcgaggggttctcaatacaagagaagtacgttgcagccgatacactatactcccagattaaggaggatgtaaaaaagcgtgccgtggctctggatgaagctatttcacagagcacccaattccacgataaaatcgatcagatactggagtccctcgaacgaatcgtggagcggttgcgacaaccgccatccatttctgcagaggtggaaaagattaaggagcagatcagtgaaaataagaacgttagtgtggacatggagaagcttcagcctttgtatgagaccctgaagcagaggggcgaagagatgatcgctagaagcgggggaactgacaaagacattagcgcaaaggcagtgcaggataagcttgatcagatggtcttcatatgggaaaacatccatactctggttgaagagagagaggccaagttgctggacgttatggaactggcagaaaaattttggtgtgaccacatgagtctcatagtcacgattaaggacacacaggatttcatcagggatctcgaggacccagggatcgatccatcagtggttaaacaacagcaagaagcggctgaaacaatccgtgaagaaattgatggattgcaagaagaactggatatagtaataaacctgggatccgagctgattgctgcttgtggggaacccgacaaacctatagtgaaaaaaagcattgatgagctgaactctatgggcttcagtaagtag

SEQ ID NO: 221517 - DNA, 1359 bp, Artificial Sequence
  Description of Artificial Sequence: Synthetic coding sequence
atgtttccagatcagcccgaaaagcccctgaatttggctcatattgtgcctccaagacccgttaccagcatgaatgacaccctgttcagtcacagtgtaccatcaagtgggtccccatttattactcgtcgactaccagagggtatatccgcttcatcacctgtggcggaagagcattctctcataaagctttacgtgaatcaactggaccatggtgccaggtctccacccaaggactcggaggtggagcagaacaaactgttggccagagccgctcctgcttttctaaagggtaaaggaatccagtattccctaaatgtcgctgatcgcctggccgacgagcacgtcctcatcggcctgtacgttaatatgctgagaaacaatcctagttgtatgctggagagttcaaacaggcttgatgaagagcacagactgatcgccaggtacgccgcaagattagccgcagagagttcaagctcacaacctccacagcagcgcagcgcgccagatattagtttcacaatcgacgctaataagcaacagcggcagcttatcgctgaactagaaaacaaaaatagggaaattctccaggagattcagcgattgcgtctggagcacgaacaggcgtcacagccgacccccgagaaagcccagcagaatcctactctactggctgagctgagattgctacgccaaagaaaagacgaactggagcaaagaatgagcgcgctgcaagaatctagacgagaacttatggttcagttagaaggccttatgaagcttctgaaaacgcagggggcaggcagtcccaggtcatcacccagccacacaattagtaggccgattcctatgccaataaggtctgcaagtgcttgttccactcctacccacaccccacaggattctctcactggcgtgggaggggacgtgcaggaggccttcgctcagagttcacgacgcaatttgaggaatgacctgctagttgctgccgactctattacaaacaccatgtcatcactggtgaaagaacttaattccgaggtgggcagcgagactgagtccaacgtagacagcgagttcgctaggactcagttcgaagatttggtgccttcaccgacctcagagaaggcgttcttggctcaaatccacgcgagaaagcccggttatattcactctggcgcaaccacgtccactatgaggggggacatggtcaccgaggatgcggacccgtacgtgcagccggaggacgagaattacgagaatgacagcgtacggcagctggaaaacgagctccagatggaagaatatctaaagcagaagctccaggatgaggcctatcaagtatcactgcaggggtag

SEQ ID NO: 221518 - DNA, 1116 bp, Artificial Sequence
  Description of Artificial Sequence: Synthetic coding sequence
atgatcgaggacagtgggaagaggggcaacaccatggctgagagacgccagctgttcgctgagatgcgggctcaagatcttgacaggatcagattatccacctatagaaccgcctgcaaactccgattcgtgcaaaaaaaatgcaatctgcacctggtagatatttggaacgtgatcgaggcccttcgcgaaaacgctctgaataatcttgatcctaacacagagctcaacgttagcaggctggaggccgtgttatccaccatcttttatcagcttaataaacggatgccaactacccaccagatccacgtagagcagagcatcagcctgctcctgaacttcttactagctgccttcgacccagagggacatggcaaaatttccgtgttcgctgtgaaaatggcgctcgcgacactgtgtggtgggaagattatggataaactccgttacattttcagcatgatatcagactcctcaggcgtgatggtctatggtagatatgaccaattcctgagggaagtcctgaaacttcccactgcggtattcgagggtccgagcttcggatacaccgagcagtccgcgcgaagctgcttcagccagcagaagaaggttaccctgaatgggttcttagacacactcatgagcgatccccctccacaatgtctcgtctggcttccacttctacaccggttagcaaatgtggagaacgtcttccatccagtggaatgcagctactgtcacagcgaatctatgatgggtttcaggtatcggtgtcagcaatgccacaactaccagctgtgtcaagactgcttctggcgtggccatgccggaggttcccattcaaatcagcaccagatgaaagaatatacaagttggaagtcccccgcaaaaaaattaaccaacgcgctctccaaatcgcttagctgcgcatccagcagagagccactccatccaatgttccctgaccaacccgaaaaacccctgaatctggctcacatcgttccgcctcgcccagtgacatccatgaacgataccttgtttagtcactccgtgccgtcatccggctcaccatttatcaccagaagcagcgacggggcatttggcggatgcgtgtag

SEQ ID NO: 221519 - DNA, 1188 bp, Artificial Sequence
  Description of Artificial Sequence: Synthetic coding sequence
atgttccccgaccagccagaaaagcccctgaacctggcacatattgtcccacccagaccagtgacttctatgaatgatacactctttagtcacagcgttccctcctcagggtctccttttattacacggaggctgcctgaaggtatatcagcttcatcacctgtagcagaggaacatagtttgatcaagctttatgtaaatcaactggatcatggggctagaatgctggagagctccaatcgactggacgaggaacaccggctcatcgcacggtatgcagcaagactagcggcagagtcatcctcatcacagccccctcagcaaagaagcgccccagacatcagctttacaatagacgccaacaagcaacagaggcaactcatcgccgagcttgagaacaagaatcgcgagattttgcaggagattcagcggctaagactcgaacacgagcaggcctcacagcctaccccggagaaggcccagcagaatccaactctgcttgcagaactgcggctgctccggcaaaggaaagacgagttggaacaacgcatgtccgcactacaggagtccaggagagaactgatggtccagctggaaggtctcatgaagctgttaaagacccagggagctgggagtccaaggagcagcccttcccacaccatctccagaccaattcctatgcccattaggtcagcatctgcatgtagcacccccacacatactcctcaggattcactcaccggcgtggggggtgacgtgcaggaggcattcgctcagagttctcgtcgcaacctgagaaacgatcttctcgtggcagcagatagcataacgaacaccatgagctcactcgttaaggagctgaattccgaagtcggctctgaaacggagagcaacgtcgattccgagtttgcgaggacacagttcgaagatcttgtgccttctccaacaagcgaaaaagcattcctcgcacagatccacgctcgaaagcctggctacattcactctggagctacaaccagcaccatgcggggtgatatggtaaccgaggatgccgatccctatgtccagcccgaggacgaaaactatgagaatgactccgtgagacagctggagaacgaactccagatggaagagtatctgaagcagaagttacaggacgaggcatatcaagtatccttacagggttag

SEQ ID NO: 221520 - DNA, 2175 bp, Artificial Sequence
  Description of Artificial Sequence: Synthetic coding sequence
atgatcgaagatagcggcaagagagggaatacgatggctgagcgcaggcagttgttcgcggaaatgcgagcacaggatctagaccggatccggctgtctacctacagaacagcatgtaagctgagattcgtccagaagaaatgtaatctgcacctggtagatatttggaatgtcatcgaggccctgcgtgaaaatgcactcaataatctggatcctaataccgagctaaatgtgagccgcctagaagccgtcctttccaccattttctatcaactcaataagcgcatgcccaccacacaccaaatccacgtggagcagtctatcagcctgcttctcaatttcctgcttgccgcatttgatccagagggccacggtaagatctctgttttcgccgttaaaatggctctggctactctctgtgggggaaagattatggacaaactccgttatatcttcagtatgatcagcgattccagtggcgtgatggtgtacggcaggtatgaccaatttcttcgcgaggtgttaaaactgcctactgccgtgtttgagggtccttctttcggatatacagagcagagcgcaaggagctgtttctctcagcagaagaaagtaactttgaacggattcctcgataccctcatgtccgatccaccaccacaatgtctggtatggcttccactgctgcatcgtcttgccaatgtagagaacgtgtttcaccccgtcgagtgctcctattgtcactcagaatcaatgatgggctttcgttacaggtgccaacagtgtcacaattaccagctgtgtcaagactgtttctggaggggacatgccggtgggtctcattctaatcagcatcagatgaaggaatacacgagttggaaaagtccagcaaagaaactgacgaacgccttgtcaaaaagcttgagttgtgctagctcacgggagccccttcatccaatgttcccagatcagccagagaaacctctgaatttagcgcacatcgtcccccctcggccagtcaccagcatgaatgacaccttgttttcacactccgtgccctcaagtgggtcccccttcatcaccaggagcatgctcgaatcaagcaacaggttagatgaagagcatcggctcatagcaagatatgccgcaagactggcagcagaaagttcctcgtctcaaccacctcagcagcgcagcgcacctgacattagttttaccattgacgctaacaagcagcagcggcagctcattgccgagctagagaataaaaaccgtgagattctgcaggagatccagcgcctcagactggagcacgaacaagcaagtcagcccacacccgagaaggcccagcaaaatcccaccctcctggccgagctgcgactacttcgacagagaaaggatgaattggaacagcgaatgagcgccctgcaagagtcacggcgtgagctgatggtgcagctcgaaggcttgatgaagcttctgaagacccagggagccggatctcctagatctagtccgtcgcacactatctccagacccattcctatgccaatccgttcagcatcagcctgttctacgccaacccatacacctcaggattctcttaccggagttgggggagacgtacaggaggcctttgctcagtcttctagacgcaacttgagaaatgatctcctggtggccgctgactcgatcactaataccatgtccagcctcgtaaaggaattgaactctgaagtcggcagcgaaaccgaaagcaatgtggactccgaatttgccaggactcagtttgaggatttagtgccgtcacctacatcagagaaagcctttctcgcccaaattcacgcgaggaagcctgggtacatccacagcggcgctaccacgtccactatgaggggggatatggtgactgaagacgcggatccatatgtccaacccgaggacgagaactacgaaaatgactctgtgaggcagcttgagaacgaactccagatggaagaatacttgaagcagaaacttcaggatgaggcctatcagctgcacgtctctaccgagactaggttggagcacccctgtcccgtctcggaaaccaagtggcgggtcctgttttggggtttcgtattctttggaggtttcctgagcctggcactccagatctacttctggggcctgttctag

SEQ ID NO: 221521 - DNA, 912 bp, Artificial Sequence
  Description of Artificial Sequence: Synthetic coding sequence
atgctggaaacacttcgcgagaggctgctgtctgtccagcaggacttcacgtctggccttaaaactttatccgataaaagtagagaggcaaaagtcaaaagcaagccgagaactgtgccctttctccccaagtattcggcgggattggaattattaagtagatatgaagacacctgggctgccctccaccggcgtgcgaaggattgtgcttcagctggagagctggtcgatagtgaggttgtcatgctctctgcacattgggagaagaagaagacatcgctggtcgagctacaagagcagctccagcaactcccagcccttattgcagatttagagtccatgaccgctaatctgacacaccttgaggccagcttcgaggaggtggagaacaacttgctgcatctggaggatttgtgtgggcagtgcgagctggagcggtgcaagcatatgcaatcacaacagctggagaattacaagaagaacaagcgcaaagagctcgagacctttaaggctgagttagatgccgagcacgcccagaaggttctcgagatggaacacacccagcagatgaagttaaaggaacggcagaagttttttgaggaggcctttcaacaagacatggaacagtatctgtctactggataccttcagatagccgaacgcagggaacctataggctctatgagcagcatggaggttaatgtcgatatgctagagcagatggaccttatggatattagtgatcaggaggcgctggacgtatttctgaacagtggcggagaggaaaatacagtgttgagccctgccttgggacgggtcgacaaattagctctggccgagcccggtcagtaccgttgtcatagcccgccaaaagttagaagagagaaccatctgcccgtgacctatgcttag

SEQ ID NO: 221522 - DNA, 1056 bp, Artificial Sequence
  Description of Artificial Sequence: Synthetic coding sequence
atgctcgaaaccttacgcgagcgactgctttcagtgcagcaggactttacaagcggcctgaagactctgtccgataaatctcgtgaggctaaggtgaagtctaaacctagaaccgtccctttcctccccaagtacagcgccggtctggaactacttagccgctatgaagatacctgggccgcactccaccggagagcaaaagactgtgctagtgcgggagagctggttgattccgaagtggtgatgttatcagcacattgggaaaagaagaagacctctttagtggaacttcaagagcagttacagcagttacctgccctcatcgctgacctcgaatcaatgacggcaaacttgactcacctcgaagcttcctttgaagaagtcgaaaacaatttacttcatctcgaagatctgtgtgggcagtgtgagcttgaaaggtgcaagcacatgcagtcacaacagttggagaattacaaaaaaaacaagagaaaagaactggaaaccttcaaagccgagctggacgccgagcacgctcagaaagttctggagatggagcacactcagcaaatgaagctgaaagaacggcagaagttcttcgaagaggcctttcaacaggacatggagcagtatttaagcaccggttatttacaaatagccgaacggagggaacccatcggaagcatgtcatcgatggaggtgaatgtggatatgctggaacaaatggatctgatggatatttctgaccaggaggcacttgatgtgttcctgaattcaggtggagaggaaaatacagtgctgagccctgccctggggccagaaagctcaacttgccagaatgagataaccctgcaagttccaaaccccagcgaattgcgcgctaagccacccagtagcagctccacatgcaccgacagtgctacccgggacataagcgagggtggtgaaagcccagtggttcagtcagacgaggaggaggtgcaggtggataccgcccttgctactagccataccgatagggaagccacgcctgacggcggagaagattcagactcatag

SEQ ID NO: 221523 - DNA, 1059 bp, Artificial Sequence
  Description of Artificial Sequence: Synthetic coding sequence
atgttagaaacgcttagagagcgactgctgtctgtacaacaggactttacctcgggcctaaaaacactcagtgataaaagccgcgaagctaaggtaaaaagcaaacctagaacagtaccctttctgcccaaatactcggctggactggaactcctttcaagatatgaagacacgtgggcggctctccacagacgggctaaagactgcgcctccgcaggtgagctggtggactcagaggtcgtgatgctgtctgcacactgggagaaaaaaaagacgtccctggtggagctacaggagcagcttcagcagctgcccgctttaatcgccgacctcgagagcatgactgccaacctcactcatctggaggcttcgttcgaagaagtagagaacaatctccttcacttagaggatctgtgtggccaatgtgagttagaaagatgcaagcacatgcagagtcagcagctggagaattataaaaaaaacaagcgcaaggaactcgaggtgacattccggtccgaactggatgcagaacacgcccaaaaggtcttggagatggaacacacacagcagatgaagctaaaagagcgtcagaagtttttcgaggaagccttccaacaggacatggaacagtaccttagcaccggctacctacagatcgccgaaagacgggaaccgattggtagcatgtcgtctatggaggttaatgtcgacatgcttgaacaaatggacctgatggatatatccgatcaggaagctttggacgttttcctcaattctggtggcgaggagaataccgtcttatcaccggctctgggtcccgaatcttcaacttgccagaatgaaatcactctgcaggtgccgaacccaagcgagctgagagccaaacctccttctagttctagcacgtgtactgatagcgcaacaagggacatctccgaaggaggcgagtccccagtggtgcagtcagacgaagaggaagtccaagtggatactgcgctggctactagccacactgatcgggaagctactcccgatgggggtgaagactcagatagttag

SEQ ID NO: 221524 - DNA, 813 bp, Artificial Sequence
  Description of Artificial Sequence: Synthetic coding sequence
atgctcagcgcgcactgggagaagaagaaaacctcactggtcgagctgcaggagcagctgcaacaattaccagccttgatcgctgacctggagtctatgaccgctaatcttacacatctggaagccagtttcgaagaagttgagaacaatctgcttcatttggaggacttgtgcgggcagtgtgagttggaacgctgtaaacacatgcagtcccagcagttagaaaattacaagaaaaacaagcgacggagattgaggaccttcaagactgaactcgacgctgaacacgcacagaaggtcctggaaatggagcacacacagcaaatgaagctgaaggagcggcagaagttcttcgaggaggcgtttcagcaggatatggagcagtatctgtccacgggctacttgcagatcgcggagagacgagagccaatcggtagtatgagctcgatggaggtgaatgtggacatgcttgaacagatggacctgatggacattagcgaccaagaagccctggacgtttttttgaacagcgggggtgaggaaaacactgtgctatcacctgcactgggacctgaaagcagtacgtgccaaaacgaaataacactgcaagttcctaatccctcagagctgcgggctaagcccccatccagctcctctacttgcacggactctgcaactcgcgatattagcgaagggggtgagtctccagtcgtccagtctgacgaagaggaagttcaagtggacacggccctggctacgtcgcacaccgatagagaggctactcctgatggcggagaggatagcgacagctag

SEQ ID NO: 221525 - DNA, 912 bp, Artificial Sequence
  Description of Artificial Sequence: Synthetic coding sequence
atgctcgaaaccctgcgagagaggttattaagcgtacagcaggactttacaagcggcctgaagaccttgtccgacaagagccgggaggctaaggttaaatccaaaccgaggactgtccctttcctgccaaagtactcagccggtctcgagcttcttagtcgctacgaggacacttgggcagccctgcaccggcgagccaaagactgcgcttctgcgggagaactggtggactctgaagtggtaatgctgagcgcccattgggagaagaaaaagacgtccttagttgagctgcaagagcagttacagcagctgcccgctctcatcgccgatttagagtcaatgactgcgaacctgacccatttagaggcctccttcgaggaggtggagaataatctattacacctcgaagatctatgcggacaatgcgagctcgaaagatgcaaacacatgcagtcgcagcagttggagaattataagaagaataaaagcaaggaactgggtaccggcaaggcggagctcgatgccgagcacgcccagaaagtactcgagatggaacacactcagcaaatgaagctcaaggaacgccagaagtttttcgaggaggcattccagcaagatatggaacagtacctgagcacaggctacctgcagatcgctgagcgacgagagccaatcggaagcatgtcatctatggaggtgaatgtagatatgctggagcagatggacttaatggacatctctgatcaggaggctctggatgtcttcctgaattcggggggagaggagaatacggtcctgtctccagcactgggccgagtggataaactcgcactggctgagccaggacagtataggtgtcattctccacccaaggtgaggcgagagaaccaccttcctgtaacctacgcatag

SEQ ID NO: 221526 - DNA, 135 bp, Artificial Sequence
  Description of Artificial Sequence: Synthetic coding sequence
atgttggagacattgagggagagactcctgtccgtgcagcaggacttcacctccggtctgaagaccttgtctgacaagtcccgcgaagccaaggtcaagagcaagcctagctggttgaaccaagaacaattttag

SEQ ID NO: 221527 - DNA, 627 bp, Artificial Sequence
  Description of Artificial Sequence: Synthetic coding sequence
atgctggagacactccgtgagagactgctgtctgtgcagcaggacttcacgtctggacttaaaactctttccgataagtcccgtgaggctaaggtgaaaagtaagccacgttatgaagatacatgggctgccctgcaccggagagctaaagactgcgcctcggccggagagttggtcgatagcgaggtcgtgatgctcagcgcacattgggaaaagaagaagacatcattagtggagctgcaggaacagctgcagcagcttccggcactgatcgcagacttggagagcatgaccgccaacctcacccatctggaggctagtttcgaggaagtggaaaacaatctcctgcatctggaggacctctgtggacagtgtgaattagagagatgcaagcacatgcagtctcagcagttggagaactataaaaagaataagcgcaaggaactggagaccttcaaagcagagctcgatgcggaacacgcacagaaagtgttggagatggagcatacccagcaaatgaaactgaaggaacggcaaaagtttttcgaggaggcgtttcaacaggacatggagcagtacctttctactggataccttcagatcgctgaaaggagaggggatccctag

SEQ ID NO: 221528 - DNA, 2235 bp, Artificial Sequence
  Description of Artificial Sequence: Synthetic coding sequence
atgattgaggacagcggcaaacggggaaatacaatggccgaacgcagacaactgttcgccgagatgcgggctcaggacttggaccggattagactttccacctacagaacggcttgcaaattaagatttgttcagaagaaatgcaatctgcatttggtggacatttggaacgtgatcgaggccctgagagagaacgcactgaataacctcgatcccaataccgagcttaacgtgtcccgtctggaggctgtcctgagcaccatattttaccagctgaacaagaggatgccaactacgcatcagatccacgtggaacaaagcatttcattgcttttgaacttcctcctcgccgctttcgacccagagggacatgggaagatcagcgtctttgcggtcaagatggcccttgccactctctgcgggggaaagataatggacaagctccgctacatattctctatgatatccgatagctcaggcgtcatggtttatggcaggtacgatcagtttctgcgggaggtgttgaagctaccaacagcggtgtttgaagggccaagcttcggatacacagagcagagcgccagatcttgcttcagccagcagaagaaggtgacattgaatggttttttagatactctcatgtccgatcccccacctcagtgcctggtgtggcttcccctactccataggttagcgaacgtggagaacgtgttccaccctgtagaatgttcttactgtcattcagaatccatgatgggtttccgttatagatgtcagcaatgtcataattaccagctctgccaggactgcttttggagaggacacgctggcggatcacatagcaaccagcaccagatgaaggagtataccagttggaaatcccctgctaagaagcttacgaacgccttatctaagagcctctcgtgcgccagctccagggaacctctacatccgatgtttccagaccaaccagagaaacccctgaatctggctcatatcgtcctggataatatgccccctcgcccagtgaccagtatgaacgacacccttttttcacacagcgtgccaagttccgggtcaccatttataacccggtccagcccccctaaagactctgaggtcgaacagaacaagctccttgcccgagccgcaccggctttcctgaaaggaaagggaattcagtactccctgaacgtcgcagatcgcctcgccgacgaacatgtacttatcggactatacgtcaatatgctccggaataatcctagctgtatgctggaaagctctaatcgcctggacgaagaacatagactgattgccagatacgccgcacggctcgccgctgagtcgtccagcagccagcctccccagcaacgtagcgcgccagacattagctttaccatcgatgcaaataagcaacagcgtcagctgattgccgaattggaaaataaaaaccgtgagatcctccaggagatccagaggctccgactggagcacgaacaggcatcacaaccaacgccagagaaagcccagcagaacccaaccttgctagcagaattaagattgttaaggcagagaaaggacgaattagaacagcgcatgtccgctctccaggaatcacgtagagagctgatggtccagctggaaggcctgatgaagctcctgaagacccagggggctggttcccctcgcagctcgcctagtcatacgatcagccgccctataccgatgcctattcggagtgcatcggcctgttccacccccacccataccccccaggatagtctaaccggggtagggggagatgtgcaggaagccttcgcacagtcatcaaggaggaacctccggaacgacctgctggtggcggcagattccattaccaacaccatgagctcactggtcaaagagctgaatagcgaggtcggcagtgagactgagagcaatgtcgactcagagtttgccagaacccaatttgaagatctcgtgccgagtcctaccagcgagaaggcttttctagcccagatccacgcccgaaaaccaggatacatacactcgggggcaacaaccagtacaatgagaggagacatggtcacagaggacgccgacccatacgtccagcctgaagacgagaactacgaaaatgatagtgtgcgccagcttgagaatgaactgcaaatggaagaatatctaaagcagaaactgcaggacgaggcataccaggtaagcttgcaagggtag

SEQ ID NO: 221529 - DNA, 1713 bp, Artificial Sequence
  Description of Artificial Sequence: Synthetic coding sequence
atgatagaggactctggtaagagaggcaacacaatggctgagcggaggcagctttttgcggagatgagagcgcaggacctcgatcggatccggttgagcacttacaggacggcctgtaagttgagattcgtccagaaaaagtgtaaccttcatctggtcgatatttggaacgttattgaggcgctgcgcgaaaatgctcttaataatttagatcccaacactgagctgaacgtgtcaaggctggaggctgtcctttcaactatcttctatcaacttaataagcgcatgcccactacacaccagattcatgtggagcagtctattagcctactcctcaacttcttgctggccgcttttgatccagagggacacggcaagattagtgtgttcgccgtgaagatggccttagcaactttatgcgggggtaagatcatggacaagttgcgatatatcttcagcatgatcagtgactcttccggcgtgatggtgtacgggcgatacgatcagttcctcagggaagttcttaagctgccaaccgccgtttttgagggaccaagttttgggtacaccgagcagtcggcccgttcctgcttctcccagcagaagaaagtgactctgaacggatttcttgacacccttatgtccgacccgccaccacagtgtctcgtctggctgcccctgcttcaccggttggcaaacgtagagaatgttttccaccccgttgagtgttcctactgtcatagtgagtctatgatgggattcagatacaggtgtcagcagtgtcacaactatcagctgtgccaggactgtttttggcgcggtcacgccggtgggagccactccaatcagcaccagatgaaagaatacacctcctggaagagtccagcaaagaaactgaccaatgctctgagcaaatccttgagctgtgcttcatcccgggagcccctgcatccgatgttccctgatcagcctgagaaacctttaaatctggcccacatcgtggacacatggccacctagacccgtcactagcatgaacgacacattgttctcgcacagcgttccctcctctggaagtccctttatcacccggtcatctccaccaaaggactctgaggtggaacagaataaactgcttgcgcgagctgcccctgcattcctgaaagggaaaggcatacaatatagcctgaacgttgccgatcggttggctgacgagcacgtattaatagggctctacgttaacatgctccgaaacaatccttcctgtatgcttgaaagtagcaatcggctagacgaggagcatagactgatcgcgagatacgccgcacggcttgccgcagaatcgagctctagccagcccccacaacagaggtctgctccagacatctctttcaccatagatgctaataagcaacaaagacagctcatcgctgagcttgaaaacaagaaccgcgagatattgcaagagattcagcgcctcaggttagaacacgagcaggcttcccaaccgacacccgagaaagcccagcagaaccccactctattggccgagttgcgtttgctccggcagcgtaaggacgagctggaacagcggatgtcagcactccaggaaagcaggcgggaactcatggtacagctggaaggcctcatgaagctcctgaaagaagaagagctgaaacagggggtctcctatgtcccctattgtcgctcttag

SEQ ID NO: 221530 - DNA, 2061 bp, Artificial Sequence
  Description of Artificial Sequence: Synthetic coding sequence
atgattgaggactccggaaagagagggaatacaatggcggaaaggaggcagttattcgcggagatgcgtgcccaagatctcgatcggatcagactctctacttataggacagcatgcaagctgcgttttgttcaaaaaaaatgtaacttgcacttggtagacatttggaatgtaatcgaggccctcagagagaacgcattgaacaatttggatcccaatacagagctgaacgtgtcacggctagaggctgtgctatccaccattttttatcagctgaataagcggatgccaaccactcaccaaatccacgtcgagcagtctatttccctcctgctgaacttccttttggcggcttttgaccctgaagggcatggcaaaatcagcgtcttcgcagtgaaaatggcattggccacactatgcggtggtaaaattatggataaactcaggtacatcttctccatgatctccgactcttcaggggtcatggtttatgggagatatgatcagtttctgcgagaggttcttaagctcccgaccgctgtgttcgaagggccaagctttggatacacagagcagagtgctaggtcctgctttagccagcaaaagaaagtcacgctgaatgggttccttgataccctgatgtctgatccccctccacagtgtttagtgtggctgcccctgcttcaccgcctagccaatgtggagaacgtgtttcatcccgtggagtgctcatactgccactccgaatccatgatgggttttaggtaccgttgccaacaatgtcataattaccaactctgtcaagactgtttctggcggggtcacgcgggaggttcacattccaatcagcatcaaatgaaggaatacacttcatggaaatcccccgctaaaaaactcaccaatgccctttcaaaatcgctgtcttgcgctagttcgcgggagcccttacatcccatgttcccagatcagccagagaagcctttgaaccttgcccatatcgtcgatacttggccacctagacctgttaccagcatgaacgatacactgtttagccacagcgtccccagttcagggtcaccgtttatcaccaggagcatgctggaatcatcaaatcgtctagacgaggaacaccggctcatagctagatatgccgctcgtttggctgccgagtcttcttcttcccagccaccacagcagagatcagcccctgacatttctttcacaatcgacgctaacaaacaacaacggcagcttatagcagaactagaaaacaagaatagagagatccttcaggagattcagcggctgcggttggagcacgaacaagcaagccagcccacgcccgaaaaggcccagcagaatcctacattgttggcagaattgagactattgagacagcggaaggatgaactggagcaaaggatgagcgccctccaggaatccaggcgcgagttgatggtgcagctcgaaggcttaatgaagttgttaaagactcagggtgccggttccccacggtcatctccatcccatacaattagccggcctatccctatgcctattcggagtgcttctgcatgcagcacccctacccacacccctcaagacagcctgaccggagtaggtggggacgtgcaggaggcctttgcccagtccagccgacgaaatctgaggaatgacctcctagtcgccgcagatagtattacgaataccatgtctagtctggttaaggaactcaattccgaagtcggctccgaaactgagagcaacgtggattccgaattcgcgcgtactcagtttgaggatctcgttccttcgccaacttccgagaaagctttcctcgcccagatccacgcgaggaagcctggttacatccactctggtgcgactacctcaaccatgagaggcgacatggtgaccgaggatgccgacccatacgttcaacctgaggatgagaactatgagaatgatagtgtgagacagctggaaaacgagcttcagatggaggagtatttgaaacagaaactgcaggatgaggcatatcaggtctctctgcaggggtag

SEQ ID NO: 221531 - DNA, 1125 bp, Artificial Sequence
  Description of Artificial Sequence: Synthetic coding sequence
atgatcgaggatagtggcaaacgtggaaacactatggctgagcgtagacagttatttgcagagatgcgggcacaagatctggaccgcatcaggctatccacatacaggacagcgtgtaaactgcggtttgtccagaaaaagtgtaacctgcacttagttgatatctggaacgtgattgaggctcttagggaaaatgcactgaacaacttagatccaaatactgagctgaacgtgtcccgcctcgaggcagttctgagtacgatcttttaccaactcaacaaaaggatgcccaccacccatcagatccacgtggagcagtccatttccttgctactaaatttcctcctggctgcgttcgaccctgaaggacacgggaagatctctgtgttcgccgtgaagatggctcttgctacgctgtgtgggggtaagatcatggataaactgagatacattttttccatgattagtgattcctctggggtcatggtgtacggacgctacgaccagtttctgcgtgaggtcctgaaactcccaactgccgttttcgaggggccaagtttcgggtacactgaacagagcgccagatcatgcttttcacagcagaagaaagtcacgcttaatggcttcctcgacaccctgatgtctgatccaccacctcagtgccttgtgtggctgcctctgctgcatcgacttgcaaatgtggagaacgtgttccatcctgtggagtgtagctactgtcacagcgagagcatgatgggattccggtaccgctgtcagcaatgccacaactaccaattatgtcaggactgcttttggaggggtcacgcgggtggctcccactctaatcagcatcagatgaaggagtacacctcgtggaagagccctgccaagaaactgacgaacgcactgtccaagtctttgtcctgcgcctcctctagagaacctctgcatccaatgtttccagaccagcccgagaagccactcaatctagctcacatagtggacacctggccaccccgacccgtgacttcaatgaatgatacactcttttctcattcagtccctagcagcgggtctccttttatcacccgcagcagtgatggtgcctttggcggttgtgtgtag

SEQ ID NO: 221532 - DNA, 1704 bp, Artificial Sequence
  Description of Artificial Sequence: Synthetic coding sequence
atgatcgaggacagcgggaaacgaggaaataccatggccgagcggcgtcaactcttcgcggagatgagagcacaggaccttgaccgcatccgcctgtccacttatcggacagcctgtaagctgcgattcgtgcagaagaaatgtaatcttcatttggtcgatatatggaatgtgatagaagctcttcgcgaaaacgctctgaataaccttgatcctaacacagagttgaatgtcagtcgcttggaggcggtgctgagcacaatcttctaccagctcaataagagaatgcccactacccaccagattcatgtggagcagtccatcagtctccttttaaactttctgctggcagcctttgaccctgaggggcatggtaagatcagtgttttcgcggtaaagatggccttggccaccctgtgcggtggcaagataatggacaaactccgttatattttctccatgattagcgatagttctggggtgatggtctatggtcgctacgaccagtttctgagggaagtgctgaagctgccaacggcggtgttcgaggggccatcctttgggtatacagagcagagcgcaagatcatgtttctcacagcagaagaaggtgaccctgaatgggtttctggataccctcatgagcgatccccctccccagtgtcttgtatggctgcctctgttacaccggctggctaacgttgagaacgtgtttcatccggttgaatgcagctattgtcactctgaatccatgatgggtttcagatatagatgtcagcaatgccataactaccagctctgtcaggattgcttttggcggggacatgctggcggaagtcacagcaatcaacaccagatgaaagagtatacaagctggaagtccccagctaagaagctaacaaatgccctgtcaaagagtctcagttgcgcctcctctcgggagcccctgcaccccatgttccccgatcagcccgagaagccgttaaacctggcgcatattgtccctccgcgaccagtaacaagtatgaatgacacattgttctctcattctgtaccgtcctcaggctctccattcatcactcgcagcagtccgcctaaagattcagaagttgaacagaacaagctcttggccagagctgcccctgctttcctgaagggcaagggaattcagtatagccttaatgtggccgaccgcttggcggatgaacacgtgcttatcggtctttacgtcaacatgctgcgcaataacccctcctgtatgctcgagtcatccaatagactggacgaggagcacaggctgattgcaagatacgctgcaaggctggccgctgagtcatcctcatctcagcctccacagcaacgctccgcaccagacatcagctttaccatagacgccaataaacagcagaggcagttaatagctgaactcgagaacaaaaaccgagaaatattgcaagaaatccaaaggttgcggttagagcatgagcaggccagccagccaactcccgaaaaagcccagcagaacccaacactgctcgccgaacttagactgctcagacagagaaaggacgaactggagcagcgtatgtccgctttgcaggagagcagacgcgaactcatggttcagcttgagggccttatgaaactgctcaaagaagaagagctaaagcagggggtatcatacgtgccctattgtcgatcatag

SEQ ID NO: 221533 - DNA, 1176 bp, Artificial Sequence
  Description of Artificial Sequence: Synthetic coding sequence
atgttccccgaccagccagagaagccgctgaatctggcacatatcgttccacctagaccggtcactagtatgaacgacactctctttagccactctgtacccagctctggcagccctttcatcacaaggagctctccacctaaagattccgaagtggaacagaacaaactgttggccagagcagcacccgcatttctcaagggtaagggaatgctggaatcttctaacaggctagacgaagagcatcggttaattgcaaggtacgcggcaaggctggctgctgagagctccagttcccaaccaccccagcagcgatcagcccctgatatctcctttaccattgatgcgaacaaacaacagagacagctcattgctgaactggagaataagaaccgagaaattctgcaggaaattcagcgactccggttagagcacgagcaagcctcccaaccaacccccgaaaaagcgcagcagaacccgaccctgcttgccgagctgcgccttctgagacaacggaaagatgaacttgagcagcggatgtcggcactgcaagaatcccggagagagcttatggtgcagctggaagggctgatgaagctcctgaaaacccagggggctggcagtcctaggagttcaccttcacacacaatctctaggcctattcccatgccgatccgatctgcttctgcttgtagcacccccacccacactcctcaggactccctcaccggagtgggcggagacgtccaggaagcatttgctcaaagcagccgccgaaacttgagaaacgacctgcttgtcgccgcagatagtattaccaataccatgtcttccctggtgaaggaactgaatagcgaggtaggaagcgaaacggaatctaatgtggacagtgagttcgcgagaacacagtttgaggaccttgtaccttcgccaaccagcgagaaagccttcctggcccagatccacgccaggaagcctggttatattcattctggagccacaaccagcactatgcgaggggatatggtgaccgaagatgctgacccctacgtgcaaccagaggatgaaaactatgagaatgactctgtccgacagctggagaatgaacttcagatggaggagtacctgaagcagaagctgcaggatgaggcatatcaggtctccctccaggggtag

SEQ ID NO: 221534 - DNA, 2232 bp, Artificial Sequence
  Description of Artificial Sequence: Synthetic coding sequence
atgattgaagactctggtaaaagggggaataccatggcagaacggcgtcagctgtttgccgagatgcgcgctcaagatctggatcggatacgcttgtcaacctatagaaccgcctgtaagctacggtttgtgcagaagaagtgcaacctgcacctggtcgacatttggaatgtgattgaggcgcttagagagaacgcccttaacaatctggatcccaacactgagctcaacgtgtccaggctcgaggccgtactgagtacaatcttctaccaacttaacaagcggatgccgaccacccaccagattcacgtcgagcaatccatttcactgttgctaaactttttgctggccgcttttgatcctgaggggcatgggaagataagtgtgttcgcagttaagatggccctggcaaccctctgcgggggaaagataatggacaagctgagatatattttcagcatgatttcggactcatccggagtcatggtatatggtagatatgaccaatttctgagagaagtgctgaaactgcctactgctgtttttgaaggcccatcctttgggtatactgaacagagcgcgagaagctgcttctcgcaacagaaaaaagtgactctaaacggcttcctcgataccctgatgtcagatccacccccacagtgtctggtctggcttccacttctccatagactggcgaatgtggagaacgtctttcatccggttgaatgttcatattgtcactcggagagcatgatggggttccggtatcggtgccagcagtgtcacaactatcagctgtgtcaagattgcttttggagggggcatgctgggggaagccacagtaaccagcatcagatgaaagagtacacaagctggaagagtccggctaagaagctgaccaatgcactgtccaaaagcctttcgtgtgcttcaagtcgggagccactgcaccctatgttccctgaccagccggagaagccactgaacctggctcacatcgttgatacatggccaccgagacctgtgacctctatgaatgacacactgttctctcactccgtaccatcttctgggtccccatttataaccaggtcatctccaccaaaagattccgaggtggagcagaacaagctgctggcacgcgctgcccctgcctttttgaagggtaaagggatccagtattcacttaacgtcgcagaccgcctggccgacgagcatgtgcttattggattatacgtcaacatgttgcggaataacccttcctgcatgttggagagttctaaccgcctcgatgaagaacatcgactcatcgcccgttatgcagctaggctggctgccgagtcgagtagctcgcagccgccacaacagcgctcagcccctgacatctccttcacaatcgacgctaacaaacagcaacgacaactgattgccgaattggaaaataaaaatcgcgagatccttcaggagatccaaaggttgaggctggaacacgagcaagccagccagcctactcccgaaaaagcgcagcaaaaccccacgctcctggctgagctaaggctcctgcgacagagaaaggacgagctcgagcagcgcatgtctgctttacaggagtcgaggagggagctgatggtgcagttggagggcctaatgaagctcctcaaaactcagggagccggatctccacgctcctcaccttctcacactatctcgagacctatccctatgcctatcagatctgcttcagcttgctcaacacccacacatactccccaggacagtctgacaggggtaggtggggatgttcaggaagcattcgcccagagttctaggaggaatctccgcaatgatttactggtcgctgcggactcaatcaccaacacgatgagtagcctggttaaggagttgaacagtgaggttggatccgagactgagtcaaacgtggattccgaattcgcaagaactcagtttgaagacctggtgcccagtcccacttctgaaaaggcatttctcgcgcagattcatgcaagaaagccagggtacattcactcaggcgcaaccacctcaacaatgcgaggcgacatggttacggaagacgctgacccttatgttcaacccgaagatgagaattacgagaacgattctgtcagacagctagaaaatgagctgcagatggaggaatatctcaagcagaagctgcaggatgaggcctaccaggtcagtttacagggatag

SEQ ID NO: 221535 - DNA, 2073 bp, Artificial Sequence
  Description of Artificial Sequence: Synthetic coding sequence
atgatcgaagactccggcaaacgaggcaacactatggccgagcggagacagttattcgcagaaatgagggcccaggacctggatcggatccgcctttcaacatacagaacagcttgtaagctcagattcgtgcaaaagaagtgtaaccttcatctcgtggatatttggaatgttattgaggctctaagggaaaacgcactgaataatttggatccaaatacagagttgaatgtgagccggcttgaggctgtcctgagcacaatcttctaccagctcaataagcgaatgcccactacacatcagatacatgtggaacagtcgattagcctgttattaaactttctccttgcagcctttgaccctgagggtcatggaaaaatttctgtcttcgcagtaaagatggcgctggcaacactgtgtggaggtaaaataatggacaaactgaggtacatcttcagtatgataagcgattcctcaggggtcatggtgtacggacgctacgatcagtttcttcgggaggtcctgaagctaccaacagcagtgttcgaaggtcctagctttggctatacggagcaaagcgcacgctcatgtttctcacaacaaaagaaagttaccctcaatggctttctggatactctgatgagcgaccccccaccccagtgcctggtgtggctgccgctgcttcataggctcgccaacgttgagaacgtgttccacccggtggaatgctcgtattgccactccgaatcgatgatgggatttagatataggtgccagcagtgccataactatcaactgtgtcaggattgtttctggagaggtcacgcaggcggatcccactccaaccagcatcagatgaaagagtacacttcctggaaatcccctgccaaaaagctgaccaacgctctgagcaagtccctctcttgcgccagctcccgggagcctctgcacccaatgtttcctgaccaacccgaaaaacctctgaatctggcacacattgtgccccctagacccgtcacctccatgaatgatacactcttttcccatagtgtgccctctagtggttctccctttatcacccgcagtatgcttgaatcttcaaataggttagatgaagagcacagactcatcgcacgctatgcggctaggctggccgctgagtcctcatcttcgcagccacctcagcagaggagtgctcccgatatttcttttaccattgacgccaataaacagcagcgtcagctaatcgccgagttggagaacaagaatagagagatactgcaggaaatccaacgcctccggctggagcacgagcaggcctcccagcccacccctgaaaaagcccagcagaaccccaccctgctagccgaacttcggttattgagacagcggaaggatgagctggaacaacgaatgtccgctctccaggagagccgtagggaactcatggtgcagctcgaaggacttatgaaattgctaaaagaagaagagctgaagcagggaactcagggggctgggagcccacgttctagtcctagtcatacaataagccgccctattccaatgccgatcagatctgcctcagcctgtagtacccccacccatacacctcaagattctctgaccggcgtggggggagacgtgcaggaagcctttgcccagtcatcacgccgtaacttacgcaacgacctgttagtggccgcagatagtattaccaacaccatgtcctctctcgttaaggagcttaattccgaagtggggagtgagacagagtctaatgtggactcagagtttgccaggacccaattcgaagatctggtgccatcacctaccagtgaaaaagcattcttggcgcagatacacgctcgtaagcccggatacatccactctggtgcaaccacatcgacaatgaggggtgatatggtcaccgaagatgccgatccttacgtgcagcctgaagacgaaaattatgagaacgacagtgttcgccagttggaaaatgagctgcagatggaagagtacctgaagcagaaactccaggatgaagcctaccaggtgagtctgcaggggtag

SEQ ID NO: 221536 - DNA, 2061 bp, Artificial Sequence
  Description of Artificial Sequence: Synthetic coding sequence
atgatagaggactcaggcaaacggggaaatacaatggccgaaagacgccaactgttcgctgaaatgcgtgctcaagacctcgaccgtatccgactgtctacctacagaacagcctgtaaactcaggttcgtgcagaagaagtgcaacctgcatctcgtggacatctggaacgtgatagaggcgctgagagagaatgccctgaataatctggatccaaacaccgagcttaatgtatcaagactcgaagctgttctgagcacaattttttaccagctcaacaagaggatgccaaccactcatcaaattcatgtggaacagtccatctctctactgctgaatttcttgctggccgctttcgatcctgagggacacggcaagatcagcgtttttgccgtgaaaatggccctagctacattgtgcggcggaaaaatcatggataaactccggtacattttctcaatgatcagtgattcctctggagtcatggtgtacggccgatatgaccagtttctccgcgaagtgctgaaactcccaacggctgttttcgaagggcctagtttcggttacactgaacagagtgctcggagctgctttagtcagcagaaaaaagtcacccttaatggatttctcgatactttaatgagcgacccacctcctcagtgtctcgtctggctcccactcctccataggcttgctaacgtggaaaacgtttttcacccagtcgagtgcagttactgccattccgagtcgatgatgggcttccggtacaggtgtcagcaatgtcacaactaccaactgtgtcaggactgtttttggagaggccatgccggtggtagccattctaaccagcatcaaatgaaggaatatacaagttggaaatcaccagcaaaaaaactgaccaatgcattatcaaaatccctgagctgcgcctctagcagagagcctctccatcctatgtttcctgaccaaccagagaagcccttgaatcttgctcacattgtgtgcttccgccctccgcgtccagtgaccagtatgaacgacaccctgttctcccattctgttcccagctccggcagtcccttcattaccagaagcatgttagaaagcagtaatcgtcttgatgaggagcacaggctcatcgccaggtacgccgcacgactcgctgctgaatcctcatccagtcagccgccacagcaacgctccgccccagatatttcctttaccattgacgccaataagcaacagcgacagctaatcgccgaactcgagaacaaaaaccgtgagattcttcaggagattcaacgcctgagactggaacacgaacaggcttcccaaccgacgcccgagaaggcgcaacagaatccgaccctgcttgcagagctgaggctcctcagacagcgcaaagacgaactggagcagaggatgagcgcgttacaagaatctcggagggaactgatggttcagctggaaggcctgatgaagctacttaagacccagggtgccggtagccctagatcttctccctcacacacaatttctcggccaatacctatgcccattcgctccgcgtctgcgtgtagcacccccacgcacacccctcaggactcgttaaccggagttggcggagatgtccaggaggccttcgcccagagctccaggagaaatttacggaacgacctcctcgtggctgctgattctataaccaatactatgagctctctggtgaaggagctaaatagcgaagtgggctccgaaaccgaatccaatgtggatagtgagttcgccagaacacagttcgaagatctcgtgccaagccctacctcagaaaaggccttcctcgcccagatccatgctagaaagcctggatacattcatagcggcgctacaacctcaaccatgaggggcgatatggtgacggaagacgcagacccctatgttcagcccgaagacgagaattatgaaaacgattccgtgagacagctggagaacgagctgcagatggaagagtacctgaagcaaaaactgcaggacgaggcataccaggtcagtctccagggctag

SEQ ID NO: 221537 - DNA, 2232 bp, Artificial Sequence
  Description of Artificial Sequence: Synthetic coding sequence
atgattgaggactctggtaagcggggaaataccatggcagagcgcaggcaactgttcgctgagatgagggcacaagatctcgatcggatacggttgtctacataccgcactgcatgcaaactgcggttcgtgcagaagaagtgcaacttacatctcgttgatatatggaacgtgatcgaggcgctaagggagaatgctcttaataacctcgaccctaatacagagctgaacgtgagtcgtctggaagctgttctgtcgaccatattttatcagctcaacaaacggatgcccactactcaccagatccatgtagagcagtcgatttctcttctgttaaattttttgttagctgcttttgaccctgaaggtcacggaaaaatcagtgtcttcgctgtaaagatggcattggctactctatgcggcggaaagatcatggataagcttaggtatatcttttcgatgataagtgatagttctggggtgatggtctacggacggtatgaccagttcctccgggaagtgttgaaactgcccacagctgtattcgaagggccaagttttggctacaccgagcagagcgcaagatcgtgcttctctcagcagaaaaaggtcaccctcaacggttttctggacaccttgatgtccgatcctcctccccaatgccttgtttggctgcccttgttgcaccgcctggctaacgtggagaatgtatttcatccggtggagtgctcatattgccactcagagtccatgatgggattccgttaccgatgccaacaatgccacaattaccagctgtgccaggattgtttttggagaggacatgcgggaggatcgcactcgaaccaacaccagatgaaggagtatacatcctggaaaagccctgcaaaaaagcttaccaacgcactcagtaagagtctctcctgcgctagcagccgggaacccttgcaccctatgttccctgaccagcccgagaaacccttgaacctcgcccacatcgtttgctttagacctccccgacccgtaacctcaatgaacgacaccctcttttcacattctgtaccctcttccgggagtccatttattaccagaagtagtcccccaaaagattccgaagtcgagcaaaataagcttttagccagggcagcaccagccttcctcaagggcaagggcattcagtattcccttaatgtggcagataggctagccgacgagcacgtgctgatcggcttgtatgtgaacatgctcagaaacaacccctcatgtatgctagagagctcaaaccgcctggacgaggaacaccgcctgattgcacgatatgccgctcgactcgccgctgaaagctcatctagccagcccccacagcagagatcagccccagacattagctttacaatcgacgctaataaacagcaacgccaactgatcgccgagctcgaaaacaaaaaccgagagatcctgcaggaaatccagaggctccgcctggaacatgagcaggcatctcagcccactccagaaaaagcgcagcagaaccccacccttcttgccgagctgcgcctgttgagacagcgtaaggacgagctcgagcaacggatgagcgcactgcaagaatctcgccgtgaactgatggtccagctggaagggctgatgaagctgctcaagacgcagggcgctggctcacctcgatcttcaccatcacatactatcagcaggccaattccaatgcctattcgcagtgcttccgcttgctccacaccaacacatactccccaggattctctaaccggggtgggaggtgacgtccaggaggccttcgcccagagctccagaagaaacctaagaaacgacctgctagtcgccgcagattctataacaaatactatgtcgagcctagtgaaggaactgaattcggaggtgggctccgaaaccgagagtaacgtcgattccgaatttgcccgaacacagttcgaggatctcgtgccatcgccaactagcgaaaaagcttttctggctcaaatccatgccagaaagcccggatacatccacagtggtgccaccacctctactatgcggggagacatggttaccgaggacgctgatccttatgtgcaaccagaagatgagaattacgaaaatgattccgtcaggcagctcgaaaatgaactccagatggaagaatacttgaagcaaaagctgcaggacgaggcgtatcaggtgagtctccagggctag

SEQ ID NO: 221538 - DNA, 2232 bp, Artificial Sequence
  Description of Artificial Sequence: Synthetic coding sequence
atgatcgaagattctggtaagagggggaatactatggctgaaaggagacagttgtttgccgagatgagggcccaagatctggaccgcatcagacttagcacgtatagaactgcatgcaaactgcggttcgtgcagaagaagtgcaatttgcacctagtcgatatttggaacgtgatcgaagctttgagagagaatgcacttaataacctggatcccaacacagagttaaacgtgagcagattggaagctgtgctgtcgaccattttctaccagctgaacaagcgcatgccgaccacacaccagattcatgttgagcagtcgattagcttactgctaaactttcttctcgccgcttttgaccccgaaggacacgggaaaatcagcgtcttcgctgtgaagatggctctggccacactgtgtggcggaaaaattatggataagctgcgatacattttctctatgatctccgacagcagtggcgttatggtatatggtcgatatgaccagtttctgcgggaagtccttaagttgcccacagccgtctttgagggtccaagcttcggatacaccgaacaaagtgccaggtcttgcttctcgcaacagaagaaggtgaccctgaacggattccttgacacactcatgtctgaccccccaccacagtgtctcgtgtggctcccactcttgcacagactggccaacgtggaaaacgttttccacccagtggagtgtagctattgccactctgagagtatgatgggatttagataccggtgtcagcagtgtcataattatcagttgtgtcaggattgtttctggcggggtcacgccggtgggagtcactccaaccagcatcagatgaaagagtacacttcttggaagagtcctgccaagaagctgacaaacgctctctctaagtccctatcttgcgcaagttccagagagcccttacatccaatgttccccgaccagcccgagaagcctctgaatttggcccatatcgtggatacttggcctcctagaccagtcacctcaatgaatgacaccttattctcccactccgtcccatctagcggttccccttttatcacacggagctcacccccaaaagactccgaggtggaacagaataagctcctcgcgagggctgcacctgccttcttaaaaggaaaagggatacagtattctctgaacgttgcagaccgcctggccgacgaacatgtgttgatcggcctgtacgtaaacatgctgagaaacaatccaagctgcatgctggaatcaagcaataggctggacgaagagcatcgattgatagcccgatacgcggctcggctcgctgctgagtcaagctcaagccagccacctcagcaacgctcagccccagatatcagcttcacaatcgacgcgaataagcagcagagacaactgatcgccgagctggaaaataaaaaccgcgagattttgcaggagatccagcgccttaggctggagcatgaacaagccagccagcctacccccgagaaagcacaacagaaccccacattactcgcagaattgcggctcctacggcagagaaaagatgagctcgaacagagaatgtctgcactgcaggaaagtagacgggagctgatggttcaacttgagggccttatgaagttactgaagacacaaggcgcagggtcccccagaagttcccccagtcataccatctcaagacccattcctatgcctattcgttccgcctctgcatgcagcacaccaacccataccccacaggactccctgaccggcgtgggaggcgatgtccaggaggcattcgcgcagtcttctcgcaggaacctgcggaacgacttactggtggcagctgactctataaccaatacgatgtcctctctggtcaaggagcttaactctgaggtaggctcagagacagaatccaatgtggattctgagtttgctagaactcagtttgaagatctcgtaccatcaccaacaagcgagaaggcgttcctggcccagatccatgcacggaagcccggatacattcactccggcgcaaccacatcgaccatgcgcggtgacatggtgaccgaagacgccgatccctacgttcaaccagaggacgagaattacgagaatgacagcgttcgacaactggagaatgagctccagatggaggagtacctgaagcagaaactgcaggacgaagcttaccaggttagccttcagggatag

SEQ ID NO: 221539 - DNA, 1176 bp, Artificial Sequence
  Description of Artificial Sequence: Synthetic coding sequence
atgtttcccgatcagccagagaaaccactgaatctggcacatattgtgccccctagacctgtcacctccatgaacgacactctttttagccattcagtgcctagctctggcagcccatttataacccgctcttctcccccaaaggactcagaggtagagcagaataagctcctcgctcgcgctgcccctgcgttcctaaagggcaagggcatgctagagtcctcaaaccgcctggacgaagagcatcggctgatcgcacgttatgcagctagactcgccgctgaaagttctagctcacagccccctcagcagcggagcgcacctgacatctcatttaccatagacgcaaataaacagcagaggcaactgattgctgagctggaaaataagaatagggagatccttcaggagatccaacgactgcgactggagcacgaacaagcatcacagcctaccccagaaaaagcacagcaaaaccccactctgttagccgagcttagactccttagacagcgcaaggatgaactcgagcaaagaatgtcagcgctccaagagagccgcagggaacttatggtgcagttggagggcttgatgaaattgttgaaaacccaaggagctgggagccctagaagcagcccttctcatactatctcccggcctatccctatgcccattaggtcggcttccgcttgcagtaccccaactcacacccctcaggacagcctcaccggagtgggtggggatgtgcaggaggcatttgcccagtcctcccggagaaatctccgcaatgacctcctggtggccgcagactctatcaccaacacaatgtcaagcctggtgaaggaattaaattcagaagtgggcagtgaaaccgagagcaacgtggattccgagtttgccagaacacaattcgaggacttggtccccagtcctacaagcgagaaagctttcctggcacagatccacgctaggaagccaggatacatccatagtggcgcaactacgagcaccatgagaggcgatatggtgactgaggatgccgacccctacgttcaaccggaagacgagaactacgagaatgattcggtccgccagctggaaaatgagctgcagatggaggagtacctcaaacagaagcttcaagacgaagcgtaccaggttagcttgcagggctag

SEQ ID NO: 221540 - DNA, 1116 bp, Artificial Sequence
  Description of Artificial Sequence: Synthetic coding sequence
atgattgaggacagcggaaaaaggggtaatacaatggctgagagacggcaactgttcgccgaaatgagagcgcaggacctggatcggatccgactgagtacctataggacagcttgtaaactgcggtttgtgcagaagaagtgtaatctccatctcgtggatatctggaacgtaatagaagccttgagggagaatgctctcaataaccttgatccgaacacagaacttaacgtgagcagacttgaggccgttctctctacaatattctatcagctcaataagcggatgcctactactcatcagattcacgtggagcagtctataagcctgttgctcaacttccttctggctgccttcgaccctgaaggtcacggcaagatcagcgttttcgcggttaagatggcccttgccaccctctgtggcggtaagattatggataaacttcgatacatcttttctatgatttctgattccagtggcgtgatggtgtatggacgttacgaccagtttctgagagaggtgctaaaactccccactgccgtatttgaggggccttcctttgggtacacagagcaatctgcaagaagttgcttctcacagcagaaaaaggtgactctgaacggctttttagacaccctgatgtcagatcctcctccccaatgtctggtctggctaccactgctccataggctggccaatgtggagaacgtttttcatcctgtcgaatgttcttactgtcacagcgaatcaatgatgggcttccgataccgatgtcagcagtgccataactaccagttatgtcaggactgtttttggcgtggtcacgcaggagggtcccatagcaatcagcaccaaatgaaagagtacactagttggaagagcccagcaaaaaagcttacaaatgccttgagtaagagtttgtcctgcgcctccagtcgtgagcctctgcaccccatgtttccggatcagcccgagaaacccctcaacctggcccatatagttcctcctagacctgtgaccagtatgaatgacacccttttttcacatagtgttccatcttcaggctccccctttattactcggagcagcgatggcgcattcggaggttgcgtctag

SEQ ID NO: 221541 - DNA, 1794 bp, Artificial Sequence
  Description of Artificial Sequence: Synthetic coding sequence
atgattgaggagagtggcaacaagagaaagacaatggcagagaagagacagttatttattgaaatgagagcccaaaacttcgatgtgatccggttatccacataccgaaccgcctgtaagctgaggttcgttcaaaagcggtgtaatctccatcttgtcgatatctggaatatgattgaggcctttcgcgacaatggactcaataccttagatcacaccaccgaaatctccgtgagccgcctggagaccgtcatttcatccatctactatcaactcaataaacgcttaccttccacacaccagatcagcgtggagcaatctataagcctactcctcaacttcatgatagcagcctatgatagcgagggtagaggcaaactcactgtgtttagcgtgaaagcaatgctggccacaatgtgcggcggtaagatgctggacaagctacgatatgtgttttcccagatgtctgacagtaatggactgatgattttctccaagtttgaccagtttctcaaggaggtgctgaagctgccaaccgctgtgtttgagggaccgtcattcggttatactgaacatagcgtacggacgtgcttcccacagcagaggaaaataatgctaaacatgtttcttgatacgatgatggcggatccacccccacagtgtttggtgtggttacccctaatgcaccggcttgcccacgtggagaatgtattccacccagtcgagtgttcttactgcaggtgtgagagtatgatggggttccgatacagatgccagcagtgtcataactaccagctatgccaaaattgcttttggcgagggcatgcgggtggaccacacagtaatcagcaccagatgaaagagcattcttcctggaagtctccggcaaagaagctgtcgcacgcgatcagcaagtctctgggctgtgtaccaacccgcgagcccccacatccggttttcccggagcagccagaaaaaccccttgatctggcgcatatcgttcccccacggcctctgacaaacatgaacgacaccatggtgtcccacatgagctcaggcgttccgacccctacaaagcgtctgcagtactcccaggatattccctcacacttagccgacgagcacgcactaatcgcctcttacgttgcgagactccagcactgcgctcgggtcctggactcaccttctcggctcgacgaagagcaccggttgatagccagatacgcagctcggctggcggcagaagccggaaatgtgaccagacctcctaccgatctctcattcaacttcgacgccaataaacaacagcgacagctaattgctgaactggaaaataagaatcgggagatcttgcaggagatacagagactgagactggaacatgaacaggcgagtcagcccacccctgagaaggctcaacagaatccaacacttctggccgagcttagactcctgaggcagaggaaagacgagcttgaacagaggatgtcagctctccaggaaagtcgcagagagctgatggtgcagctcgaagagcttatgaagcttctcaaagaagcagaagcccgtgagagtgcccaggcgacaggttctcctcatacctctccgactcacgggggtggccgaccaatgcctatgcctgtaagatctacctctgccggtagcactccaacacactgtccacaagattctttgagcggcgtggggggagacgtgcaggaggcctttgcgcaggccgaagagggtgcagaagaggaagaagagaagatgcagaacggcaaggaccgcggatag

SEQ ID NO: 221542 - DNA, 567 bp, Artificial Sequence
  Description of Artificial Sequence: Synthetic coding sequence
atgattgaggaaagcgggaacaagagaaagaccatggccgagaaaagacagctgttcattgagatgagagcgcagaatttcgacgtgataagactttcaacttatcggaccgcttgtaagcttcggtttgtgcagaagcgctgtaacctgcacctggtggatatctggaatatgatcgaggcctttagggataacggcttaaataccctggaccacacaacagagatttctgtctcgagactcgagaccgttatcagctcaatctactaccaactcaacaagcgactgcccagcacgcaccagatctccgtggaacagagcatctccctcctgttgaatttcatgatcgccgcatatgacagcgaaggtagaggcaagcttacggtcttcagtgtgaaggccatgctggcaaccatgtgtggtggaaagatgcttgacaagctcagatacgtgttctctcagatgtcagacagcaatggactgatgatttttagtaaattcgaccagtttttaaaggaagtgctgaagctgccaacagctgttttcgaggggccaagtttcggctag

SEQ ID NO: 221543 - DNA, 399 bp, Artificial Sequence
  Description of Artificial Sequence: Synthetic coding sequence
atgatagaagaaagcgggaataagcgcaagaccatggctgagaagagacagctcttcatcgaaatgagggcacagaattttgacgttattaggctgtcaacttaccggacagcctgtaaactccggtttgttcagaagcggtgtaatctgcatctggtcgacatttggaacatgatcgaggcttttcgggataatggactgaatacacttgaccacaccaccgaaatcagtgtatcccggttagaaaccgtaatatcctccatttattaccagttgaataagcggttaccatctacacaccaaatcagtgtggaacagtcaatttcacttttgctaaacttcatgattgccgcttacgactcagagggacgcggaaaacttaccgtgttttcagtgtag

SEQ ID NO: 221544 - DNA, 450 bp, Artificial Sequence
  Description of Artificial Sequence: Synthetic coding sequence
atgatcgaagaatctggcaacaagcgaaaaacgatggcagaaaagcgccagctgttcatcgagatgcgggcacaaaactttgacgtcatccgactctctacttaccgcaccgcgtgcaaattacggtttgtccagaaacgttgtaatttgcaccttgtcgatatctggaatatgattgaagcattccgcgataacggactgaacacactggaccataccaccgaaatcagtgtcagccgcctggaaactgttatcagttcaatctattatcagctcaataaaaggttgccctccacccatcagatttcagtcgaacagtctattagtctccttctgaactttatgatcgccgcatatgattctgaaggccgtggcaagctgacagttttttctgtgaaggctatgctggctaccatgtgcggcggaaaaatgctggataagctgcggtag

SEQ ID NO: 221545 - DNA, 1794 bp, Artificial Sequence
  Description of Artificial Sequence: Synthetic coding sequence
atgatcgaagaatccggcaacaagagaaaaaccatggccgagaaacggcagctctttatcgagatgagggcacaaaactttgacgtgatcaggctgagcacgtaccgtaccgcatgcaaactgcgctttgtccagaagaggtgcaatctccacctggtcgacatctggaatatgattgaagctttcagggataacggtcttaacacccttgatcatacaaccgagatttccgtgtcaaggctcgagactgtcatctcttcaatttactaccaactcaacaaaagattgcctagcactcaccagatttctgtggagcagtcgatcagcctgctcctcaacttcatgatcgccgcatacgattccgagggtcgcggaaagctaactgttttctccgtcaaagccatgctggccacaatgtgcgggggaaaaatgctggacaaactgaggtacgtcttctcccagatgagcgacagtaacggtctgatgatcttctccaaatttgaccagttcctgaaagaggtcctgaagcttcctactgccgtattcgagggcccatccttcggctataccgagcacagcgtaaggacgtgctttcctcaacagaggaaaatcatgcttaacatgtttctcgacacaatgatggccgatccacctccccagtgtctcgtgtggctgccactgatgcacagattggctcatgtggagaatgtctttcatcccgtagagtgttcgtactgtaggtgcgagtccatgatggggttccgatacaggtgccagcaatgccacaattaccagttgtgccagaattgtttttggcgcggacacgccggaggcccacacagcaaccaacaccagatgaaagagcattcttcatggaagagtccagcaaagaaactgtcccatgctattagcaaatcactgggatgcgtgcccacacgtgagccacctcatcccgtgttccctgagcagcctgaaaagcctctcgacctggctcacatcgtgccgccaaggcctctgaccaatatgaacgatactatggtctctcacatgtcaagtggggtacccactcctactaaaagattgcaatatagccaggacattccgagccacttagccgacgaacacgctcttattgcaagctacgtggccagactgcagcattgtgctagggtgctggactctccgtctcgtctggacgaggaacacagattgatcgcgaggtatgctgctagactagctgctgaagccggaaacgtgactcgccctcctaccgacctcagcttcaattttgacgctaataaacagcagagacagctgattgccgaactggaaaataagaatcgcgagatccttcaagaaatccagagactcaggctggaacacgagcaagcatcacagccaacaccagaaaaggctcagcagaaccccacgctgcttgctgaactgcgccttttacgccagcggaaagacgagcttgaacagcgtatgtccgccctccaagagagccggagagagttgatggttcagctggaggagctgatgaagctactcaaagaagaggaacagaaacaggccgcacaggctactggatcgccccacaccagccccacacacggaggaggcagacctatgcctatgccggtgcggagcacttctgccggttcaacaccaacccactgcccccaggacagtctgtctggagtaggaggggacgtccaggaggcattcgcacaggctgaggaaggtgcagaggaggaagaagagaagatgcagaatgggaaggatagaggatag

SEQ ID NO: 221546 - DNA, 1683 bp, Artificial Sequence
  Description of Artificial Sequence: Synthetic coding sequence
atgattgaagagtcagggaacaagcgcaaaacaatggcggaaaagcgtcagctgttcatcgagatgcgcgctcagaacttcgacgttattcggctttccacttaccgcactgcttgcaaactccggttcgttcagaagagatgcaaccttcatctagtggatatttggaatatgatcgaggctttccgagacaacggattgaatactttagatcacactactgagatctctgtctctagacttgagacggtcatcagctctatctactatcagctgaacaagaggctgccttctacacaccaaattagtgtggaacaatccatcagtttgttgcttaactttatgatcgcagcctacgattcagaagggagaggcaagctgaccgtcttttctgtgaaggcaatgctcgcaacaatgtgcggcggaaagatgctcgacaaactgcggtatgtgttctctcagatgtccgactctaatgggctcatgatcttctccaagttcgatcagtttctgaaggaggtgctcaagttgccaaccgcagtgtttgaggggccttcatttgggtacacagagcattccgtcaggacatgcttcccacaacagaggaagattatgttaaatatgttccttgatacaatgatggccgaccctcctcctcaatgcctggtgtggctgcctctaatgcataggctggcccatgttgagaatgtgtttcatcctgtcgagtgttcatattgcaggtgtgagagtatgatgggatttcgctatcgatgccagcaatgtcacaactaccaactgtgtcagaactgtttttggcgaggccacgccggaggacctcactctaaccagcatcagatgaaagaacacagcagctggaagagcccagcaaagaaactgtctcatgcaatctccaaaagcctgggttgcgttcccacccgcgagccaccccacccagtcttccctgagcagccagaaaagcccctagatctggctcacattgttcccccacgacctttgacaaacatgaatgatactatggtgagccacatgagctctggcgtgcctactcctactaagagtgtgttggattctcccagccgtcttgatgaagagcacaggctcatcgcacgttacgccgctcggcttgctgctgaagctggcaatgttacacggccacccactgatctgtcctttaatttcgatgccaacaaacagcagcgccaactgattgccgagttggaaaacaaaaacagggaaatcttacaggaaatacagaggctgcgcttagagcatgagcaagcatctcagccgacccctgagaaagcccagcagaaccccacccttctcgctgaacttagactcctcagacagcgcaaggacgaactggaacagcgcatgagcgctcttcaggaatcaaggagagaactgatggtgcaactcgaagagctgatgaagctgctcaaggcccaggctacgggttccccccacactagccccacgcacggcggtggaaggccaatgcccatgccggtgcggagcacatctgcaggctccaccccaacccattgtcctcaagattcactgtccggcgtgggaggggacgtacaagaagccttcgcccaggctgaggagggagctgaggaagaggaggagaagatgcagaatggcaaggatcgagggtag

SEQ ID NO: 221547 - DNA, 1884 bp, Artificial Sequence
  Description of Artificial Sequence: Synthetic coding sequence
atgatcgaagagtccgggaacaagcgcaaaactatggccgagaagaggcaactgtttattgaaatgagagcgcagaactttgacgtaatcagattatcaacatacaggacagcctgcaaactgaggtttgtccagaaacgatgtaacctccacctggttgacatttggaacatgatcgaagcatttcgggacaacggcctgaataccttagaccataccacagagattagcgtttcaaggctggagaccgtgatttcaagcatatattaccaactcaataagcggctgccctcaactcatcagatttcagttgagcagtcgattagccttctccttaatttcatgatcgcagcctatgacagtgagggacgaggaaaacttactgttttttcagtcaaagcgatgttagccactatgtgtggaggaaagatgcttgacaagttgaggtatgtgtttagccagatgtcagactccaatggtctgatgatttttagcaagttcgaccagtttctcaaagaagtcctgaagttaccaactgctgtgtttgaaggcccaagcttcggatacacagagcattcagtgagaacctgcttcccccagcaacgtaagatcatgctgaacatgttcctcgatactatgatggcagaccctccaccccagtgtcttgtttggctcccgctgatgcacagactagcacatgtggagaatgtgtttcatcctgtggagtgctcttactgccgatgcgagtcaatgatgggcttcaggtatcgctgccagcagtgtcacaactatcaattgtgtcagaattgcttttggagggggcacgccggtggccctcattccaatcagcatcaaatgaaggagcactctagttggaaatctcctgcaaagaaacttagccacgcaatcagtaaaagcctgggatgtgtaccgacacgcgagccgccacaccccgtcttccccgagcagcctgaaaagccgttagatctcgcacatatagtgcctcccaggcccttgacaaatatgaatgacacaatggtttcacatatgagctccggggtaccaactcccactaaacgcctccagtattcacaggatattccatctcatctcgctgatgaacacgccctcattgctagctatgtggctcggcttcagcactgtgctcgagttctcgactctccaagccgcctggatgaggaacaccgtctgattgcaaggtacgcagcgaggctggccgctgaagcagggaacgttacgcggccaccgacagacttgtcgtttaatttcgatgcgaacaaacaacaaaggcaactaatcgccgagcttgaaaataagaaccgggagatcctccaggaaatccagcgactaaggctcgaacacgaacaggcatcccaacccacccccgagaaagcacagcaaaaccccactttactggccgagttgagactgctgcgacagaggaaagatgaactcgagcagaggatgtcagccctgcaggaaagtaggcgtgagctgatggttcagttagaagagctaatgaagttgttgaaagaagaggaacaaaagcaggcggctcaggctacagggagccctcacactagccccacccatggaggcggaagacccatgcccatgcccgtccgctcaaccagtgcaggcagcaccccaacccattgtccccaagacagcctctcaggggttggaggcgacgtgcaggaagccttcgcacagggtacgaggcgaaaccttaggaatgaccttcttgttgccgctgacagcataactaatactatgtccagcctggtgaaggagctgcactccgctgaggagggcgctgaggaggaagaggagaaaatgcagaatggcaaagatagaggatag

SEQ ID NO: 221548 - DNA, 1704 bp, Artificial Sequence
  Description of Artificial Sequence: Synthetic coding sequence
atgatcgaggaatccggcaataagcggaagaccatggctgagaagcgccagctattcattgagatgagggctcagaactttgacgtaattagactctctacttacagaaccgcatgcaaactccggtttgttcagaaacgctgcaatctccacctggtggacatctggaacatgattgaggcattccgggacaacggcctgaatacacttgaccatactacagaaataagcgtgtcaaggctggagacagtgatctcctccatctactaccagctgaataaaaggctgccatcaactcaccagatttcagtggaacagtccattagcctcttactgaattttatgatagccgcttatgactctgaaggccgagggaagctgacagtgttcagtgtcaaagcaatgctggcgaccatgtgtggcggaaaaatgctggataagctcagatatgtgttctctcagatgtctgatagcaatggcttgatgatcttctcaaagtttgatcagtttttaaaggaagtcctgaagctgcccacagcagtgttcgaggggccttcttttggttataccgagcatagcgtcagaacttgttttccccaacagcgcaagatcatgctcaacatgttcctcgacacaatgatggctgacccacctcctcagtgtctcgtgtggctcccactgatgcatcgactagcccacgtcgagaatgtatttcatcctgtggagtgttcctattgccgatgtgagtcaatgatggggtttaggtaccgatgtcagcagtgccacaattaccagctgtgccagaactgcttttggagggggcacgcaggtggccctcacagcaaccagcaccagatgaaagaacatagcagttggaagtctccggcaaagaagcttagtcacgcgatttccaagtccctgggctgtgtgccgacacgtgagccccctcatcccgtgttccctgagcagcccgaaaaaccgctcgacttagcccacatagtgcccccaaggccacttacgaacatgaacgatacaatggtgtcccatatgtccagcggcgtcccaaccccaactaagagcgtactagactctccgtcacgtctggacgaggagcatcggcttatcgccagatacgcagcacgattggctgccgaagccggaaatgtgacccggccacccaccgacttatctttcaattttgatgccaacaagcaacaaaggcagctcatcgccgagctggagaacaaaaaccgggaaatcttgcaagaaattcagcggctgcggctggaacacgagcaggctagtcagccaactcctgaaaaagcccagcagaatccgacgctgcttgccgaacttcggctgttgcggcaaaggaaggatgaactggaacagcgcatgtcggctttgcaggaatctaggagagagctgatggtccagctggaagagctgatgaaactgttgaaggaggaggaacagaagcaggctgctcaggcaacaggcagtccacacacatcacccacccacgggggaggaagaccaatgccaatgcccgtccgttctacaagcgccggatctacaccaactcactgtccgcaggactcattgtcaggagttgggggagacgttcaggaggcatttgctcaagccgaggaaggggcagaagaggaggaggagaaaatgcagaatgggaaagaccgcggatag

SEQ ID NO: 221549 - DNA, 1773 bp, Artificial Sequence
  Description of Artificial Sequence: Synthetic coding sequence
atgattgaagaatccggcaataaaaggaagaccatggccgagaagagacagctgtttatcgaaatgagagcacagaacttcgatgtaattagactgtccacatatcggacggcctgtaagctacggtttgttcagaaaagatgtaaccttcacttggttgacatttggaatatgatcgaagccttcagagacaatggactgaacacattagatcatactacagagatttctgtcagtcggctagaaactgtgattagctctatctattatcaactcaataagcgcttacccagcacccaccagatttccgtggagcaatcaatcagcttacttctgaactttatgatcgctgcctacgacagcgagggcagggggaaacttactgtgttcagtgtgaaagcaatgctggctacgatgtgtggcggtaagatgctcgataaactccggtatgtgttttctcaaatgtccgatagcaatgggcttatgatctttagcaagtttgatcaatttctcaaggaggtgctgaagttgccaacagcggtgttcgaaggtccctcctttggctataccgaacactccgtccgaacctgctttcctcagcagcgcaagataatgcttaatatgttccttgacactatgatggctgaccctccacctcagtgcctagtgtggctgccccttatgcacagactcgcccatgtggagaatgtctttcatcccgttgagtgttcttattgtaggtgtgagtcgatgatgggcttccgctatagatgccagcaatgccataactaccagctgtgtcagaattgtttttggagagggcacgctggtgggcctcattcgaatcagcatcaaatgaaggaacattcctcatggaagagccccgcaaaaaaattgtctcacgccattagcaagtcactgggttgtgtgcccaccagagaacctccacatcctgtgtttcctgaacagcctgaaaaaccactcgacctcgcacacatcgttccaccgaggcccctaacaaatatgaatgacaccatggtcagccacatgagcagtggagttcctactcctacaaaaagtgtcttagatagccccagccgactggacgaagagcataggctgatcgccaggtatgcagcaaggctcgccgctgaggctgggaatgtgacccgcccaccgaccgacctgagcttcaatttcgacgctaacaaacagcagcggcaactgatcgccgaattggagaataaaaacagagaaatccttcaggaaattcagagacttcgactcgagcacgaacaggccagtcagccaacaccagagaaggctcaacagaaccccacactgctagcggaactgcggctgctgcgacagcgcaaggacgagttggagcagaggatgagcgcgctgcaggagtctaggagggagcttatggtgcagttagaagaacttatgaagctgctcaaggctcaagccacgggatcccctcatacaagtccgacacatgggggaggacggccaatgcccatgcccgtgcggtctacatccgctggcagtacaccaacacattgcccacaagatagtctgagcggggtggggggtgatgtgcaggaggcttttgctcagggcactcgcaggaacctgcgtaatgacctcctcgtcgccgcagacagtatcactaacactatgtcttccctggtgaaagagcttcacagtgcagaagaaggagcagaggaagaggaagagaagatgcagaatggaaaagaccgaggctag

SEQ ID NO: 221550 - DNA, 1830 bp, Artificial Sequence
  Description of Artificial Sequence: Synthetic coding sequence
atgatagaagagagtggtaacaaaagaaagacaatggcagaaaaacgacagctcttcatcgagatgagagcacagaatttcgatgtcatcaggctctccacataccgtacagcatgtaaactccggttcgtgcagaaaaggtgcaacctccacctagtagacatttggaacatgatcgaagcttttagggataacggactgaacactctggatcataccaccgagataagcgtgtcaaggctagaaactgtaattagcagtatttattatcagctcaataagaggctgccctccacgcatcagatctcagtagagcagagtatctccttgcttctcaatttcatgattgccgcttatgactcggagggcagggggaaactgaccgtgttcagcgtgaaagctatgctggccaccatgtgtggcggaaagatgttagataagctgagatatgtgttctcgcagatgagcgattctaatgggctaatgatattttccaaatttgaccagtttcttaaggaggtattaaaactgcccaccgccgtgttcgagggaccctcatttggctatacagagcattcggtccgaacctgctttccccagcaaaggaaaattatgctcaatatgttcctagacaccatgatggccgatcctccccctcaatgccttgtctggctacccctcatgcacaggcttgctcacgtggaaaatgttttccaccctgttgaatgctcttactgccgatgcgaaagcatgatgggattccgctataggtgtcagcagtgtcataactatcagctgtgtcaaaactgcttctggcggggacacgcaggcggtccacactccaaccagcaccagatgaaagaacattccagctggaagtctcctgcaaagaaactgtctcatgctatcagcaaaagcttgggctgcgtccctactagggagcctccacaccctgtgtttcccgaacagccggaaaaacctctagatctggctcacattgtacccccacgtccactgactaatatgaacgacaccatggtgtcccatatgtcgtctggggtgcccactcccaccaaacgactccagtactctcaggacattccttcccacctagcggacgaacacgcactgatcgctagttatgtcgcaaggttacagcactgtgctagggtcctggactccccctctcgtctcgatgaggaacataggctcatcgctcgttacgccgctcggctagcagccgaggcaggtaatgtgacacggccacctacggacctttctttcaatttcgatgcaaataaacagcagagacagctcatcgcggagctggaaaataagaacagggagatcctacaagagatacagagactgaggctggagcacgaacaggcttcccagccaaccccagaaaaggctcagcagaatccaacgctgcttgccgagcttcgcctgttgcggcagaggaaagacgaactggaacagcgaatgtctgccctgcaagaatccagacgggaactgatggttcagctggaagaacttatgaaattgctcaaggaagaagaacaaaagcaagccgctcaggcgaccgggagcccacacacttccccaacccacggcggtggtcgacctatgcccatgccagttaggtcaacctccgcgggttccacccccacccactgtcctcaggactccttatcaggtgtgggcggtgacgttcaggaggccttcgcccaggggacgcgacgcaatcttaggaatgacctgctggttgcagctgatagcattaccaacacgatgtccagcctggtgaaagagcttcactctgggtag

SEQ ID NO: 221551 - DNA, 1638 bp, Artificial Sequence
  Description of Artificial Sequence: Synthetic coding sequence
atgattgaagcttttagagataatgggctaaatacgctcgaccacactaccgagatttctgttagtcggcttgaaacagtgatcagctccatctactatcagctgaacaaaaggctcccgagcacacatcagatctccgtggaacagagcatctccttgctgctcaatttcatgatagcggcatacgacagcgaggggcgaggaaagctcacagtcttttcagttaaggcaatgctcgcaaccatgtgcggcggaaagatgcttgacaaactgcggtatgttttctcccagatgtcagacagcaacggattgatgatcttctctaagttcgatcagtttctgaaggaggtactgaaattacccacagcagtgttcgaaggacccagcttcggttatacagagcacagtgtcagaacctgcttcccccagcagaggaaaatcatgctcaatatgtttttagacactatgatggccgaccctcccccacagtgcttggtctggcttcccctcatgcaccggctggcccacgtagaaaacgtcttccaccccgtggagtgttcctactgtagatgcgagtctatgatgggattccggtatagatgtcagcagtgccacaattatcaactgtgccagaactgcttttggcggggtcatgccggtggacctcactcaaaccagcaccaaatgaaggaacattcttcttggaaaagtccagccaaaaagctttcgcacgctatctccaagagcctggggtgtgtacctacgcgagaacctcctcatcccgtgtttccagagcagcctgaaaaacccttagacctggcacatatcgtgccacctcgaccccttaccaacatgaatgatacaatggtgtcccatatgagcagcggcgttcccactccaactaagaggttgcagtactcccaagacatcccctcccacttagctgatgagcatgcattaatagcgagttacgtggccaggctgcagcactgtgcgagggtgctggattctccatctcgattggacgaggagcaccgcctgatagcacggtacgctgcccgactggccgctgaggcaggaaacgtgacgcgtcccccaaccgacctatctttcaactttgatgcaaacaaacagcagcggcagcttatcgcagagttggaaaacaagaaccgggagattctgcaggagatccaaaggctgcgccttgagcatgagcaggccagccagccgaccccagaaaaggcgcagcagaatccgacactacttgctgaactgcggttactgagacagaggaaggatgagttggagcaacggatgtctgctctgcaggagagccggagggagctgatggtacagttagaagaactgatgaagctgctgaaagctcaggccactggttccccccacactagcccaactcacggaggagggcgaccaatgcccatgccagtgcgtagcaccagcgctggctccacacccacacattgcccacaggactccctcagtggagtgggcggagatgtccaagaggcattcgcccagggcactcggaggaaccttaggaacgacctgctcgtggctgccgattccattaccaatacaatgagcagcttggttaaagagctgcactccggctag

SEQ ID NO: 221552 - DNA, 960 bp, Artificial Sequence
  Description of Artificial Sequence: Synthetic coding sequence
atgaccgacgttttttctcagatgtctgactcaaatggactcatgattttcagcaagtttgatcagttcctgaaggaagttctaaagcttccaacagcagtctttgaaggcccatccttcgggtatacagagcacagtgtgagaacctgtttcccgcagcagcggaagattatgctaaatatgtttctcgacactatgatggcagaccctccccctcagtgtcttgtttggcttccactgatgcacaggctggcacacgtcgagaacgtgttccacccagttgagtgctcttattgcagatgtgagagcatgatgggtttccgctaccgctgccagcagtgccacaattaccagctgtgtcagaactgtttctggagaggtcatgctggcggtcctcactctaatcagcatcagatgaaggaacactcatcttggaaatctcccgctaagaagctctcacatgctataagcaaatccctcggctgtgtgcctacacgagaaccacctcatcccgtgtttcctgagcagccagagaagccactggatctggcccatattgttccgcctagaccccttactaatatgaacgataccatggtgtcccacatgagctcaggagtccctaccccgaccaaacggctccaatacagtcaagatatcccaagccaccttgccgacgaacatgctctcattgcaagttacgtggccagacttcagcactgtgctcgtgtactcgactctcccagccggctagacgaagagcacaggctcatagccagatatgcggctcgactggcagccgaggccggtaacgtaacccgaccaccaaccgatctgagtttcaacttcgacgcaaataagcagcagagacaactgatcgccgagctggagaataaaaaccgtgagatcttgcaggagatccaacggttgcgcctagagcacgaacaggcatcacagtag

SEQ ID NO: 221553 - DNA, 1251 bp, Artificial Sequence
  Description of Artificial Sequence: Synthetic coding sequence
atgttaaacatgttcttggatactatgatggcagacccaccccctcagtgcctggtctggctaccactgatgcatcggcttgcacatgtggaaaatgtcttccaccccgtggagtgttcttactgccgatgtgaaagcatgatgggtttcaggtaccggtgtcagcagtgccacaactatcagctatgtcagaattgcttttggagggggcacgcagggggacctcactcaaatcagcaccagatgaaggaacactcatcttggaagtcgcccgcaaagaagctgagccacgcaatcagcaaaagtctcggctgtgtcccaactagggagccgcctcatcctgtgtttcccgagcagccagagaagcccctagatctggctcacattgtaccgccaaggccgctcaccaacatgaatgacacgatggtgtcccatatgtcatccggcgttccaaccccgaccaagagactgcagtacagtcaagatattccaagccacctcgcagatgaacacgctctgattgcgagctacgtggccaggctgcaacattgtgcccgagtactcgacagcccctctcgacttgatgaagaacacagactgatcgcaagatatgccgcaaggctggcagccgaggctggcaacgtgactaggccacctaccgacctctcgttcaatttcgatgctaataaacagcagcggcagctcatcgccgaacttgagaacaaaaatagagagatcctccaggagatccagcgcctgaggctcgagcacgaacaggctagccagccgactcctgagaaagcccaacagaaccccactctgctggccgagcttaggctgttacggcagcgcaaggatgagctcgaacagcgcatgagtgcgctgcaagagtctcggagagagctgatggtacaattagaagaactgatgaaactgctcaaggcgcaggccactgggtccccgcacacgtcaccaacccatggtggagggcgaccgatgcccatgcctgttaggagcacctccgccggttctactcctacacactgtccacaggactccctctcaggtgtgggcggagacgtgcaggaagctttcgcccagggcacaagacgcaatctgagaaacgatcttctggtggctgctgattcaataacaaacactatgtcatccctcgtgaaggaactgcattctgcagaagagggcgctgaggaagaggaggagaaaatgcaaaacggcaaagaccggggatag

SEQ ID NO: 221554 - DNA, 2688 bp, Artificial Sequence
  Description of Artificial Sequence: Synthetic coding sequence
atgcgaatgagcgtggggttgtctcttcttcttcccttaagcggccgaacatttttacttttgctgtcagttgtcatggcacagagccattggccaagcgaacccagcgaagcagtgcgcgattgggagaaccagctggaagcaagtatgcactcggtcctgtctgacttacatgaggccgtgcccactgtagtgggaatacccgacggtaccgccgtcgtggggagaagctttagagtgacaatccccacagatcttatcgcttctagcggcgacatcatcaaagtcagtgcagccggaaaggaagccctcccatcatggctacactgggactctcaaagtcacactctggagggactgcctttggataccgacaaaggggtgcattatatctcggtgtcagccacaaggctgggcgctaatggttcccacattccacaaacctcttctgtgttctctattgaggtgtatcccgaggatcacagtgagcttcagagcgttcgtactgcctccccagacccgggagaggtggtcagctccgcatgtgccgctgacgaacctgtcaccgttctcactgtgattctggacgcggatcttaccaagatgaccccaaagcagcgcatagacctcttgcaccgtatgcgatcctttagcgaggtggagctccataacatgaaactagtgccagtcgtgaacaataggttgtttgacatgtccgccttcatggcagggcctggcaacgcgaaaaaggttgtggagaacggcgctctgctgtcgtggaagctggggtgcagtctgaaccagaattctgtacccgacatccatggagtcgaagcgcctgcgagagagggggcaatgagcgcccagctcgggtacccagtcgttgggtggcacattgcgaataaaaaacctcctctcccaaaaagagtacgtagacagatccatgcgacccccactcccgtcacggccatcgggcctccaacaacagccatccaggaaccgccttcccgtatcgtccctaccccaacctctcctgccattgcacctcccaccgagacaatggcccctcccgtccgggaccccgtgcctgggaaacctacagtgacaattcgaacacgcggagccattatccagacacccaccttgggtccaatccaacccacccgggtgagtgaggcaggcactaccgtgccaggacagattcggcctacgatgaccataccgggttacgttgaacccactgctgtggctacccctccgaccacaacaaccaaaaaaccgagggtctccactcctaaacctgctaccccctctaccgattcaaccaccactacaactagaagacctaccaaaaagcctcggacacctagaccggttcctcgggtgaccacaaaggtgagtatcactcgacttgagacagccagtccacccactaggatcaggacgactactagtggggttcctcgcggtggggaacccaaccagcgccctgaacttaagaatcacatcgaccgggtggatgcgtgggtgggaacttactttgaggtgaaaatcccatcggatacattctacgaccacgaagacaccaccaccgacaagctgaaactaacccttaagcttagagagcagcagttagtgggcgaaaaatcctgggtccagtttaacagcaactcacaactgatgtacggattacccgactcatcccacgttgggaaacacgaatatttcatgcacgcgactgacaaagggggactctccgctgtggacgccttcgagatacatgtgcacagacgaccacagggcgatagggccccagctcggttcaaggccaagttcgttggcgatcccgctcttgtactgaacgacattcacaagaagattgctcttgttaagaaacttgccttcgcctttggcgatcgaaattgtagcacaattacacttcagaatattactcgcggatcaattgttgtggaatggacgaacaacaccctgccgctggaaccctgtcccaaagagcaaatcgccggattgagtaggcgaattgcagaagatgacggcaaaccaaggccagcattctctaatgcattggagcctgactttaaggcaacatcaattactgtgaccggttccgggagctgcaggcatctgcagtttatccccgtggtgcctccgagaagagttccatccgaagctcctcctactgaggtccctgaccgggaccccgagaagtcctccgaggacgacgtgtacctgcacacagtcatccccgctgtagtggtggcggctattttgttgatagccggtatcatcgcaatgatctgctatcgaaagaaaagaaagggaaagttaacactagaggaccaagcaacattcatcaagaaaggcgttcccattatattcgccgacgagttggatgacagcaagccacccccaagttccagtatgcccctcatacttcaggaagaaaaggccccattgccaccacccgaatatccaaatcaatccgtgcccgagacaacacctcttaaccaggataccatgggcgagtacacgccactgcgggacgaggaccccaacgcacctccctaccagccgccaccaccattcacagcgcctatggagggcaagggatctcgccctaagaacatgacgccttacagaagtcctcctccgtatgtcccaccttag

SEQ ID NO: 221555 - DNA, 432 bp, Artificial Sequence
  Description of Artificial Sequence: Synthetic coding sequence
atgaccccgaaacagaggatcgaccttcttcatcgcatgcgttccttctccgaagtcgagcttcacaacatgaaactagtgccagtcgttaataacagactcttcgatatgtcagcctttatggctggtcctggaaatgcaaaaaaggtggtcgaaaacggggctttgctttcctggaaactgggctgctcactcaatcagaatagcgtacccgacatccatggagttgaggctcccgctcgggagggcgctatgagtgcccaactcggttatcccgtggtcggatggcacatagccaataagaaaccacctgcactctccggtccacctaagcctcagtcgtcttggcgtgacttcggggatttctttatctttatcttctgcctcacagcatttggactgttcattgagaattcctcccttcacttttag

SEQ ID NO: 221556 - DNA, 267 bp, Artificial Sequence
  Description of Artificial Sequence: Synthetic coding sequence
atgaggatgagcgtgggtctgagcttgctcctgcctctgtccgggaggacctttctgctgttgctgtccgtggtgatggcacaaagtcactggccttcggagccatctgaagctgtgcgtgactgggagaatcaactggaggcaagtatgcacagtgttctttccgacctgcacgaagccgtacctacagtcgtgggcattccggacggcactgccgtagttggtcgctccttcagggttacaattcctacagacttaatcgcttag

SEQ ID NO: 221557 - DNA, 48 bp, Artificial Sequence
  Description of Artificial Sequence: Synthetic coding sequence
atgcgcatgtcagtcgggttgtcactgctgttacctctgagtgggtag

SEQ ID NO: 221558 - DNA, 321 bp, Artificial Sequence
  Description of Artificial Sequence: Synthetic coding sequence
atgaggatgtctgtgggcttgagtctgttactacctctctcaggcaggacgtttctactgctgctgtcggtagtgatggctcaaagccactggccctccgaaccatcagaggcagtgagggactgggagaaccagctcgaggcttctatgcactctgttttgtcagatttgcacgaggcggtgcccacggtcgtcgggattcccgacggcactgctgtagtgggacgatccttccgtgtcactatcccaaccgatctgatcgcgtcgtccggcgatataatcaaggtgtcagctgcgggaaaagaagcactgcctagctag

SEQ ID NO: 221559 - DNA, 291 bp, Artificial Sequence
  Description of Artificial Sequence: Synthetic coding sequence
atgcggatgagtgtaggcttaagtctgcttctgcctctttctgggagaacctttctgctcttactttcggtagttatggcacaatctcattggccctccgaacctagcgaagccgtgcgtgactgggaaaatcagctggaagcctctatgcattccgtgttatcagatctgcacgaggcagtgccaactgttgtgggcatccctgacggtacagccgtcgtgggtcggtccttcagggtgaccatccctaccgatctgatcgcgagttccggagatatcatcaaggtatag

SEQ ID NO: 221560 - DNA, 30 bp, Artificial Sequence
  Description of Artificial Sequence: Synthetic coding sequence
atgcgcatgtccgttgggctgtccctgtag

SEQ ID NO: 221561 - DNA, 354 bp, Artificial Sequence
  Description of Artificial Sequence: Synthetic coding sequence
atgcgaatgagtgtggggctgtccctccttctgcctttaagtggcaggacctttcttctgctcctgtccgtcgtgatggcacaaagccactggccctctgagccttccgaagccgtgagagattgggagaatcagcttgaggcctcaatgcactcagtcctgtctgatctgcacgaagccgttcctaccgttgttggaatccccgacggaacagcggtggtcggcagaagctttcgtgtgactatcccaactgacctgatcgcctctagcggggacatcattaaagttagcgctgccggaaaggaggccctccctagctggttacattgggactctcagagtcacacactctag

SEQ ID NO: 221562 - DNA, 159 bp, Artificial Sequence
  Description of Artificial Sequence: Synthetic coding sequence
atgcgtatgtccgtcggcctcagtctgttactgcctttgtctggacgtactttcttactgctcctatcggtcgtgatggcccagagccattggcctagtgagccgtcggaagctgtgcgtgactgggagaaccagctcgaggccagtatgcatagttag

SEQ ID NO: 221563 - DNA, 261 bp, Artificial Sequence
  Description of Artificial Sequence: Synthetic coding sequence
atgcgcatgagcgtcggcctgtccctcctgctccctttgagcgggagaaccttcctccttctcctgagcgtggtcatggctcagagtcattggccttcagaacccagtgaagcagtgagggactgggagaaccagctcgaggcctctatgcactcggtactttccgatctgcatgaggccgttcctacagtcgttggcatccccgacggcacagcagtggtgggcaggtcattccgcgtgactattccaacagatctttag

SEQ ID NO: 221564 - DNA, 126 bp, Artificial Sequence
  Description of Artificial Sequence: Synthetic coding sequence
atgcgaatgtctgtgggcctgtccctgctgctgccactgagcggacgcaccttcctcctgctgctctccgtggtgatggctcagtcacattggccaagcgaaccctccgaagctgtacgggactag

SEQ ID NO: 221565 - DNA, 2688 bp, Artificial Sequence
  Description of Artificial Sequence: Synthetic coding sequence
atgcgtatgtccgtgggattatctttgttactgcccttgtcaggcagaacctttctgttactgctgtccgtggtgatggctcaaagtcattggcctagcgaaccatctgaagcagtcagagactgggagaatcagctggaagctagtatgcattctgtcctctctgacctgcacgaggccgtgcccaccgttgtgggtattcccgacgggactgccgtggtgggacggtcttttagagttactatccccacggatctaatcgccagttctggggatataattaaggtcagcgccgcaggcaaggaggccttgcccagctggttgcattgggattcacagtctcatactctggagggattgccgttagataccgacaagggcgttcattatatttcagtgtccgcgacccgactcggagccaacggaagtcacattccccagacgtcatctgtattttcaatagaggtatatcctgaggaccactccgaactccaatctgtgagaaccgccagccccgatcccggtgaggtagtaagttcggcttgcgcggcagacgaacctgttaccgtcctgacggtgatacttgatgctgatctgacaaagatgaccccaaaacagcggattgaccttctgcacaggatgcggtctttctccgaggttgaactccataacatgaagcttgtgcccgtcgtgaataacagattgttcgacatgagtgcctttatggctggccctggaaatgcgaaaaaagtcgtcgaaaacggggcactcctcagctggaaactgggatgtagtttgaaccagaattccgtgcccgatatacatggggtggaggcacccgcaagagagggagctatgagcgctcagcttggctatccagttgtggggtggcacattgctaacaaaaagcccccactgcccaaacgggtgcgcagacagatccatgcaacgccaacccctgtaacggcgattgggcctccaaccacagctatccaagagccaccgagtagaatcgtgccaacaccaacaagcccagcgatcgctccacccactgagaccatggcgcctccagttagggacccagtccctggaaaacctacagttaccatcaggactaggggcgcaattattcagacccccactctcggtccaattcaacctactcgcgtgagcgaggcaggcaccactgtgccaggacaaattagacccaccatgactatccctggatatgtggaaccaacagccgtggctacacccccaaccactaccaccaaaaaaccacgggtgagcacccctaagcctgcaactccatcaaccgacagcacgaccacgaccaccagaagaccaacaaaaaagccgagaacacctagaccagtgccgagagtgacgaccaaagtgagcattactcgcctggagacagcttcacccccaacccgtatcagaactacaactagcggggtgccacgcggtggcgagccaaatcagcggcctgaacttaagaatcacatcgatcgtgttgacgcctgggtcggcacatacttcgaagtcaagatcccgagcgacacattttacgatcacgaagatacgacgactgataagttaaagctgacactgaagcttagggagcaacaactcgttggcgagaagagttgggttcagttcaactccaacagtcaacttatgtatggtctgcctgactcctctcacgtggggaagcacgagtactttatgcacgccacagataagggcggactgtctgccgtggatgcattcgaaattcatgttcaccgcaggcctcaaggcgatcgggcacctgcccgatttaaagcaaagttcgtgggcgatcctgcgctagttttgaatgacattcataaaaaaatagccctcgttaagaagttggcattcgccttcggggatagaaattgcagtacaattactctccagaacatcacaagagggtcaatagtggtggagtggactaacaatacgctgcctctcgaaccttgccctaaggagcagattgcagggctctcacggcgtattgcggaggatgacggcaaacctagacccgcattctcaaatgccctggagcccgacttcaaggctaccagtattacagtaaccgggtcaggctcatgtcgccatttacaatttatacccgtggtgccccctagacgtgttccatccgaggctccaccaaccgaggtgccggacagggatccagaaaagtcctccgaagacgacgtgtatttacacacagtcatcccagcggttgtcgtggcggctatcctcctgatcgccggaattatcgcaatgatctgctaccggaagaagcgcaagggcaaactaactttggaagatcaggccacattcattaagaaaggtgtacctatcatttttgctgatgaactggatgactccaagccgccacccagctcctctatgcctcttatcctgcaggaagagaaagccccactgcctccaccggagtaccctaaccagtccgtgcctgagaccacacctctgaatcaagataccatgggcgaatacacaccgctcagagacgaggatcccaacgccccaccataccaaccacctccccctttcactgcgccaatggagggcaaagggagcaggcctaaaaatatgacaccctaccgcagccctcccccttacgtgccaccatag

SEQ ID NO: 221566 - DNA, 2688 bp, Artificial Sequence
  Description of Artificial Sequence: Synthetic coding sequence
atgcggatgagtgttggattgagtttactgctgcccctgtctggcaggactttcctgctgctgctcagcgttgtcatggcacagagtcattggccatcagaaccttcagaggcagtacgcgattgggagaatcaattggaggcatctatgcattccgtgctgagcgatcttcacgaggcagttcccacagtggtgggcatccctgatggtactgcagtggttggtcgctcttttagggtgacaatcccgactgatctcatcgcctcaagcggggacattatcaaggttagcgccgcaggcaaggaagctctcccaagctggctgcactgggactcacagtcccatacattggagggcttgccattggataccgacaagggcgtgcactatatttcagtgtctgctactagactgggcgctaacggcagccacattccacagacctcctcggtcttctctattgaagtgtaccccgaagatcatagcgaattacaaagtgtaaggactgccagcccggatcctggcgaggttgttagttccgcttgtgctgcagacgaacccgtcacagtgcttacagtgatactggatgctgaccttactaagatgactccaaaacagagaattgatctgctccatcgcatgcgaagctttagcgaggttgagctgcacaatatgaaattagtacctgtggtaaataacaggctgtttgatatgagcgcattcatggcaggcccaggtaatgccaagaaggtagtagaaaatggcgctctgctgtcctggaaattgggctgttcactcaatcaaaattctgtgcccgacatacacggagtcgaggcgccagctcgtgagggggctatgtcagcacagttggggtatcccgtggtgggatggcatattgcgaacaagaagccgcctcttccaaagcgtgtaagaaggcaaattcacgccacccccactcccgtcactgctatcgggcctcctaccacagcaattcaagagcccccatccagaatagtgccaacacctaccagcccagccatcgccccacccacagaaacaatggcacctcctgtgcgagacccagtccctggcaagccgactgtgaccatcagaacaaggggagccattatccagactccgactcttgggccaatacagcccactagggtctccgaagccggtacgacagtcccgggacagatcagaccaaccatgacaatccctggatatgtggagcccaccgctgtcgcaactccacccaccaccactaccaaaaagccacgggtctccacacccaaacctgctactccttccactgattcaacaactaccacaacccgtcgcccaaccaaaaaaccccgaacaccacggcctgtacccagagtcactactaaagtctccatcacgagactagagaccgcatcgccacctacgcgcattaggacgactacgtcgggggttccacgcggaggtgagcctaaccagaggcccgagttgaagaatcacatcgaccgcgttgatgcatgggtgggtacctattttgaggttaaaattccctccgacaccttctatgaccacgaagatacaaccacggacaagctaaaactgactctcaaactccgagagcaacagctggtgggagagaaatcttgggtccagttcaattctaatagccagctcatgtacggactgcctgactcatcccatgttggtaaacacgaatattttatgcatgccacggataagggaggactttcggctgtggatgctttcgaaatccacgtgcataggcggcctcagggcgaccgagcccctgcgcgatttaaggcgaagtttgtgggtgaccctgcgctggtgctgaatgatatccataaaaaaattgcactggtcaagaaactcgcatttgctttcggagacagaaactgctccacaatcaccctccagaacatcactcgcggtagtatcgttgtggaatggactaataacacactgcctcttgagccttgtccgaaagagcagatagcgggattatccaggagaattgctgaggatgatggaaaacctcggcctgcattttctaatgctctggagcctgatttcaaagccacgtctattactgtaaccggttcaggcagctgccgacacctgcagtttatccccgttgtccctcctaggcgggtgccttcagaggctcctcctaccgaggttcctgacagggacccagaaaagtcaagtgaagacgatgtgtatctccacaccgtcattcccgctgtggtggtagcagccatcttattaattgctggcatcatcgccatgatctgctaccggaagaaaaggaaaggaaaactgactctagaagaccaggcgactttcattaagaagggtgtacctatcatctttgcagatgaacttgacgatagcaaacctccacctagttctagcatgcccctgatcctgcaggaagaaaaggcccctctgccaccacctgagtacccaaatcaatctgtcccagagactaccccccttaaccaggacacaatgggggagtacactccgcttcgagacgaggatccaaacgcccctccttaccaaccaccacctccatttacggcgcctatggaagggaaaggaagccgtccaaaaaatatgactccgtatcggtcaccgccaccatatgttcccccttag

SEQ ID NO: 221567 - DNA, 2688 bp, Artificial Sequence
  Description of Artificial Sequence: Synthetic coding sequence
atgaggatgagcgttgggctgtccctattactcccactttctggcagaacttttttgttactgctctctgtggtgatggcacagagccattggccatccgagccttccgaagctgtccgggactgggaaaatcagctagaggcttccatgcattccgttctctcagaccttcacgaggctgtgcccaccgtcgtgggtatacctgacggcaccgccgtggttggtcggtcgtttcgcgtcacaatcccaactgatctgatcgcgtcatctggagacatcatcaaggtcagtgcagccggaaaagaggcgctgccatcctggctgcactgggacagccagtcgcacacattagagggcttacctctggataccgacaagggcgttcactacatttccgtgtctgcaacccgcctcggggctaacggaagccatataccacagacatccagcgtcttctctatcgaagtctaccctgaagaccattctgaattgcagtcagtgagaacagcttcgccggacccaggcgaagtcgtatcaagcgcctgtgctgccgatgagccagtaacagtgcttaccgtgatcctcgatgctgacctaacgaagatgacccccaagcagcgaatcgacctcctgcaccggatgcggagcttctctgaagtagagcttcacaatatgaaactggtccccgtggtcaacaatcgccttttcgacatgagcgcatttatggcagggcctggaaatgcgaagaaagtggtagagaacggcgcactgctcagctggaaactaggctgttcattaaaccagaactccgtgccggacatacacggggtggaggcgccagctagggagggtgcaatgtctgcacaattgggctatccagttgtgggctggcatattgcaaataagaagccaccacttcccaagcgcgtccgacgacagattcacgcaacacctacacccgtgaccgccataggtccacccaccactgccatacaggagcccccaagtagaatcgtgccaacacccaccagtccggcaatcgcgcctcctacggagactatggcaccacccgtcagggaccctgtgcctggcaaaccaactgtgaccattaggactcgaggcgcaattattcagacgcccactctcgggcctatacagccaaccagagtgagtgaagcagggacaaccgtgcctggacaaatccgcccaacaatgacgattcccggttatgtcgagcccacagccgtcgctacaccccctactaccaccactaaaaaacctcgggtgagtacaccaaagcctgccaccccaagcaccgattcaaccaccactaccacccggaggccaaccaagaagccacgtacaccacggcctgtgccacgggtcacaactaaggtctcaataacccggctggaaacagcgtcaccacccacccgaatccggacaactacaagtggcgtccctaggggcggtgagccaaaccagaggccagaactcaagaaccatatcgacagagtggacgcatgggtggggacttactttgaggtgaagatcccatctgatactttttatgaccacgaagacacgaccaccgacaagctgaaactgactcttaaactgagggagcagcagctggtaggcgaaaaatcttgggttcaattcaactccaactcccaactgatgtacggcctgccagactccagccacgtaggcaaacatgagtacttcatgcacgcaaccgataaaggtggtttgtccgccgtggacgcctttgaaatccatgtgcatcggcgaccgcagggcgaccgcgctccagctagatttaaagctaaattcgtcggggatcccgcactcgtcttgaacgatatacataagaagatcgcactggtgaagaaacttgcctttgcttttggagaccgcaattgtagcacgataacccttcagaatatcactaggggctctatcgttgtggaatggactaacaacaccctgcccctagagccatgccccaaagagcagatcgcaggcctgtcgaggcgcatcgccgaagatgatggcaagccccgacctgctttcagcaatgcactcgagcctgatttcaaggctaccagcataaccgtgacaggatctggaagttgcagacaccttcagtttatcccggtggtgcccccacgcagagtcccaagcgaggccccacccacagaagtgcccgatcgggaccccgagaagagcagcgaggatgacgtgtatctgcatacggtgattccagcagtggtggtagctgcgatcctgctcatagctgggatcatcgcaatgatctgttacaggaagaaacgtaagggcaagctcaccctggaggaccaagctacgtttattaagaagggggtgcctatcatctttgcagatgaactcgatgatagcaagccacccccttcctcctccatgcccttgatactgcaggaagaaaaggccccactgcccccaccagaataccctaaccaaagcgtgcccgaaaccacccccctgaaccaagatacgatgggagaatatacacccctgagggacgaggatcctaacgccccaccataccagcctccaccgccattcaccgccccaatggagggcaaggggtcgcggccaaagaatatgaccccttaccggagtccccctccgtacgtgccaccttag

SEQ ID NO: 221568 - DNA, 2688 bp, Artificial Sequence
  Description of Artificial Sequence: Synthetic coding sequence
atgcggatgtcagtgggactctccctgctgctccctctgtccggacgcacttttctcctgctactgtccgttgttatggcccagtctcattggccctccgagccatccgaggccgtgagggattgggaaaatcagctcgaggctagcatgcattcagtgttgagtgacctacacgaagccgtgcctacagtggtggggattcctgacggaaccgccgtggttggtaggtccttccgcgtcactatcccgactgacctcattgccagttccggcgacatcattaaggtgtccgctgcaggcaaagaagcgcttccatcgtggctacattgggattctcagtcgcacactctcgaagggcttcccctggatactgataaaggcgtccactacatcagcgtctcagccacaagactcggggcaaacgggtcccatattcctcagacgagctccgtgttttctattgaagtctatccagaggaccacagcgaattgcagtctgtgcggacagctagcccagacccgggagaggtggtctcttcagcctgcgccgctgatgaaccagtcaccgtcttaacagtcattcttgacgcagatctgacgaaaatgacccctaagcaaagaatcgatctactgcacaggatgcgctctttctccgaagttgagctgcataacatgaagctcgtgccagtggttaataataggctctttgacatgtcggccttcatggccggacctggaaatgctaagaaggtggtggagaatggggcattgctcagctggaaactgggatgcagtcttaatcagaactccgttcctgacatacacggcgtggaagcccctgctagagaaggggctatgagtgcccagctagggtatccagtggtgggctggcatatcgcgaataaaaagccgcctcttcctaagcgcgtgcgtaggcaaatacatgcaactcctacgcccgtcaccgccataggcccacccaccaccgctatccaggaacccccaagccgcatcgttcctacacccacatcaccagcaattgcgcctcctactgagacaatggcacctccggtcagagatcctgtacccggaaagcccactgtcaccatacgcactagaggagcaatcattcagaccccaaccttgggccctatccagcctaccagagtgtccgaagctggcacaactgtccccggacaaatccggccaacaatgaccattcctgggtatgtggagcctaccgcagtagctacacccccaacgactaccaccaaaaaaccgcgagtgtccaccccaaaacccgcaactccatccacggacagtaccacaaccactactcgacgtccaacgaagaaacccaggacccctagaccagtacctcgggtcacaacaaaggtgagcataacccgactggaaactgcatctccaccaacacgtattaggactaccacctcgggagttcccaggggcggagagcctaaccagcgtcctgagcttaaaaatcatatcgaccgtgtggatgcctgggtgggcacctattttgaggtcaaaatcccctccgacacattttatgaccacgaagacactaccactgacaaactcaaacttacactgaaactacgcgagcagcagctcgtgggggagaagtcctgggtccagttcaactctaactcgcagctcatgtacgggctgcccgattcttcccacgtaggcaagcacgagtatttcatgcacgccaccgacaaaggcggactgtcagcggtcgatgctttcgagattcatgtgcacagacggccacagggagatagggcaccagctcgctttaaggccaaatttgtgggcgacccagctctcgtactcaacgatattcacaaaaagatcgccctcgtgaaaaaactggcctttgccttcggggataggaattgcagcacaatcacactccagaatattacccgtgggtcgatcgtagtggagtggaccaataataccctgccgctggaaccgtgcccaaaggagcagatcgcagggctttccaggcgaattgcagaagacgacggcaaacccaggccagcctttagcaacgctctcgaacctgactttaaggcaactagtatcaccgtcacaggttcaggctcatgcaggcacctccagtttatacctgttgtaccccctagaagagtcccttccgaagcccctcccaccgaggttccggacagggacccagaaaagagttcggaagacgatgtgtatcttcacacagtgataccagctgtcgtcgtggcagctattctcctcatcgccggtattattgccatgatctgctatagaaaaaagaggaaaggcaagcttactctggaggaccaggccacatttataaaaaaaggtgtgccaatcatctttgctgacgagttggacgatagtaagcctccaccaagcagcagcatgcctttgatcctgcaggaagaaaaggcacctctgccacctccagagtatcccaaccagtccgtccctgaaacaacaccgttgaatcaggacactatgggcgaatataccccactccgtgatgaagaccccaacgcgccaccatatcaaccaccacccccattcaccgcacctatggagggaaaggggtcgcggccaaagaacatgacgccttataggtctccacccccttacgttccaccttag

SEQ ID NO: 221569 - DNA, 2688 bp, Artificial Sequence
  Description of Artificial Sequence: Synthetic coding sequence
atgcgcatgagtgttggtctgtctctgctgctgccgctgagcggccgtaccttcctgctgttgctgagtgtggttatggcccaaagtcattggccgtcagaaccctccgaagccgtgagagattgggagaaccaactggaagccagtatgcactctgtgctgagtgatttacacgaggccgtgcctacagtggtcggcatacctgacgggaccgccgtggtgggacgcagctttagagtgacgattcccacagatctcattgcttcatctggggatattattaaggtgagcgctgctggaaaggaagctctgcctagctggctccattgggactcccagagccacaccttagaaggacttccactggacacagataaaggggtccattatatctccgtgtcagctaccagacttggagccaacggcagccatattccgcagacttcgagtgtgtttagtatagaggtgtaccctgaagatcactctgaactgcagagcgtacgaacagcctctcccgatccgggtgaggtggtaagctctgcctgtgccgcagacgaaccagtgacagtgctcacggttattttggacgcagatctgactaaaatgacgcccaaacaacgcatcgacctcctgcaccgtatgcggtcttttagtgaggtggagctgcacaacatgaagttggtgcctgtcgtcaataacaggctgttcgatatgagtgcatttatggcaggccctggaaacgctaagaaggtagtggagaacggggctctactctcttggaaacttggttgttctcttaatcaaaatagtgtgccagacatccacggtgtggaagcacctgcccgtgaaggggctatgagcgcgcagctgggttaccctgtggtgggctggcacatcgcaaacaagaaacccccactccctaagcgcgttcgacgacaaatacatgccacgccaaccccagtgacagcaataggaccacctacaactgctatccaggagccaccatccagaatcgttccaacccccacctctcctgccattgctcccccaaccgagacaatggctccaccagtacgcgaccctgtgccaggcaagccaaccgtcactatacgtacacggggtgccattatccagactccgacgctggggccaatccaaccaacacgagtgtccgaggctgggactacggtaccgggacaaatccggccaaccatgactatcccaggctacgtcgaaccaaccgccgtggccaccccgccaacaacaactaccaagaagcctagggtgagcactcccaagcctgcaacgccatctactgattctacaaccactacaaccaggaggccaaccaaaaagccgaggaccccgagacctgtccccagagtgactacaaaggtgagcataacacgtctggaaactgcgtctcctccaactcgcattcggacaaccacttcaggagtgcctcgcggaggcgaacccaatcagcgtccggagcttaaaaaccatatagacagggtggatgcgtgggtgggcacttacttcgaggttaagattccaagcgatactttttacgatcacgaagacaccaccactgacaagctaaagctgacactgaagctgagagaacagcagctcgtaggagagaagagctgggtgcaatttaacagcaattctcagctaatgtatgggcttcctgattcctctcatgtgggcaagcatgagtattttatgcacgcaaccgacaagggaggtctaagtgccgtggatgcttttgaaatccatgttcaccggcgaccccagggcgaccgggcacccgcaagattcaaagccaaattcgtcggcgacccggctctggtcctcaatgacattcataagaaaattgccctggtgaagaaattggcattcgcgttcggggacagaaattgttccacgattactctgcagaatatcacccgcggttccattgtggttgagtggaccaacaataccctcccactggagccatgtccaaaggagcagatcgctgggttgtcgaggcggatcgccgaagacgatggcaaaccaaggccagctttttccaacgctttagagcctgattttaaagctaccagcattaccgtgaccggttccgggagttgccggcacctgcaatttatcccagtggtccctccaaggcgcgtgccctccgaggcccctcccacagaagtgccagacagggatcccgagaagtcctcagaagatgatgtgtatttacatacagtgatcccggcagtggtcgtggcggctatcctgttgattgccggaataatcgcgatgatctgttatagaaagaaacgaaagggtaaactgaccctagaggaccaggcgacattcatcaaaaagggtgtacccatcatattcgcagacgaattggatgactccaaacctcccccttcgagcagcatgcccctgatactgcaggaggaaaaggctcccctgcctccgccagagtatccgaaccagtctgtccccgaaacaacgcctctgaatcaggataccatgggcgaatacacccctctgcgggatgaggatcccaacgctccaccgtaccagcctccccctccattcacagcgccaatggagggtaagggctcacgccctaagaacatgaccccttacagatccccacccccatacgtacccccttag

SEQ ID NO: 221570 - DNA, 2025 bp, Artificial Sequence
  Description of Artificial Sequence: Synthetic coding sequence
atggccgctgggggagccgagggaggctcaggtcccggagctgcaatgggagactgcgctgagatcaaaagccaatttcgaacacgggaagggttctacaagctgctgcccggagacggagcggctcggcgatcgggaccggcatcggctcagacgccagtccccccacagccacctcagcccccaccagggcctgcctcagcatccgggcctggcgcagccggtcccgctagctctccaccccctgctggccctggcccaggccctgcgttgccagctgtgcgcctgtctctggtgcgcctgggcgaacccgatagcgccggagcaggagagccccctgccacgccagccggactggggtcaggtggcgaccgcgtctgtttcaacctgggaagagaactgtatttctaccctggttgctgccggagaggttcccagagatccatcgacctgaataaaccaatagacaagaggatttataaaggcacacagcccacctgccatgactttaaccagttcactgccgcaacagagacaattagcttattggtgggcttctctgctggccaggtgcagtatctggatctgataaagaaggacaccagtaagctgtttaatgaagaaaggctgatcgacaaaacgaaggtgacctacctgaagtggctgccggagtctgagtcgctgtttcttgcctcacacgcatctgggcacttatacctgtacaatgtctcacacccatgcgcttccgcacctccacagtattcattgctgaaacagggggaagggttctctgtatacgctgcgaaaagcaaagcccctcgtaacccgttggccaagtgggctgtgggtgaagggcctctcaacgaattcgccttcagccccgacggcaggcaccttgcatgtgtatcacaggacggctgccttagagtgttccatttcgactctatgctgctacgagggctcatgaaatcctatttcggcggactgctctgcgtgtgctggtccccagatggccgttacgtggtgacaggtggtgaggatgacctcgtgacggtgtggagtttcacggaaggcagggtggtggccagggggcacggccataagtcgtgggtgaacgcggtggcgtttgatccttacactacgcgggctgaagaggcagcaaccgctgctggtgctgatggcgagcgtagtggcgaggaggaggaggaggagcctgaggcagccggaacagggtccgctggaggcgctcccctctccccacttcctaaagctgggtccattacttatcgctttggatctgcagggcaggacactcagttctgcctgtgggatttgactgaggatgttctataccctcatcctccactggccagaactagaacactgccaggcacaccaggcacaacacctccggctgccagcagctcccgtggaggagaacccggtcctggaccgttgccgaggagccttagtaggtcgaattccctgccacatcctgctggaggtgggaaggccggtgggccaggggtggccgcagagccaggcacaccatttagcattggacgattcgctacgcttaccctgcaggaaagaagagaccgaggagccgaaaaggaacataagagataccattcactcggcaacataagtcggggtgggtcaggcggaagcgggtcggggggtgagaaaccgtccgggcctgttccaaggagccgattggacccagcgaaggtcctgggaacagcgctgtgtccacggatccacgaggtgcccctcctcgaaccattggtgtgtaaaaaaatcgctcaggaaagactgactgtactgctcttcttggaagactgcatcattaccgcgtgtcaagagggtttgatatgtacctgggccagacctggaaaggcctttaccgacgaggaaacggaggcacagacgggcgagggatcttggcctaggtccccgtcaaagtccgttgttgagggaattagctctcagcccggaaacagtccttccgggaccgtcgtctag

SEQ ID NO: 221571 - DNA, 1890 bp, Artificial Sequence
  Description of Artificial Sequence: Synthetic coding sequence
atgtccgccgaagtacgcctgaggcgccttcagcagttggtactcgaccccggttttctgggcttagaacccttgctggacctgttattgggagttcaccaggagctgggggcttcggagctagcccaggataaatacgtggctgatttcctgcagtgggcagagcccattgtggtgcgactgaaggaagtacgcctgcaacgggacgacttcgagatcctgaaggtgattggcagaggggctttcagtgaagtcgctgtggtaaagatgaagcagactgggcaagtgtatgcgatgaaaatcatgaataagtgggatatgctcaaaaggggtgaggtaagctgcttcagagaggaacgcgatgtcttggtcaacggggaccgacggtggatcacccagctgcactttgctttccaggacgaaaactacctatatctggtgatggagtactacgttgggggtgatctgctgactttgctgagtaaattcggcgagcggatccccgctgagatggcaagattctatttagccgagatcgtcatggccatcgactctgtgcaccgtttaggctacgtccaccgggacatcaagcctgataatatattgctggaccgatgtgggcacataaggcttgccgactttgggtcctgtcttaaactccgtgcagatggaacagtccgtagcttagtggccgtaggtaccccagattatctcagtccagagattttgcaagccgtgggtggcggacctggaaccggctcttacggcccagagtgcgactggtgggctctgggtgtgtttgcctatgaaatgttctacgggcaaacacccttttacgcagatagcacagctgagacttatggcaaaatagtccactacaaagagcatctcagccttcctttagtcgatgagggagtgcctgaagaagctcgggattttatccagcgcttgctgtgtcccccagagacgaggctggggaggggcggagctggcgacttccgcacccacccttttttcttcggtctcgactgggatggtcttcgggacagcgtcccacccttcacaccagacttcgaaggggcaactgatacctgtaatttcgatctcgttgaggatggtctgaccgcaatggtgagtggcggtggagagacacttagtgatatcagagagggggctccactgggtgtacacctccctttcgttggatacagctacagctgtatggccctcagagatagcgaagtacctggacccactccaatggaactagaagccgagcagctcttagagccccacgtccaggccccatcactagaaccatccgtgagcccgcaggacgagacagctgaagtcgctgtgccagcggctgtgcccgcagccgaggccgaagctgaagttaccctaagggagctgcaggaagcccttgaagaggaggttttgacacgtcagagcttgagcagggaaatggaggcaatccgaaccgataatcagaatttcgcaagccagcttcgtgaggccgaggccagaaatcgagatctagaggcgcatgtgagacaactgcaggaacgaatggaactcctccaggcagagggagccaccgcagtaacaggagtgccctccccgagggctactgaccctcccagtcacctcgacggtccaccggctgtagccgtgggccagtgccctttggtcggcccaggtcctatgcaccgcaggcacctgttgttgccagccagagtgcccagacccggactgagcgaggcgttgagcttactcctctttgcagtggtactttcccgcgctgcggctctggggtgcatcggattggtggctcacgctggccagctgaccgccgtgtggcgtcgacccggagcagctcgcgctccttag

SEQ ID NO: 221572 - DNA, 1968 bp, Artificial Sequence
  Description of Artificial Sequence: Synthetic coding sequence
atggtcttgcctgtgcagcacgtgtcgcgcggtgccgctgaggccgctccagccgctggcgtgggtccaggcctccctggtgcaggcgcacctgcccgaccctccccaggcagacctcccggtgctgggcgactgcgaacaggacctggtcaggtgcggggacgcttgttggctgttggccctaaatcccgggtctttcagagcgttgtgcaggaaccacctgcctctgaaagccgagcggagcccattgtggtccgactgaaggaagtccgcctccagagagacgattttgaaatcctgaaggtcatagggcgaggagccttctcagaggtggccgtggttaagatgaaacagacaggccaggtatacgctatgaagatcatgaacaagtgggacatgctaaagaggggcgaggtgagttgcttccgggaagaacgagacgtacttgtgaacggcgataggaggtggattacacagctccattttgctttccaagacgagaactatttgtaccttgtcatggaatattacgtaggcggagatttgctgaccttgctgtcaaagtttggagagagaatccctgccgagatggctcgcttttacttggccgagatcgtgatggctatcgattccgttcacagactggggtacgtgcatcgcgatataaaacctgacaacatcttgctggacaggtgtggacacatcagattagctgattttggctcttgcttgaagttaagggccgacgggaccgtgcgtagcttggtggccgttggcacacccgactacctgtcccccgagatcctacaggccgtcgggggaggaccaggcacgggctcttatggtcctgaatgcgactggtgggcccttggcgtcttcgcctacgaaatgttctatgggcagacacccttttatgcagactcgacggcggaaacctacggcaagattgtccattacaaggaacatttaagcttgcctctggtggacgaaggcgtgccagaagaagcccgagattttatccaacggctcctctgtccccctgagacacgcctaggacgaggaggcgcaggagattttaggacgcacccattctttttcggcttggactgggatggcctgcgggacagtgtaccgcctttcactcctgattttgagggcgcaaccgacacctgtaattttgatctagtggaagacggactgacagcaatggtttctgggggtggtgaaaccctgtcagatattcgcgaaggtgcccctctaggggttcaccttccttttgtcgggtattcctacagctgtatggcgctgagggattctgaagtgcccggtcccacccctatggaactcgaggctgagcaattgcttgagccgcatgtgcaggctccttcactcgagcccagtgtttctccccaggatgagacagccgaagtggctgttcccgctgctgtgccggcagctgaagctgaagccgaagttacactgcgagaactgcaagaggccctcgaagaggaagtgctgacgcgccagtctctctcccgggaaatggaggccattagaacggacaatcagaactttgccagccagctgcgcgaagcggaggccaggaacagagatctggaggcacatgttaggcagctccaggaacgaatggagctattgcaagccgaaggggctaccgccgtgaccggagtccccagtcccagagcaacagatccgccaagccaccttgacgggccaccagcagtggcagttgggcaatgcccactcgtgggcccagggcctatgcataggcgccatttgctgctcccggctagggtgccaaggccagggttatcagaagctctgtcactgcttctctttgctgtcgtgctctcccgggcagccgcacttggctgtatcggattggtcgcgcacgctggacagctcactgctgtgtggagaaggcctggggcagctcgggctccctag

SEQ ID NO: 221573 - DNA, 1920 bp, Artificial Sequence
  Description of Artificial Sequence: Synthetic coding sequence
atgggcggacacttctggccccctgagccatacactgtttttatgtgggggtccccttgggaagcggatagtccaagggttaagttgcggggacgggagaagggacgccagacggaggggggtgcctttccactggtgagttcggccctgagtggcgacccaagattcttttcccccactactccgcctgctgagccaattgtggtaaggttgaaggaggtgcgcctgcagcgagacgactttgaaattctgaaagtaataggcagaggcgctttctccgaagtggccgttgtcaagatgaagcagaccggccaggtgtacgcgatgaaaatcatgaataagtgggatatgctgaaacggggtgaggtttcctgtttcagggaggagagggacgtgctggtgaacggcgaccgcagatggatcacgcaactccatttcgcttttcaggacgaaaactatttatatctcgtaatggagtattacgtgggtggggacttgctgacccttctttcgaagttcggcgagcgcatccccgctgagatggcccgtttttatttagctgagattgtgatggccattgactctgttcaccggctaggctacgtgcaccgcgatatcaaacctgataacatactgctggaccgctgtggccatatcagactcgctgacttcgggtcatgtctcaaactgcgcgctgatggtactgtgcgaagtctcgtggcagtaggcacaccagattacttgtctcctgagattctacaggcggtgggtgggggtccgggtactggctcctacggcccagagtgcgattggtgggcactcggcgtgttcgcctatgagatgttttacggccagacccctttctatgcagactctaccgctgagacctatggaaagattgtccactacaaagaacacctgtcgctgcctctggtggacgaaggcgtgcccgaggaagcacgcgatttcattcagcggctgctatgtcctccagagacgagactcggcaggggtggcgctggcgattttagaactcacccatttttctttggattagactgggatggattgcgcgatagcgtcccccctttcactccagactttgaaggagccactgacacatgcaactttgatctggtggaagatggcctcacggctatggtatctggcggtggagagactctgagcgatataagagaaggcgctcccctgggagtccacctgccttttgtcggatattcctacagctgtatggcattgcgcgactcagaggtcccaggcccaacacctatggaactggaagctgagcagctgctggagccccacgtccaggctccctccctcgaaccttcagtgtctccacaagatgagaccgcagaagttgctgttcctgcggcagtgcccgctgcagaggctgaagccgaggtcacgctgcgggagctgcaggaggctttggaggaagaagtgctgacaagacagagcctttcccgtgagatggaggctattaggaccgataatcagaactttgcttcccagcttagggaggcagaggctaggaatagggatttggaggcacacgtaaggcagttacaggaaagaatggagttactgcaggccgagggcgctacagcggtgaccggggtcccaagccctagggctacagacccaccatctcatctggatggccctcctgctgtcgctgtggggcagtgccccctggtgggcccaggtcccatgcaccgacggcatctcttgttgccggcaagagtgccacgcccaggtctctcagaggcactgtctcttctgctgttcgctgtggtgttatctagagctgctgccttagggtgtatcgggcttgtcgcgcacgcagggcagcttacggccgtgtggagacgacctggtgccgctagggctccatag

SEQ ID NO: 221574 - DNA, 1830 bp, Artificial Sequence
  Description of Artificial Sequence: Synthetic coding sequence
atggggggacacttttggccacccgagccttacactgtattcatgtggggtagcccctgggaagccgacagtccgagggtaaagctaaggggcagggaaaagggccgtcaaactgaaggcggagcctttcctctcgtgtcatcagctctctcaggcgacccacgattcttctctccgacaactcctccagccgagccaatcgtagtcagactcaaagaggtgcgtctgcagcgggacgactttgagattctgaaagtgattggacgcggagccttttctgaggtggccgtggtgaagatgaaacagacagggcaggtgtatgcaatgaagattatgaataagtgggacatgctgaagaggggagaagtatcctgttttcgggaggaacgcgacgtcttggtgaacggcgacaggcgttggattacccagctgcatttcgcttttcaagacgaaaattacctctatcttgtgatggagtattacgtgggtggggatctcctgactctcctttccaagttcggggagcgcataccagccgagatggccaggttttatctggctgaaatagtgatggctattgactcggtgcacaggcttgggtatgtacatagggatattaagccagacaacattttgttggatcgttgcggccacattcggttagctgattttggatcttgcctgaagctgagggcagatggcaccgtgcgttctctggtcgccgtgggaacacccgactacctttcaccggagatactgcaagctgtgggtgggggaccaggcaccggatcctatggaccagagtgtgattggtgggcactcggtgtatttgcgtatgaaatgttttacggacagacacccttttacgcagactcaaccgccgaaacatacggaaaaatcgtgcactataaagagcacctgtctcttccattagtagacgagggggtgccagaggaagcgagggattttattcagcgattactctgtccacccgagacaaggctcggacgcggtggggcaggagattttagaacccatccattcttttttgggctagactgggacggcctacgagattcagtgcctccttttacgccggacttcgagggggctacagatacgtgtaatttcgatctggtggaagacggcctcacggcgatggtcagcgggggaggggaaactctttctgatatcagagagggcgcacccctaggggtccacctgccgtttgtcgggtatagctatagctgtatggctctccgggactccgaagtacccggacctacacctatggagctagaggccgagcaactgctggaaccacatgtgcaggctccttcgttggagccaagcgtctcccctcaggacgagaccgcagaagtcgcggtgcccgctgcagtgcccgctgcagaggctgaagctgaggtgactttacgcgaactgcaagaagccctggaagaagaggtgctgacccgccagagcctgtcccgggaaatggaagcaatacgtacagacaaccagaacttcgcttcacagctcagagaagcagaggccagaaacagggacctggaggctcatgtacggcagctgcaggaaagaatggagttgctacaagcagaaggcgctaccgctgttacgggagtaccttccccacgcgcaaccgaccccccatcccatgtgcctagaccagggttatctgaagccctgtccctactgttatttgccgtcgtcctcagtagagcggctgcccttggttgtattggcttagtcgcccatgctgggcaattgactgccgtctggaggcgccctggcgcagctcgggctccttag

SEQ ID NO: 221575 - DNA, 1593 bp, Artificial Sequence
  Description of Artificial Sequence: Synthetic coding sequence
atgtctgcggaggtgcgcctgcggagattacagcagcttgtcctcgatcctggatttctaggactagaaccacttttggatctcctgttgggcgttcaccaggagctcggtgccagcgagcttgctcaagacaaatacgtggctgacttcctgcagtgggccgaaccaatagttgtacgcctgaaagaagttagattgcaacgggacgatttcgagatactgaaggtgattggtcgaggagcattctctgaggttgccgtagtgaagatgaaacagactggtcaggtatatgccatgaagattatgaacaagtgggacatgctcaagcgcggtgaagtttcttgcttcagagaggaaagggatgttttagtgaatggagaccggcgatggatcacccagctgcatttcgccttccaggatgaaaactacctgtatttggtaatggaatattacgtgggaggagatctgctaactctgctcagtaagttcggcgagcgcattccggctgaaatggcaaggttctacctagctgagatagtgatggcaattgattctgtgcatagactcgggtacgtccacagagacataaaacccgataacattctcctcgatcggtgcggacatattcgattagcggactttggctcctgcctcaaactgagagcagacggaacggttcgctctctcgttgccgttgggacccccgattacctgtctcccgagattctccaggcggtggggggaggtcccggaacaggaagctatggccctgagtgtgactggtgggccttgggggtcttcgcttacgagatgttctatgggcagaccccattctacgccgattcaacagccgaaacctacgggaaaattgtgcactacaaggaacaccttagtttacctcttgtggatgagggcgtgcccgaggaggcaagagacttcattcaacggctgctgtgtccgccagaaactcggctcggacggggtggagcaggagacttccggacacacccattcttctttgggctggactgggacgggctgcgcgatagtgtgcctcctttcaccccggatttcgaaggcgcaacagacacttgcaacttcgatctggttgaggatggcctgaccgccatggaaactctgagcgacatacgggagggggctcctttgggcgtgcatctccctttcgtcggctattcctactcttgtatggcgcttcgcgatagtgaagtgcctgggcctactcctatggaactcgaagccgagcagttgctcgaaccgcacgtccaggccccaagcttggagcctagcgtgtcccctcaagatgagacagccgaagtggctgtgcccgctgccgtgcccgctgcagaggccgaggccgaggtgactttacgtgagttacaggaggcattagaggaagaggtactgactcggcagtcactgtcccgcgagatggaagctatccgcaccgacaaccagaacttcgcctcacagttgagagaagctgaggctcggaatagagatttagaagcccatgtccgccagcttcaggaacgaatggaactgctgcaggccgaaggcgctacagggccatag

SEQ ID NO: 221576 - DNA, 1866 bp, Artificial Sequence
  Description of Artificial Sequence: Synthetic coding sequence
atgtcagcagaagttcgcttgagaagacttcagcagctcgttttagaccctgggtttctgggccttgagcccctactggatttgctgctgggcgtacatcaggagcttggggcaagcgagctcgcgcaggataaatatgtggccgactttttacagtgggccgaacctatagtcgtgcgcctcaaagaggtcaggctccagcgcgatgatttcgagattttaaaggtcatcggacgaggcgctttctccgaggtagccgttgtcaagatgaagcagacggggcaggtgtatgccatgaaaatcatgaacaagtgggatatgctgaagcggggtgaggtgtcttgtttccgtgaggagagggatgtgctggtaaacggcgatcggaggtggatcacacagctgcactttgcattccaagatgaaaactacctgtacctggttatggaatactatgtgggaggggatctgctgaccctgctctccaaatttggggaacggatcccagctgagatggctagattttatctcgctgaaatcgtaatggccatcgacagcgtgcataggttaggctacgtgcatcgtgatattaaacctgacaatattctgctagacaggtgcggtcatattagactcgcagattttggctcatgccttaaactccgtgcagatggtactgtgcgcagtttagtagccgtggggacccccgactatctgtctcctgagattttacaggcagtcggaggaggacccggtactggctcctatggcccagagtgtgattggtgggcacttggagtctttgcctacgaaatgttctacggccagactccattctatgccgacagtaccgctgagacatacggcaaaatcgttcattacaaagagcatctctccctgccgctagtcgatgagggggtcccagaagaagccagagattttattcagcgcctgctgtgtccaccagagacaagattaggaagaggaggggcaggggacttcaggactcatccattcttcttcggtcttgattgggacggactcagggacagtgttcctccctttacacccgattttgagggggctaccgacacgtgcaatttcgacctggttgaggacggtctcaccgcgatggaaaccctaagcgatattagggagggcgcacctctgggggtgcaccttcctttcgtgggttactcatatagttgcatggctcttagagactccgaggttcccggtcctacccctatggaactcgaggctgaacagctattggaaccccatgtgcaggctccttctctcgagccatctgtaagcccccaggatgaaactgcggaagtggcagtccccgcagctgtgccagcggctgaggcagaagcggaagtgactctcagagaactccaggaagccctggaggaggaagtgttgacacggcagtccctgtctcgcgaaatggaggcaatcaggacggacaatcagaactttgcctctcagctgagagaggccgaagctaggaatagggacctagaggcccacgtgcggcagttgcaagagagaatggagctcctccaggccgagggcgcaactgccgtgaccggagtgcccagtcctcgtgcaaccgaccccccttcccatctggatggtcctccctggctttgggcttcggctaggtggtgggggcagatgcacaggcggcatctgcttctgccagcacgggtccccaggccaggactatcggaagccctctccctcctgttatttgccgtggttctgagccgcgctgccgctctgggctgcattggcctggtggctcatgcaggccagctgaccgctgtgtggagaaggcccggtgctgcacgggctccctag

SEQ ID NO: 221577 - DNA, 1875 bp, Artificial Sequence
  Description of Artificial Sequence: Synthetic coding sequence
atgtcagccgaagtgagactgcgcaggctccagcaactggttctcgacccgggtttcctggggttggagccgttgctcgatcttctgcttggcgtccaccaggagctgggggctagcgaactggcacaagataagtacgtcgccgacttcctgcagtgggctgaaccaatagttgtaagactaaaggaggttcggttacagagagatgatttcgagatcctgaaggtgattggccgaggggctttctcagaagttgcggtggtgaaaatgaaacagaccggacaagtgtacgctatgaaaattatgaataagtgggatatgctgaagcggggagaagtcagttgttttagagaagaacgtgacgttctcgtgaatggtgaccggaggtggatcactcaactgcatttcgctttccaggatgagaactacctgtaccttgtgatggagtactacgttggcggtgacctcctgactctactttccaaatttggcgaacggatacctgccgagatggccaggttttacctggcagagatcgtgatggctatagactcagtacacagacttgggtatgtgcatcgagatattaaaccagacaatatcctgctcgatcgctgcgggcatatcagactcgcagattttggttcatgcctcaagctgcgggctgacggaacagtccggagccttgtagccgtgggcacccccgactacctgtctccagaaatccttcaagctgtcggaggcggtcctgggacagggtcctatgggccagaatgtgactggtgggcactcggggtctttgcatacgaaatgttttacgggcagacgcccttctatgcggatagtaccgcagagacgtacggaaaaatcgtgcactataaagaacacttgtctctgcctcttgtcgacgagggcgtgcctgaagaagcgcgagattttattcagcggcttctgtgcccaccagagacacgactgggacggggaggcgctggggatttccgaactcatccgtttttttttgggcttgactgggacggtctgcgcgactctgtgcccccatttacccccgactttgagggcgcaacagatacttgcaattttgacctggtagaggatgggctcaccgcgatggagacactgagcgacatccgcgaaggcgctccactgggcgttcatctaccatttgtgggctattcttattcctgcatggcccttagagactcagaggtgcccggacccacaccaatggaacttgaagccgaacagctcctcgagccacatgtgcaagctccgagcctggaaccgtcagtcagcccccaggatgagacggccgaagtggcagtacccgcagctgtgcctgccgcagaggccgaggcagaagtgaccctccgcgaattgcaggaggcattggaggaggaggtcctcacgcgccagagtctatcaagggagatggaggccatacggacagacaaccaaaattttgcttctcagctgcgtgaagccgaggcaaggaaccgggatctggaggcccacgtgagacagctgcaggaacgaatggagctgctccaggctgagggagcaactgccgtcaccggggtccccagtccgagggctaccgaccctcccagtcacctcgacggaccacctgccgttgccgttggacagtgtccattggtagggccaggcccaatgcatagacggcacctgcttttgcccgcacgtgtgccccgtccaggattatcagaagcactcagtctgctgttattcgccgtggtgctatccagagctgctgctttgggctgtattggccttgtagcacatgctggtcagctgacagcggtctggcgaagacccggagccgctcgcgctccctag

SEQ ID NO: 221578 - DNA, 1878 bp, Artificial Sequence
  Description of Artificial Sequence: Synthetic coding sequence
atgtcagcagaagttaggctgcgcagactgcagcagctggtgctcgacccaggctttttgggtttagagcctctactggatctgctgctcggggtccaccaggagctgggggcatcagaactggcgcaagacaagtatgtcgccgatttccttcagtgggccgaacctattgtggtgcgtctgaaggaagtgagactgcagagggatgactttgaaattcttaaggtgatcggacggggagcattcagcgaggtggctgttgtcaagatgaagcagacaggacaggtttatgcgatgaaaattatgaataaatgggatatgttgaagcgaggggaggtctcctgttttagggaggagcgcgacgtcttagtcaatggtgatcggagatggatcacccagctgcactttgcgttccaggacgaaaactatctttatctagttatggagtattatgtgggcggagacctgttgactcttctgtcaaagtttggcgagagaatccccgcagagatggcgcgattctacctggccgaaatcgtcatggccatagattcagtccaccgcctgggatacgtccacagagacataaagcctgacaatattctgctggacaggtgtggccacattagactcgccgacttcggcagctgcttaaaattgcgagcagacggaactgtgaggtctctggtggcagtcggtactccagattatctgtcccctgagattctgcaggcagtcggcggtgggccagggacaggatcctacggcccagagtgtgattggtgggcactgggagttttcgcttacgagatgttctacggccagacccctttttacgccgatagtaccgctgaaacctatggcaagatcgtgcactacaaagagcacctttccctgccattggtggatgaaggagtcccagaagaagccagagattttatacagcggttgctgtgccctccggaaactcggctcggtcggggaggcgcaggtgactttaggactcacccattctttttcggcctggactgggacggcctgcgcgactccgtgccccctttcactcccgacttcgagggcgctactgacacctgcaattttgatctggtcgaagatggtttaaccgcaatggagaccctatctgatatacgggagggcgctcccctgggtgtgcatcttccttttgtcggctattcttactcatgcatggctctgagagattcagaagtgcctggcccaactcctatggagttggaagcagagcaactccttgagcctcatgtccaggccccttctttagagccaagtgtgtctcctcaggacgaaaccgcggaggttgcagtacctgccgcagtcccagctgccgaagcagaggctgaagtcacgctccgggaactgcaggaggctctagaggaagaggtgctgactcgccagtctctctctcgcgaaatggaggcgattcgcacggataatcagaatttcgcgtcacaattaagggaagccgaagccagaaaccgggacctggaagcacatgtccgtcagcttcaggaacggatggagctgctccaggcggagggagccacagcggtgactggagtgcccagtcctcgggcaactgaccccccatcccatatggcgccacgcccttggctgtgggctagtgccaggtggtggggacaagccccttgtactgcggctacttgttgtagcttgcccggtagcttggggctcgcttaccgtagaaggttcccctgctcttgctctccattgttttgtctcgtgccccctccctgggccgctctcgggtggtggccaacccctgccaacagtccccaaagcggagccgcacaggaaccacccgcattgccggagccctag

SEQ ID NO: 221579 - DNA, 129 bp, Artificial Sequence
  Description of Artificial Sequence: Synthetic coding sequence
atggaactgttacaagctgagggcgcaacggctcgctggccccctggtcggggatgcgggcctgtgccagcaggcggtgctaggccacacgccccaccccctcccgctgccccttgccaaggcccttag

SEQ ID NO: 221580 - DNA, 3402 bp, Artificial Sequence
  Description of Artificial Sequence: Synthetic coding sequence
atgccctcgtccctgatgctcgaggtgcccgctctcgctgatttcaatagagcgtggaccgagttaactgattggttatctttactggatcaagttataaagtcccaacgtgtgatggtcggcgacctggaagatatcaatgagatgattatcaaacaaaaagcaactatgcaggacctcgagcagcgaaggcctcaactggaggagcttatcacagccgctcaaaatctgaagaataaaacaagcaaccaggaagctaggaccatcattaccgacagaatcgagaggattcagaaccagtgggacgaggtgcaagagcacctgcaaaaccggcgtcagcaactcaatgaaatgcttaaggatagcacccagtggctcgaagcgaaagaggaagccgaacaagtcttggggcaagcccgtgccaaattagaatcttggaaggaaggaccatacactgtcgacgccatccagaaaaagatcactgagaccaaacaactggccaaggatttgaggcagtggcagacaaatgtcgatgttgctaacgacttggcactcaagttattgcgtgattactctgccgatgacaccagaaaagtacatatgattacggaaaatattaacgcctcctggcgcagcatccacaagcgcgtttcagagcgtgaagctgcactggaagagacccacaggttactacagcaatttccactggacctggagaagttcctggcttggctcacggaagccgaaaccacagccaacgtgttacaagatgctacgaggaaagaaagattattagaggactccaagggagtgaaggagctgatgaaacagtggcaggatctgcagggtgaaatagaggcacatactgatgtgtaccataacctggacgagaactctcaaaaaatactacgatcactggagggcagcgacgacgccgtattactacagaggcgtctcgacaacatgaattttaaatggagtgagctaagaaaaaagtcccttaatattaggtcgcatctcgaagcgtcaagcgaccagtggaaaagactgcacttgtccttgcaggaactgctcgtttggttacagcttaaagatgatgagctgtcacgccaggctccaattgggggagattttcctgccgtgcaaaagcagaatgatgttcaccgcgctttcaagagagaacttaagacaaaggaacctgttatcatgagcacgcttgagaccgtacgcatttttctgaccgagcagccgttagagggtcttgaaaaactgtaccaggagccacgcgaactgccaccagaagaaagagcacagaatgtgacccggctcctacgcaagcaggcggaagaggtgaataccgagtgggagaagcttaacctccatagcgcagactggcagcgcaagatcgacgaaactctggagagactgagagaactccaggaggccaccgatgagttagacttaaaactccgccaagccgaggtgatcaagggcagctggcagccggttggcgacctgttaatagacagtctgcaagatcacttggaaaaagtcaaggctttgcggggtgagatagctccgctgaaggaaaatgtgagccacgtgaatgatctcgctaggcagctgactacgctcggaattcaactatccccatataacctaagcacactcgaagatctaaatacccggtggaagttgctacaggtggctgtggaagaccgcgtaaggcagttgcacgaggcccaccgggatttcggaccagcttctcaacatttcctgagcacctccgtccagggaccgtgggagcgcgctatcagcccaaataaggtgccatactatattaaccatgaaacgcagaccacgtgttgggaccatccgaagatgacagagctttaccagtccctggccgacctcaataacgtcagattttctgcttatcgaacagccatgaagctaagaaggctgcagaaagccttatgcctggatctcctttcgctctcggcggcttgcgacgccctggatcagcacaacttaaagcagaacgatcaaccgatggatatcctccagataataaattgtctgacaacaatttatgatcgcttggagcaggagcacaacaaccttgtgaacgtgccgttatgtgtggacatgtgtcttaattggcttctgaacgtgtacgatacgggaaggacaggaagaatacgtgtcctgtctttcaagaccggcataattagcctctgtaaggcccatctcgaggacaaatatcggtacctcttcaagcaagtagcttcatccaccggtttttgcgaccaaagacgtctagggctgttgctccatgactccattcagattccgcgacagctcggggaggtggcatcattcggagggtccaatattgaaccttccgtcaggagctgtttccagtttgcaaacaacaaacctgaaatcgaggcagccctttttctggactggatgcgccttgagcctcagtctatggtgtggctcccagtgctccatagagtggctgcagctgagactgccaaacaccaggccaagtgcaatatatgtaaggagtgccccattattggcttcagatatcggagcctgaagcattttaactacgacatttgtcagagctgctttttttccggccgagtagctaaaggccataaaatgcattaccccatggttgagtactgtaccccaacaacatccggcgaggacgtccgggattttgcgaaggtccttaaaaacaaatttcggaccaagagatatttcgccaaacacccaagaatgggctacctccctgtacagacggtgctcgaaggagacaatatggaaactaacctgcaggcggaatacgaccggctgaaacagcagcacgagcataaagggctgagccctctaccaagccctcctgagatgatgccgacgtccccacagtcacctagggatgccgagctgatcgccgaagccaagctgctgaggcagcacaaaggcaggctcgaggcaagaatgcagatcctcgaagaccacaataaacagctcgaaagccagttacatcggctcaggcagttgttggagcagccccaagccgaagccaaggtgaatggcaccaccgtttcatcaccaagcacatccctgcaacgcagtgacagctcgcagcctatgctgctgagagtggtgggctcccagacttccgactccatgggggaggaggatttactttctccgccacaggatacgagtacagggctcgaggaggtaatggaacagcttaataacagttttccgtcaagtaggggccacaatgtcggctccttattccacatggcagatgatttaggtcgagccatggagagcctggtgtctgtaatgacggatgaagaaggcgctgaatag

SEQ ID NO: 221581 - DNA, 11058 bp, Artificial Sequence
  Description of Artificial Sequence: Synthetic coding sequence
atgctgtggtgggaggaagtggaagattgctacgaacgtgaggacgtccaaaagaaaacttttactaagtgggtgaatgcccagttctccaaattcggaaaacagcatattgagaacctgtttagtgatctacaggacggacgtagactgctcgatcttctcgaaggactcactggacaaaagctgcctaaagaaaagggaagtaccagagtacacgccctgaataatgtgaacaaagccctgagagtcctgcagaacaataacgttgatttagtcaacattggctccaccgacattgtggacgggaatcacaaactgaccctgggcctcatttggaacattattctgcactggcaagtcaaaaacgtgatgaaaaatatcatggcgggattgcagcagaccaatagtgaaaagattcttctgagttgggtgaggcagtccaccaggaattacccccaggttaacgttataaacttcacaaccagctggtctgatggacttgccctcaatgccctgattcacagccaccggccagacctgttcgactggaactctgttgtatgtcagcagtctgccactcagagacttgagcatgcattcaatatcgctcgctaccagcttggcattgagaaactgctcgaccccgaagacgtggatacaacctaccccgataaaaagtcgattctgatgtatatcacatccctctttcaggtccttccccagcaagtaagtatcgaggcaatccaggaggtggaaatgttgccaagaccacctaaggtcaccaaagaagaacattttcaacttcatcaccagatgcattattctcagcaaatcactgtgtcactggctcagggctacgagaggacctctagtcccaaacccaggtttaagtcttatgcctatacgcaggccgcttatgtgaccacttctgatcctacccgcagcccattcccctcccagcatctcgaagctcctgaggataagtcatttggaagctcattgatggagtcagaggtgaacctggataggtatcagaccgccctggaagaagtgctatcttggctgctatcggccgaagacaccctccaggctcagggtgagatatccaatgacgtcgaagtggttaaagatcagtttcacacccacgagggctacatgatggacctgacagcccatcagggacgcgtgggcaacattctccagctgggcagtaagctgataggcacgggcaagttgtcagaggatgaggagacagaggttcaggagcagatgaatctgctgaattcacggtgggagtgtctgagagttgcttccatggaaaagcagtctaatcttcacagagtcctgatggacctgcagaatcaaaaactcaaggagctgaacgattggttgacgaaaacagaggaacgaacacgaaagatggaggaagagccattgggacctgacctcgaagatctaaaaagacaggtccagcagcacaaggtgctacaggaagacctggagcaggaacaagtcagggttaattctctcacacacatggttgtcgttgtggacgagagttctggcgatcacgccactgccgctcttgaggagcagctcaaggtgctaggggaccggtgggccaatatatgccgttggaccgaggataggtgggttcttttacaggatatccttcttaagtggcaaaggctcacagaggagcagtgtcttttctctgcttggttaagcgagaaagaagatgctgttaacaagatacacactaccggcttcaaggaccagaatgagatgctgagttccctccagaagcttgcggttctgaaggctgacctggaaaaaaagaagcagagcatgggtaagctgtacagcttgaaacaggacctgctttctacactcaagaacaagtcagtgacacagaagacagaggcctggttggataactttgcccgatgttgggacaatttagtccaaaaattggaaaaaagtaccgctcaaatctcccaggctgtaaccacaacccagccttctctgacccaaactactgtgatggaaactgtgacgaccgtgaccacgagagagcaaatcctggtgaagcatgcacaggaagaactccctccccctccgcctcaaaagaaaaggcagataactgtggacagtgagattcgcaagcgcctggatgttgatattacagagctgcattcttggatcactcgctcagaggctgtcctccagtccccagaatttgccatctttcgtaaggaaggcaacttctctgatcttaaggaaaaggtgaacgccattgagcgggagaaagccgagaaatttcgcaagttacaggacgcttcccggagcgctcaggcactggtggagcagatggttaacgaaggagttaacgccgattctattaaacaagctagtgaacagttgaactcccgatggattgagttttgtcagttgctgtccgaacgactcaattggttggagtaccagaacaatatcattgccttctacaatcaactgcagcagctcgagcagatgacgaccacagctgagaattggttaaagatccagcccacaaccccctctgaacctacagcaatcaagtctcagcttaaaatttgcaaggatgaagttaataggctgtcagatttacagcctcagatagagcgcctcaagatccagagtatagcactaaaagagaagggccagggacctatgtttttggatgccgacttcgtcgcttttaccaaccattttaagcaggtgttcagcgatgtccaagcccgtgagaaggagctgcagaccatttttgataccctgccccctatgcgctatcaggaaacaatgtccgctattcgaacctgggtgcagcagtctgagactaagctgagcataccgcagctgtccgtgacggattatgaaataatggaacagaggctgggtgagctgcaagctttacagtcttctctccaggagcagcagagtggcctgtactacctgtccaccaccgtaaaagagatgtctaaaaaagcaccatccgaaatttctcgaaagtaccagtctgaattcgaagaaatagaggggaggtggaaaaagctctcgtcacagctggtggaacattgccagaaactcgaggaacagatgaataagctcagaaaaatacaaaatcacattcagacccttaagaagtggatggcagaggtcgacgtttttctgaaggaggaatggccagcactcggtgatagtgagatcctgaaaaagcagctgaagcaatgtcgcctgcttgtcagtgatatccagaccattcagccctctctcaatagcgtgaacgagggtggacagaagattaaaaatgaggcagaaccagaatttgctagccgactcgagacagagctgaaagagctcaatacacagtgggatcacatgtgccagcaggtctacgccaggaaggaggctttaaaaggcggactcgaaaagacagtctcactacagaaggacctgagtgaaatgcacgaatggatgacccaggcggaggaagagtatcttgagcgggattttgaatacaagactccagacgaactgcagaaagcagtggaagagatgaagcgggcaaaggaagaagcccagcagaaagaggcaaaagtcaaactcctgacggagtcagtgaatagcgtgatcgctcaggcccctcccgtagcccaggaggctctgaaaaaagaactcgagacccttactacgaattaccagtggctttgtacacggctaaacgggaagtgcaaaaccctggaagaggtatgggcttgctggcacgaactgctgtcatacctggagaaggccaataagtggttgaacgaagttgagttcaaactcaagactactgagaacatcccaggaggtgctgaagaaattagcgaagtgttggactcattggagaacctcatgagacactccgaggacaaccccaatcagatcagaattcttgcccagaccctgacagacggtggagtgatggatgaacttattaatgaagaactggaaacctttaattccaggtggcgcgagcttcatgaagaagcggttagacggcagaaactgctggagcagtccattcaatcagcccaagagaccgaaaagagtttgcacctgattcaggagagcctgaccttcattgataagcagctagccgcttatatcgcagataaagtggatgcagcccagatgcctcaggaagctcaaaagatccagagcgaccttacaagtcacgagatctcactcgaggaaatgaaaaaacacaaccagggcaaagaagctgcccagagagttctgagccaaatagatgtcgcccagaaaaagcttcaagatgtgtccatgaaatttcgcctgttccagaagcccgcaaatttcgaacagcggctgcaggaatccaagatgatattagatgaagtgaagatgcacctgccagcactggaaactaagtcggtggaacaggaggttgtgcagtcgcagcttaatcactgcgtcaatctctacaaatcgctttcagaggtcaagtcggaagttgagatggtcataaagacaggacgccagattgtgcagaagaagcagacggagaacccaaaagagctggatgaacgagttaccgctctaaagctgcattacaacgagttgggggcaaaagtgaccgagcggaagcaacaactagagaagtgccttaagctctccaggaagatgcgcaaagaaatgaatgtactgacagagtggttagcagccacggacatggagctgacgaagcgttctgccgtggagggcatgcccagcaatctggacagcgaggtcgcttgggggaaggctacgcagaaggagatcgagaagcagaaggtgcatttgaagtctattaccgaggtgggggaggccttaaagactgtgcttgggaaaaaggaaactctggtcgaagacaaactgagcctcctaaacagtaactggatagctgttacttccagagctgaggaatggcttaatctgctcctcgaataccagaaacacatggagactttcgatcagaacgtggatcacatcaccaagtggattatccaggctgacacactgttggatgagagcgaaaaaaagaagccacaacagaaagaagatgtcctgaaaaggctgaaagctgaactgaacgacatccgcccaaaggtggacagcacacgagatcaggccgctaacctcatggctaatcgcggtgaccactgtcgcaagttggtggagccacagattagcgagctcaatcaccggtttgctgcaatcagtcaccggattaagactgggaaggcctcaatccctctcaaagaactggagcagtttaactcagatatccagaagctcctggagcctctcgaagcagagatacaacagggcgttaaccttaaggaggaggacttcaacaaagacatgaatgaggataatgagggtaccgtgaaggagctccttcagcggggagacaatctccagcagaggattaccgacgagcgcaaacgggaagagatcaagattaagcaacagcttctgcagacgaagcacaatgcgttaaaagacctacgctcccagcggagaaaaaaagctctggagatttcccaccagtggtatcagtacaagaggcaagccgacgacctgctgaagtgcttagatgacatcgaaaaaaagttagcctcactgcccgagccacgcgatgaaagaaaaattaaggaaattgatagagagctgcagaagaagaaggaggagctgaacgctgtgcgcagacaagccgaaggactgtcagaggacggggcagcgatggcagtcgaacccactcaaattcagctgtcgaaacgatggcgggaaatagagtccaagtttgctcagtttcggcgacttaattttgcacagatccacactgtacgggaggaaacaatgatggtcatgactgaggatatgccactggagatcagttatgtgccttctacatacttgacggagataactcatgtatcccaggcccttctggaggtggaacagctgttgaacgctccagatctgtgtgcaaaggatttcgaggacctgtttaagcaggaggaatctctcaaaaacatcaaagacagcctgcagcagtccagtgggagaattgatattatccactctaagaagaccgccgctctgcagagcgctactcctgtggaacgggtcaaactccaggaggccctgtcgcagttggactttcagtgggagaaagtgaataaaatgtataaggaccgacaggggagatttgatcgatccgttgagaaatggcgaaggtttcactatgacatcaaaatttttaaccagtggttaactgaggctgagcagtttcttcgaaaaacgcagatcccggagaattgggagcatgctaaatataagtggtacttgaaggaattgcaagatggcatcgggcagagacagacagtggtgaggaccttaaatgccaccggggaggagattatacagcaaagcagcaagacagacgcctctatcctccaggaaaaattaggctcgctcaatctgaggtggcaagaggtgtgcaaacaactttccgaccgcaagaagcgcctggaggagcagaagaatattttgagcgaattccagagagacttaaacgagtttgttctctggcttgaagaagcagataatattgcgtctataccacttgagcctggcaaggaacaacagctgaaagagaagttggaacaggtcaagctcctggtagaggagctccccctgaggcagggaattttgaagcagttgaatgaaaccggtggccctgtcttagtttccgctcccatctcgcctgaggagcaggataaactcgagaacaagctaaaacagactaacctgcagtggatcaaagtttcccgtgctttgcctgagaaacagggcgagatcgaggctcagatcaaagaccttggccagctagaaaaaaagctggaggatttggaagaacaactgaatcatttgctgttgtggttgagccctatccgcaatcagttggaaatatacaaccagccaaaccaagagggcccatttgacgtgaaggaaaccgaaatcgccgtgcaggctaaacaaccagatgtggaagagattctctcaaaaggacagcatctgtacaaggaaaaacccgctacccagccagtaaagcgcaagctggaggatcttagtagcgagtggaaggcagtgaatcgcttgcttcaggaactgagggcaaagcagccagacttggccccaggactgacgacaatcggagcctcgcctacacaaaccgtgactctggttactcagcctgtggtcactaaagagactgcgatttccaagctggaaatgcctagctctctcatgctggaggtgcccgcacttgctgattttaacagggcttggaccgagctgactgactggctgagcttactagatcaggtgatcaaaagtcagcgggtaatggtcggcgatcttgaagacatcaacgaaatgattatcaagcagaaggcgacgatgcaggatctggagcaaagacggccacagcttgaggaactgatcactgccgctcagaaccttaagaacaaaacatctaaccaggaggcaaggaccattatcactgaccggatcgaacgcatacaaaaccaatgggacgaggttcaggagcacctacagaaccgacggcaacagctgaacgagatgctgaaggatagcacccagtggcttgaggccaaagaggaagcagaacaagtgttgggtcaggcaagagcaaaactcgagtcttggaaggagggaccatataccgtcgatgccatccaaaaaaaaatcaccgaaacaaaacagctggcaaaagatcttcgtcagtggcagactaacgttgacgttgcaaacgacctcgcccttaaactcctcagggactacagtgccgatgacacccgcaaagtccatatgattacggagaacatcaacgcatcatggcgctctattcataaacgagtgagtgaacgggaggcggctctggaagagactcataggctactgcagcaattcccgctagacctggagaaattcctggcttggctgaccgaagccgaaacgaccgctaacgtgctccaggacgcaactcgcaaggagagactgctcgaagactccaaaggggtgaaggagctcatgaagcaatggcaggatttgcaaggtgaaattgaagcccacaccgacgtgtaccataacctcgacgaaaactcccagaaaatattgagatcattggaagggtctgacgatgcagtgctattacagcgcaggctggataacatgaactttaagtggtcagagctgcggaaaaagagcctcaacatcaggtcccatttagaagcatcttcagaccaatggaaacggttacacctgagtttgcaagaactgcttgtctggttacaactaaaagatgatgaactcagccgtcaagcaccgatcggcggtgactttcccgcagtgcaaaagcagaacgacgttcatcgcgcatttaaaagagaactgaagacaaaagagccagtcataatgagcactctggaaaccgtgagaatatttcttacagagcagcctttggaaggcctggagaagctttaccaagagcctagagaactgccacctgaggaaagagcgcagaatgttacaaggttactgcgcaaacaggcagaggaagtgaatacggagtgggaaaaactgaatctgcactccgccgactggcagaggaagatcgacgagactctcgagaggcttcgggagctgcaagaagcaacagacgagctggatctgaaattgagacaggctgaggtgattaagggcagctggcaaccagtgggagatctgctcatcgactccctgcaggatcacctcgaaaaggtaaaagccctcaggggcgagatcgctccgctgaaggaaaatgtaagtcatgtgaacgacctggctcgccagctgacgaccctgggtattcaacttagtccctataatctgagtacactggaagatcttaacacccggtggaagctgctccaggtggcagtggaggacagggtgcgtcaactgcatgaagcccacagggattttggcccagcatctcaacactttctgtcgactagcgtccaaggtccttgggagcgggctatctcccctaacaaggtaccatattacatcaatcacgagacacagactacatgctgggatcatcccaagatgacagaattataccagtctctggcggatctgaacaatgtgcgcttcagcgcttacagaaccgctatgaaacttcggagactgcagaaagcactctgtctggatctcctgagcctctccgcagcatgcgatgctctggaccagcataatctaaagcagaatgatcagcctatggatatacttcagatcataaattgtctcaccactatatatgacaggttagagcaggagcacaacaacctggtgaacgtccccctgtgtgtcgatatgtgcttgaattggctgttaaacgtgtatgatacagggcgtacaggccgaattcgtgtcctgtccttcaagactggcatcatcagtttatgtaaggcacacctggaagataagtataggtacctgtttaagcaggtggcttcaagcactggcttttgtgaccaacgacgcttaggccttttgttgcacgatagcatacagatcccaaggcaactgggggaggtggcctcgtttggaggctcaaacatcgagccttcagtaagatcatgtttccaattcgcaaataacaaacccgagattgaagccgctttgttcctggactggatgagactcgagccccaatctatggtctggctgccggtgctgcatcgcgtcgccgctgcggagacggccaagcaccaggcgaagtgtaacatctgtaaggagtgccccatcattggctttaggtatagaagcctcaagcactttaactatgatatttgccagagctgcttcttctccgggagagtggcaaaggggcataagatgcactaccctatggtggaatactgtacccccacgacgagcggggaagatgttagggactttgcgaaggtgctaaagaataaattcagaacgaagcgttactttgccaagcatccccgaatgggttatttgccggtgcagactgtccttgagggtgataacatggaaacgcccgtgactctgattaacttctggcccgtagactccgctccagcatcctcccctcagctcagccatgacgacacgcactcccggatcgagcactacgcctctcgacttgccgagatggagaactctaacggctcttacctgaacgacagtattagccccaatgagagcattgacgatgagcacttactgattcaacactactgtcaaagtctgaaccaagatagtccactatcacagccacggagcccggctcagatccttatttctctcgagtccgaggagaggggagaactcgagagaatactcgctgatctggaagaggaaaatcgaaatttacaggcagaatatgacagacttaagcaacagcacgagcacaagggcctttcgcctcttcctagccctccagaaatgatgcccacctccccccaatctccaagagacgccgagctgattgcggaggcaaagctacttcggcaacataaggggcgactcgaggctcgcatgcagattttggaagatcacaacaagcagctcgaatcacagctgcaccgcttgcgacagcttttagagcagccgcaggctgaagcaaaggttaacggtactacagtgtcttcaccatcgacttcacttcagaggtcagactcttctcagccgatgctgttacgcgtggtgggctcacagactagtgactccatgggggaggaagacctcctatcgccccctcaggacacctcaacagggctcgaagaagtgatggagcaactaaataatagtttcccttcgtcccggggacgaaatacgcccggtaagccaatgcgcgaggatacaatgtag

SEQ ID NO: 221582 - DNA, 3693 bp, Artificial Sequence
  Description of Artificial Sequence: Synthetic coding sequence
atgccttcaagcctgatgctggaggtaccagctcttgctgattttaatcgtgcgtggaccgagctgacagattggctgtccttacttgaccaggtaatcaagagtcaacgtgttatggtgggcgatctcgaggacatcaatgagatgataatcaagcagaaagccaccatgcaagatcttgagcagaggcgacctcaactagaagagctgattacagctgcccagaatcttaaaaataaaacctctaatcaggaggcccgaactatcataaccgataggatcgagcgcatccaaaaccaatgggacgaggtccaagaacacttacagaatagacgtcaacaactgaatgaaatgctcaaggattccactcagtggctggaggcaaaggaagaggccgaacaggtattggggcaagccagggccaaactcgagtcctggaaagagggcccttacaccgttgatgccattcagaagaaaatcactgagacaaaacagctggccaaggatctacgccaatggcagaccaatgtggatgtcgccaatgacctggcgttgaagctgcttcgagactactctgccgatgacacacgcaaagtgcacatgattaccgaaaatattaacgcatcttggagaagtatacataaacgcgtgtccgagcgggaagctgcgctggaggaaactcaccggttgctgcagcagttccccttagacctcgagaagttcctggcctggctaaccgaggcagaaacaacggccaacgtgctccaggacgccacacgtaaggaacgtctgctggaggacagcaagggcgtgaaggagcttatgaagcagtggcaggacttgcagggggagatcgaggcgcataccgacgtctaccacaatctggatgaaaattcgcagaagatacttagaagcctcgaaggcagtgacgacgcagttctcctgcagcgcaggctggacaacatgaattttaaatggtccgagttacggaagaagagtttgaacatccgctctcatctagaggcctcttccgaccagtggaagcgactgcatctatcacttcaggaattactggtctggttgcagctgaaggatgacgaacttagtagacaagctcccatcggcggagactttcccgctgttcaaaaacaaaacgacgtgcatagggcttttaagagggagcttaaaaccaaagaacctgtgattatgtcaaccctcgaaacggtgcggatcttcctgacggaacaacctctggaggggttggagaaactgtaccaagagccaagggagctgcccccagaggaaagggctcaaaacgtaactcgcctgctccgaaagcaggccgaggaagtcaacactgagtgggagaagctcaatctgcacagcgcggattggcagagaaagattgatgagactctcgagcgcttaagggagctgcaggaggctacggatgagctggatctgaagttgaggcaggccgaggttatcaaggggagctggcagcctgtgggcgacctgcttatagattcgctgcaggaccaccttgagaaggtgaaagcactacgtggcgaaattgcccctctgaaagagaatgtctcacatgtgaatgacctggccaggcagctgacaaccttgggcattcagctatccccttacaacctctcaaccttggaagatctgaatacacgctggaaattacttcaggttgctgtggaggatcgcgtaagacaactacatgaggcccaccgtgactttggcccagcttcacagcacttcctcagcacttctgtccagggcccatgggagagggcaatctccccaaacaaggttccatattacattaaccacgagacccagaccacatgttgggaccaccccaaaatgacggaactctaccagtctctggctgacttgaataacgtgcggttctccgcctacagaactgcgatgaagctccgccgactgcagaaggcactctgtctagatttactgtccctgtccgccgcttgtgacgcattggatcagcacaatctcaagcagaacgatcaacccatggatatccttcaaatcattaactgtttaaccacaatttatgaccgattggagcaggagcacaataatctggttaatgtacccctgtgtgtggacatgtgcctaaattggctcttaaacgtgtacgatacaggtaggactggtcgcatcagggtgttaagtttcaaaaccggtataatttccctatgcaaggcccatctggaggacaaataccgttatttgttcaagcaggtcgcctcctccactggcttttgcgaccaaaggagactgggtttgcttctccacgattccatccagattccacggcagctgggagaggtggcctcatttgggggaagcaatattgagccaagcgttcggagttgctttcagtttgctaacaacaagcctgagatagaggctgctcttttcctcgactggatgcggttggagccccagagcatggtttggctccccgtgctacatagagtggccgctgcggagaccgcaaaacatcaggcgaagtgtaacatttgtaaagagtgcccaattatcgggttcagatacagatctctgaaacacttcaactacgatatatgtcagtcttgcttcttttctggcagggtcgccaagggacacaagatgcattacccgatggtcgagtattgcacccccaccacaagtggtgaggatgtgagagacttcgccaaagtgctgaaaaataagtttaggacaaagcgctatttcgccaagcaccctcgcatgggctacttaccggttcagaccgtgttggagggagataacatggaaacacccgcttcttcaccccagctaagccacgatgatactcattcgcgcatcgaacattatgccagccgactggccgaaatggagaattcaaatggatcatacctgaacgattctatttcgccaaatgaaagtatcgacgatgagcacctccttattcagcactactgccagagcctgaatcaggatagccccctgtcccaaccgaggtctcctgcccagatattgatttccttggaaagcgaagagcggggtgagctggagcggatcctagccgatctggaggaggagaaccggaacctgcaggctgaatatgatcggctaaaacagcaacatgaacacaaggggctaagtcccttaccttctcctcccgaaatgatgccaacctcccctcaatctccacgcgacgccgagctgatcgccgaggccaaactcctcaggcaacataaaggaaggcttgaggctcggatgcagatcctggaagatcacaataaacagctggagtcacagctgcacaggctccgccagctgctggaacagccacaggctgaagccaaggtgaatggtacgacagttagcagtccgagtacgagtctgcagcggtccgattccagccagccgatgcttctccgggttgtcggctcccagaccagcgattccatgggcgaggaagacctgttatctccgccacaggatacaagcaccggccttgaggaggtgatggaacagctgaataacagtttcccttcgtcgcgaggacacaatgttgggtccctgtttcatatggcagacgatttgggacgggctatggaatccttagtgtctgttatgactgatgaggagggagcagaatag

SEQ ID NO: 221583 - DNA, 1869 bp, Artificial Sequence
  Description of Artificial Sequence: Synthetic coding sequence
atgcgagagcagttgaagggtcatgagacccagactacttgttgggatcacccaaagatgacggagttatatcagtccctggcggatttgaacaacgtgcggttcagtgcctatcgcactgcaatgaagctgagaagacttcaaaaagcactctgtctggacctgctgtctctgagtgccgcatgcgatgccctcgaccaacacaatctcaagcaaaacgaccagccgatggatatcctgcagatcatcaactgcctgactaccatctacgacagactggagcaagaacacaacaatctggtgaatgtgcccctgtgtgtggatatgtgtctgaattggctgctcaatgtttacgataccggccgaaccgggagaattagggtgctgagcttcaaaacaggcatcatttccctgtgcaaagctcacctggaagataagtataggtaccttttcaaacaagtggcctcttccacaggattctgtgaccagcgtaggctgggattgttactccacgatagtattcaaattccacgtcagctgggggaagtcgcctcttttggtggctccaatatagagccatcagtgcgatcatgttttcaatttgccaacaataagcctgagatagaggctgctcttttcttggactggatgagattagaaccacaatctatggtctggctgcccgttcttcatcgcgttgcagccgctgaaaccgctaagcatcaggccaagtgtaatatctgcaaagagtgcccgattattgggttcaggtaccggagtttaaaacactttaattacgatatctgtcaaagctgtttcttctccggccgagtggcgaaaggtcataagatgcattaccccatggtggaatactgtacacccaccacttcgggcgaggacgtgagagattttgcaaaggttctgaagaataagtttcggaccaaaagatatttcgccaagcaccctcggatggggtatcttccagtacagaccgtgttggaaggtgacaacatggaaactcctgcctcttctcctcagctgtctcacgacgatacccactcccggattgagcactacgcttctcgcctcgcggaaatggaaaactcaaatgggagctatctgaacgactcaatcagtcccaacgagagcatagatgacgagcatctgctgatccagcattactgtcagtctttaaaccaggatagcccactctcccagccccgatctcccgctcaaattctgatttccttggaatcagaagaacggggagagctagaacgcatactggccgacttagaggaagagaatcgaaacctgcaggctgaatacgatcgattgaagcagcagcacgagcacaagggcctgagcccactacccagcccgcctgaaatgatgcctacttcaccccagtcccctagagatgctgagctcatcgcagaagctaagttattgagacagcataagggcaggctcgaagctaggatgcagatactggaagaccataataaacagctcgaaagccagctgcatcgtctcaggcaacttctggaacagccccaggccgaggctaaggtgaatgggaccacagtgagcagccccagcacctctctgcagagatccgactccagtcagcccatgctgttacgggtagtgggcagccagacctccgactccatgggagaggaggacctgctgagcccacctcaggatactagcacaggactcgaagaggtgatggagcaactgaacaatagctttcccagttctcgaggccataacgtgggatccctgtttcatatggctgacgacctggggagggccatggagtctctcgtctcagtgatgaccgatgaagaaggggctgaatag

SEQ ID NO: 221584 - DNA, 11046 bp, Artificial Sequence
  Description of Artificial Sequence: Synthetic coding sequence
atgagtgaggtatcatccgatgaaagagaggatgtgcagaaaaagacttttaccaagtgggtcaatgctcaatttagcaaatttggtaagcagcacatcgaaaacctgttttctgatctccaggacgggaggcggctgctggatctcctggaaggcttgactggccaaaagctccctaaggaaaaaggctccacccgcgtgcacgccctgaacaacgtaaataaggcccttagagttctgcagaacaacaacgttgatctcgtgaatattggctccacggacattgtcgatggcaaccacaagctcacattaggccttatatggaacatcattcttcactggcaggttaaaaacgtaatgaagaacattatggcgggactgcagcagaccaactccgagaaaattctcctttcatgggtgcgacagtcgacccgaaattacccccaagtcaacgtgatcaacttcactacctcctggagcgatgggcttgccctgaacgccctgatccactctcaccggccagacctgtttgactggaatagcgttgtatgccagcaatcggctacgcagaggcttgagcacgcatttaatatcgctcggtaccaactgggcatcgaaaagctgcttgatcccgaggacgtggataccacctacccagacaaaaaaagcattctgatgtacattaccagcttgttccaagtgttgccgcagcaggttagtatcgaagctatccaagaggtagaaatgctcccccgtccccctaaggtgaccaaggaagaacattttcagctccaccaccagatgcattactctcagcagattactgtctctctggctcagggatacgaacgcacaagctcgcccaaaccacgtttcaagtcttacgcttacacccaagctgcttacgtcacaacatccgacccaacgcgatcccccttccccagccagcacttggaagccccagaggacaagagcttcggaagttccttgatggaatccgaggtgaatctcgatagataccaaactgccctggaagaagtgctcagctggttgctgagcgcagaggacacattgcaggcgcagggagaaatcagcaatgatgtcgaagtggtcaaagatcagtttcatacacacgaaggatatatgatggatctgacagcacatcaggggagagtgggaaatatcctgcaattgggctcgaagctaatcggtactggcaagctctccgaagacgaagagaccgaagttcaggagcagatgaaccttcttaactcacggtgggagtgcttaagggtggcttccatggagaagcaatctaacctacaccgtgtcctgatggatctgcagaatcaaaagttgaaggaactgaatgactggcttacaaaaacagaagaacgcacccgtaaaatggaggaggagcctctaggtcccgatctggaagatctgaagcgccaggtacagcagcataaggtcctgcaggaggatctggaacaggagcaggtaagggtcaattccctcactcatatggttgtggttgtggacgaaagtagcggagaccatgccactgccgctctggaagaacagctcaaggtgctcggcgacagatgggccaacatctgccgctggacagaagaccgatgggtactcttgcaagatatcctcctcaaatggcaacggttgactgaagaacagtgcctgttcagtgcatggctttccgagaaggaagatgcggtgaataagatccacacaaccggattcaaggatcagaacgagatgcttagctcgctgcagaaactggcagtcctgaaagccgacctggagaaaaagaagcagtcgatgggaaaactatatagcctgaaacaggacctgctatctactctgaagaacaagtccgtcactcagaagactgaagcctggctggataacttcgcacggtgctgggacaacctggtgcagaagcttgagaaaagtacagcccagatttctcaggccgtcaccactacgcagccaagcttaacccagactacagtgatggagacagtaacaacggtgacaaccagggaacaaattcttgttaagcacgcccaggaggagttacccccacccccaccccagaaaaagcgccagataacagtggacagtgagatccgtaaacgcctagacgtggatattaccgagctgcattcatggattacaagaagcgaggcagtgttgcagtcccctgagttcgccatatttcgaaaagaaggaaacttcagtgacttaaaagagaaggtaaacgcgatcgagcgagagaaagccgagaagtttcgcaaattgcaggatgcctccaggtccgcgcaggccctggtggagcagatggtgaatgagggcgtgaatgccgatagtatcaagcaagcgtcagaacagctgaactctagatggatagaattctgccagctgttgtccgaacggcttaattggcttgaatatcagaataacattatagctttttacaatcaattacagcaactggagcagatgacaaccaccgccgagaactggctgaaaatccaacccactactccatctgagcctaccgcgattaagtcccaactcaaaatttgcaaggacgaggtgaatcggctgtccgacctgcagccccagatcgaacgcctgaagattcaaagcatcgccctgaaggaaaaaggacagggccctatgtttcttgatgctgacttcgtagcattcacaaaccatttcaaacaggtgttctcagatgtgcaggcacgggagaaagagctgcagaccatctttgacaccctgccacctatgcggtatcaggagacgatgagtgccatcagaacatgggtgcagcaatctgagacaaagttgagtattcctcagctcagtgtgaccgactacgaaatcatggaacaacgtctgggagaactccaagccctgcagagcagcctccaggagcagcaatcgggtctgtactatctatccactaccgtgaaggagatgagcaagaaggccccaagtgaaatctctcggaagtatcagtctgagttcgaggagattgaagggaggtggaagaagttgagcagccagctagtcgagcattgccagaagctcgaagagcaaatgaacaagctccgaaaaatccagaaccacatccagacgctgaagaagtggatggcagaggttgacgtgttcctgaaagaagagtggccagcattgggtgattctgaaattctaaagaagcagttgaagcagtgtcgccttctagttagcgatatccagaccatccaaccctccctgaactccgttaacgagggcggacagaaaatcaagaacgaggcggagccggagtttgcctcaaggctggaaaccgaactcaaagagctgaacacacaatgggaccacatgtgtcaacaggtgtatgccagaaaagaggccttgaaagggggactagagaagacagtgtccttacagaaagacttgtctgagatgcatgagtggatgactcaggccgaggaagagtaccttgagagggacttcgagtacaagacgccggatgaactgcaaaaggcagtggaagagatgaaaagagccaaagaggaagcacagcagaaggaggctaaagtcaagttgctgactgagagcgtgaactcagtcattgcccaggcccctccagtcgcccaggaagcgctcaagaaggagctggagacactcactactaactaccagtggctgtgtaccagactgaatggcaagtgtaaaaccctcgaggaagtatgggcgtgctggcacgagctgctgtcctacctcgaaaaggctaacaaatggctcaatgaggtggaattcaagctgaagacaacagagaacatccctggaggggctgaggaaatctccgaggttctggattctctggaaaaccttatgcgacactcagaagacaaccccaatcagattcggatacttgcccagacgttgaccgacgggggtgtcatggatgagttgataaatgaagaattagagaccttcaactcgagatggcgggagttacacgaggaggcagtgcgcaggcagaagctgttagagcagtcaattcagtctgctcaggaaactgaaaagagcctccacctcattcaggagagtcttacattcatcgacaagcagctagccgcatacattgcagataaagtagacgccgctcagatgcctcaagaggctcagaaaattcagagcgacctgacttcccacgagatcagtctggaagagatgaagaagcacaaccaaggaaaggaagccgcacagagggtgttgtcacagatcgacgtcgctcaaaagaaactgcaggatgtgagcatgaaatttcgcctctttcagaaaccagccaacttcgagcaacggctgcaggaaagtaaaatgatccttgacgaagtgaagatgcacttgcctgcccttgagaccaagagtgttgagcaggaggttgttcaatcacaactgaaccattgcgtgaatctctacaagtcactgagtgaagtgaagagtgaggtcgagatggtgattaaaaccggcagacaaatcgttcagaagaagcagactgagaaccctaaggagctggatgaacgagtaaccgctttgaagctgcactataacgaattaggggctaaagtgaccgaacggaagcagcagcttgagaagtgtcttaagctaagtcgcaagatgcgcaaagaaatgaatgtgttaacggagtggctggctgccacagacatggagctgaccaaacgttccgcagtggagggcatgcccagcaacctggacagcgaagtcgcgtgggggaaagctacccagaaggagatagaaaaacagaaggttcatctcaagagcatcactgaggtcggtgaggccctgaagaccgtgctgggcaagaaggagactctggtcgaggacaaactcagtctattgaatagcaattggatagcagtgacctctagagcagaggaatggctaaacctgttacttgaataccagaagcatatggaaacttttgaccagaacgttgaccacattaccaaatggattattcaggccgataccctgctggacgaaagcgagaagaagaagcctcagcagaaggaggacgtgttgaaacgactcaaggccgaattaaatgatatcagaccaaaagttgattccacccgtgatcaggctgctaatctgatggccaaccggggtgaccactgtcgtaagctggtggagcctcaaattagcgagttgaatcacaggttcgcagcgataagccatcgcatcaaaactggtaaggcttcaatccccctcaaggagcttgagcagtttaactctgacatccagaagctgctcgagccgttggaagcagaaatacagcagggcgtgaaccttaaagaagaagatttcaacaaggacatgaatgaggacaatgaggggaccgtgaaagagctcctacagcggggtgacaacctacagcagcggattactgacgagaggaaaagggaggaaatcaagattaagcagcagctgctgcagaccaagcacaatgccctaaaagacctgaggagtcagcgccgaaagaaagctctagagattagccaccagtggtaccagtacaaaagacaggctgacgatctgttaaaatgtctcgacgacattgagaaaaagttagcctctcttccagagcccagagatgaaagaaagatcaaagaaatcgacagagagctgcaaaagaagaaggaggaattaaatgctgttagacgccaggctgagggcctgtccgaagacggagctgccatggctgtggagccaactcagattcaactttccaagcggtggcgggaaatagagagcaaattcgcccagtttcgcaggctgaacttcgctcagatccacactgtcagagaggagacgatgatggtaatgactgaggacatgccacttgaaatctcttatgtaccctccacatatctcactgagatcacccacgtgtcccaggctttgctggaggttgagcaactgttgaacgccccagacctgtgcgctaaggacttcgaagatctgttcaagcaagaagagagcctgaaaaatataaaggacagcttgcagcagtctagtggcaggatcgatattatccattctaaaaaaactgctgctcttcagagcgccacacctgtggagcgggtaaagctgcaagaggctctcagtcaattagatttccaatgggaaaaggtgaataagatgtataaagaccgacaaggaaggttcgaccgcagcgtggagaagtggcggcgatttcactatgacatcaagattttcaaccagtggctcacagaggccgaacaatttctcagaaaaactcagattccagagaactgggaacatgcaaagtacaaatggtatctgaaggagctgcaggatggcattgggcagcgacagactgtcgtcagaacattaaacgccacgggtgaggagattatccagcagagttctaaaacagatgccagcattctgcaggaaaagctggggagcctaaaccttagatggcaagaagtatgcaagcagctctctgaccgtaaaaaaaggcttgaggagcaaaagaatatactttcagagttccagagggatctcaacgaattcgttctttggctggaggaagccgacaacatcgcctcaatcccattggagcctggtaaggaacaacaactcaaggaaaagttagagcaagtcaagctgcttgttgaagagctgccactgcgccaggggatccttaaacagctcaacgagacaggaggtccagttctggtaagtgccccaatttcccctgaggaacaagacaagctggagaacaaactcaagcagacaaatctgcaatggattaaggtttccagggctctccccgaaaagcaaggggagatcgaggctcaaatcaaagatctgggccaactggaaaaaaaactcgaggatctagaggaacagctgaatcatctcctgttgtggctgagcccaatcaggaatcaactggaaatctataaccagcctaaccaggaaggtccatttgacgtgaaggagacagagatagccgtacaagcaaaacagcccgatgtggaggagattctctcaaaggggcagcatctgtacaaggaaaagccagccacccagccagtgaagcgcaaactcgaggacctgagcagtgagtggaaagcagtgaaccgcctgctccaggaattacgtgcaaagcaacccgatctggcccctggactgacaacaataggcgctagcccgacacagaccgtgaccctggtcacacagcccgtggtgaccaaagagaccgctatctccaaactcgagatgccatcctcccttatgctggaagtgcccgcactcgccgactttaaccgggcatggacggaactcacagactggctgagtctactggatcaagtgataaagagccaacgagttatggtcggagacttagaggacattaatgagatgatcataaaacagaaggcaactatgcaggatctcgaacaaaggcgaccccagttagaggaattaataacggcagcccagaatctgaagaacaagacgagtaaccaggaggcacggaccattatcactgataggatcgagagaattcagaaccaatgggatgaggttcaggaacatctccaaaatagacgccaacagctgaacgagatgcttaaagacagcacccagtggctggaagccaaggaggaggctgagcaggtgttgggccaagcacgagccaagctcgagtcttggaaagaaggcccttacacagtggatgctatccagaagaagattacagagacaaagcagctggccaaggatctgagacagtggcaaaccaacgtcgatgtcgctaatgatctggcactcaagttattaagagactacagcgccgacgacaccaggaaggtccacatgatcaccgaaaacatcaacgcctcttggcggtcaattcataagagggtctctgaacgcgaggctgcactggaagaaacccacagattgctccagcaattcccactcgacctggaaaagtttctcgcctggcttaccgaagccgaaaccacagccaacgttttacaggatgccactcggaaggaacggctgctggaggacagtaaaggcgtcaaggagctcatgaaacagtggcaggatctccagggggagatagaggcacacacagatgtttaccataaccttgacgagaatagtcagaagatcttgagatcactcgaaggaagtgacgatgctgtgctcctacagaggcgtctggacaatatgaacttcaagtggagtgaactgaggaaaaagtccctcaatatcaggtcacatttggaagcctcaagtgatcaatggaagcggctgcacttatcactccaggaactgctcgtgtggctccaacttaaggatgatgaactctcgcgtcaggcaccaatcggcggagatttcccagcggtgcagaagcagaacgacgtgcacagagcatttaaacgagaattgaaaactaaagagcctgttattatgtcgactctcgaaaccgtacgaatctttttaacagaacagccccttgagggactggagaagttgtaccaggaacctagagagctgcctcccgaagagagagcgcagaatgtcacccgcttgctacgaaaacaggccgaggaggtcaatacggagtgggaaaagctgaacctccactcagctgattggcagcgaaaaatcgatgagacactggaaagactaagagaactccaggaagcaacagatgaactggatctgaagctgcgccaggctgaagtcattaagggctcctggcagcccgtaggcgacttgctcatcgactcactccaggatcacttggaaaaagtgaaagcgctcaggggtgagattgcaccgttgaaagaaaacgtcagccacgtgaacgacctcgctagacagctcactacacttggtattcaactgagcccttacaatctttcaaccctcgaggacctgaatacacggtggaaactgctgcaagtggccgtggaggatcgggtcaggcaactgcacgaggcccaccgggatttcggtcccgcttctcagcacttcctcagtacttccgttcaggggccatgggagagagccatttcacccaataaagtcccttactatatcaaccatgagacccaaactacctgttgggatcaccccaaaatgactgaactttaccagagcttggccgacttgaacaatgtgcgctttagtgcatataggaccgcaatgaaactgcgaaggctgcaaaaagccctttgtctcgacctgctgtctctgagcgccgcttgtgacgccctcgatcagcacaatctcaagcagaacgatcaaccaatggacattttacagatcataaattgccttactacaatatatgaccgcctcgaacaggagcataataatttggtcaatgttcctctgtgcgtggacatgtgcctgaattggctgctgaacgtatacgataccgggcgaacaggccgaatccgggtcctgtcttttaagactggtatcatttccctatgtaaggcgcatctcgaggataagtacagatacctgttcaagcaagtcgcctcctcgaccggcttctgcgatcagaggaggctaggtctgctcctgcatgactctattcagatccccagacagctcggcgaggtagcttccttcggaggaagcaacattgagccatccgtgcgctcatgttttcaattcgccaacaacaaaccggaaattgaggctgctttgtttctggattggatgagacttgaacctcagtcgatggtatggttgcctgtgctgcatcgagtggcagccgctgaaacagctaagcatcaagccaaatgcaacatctgcaaggaatgccccatcattggattccgttataggtcacttaaacattttaactatgatatctgtcagagttgctttttttcaggaagagtggccaagggacataagatgcattatccaatggtggagtattgtacacccacaacttctggcgaagatgtgagggacttcgccaaagttctaaaaaataaatttagaactaagaggtattttgctaaacacccgcgtatgggttatctgccagtccagaccgtcctggagggggacaacatggaaactcccgtgaccctgattaacttttggccagtggacagcgcacccgcaagcagccctcagctgagccatgacgacacgcatagcaggattgagcactacgcaagtcgtctggctgagatggagaactccaacgggagctacctcaacgactccatctctcccaacgaatctatcgatgacgagcacctgctgatccagcactattgtcagtcactgaatcaggattccccactgtcccaaccacggtctcccgctcagatcttaatcagtctggagtccgaggaacggggagagcttgagaggatcctggcagatctcgaagaagaaaatcgaaacttacaggccgagtatgaccgcctcaagcagcagcatgagcacaaaggattatccccactccctagcccaccagaaatgatgcctacaagcccacagtcccccagggacgctgagctcattgccgaggcgaaacttttgaggcaacataagggaaggcttgaagcgcgtatgcagatcctggaggaccacaacaagcagctagaatctcagttgcacaggctgcgacaactgttggagcagccgcaggccgaagctaaggtgaacggcaccacagtgtcttcacccagcacaagcctccagcgcagtgattcgtcacagcctatgctgctgcgagtggtgggaagccaaacctctgattcaatgggggaggaagacctcctcagtcctccacaggataccagcacgggcctcgaagaggtgatggagcagctgaacaacagcttcccatcgtctcggggtcgcaatactccaggcaagcccatgcgagaagatacgatgtag

SEQ ID NO: 221585 - DNA, 7034 bp, Artificial Sequence
  Description of Artificial Sequence: Synthetic coding sequence
atgaccgagatgattctgctgatcttcttcccggcttattttctgaacgccgtgaggcgacagaagcttctggagcagagcatccaatcagctcaggaaacagagaaatctctgcatctaatccaagaatccctgaccttcatcgacaagcagctggcagcttatatagccgacaaagtggacgctgcacaaatgccccaggaagcccaaaagatccagagcgacctgacatcgcacgagattagtctcgaggaaatgaaaaaacataatcagggcaaagaagctgcccagagagtcctcagccaaattgatgttgcccagaagaagttacaggatgtcagtatgaagttcagactgtttcagaaaccggctaattttgagcaacgcctccaagagtctaaaatgattcttgacgaggtgaagatgcacctgcccgctctggaaaccaagagtgttgaacaagaagtcgttcagagccaactcaatcactgcgtaaatctgtataaaagcctctcagaggtcaaaagcgaggtagaaatggtcatcaagacagggaggcagattgtgcagaagaagcagactgagaaccctaaggagttagacgagagggtgactgcgctcaagctgcattacaacgagctcggagcaaaggtgaccgagaggaaacagcagctggagaagtgtctgaaactgtcccggaaaatgcgcaaggaaatgaatgttctgacagagtggctggcagccactgacatggaactaactaagcgctccgctgtggagggcatgccaagtaacctcgactctgaggtcgcgtggggtaaggccacccaaaaggaaatcgaaaagcagaaagtccacctaaaaagcattaccgaggtgggggaagcactcaaaacagtgctcggtaaaaaagagaccctggtcgaagacaaattgagccttttgaacagtaactggatagcagtcacaagtagagccgaggagtggctgaacctgttgctggaataccagaagcatatggaaaccttcgaccagaacgtggatcacatcaccaagtggattattcaggctgacaccctgttagacgaaagtgagaagaaaaaaccccaacaaaaggaagatgtgttaaagcgactgaaggccgagttaaatgacatccggcctaaagttgattccacaagagaccaggccgcaaatcttatggcaaacaggggggaccactgccgaaagctcgtcgaaccacagatatccgagctgaatcatcgtttcgcggctatcagtcacagaattaagaccggtaaggcgtctatccctctgaaagagctcgagcagtttaacagtgatatccagaagctactggagccgctggaggccgaaatacagcaaggcgttaacttgaaagaagaggactttaataaggatatgaacgaggacaatgagggaacagttaaggagctcctacagcgcggtgacaacctacagcagcgcatcacggatgagcgaaagcgggaggagatcaagatcaagcagcaactgttacaaaccaaacacaacgcgcttaaagacctccgctcacagcggagaaaaaaagcactggagatctctcatcagtggtatcagtataagcgccaggccgacgatctgctgaaatgcttagacgatatagagaagaagctagcatccctgccagaaccaagggatgaaagaaagataaaggagattgatagagagcttcagaagaaaaaggaagagctgaacgccgtgcgtagacaagccgagggcctgtcagaggatggcgctgctatggctgtcgaacctactcagatccagctctccaagaggtggcgggagattgagagtaagttcgctcaattcagacgattgaacttcgcgcagatacatacagttcgggaggagaccatgatggtcatgactgaagacatgcctttggaaattagttacgtccctagcacctatctgacagagattacgcacgtcagccaagccctcctggaggtggagcagctcctgaatgctcctgatctgtgtgccaaagatttcgaggatctctttaagcaggaggagagccttaaaaacattaaggattcgctgcagcaaagcagtgggaggatcgacataatccacagcaagaagaccgctgctttgcagagcgctacccctgtggagagggtaaaactccaggaggccctaagccagctagactttcaatgggagaaggtgaacaagatgtacaaagatcgacagggtcggttcgatcgctctgtcgaaaagtggaggcgattccactatgacattaaaatctttaaccaatggctaaccgaggcagaacaatttctcagaaagacacaaatccctgagaactgggagcacgccaagtataagtggtacctgaaagagctccaggatggaataggccagaggcagacagtagttcgcactctgaatgccaccggcgaggagatcatccagcagagctctaagaccgacgcctctatcttgcaggaaaagctagggtcattgaatctgcgctggcaggaggtttgtaaacaactgtccgacaggaagaaacgtcttgaggagcaaaagaacatcctgtccgagttccagcgagatctcaatgagtttgtcctgtggctcgaggaggcagacaacatcgccagtatacccctggaacccggaaaggagcagcagctgaaagaaaaactggaacaggtgaagcttttagtggaggaactgcctttaagacaggggattctgaaacagctgaacgaaacgggcggacctgttctggtttccgcaccgatctcacctgaggagcaggataaactggagaataagctaaagcagacaaatctacagtggatcaaggtgagtcgtgctctcccagagaagcagggggagatcgaagctcagattaaggacctaggacagctcgagaagaaactggaggatttggaggaacagctaaaccacctgctgctgtggctaagccccattagaaaccagctggaaatctacaaccaacccaaccaggagggcccttttgacgtaaaggaaactgagatcgccgtacaggctaagcaacccgacgtcgaggaaatcctatctaaaggacaacacctctataaggaaaagccagccacccagccagttaagcgcaagttggaagacctgagctctgaatggaaggcagtgaatcgcttgcttcaggaactgcgggcaaagcagcccgatctggcccctggcctcaccacaatcggggcttctcccacccagaccgtaacattagtcacccaacctgttgtaaccaaggaaactgccatctccaaactggaaatgccatcctctttgatgctggaggttcctgccctggctgacttcaacagagcctggacagagctgacagactggttgagtctgctcgaccaggttatcaaatctcagagagttatggtgggcgatctggaagatatcaatgagatgataattaaacagaaggcaaccatgcaggacctcgaacagcgcaggccacagctcgaagagctgattaccgcggctcagaacctgaagaataagacgagcaatcaggaggcgagaactattatcacagacaggattgagcgaatccagaaccagtgggatgaggtccaggaacacctgcagaatcgacggcaacagctgaatgaaatgttaaaggattctacccagtggctcgaagctaaggaggaggcagagcaagtgctgggacaggcaagagccaaacttgagtcttggaaggaaggtccttacacagtagacgcaatccaaaagaagataaccgaaacaaagcaactcgcaaaggacttgaggcagtggcagaccaacgtagacgttgccaatgatcttgccttaaagctcctgcgggattattcagccgatgatacaaggaaagtacacatgatcacagaaaatattaacgcttcttggaggtcaattcacaagcgggtcagtgaacgggaagctgcgctcgaggagacccaccggctgcttcaacagttccctttggatttggagaaatttctggcctggttgactgaggcagagactacagccaatgtgttgcaggacgctactcgcaaggagagactgctcgaagactccaagggggtaaaagagttgatgaagcagtggcaggaccttcagggggaaattgaagctcatacggatgtgtaccacaacctcgatgagaatagtcaaaaaatactgcgttcacttgagggatccgacgacgccgtactcctgcagagaagactagacaacatgaacttcaagtggtcagagctaagaaaaaaaagtctaaacatcaggagtcacttggaggcatcctccgaccagtggaagcgtctccacctaagcctgcaggagctcttagtctggctgcagctcaaggatgatgaactgtcccggcaagccccaatcggcggagattttcctgctgtacagaaacagaacgatgtgcatagagccttcaaaagggagctcaaaacaaaggaaccagtcatcatgtcaacattggagacagtcaggattttcctgacggaacagccactggagggacttgaaaaactgtatcaagagcccagggagctgcccccagaagagagagcccaaaatgtcactcgactgttgcggaagcaggccgaagaagtgaacactgagtgggaaaagctgaatctgcatagtgctgattggcagaggaaaattgacgaaaccctggaacgcctacgcgaactgcaggaggctacggatgaactggatttgaagctgcgacaggccgaagtcatcaagggttcttggcagcctgttggcgatctactaatcgattcgcttcaagaccacttggagaaagtgaaagctctcaggggagaaatcgctcccttaaaggaaaatgtgagccacgtcaatgacctggccaggcaattaactaccttgggaatacaactctctccttacaacctttccacactggaagacctgaacacgagatggaaactcctgcaagtggctgtggaggatcgggtgcggcaattgcacgaggcccatagagattttggacccgctagccaacatttcttgagcacatcagtccagggaccctgggagagggcaatctcccctaataaggtcccctattatattaaccatgaaacacagaccacctgctgggaccacccaaagatgactgagttgtaccagtcacttgctgacttaaataacgtccgattctcagcttatcggaccgcgatgaagctgagacggctgcagaaagccctctgtcttgacctgctgtctctgtcagcggcttgcgacgctctggatcagcataacctcaaacaaaatgatcagcctatggatatcctccagatcataaactgcctgactacaatttacgatcggcttgaacaggagcataataatctggttaacgtgcctctgtgcgtcgacatgtgcctaaattggctgctcaacgtgtacgataccggtcgtacagggaggatacgagtcttgagtttcaagacagggataatcagcctgtgtaaagcgcaccttgaagacaagtatcggtacctgttcaagcaggtcgcgagttcaactgggttttgcgaccagagaagactcggcttgcttctacacgactctattcaaatacctcgacagctgggcgaagtggcttctttcggcggaagtaatatcgagccttcagtgcgctcttgcttccagtttgcaaataacaagcccgagattgaggccgctctgttcctcgactggatgagattggagcctcagagcatggtgtggctgcctgtactccaccgggtggccgcagccgagacagcaaaacaccaggcaaaatgtaacatttgcaaagagtgccctataatcggatttagataccgcagccttaagcactttaactatgatatatgccaaagttgcttcttttcaggaagagtcgccaaaggtcacaagatgcattaccccatggtggagtattgtacaccaacgacgtccggcgaggacgtcagagacttcgccaaggttctgaagaataagttcaggaccaaacgatatttcgctaaacatcccaggatggggtacctacccgtgcagacagtcctggaaggggacaatatggaaacccccgtgaccctgattaacttttggccagtcgactcagcacccgctagcagtccccaactgagtcacgacgacacacacagccggatcgaacattacgcatctaggctcgccgaaatggaaaacagtaacgggtcctaccttaatgactccatcagtcctaatgagtctattgacgacgaacacctgctgatccagcactactgccaatctctgaaccaggactcacctttgagccagccccgaagcccggcacaaatcttgatctccctggaaagcgaagagcgcggagaactcgaacgaatactcgcggacctcgaggaagagaataggaacctccaggccgaatatgacaggctgaaacaacagcatgagcacaaaggccttagcccgctgccctccccaccggagatgatgcctacatctccacagagtcccagagacgcagagctgattgctgaggcgaaactgcttcgccagcataaaggacggcttgaagcgagaatgcagatcctggaagaccataacaaacagctggagtcccagctacatcgcttgagacaactcctggaacagcctcaagctgaagccaaagtcaatggaactacagtctcctcccccagcacatccctgcagcgcagtgatagttctcagccaatgctgctacgcgtggtggggagccagacctcggactctatgggagaagaggaccttctgtctcctccacaggacacgagtaccggactggaggaagtgatggagcagttaaataatagctttcctagcagtcgcggaaggaacacaccaggcaaacccatgcgggaagacacaccata

SEQ ID NO: 221586 - DNA, 7026 bp, Artificial Sequence
  Description of Artificial Sequence: Synthetic coding sequence
atgagtgcacggaagctgaggaacctgagctataagaaggccgtgcgccgtcagaaactcctggaacaaagcatccaaagtgcccaggagaccgaaaaatcactccatctgattcaagagtctctaacttttatcgacaagcaactggccgcttatatcgctgacaaagtagatgccgctcaaatgccacaggaagcacagaagatacagtccgatctgaccagccacgagatttccctggaggagatgaaaaagcacaaccaaggaaaagaagccgcacagcgcgtgctcagccagatcgacgtcgctcagaagaagttacaagacgtgtcaatgaagtttagattatttcagaagcctgctaactttgagcagcgattgcaggaaagcaaaatgatccttgacgaagtcaagatgcacctccccgcactggagaccaagagcgtcgagcaggaggtcgtccagagtcagctcaatcactgtgtgaacctctacaagtcattaagcgaagtaaaatccgaggttgagatggttattaagaccggacgacaaatcgtgcagaaaaaacaaacagaaaatcccaaagagcttgatgagcgggtgacagctctgaaactccactacaacgagctaggcgctaaggtgactgaaaggaagcaacagctggagaaatgtttgaagctgtcaagaaagatgcgcaaggaaatgaacgtgcttaccgaatggctggcggcaaccgacatggagctaacgaagcgctccgccgtcgagggtatgccgagtaacctcgattcagaagtcgcctggggcaaggccacccagaaggagatcgagaaacagaaagtacatcttaaaagcatcacagaggtcggggaagcactgaaaactgtgctgggtaaaaaagaaactcttgttgaagataaactgtctcttctgaatagcaattggatagccgtcaccagtcgcgcagaagagtggctcaacttactcctggagtaccagaagcacatggagacatttgatcaaaatgtggatcacattacaaaatggatcattcaggccgacaccctgttggacgagtccgagaaaaagaagccccagcaaaaagaagatgtgctcaaacggcttaaggccgagctgaatgatatccggccaaaggttgattccaccagagaccaagccgcaaacctcatggcaaatcgcggagatcattgccgcaagctggtggaacctcagatctccgagttaaatcatcgatttgccgcaattagccatagaatcaagaccggcaaggcttccatccctttaaaggagctcgagcagtttaactccgacattcaaaagttactagaaccgctcgaagcagagatccagcagggggtcaatctcaaggaagaagacttcaataaagacatgaatgaggataatgagggaacagttaaggaactgcttcaaagaggggacaacttgcaacagcgcataaccgatgagcggaaaagggaggagattaaaattaaacagcagctgctgcagacaaaacacaacgccttgaaggatcttcgaagccaacggaggaaaaaagccttggaaattagccaccagtggtaccagtataagcgtcaggccgacgatttgctaaagtgccttgacgacatagaaaaaaaattggcgagtcttcccgagccacgcgatgagcggaaaattaaagagattgatcgggaactgcaaaagaaaaaggaggagctcaatgcagtgaggaggcaggcagaaggcctgagtgaagacggagccgcaatggccgttgaacccacacagatccagttgtctaagagatggcgagagatagagagcaagtttgcgcagtttagacggcttaacttcgcacagatccacaccgtccgcgaggagaccatgatggtcatgactgaagacatgcctctcgagatctcttatgtccccagcacatatctaacggagatcactcatgtatcacaagccttgctggaagtagagcagctccttaacgctcctgatctctgcgctaaggactttgaagatctgttcaaacaggaggaaagccttaagaacataaaggactccttacagcagtcttcaggaaggatcgacattattcactccaaaaaaacagcagccttgcagagcgcgacacccgtcgagagagtaaagcttcaagaagctttgagccagctcgactttcagtgggagaaggtaaacaagatgtataaagatcggcagggaaggtttgaccggtctgtagaaaagtggcggagattccactacgacatcaagatcttcaatcaatggctcaccgaggccgaacagttcctaaggaagacacagatcccagaaaattgggaacacgctaagtacaagtggtatctgaaggagctacaggacggaatagggcagcggcagacggtggtgaggaccctaaatgccacgggcgaagagataattcagcagtcttcaaagactgatgcctccattctgcaagaaaaactggggagtcttaacctgagatggcaagaggtctgcaaacaattaagtgacagaaaaaaaaggttagaggagcagaaaaatatactttccgaatttcaacgggacttaaacgaattcgtcctctggctggaggaagctgataacatcgcaagcatcccactcgagcccggtaaagaacagcagctgaaggaaaaactggagcaggtaaaactgttggttgaagagctgccccttcgacagggcattttaaagcagctcaacgagacaggaggcccagtgctggtcagtgctcccatctccccagaggaacaggacaaattggagaataagttgaaacaaacgaatctccagtggatcaaagtgagtagggccctgccagaaaagcagggggagatcgaggcccagatcaaagacttaggccaactggagaagaagcttgaggatcttgaggaacaactcaatcacctgcttctctggctgtccccaattagaaaccagctggagatctataaccaacccaaccaggagggaccttttgatgtcaaagagaccgagatcgcagttcaagccaagcagccagacgtagaagagattctgtctaagggacagcacctctataaagaaaagcccgctacacagcccgttaaacgaaaattggaagacctctcttctgaatggaaagcagtaaacagactgttgcaggaactaagggccaaacagccagatcttgcccctgggttgaccaccattggagcttcccctacccagacagttacgttggtcactcaaccagtagtaacgaaagaaaccgccatctcaaagctggagatgccatccagcctgatgttggaagtgccagccctagctgattttaatcgggcatggaccgagctgactgactggctctcgttattagaccaggtgattaaatcacagagagtgatggtgggtgaccttgaagacattaacgagatgataattaagcagaaggccacaatgcaggaccttgagcagcgacggcctcaattggaggagcttattactgctgcccagaatctcaagaataagacaagcaaccaggaggctcggacgatcatcaccgatcgcatcgaacgtatccagaatcagtgggacgaagtccaggaacatctgcagaatagacgccagcagttgaatgaaatgctcaaggattccacacagtggttggaggctaaggaagaagccgaacaggtcctgggccaagctcgggctaagctcgagtcttggaaggagggaccctacacagtagatgccattcagaaaaagatcactgaaacgaaacagctcgccaaggatctacgccaatggcagaccaacgtggatgtggctaacgatctcgccctgaagcttctgcgggactattccgctgacgacactcgcaaggttcatatgattactgagaacatcaacgctagttggagaagcattcacaagcgcgtgtccgaacgagaagcagctctggaagaaacccataggctgctgcagcagtttcctctggatcttgagaaatttctggcctggctgaccgaagctgaaacaacggcaaatgtacttcaagacgccaccaggaaagagaggcttctcgaagactccaagggggtcaaagagctaatgaagcagtggcaggacctccagggcgagattgaagcacatactgatgtctaccataaccttgacgagaatagccagaaaatactgcggtccttggagggatccgacgacgccgttctgcttcagcgaaggctggataacatgaacttcaagtggtctgaactccggaagaagagcttaaatatcagaagccacctggaggcatccagtgatcagtggaagaggctccacctgagcttgcaagagctccttgtctggctgcaactgaaagacgacgaactcagtcggcaggctcccatcggaggggattttcctgcagtgcagaagcagaatgacgtacatcgtgccttcaagcgtgaactgaagaccaaggaaccggtgatcatgagcacgcttgaaactgtcaggattttcctgaccgaacagccattggaaggattggaaaagctttatcaggaaccgagggagctaccacctgaagagagggcccaaaatgttacccggctgttgagaaagcaggccgaggaggtcaacacagaatgggagaaattgaacctgcatagcgccgattggcaacgcaaaatcgacgagactctcgagaggctgagggaattgcaagaggctaccgacgaactcgacttaaagctgcgccaagccgaggttatcaaaggctcctggcaaccagtgggcgatctgctgatagactcccttcaggaccacctggagaaagtgaaggccctccgaggggagattgcaccattgaaagagaacgtgagccacgttaacgatctagctcggcagctgaccaccttaggtatccagttgagtccctacaatttaagcacactggaggacctgaatacgcgctggaagctgcttcaggtagctgtggaggatagggtgcgtcagcttcatgaagcccatagagatttcggaccagccagccagcacttcctgtctaccagcgtgcagggcccttgggagagagccatcagccccaacaaggtgccctattacattaatcacgaaactcagacgacctgctgggatcatcccaagatgactgagctctatcagagcctagctgatctgaataatgtgcgcttttcagcctaccgtacggcgatgaaacttaggcggctgcagaaagcgctctgtctggacctcctgtccctatcagctgcttgtgatgcactcgaccagcataatttaaagcagaacgatcagcctatggatattcttcaaatcatcaactgtctgactactatctatgataggctggaacaggaacataacaacctggtcaatgttccattgtgcgtcgacatgtgtctgaattggctcttgaatgtgtatgatacggggaggacaggaagaattcgcgtactctcatttaaaacaggaatcattagtctgtgcaaggcgcacctcgaagacaagtatcggtacctgttcaaacaggtcgccagctcgactggcttctgcgatcagcgtcgcctgggactcctcctgcacgactccattcagattcctaggcagctaggcgaggtggcctcctttggtggatcaaatatcgagccgagcgtcaggagttgctttcagttcgccaataataagcctgagatagaagcagctctttttctcgactggatgagacttgagccccaatccatggtttggctcccagtccttcaccgggtggctgcagcagagacagcaaagcaccaggcaaagtgcaacatttgtaaagaatgtccgatcatcggttttcgttatcggagtctgaaacattttaattacgatatttgtcagagttgctttttcagcggaagggtggctaagggccataaaatgcactaccccatggtggaatattgcacacccacaacgtcgggcgaagacgtgagagactttgcgaaggtactcaagaacaaattcaggacaaaacggtatttcgctaagcatcctcgaatgggttatttacctgtccagaccgtcctggaaggggacaatatggagacgcctgtgaccttgattaacttttggccagtcgattctgccccagcctcctccccccaactgagccacgatgacactcattctcgtatcgagcattacgcttcccgattggcagaaatggagaattccaacggctcttacctgaacgatagcatttctcctaatgaatctattgatgatgagcacctactgatacagcactactgccagtcgcttaatcaagactcccctctttcccagccacgctcaccagctcaaatcctgatttctctggagtctgaggaacggggtgagctggaaagaatactggccgatttagaggaggagaaccggaatcttcaggccgaatacgaccgtctgaagcagcagcacgaacacaaaggtctttcccccttaccctctcctcccgagatgatgcccacatctcctcagagtcctagagatgctgagctgatcgctgaggccaagttattacgacaacacaaagggaggttggaagccaggatgcaaatactcgaggaccacaacaaacagctggaaagccagctgcacagactgcgccaactcttggagcagccccaggcagaggccaaagtaaatggaactaccgtgagctccccttctactagcctgcagcggtctgatagcagccagccaatgctgcttcgtgtggtgggctcacaaacctccgactccatgggggaagaagaccttctcagcccgcctcaggacacctccaccggtttggaggaagttatggaacagctgaacaatagcttccccagcagcagagggcgaaacactcctggaaaacccatgagggaggacacaccatat

SEQ ID NO: 221587 - DNA, 1854 bp, Artificial Sequence
  Description of Artificial Sequence: Synthetic coding sequence
atgcgagagcagttaaaagggcacgagacacagacaacttgttgggatcaccccaaaatgactgagctttaccaatctctcgcagacctaaataatgtacggttcagcgcctaccgaacggccatgaaactcagaagactgcagaaagccctttgcttagatctactgtctttgagcgccgcttgtgacgctctggaccaacacaatctgaaacaaaacgaccagccaatggatatccttcagattataaactgtctgactactatctacgatcgcttagagcaggagcacaacaacctagtgaacgtgcccctctgtgtcgatatgtgcttgaattggctgctgaatgtatacgacacgggcagaactggccgtattagagtgctgtcattcaaaaccggaatcatcagcttgtgcaaggctcaccttgaagataagtataggtatctgttcaaacaggtagcgtctagtactggcttctgtgaccagcgcagactggggctgttgctgcacgacagcattcagatccccagacagctgggggaagtagcgtccttcggcggatccaatatcgaaccaagtgttaggtcctgtttccaattcgcaaacaataagccagagatcgaggctgcgctcttcctggattggatgcggctcgaaccacagtcaatggtgtggctgcctgtcttgcatcgcgtggccgctgccgaaactgcgaagcatcaagcgaagtgcaacatctgcaaggagtgcccaatcatcgggttccggtacaggtctctaaaacacttcaactacgatatctgtcagagttgttttttttctggacgggtggccaaggggcataagatgcattaccctatggttgagtactgtacgccaacaaccagtggggaggacgtgcgggatttcgccaaggtcctaaagaataaatttagaacgaagcggtatttcgctaagcaccccagaatggggtacctgcccgtgcagacagtgctggagggggacaacatggagacaccagtcactctgatcaatttctggccagtagacagcgcccctgcttccagcccccagctctctcacgacgacacacatagccgtattgaacactatgcaagtcgtctggccgagatggagaacagcaacggcagctacctgaacgactcaatctcgccaaatgagtcaatagacgacgagcacctactgatccagcattattgccaatcactaaatcaggatagtcctttgtcccagccgcgatctcccgcacagatactaatcagcctggagagtgaggaacggggtgagctggaaagaattctggcggacctcgaggaggaaaatagaaatctgcaagcggagtacgatcgcctgaaacagcagcacgaacataaggggctgtccccactcccctccccgccagaaatgatgccgactagtcctcagtctcctagggatgccgagttaattgccgaggctaagctgctaagacagcacaaggggaggctcgaagctcggatgcagatcctggaggatcacaacaagcagctggagtctcagctccaccggctgagacagctcctcgaacaaccccaggccgaggccaaggtgaatgggaccactgtgagctccccaagcacaagtcttcagagaagtgactctagtcagccaatgctgctgagggtggtagggtcccagacttccgactcaatgggtgaagaggacctattgagtccccctcaggatacttctaccgggctcgaggaagtgatggaacagctgaataatagtttcccctcaagcagaggcaggaacacacccggtaaacctatgagagaagacacaatgtag

SEQ ID NO: 221588 - DNA, 3678 bp, Artificial Sequence
  Description of Artificial Sequence: Synthetic coding sequence
atgcccagttccctgatgctagaggttcctgctcttgcagatttcaatagggcatggactgagctaaccgactggctcagcctgctggatcaggtcatcaaatcccagcgagtaatggtgggtgacctggaagatatcaatgaaatgatcattaaacaaaaggctacaatgcaggacctagagcagcggagaccccagctggaggaactgatcactgctgcccagaacctgaaaaacaaaacgtctaatcaggaggccaggaccattattacagacaggattgaacgcattcagaatcagtgggacgaagtgcaggagcatctccaaaatagacgtcagcagctaaacgaaatgctcaaagattctacacagtggctcgaggccaaggaagaggctgaacaggttcttggccaggccagggccaagctggaatcttggaaggaaggaccatatactgttgacgcaatccagaaaaagatcacagagacaaaacagcttgcaaaagatctacggcaatggcagacaaatgtggacgttgcaaacgacttagctcttaaactgcttagagactatagcgcagatgacactcgaaaagtgcacatgataaccgagaatataaatgcctcttggaggtccattcacaagcgcgtttccgaaagggaggcagccctggaggaaacacacagacttctccaacagtttcccctagacctggagaaatttctggcttggcttactgaggcagagactaccgcaaatgtgttgcaggacgctacacgcaaggagagactcctcgaagactccaaaggagtcaaggagcttatgaaacaatggcaggatcttcagggtgaaattgaagcgcataccgacgtctatcataacttggacgaaaactctcagaagatattacggtctcttgaggggagcgacgatgcagtgctactccagcgcaggctggataatatgaattttaagtggagtgagctgcggaagaagagtctcaatatcaggtctcacctggaagcaagctcagaccagtggaaacggctgcatctgtccctgcaagaacttctagtatggctgcagctgaaagacgatgagctgtcacgacaggcacccatcggtggcgattttccagccgttcagaagcagaacgatgtgcacagggccttcaagagggaactgaaaacaaaagagccagtgataatgtccacactagaaactgtcaggatctttctgacggagcagccccttgaaggcctggaaaagctgtaccaagagcctagggaactcccccctgaagagagagcccagaacgtgactagactcctccggaagcaagcagaagaggtcaataccgaatgggagaaactcaacctgcactctgccgattggcaacgcaaaattgatgagactctggagagactgcgggaacttcaggaagccaccgatgaactggacttgaagttaagacaggcagaggtcatcaaggggagttggcaaccagttggcgacctccttatcgattcattgcaggaccatctcgaaaaggtcaaagcattgaggggtgagatcgcacctctgaaagagaacgtgtcccatgtaaacgacctcgcgaggcaactaacgaccctggggattcagctctccccctacaatctttctacactggaggatctcaatacccgctggaagcttctccaggtggccgtggaggatagagttcgtcagctgcacgaagcccacagggactttgggccagcatctcagcattttctgtcaacttccgtccagggaccatgggagcgcgcaatctctcccaacaaagtcccttactatattaaccatgagacacagactacatgctgggaccatcccaaaatgaccgaactttaccagtccctggcagacctcaataatgtcagattctctgcctataggacggccatgaagctgcggcgacttcagaaggcgctgtgccttgatctcctgtccctcagcgctgcctgtgatgccctggatcagcacaatctgaagcagaacgatcaacccatggacatcttacaaataattaactgtctcaccactatatatgataggctcgagcaggaacacaataatttggtgaacgtgcctctgtgtgtcgacatgtgtttgaactggctacttaatgtgtacgacacaggcagaacaggccgaattcgcgtcctgtccttcaaaacaggtatcatctctctctgtaaggcccatctggaagacaagtataggtacctgttcaaacaggtagctagctctaccggcttctgcgaccagcggagattgggcctgctgctacacgacagcatccaaatccccaggcagctgggcgaggtagcaagctttgggggaagtaatatcgaaccgagcgttaggtcatgttttcagttcgccaataataagcccgaaatcgaagctgctctcttccttgattggatgaggcttgaaccccaatcaatggtgtggctccctgtgctgcacagggttgccgctgccgaaacagccaaacaccaggccaaatgcaatatctgtaaagagtgtcccataatcggcttcaggtaccgctccttgaaacattttaactatgacatttgccagagttgtttttttagcggtagagtagccaaagggcataaaatgcactaccctatggtggaatactgtacgcccaccacttcaggcgaagatgttagagacttcgccaaggtcttaaaaaacaagtttcgcactaaaaggtactttgccaagcatcctcggatgggttacttgcctgtccagaccgtccttgagggagacaatatggagacccctgttactctgatcaacttctggccggttgactctgccccagccagttctcctcagctctcccacgacgacacgcacagtagaatagaacattatgcctctagactcgccgaaatggagaactccaacggttcctacctgaatgactccatttcgccaaatgagagcattgatgacgagcacctgctcattcaacactactgtcagtccctcaaccaggattcccctttgtcccagcctcgctccccggctcaaatcctgattagccttgagagcgaggagaggggcgagctagagaggattctggcggacctcgaggaggagaaccgcaacctgcaggcagaatatgatcggctgaagcagcaacacgaacataaaggtctgtccccccttcccagcccacctgaaatgatgcccaccagcccacagagccctcgggacgccgagttgatcgcggaggctaagctcctgcggcagcataaggggagacttgaagccagaatgcagattttggaggaccacaacaaacagctggagtcccagctgcatcgcttgcgacagctgctggagcagcctcaagcagaggccaaggtcaacggtaccactgtcagctctccttcaacgagccttcagagatcagattcatctcaacccatgcttttgagggtggtcgggtctcagacaagcgattcaatgggtgaagaggacttgctgagcccacctcaggacactagcactggcttggaagaagtgatggaacagctgaataactcatttccgtcctcccggggtcggaatactcctgggaaacccatgagggaggataccatgtag

SEQ ID NO: 221589 - DNA, 1908 bp, Artificial Sequence
  Description of Artificial Sequence: Synthetic coding sequence
atgcgcgagcagctgaaagggcacgaaacacagacgacatgctgggatcaccccaaaatgacagagctctaccagagcctcgccgacctcaataatgtgcggttcagcgcttatcgaaccgctatgaagctccgcaggctgcaaaaagctctgtgcttagaccttctgtctcttagtgctgcatgcgatgcgctcgaccaacacaatctgaaacagaatgaccaacctatggatatacttcagataatcaattgcttgactactatctacgataggctggaacaagaacacaacaatctggttaacgtgcctctctgtgtggacatgtgtctgaactggcttcttaacgtttatgacacaggacgcacaggccgaatacgcgtgctgtcattcaagactggcataatatcactgtgcaaagctcatctggaggacaagtaccgctacctgttcaaacaggtggcctctagcaccggattctgtgaccaacgccgactgggacttctcctccacgattccatccaaataccacggcaactgggggaggtagcctccttcgggggttccaacatcgaacccagtgtccggtcatgctttcagtttgcgaataacaaacccgaaatagaagctgcattgttcctggattggatgcgtttggagccccaatcaatggtctggctgccagtactgcaccgtgtagcagccgctgagactgcgaagcaccaggccaaatgtaacatctgtaaagagtgccctataattggattcagataccgctctctgaagcacttcaactatgatatttgccaatcctgcttctttagcgggagggtggcaaaaggacataagatgcattaccccatggtggaatattgcacccctaccacaagcggagaagacgtgagagacttcgccaaggtcctaaaaaacaaattcagaacaaagaggtatttcgcgaagcaccctagaatgggctacctccctgtgcagacagtgctagaaggagacaacatggagacacctgtcacgttaatcaatttctggcctgtcgactcggccccagccagctcacctcagctcagccatgatgatacacatagtagaattgaacattacgccagccgcttagctgaaatggagaacagcaacgggagttatctcaatgactcaattagcccaaatgaaagtatagatgatgaacacttgctgattcagcactattgtcaaagcctaaatcaggactcacccctttcccagcctcgcagcccggcacaaattttaatcagcttggagtcagaggagcgtggcgagttagaacgaatcctagcggatctggaggaagagaatcgtaatcttcaggccgagtatgacagactgaaacagcagcatgaacacaagggccttagtccactcccttccccccctgaaatgatgccaacaagccctcagtccccccgagacgccgaactgattgctgaagcaaaattgctgcgccagcataaaggtcggctggaggctaggatgcagattcttgaggaccacaacaagcaattagagtctcagcttcatcgtctgcggcagctgctggagcagccccaggccgaagccaaagtcaatggtactactgtatcctctccgtctacatctctgcagcggagtgactcctcacagcctatgcttctcagggttgtgggatctcagactagtgactctatgggggaagaggacttactctcgcccccacaggatacaagcaccggcttggaagaggtcatggagcaactgaacaattctttcccgagcagcagaggtcataatgttgggtctctgtttcatatggccgatgacttaggacgcgcaatggaatctctcgtgagcgtgatgacagacgaagagggcgcagaatag

SEQ ID NO: 221590 - DNA, 3732 bp, Artificial Sequence
  Description of Artificial Sequence: Synthetic coding sequence
atgccatcaagcctgatgctcgaggtgccagccctggccgacttcaaccgcgcatggaccgaactgacagactggttaagcctgctggatcaagttatcaaaagccagcgggtcatggtaggcgacctcgaagacataaacgaaatgatcattaagcagaaggctactatgcaggatttggagcaaaggaggcctcagcttgaagaactcatcacagcagcccagaatcttaagaacaagacaagcaatcaggaagcgcgaacaatcatcaccgatagaatcgagcgcatccaaaatcaatgggacgaggtgcaggagcatttgcaaaacaggaggcagcagcttaatgaaatgcttaaggatagtacgcaatggcttgaggcgaaggaagaggcggaacaggtcctgggacaagcccgagctaagctggagagctggaaagaggggccatacacagtcgatgccatccagaagaagattactgagactaaacagttagcaaaggacttgcgtcagtggcaaaccaacgtcgacgtggccaacgatctggcactgaaactgctccgcgattattccgccgatgataccaggaaggtacatatgatcacggaaaatatcaacgcatcctggcgttctatccataaaagggtcagcgagcgcgaggccgctctggaggaaacacaccggttactgcaacaattcccgctggacttagagaaatttctggcctggctcacagaagcggagactaccgcaaatgttcttcaggatgccactcggaaagaacgactgctggaagactcaaaaggagtgaaagagttaatgaaacagtggcaggacctgcaaggcgaaattgaggcccacactgatgtgtatcacaaccttgacgaaaactcccaaaaaatcttgcgctccctggaaggaagcgatgacgcagtactgttgcagaggcgactggataatatgaactttaagtggtcagaattgaggaaaaagagcctgaacattcggtcccacttggaggcatcttctgaccagtggaaacgcctccacctctcattgcaggagcttttggtctggttacagcttaaagatgatgaactgagccgtcaggccccaataggaggagatttccctgccgtacaaaaacagaacgatgtgcatcgggctttcaagagagaattgaagaccaaagagcccgttatcatgtctactctggagacagtgagaatctttctgaccgagcagccactggagggcctggaaaagttataccaggaacccagggaactgcccccagaggagcgagcgcaaaacgtgacgaggctcctgcggaaacaggcagaagaagtaaacaccgagtgggagaagctgaacttacattcagccgactggcaaaggaagatcgacgagactttggaaaggctcagagaactgcaagaagcaacagacgagctggatcttaagctgcgccaggctgaagtcatcaaggggtcctggcagccagtaggagatctgctgatcgacagtttacaagaccacctggaaaaggttaaggctctgaggggcgaaattgcaccccttaaggagaatgtgagccacgtgaatgatttggcaagacagttaactaccctgggcattcagctgtccccctataatctgtccacgctcgaagacttgaatacaaggtggaagctgctgcaggtggccgtggaggaccgggtgaggcagctgcacgaagcccacagggatttcggaccagcctcccagcattttctgtctacatccgtacagggcccttgggaaagggccatctctcctaacaaggtcccgtattacatcaaccacgaaacacaaacaacttgttgggaccatcccaaaatgaccgaactgtaccagtctttggccgacctgaacaatgtcaggttctctgcctacagaaccgcgatgaagttacgacgattgcagaaggcgctgtgtctggacctgctcagcctatctgccgcatgtgacgccctcgatcagcacaacctgaagcagaatgatcaaccaatggatatactacagattattaattgtctgacaaccatctacgacagattggagcaggagcataataatttggttaatgttcctctctgtgtcgacatgtgcctgaactggttgctaaacgtgtatgacacaggcagaactggcagaattagggtgttgtccttcaaaaccggcatcatctccttatgtaaggcacatctcgaagacaagtacaggtatctttttaagcaagtggccagctcgactggcttctgtgaccagcgtaggcttggccttctgctccatgacagcattcagattcctcgtcagcttggcgaagtagcttcatttggtggcagcaatattgaaccttctgtccggtcatgtttccagtttgcgaataataaaccagagatcgaagccgctttgttcctggactggatgaggcttgaaccccaatctatggtttggctcccagtcctccaccgggtcgcagccgctgagactgctaagcatcaggcaaagtgtaacatttgcaaggagtgtccaatcataggattcaggtaccggtctctcaaacacttcaattacgacatctgccagtcatgctttttctctggcagggtcgccaaaggccataagatgcactatccgatggtcgagtactgtactcccaccactagtggagaagatgtgcgtgactttgccaaggtgctgaagaacaagttcagaacgaagcggtattttgctaagcatccgaggatggggtatctccctgtccaaactgtccttgagggcgataatatggagacccccgttacattgatcaacttttggcccgtggactctgcccctgcttctagcccccaactgtcacacgacgatactcactctcgtatagaacactacgcctcaaggcttgctgaaatggagaacagcaacgggagttacctgaacgacagcatcagtcctaatgagtccatcgatgatgagcacctattgattcagcattactgtcagagcctcaaccaggacagccctctcagtcagcctagatcaccagctcaaatcctcatctccctggagtcagaggagagaggagagctagagaggatcttggccgacctggaggaggagaacagaaatctgcaggctgaatacgataggctaaagcagcagcatgagcataaaggcctctcccctctgccctccccccctgagatgatgcctacaagcccccagagtcccagggacgccgaacttatcgccgaggccaagctgctccgacagcacaagggcaggcttgaagctcggatgcaaatcttggaggaccataacaagcagctggagtctcagcttcatagacttagacagctactggaacagccgcaggctgaggcgaaggtcaacggcactactgtgtctagtccgtccaccagcctccaacgtagcgactcatcgcagcccatgttactgcgggtggtcggctcacagacctcagattccatgggggaagaggatctgctcagccctccgcaagatacttccaccggtcttgaagaggttatggagcagctgaacaatagcttcccatcttctagaggccacaatgtaggatcactttttcacatggcagacgacttggggagggcaatggagtcattagtgtccgtgatgacagatgaggagggtgctgaatag

SEQ ID NO: 221591 - DNA, 11034 bp, Artificial Sequence
  Description of Artificial Sequence: Synthetic coding sequence
atcctggatgagcgtgaggacgtgcaaaagaagactttcaccaagtgggtgaacgcacaattctccaagtttggcaaacaacacatagagaacctgttcagtgacctccaagatgggcgtagactgctcgacctgctggaagggctcaccgggcaaaagttgcctaaggagaaaggctctactcgcgttcacgctctgaataatgtgaacaaagcgctgagagtgctgcagaacaataacgttgatctggtgaatatcgggagcaccgacattgtggacggcaaccataaactgacgctcgggctcatttggaatattatcctccattggcaggttaagaacgtgatgaaaaatataatggcgggtttacagcagaccaattcggagaaaattctgctcagttgggtgcggcagagcaccagaaactatccccaggtgaatgtgattaactttaccacttcatggtcagatgggctcgccctgaatgctctcatacattcacataggcctgatctcttcgactggaattctgtggtgtgccaacaaagcgccacccaaaggttagaacacgccttcaacattgcgcgatatcagctaggaatagaaaagctccttgatcccgaagacgtagacacaacataccccgacaaaaaaagtatccttatgtacatcacaagtctgttccaggtgttgcctcagcaggtgtcaattgaggccattcaggaggtcgaaatgctaccacgaccaccaaaagtaaccaaggaggagcatttccaacttcaccatcagatgcactacagtcaacagatcaccgtctctctggctcagggctatgagaggacctcttctcccaagccacgctttaagtcctatgcctacacgcaagctgcctacgtgacgacctcagaccctaccagatcaccctttccaagccaacatctggaagcacccgaggataagagctttggttccagtctgatggaaagtgaggtgaatttggatagatatcaaaccgcattagaggaagtgctgagctggcttctgagcgccgaagatactctgcaggcgcagggcgagatctcaaacgatgttgaagttgtgaaagatcagttccatacccatgaggggtacatgatggacctgacagctcatcagggcagagtgggtaacattttgcagctgggcagcaagctgatcggaaccggtaagctgtccgaggatgaggaaacggaggtgcaagagcagatgaaccttctgaacagcaggtgggagtgcctgagggttgcatccatggaaaaacagtccaacctccaccgggtactaatggacctgcaaaatcaaaagcttaaagagctgaacgattggctaactaaaactgaggaacgaacaagaaagatggaggaggagcctctcggtcctgaccttgaagacctgaagcggcaggttcagcagcacaaagttcttcaggaagacctggagcaggaacaggtgagagtcaactccttgacacacatggtggtggttgtggatgaatcatccggcgaccatgccactgccgctctggaagagcagctaaaagtccttggtgataggtgggctaacatctgccgatggaccgaggataggtgggtcctgcttcaggatatcctactgaaatggcagcggctcactgaggaacaatgtctgtttagcgcatggctgagcgaaaaggaagatgccgtcaacaagatccataccactggatttaaggaccaaaatgagatgttgagtagtttgcagaagctggctgtgctgaaggctgatctcgagaagaagaaacaatcaatgggaaagctgtactctctgaaacaggacctgttgtctaccttaaagaacaaatccgtaacccaaaaaactgaggcttggctcgataattttgctagatgttgggataacctcgtgcaaaagctcgagaagtccaccgctcagatttcgcaggctgtgaccaccacgcagccatcactgacgcagaccaccgtcatggagactgtcaccacggtcacaaccagagagcagatcctagttaaacacgcccaggaggaactgccccctccaccaccccaaaaaaaacggcagattactgtggactccgaaattcgtaagcgactggatgttgacattactgagctgcacagctggattactcgatctgaggcagtgctgcagtcgcccgagtttgcaatattcagaaaggaaggcaacttctcagacttaaaagaaaaagtcaatgctatagagagagagaaagcagagaagttcaggaagctgcaggacgcttcccggagtgcacaagctctcgtggaacagatggtgaacgaaggggtcaacgcggactctataaagcaggcatccgaacagctgaattccaggtggatcgaattctgccaacttctttcagaaaggctgaactggctcgaataccaaaacaacattatcgctttctataaccaactgcagcagttggagcagatgaccaccaccgccgagaattggctaaaaatacaacctaccacacccagtgaacctaccgctatcaagtctcaactgaagatctgtaaggatgaagtgaaccggctttctgacctgcaacctcagattgaaagacttaagattcaaagcattgcgctcaaagagaagggtcagggacccatgtttctggatgcagacttcgttgcattcacaaaccacttcaaacaggttttctctgatgttcaggctcgggagaaggaactccagactatcttcgacaccctccccccaatgcgatatcaagagaccatgtccgcaattaggacctgggttcaacagtccgaaacgaagctgtctataccccaactctcggtgacagattacgagattatggaacagagactgggggagttgcaagccctccaatcttcccttcaggagcaacaatcggggctatactacctttctaccacagtcaaagaaatgagtaagaaagcccctagtgaaattagccgaaagtaccagtcagagtttgaggagatcgaaggaaggtggaaaaagctgtccagccagctggtcgaacactgccagaagctcgaggaacagatgaataaactgcggaagatccagaaccatatacaaaccctgaaaaaatggatggcggaggtggacgtctttctgaaagaggagtggccagcactgggggatagcgaaatcctcaagaagcagctgaagcagtgccggctgttggtgtctgacatccagactatacagccttcactcaacagtgtgaatgaaggcggtcagaaaataaagaacgaggccgaacccgaattcgcgtccaggctcgagaccgagttgaaggagttgaacactcagtgggaccatatgtgccaacaggtgtacgcacgtaaagaagctctgaaaggtgggctggagaaaaccgttagcctgcagaaggacctgtccgaaatgcacgaatggatgacgcaggctgaagaagaatatttggagagggactttgaatacaaaacacctgacgagcttcagaaggccgtggaagaaatgaaacgagccaaagaggaagcacaacagaaagaagcgaaagtcaaattgctgacagaatccgtgaatagcgtgattgctcaggccccacccgtggcccaggaagctctgaagaaagaactggagaccctgacaaccaactaccagtggttatgtacccggctcaatggaaagtgcaaaaccctcgaggaggtgtgggcatgctggcatgaacttctgtcatatctcgaaaaagccaacaagtggctcaatgaggttgaattcaaactgaaaaccacagaaaatatcccagggggagccgaggaaatctctgaagtactggacagcctcgagaatttgatgcgtcactccgaggataaccccaaccagattagaattcttgcacagaccttaaccgacggtggggtcatggatgaacttatcaacgaagagttggaaacatttaactcgcggtggagggaactccatgaagaagccgttcggaggcagaaacttctggagcagtctattcagagcgcacaggagacggagaaatctctgcacctgatccaagaatcactgactttcatcgacaaacaattagccgcatacattgccgacaaagtggatgcagcccaaatgccacaggaggcacagaaaatccagtctgatctgacatcccatgagatttccctggaggaaatgaagaaacataaccaagggaaggaggccgcacagcgagtgctgtcccagatagacgtcgcacagaaaaaactccaggatgtgagcatgaagtttagacttttccaaaagccagccaattttgagcagaggctccaggaaagtaagatgatactggatgaagtgaaaatgcatctccctgctctggagactaagtccgtggaacaggaagtggtgcagtcccagctcaatcactgcgtgaacctttacaaatctctgtccgaggtcaagagcgaggtcgaaatggtcattaagactggcaggcaaatcgtccaaaaaaagcagacagagaatcctaaggaattggacgaacgggtaacagctctgaagctgcattacaacgagctgggtgccaaggttacggagaggaagcaacaactggagaagtgcctgaaattgtcccgcaaaatgcggaaggagatgaatgttttaacagagtggcttgcagccacggatatggagcttaccaagcggtcagccgtggaggggatgcccagtaacctggattctgaagtggcgtggggcaaagcgactcaaaaagaaatcgagaagcaaaaagtgcatctgaaaagcatcacggaggtgggcgaggctcttaaaaccgtactgggaaaaaaagagacactcgtggaagataagctcagcttgctgaatagcaactggattgcagtgacatcaagagccgaagagtggctgaatctgcttttggaataccaaaagcacatggaaaccttcgatcagaacgtggaccacataaccaagtggattatccaagctgatacactcctcgatgagtctgagaaaaagaagccacagcagaaggaagacgtgctcaagcgccttaaagcggagctcaacgacataaggcccaaagtagacagcaccagagatcaagccgctaacttgatggccaatcggggtgatcattgcagaaaacttgtagagccacagatcagtgaacttaatcacaggtttgccgctattagtcacaggattaaaacgggcaaggcctccatccccttaaaagaacttgaacagttcaatagcgacatacagaaacttctcgaacccctggaggccgagatccaacagggcgtgaatttgaaagaagaagatttcaacaaagacatgaacgaagataatgaaggaacagtcaaagaactcttgcaacggggagataacctccagcagcgcatcaccgatgagcgtaaacgggaagagattaaaatcaagcagcagttgctgcagaccaaacataatgctctgaaagaccttcgctcacagcgaaggaagaaagccttggaaatcagccatcaatggtatcagtacaagcggcaggcagacgacttactaaagtgcctggatgacatagagaagaagctagcctctcttccagaaccacgcgatgaacggaaaatcaaggaaattgatagggaactccaaaaaaaaaaagaggagctgaatgccgtccgacgccaggcagaaggactttctgaagatggtgcagccatggcggtggaaccaactcagattcagctttcaaaacggtggcgtgagatagagagcaagtttgctcagttccgacggctcaactttgctcagatccacacggtgcgcgaggagacaatgatggttatgactgaggacatgccgctggagatatcgtacgttcctagtacataccttaccgagatcacacatgtgtcgcaagctctgctggaagtggagcagctcctgaacgcacctgatctgtgcgccaaagacttcgaggacttattcaagcaagaagagtctttaaaaaatattaaggattccctacagcaatcctctggcagaatcgacataatacactccaagaagaccgctgcactccagtcggcaactcctgtcgaaagggtgaagttgcaggaagccctctctcagttagactttcagtgggaaaaggttaataagatgtacaaagacagacagggcaggttcgacaggagtgttgagaaatggcgacgcttccactatgatattaaaattttcaaccagtggttgactgaagccgaacaatttctgaggaagacacagataccagagaattgggaacacgctaagtacaagtggtacctcaaggagctccaggacggtattggacagcgccagaccgtcgtaaggaccctgaatgccactggggaggagataatccagcagagcagtaagaccgacgcttcaattttgcaggagaaactgggctcccttaacctgagatggcaggaggtctgtaagcagctctcagatagaaaaaagagacttgaggagcagaagaatatacttagcgagtttcaaagggatctgaatgagttcgtcctctggctcgaggaagcagataatatagcctctatccctctcgagcctggcaaagaacagcagctgaaggaaaagctcgaacaggttaagctattagtcgaagagctccccttgagacaagggattctgaagcagctgaatgagactgggggaccggtcctcgtatcagctcctatttcacccgaggagcaggataaactagaaaacaaactgaagcagacaaacctacagtggatcaaggtatccagggcactgcctgagaaacaaggcgagattgaagcccaaatcaaggatctcgggcagctggagaaaaagcttgaagacctggaagagcagctaaatcacttgctgctttggctctcaccaatccggaaccagctggaaatctataaccagcccaaccaggagggaccatttgatgtgaaggagacagagatcgcagtccaagcaaaacagccagacgttgaagagattctatccaagggccagcacctgtacaaggaaaaaccggctactcagcccgttaaacggaagctggaggatttgtcctccgagtggaaggccgtgaacagacttctgcaggaacttcgtgcgaagcagcccgaccttgcgcctggactgacaaccataggcgcatctccgacacagacggtgactctggtgacccaaccggtggttacgaaggaaaccgcaatcagtaagttggagatgccttccagtttgatgctcgaggtcccagcgttagcagattttaatcgggcatggactgaacttactgattggctgtcccttttagaccaggtcattaagtcacagcgagtgatggtgggagatctcgaggacatcaatgagatgatcattaaacagaaggccactatgcaggacctagagcagagacggccacagctggaggagctgatcacggcagcccagaatctgaagaacaagaccagcaaccaggaggctcggacgataattaccgaccggatcgagaggatacaaaaccagtgggacgaagtgcaagaacatctacagaaccgccgacaacagctgaacgaaatgttaaaggattcaactcagtggctcgaggcgaaggaagaagcggaacaggtcctgggtcaagctcgtgccaaactagaaagctggaaagagggaccctatactgtcgacgccatccagaagaaaatcaccgagacgaaacaactggccaaggacctccgtcagtggcaaaccaatgtggatgtcgccaacgatctggccctcaagctgctgagggattattctgctgacgacacccgaaaagtgcacatgataactgagaacatcaacgcatcctggcggtcgattcataagagagtcagcgagagagaagcagcactggaagagacacaccgattgttacagcagttccccctcgatctcgaaaagttccttgcgtggctcacagaggctgagaccaccgccaacgtgctgcaagatgctacaaggaaagagcggctgctggaagatagcaaaggtgtgaaagagctcatgaaacagtggcaggaccttcaaggcgaaatcgaagcacacacagatgtataccacaacttagatgaaaatagccaaaaaattttgagatcgttggaagggagtgacgacgctgtgctccttcagcggagactggacaacatgaattttaagtggtcagagctccgcaaaaaatcactgaacatcaggtctcacttagaggcctctagcgaccagtggaagagattacatctctcactgcaggaattgttagtctggctccaactgaaagacgacgagctctcgaggcaagcaccgattggcggtgatttccccgctgtccagaagcagaacgacgtgcatcgtgccttcaaacgggaattgaagacaaaggagcctgtcattatgtccacgctcgaaactgtgcggatctttctgactgagcagcctctggagggcctggaaaaattgtaccaggagcctagggagttgcctcccgaagaacgcgctcagaatgttacacgcctgctgcgcaaacaggctgaagaggtgaataccgagtgggaaaaactcaacttacatagcgcagattggcagagaaagattgacgagactttagaaagattgcgtgaattgcaagaggcaactgacgaactcgacctgaaacttcgacaagccgaagtcattaaaggatcctggcagccggtgggcgatctactgatagacagtctgcaagatcatctggagaaggtgaaagccttacgcggagaaattgcaccactgaaggagaatgtgtcacacgtgaacgatctcgcacgccaacttacgacattagggatacagcttagcccatacaacctgtccacactcgaagacctgaacacaagatggaaattgcttcaggttgcagtggaggatcgcgtgcgccagctgcacgaggcgcacagagatttcgggccagcctcccagcactttctgtctaccagcgtgcaaggcccatgggagcgcgcaatttcacctaacaaagtgccgtattacatcaatcacgagactcaaactacttgctgggatcatccaaagatgaccgagctgtaccagagccttgcagatcttaataacgtacgcttctccgcgtatagaacagccatgaaacttaggaggcttcagaaggcactttgcctggacttgctgagtctgagcgcagcctgcgacgccctggatcagcataatctaaaacagaacgatcagcctatggatattctgcaaattatcaattgtctgaccaccatttatgatcggctggaacaggagcacaataacctggtgaatgtgcccctctgcgtggatatgtgtctcaattggctcctgaacgtttacgacactggacggacaggccgaatccgagtgcttagctttaagacaggaatcatttctctgtgtaaggcacacttggaagataagtatcgctatctctttaaacaagtcgcctcatccactgggttctgtgaccagaggcgtctggggctgctcctacacgattccatccagatcccacgccagttaggtgaagtcgcctcattcggcggaagcaacattgaacccagcgttcggtcgtgcttccagtttgcaaacaacaaacctgagattgaggctgctctattcttggactggatgcgactcgagccgcagagtatggtctggctgccggtgttacatcgtgtggccgcagcggagaccgctaaacatcaggctaagtgtaacatatgcaaagaatgtccaataataggatttcgataccggtcactgaagcattttaactacgatatctgtcagtcttgctttttcagcggtcgagtcgccaagggacataaaatgcactatccaatggtcgagtattgtactccaactactagcggagaggacgtacgcgactttgctaaagtgctcaagaataagttcaggacaaaacgctatttcgctaaacatccgaggatgggatacctgccggttcagacggtcctggagggtgataacatggagacgcccgtcactctgatcaacttctggccagtcgatagcgccccagcctcgtcgccacaacttagtcatgacgacacccattcgagaatcgagcattacgcatcacgtctggccgaaatggaaaacagtaatggctcgtatctgaatgactcaatctctcctaatgagagtatagatgatgagcatctactgatacagcactactgccagagcctaaaccaggactcccctctatcccagccgcgatctccggctcagatcctgatttccttggagtctgaggagagaggcgagctggaaaggattctggcagacctggaagaggaaaaccgcaacctgcaagcagagtatgacaggctgaaacaacagcatgaacacaagggactttcgcctctgccctcaccgccagagatgatgcccacttctcctcagtcccctcgcgacgctgagctgatcgcagaggcaaagctcttacgtcagcataaggggcgtcttgaagcccgaatgcaaatcctcgaggaccacaataaacagctggagtcacagctgcatagactccgacagctccttgagcaaccccaagccgaggccaaagtgaatgggacgacagtcagttccccctctacatctcttcagcgctccgatagctctcagcctatgctgctgcgcgttgtgggcagtcagaccagcgattccatgggtgaggaagatcttctgtcccctccccaggacacctctacaggcctcgaagaggttatggaacagctgaataatagtttcccttcaagccgcggacgaaatacccccggtaagccgatgagggaggatacaccctaa

SEQ ID NO: 221592 - DNA, 10689 bp, Artificial Sequence
  Description of Artificial Sequence: Synthetic coding sequence
atgaaaaacatcatggcaggcctacagcaaacaaatagtgaaaagatcctgctcagttgggtacgtcaatctacaagaaactacccccaggtgaacgtgattaacttcactacttcctggtcggacggcctggcgttgaacgcactgattcattcgcaccgacctgacctcttcgattggaatagtgtcgtttgccagcagtctgcaacccaacgattggagcatgcttttaacatcgccagatatcagctggggattgagaaactactcgatcccgaggacgtcgacacaacttatcctgataagaaatctattctcatgtatattactagtctcttccaggttctccctcagcaagttagtattgaggctattcaggaggtggaaatgcttccgagaccccctaaggtcacgaaagaagagcatttccagctgcaccaccagatgcactactcacagcagatcaccgtctccctagcccagggctatgagagaacatcatctccaaaaccaagatttaaaagctacgcttatacccaggccgcttatgtgacgacaagcgaccctacccgttccccctttccatcccaacatcttgaagccccagaggacaaaagctttggaagctccctgatggagtctgaagtcaacctcgatagatatcagacggcattagaggaggtcctcagttggctgctttctgccgaagacacactgcaagctcaaggggaaatctctaatgacgtcgaagttgttaaggaccagttccatactcatgagggttatatgatggacctgaccgctcaccagggtcgcgtgggcaatatcctccaattgggctcaaaactcatcggaaccgggaagctgagtgaagacgaggaaaccgaagtgcaggagcagatgaacctgctgaattcaaggtgggagtgtctcagggtggcctccatggagaagcagtccaaccttcatagggttttgatggatcttcagaatcagaaattgaaagagttaaacgactggctgactaaaacggaagaaaggacgcgcaaaatggaggaagaacccctgggtcccgacctggaagatttaaagagacaggtacagcagcataaagtgcttcaggaggacctcgagcaggagcaggttcgagtgaacagtcttactcatatggtggtcgtcgtggacgagtcctccggggatcatgcgacagctgcattagaagagcagctaaaagtgcttggcgaccgctgggctaacatctgccgttggaccgaagatagatgggttctcctgcaggacattctgctcaagtggcagagactgaccgaagaacagtgtctcttctctgcgtggctctccgagaaagaggacgcggtgaacaagattcatacaacgggctttaaggaccaaaacgagatgcttagttcgctgcaaaaactcgcggtgcttaaagcggatctcgagaaaaagaagcagagcatgggcaagctgtactctcttaaacaggatctgctctcgactttgaaaaacaaaagcgttacccagaagacagaagcgtggctcgacaacttcgctcggtgttgggataatctggtgcagaagctagaaaaatcgacggcccagatttcgcaagccgtgacgacgacacagccttctctcacacaaacgaccgtgatggagacagtcactactgtgaccacccgagagcagatcctggtgaagcatgcccaggaagagctgcccccaccgcctccccagaaaaaaaggcagattaccgtggacagcgagatccggaagagactcgatgtggacattaccgagctgcacagttggatcactagatctgaggccgtgttacagtctccggaatttgcaatctttcgaaaagagggtaatttttctgacctgaaggagaaagtgaatgcgattgagcgagaaaaggccgaaaagttccgtaagctacaagacgcttcaagaagcgctcaggctctggtggagcagatggtaaacgagggagttaatgccgactcaatcaagcaagcatcggaacagctgaatagcagatggattgagttctgccagctgctgtcagagcggttgaactggttggaataccaaaataacataatcgctttttataaccaattgcagcagctcgagcaaatgaccaccaccgctgagaattggctcaagattcaaccaactacaccatcagagccaactgccatcaaaagccaactgaaaatctgcaaagacgaagtgaaccgactgagcgacctccagcctcagatagaacggctcaaaatacaaagcatcgccctgaaagaaaagggacagggccctatgtttttagatgcagatttcgtcgcctttacgaaccattttaagcaggtctttagcgatgtgcaggctcgagagaaagaactgcagacaatcttcgacacccttccccctatgcgctaccaggagaccatgtcagccattcggacctgggtgcagcaatccgagacgaagctttcgattccgcagctatctgtcacagactatgagattatggaacagaggttaggggagttgcaggccctgcaaagtagcctccaggagcagcagagcggactgtactatctgagcaccacagtgaaggaaatgtcaaaaaaggcccctagcgagatttcccgcaaatatcagtcagagtttgaggagattgaaggacgctggaagaaactgtctagccagctagtagagcactgccagaaactcgaggagcagatgaacaaactacggaagatccagaaccacattcagacgttgaagaaatggatggctgaagtggatgtgtttctgaaagaggaatggcctgccctgggtgacagtgaaattcttaaaaagcagctgaagcagtgtaggttgcttgtgagtgacatacagacgatccagcccagcctgaactccgtgaacgagggtgggcaaaaaattaaaaacgaggcagagccagaattcgcaagccggctggaaacagagcttaaagagctcaacacccagtgggaccacatgtgccagcaagtctatgccagaaaggaggccctgaagggcggtctggagaagacagtgtctctgcaaaaagatttaagcgagatgcacgaatggatgacacaggctgaggaggaatatttagaacgtgacttcgaatacaagacccccgatgagctgcagaaagccgtagaagaaatgaaacgcgctaaagaggaggcgcagcaaaaggaggccaaggtcaagttgttgacagagtcagtaaacagcgtaatcgctcaggctccaccagtggcgcaggaggcccttaaaaaggagctggagactctgacgacaaactatcagtggctatgtacaaggctgaacgggaagtgtaaaacactcgaggaggtgtgggcctgctggcacgagctgctcagctacctcgaaaaggccaacaagtggctgaacgaagttgagtttaaactcaaaactacagaaaatatcccgggaggcgctgaggaaatctccgaggtgcttgattccctcgaaaacctcatgcgccacagcgaggacaaccccaaccaaattcgcattctggcacaaacactgaccgatggaggggtaatggacgaactgataaatgaagaacttgaaactttcaattcccgatggcgggagctgcatgaagaggcagtaaggaggcagaagctgctggagcagtctatccaatcggcgcaagagaccgagaaaagcttgcacctgatccaggaaagccttaccttcatcgataagcaactagctgcctatattgcggacaaagtcgatgccgctcaaatgccacaagaggcccagaagatacagagcgacctcacctcacatgagatctccctagaggagatgaaaaaacataatcagggcaaggaagccgctcagagagtgttgtcgcaaattgacgtggcacagaaaaaacttcaggatgtgagtatgaaattccggctgtttcagaagcccgctaattttgagcaaaggctgcaggagagcaagatgatcctggatgaagtaaagatgcacttgccagctctcgagacaaaatctgttgagcaggaggtggtgcagtcacagctgaatcactgtgtcaatctctacaagtccctctctgaggtgaagtcagaagtagagatggtcatcaagactggtcggcaaattgtgcagaagaagcaaacagagaatccaaaggaactggacgagcgagtgaccgccctgaaactacactataacgagttaggggctaaggtcaccgagcgaaaacagcagcttgagaagtgcctaaagctcagtagaaagatgcggaaggagatgaacgtcctgaccgagtggttggccgctaccgacatggagcttacgaaaaggagtgctgttgagggcatgcccagtaatctcgactccgaagtcgcctggggtaaagcaacccagaaggaaatagagaagcaaaaagtacatctcaaatcgatcactgaggtgggagaggctctgaagactgtgttgggaaaaaaggaaacactggtggaggataaactctctttactcaattcgaactggattgctgtaacttcacgggcagaagaatggttaaacctgctgttagagtatcaaaagcacatggagacttttgaccagaacgtagaccacatcactaagtggatcatccaggcagatacgctgctcgacgaaagcgaaaagaagaagccccagcagaaggaggacgttctcaagagacttaaggctgaattaaacgacatcagacctaaggtggattcaacgcgagatcaagcagctaatttgatggctaataggggggaccactgccgaaagctggtggagccccaaatctctgagttgaaccatcggttcgcagctatatcccaccgaattaagacaggcaaggcaagtatcccattgaaagagctcgaacaatttaattccgatattcagaaactcctcgagcctctagaggccgaaatccagcagggcgtaaatttgaaagaagaagacttcaacaaggacatgaacgaggataacgaggggaccgtaaaggaactgctccagcggggagacaatctccagcaacggatcactgatgaaaggaaacgggaagaaattaaaataaagcaacagctgctccaaactaaacataacgccctgaaagacctgagatcccagaggcgcaagaaagcattagaaatctctcatcaatggtatcaatataagagacaagcagacgacttactgaagtgcttagatgatattgaaaaaaagcttgcttcactgcccgaaccacgcgacgagagaaagattaaagaaattgaccgcgaactgcagaagaagaaagaggagctgaatgcggtgcggcgacaggctgagggtctgagcgaagatggtgctgcaatggcagtggagccgactcaaattcagctgtccaaacgctggcgggagatcgagtccaaattcgcccagtttagaaggctcaactttgcgcagattcacactgttcgagaggaaacaatgatggtcatgactgaggatatgccgctggaaataagctatgtcccctctacctacctcactgagatcacacatgtgtcacaggccctgcttgaagtggagcagctgctaaatgcaccggatctgtgtgctaaagactttgaggatctgttcaagcaggaagagtctctgaaaaatattaaggattcgttgcagcagtcttccggcaggatcgatatcatccatagcaagaaaacagccgcactgcagtctgccactcccgttgaacgggtgaagctccaggaagccttgtcacagctcgattttcagtgggaaaaagtcaataagatgtataaggaccgtcaggggcgtttcgatcggtctgtggagaagtggcgacgttttcactacgatatcaaaatttttaaccagtggctcaccgaggctgaacagttcctgaggaagacccagattcccgaaaactgggagcatgccaagtataaatggtatctcatcgccttgaaagacggaatcggtcaaagacagacggttgtgagaactctgaatgccacaggtgaggaaattatccagcagagcagcaagacagatgctagcattctgcaggagaagcttgggagtctgaacttgcggtggcaggaggtgtgcaagcaactttccgaccggaagaaacgcttggaggaacagaaaaacattctctctgagtttcagcgggatctgaacgagtttgtgctgtggctcgaggaggccgacaatattgcgtccatccctcttgagcccggaaaagagcagcagttaaaagagaaactggagcaggtcaaactgctggtggaggagttgcccttgagacaaggcatcttgaagcagctgaacgagacaggcggtccggtgttagtgagcgccccaattagtccagaagaacaagacaaactcgaaaataaactcaagcagaccaacctacagtggattaaggtgtctcgagccctcccagagaaacagggggagattgaggctcagatcaaggatcttggccagctggaaaaaaaactggaggatctggaagaacagttgaaccatctcctactgtggctctccccaattaggaatcagctcgagatctataaccaacccaaccaggagggacccttcgacgtcaaggagaccgaaatagcggtgcaagctaaacaacccgatgtggaagagatcctgtcgaaagggcaacacctatacaaagagaagccagccacccagccagtgaagcggaaactcgaagacctgtcgtctgaatggaaagctgtcaaccgtctgttacaagaattgagagctaaacagcctgatttagctccagggttgactaccataggcgcatcgcccacgcaaactgtcacacttgtgacgcagcccgtggtgaccaaagaaaccgcgataagcaagctcgaaatgccttcctctctgatgctggaagtgccagctctcgctgactttaacagagcatggactgaactgaccgactggctgtctctcttggaccaggtgatcaaaagtcaacgcgtgatggtgggagaccttgaggacatcaatgaaatgatcatcaagcaaaaggccaccatgcaagacctcgaacagcggagaccccaattggaagagttgatcaccgcggctcagaacctgaagaacaaaacctctaatcaggaggcgcgaacaatcatcacagacaggattgagcgcattcagaaccagtgggacgaggtgcaagagcatcttcaaaatcggaggcagcagctcaatgaaatgcttaaagattccactcaatggctagaagcaaaagaggaagccgaacaggtgctcgggcaagcaagagccaaattagagtcttggaaagaaggtccttacactgtcgacgccatccagaagaaaattactgagactaagcagctcgcgaaggacctgaggcagtggcagaccaacgtcgacgtagccaacgacttggcattaaagctgctgcgggactactcagccgatgacacgagaaaagttcacatgatcacagagaacattaacgctagttggcgcagtatacataagagagtctccgaaagagaggcagctcttgaggaaacccaccgactgttgcagcagtttccccttgacctcgaaaagtttcttgcatggttgacagaagcggaaacgacggccaatgtgttgcaggacgctactaggaaagagcggttgttggaggatagcaagggtgtaaaggagttgatgaagcagtggcaggacctgcagggggagattgaagcccatacagacgtttatcacaaccttgatgaaaactcgcagaagattctgcgatcactcgaaggatccgatgatgcggtgttgctccagagacgactggacaacatgaatttcaagtggagcgagctgcgcaaaaagtccctgaatatcagaagccatctggaggcgtcatctgatcagtggaaacggctgcatttgtcattgcaggagctgctcgtctggctccagttgaaagatgatgaactgagccgacaagccccaatcgggggagatttccccgctgtccagaagcaaaatgacgttcaccgcgcttttaagcgcgagctgaaaaccaaagagccagtcattatgtcaacactggaaaccgtgagaattttcctgactgaacagccactcgagggactagaaaaactttaccaggaaccacgggaactgccacctgaggagagggctcagaacgtaacacggctgctcagaaagcaggcggaggaggtgaacactgagtgggagaaactgaatttgcattctgcagactggcagagaaagattgacgagaccttggaaagactgcgcgaactgcaggaagctaccgacgaactggacctgaaactgagacaggcagaggttataaagggatcctggcagcccgtcggcgatctgcttattgactcgttgcaggatcacctcgaaaaagtgaaagccctcagaggagaaattgctccactgaaagaaaacgtgagtcacgtcaatgatttggcacgccagctgaccaccctggggatccagttgagcccctataacctttccactctggaagacctcaataccaggtggaagttgctccaggtggcagtcgaagacagggtccgccaactccacgaggcacatagggattttggcccagcctctcagcactttctctccacttccgttcagggaccgtgggagagagccatctcacctaacaaggttccctattatattaaccatgagacacagactacctgttgggaccatccgaagatgactgagttatatcagagcctggctgatcttaacaatgtgcggttcagcgcatatcgcactgccatgaaactccgcaggctgcagaaggcactgtgcctggatctgctctccctgtccgccgcatgcgacgccctcgaccagcacaacctaaagcagaacgatcagcccatggatatcctgcagatcatcaactgtcttaccaccatctacgaccgcttggaacaggagcataacaacctggtcaatgtgcccctctgcgtggacatgtgtttgaactggctgctgaatgtctatgataccggccgtaccggacggatcagggttctttcctttaaaactggaattatctcactttgcaaagcacacctcgaagataaatatcgatacctttttaaacaggttgcttcaagcaccgggttctgcgaccagcggaggctggggctgcttctgcatgatagcatccagatcccccgacagcttggcgaggttgctagcttcggcggtagcaatatcgaaccgtctgtaagatcttgcttccaatttgcgaacaacaaacctgaaatcgaggccgctcttttcctcgactggatgcggttagagccacagagtatggtgtggctccccgtgctgcatcgcgtggctgctgccgagacagccaagcatcaggccaaatgtaacatctgtaaggagtgtcccattattggcttcagataccggtccttgaagcatttcaactatgacatatgccagagttgtttcttcagtggcagggtggcaaagggccacaagatgcattatcccatggtggagtactgcacaccgaccaccagcggtgaagacgtgcgggatttcgctaaggtgctgaaaaataagtttaggacaaaacgctacttcgctaagcatcctagaatggggtatctgccagtccagaccgtattggagggagataacatggagacacctgtcaccctgataaacttttggccagtcgacagcgctcccgcatcttctccgcaactgtcacacgatgacacacactctagaattgagcattacgcatctcgccttgctgaaatggaaaatagcaatggcagctaccttaatgattcaatcagtcctaatgaatcgatcgacgatgagcacctgctaatccaacactactgccaatcactgaaccaggacagccctttaagccagcccaggtcccccgctcagatactaataagcttggaaagcgaggagcggggtgagttggaacgcatcttggccgaccttgaagaagaaaaccgaaatctgcaggctgagtatgatcggctaaaacaacagcacgagcacaagggcctttcccccctcccttctccgccagagatgatgcctacctcaccacaatcccctcgcgatgctgagcttatagctgaagccaagcttctccggcagcacaagggccgactggaggcccgaatgcaaattctggaggaccataataagcaactcgaatcccagctccataggcttagacagctgcttgagcagccccaggccgaggccaaagtcaatggcactactgtgagtagcccaagcactagcctgcagagaagcgatagctcccagcccatgctgctcagagttgtgggcagccagactagtgactccatgggggaggaggacctgttaagtcccccacaggatacttccaccggactggaagaagtcatggagcagttgaataactcctttccgtccagccggggacgcaacactcctggcaaaccgatgagagaggacacaatgtag

SEQ ID NO: 221593 - DNA, 3348 bp, Artificial Sequence
  Description of Artificial Sequence: Synthetic coding sequence
atgccaagcagtttgatgcttgaagtgccagcactggcggacttcaatcgagcctggacggaattaacagattggcttagccttctcgaccaggtgatcaagtcacagagagtgatggtcggcgatttagaagatattaatgagatgataatcaaacaaaaagccaccatgcaggatctggaacagcgacgaccacagttggaggaactcataaccgcagctcagaatctcaagaacaagacgagcaaccaggaggcccgtacaatcattactgaccggatcgaacgcatccagaaccaatgggatgaagtccaggagcatctgcagaatagacgccaacagcttaatgaaatgctgaaagattctacccagtggcttgaagcgaaggaagaagccgagcaggttttggggcaggccagggcgaagctcgagtcctggaaagaaggcccatacaccgttgatgcaatccagaagaaaattaccgaaacaaaacagctcgctaaggacctcagacagtggcaaactaatgtcgatgtggccaacgatctggcccttaagttgctgagagactacagcgccgatgatacaagaaaggtccatatgattaccgagaacattaacgcctcatggcggagtatccacaaaagggtgtctgaaagagaagcagcgctagaggagacacaccgcctgctccagcaattccctctggatctggaaaaatttttggcgtggcttactgaagccgaaaccaccgcaaatgtgctgcaggatgccacgaggaaagaacgcctgcttgaggattcgaagggtgttaaggagttgatgaaacagtggcaggacctacaaggtgagattgaggctcacacagatgtttaccacaacctggacgagaattcgcagaaaattctccggtcgctagaagggagcgatgacgccgtcctgcttcagagaagactggacaatatgaactttaaatggtcagagctgagaaaaaaatcgctcaatattagatcccatctggaagcttcctctgaccagtggaagcgtctgcatctgtcattacaggagctgctggtttggctacagttgaaggacgacgagcttagtaggcaggccccaattgggggagacttcccagcagtgcagaagcagaacgacgtacaccgggcttttaagagggagctgaagaccaaggaaccagtgattatgtctaccttagagacagtcagaatcttcctcacagaacagccacttgagggactcgagaagctataccaggagcctagagagctgccccctgaagagagagctcagaatgttacccgacttctgcgaaagcaggcggaggaggtgaacactgagtgggaaaagctgaacctccactccgccgactggcagcgaaaaattgacgaaacactggaacgtttacgtgagctgcaggaggctacagatgagctggacctgaagctgaggcaggcagaagtgataaagggtagctggcagccagtgggcgatcttctgattgactcactgcaggatcatcttgagaaagtgaaagcactacgcggtgagatcgccccactcaaagagaatgtatctcacgtgaacgacctggctcggcaactgacaacactcgggatacagctatctccctataatctgtctactctcgaagatcttaacacacgttggaagcttctgcaagttgctgtggaagatagagtcaggcagcttcacgaagctcacagggattttgggcctgcctctcagcactttctctcaacatcagtgcaggggccatgggagcgagccattagccctaacaaggtgccctactacataaaccacgaaacgcaaaccacgtgctgggaccacccgaagatgactgagctgtaccagtctctggccgacctgaacaatgtgcgcttctctgcctacagaactgccatgaagctgcggcgtctgcaaaaggccctttgtttagatctactgagtttgagcgctgcttgcgatgccctggatcagcataacctgaagcagaatgaccagcctatggacattctgcaaatcattaattgccttactaccatctatgaccggttagaacaggagcataataacctcgtgaatgtgcccctatgcgtcgacatgtgtcttaattggctgctgaacgtctacgataccggcagaactggcagaattagggtgttgagctttaagaccggcattatttctctatgcaaagctcatcttgaggataagtatcgatatctatttaaacaggtagcttcgtcgactggcttttgtgatcagcgtcgactcggcctcctgctccatgatagtatccagatcccaagacagctcggcgaagtcgcttcattcggcggatccaacatcgagccatctgtgaggtcctgcttccaattcgcgaataacaagcccgagattgaagccgcactctttttagactggatgcgcctggaaccccagtcaatggtatggctgccagtcctccacagggtcgcggctgcagaaacagctaagcaccaggccaaatgcaatatctgcaaagagtgtcccatcattgggtttagatatagaagcctgaaacattttaactacgacatctgccaatcctgcttttttagcggacgggttgcgaagggacataaaatgcattacccaatggtcgagtactgcaccccaaccacgtcaggtgaagatgtcagggactttgcgaaagttctgaagaacaaattccgtaccaaacggtattttgcgaaacacccgcgaatgggttacttgccagtccagactgtgcttgaaggggacaacatggagacgaacttgcaggccgaatatgatcggctgaagcagcagcacgaacacaaagggctgtcacctctcccttcaccacccgagatgatgccaactagcccccagtccccccgagatgcagaactcatcgcagaagccaagctgctgcgccagcataaaggcagactggaggcccgaatgcagattttggaagaccataacaagcaactggagagtcaactgcatagactgcgacagctgctggagcagccgcaagcggaagccaaagttaatggaaccaccgtcagttcgcctagtaccagtctgcagcgctctgacagtagccagcctatgctgctgagagtggttgggtcccagacgtctgacagtatgggagaagaagatcttctgagccctccccaggacacctctactggacttgaagaagtgatggaacagctgaacaactcgttcccatcctccaggggacgcaacactcctggaaaacccatgagagaagacacaatgtag

SEQ ID NO: 221594 - DNA, 11058 bp, Artificial Sequence
  Description of Artificial Sequence: Synthetic coding sequence
atgctgtggtgggaagaggttgaagactgttacgagcgcgaggacgtgcaaaagaagacatttacaaagtgggtgaacgcgcagttctccaagtttggcaagcagcacatagaaaacctatttagcgaccttcaggatggccgtaggctcttagacctgctcgagggactgacaggccaaaagttgccgaaggagaaggggtctaccagggtccacgccctcaacaatgtcaacaaagccttacgagtcttgcagaataataacgtagatttagtcaatatcggttccacagatatcgtggacggaaatcataaattaaccttggggcttatctggaatatcatcctgcactggcaggtgaaaaatgttatgaaaaatataatggctgggctgcagcagacgaatagcgaaaaaatattgttgtcttgggtcaggcaaagcacacggaactacccccaggtgaatgtgattaactttaccaccagttggagtgacggccttgcactgaatgccttgattcactctcacagacctgatctctttgattggaacagtgtggtgtgccagcagtccgccacacagcgcctggaacacgccttcaacattgctaggtatcagttaggaattgagaagctgctggaccccgaggatgtagacacaacctatccagataaaaaatccatcctgatgtacatcactagcctctttcaggtgcttcctcagcaagtatctatagaggccatccaggaggttgaaatgctgcccaggccccctaaagtcactaaggaggaacattttcagctgcaccatcagatgcactattctcagcaaatcactgtctcactagcccagggttatgaacgtacatcatccccaaagcctcggttcaaatcctacgcttacacacaagcagcctacgtgactacgtctgatcctactaggtcaccattcccttctcaacacctcgaggccccagaagacaagtccttcggttcttctctcatggaaagtgaggttaatcttgaccgataccagaccgctcttgaggaagttctgtcctggctgctatcggccgaggacaccctccaggcacagggcgaaataagcaacgacgtggaggtcgtgaaggatcagttccacacacatgagggatacatgatggacctaaccgcccatcagggacgggtcggaaacatcttgcagctgggctctaaactgatcggtacgggaaaattgagcgaagacgaagagaccgaggtgcaggaacagatgaatttgttaaactctcggtgggaatgtctgcgggtcgcatctatggagaaacaaagtaacctgcaccgtgtattgatggatctccagaatcaaaaactgaaagaattgaatgattggcttacaaaaaccgaggagaggacaaggaagatggaagaggaaccactgggtcctgacttggaggacctgaaacgacaggtccagcagcacaaagtgctccaggaggaccttgaacaggaacaagttagagttaattccttgactcatatggtggtcgtggtggatgagtcgtctggcgatcatgctactgccgcattggaggagcaactgaaagtgctcggggaccggtgggctaatatctgtaggtggacggaagataggtgggtcctactccaggacatcttgctgaaatggcagcggctgaccgaggagcagtgtcttttttccgcatggttgtcggagaaggaagatgcggtgaataaaattcatactacaggatttaaggatcagaacgagatgctatcttccctccaaaagcttgctgtcctgaaggctgatctcgagaaaaaaaagcagagcatgggcaagctttactccctcaagcaggatcttctgtctactctcaagaataaatctgtcactcagaaaacagaagcgtggctggacaattttgcacggtgctgggataatcttgtgcagaagctggaaaaaagcacagcgcagatttcacaggccgttaccacgacccagccaagtcttactcagactacagtgatggagactgtgactacagtcacgacacgtgagcagattctggtcaaacacgcacaggaagaactgccccctcctcccccacagaagaagagacagatcaccgtggactctgaaattcgcaaaagactggatgtcgatatcaccgaattacactcctggataaccaggagtgaggccgtgctgcaaagccctgaattcgcgatttttcgtaaggaggggaacttttccgatctcaaagagaaagtgaacgcaatcgagcgggagaaggcagagaaattcagaaagctgcaagatgctagccgcagcgcacaggccctggtggagcagatggtcaacgaaggtgtgaacgccgattctatcaagcaggctagtgagcagctaaacagccggtggatcgaattctgtcagcttctctctgagagattgaactggctcgaatatcagaacaacatcattgcattctataaccaactgcagcagctcgagcagatgaccaccaccgctgagaactggctaaagatccagccaactactccttctgaaccaacagccatcaagtctcagctgaaaatttgtaaggatgaggtgaacaggctgtcagaccttcagccacagatagaaaggctgaaaattcagagcatagctctaaaagagaagggccagggtccgatgttcctcgacgccgatttcgtggccttcactaaccactttaaacaggtatttagcgatgtgcaggctagagagaaagaactacaaactatatttgacaccttgccgcctatgcgctaccaggaaacgatgagcgccatcaggacttgggtgcagcaaagtgaaaccaagctgtcaatcccacaactttcagtgacagactacgagatcatggaacagcgtctcggcgagcttcaggcccttcaatcttccctccaggaacagcagtccggactgtattatttgtcaaccaccgtgaaagagatgagcaagaaggccccttccgagatttcacggaaataccagagcgaattcgaagagatcgaaggaagatggaagaaactcagcagccagctcgtggaacactgccagaagcttgaggagcagatgaacaagcttcggaagattcagaaccatattcaaactctgaaaaaatggatggcagaagtcgatgtcttcctgaaggaagaatggccggctctgggagacagtgaaatcctgaagaaacagctgaagcagtgccgcctgctcgtgagcgatatacagaccatccagccctccctgaactctgtcaacgaaggcggtcaaaaaatcaaaaacgaggccgagccagagttcgcctccagactggagacagagctgaaggaactaaatacccagtgggatcatatgtgtcaacaggtgtacgctaggaaggaagccctaaagggtggcttagaaaagaccgtgagcctccagaaagacctgtcggaaatgcatgagtggatgacacaggcagaggaagagtatctggagcgcgacttcgaatacaagaccccagacgaactccagaaagccgtagaagagatgaagagggcaaaagaggaagctcagcagaaggaagctaaggtgaagttgctaaccgagagcgtgaattccgtgatcgcgcaggcgccaccagtggcgcaggaggccctcaagaaagagctggaaactctgacaacaaactatcaatggctgtgcactcggttaaacggcaaatgtaaaacattagaagaagtctgggcgtgttggcatgagctgctgtcgtacctggagaaggccaataaatggctgaatgaagtggaattcaaactcaagacaactgaaaacatacctggtggggctgaggaaatctctgaagtcctcgatagcctggaaaatctgatgagacatagcgaggacaatcctaaccagatacggatcctggctcaaacattgaccgatggaggcgtcatggatgaactaattaacgaggagctggaaacattcaactccaggtggagggagctgcacgaagaagctgtccgcaggcagaagctgctggagcaatcgatccaatctgcacaggagactgagaaaagtctgcatctgatccaggagagtcttacgtttatcgacaagcagttagcggcatacatagctgataaggtcgatgctgcacagatgccacaagaggcccagaaaatccagtcagatttgacatcccacgagatatctctggaagagatgaagaagcacaatcagggaaaagaagcagctcaaagagtactgagccagatagacgtagcccaaaagaagcttcaggatgtctccatgaagttccgcctgttccagaagcccgcaaactttgaacagcggctccaggaaagcaaaatgattctggatgaggtgaaaatgcatttgcctgctctagagacaaagtccgtggagcaggaagtggtgcaaagccagcttaatcattgtgtgaacctctacaaatctctcagtgaggtcaaatctgaagtcgaaatggtgatcaaaaccggtcgacagatcgtgcaaaaaaaacaaaccgagaatcctaaggaactggacgagcgggtgactgctctgaaactgcactataacgaattgggggcaaaagtaacagagcgcaaacagcagctggaaaaatgcttaaagctgagtcgtaaaatgcgcaaagagatgaatgtcttaaccgaatggctggccgctactgacatggagctgaccaagcgctctgccgtggagggaatgcccagcaacctggactctgaggtggcatgggggaaggctacgcagaaggagattgagaagcagaaggtgcacctcaaaagcattacagaagttggggaagctttaaaaactgtgttaggtaagaaagaaactctagtagaagacaagttgagtctcctcaactctaactggatagctgtgacaagtcgtgcagaggagtggcttaatttattgctggaataccagaagcacatggaaacttttgatcagaatgtggaccatatcaccaagtggattatccaagccgataccctgctggatgagagtgagaagaaaaagccccagcagaaagaggatgtcttgaaacggctcaaggcagagctcaacgatatccggccaaaggtggacagcaccagggaccaggccgcaaacctgatggccaaccggggtgatcactgccgaaagttggttgaaccacaaatatccgagctgaaccatcgcttcgctgccatcagccatagaatcaaaacagggaaggccagtatccctctcaaggaattagagcagtttaacagcgacatccaaaagcttctggaacctctggaagccgagattcagcagggggtgaatctcaaggaggaagatttcaataaggatatgaatgaagataatgagggcacggtgaaggaacttctgcaacgcggagacaaccttcagcagcggatcaccgacgaacgtaaacgggaggaaatcaagatcaagcagcaactgttacagaccaagcataacgcgctgaaagatctccgaagccaacgaaggaaaaaggccttggagatctcacatcagtggtatcagtacaaacgccaagctgatgatctactgaagtgcctagacgacatcgaaaagaagctggcctctttgccggagcctcgggatgaacggaagataaaggagatcgacagagaactgcagaaaaagaaagaagagctgaatgcggtgaggagacaggccgaaggcctctctgaagatggggctgcgatggccgtggaaccaactcaaatccagctatccaaacgttggcgggagatcgaaagcaagttcgctcagtttcggcgactcaatttcgcccagatccatacagtgcgcgaggagacaatgatggtcatgaccgaggacatgcctctagagatctcatacgtgccatcaacttacctgacagagataacacacgtgagccaggctttgctggaggttgagcagcttttaaacgcacctgatctgtgcgcgaaagactttgaggacctcttcaagcaggaggagtccctcaagaatatcaaagactctttgcaacagtcaagcggcaggatagatatcatccactcgaagaaaacagctgcccttcagagcgcgacaccagtggagcgagttaagctgcaggaggccttatcacaactggattttcaatgggagaaagttaataaaatgtacaaggaccggcagggccgattcgaccggtctgttgagaagtggagacgattccactatgatatcaagattttcaaccagtggctgaccgaggccgagcagtttctccgcaagacccaaatccccgagaattgggagcacgccaagtacaaatggtatctcatcgcactgaaagatggtatcgggcagcgacaaaccgtcgtccggactcttaacgcgaccggagaagagattattcaacagtcctctaaaacagacgccagtatacttcaggagaaattgggaagccttaatttgagatggcaggaagtatgcaagcagctgtccgatcggaagaaacggctggaggaacaaaagaacatcttgagtgagttccagcgcgaccttaatgagttcgtgctgtggctagaggaggcagataacatcgcttccatcccattggagccaggcaaagaacagcagcttaaagagaagctggaacaggttaaactgttggtggaggagctgccacttagacagggtatcttaaagcagctgaatgaaactgggggacctgtgcttgtgtccgcccctatctctccagaagaacaggataagttggaaaacaagctcaagcagactaacctccagtggattaaggtgtctagggccctccctgagaagcagggcgagatcgaggcacagatcaaggaccttggtcagctggaaaaaaagctggaagatctggaagagcagctcaatcacttactgttatggcttagccccattcggaaccagttggagatctataaccagccaaaccaggaagggcctttcgatgttaaggaaaccgagattgctgtgcaggcgaaacagcctgatgtggaggagatactgtctaagggccaacacttgtataaggagaagcctgcaacccagccagtcaagcgcaaactggaagatctgagtagcgagtggaaagcagtcaaccgactgcttcaggaacttcgggcaaaacagccggatctggccccaggcctcacaactattggagcaagcccgacacagaccgtgactttagtaacacaacctgtggtgactaaagaaaccgctatctccaagttggaaatgccttcgtctctgatgctcgaggtgccggctctggctgacttcaaccgcgcatggaccgagttaacggattggttatctctgctggaccaggtgattaaaagccagcgagttatggtaggtgacctggaagatatcaacgagatgattataaaacagaaagctacgatgcaggacctggagcagcggcgaccgcagctggaagagctcattaccgcggcacaaaatttgaaaaataagacttctaaccaagaagcgaggactataatcacagaccggattgagcgcattcaaaatcagtgggatgaagtacaagagcacctccaaaacaggaggcagcagctgaacgagatgctaaaggactccacccagtggctcgaggctaaggaagaggcagaacaggtcctggggcaggccagggcaaagctagagtcttggaaagaaggaccatataccgtggacgccattcaaaagaagatcactgaaaccaagcaattggcaaaggatctccggcagtggcagactaatgttgacgtggctaatgacctcgcactcaaactgttgcgagactactccgccgatgacacaaggaaagtacatatgataaccgagaacatcaatgcgtcatggcggagtattcacaagcgagtgtcagaacgcgaggccgcactggaggagacccaccgactcctgcaacagtttcccctcgacctggaaaaattccttgcctggctgacagaggccgaaactacggcgaatgtcctgcaagatgccaccagaaaggaacggctcctggaggatagcaaaggggttaaagaactgatgaagcaatggcaggacctgcagggagagatcgaagctcacacagacgtttaccataacctggatgagaactcccagaaaatcctacgctctctggagggctccgacgacgccgtgttgttgcagcggagactggacaacatgaactttaagtggagcgaacttagaaagaagagccttaatatacgaagccacttagaggcaagctccgatcagtggaaacgccttcacctctctctccaggagctgctggtgtggctccagctgaaggacgatgagctatcacgccaggccccaatcgggggagatttcccagcagtgcagaaacagaacgacgtgcaccgggcatttaaacgagaactgaaaacaaaagagcccgtcatcatgtctactctggaaacggtccggatcttcttgacagaacagccgcttgaaggtcttgaaaagctctatcaggagcctagagagttacccccagaggaacgcgcacagaacgtcacgaggctccttcgtaagcaggctgaggaagtgaacactgagtgggaaaaactaaacctacacagcgccgactggcagcgaaagatcgatgaaacattggagagactacgggaactccaggaagccacggacgagctggacctaaagttacgacaggcggaagtcatcaaaggcagttggcagccagtgggtgacctcctgatcgattctttgcaagaccatctggaaaaggtgaaagctctgagaggtgaaattgccccactgaaggaaaacgtgagccacgtgaatgacttagccaggcagctcacgaccctgggaatacagctgagtccgtataatctgagtacactggaggatctgaacacaaggtggaaactcttacaagtcgccgttgaggatagagtgagacagttgcatgaagcgcaccgagatttcggccctgcaagccagcactttctgtcgactagcgttcaaggcccttgggagagggccatctctcccaataaggtaccgtactacattaaccacgagacccagactacgtgttgggaccatccaaagatgaccgagctctaccagtctctcgctgatttaaataacgtgaggttctccgcatacaggacagccatgaagctgcggcgtctgcagaaagccctttgccttgaccttctgtctttatctgctgcatgcgatgccctcgaccagcacaatttgaagcaaaacgaccagcccatggatattttacaaatcataaactgcctgactaccatctatgatagactggagcaggagcacaacaacctcgttaatgtgcccctatgtgtcgatatgtgcctgaattggctgctgaatgtctatgacacaggaagaacggggcgtattcgggtgttgtccttcaaaaccggaattatatctctctgcaaggcgcacctggaggataagtatcgctacttattcaagcaggtagctagtagtaccggattttgtgaccagagacgtctaggcttgctcctccacgacagcatacaaatccccaggcaactgggggaggtcgcttccttcggcggaagcaatatagagccctcggtaaggtcctgtttccagtttgcgaataacaaaccagagattgaagctgcgctgttcctagattggatgcggctcgaacctcagagtatggtctggttgcctgttcttcacagagtggccgcagctgaaaccgcaaaacaccaggccaagtgtaacatttgcaaggaatgtcccatcatcggcttccggtatagaagcctgaagcattttaattacgacatttgccagtcctgctttttttccggccgtgtggccaagggccacaaaatgcattacccaatggtggagtactgtactccaaccacctctggagaagatgttcgagacttcgccaaagtgcttaagaataaatttaggacgaagcggtactttgccaagcatccccgtatgggctacctgcctgtacagaccgtgctagagggcgataacatggaaactcctgtgactctcataaatttctggccggtcgatagcgcccctgcctccagccctcaattgagccacgatgacacgcacagtaggatcgaacattacgcttctcgcctagccgagatggaaaactctaacgggtcctatctgaacgactccatatcacctaatgagtccattgatgacgaacacctcctgatacagcattactgtcagtctttgaatcaggattcacctctatcacagccgagatctcctgcccaaattcttatttccctggaatctgaagaaagaggagaattggagagaatcctggccgaccttgaagaggagaatcggaatctccaagccgaatatgatcggctgaagcagcagcacgagcacaaggggctgagtcccctgccctcaccacctgaaatgatgcccacctcgccacagtctccccgagatgctgaactgatagccgaagctaagctgctccggcagcacaagggccgtctggaggcacggatgcagatattggaagatcacaataaacaattggagtcacagctccaccgtttaaggcagctgttggagcagcctcaagccgaggccaaagtcaacggtactacggtgagttctccctctacctcactccagcgatcagactcttcccagccaatgttgctgagagtcgtggggagtcagactagtgatagcatgggtgaggaggacttattgagcccgccacaggacacgtccaccggcctcgaagaagtgatggagcagctgaataactctttcccttcgtctcgcggtaggaatactcccggaaagccaatgagggaggacactatgtaa

SEQ ID NO: 221595 - DNA, 2874 bp, Artificial Sequence
  Description of Artificial Sequence: Synthetic coding sequence
atgcagccaatggttatgcaggggtgtccctacaccctcccgagatgtcacgactggcaggctgcggaccaattccaccattccagctcactgagatccacgtgtcctcatccacaggtacgtgctgctgtcacgtctccggcaccccctcaggacggggcaggagttccgtgtctctccctcaagctcttaaacgggtccgtgggagccagtggccctttggaacccccagccatgaacctgtgctggaacgagatcaaaaagaaatcccacaatctgagggctcgcctggaggcattcagcgatcactcgggaaagctgcagcttccacttcaggaaattatcgattggctctctcaaaaggacgaagagctttccgcgcaattgccgttgcagggcgatgtcgctctagtgcagcaggagaaggagacacatgccgcatttatggaagaggtgaaatccagagggccatacatttattccgtcttggagtcagcacaggcttttctgagtcagcatccatttgaagaacttgaggaacctcatagtgaatcaaaagatacctctcctaaacagaggatccagaatctttcgcggtttgtgtggaagcaggccaccgtggcatcagagctgtgggaaaagctgaccgcacggtgtgttgaccagcacaggcacatagaacggacactggagcagctactcgaaatccagggggcaatggaggagctgagcactaccctcagccaggcagagggggtgagggcaacgtgggaacctattggcgatctgttcatagacagtctgcccgagcacatacaggctatcaaactcttcaaagaggaattttcccccatgaaggacggcgtgaagctggtgaatgatctggcgcaccaattagcgattagcgacgtacatctcagcatggagaactcgcaggccctagaacagatcaacgttaggtggaagcagcttcaggcctcggtgtcagaacggctcaaacagctgcaggatgcccatcgcgatttcggacctgggagccagcacttcctttcgtctagcgtgcaggttccctgggaaagggcgatctcccccaacaaggtgccctactacatcaatcaccaagctcagacaacctgttgggaccatccgaaaatgacagagctttatcaaactttggccgatctaaataacatcaaatttagcgcttacaggactgctatgaaacttagaagagtgcagaaggctttaaggctggatctcgtgaccctgacaacagctctcgagatctttaacgagcacgacctgcaggcaagcgagcatgtgatggatgtagttgaagttattcactgcctaaccgccctttatgagaggttggaagaggaaagaggaatcctcgtcaacgtgcctctgtgcgttgacatgagccttaattggctgctcaacgtttttgactccggcagatctggcaaaatgcgcgcactttcctttaagacagggatagcctgcctctgcgggacagaggttaaggagaaattgcagtatctgttctcccaggtcgctaactccggctctcagtgcgaccaacgccacctcggcgttcttctacacgaggccattcaggtacctcgacaactcggtgaggtagccgcatttgggggttccaacgtggagccatccgtgcgatcctgctttagattctccacagggaaaccagttatagaggcatcacagtttctggaatgggttaatcttgagccccaatcaatggtttggctagccgtgttgcatcgcgttactattgccgaacaagtgaagcaccagacaaaatgttccatttgccgccagtgtcccattaaaggatttcgctaccggagcctaaagcagtttaatgtggacatctgtcaaacctgcttcctgacgggaagggcctcaaagggtaataagctacactaccccataatggagtattatacccctaccaccagttccgagaatatgcgcgacttcgcaaccactcttaaaaacaagttcagatcaaaacattacttctcaaaacatccacagcggggttaccttcccgtgcagtccgttctcgaagcggactactccgagacacccgcttcatctccaatgtggcctcacgccgacacccatagtaggatagagcatttcgccagcagactggccgaaatggaatcgcagaattgcagcttctttaatgattctctgtcccccgacgattccatcgatgaggatcagtatctactgagacattcttcacccatcaccgatcgggaacctgccttcggtcagcaggccccatgttccgtggccacggaatctaaaggcgagctccagaaaatcctggcacatcttgaagacgaaaaccgcatccttcaaggagaactgcgcaggttgaaatggcaacacgaggaggcagccgaagctcccagtctggccgatgggtctaccgaggccgctaccgaccaccgtaacgaggagctactggctgaggcccgaatcttacgtcaacacaagtctagactcgagacaaggatgcagatcctcgaggatcataacaagcagttagaatcacaactccagagactgcgagagctgttgctgcaacctccaacagagtcggacgggagcggtagcgccggttcaagcttggcaagtagcccacagcagtcagaaggttctcatcccagggagaagggtcaaactacgcccgatacggaggccgctgatgatgtcgggtctaagagccaagacgtgagcctctgcctggaggatatcatggagaaactgcgccacgcctttccttctgttaggagttccgacgtgacggcgaatacactgttggccagctag

SEQ ID NO: 221596 - DNA, 2874 bp, Artificial Sequence
  Description of Artificial Sequence: Synthetic coding sequence
atgcagccaatggttatgcaggggtgcccctataccctgccgaggtgccatgactggcaggcagccgatcagttccatcactcatcctccttgaggagcacatgcccccacccccaggtgagggcggctgtgacctcacctgctccgcctcaggacggcgcaggagtaccgtgtctatcactaaaactacttaacgggtctgttggcgcatctgggcctcttgaaccacctgcaatgaacctgtgttggaatgaaattaagaaaaagagccacaacctaagagctcgcctcgaagctttcagcgatcatagcgggaagttacagctcccactgcaggagattattgattggttatcccagaaagatgaggaactgagtgcacagttgccactgcagggggatgtcgccctggtgcagcaggagaaagaaactcacgccgctttcatggaggaggtgaaatcaagaggaccttacatatattcagttttggagtccgcacaggcattcttgtcccagcaccctttcgaagagttagaagagcctcacagtgaatcaaaagatacttctcccaaacagcgcatccaaaacctatcgcgtttcgtctggaagcaggctaccgttgccagcgagctgtgggagaaactcaccgcacggtgtgtcgaccagcatagacatatcgaacgcacactagaacagctcctggagatccagggcgcaatggaagagctgtcgactacactgtcacaggctgagggagtgcgggctacctgggaacctatcggcgatctctttattgattccctccctgaacatatccaagctatcaagctgtttaaggaagagttcagtcccatgaaggacggggtgaagctcgtcaatgacctggctcatcagcttgctatctctgacgttcatctaagcatggaaaacagccaggcactggagcagataaatgtgcgctggaagcaactgcaagctagcgtatctgaacggctaaagcagctgcaggacgcccatagggacttcggccctggctcacaacatttcctgagctcaagcgtccaagtgccatgggaacgcgcaatcagcccaaataaagtaccgtattatatcaatcaccaggcacaaacaacctgttgggaccaccccaagatgacagagctctaccagaccctggctgacctgaacaacatcaagttctctgcttatcgaaccgccatgaagctaagaagggtccaaaaggctctgagattggacctggtaactctaacaactgcccttgagatcttcaacgagcacgacttgcaagctagtgaacacgtcatggacgttgtcgaggtgatccattgccttacagcactttacgagcgcctggaggaagagcggggtattttggtgaatgtcccactgtgcgtcgatatgtccctcaactggctcttgaatgtgttcgattccgggagatctggtaagatgagagccctgtcgttcaagactgggatcgcttgtctgtgcggcacggaggttaaggagaagctacaatatctgttcagtcaagtggccaactcgggcagtcagtgcgatcagcgacacctgggtgtgctgcttcatgaggccattcaggtccctcggcagttgggggaggtggccgcatttggcggtagtaacgtggaaccctctgtacggtcctgcttccgattctccacagggaagcctgtgatcgaggccagtcaatttctggagtgggttaaccttgaaccacaatctatggtctggctggcagtactgcatcgagtgaccatagccgagcaagttaagcaccagaccaaatgctctatttgtcggcagtgccccatcaaaggtttccggtataggagcctcaagcaattcaacgtcgacatttgccagacctgctttctgaccggcagagcatcaaagggtaataaattacattatccgattatggagtactacacacccaccacaagtagcgaaaacatgagagatttcgcaaccacactcaaaaacaagttccgtagcaagcactatttcagcaagcacccacagcgcggatatctccccgtgcagagcgtcttagaggccgactacagcgagacacccgcttcctccccaatgtggccacacgccgatacccacagtagaatcgagcactttgctagccggctcgctgagatggaatcacagaactgttccttctttaatgatagcctttctccggacgacagcatcgacgaagatcagtatctgctccggcacagtagcccaatcacagatagggagccagcattcggacagcaggcaccttgcagcgtggctaccgagagcaagggagagttgcagaaaatcctggcccacctggaagacgaaaatcgcatactgcagggtgagctcagacgacttaagtggcagcacgaggaagccgctgaggcaccttcccttgcagacggctccaccgaggccgctaccgatcatcggaacgaggaattgttagccgaggccagaattctccgccagcacaagtcgcgcttagagacgcgaatgcagatactcgaggaccataacaaacagttagaatctcagctccagcggctgagggagcttctgcttcagcccccaacagagtctgacggctctggcagtgccggaagcagcctggcttccagcccgcagcagtctgagggttctcatcccagagaaaagggtcagacaacacctgacacggaagccgctgacgacgtcggctcgaagtcacaggacgtctctctctgcttggaggacatcatggagaaactacggcatgcttttccatccgtacgaagtagcgacgtgaccgctaataccttgctggcaagctag

SEQ ID NO: 221597 - DNA, 2874 bp, Artificial Sequence
  Description of Artificial Sequence: Synthetic coding sequence
atgcagccaatggtcatgcagggatgtccctacacactgccccgttgccacgactggcaggcagccgatcagttccatcacagctcctcgcttcggtccacctgtccccatccccaggtgcgggcagcagtgacaagtcccgctccaccccaggacggcgctggcgtgccctgcctgtcactgaagctgctgaacggctctgtgggtgcgtctggacctttagagcctccagccatgaacttatgctggaacgaaatcaagaagaaatcgcacaacctaagagcaagactggaggctttctccgatcattcaggcaagttgcaactgccactgcaggaaatcatcgattggttaagccagaaagacgaagaactgagcgcacagttgccactccagggagacgtggccctggtgcagcaagaaaaagagacgcacgcagcatttatggaagaggtaaagagtagaggaccttacatatacagtgtgttagagagcgcacaggcattcttgagccagcatccctttgaggagctggaggaaccgcattctgagagtaaggatacatccccaaagcagaggatccagaacctatctagatttgtgtggaaacaggccaccgtggcctcagaactttgggagaagctcacagcccgatgtgttgaccaacatcgtcatattgaacgaaccctagagcaattgctggaaatacagggcgcaatggaagagcttagtaccactctctcccaagccgaaggggtccgtgcaacctgggaacccataggggacctctttatcgactcattgcctgagcatatccaagctattaagctgtttaaggaggaattcagcccaatgaaggacggcgttaaactggtcaacgatctcgctcatcagctggctatctccgacgttcatctatccatggaaaattctcaagccctcgaacagattaatgtgcggtggaaacagctccaagcgtcagtatctgagcggcttaaacagttgcaggatgcacaccgcgatttcggtccaggatcccagcatttcctctcctcaagcgtacaggtgccgtgggagagggcaattagccccaacaaggtaccttactatatcaaccatcaagctcaaacaacatgctgggatcatccaaaaatgaccgagctctatcagacattagccgacctgaacaacatcaaattctcggcataccgaacagccatgaagctgcgaagagtgcaaaaggccctccgtctggatctagtgacccttactaccgctcttgaaatattcaatgagcatgatttgcaggcaagcgaacacgtgatggacgtggtggaggtgattcactgcttgaccgccttatatgaaagacttgaagaggaaaggggcatcctggtgaatgtcccactgtgcgtagacatgtccctgaattggcttttgaatgttttcgactcaggacggtccggtaagatgcgggctctgtcctttaaaaccggaattgcctgtttatgcggcacagaggtaaaggagaaactccagtacctgtttagccaggtggccaacagcgggtctcagtgtgatcagagacacctgggtgtgttgttacacgaagccattcaggttcccagacaactgggcgaagtagccgctttcggcggtagtaacgtggaaccatctgtccggtcctgcttccgattctctaccggcaaaccagtaattgaggcctcccaattcctggagtgggtgaacctggagccacagtcgatggtttggcttgccgtgttgcaccgggtgacaatagccgaacaggtgaagcatcagacaaaatgtagtatctgtaggcagtgcccaattaagggtttccgttaccgtagcctcaaacagttcaatgttgacatctgtcagacttgctttctgacaggcagagcttccaaaggaaataaacttcactatccaatcatggagtactatacccccacaacttcttcagagaatatgagggattttgccacgaccctgaagaataagttcaggagcaaacattacttttccaagcacccacagcgtgggtatctgccagtgcagtctgtgctagaggccgactactcagaaacgcctgcttcatcacctatgtggccgcatgctgacacccactcccggatagagcattttgccagcagactagctgagatggagagtcagaattgtagtttctttaatgattcactgagccctgatgactccatcgacgaggaccagtacctgttaaggcactccagtcctattaccgacagagaacctgcttttggacagcaggcaccctgttctgtggctactgaatccaaaggcgagctacagaagattctggcacatctcgaggacgaaaataggattttacagggcgaactgagacggctgaaatggcagcacgaggaggccgcagaggccccttcattagcagacggctctaccgaggcggcaaccgatcaccgaaatgaggagctcttggccgaggccaggatccttagacaacataagagcaggctggagacccgtatgcagatacttgaggatcacaataagcagctggagtcccagttgcagcgcctgcgcgagctacttttgcaaccgcctaccgagtccgacggctctggttccgccggatcttctctggctagttccccacagcagagtgaaggttcacatccacgagaaaagggtcaaactactcccgatactgaagccgctgatgatgttggctcaaaatctcaagacgtttccctctgcctggaagacatcatggaaaaacttaggcacgcgttccccagtgtccgtagtagcgacgtgactgccaacaccctccttgcctcatag

SEQ ID NO: 221598 - DNA, 2640 bp, Artificial Sequence
  Description of Artificial Sequence: Synthetic coding sequence
atgaatctgtgttggaatgaaatcaagaaaaagagtcataacctccgcgctaggctggaggccttttctgatcattccggaaaattgcagcttcccctacaagagattatcgactggctgtctcagaaggacgaagaactgagtgcgcagctacccctccagggagatgtggccctcgttcagcaggagaaagagacccatgccgcatttatggaagaggtgaaatcacggggtccctatatttattctgtactggagtccgcccaggcatttttgtcccaacaccccttcgaagaactggaagagccccatagtgaatctaaggataccagccctaagcagagaattcagaacctcagccgctttgtgtggaaacaggcgacagtagcatctgagctgtgggagaaactcacagcccgatgtgtggaccagcacaggcacattgagaggaccctggagcagctcctcgagatccagggagccatggaggagctctccactacgctaagccaagccgagggggtccgggcaacttgggaaccaatcggagacctattcattgacagcctacccgagcacattcaggctataaagctgttcaaggaagagttttcacctatgaaggatggcgtcaaactggtcaatgatttagcccaccagctggccatctcggatgtgcaccttagcatggagaattctcaggcccttgaacagattaacgtccggtggaagcagctccaggcatcagtcagtgagcggctcaagcaattgcaggacgctcacagggattttggacccggaagtcagcacttcctgagctccagcgtacaggtgccgtgggagagggccatatcaccaaacaaggtgccgtactacatcaaccatcaagctcagactacatgctgggatcatcccaaaatgacagagttgtaccagaccctggcggatctcaataatattaagttttccgcatacagaaccgctatgaaactgcggagagtgcaaaaggccctgcgccttgatctggtgactttgacgaccgctctggaaatcttcaatgaacacgatttacaggcgagcgagcatgtcatggacgtcgttgaagttatccactgtctgacggctctctatgaacggcttgaagaggaaagagggatcctggtgaacgtgccactgtgcgttgacatgagcctgaactggctgttgaacgtctttgattctggccgtagcggcaagatgcgggcactcagcttcaaaactggaatagcctgtctatgcgggacagaggtgaaggaaaagctgcagtacctcttttctcaggtggctaacagcggaagccagtgtgaccaaaggcacctcggggtactgctgcatgaagcaatccaggttcccaggcaattaggcgaagtggccgctttcgggggaagcaacgtggagccgtctgtacgtagctgcttccgtttctccactggcaagcctgtgattgaagcatctcagtttctggagtgggtgaatctagaaccgcagtccatggtatggttggctgtgctccatagggtgaccattgccgaacaagtgaaacaccagaccaaatgtagcatttgccggcaatgcccaattaaagggttccgatataggtctcttaagcagtttaatgtcgacatctgccagacctgttttctgaccgggagggcatccaaaggaaacaaactgcactacccaataatggaatactataccccaacgacaagtagtgagaatatgcgcgacttcgcaacaactcttaagaacaaattccgcagcaagcactatttcagcaagcacccccagagaggatatctgccggtgcaaagtgtgctcgaggccgactattccgagacacctgcgtcctctccaatgtggcctcacgccgatactcactccaggatcgagcattttgcatcaagactcgcggagatggagagccagaactgctctttcttcaatgactcccttagccccgacgattcaatcgatgaggatcaatatcttctgcggcacagtagtccaataacagaccgagagcctgccttcggtcagcaggcgccttgttcggttgccaccgagagtaagggggagctgcagaaaatactggcccacctcgaagatgaaaataggatcttgcagggggagctgcgtaggctgaaatggcaacacgaggaggctgctgaagcaccatctctggcagacggtagtaccgaggccgcaaccgaccatcgcaacgaggaactgttagccgaggccagaattctgaggcaacacaaatcgagattagagactaggatgcagatcctggaggatcacaacaaacagttggagtctcaactgcagcggctaagagagctattgctgcagccacccactgaatccgatggatcagggagcgccggatcgtcactcgcatcttctccacagcagtctgagggttcacaccccagagaaaaaggccaaactactcccgacactgaggccgcagacgacgttggctctaagtcccaggacgtaagcctctgtctggaggatattatggaaaagctgagacacgcttttccgtcagtgagatcctctgacgttacagccaacacattgctggcgagctag

SEQ ID NO: 221599 - DNA, 9128 bp, Artificial Sequence
  Description of Artificial Sequence: Synthetic coding sequence
atgcaccatgggaccggtcctcaaaacgtgcagcatcaactccagcgatctagggcttgccctgggtctgaaggtgaggagcagcccgcacatccaaacccgcctcctagtccagccgcacccttcgccccatccgccagcccatctgctccccagagccccagctaccagatccagcagttaatgaacaggtctccagcgacagggcagaacgtcaacattacattacagagcgtggggccagtagtggggggtaaccagcagataacactggccccactgcccctcccttcccccacatccccgggtttccaattttctgctcaacctagacgattcgagcatggaagcccaagttacatacaggtcactagccccctgagccagcaggtgcagacacagtcgccaactcagcctagccctgggcctggccaagccctacagaacgtgcgggctggggcaccaggtcccggtctcgggctatgttcctccagccctacaggcggtttcgttgacgccagcgtgctagtgagacagattagcttaagcccgtccagtggagggcacttcgtgttccaggatggctccggtctaacacaaatcgcccagggggcacaggtacaactgcagcaccccggaacacctataactgtgcgcgaacgtcggccaagccagccccacactcagtctggaggcactatacatcacctggggccacagtcacctgccgcagcaggaggcgcagggctccaaccgctggcatccccatcccacatcaccactgctaacttaccccctcagatctctagcattattcagggccagctggtgcagcagcagcaggtgctgcagggccctccactgcctcggcctttagggttcgaaaggacacccggtgtgttgctgccaggcgctggtggagctgctggctttggaatgacaagcccaccgcctcctacttccccaagcaggaccgctgtacccccaggcttatcatccttgccattaacgagtgtagggaatacaggaatgaaaaaggtccccaaaaaactcgaagagatccccccagcttccccggaaatggcacagatgcggaaacaatgcctggattaccactatcaggagatgcaggctttaaaggaagttttcaaagagtacctcattgaattgttttttctacaacactttcaggggaacatgatggactttctggccttcaaaaaaaagcattatgcccctctccaagcttacctgagacaaaatgacctggacatcgaggaagaagaggaggaggaagaggaggaagaggagaagagtgaagtcatcaacgatgagcaacaggcactagctgggagccttgtcgccggtgccggatcaacagttgagactgatctgttcaagcggcagcaagccatgccatcaacgggcatggccgaacagagtaaacggcctcggctggaagtgggccaccagggggtggtatttcagcaccccggagcggacgcaggagtgcctttacaacagttgatgcctacggcccagggcggaatgccgcctacaccccaggccgctcagctcgctggccagcggcagtcccagcagcagtatgatccctctacaggcccacccgtgcaaaatgcagccagtctgcacaccccgttgccacagctgcccggaaggctcccccctgcaggagtgcccaccgcagctctgagctccgccctgcagtttgctcagcagccacaggttgtggaggcccaaactcaattgcagatccctgtgaaaacacagcaaccaaacgtgccaattcctgcaccgccttcatcccagctgcctatccctcccagccagcccgctcagctggcgctgcacgtccccaccccaggtaaggtccaagtccaagcttctcagttaagcagtttaccacagatggtcgcctccactagacttcctgtggacccagcacccccttgtcctaggcccttgcccactagctccactagtagtttggcaccagtctccgggtctggcccagggccttctccagccaggtctagtcccgttaaccggcctagctcagctactaacaaggccctttcacccgtcacttcccggacccctggcgtggtcgcctctgcccctactaaaccccagtcacccgcacagaatgccacctcctctcaggatagctcccaggacactctgactgaacagataactttggagaatcaggtgcatcaacggattgcagaactgcggaaagccggactttggagtcagcgtcggctgccaaagcttcaagaggcccctagacccaagtcacattgggactatctcctagaagagatgcagtggatggctaccgactttgctcaggaaagacgctggaaggtcgccgcagcaaagaaactagtcagaacagtggtccgacatcatgaggaaaaacagctcagggaggagagaggtaagaaggaggagcagagtcgcctgaggcgcatagccgcaagtactgcacgggagattgaatgcttctggtctaacatcgagcaagtggtagaaatcaagctgcgcgtggagctggaggaaaagaggaaaaaagccttgaacttgcagaaagtttctaggcgtgggaaggagcttcggcctaaaggcttcgacgctctccaggaaagttccctggactccgggatgtccggtagaaagagaaaagcgtcaatttccctcaccgatgatgaggtggatgacgaagaggagacaatagaagaggaggaggccaacgaaggtgtggtagatcaccaaactgagctgagtaacttagctaaagaggccgagctccccctgctggacctcatgaagctctatgagggtgcctttctgccttccagtcaatggcccaggccaaagcctgatggggaagacacgagcggtgaggaggatgctgatgattgtccaggagacagggagtcaaggaaagatttagtgctgatcgactccctgttcattatggaccagtttaaagccgctgagcggatgaatattgggaagcccaacgctaaggatattgcagacgtcaccgcagttgcagaagcgatcctgcccaagggcagcgctcgggtgacaacctcagttaaatttaacgctccatcactgctatacggcgcactgagagattaccagaaaattggtctggactggctggcaaagctctatagaaagaacctaaacggaatcctggcagatgaggctggtctgggaaaaacggtgcagattatcgcattcttcgcccacctcgcgtgcaatgaggggaattgggggccacacctggtggtggtcaggtcctgtaacatactcaagtgggagctggagttgaaaagatggtgtccgggtttaaagatcctctcatatatcggtagtcaccgtgagttgaaggcaaagagacaggaatgggccgaaccgaatagctttcatgtctgtatcactagctacacgcagttctttagaggcctaacagcgtttacaagggtgagatggaagtgtctggtcatagacgaaatgcagagagtgaagggaatgaccgaacgccactgggaggcagtcttcacccttcagtcacaacagaggctgctcctgatcgattctcctttacacaatacattcctggagctgtggactatggtgcatttcttggtgcctggtatctccagaccatacttgagcagcccattacgagcccctagcgaagagagccaagactactaccacaaggtggttattagactgcaccgcgtgacacagccatttattcttagaaggactaaaagggacgtggagaagcaactcaccaaaaagtatgaacatgttctcaaatgtcggctctctaacaggcagaaagcgctgtatgaagatgtcatcttgcaacctggtactcaagaggcgctgaagagtgggcatttcgtcaatgtgctgagtatcctcgttcgtctgcagaggatttgtaaccaccctggcctcgtggaacccagacatcctggaagttcgtatgtggctgggcctctggagtatcccagtgccagcctgatattgaaagccttggagagagatttctggaaggaggcggacctgagcatgttcgaccttataggcttagaaaataaaattaccagacatgaggccgagttgctgagcaagaaaaagatcccacgaaagcttatggaggaaataagcactagtgccgctccagctgcccgacctgctgcagccaagctcaaagcctcaagactcttccaacctgtacaatacggacagaaaccagaaggtcgaactgtcgcctttcccagtacacatccccctcggactgctgccccaaccactgcgtccgccgctccccagggcccattgcgaggcagaccacccattgccaccttttcagcaaaccccgaagctaaaggaggcgaagtcgtgaagatagctcagctggcctcaataaccggtcctcagtcccgagtggctcagccagagactccagttaccctgcaattccaaggctccaaattcacgctcagccactctcagctgcgtcaattgacagccggacagccactgcagctgcaggggagcgtgcttcagatcgtgtctgctccagggcagccttatctgagagcaccaggaccagtagtgatgcagactgtctctcaggcgggagccgtgcacggcgcattgggcagcaaacctccagccggaggacccagtcccgctcctctgacaccacaggtgggtgttcccggtcgcgtcgccgtcaatgcactggcggtcggtgaaccaggcaccgcgagcaaaccagcatcccccattggtggacccacacaggaggaaaagacacgactgctgaaagaacgactggatcagatataccttgtcaacgaaagacgttgctcccaggctccagtgtatggaagagatctgctgagaatatgcgctttacctagccacggaagggtgcagtggagaggttctctggatgggaggagaggcaaagaagcgggtccagcccattcctacacgagtagttcggaatccccctccgaattgatgcttaccctgtgtcgatgcggagagtctttgcaagatgtgattgatagggtggcctttgtgataccccctgtggtagccgctccaccttcactccgggtgccccgaccacccccactgtactcacaccgcatgagaatactgcgccaggggttgagggagcacgccgctccgtacttccaacagttgcgccagactaccgctccgagactcttgcagttccccgagctgcggctcgtgcagttcgactctggcaaattggaggcgctggctatcctcctacaaaagcttaagagcgagggacgtagggttctcatcctcagtcagatgatcctaatgctcgatatcctggagatgtttcttaatttccactacttaacctacgtgcgcatagacgagaacgctagttcggaacagagacaggaactgatgaggagttttaaccgtgatcgcagaatcttctgtgctatcctgagtacgcactcccgaacaacagggatcaacctcgtcgaggccgatacagtcgttttttacgataatgacttgaatccagttatggacgcgaaggcgcaagagtggtgcgaccggatagggaggtgtaaggatattcatatctatcgcttagtcagcggaaattcaatcgaggaaaagctgctgaaaaatgggaccaaggatctgattcgggaagtggctgcacagggcaatgattactcaatggcttttctgacccagcgtactattcaggaactcttcgaggtttacagccccatggacgatgccggattccccgtgaaggcagaagagtttgtggtactgtctcaggagccgtcagttactgaaaccatcgctcctaaaatagccagaccgttcattgaagctctcaaatctatcgagtatctggaagaggatgcacagaaaagtgcccaggaaggagtgttgggacctcacactgacgctcttagctctgatagcgagaatatgccatgtgacgaggagcccagtcagttggaagagctggccgacttcatggaacagctgaccccaattgagaaatatgcactgaattatctggagcttttccatacaagtattgaacaagaaaaggaacggaatagtgaggacgcagtgatgaccgctgtacgcgcttgggagttctggaatttgaaaacattacaagaaagagaggctaggctgcggcttgagcaggaggaagccgagttactcacttatacccgagaggatgcatacagtatggaatacgtgtacgaagacgtcgacgggcagacagaagtcatgcccctgtggacacccccaaccccaccccaagacgacagcgacatttatctagattcagtaatgtgcctgatgtatgaggccaccccaattcctgaggccaagctgcccccagtctacgtgaggaaggagcggaagcggcacaaaactgacccgtccgcggcaggtcgcaagaagaaacaaagacacggagaagctgtggtgccacccagatccttattcgatagggctacgccagggcttctgaaaattcgtagggagggcaaggaacagaagaagaatattttgctgaaacagcaggtgccattcgccaaacccttgcctaccttcgctaagcccacggccgaaccaggtcaagataatccggaatggttgatctctgaagattgggctctcctgcaagccgtgaagcagcttctggagcttcccctcaacctgacgattgttagtcctgcccacacccccaactgggatctcgttagcgacgtggtcaattcatgcagccgtatttataggagcagtaaacagtgccgcaacaggtacgagaatgtgattattcctcgggaagagggtaagtccaaaaataacaggccccttcgaacctcacaaatttacgcccaagatgagaatgctactcacacacagctttacacaagtcacttcgatctgatgaagatgacagctggcaaacggagtccaccaatcaagcccctgctgggcatgaatccttttcagaagaacccaaagcacgctagcgtccttgcagaatccgggatcaattatgataagccattgcctccaattcaggtagcctctttgcgagcagagcgtatcgccaaagaaaagaaagctctggccgatcagcagaaggctcaacagcctgcagtcgcacagccccctccgcctcagccccagccacctccccctccccagcagcccccaccacctcttccacaaccacaggctgcgggttctcaaccaccggcaggaccccctgcggtccagccgcagccacagccccaacctcaaacacagccccaacccgttcaagcgcctgcgaaagctcaacctgctatcaccacgggtggttccgcagcagtcttggcgggaaccataaagacttccgtcactggcacctccatgccgactggggctgtgagcggcaatgtcatcgtgaatacaattgccggtgtgcccgctgcaacttttcagtccattaacaaacgactggcaagccccgtggcaccgggtgcccttactactccaggcggttccgcacctgcccaggtcgtacacacccagcccccaccccgtgccgtgggaagccccgctaccgccaccccggaccttgtttccatggccactactcagggcgtgcgcgcagtcacctctgtaaccgcaagtgctgttgtgacgaccaatctcacaccagtccagactccagctcgttcactcgtcccacaggtgtcacaggctacaggggtgcagcttcccggaaaaaccattactccagcacattttcagctcctgcgacagcaacagcagcagcagcagcagcagcagcagcagcaacagcagcagcagcagcagcagcagcagcagcagcagcagcagcagcaaaccactaccacaagccaagttcaagttccgcaaatacagggccaggcgcagagcccagctcagattaaggccgtcggcaagcttacaccagaacacttaattaaaatgcagaaacagaagctgcaaatgcctcctcaacctcctccccctcaggcccagagcgctcccccacagccaacagcccaggttcaggtgcagacttctcaaccccctcagcagcagagcccccagttaaccaccgtaaccgccccaaggcctggggctttgctgaccgggacaactgtcgcgaacctgcaggtcgctaggctgacacgtgtccctaccagtcaactgcaggcgcaagggcagatgcagacccaagctccacaacctgctcaggtcgctctggctaagccgcctgtggtttcggtcccagcagcggtggtctcctcacctggtgtaacgactctcccgatgaacgtggcgggtatatcagtagccatcgggcagccacaaaaggctgccggtcagaccgtggtcgctcagccagtgcacatgcaacagctgttaaagctcaaacagcaggccgtacagcagcagaaagccatccagcctcaggctgcccagggaccggctgccgtccaacagaagatcacagcacagcaaataacaacccccggagctcagcagaaagtggcgtatgctgctcagccagcgctgaaaactcaatttcttacgacgcccatttcccaggcccagaagcttgcaggggcacagcaagttcaaacacagattcaggtcgctaaactccctcaggtggtgcagcagcaaacccccgttgcctccatccagcaggtagcatccgcttcccagcaggcaagtccgcagactgtagctctcactcaggcaactgccgcaggccagcaggtccagatgatccccgcagtgacagccaccgctcaagttgtacagcagaaactgattcagcagcaggtggtaacaacggcaagtgcacctctacaaacacccggagctcccaatcctgctcaggtaccagcttcctccgattcgccttcccagcagcccaagttgcagatgagagtccctgcggtccgactgaagaccccgacaaagccgccttgtcagta

SEQ ID NO: 221600 - DNA, 9260 bp, Artificial Sequence
  Description of Artificial Sequence: Synthetic coding sequence
atgcaccatggaacggggccacagaacgtccagcaccaactgcaacgcagtagagcctgtcctgggtccgaaggtgaggaacagccagcccaccctaatccgcctccttctcctgctgcacctttcgcaccatcagcttctccgagcgctccccaatcaccctcttatcagattcaacaacttatgaatcgatcccccgctactgggcagaacgtcaacattacgctacagtctgtgggccctgtggtcggaggcaatcagcagatcacgctagctcccctgccactgcctagccccacctcccctggttttcagttcagtgcgcagcctcgaaggttcgagcacggcagtccctcatacatccaggtcacatcaccactttcgcaacaggtccagacccaatctccaactcaaccatctccagggccaggacaggcgttgcagaatgtcagggcgggagcaccaggtcctggcctaggtctctgcagctccagccccaccggcggattcgtcgacgcgagcgtgttggttcgacagatcagcctttccccttccagtgggggacatttcgtgttccaggatggtagcggcctgacacagattgcgcaaggtgcgcaggtgcaactccagcatccgggaacaccgattacagtaagggagaggcggcctagtcaaccgcatacgcagagtggcggtaccattcaccacctagggcctcaatcacccgcagcagccggtggtgccggactgcagccacttgcatcaccttctcatattactacagccaatctgcctccccagatctcatcaattatccagggccagctggtacagcagcagcaggtactacaggggccacccctgccacgtcctcttggattcgagcgcacccccggtgtcctgctacctggggctggcggagcagccggttttggcatgacgagtcctcctccacctacatctcccagccggactgccgtgcctcccggactctcttccctccccctgactagcgtgggaaatacgggtatgaagaaggttcccaaaaagctggaagaaattccccctgcttcacctgagatggcccagatgcgcaagcagtgccttgactaccattaccaagagatgcaggccttaaaggaagtgtttaaagagtatttaatagagcttttctttcttcagcatttccagggtaatatgatggacttcctcgccttcaaaaaaaaacactacgctccactccaggcttatttacggcagaacgatctcgatattgaggaagaggaggaggaagaggaggaggaggaggaaaagtctgaggtgattaatgatgagcaggcccttgccggtagcctggtggctggcgctggcagcacagtggagacagatctgtttaaacggcagcaggcgatgccctctaccggaatggctggaggcatgcctccgactccccaggccgctcagctggctggacagcggcagtcgcaacagcagtacgacccgtccaccggcccacctgtgcagaacgccgcatcactccacaccccactgccacagctgcctgggagactgccccctgccggagtccccacggctgccctgagctctgccctgcaatttgcgcagcagccgcaggttgtggaagctcagactcagctgcagattcccgtcaagactcaacagccaaacgtccccatccctgctccacctagtagccagctacccatccctccaagtcaacctgcccagctggcactccatgtgcctactccaggcaaagtccaagtccaggcaagccagctgtcctctttgccgcaaatggtcgcttcaacccgcttgcctgttgatccagcgcctccctgccccaggcctttacccaccagttcaacaagttccttagcaccagtgagtggatcaggacccggaccgtcacccgcacgtagttcacccgtcaaccgcccttcttccgctactaataaggctcttagccccgtcacaagccgaacccccggtgtagtggcttctgccccaactaagccccagagcccagctcaaaacgccacatcttctcaggacagtagtcaggatacacttacggagcagatcactctggagaatcaagtccaccagcgtatcgctgagctgcgcaaagcaggtctttggtctcagagaagactgcccaaactgcaggaggctccgagacccaaatcccattgggattacctgttggaagagatgcagtggatggccacagactttgcccaggaacgcaggtggaaagtggcggcagcaaagaaactagtgcgcacagtcgttcgtcaccacgaggagaaacagctgagggaggaaagaggtaagaaagaagaacagtctagactgcgacggatcgccgcatcgactgccagggagatcgagtgcttctggagtaatatcgaacaggtggtggagatcaaactcagggtagagttagaggaaaaacgaaaaaaagccctaaacttgcaaaaggtaagtcggagaggaaaggagttgcggcctaaaggctttgacgctctccaggaatcttcattagactccggcatgtccggtcgaaagaggaaggcttcaattagtttgaccgacgacgaggtcgatgacgaggaggagactattgaggaggaggaagccaatgagggagtggtcgaccaccagacagagctgtccaatctcgctaaggaagcagaattgccgcttctggaccttatgaagctgtatgagggggcatttctgccttccagccagtggcctaggcctaaaccagacggcgaggacaccagtggcgaggaggatgccgacgactgccctggggatcgcgaatctcgcaaagatcttgtgctgattgactctttgtttattatggatcagttcaaagctgcggagcggatgaacattggcaagcctaacgccaaagatatcgccgatgtcacagcggtcgccgaagccatactgcccaaagggtccgccagagtcacaacctcagtgaaatttaacgctccctcacttttatatggggcactgcgagactaccagaaaattggactggattggttagccaagctgtaccgcaaaaatctcaacgggattctcgccgatgaggctggattgggcaaaactgtgcagattattgccttctttgctcacctcgcgtgcaatgagggcaactgggggccacacctggtggtcgtgcggtcttgtaatattcttaaatgggagctcgagctgaaacgatggtgcccagggctgaagattctgagttatattggttctcacagagagctcaaagcaaagaggcaagaatgggccgaaccgaacagcttccacgtatgcatcacgtcttacactcagttttttcggggtctcactgccttcaccagggtgcggtggaaatgtctcgtgattgacgaaatgcagagagtgaagggaatgaccgagcgccattgggaagccgttttcactttgcaatcccagcagcggttgctcctgatcgattctcctcttcataataccttcctggaactgtggacaatggttcacttccttgtcccgggaattagtcgcccttacttatcttcaccactgcgcgcaccctccgaggagagccaagattattatcacaaggtggtgattcggctccatagggtgacccagccgtttatcctgcgacggaccaaaagagacgttgagaagcagctgacgaagaagtacgagcatgtgctgaaatgcaggctgagtaaccggcagaaagcactctacgaggatgtcatactgcagccaggaacacaggaggcactgaagagcggacattttgttaatgtactaagcattctggtccggctgcagcgcatatgtaatcatcccggactggtcgagccacgccatccaggtagcagctacgttgccggaccattggaatatccctctgcaagcctcatcctaaaagccctcgaaagggatttctggaaggaggctgacctgagcatgtttgatttaattggactcgaaaataagattactcgccacgaggcagaacttcttagtaaaaagaaaattcctcgcaaactgatggaggaaatctcgacctctgcagcacccgcagcgagacccgctgccgctaagttgaaggcttcacgcctgttccagcccgttcagtacggacagaagccagaggggcgaaccgtggcatttccctccacgcaccctcccagaactgcagcccctactactgcctcggctgctccacaaggcccacttagaggccgtcccccaattgccaccttttctgcaaaccccgaggccaaggctgcagcggcacccttccagacatctcaggcgtctgcatcagcccctaggcaccagccagccagtgcctctagtacagccgcttctcccgctcatcccgctaagcttcgagcccagacgactgctcaggcaagcactcccggtcagccccctcctcagccccaggccccttcccatgcggcagggcagagtgcactcccccaacggctggtcctcccctcccaggctcaggccaggcttccctcaggagaggtcgtaaaaatcgcacagctggcgagcattactggtccccagagccgcgtcgcccaacccgaaaccccagttaccctgcagttccagggcagcaagttcaccctctctcacagccaactacgacagctgaccgccggacaacctctacagctgcagggctccgtactacagatcgtatctgctccagggcagccatacttacgcgctccaggtcctgtcgtgatgcagacagtgtctcaggcaggagctgttcacggtgcccttggcagtaaaccaccagctggagggccatcccctgccccactgactccccaagtaggagtgcctggcagggtcgcggtaaacgctctggccgttggagagcctggcacagcatccaagccggcttcccccataggcggacctacccaggaggaaaaaacacgcctcctgaaggagagactggaccaaatttacctcgtcaacgagcggcgatgcagccaggctccagtgtacggtcgtgatctgctgcggatctgcgctcttccctcccacggcagagtgcagtggcggggatcactcgatggccgacggggaaaagaggccggtcctgctcactcctatacctctagcagtgagagtccttctgaactgatgctaaccctctgcagatgcggtgagtccctgcaggatgtgatagatcgcgtcgccttcgtaattcccccagtcgtggcagcccctccatccctccgggtgcctaggccaccgcctctttatagtcaccgcatgcgcatccttcgtcaaggactccgggaacatgccgctccttacttccagcaactccggcaaaccaccgctcccagactgctgcagtttcccgaacttaggctggttcagtttgacagtggtaagcttgaggcacttgcaattctcttgcagaaactgaaatcagagggacgtagggtcctgatcctgtcgcaaatgatcctgatgcttgacattctcgagatgtttctgaattttcattatctcacttacgtaaggatagacgagaacgcatcctccgagcagaggcaagaattgatgcggtctttcaaccgagatcgccgtattttctgcgctatcctcagcactcatagtcggacaacgggcatcaacttggtggaggcagacactgtcgtgttttacgacaacgacctgaatcccgtcatggatgctaaggcgcaggagtggtgtgataggatcggacggtgtaaggatattcatatttaccgcttagtaagcggcaatagcatcgaagaaaaactgcttaagaatggaacaaaagacctcattcgcgaagtagcagcccaagggaatgactactctatggccttcctcacacaacggaccatacaagagctgtttgaagtttactcacccatggatgatgctggctttccggtcaaagcagaggaattcgtcgtcctgagtcaagaaccctctgttacggaaacaatcgcaccaaaaatcgctcgcccattcatagaggccctgaagagcattgaatatctggaagaggatgcgcagaaaagtgctcaggaaggggtattaggccctcacacagacgccctctcctctgattccgagaacatgccttgtgatgaggagccatcgcagctggaagagcttgccgactttatggagcagctgacacctatcgagaaatatgcattgaactacctggagttattccacacttccatcgaacaggaaaaggaacggaacagtgaggacgccgtaatgaccgctgtgagagcatgggaattctggaatctgaaaacgttacaggagagagaggcccgtttgcgactcgaacaagaagaagcggagctgctcacatacactagggaggacgcttattctatggagtacgtgtacgaggacgtggacggccagaccgaggtcatgcccttgtggacgccacccaccccccctcaagatgactccgatatatatctggactccgtcatgtgtctgatgtatgaggccacaccaatcccagaggccaaactgccccctgtctacgttagaaaggagagaaaaaggcataaaactgatcccagcgccgctgggaggaagaagaagcagcgccacggagaggccgtcgtgccccctaggtctctgtttgacagagcaactcctggtctactgaagattcggcgtgaaggtaaggaacaaaaaaaaaacattttactgaaacaacaagtgccctttgccaaacctctgccaacctttgctaagcctactgccgaacccggacaggataacccagaatggctgatcagtgaggactgggccttactgcaggcggtgaaacagcttctcgagctacccctcaacctcacaatagtgagtcccgctcacacccccaattgggatctggtgagcgatgtcgttaatagttgctctcgcatttatcggagctccaagcagtgccgcaaccgctacgagaatgtgatcatcccacgcgaggaagggaagtctaagaataatcggcctctgagaacctctcagatatacgctcaagacgaaaatgctactcacacccagctttacactagccatttcgacctgatgaagatgacagcaggaaagcgcagcccccctatcaaaccccttttaggaatgaatcctttccagaaaaatcccaagcacgccagcgtgttggcagaaagtggtattaactatgataagccgctgcctcctattcaggtagcatcactgcgagccgaaagaatcgccaaagagaaaaaagccctcgcggaccagcagaaggcccagcaaccagcggtggctcagccacctccacctcaaccccaacctccccctccaccacagcagcctccccctcctctacctcagccacaagcagccggttcccaaccacccgctggcccaccagctgtccagcctcaaccccagccccagccgcagacccagccgcagcccgtacaggccccagctaaagctcaacctgcaattactactggcggttccgcagcggtgctggctgggacgattaaaacctcagtcaccggaacttctatgccaacaggcgctgtgtctgggaacgtgatcgtgaatacaattgcgggagtacccgctgccacctttcaaagtattaacaaaagacttgcatctcctgtggctcctggtgctctgacaactcctggagggtcagcaccagctcaggtggtccatacccagcctcctcccagagccgtgggatcacctgcgacagctacccctgatttagtctcaatggctacaacacagggcgtacgggcagttacctctgttactgcaagcgctgtggtaaccaccaatctgacaccagtccagacccccgctcgctctctggtgcctcaggtcagtcaggcaacaggtgtgcagttacctggaaaaacgattacacccgctcacttccagctgctaagacagcagcaacagcagcagcagcagcagcagcaacagcagcagcagcaacagcagcaacagcagcagcagcagcagcagcagcaacagactacaaccaccagccaggtgcaggtgccccagatccaagggcaggctcagagcccagctcagataaaggccgttggcaaactcacacccgaacacctcataaaaatgcagaagcagaagctgcaaatgccccctcagcccccaccacctcaggcacagtctgccccacctcagccgacagcccaagtccaggtccagacgagccagccaccgcaacagcaaagcccgcagctgaccacggttacagccccaaggcccggagcacttctgaccggaactactgttgccaacctccaggttgcccgactaactcgggtcccgacgagtcaactgcaggcccagggacaaatgcagacgcaggctccgcagcccgctcaggtggcactcgcaaaaccccctgtggtttctgtaccagctgcagttgtaagttcccctggagtgacaactctaccgatgaacgtcgctggcatctcagtcgcgatcggacagccccaaaaggctgccggacagacggtggtggctcagccagtacacatgcaacaactgctcaaactgaagcagcaggcagtgcaacagcagaaagccatccagcctcaggccgcacaggggcctgccgctgtacagcagaaaatcaccgcccaacagattacgactcccggtgcccagcagaaggtagcctatgccgcacaaccagctctcaaaacccagtttctgacaacaccaatttcgcaggcacagaaactggccggtgcacagcaagttcagactcaaattcaggttgcaaaactgcctcaagtggttcaacagcaaacccctgttgcgtcaattcagcaggtggcttccgcctctcagcaggcttctcctcaaacagtggctctcacccaagctacagcggctgggcagcaggtccagatgatccccgctgtgactgcgaccgcccaggtggtgcagcagaaattgattcagcagcaggtcgttacaacggccagtgctcctttgcagaccccaggagcacccaatcctgcccaagtgcccgcttcctctgattccccaagccagcagcctaaactccaaatgcgggtccctgcggtccgcctgaagactcctacaaaacccccttgtcaata

SEQ ID NO: 221601 - DNA, 9479 bp, Artificial Sequence
  Description of Artificial Sequence: Synthetic coding sequence
atgcaccacgggaccggtccacagaatgtgcagcatcaacttcagcgctcccgggcttgtccaggttcggaaggtgaagaacagccagcacaccccaaccctcctcctagcccagccgctcccttcgctccctccgcctccccttctgctcctcagtcaccttcataccagattcagcagctgatgaatcggtctccagcaacagggcagaatgtaaacattacactccagtcagtaggccctgttgtgggagggaatcagcagattactctggcaccattgccactgccctcacctacgtcacctggatttcaattctctgctcaaccacgtcggtttgagcatggctcaccatcatacattcaggtcacatcacccctgtcccagcaggtacaaacccagagtcctacccaaccctcacctggccctggtcaggccctgcagaatgtgcgcgctggagcgcctggcccagggctcggtctgtgctctagtagtcccaccgggggattcgttgacgccagtgttcttgttcgccagatctccctttctccctctagcggtggccacttcgtctttcaagacgggtccgggctgactcagattgcacagggagcccaggtgcagctgcagcatccaggcaccccaataacagttcgtgaacgtaggccatcccagccccatacccagagcggtggcacaattcaccatctggggcctcaaagccccgctgctgccggtggggctggcctccagcccctcgctagtccttcccatattaccaccgccaatctacccccacagatttcctctattattcagggacagttggttcagcagcagcaggttctgcagggtccacctctgccaagaccgttaggcttcgaacggacgcccggagtgctattgcccggagccggaggcgctgccggattcgggatgacaagccccccacctccaaccagcccctctaggaccgccgtacctcccggactgagctctttgccactgacatctgtagggaacactggaatgaagaaagtccctaagaaattggaggaaatacctcctgcctctccagagatggcacaaatgagaaaacaatgtcttgattatcactaccaggaaatgcaagccctgaaagaagtctttaaagagtacttaatcgagctgttctttttgcaacatttccagggaaatatgatggattttctcgcatttaagaagaaacattacgcgcctcttcaggcttacctacggcaaaacgacctggacatcgaggaggaggaagaggaggaggaagaagaggaagagaaatccgaagtaatcaatgatgaagtcaaggtcgtcactgggaaagatgggcagaccggcacaccggtagctatcgccactcagttgcctccgaaagtgtcagccgcatttagctctcagcagcagccatttcaacaggccctcgcagggagcctggttgccggtgcaggaagtacagtggagacagacctttttaaacggcagcaggcaatgccatcaacaggtatggcagaacagtctaaacggcctcgtcttgaagtgggccaccagggtgtggtgttccagcaccctggcgctgatgcaggcgtccccttgcagcaattaatgcccaccgcacagggcggaatgccccctacaccacaggctgctcagctggccggacagcggcagagccagcaacagtatgacccatctacgggccctcctgtgcagaacgccgcttctctgcatacaccactcccccagctccctggcaggcttcccccagccggtgtccctactgctgctctttcatcggcccttcagtttgcccagcagccccaagtcgttgaagctcagactcagttgcaaatacccgtgaaaacacagcagcccaacgttcctatacccgctcctccctcttctcaacttcccatacccccaagccagcccgctcaattggctttgcatgtccctacgccgggtaaggtccaggtacaagccagtcagttgagcagtctgcctcagatggtggcatcaacaagactgccggtagatcccgctccaccctgtcctcgcccattacccacgtcctctaccagttccctggccccagtctcagggtccgggccaggacccagtcccgcacgaagcagtcctgtgaaccggcctagcagcgctacaaacaaagccctgtctcccgttaccagtcgcacacctggagtagtagccagtgccccaactaaaccacagagccccgctcagaatgccacctccagtcaagacagctcccaggacacactcactgagcagatcactttagaaaaccaagtgcatcagagaatcgctgagctccggaaggctggattatggagtcagagacgtctgccaaagctccaagaagctcctaggcccaagagccactgggactatctgttagaggagatgcagtggatggcaacagatttcgcgcaagagcgccgatggaaggttgccgcagctaaaaagctggtcaggacagtggtgaggcaccacgaggagaaacaattacgtgaagaacgcggtaagaaagaagagcagagtcgcctaaggcgcattgctgctagcacagctcgcgaaatcgaatgtttctggtctaatatagagcaagttgtggaaataaaacttcgggtcgagttggaagaaaagaggaaaaaggctctcaatctacagaaggtgagtagaagagggaaggaattgcgtccaaaaggattcgatgccctgcaagaaagctcccttgactcagggatgagcgggagaaagcgaaaagcctcaatctctctcactgacgacgaagtggatgacgaggaggaaaccatcgaggaggaagaagcgaatgaaggagtagtagatcaccagaccgagctttcaaatttggccaaggaagccgaactgcccctgctggacctcatgaagctttatgagggggctttcctgccttcctcccagtggccaaggcccaaaccagacggtgaggataccagcggggaggaggacgcagacgattgtcctggcgaccgtgagtcacgaaaagatctggtgttaatagactcactctttataatggaccagttcaaagccgcagaacggatgaacataggtaagccaaatgctaaagatatcgctgacgtaaccgctgttgccgaggcgattctgccaaagggctctgctcgggtcaccacatctgttaagtttaatgcaccaagcctgttgtatggggcattacgggattaccagaaaatcggccttgattggctggctaaactgtataggaagaacctaaacgggatcctggctgatgaggctggacttggcaagactgtgcaaatcatagccttcttcgctcacctggcatgcaatgaggggaactggggacctcacctcgtcgtggttcgatcctgcaatatcctcaagtgggaactggagcttaaaagatggtgccctgggctgaagattttgagctatattggatcgcaccgtgagcttaaggcgaaacgccaggagtgggccgaacctaattcttttcacgtgtgcattacatcatatacccagttttttagaggcttgaccgcttttacgcgtgtgcgatggaagtgtcttgtcattgacgagatgcagcgggtcaaggggatgactgagagacactgggaagcagttttcaccttacagagccagcagcgcctattactgatcgattctcctctgcacaacactttcctagagctttggacaatggtgcactttctagtccctggaatttctcgaccctacctgagcagccctctgagggctccttcagaggaatctcaggactattaccataaggtggtgattagacttcacagagtcacacagccttttattctgcgaaggacaaaacgggacgtagagaagcagctgaccaagaaatacgagcacgtcttaaagtgtaggctttcaaatcgccagaaagccctgtatgaagacgtgatcctgcaacccggaacccaggaggctctgaaatccgggcactttgtaaatgttttgtctatattggtccgtttacagcgcatctgtaaccaccctggcctagtagagcctagacaccctgggtctagttacgtcgccggtcccctggagtacccgagtgcgagcctcatcctaaaggcactggaacgcgacttctggaaggaggctgatctgtctatgtttgacctaattggcttggagaacaaaatcacgaggcatgaggcggaactgcttagcaagaagaagattcctaggaagctaatggaggaaatctctacttccgccgcacccgctgctaggcccgcagccgctaagctgaaagcgtccagattgttccaacctgttcagtatggccagaagcctgaagggagaacggttgcattcccgtcaacccatccgccacggacagctgccccaacaacagcaagcgccgctccacagggccctctgcgtggcagaccgccaatagccactttcagtgccaatcctgaggccaaggccgcagccgctcctttccagacttctcaggccagcgcgtcggcgcctaggcatcagcctgctagcgcatctagcactgcagcctcaccggcacacccagcaaaactcagggctcagactaccgcgcaagcatctacgcctgggcagcccccaccccaaccacaggctcccagccacgccgctggccaatctgcgctgccccagcgactggttctgcctagccaggcccaggcgaggttgccttctggagaggtagtcaaaattgctcagctcgcgtctattaccgggccacaaagccgggtggcgcaacctgagacacctgtgaccctgcagtttcaaggcagtaagttcaccttgagccatagtcaattacgtcagctgactgctggccagcccctccagcttcagggttcagtcctgcagattgtgtccgctcccggtcaaccctaccttcgcgcacctggccctgtggtgatgcagaccgtttcccaggcaggtgcagttcacggtgctctaggttctaagcccccagcaggcggtccctcccccgcacccctgaccccccaggtcggcgtgccaggcagagtcgccgtgaacgctctcgccgttggggagccgggtaccgcatccaagccggcttcacccatcgggggacctacccaggaagagaaaactagacttctcaaagagcggcttgatcaaatctacctggtcaacgaacggcgttgtagccaggccccagtgtacgggagagatctactgcgtatatgtgcgttgccatctcacggcagggtgcagtggagaggcagccttgacggcaggagaggcaaagaagcgggacctgctcacagctatacctcgtcctccgaatccccatctgagctgatgttgactctgtgtcgatgcggagaaagtcttcaggatgtgatcgatcgcgtagccttcgtgataccacccgttgttgctgctccaccctcactgagggtccctaggcctccgcctctgtattcacacaggatgcggatactgcgacagggactccgagagcacgccgctccgtactttcagcagctgagacaaaccaccgcccctcggctgttgcaattcccggaactgcgcctggtgcagttcgatagcgggaaattagaagccctggccatacttcttcaaaagcttaagagcgaaggacgacgcgtgctgattctcagtcaaatgatcctgatgttggacattcttgagatgtttcttaatttccactatctcacgtatgtgcggattgacgaaaatgcttccagcgagcagcgtcaggaattgatgcgctcctttaatagagatagacggattttctgtgctattctgtcaactcacagtcgaacaactggaatcaacctggtggaggccgacaccgtggttttttatgacaatgaccttaatccggtgatggatgcaaaggctcaggagtggtgtgatagaatcggccgttgcaaagacatccacatttatcgattagtgtccggcaacagcatcgaagagaaattactgaagaatggaaccaaagacctcattcgggaggttgcagcacagggcaacgactactcaatggcatttcttacccagaggaccatccaggaactgtttgaggtgtatagcccaatggacgatgccggttttccagtaaaggccgaggaatttgtagttctctcccaagagccttcagtcacagagactatcgccccaaagatcgcaagacccttcatcgaggcgctgaagagtatcgaatacttggaggaagacgctcagaagtccgcccaggagggcgtgctggggcctcataccgatgcactgagtagcgactctgagaatatgccatgcgacgaggagccatctcagcttgaagaactggccgatttcatggagcagttgacaccaatcgagaaatatgccctgaactatctggaactgttccacacatccattgagcaggagaaagagcgaaacagcgaagacgctgtgatgactgctgtaagggcatgggagttttggaaccttaagaccttgcaagaaagggaggccagattacggttggagcaggaagaagctgagctgctgacgtatacacgcgaggacgcctattcgatggagtatgtgtacgaggacgtggatggccaaacagaagtgatgccgctgtggacaccgcctaccccccctcaagacgactcagatatttatcttgatagcgtaatgtgcttaatgtatgaagctacacccataccagaggccaaattgccacctgtgtacgttcgcaaagaacggaagcgacacaaaaccgacccgtccgcggctggccgaaagaaaaagcagcggcacggggaagccgtggtgcctcctaggtctctcttcgatagggccactccaggcctccttaagattcgtagggagggcaaggaacagaagaagaacattctcctgaagcagcaggtgccgttcgcaaagcccctgcccacctttgctaagcctacggccgagcccggacaagacaacccagagtggcttatctcagaggattgggcacttctgcaggctgtgaagcagttgctggaactgcctttaaatctgactatagtgtcgccagctcacacccctaattgggatctagttagcgatgtggtgaactcttgctcgaggatatataggtcttcaaaacagtgtcgtaataggtacgaaaatgtgatcatcccaagggaggaaggcaaaagcaagaataaccgtccactgcgcacctcccaaatatacgcacaggacgagaatgcaacccatacgcagctctacaccagccatttcgaccttatgaaaatgaccgccggaaaacgctctcccccaattaagcctctgctgggcatgaatccatttcagaaaaaccccaaacatgctagcgttttggcggaatccggcatcaactacgacaaacccctacccccaatccaggtggcctctctgagggctgagagaatcgctaaagagaagaaggcactggccgatcagcagaaagcccagcaacctgcagtggcgcagccacctcctccccagcctcagcctccgccacccccacagcagcccccacctcctctgcctcagccgcaggcggcagggtcccagccccctgcgggaccccctgctgtccaaccacaaccccagcctcagccacagacccaaccacagccagtacaggctcccgctaaggcacagcccgctatcactaccgggggttctgctgccgtgctcgccggaactattaaaactagcgtgacgggcacctctatgccaaccggcgcagtaagcggaaatgtgatcgttaacacaatcgctggggtacccgctgctacattccagagcatcaataagcggcttgcttcacccgtggcccctggcgcactgaccacccctggagggagcgcccctgctcaagtggttcacactcaacctcctcctcgtgcagttggaagccctgccacggccacacccgaccttgtgtccatggccactacacagggtgtgagggccgtcacgagtgtgactgcaagcgccgtcgtgactacaaatctgacaccagtacagacccctgccagatcgctggtgcctcaggttagtcaggctacaggagtgcaattgcctgggaaaacgatcactcccgctcattttcagttgcttcgacagcaacaacagcagcagcagcagcagcagcaacagcagcagcagcagcaacagcaacagcaacaacaacagcagcagcagcagcagacaacgacgaccagtcaggtgcaggtgcctcaaatccagggccaagctcagtcgccagctcagatcaaagctgtgggaaaacttactccggagcacctgataaagatgcaaaaacagaaactccaaatgccaccccagccacccccaccccaggcccagagcgccccacctcaacccacagctcaggtgcaggtgcaaacgtcccagcctcctcagcagcagagtccccaactgactacggtgacggccccaagaccaggcgctcttctgacaggtaccacagtggccaacctacaggtggctaggttgactcgagtccccaccagccagctacaagctcaggggcagatgcagacccaagcaccgcaaccagcccaggtcgctttagccaagcccccagtcgtgagcgtgcccgctgctgttgtctctagccccggagtcactactctgcctatgaacgtggccggaatctccgtagccatcggtcagcctcagaaagccgcaggacagacggtcgtagcgcagcctgtacatatgcagcagctgctgaagctgaaacagcaggcagtgcagcagcaaaaggccatacagcctcaggccgcacaggggcctgcggctgtccagcaaaagattaccgcacagcagattacaacccccggagcacaacaaaaagtcgcctatgctgcacagccagcgctgaaaacacagttcttgaccacccctatttcacaagctcagaaactcgcgggtgctcagcaggttcagactcagattcaggtggccaagctcccccaggtcgtccagcagcagacgccagtggcatccattcagcaggtggccagcgcctctcagcaggcgtctcctcagacggtcgctctgacccaggcgaccgcggctggtcagcaggtacaaatgattcctgccgtgaccgctacggcccaggtggtgcaacagaagttgattcagcagcaggtggttacaaccgcctccgcaccactgcagacacccggagcgcctaatcccgctcaggtgcctgccagtagcgatagtccctcccagcagccaaagcttcagatgagagtgcccgcagtgcggctcaagacccccaccaagccaccctgccaata

SEQ ID NO: 221602 - DNA, 9371 bp, Artificial Sequence
  Description of Artificial Sequence: Synthetic coding sequence
atgcaccacggaactggcccacagaacgtgcagcaccagctgcagcgttctagagcttgtcccggaagtgaaggtgaggaacagccagcacatccaaatcctcccccttcgcccgctgctcccttcgctccctcagcaagcccctcggcaccacagagcccgtcttaccaaatccagcaactaatgaatcggagtcccgctaccggtcagaatgtgaacataacactgcagagcgtaggtccagtagtgggtggtaatcagcagatcactctggctccacttcccttgccatcccctacttcaccaggcttccagttctctgctcaacctagacgttttgagcacggcagccctagctacattcaggtaactagccctctctcccagcaggtgcagacacaaagtcccacacaaccatctccaggccctggtcaggcgctgcagaatgtgcgcgctggtgccccaggacctgggctgggtctgtgttctagctctcccactgggggattcgttgatgcatccgtgctcgtgagacagattagcctcagtccatcaagtggcggacatttcgtgttccaagacgggagtggattgacccagatagcccaaggtgcccaggtgcaactgcagcacccaggaactcccatcactgtgcgtgagagaaggcccagccagccacacactcagtccggcggtactatacatcacctgggaccacagtcgcccgctgctgcaggaggtgctggactgcaaccactcgcctccccctctcacattaccactgccaacttgccccctcagatctccagcattattcagggccaattggttcaacaacaacaagtgcttcaaggaccaccactccctcgccctctggggttcgagcgaacaccaggcgtgctgcttcctggggctgggggagccgctggtttcggcatgacctccccaccgccaccaacgtctccatcgaggaccgctgtacctcctggtctgtccagcctgcctttgacaagcgtgggaaacacaggtatgaaaaaggtgcccaagaagttggaagagatccctccggcttctcccgagatggcccagatgcggaagcaatgccttgattaccattaccaggagatgcaggccctcaaggaggtgttcaaggagtatctgatagagctgttcttcctacagcacttccaaggtaatatgatggattttttggcctttaagaaaaagcactatgccccattacaggcatacctgcggcagaatgacctggatatcgaggaggaggaggaggaggaggaagaggaggaagagaagtccgaagtcataaacgacgaacagcaagctctggctggttctctagttgccggagcaggctctaccgttgagaccgatttattcaaacgccaacaggctatgccttccactggcatggctgaacagtctaagcgccctaggctggaagtgggccaccagggagttgtcttccagcatccgggagcggacgcaggagtgccactccagcagctcatgccaactgctcagggcggaatgccaccgacaccccaagccgctcagttggccggtcagcggcagtctcaacaacaatatgatccttctactggcccaccagttcagaatgcagcaagcttacatacacctcttccacaactgcccggacgcctgcctccagcgggagtgcctacagcggcactcagcagcgctctgcagttcgcccagcagccacaagtcgtcgaagcccagacacaactacaaattccggtcaagacacagcagccaaacgtcccgattcccgctccaccctctagccagctcccaattcctccctctcagcctgcccagctggccctgcatgtccccacccctggcaaggtacaggtacaggccagccaactgtccagtctgccacagatggtcgcctcaacgcgcctgcccgtcgatcccgctcctccttgtcccagaccgctgcccacaagcagcacttcgtccctggcaccagtttcgggatcagggcctgggccttctccggcaaggagcagccccgttaacaggccatcctctgccaccaataaagctctgtcacccgtgacctctagaactcctggtgttgttgcttccgccccaactaaaccccagagtccagctcaaaatgctactagcagtcaggactcctcccaggatactctgacggaacagataactctggagaaccaggtgcaccagagaattgcagagttgaggaaggctggcctgtggtctcagagaaggctgcccaagctgcaggaagccccacggcctaagtcacactgggattatctcctggaggaaatgcagtggatggcgaccgacttcgcccaagaacggagatggaaggtggccgctgccaaaaagcttgtccggaccgttgtgcggcaccatgaggagaagcagctacgggaggagcgtggcaaaaaagaggagcaatctagactgcggcgtattgctgccagcacagcccgagaaattgagtgcttctggtccaacatcgagcaagtcgtggagattaaattgagagtggagttggaggagaagagaaaaaaggccctgaatcttcagaaggtgtcccggcgaggaaaggagttgcggccaaagggttttgatgctcttcaagagtcttctctcgatagcggaatgagtggtcggaagcgcaaagcttctatttcccttacagacgatgaagtcgacgacgaagaggaaaccatcgaagaggaggaagcaaacgaaggagtggtcgatcatcagactgaactcagcaaccttgcaaaagaggctgagctgccgctgctggacctcatgaagctctacgagggagctttccttccctcgtcccagtggcctcgtccgaagcctgacggcgaagacacatccggtgaagaagatgcagacgactgcccgggagatcgggagtcacggaaggacctcgtactgatagatagcctgttcattatggatcagttcaaggccgctgaaaggatgaacattggcaagcccaatgccaaagacatcgccgacgtcactgccgttgccgaagctattctgccaaaaggaagcgcgcgagtgaccacttccgtgaagttcaatgccccaagcctgctctacggggcactcagagattatcagaaaatcgggctggactggctcgccaagctctatcggaaaaacttgaatggcatactagcagacgaagctggcctgggaaagaccgtgcagattatagcatttttcgcccacttagcctgtaatgaaggtaactggggtccacacttggtggtcgtgcgctcttgcaacattctgaagtgggagttggagctgaagcgttggtgcccaggcttaaagattctgagctacattggctctcatcgcgaactcaaggcaaagaggcaggaatgggcagagccaaattcatttcacgtatgtattacctcctatactcagttcttccggggactcaccgcctttactcgggttaggtggaagtgtctggtcatcgacgagatgcaaagggtgaaaggcatgacggagcgacactgggaggccgtgttcaccctccagagtcaacagcggttgctgttgattgacagtcccctgcacaacacttttttagaactgtggacgatggtccacttcttggtgccgggtatctcccgaccctacttgagttccccactgagggcgcctagcgaagaaagtcaggattactatcacaaggtcgtgatcaggcttcacagggtcacacagccatttatcttacgaaggaccaagagggacgtggagaaacagctgaccaagaaatatgaacacgtcctgaaatgccgattgagcaatcggcaaaaagctttatatgaagacgtgatcttgcaacccggtacccaggaggcattgaagagtggccacttcgtcaatgttctgtccatcctagtgcgactccagagaatctgtaaccatcctggactagtggaacctagacatcctgggagctcatacgtggcaggtcccctggaatatcctagcgcttctctcatactgaaggccctggagagggatttttggaaagaggcagacctatccatgttcgacctgattggcctagagaacaagatcacgaggcacgaggctgaattactgtccaagaaaaaaattccacgaaaattgatggaggagatatcaacatcggccgcaccagctgcacgacccgcagccgcaaagcttaaagcgagccggttgttccaacccgttcagtacggccagaagcctgaaggaagaactgtagcctttccatcaacccatcccccacgtaccgccgcacccacgaccgcttctgcagcaccccagggacccctgaggggccgtccccctatcgccacatttagcgccaaccctgaagcaaaagccgctgcggcaccattccaaactagtcaggcaagtgccagcgcaccaagacaccagcctgcctctgcgtcaagcactgctgcgagtcccgctcatccagcaaagctccgggcacaaaccactgcacaggcctctactcctggtcagcctccccctcagccacaggcccctagtcatgctgcgggacagtctgctctgccacaaagattagtgcttcccagccaggctcaggcacggctgccaagcggagaggtggtgaaaattgctcagctcgcatccataaccgggcctcagtcacgggtcgcccaaccagaaacaccagtcacactacagttccagggtagtaagtttacgctttcacactctcaattgagacagctgaccgcgggacagcctctgcaactgcaggggtccgtgctgcaaattgtctcagctcctggacagccttatctgagggcacctggacccgtggttatgcaaacagtgagccaggccggagcggtccacggagctctaggcagcaagcccccagccggagggcctagtccagcccctctaaccccccaggtgggtgtgcctggaagggtagctgtcaacgcacttgccgtgggcgagcctggaaccgcttctaaaccagcatccccaatcggtggaccaacacaggaggaaaaaacccgccttttgaaagaaagactggaccagatctacttggttaatgaaaggcgctgttcacaggccccagtgtatgggagggatctgctccgtatctgcgctctcccgtcccacggccgtgtgcagtggagaggcagtctggatgggagacggggtaaggaagcagggccagcccactcctatacctcctccagcgagagcccaagcgagctgatgttgactctctgccgatgtggcgagagtctccaggatgtcatcgatcgcgttgccttcgtgattcccccagttgtcgccgcacctccaagcctaagggtcccgaggccgcctcctctgtattcacacaggatgagaattctaaggcagggcttacgcgaacatgcagcaccatacttccagcagttgagacagactaccgcgcctcggctcctacaatttccagaactgcgcttagtgcaattcgattcgggtaaactggaggccctcgccatactgttgcagaaacttaaaagcgaaggcaggcgggtcttaatcctaagtcagatgatcttaatgttggacatactcgaaatgtttcttaattttcattatcttacttatgtgagaattgacgagaacgcctcaagcgagcagcgtcaggagctgatgcgatcgtttaatagggatagaaggattttttgcgccatactgagcacacactcccgcactacaggtatcaacctcgtggaggccgacaccgtggtcttttacgacaacgaccttaaccccgtcatggacgcgaaagctcaggaatggtgcgaccgaattggtaggtgtaaagacatacacatctatcgccttgtgtctggtaatagcatcgaagaaaaactcctcaagaatgggactaaagatctgattagggaggtggccgcacaaggcaacgattattctatggcattcctgactcagcgcacaattcaggaactgtttgaggtgtattctcctatggacgatgccggtttcccagtgaaggccgaggaattcgtagtgctgtcccaggaaccgtcagtcaccgaaactatcgctcctaaaattgcgagaccgtttatcgaggcattgaagtccatagaatacctggaggaagatgctcaaaaatccgcccaagagggcgtattgggcccacacacagacgcgttatccagcgacagcgaaaatatgccctgcgacgaagaaccatctcagctggaagagctcgccgatttcatggaacaactgacaccaatagagaaatatgcactaaattacctagaactgttccacacttctattgagcaggagaaagagaggaatagtgaggacgccgtgatgactgcagtccgggcttgggaattttggaatttgaagacactgcaggaacgggaagccaggttgcggctggaacaggaggaggctgagcttttgacatatacccgggaggacgcatactccatggaatatgtctatgaggacgttgatggacagactgaggtcatgcctctctggacccctcctacacctccccaggacgactcggacatttacctggattcggtgatgtgtctgatgtacgaggccacaccaataccagaagctaagttgccacctgtctacgtgcgaaaggaacgtaaacgacataagactgatccctccgccgctgggcgtaaaaagaaacagaggcacggtgaagcagtcgtgcctccgaggtccctcttcgaccgcgctacgcccggactcctcaagatcagacgcgaaggaaaagaacagaaaaagaacatccttctcaaacaacaggtgcctttcgcaaagccactccctacctttgctaagcccactgctgagcctggtcaggataatcctgaatggctgatcagtgaagattgggctctactgcaggccgtaaagcagttgctggagcttccactgaacctcaccatcgtgagccctgcccacacgcctaactgggatctcgtctccgacgtagtgaactcatgcagccgaatatacaggtcctctaagcaatgtagaaataggtacgagaatgtcattatcccgagggaagaaggcaaaagtaaaaacaatagacccttgcggacaagccagatatatgcacaggacgaaaatgctacgcatacacagctctatacatcgcacttcgacttgatgaagatgaccgcagggaagcggtccccacccattaaacccctgctgggaatgaacccatttcagaagaatccaaagcacgcgtccgtgctggcagagtcaggcattaattatgataagcccctccctccaatccaggttgccagtttgagagccgaaagaatcgccaaggaaaagaaagccctcgctgaccaacagaaagcacaacaaccagcagtagcgcagccacctcctccacaaccgcagccgcctccaccaccccagcaacctcctccccctctgcctcagccccaggccgctggctcccagcctccggcagggcctcctgctgtgcagccccaaccacaaccccagcctcagactcagccccagcccgtgcaggcccctgccaaagctcaaccagctattactaccgggggaagtgcagccgtgctggccggaacaatcaagacgtccgtgactggaacttcaatgccgaccggggctgtgtcaggcaatgtcatagttaacaccatagctggagtgccggcagctacgtttcagtctatcaataaaagactggcttcacctgtcgccccaggggctcttacgacccccggtggatctgctcccgcacaagtcgttcacacgcagcctccgcctcgagcagtgggctcccccgcaacagctaccccagatctcgtatccatggccacgactcaaggcgttagagcggtcacatcggtcaccgcgtccgccgtcgtgactaccaatctgaccccggtgcaaactccagcgcgatccctcgtcccccaagtaagccaggccaccggtgtgcagctccccggaaagaccatcacaccagcccacttccagctcttgcgccagcagcagcaacaacagcaacagcagcagcagcagcagcaacagcaacagcagcagcagcaacagcagcagcaacaacagcagcagacgacaactacttctcaggtacaggtccctcaaattcagggtcaggcacaaagccccgcacagattaaagcagtgggtaaacttacccctgagcacctaatcaaaatgcaaaaacaaaaacttcagatgccaccccagcccccacccccacaagcacaatccgctcccccacagccaacagctcaggttcaggttcagacttctcaaccaccacagcagcaatctcctcagcttacaactgtgactgctccacgacctggggcactgctgaccggaaccaccgtggcgaatcttcaggtggcaagactcactcgtgtccctactagtcagctccaggcccagggccagatgcagactcaggcgcctcagccagcacaggtcgcgctcgcaaagccaccagtcgtatctgttccagctgctgtggtatcctctcccggagtgacaaccctgccaatgaacgttgctggtatatcagttgcaatcggacagcctcagaaagcagcaggccagacggtggtggcacagcctgttcacatgcagcagctgcttaaactgaaacaacaggcagtgcagcagcagaaggccatccagcctcaagccgctcagggcccagctgccgtccagcagaaaatcacggcgcaacagattactacccctggtgcgcagcagaaagtcgcctacgcagcccagccggcattaaagacccagtttctgaccacgcctatttcccaggcccagaagttggccggagcccagcaggtgcagactcagatccaggtcgcgaaacttccacaggtggtgcaacaacaaactcctgtcgcctctatccagcaggttgcatctgcttcgcagcaggcctccccgcagacagtggctttaacccaggccactgccgcaggccagcaggtccagatgattccagcagtaaccgcaacggctcaggttgtgcaacagaagctgattcagcagcaggtcgtgactactgcctcagcgccactgcagaccccaggtgctcctaaccccgcacaggttcccgcatcaagtgactccccttcccagcagccaaaacttcaaatgcgcgtgccagccgtacggctcaagaccccgacaaaacccccatgccagta

SEQ ID NO: 221603 - DNA, 9369 bp, Artificial Sequence
  Description of Artificial Sequence: Synthetic coding sequence
atgcaccatggtactggtcctcagaatgtccagcaccaactgcagcgcagtcgcgcatgcccgggatctgaaggcgaggagcagcccgcacatcccaatcccccaccatcccctgcagccccattcgccccatcggcatccccttctgccccacagagcccatcttatcaaatacaacagctgatgaatcgcagcccagctaccgggcaaaacgtcaatataaccttacagtcggtgggccctgtggttggtgggaatcagcagatcacacttgctcctctccctttgccgtcccctacaagccccggattccagttcagcgcccaaccccgtcgctttgagcacggctcaccttcatatatacaagtgaccagccctttgagtcagcaggtgcaaacccagagcccgacacagccgagccctggaccaggccaggctctgcagaatgtgagggccggtgctcctggacccggattgggcctgtgttcgagttcaccaacaggaggcttcgtggacgcctctgtgctggtgaggcagattagtctcagtccttcttccggtggacattttgtgttccaggatggaagcggactcacacagatcgcacagggcgctcaggtgcagctgcaacatcctggtacacctataactgtcagagaacggcgaccatctcagcctcatacgcaaagtggcggtaccattcatcatttagggcctcagtcacccgctgcagccggtggggctggactgcagcctcttgcgagtccttctcacatcaccactgccaacctgcctccccagatttcgtctatcatccagggccagctcgtgcagcagcagcaggtcttgcagggacccccactccctcggcctctgggatttgagagaacacccggtgtactgttgcccggagcagggggtgccgcaggcttcggcatgactagtcctcctcctcccacctctcctagtcgcaccgccgttccccctggactgtccagcctgcctctgacgtctgtggggaacacaggcatgaaaaaagtccccaagaaacttgaggagatccccccagcctcccccgagatggctcagatgcgaaaacagtgcctggactaccattaccaggagatgcaagcattgaaagaggtgtttaaagagtacctgatcgagctttttttcctccagcacttccagggtaacatgatggattttcttgctttcaaaaagaagcattatgcgcctctccaagcatatttacgacagaatgacttagacatcgaagaggaggaggaggaggaagaagaggaagaagaaaagtcggaagttattaacgatgaacaagcgttagccggatctttggtggctggagccggtagtacagtggaaactgatctctttaaacgtcaacaggctatgccctccacaggcatggccgagcaatccaagcggcctaggcttgaagtcggacaccagggagtggtgtttcagcatccaggggctgatgctggtgtccctctgcagcagctgatgcctactgcacaaggaggcatgccccctactcctcaagcggctcagctggcaggtcaacggcagtcccagcaacaatatgacccgagtaccggcccacccgtacagaacgccgcaagcttacatacccctctgccacaattgccagggcgattaccacccgcaggcgtgcctaccgcggcactatccagcgcactacagtttgcccaacagccacaagtcgttgaagcacagactcagttgcagattccagtgaagacccagcagccgaatgttccaatcccagcacccccttcatcccaactgccaattcctcccagccagcccgctcaattggccctgcacgtgcccactcctggcaaagtacaggtgcaggcttctcagctgagttccctcccacagatggtggcttcaactcggttgccagttgatcccgcaccaccatgccctaggcccctgccaacttcttccaccagttctctagcccctgtgtctggtagtggccctggcccttcccccgcacgatccagccccgtgaacaggccttcaagtgctacaaataaggccctttcccccgttacctccagaactccgggagttgtcgcttctgcccctacaaagcctcagtcccctgctcagaacgcgacatcaagccaggacagctcgcaggacacactgaccgagcagatcacattagagaatcaagtgcaccagaggatagcagaactacggaaggcaggattatggtcgcagagacggctgccaaaactgcaagaagctcccagacccaagtctcactgggattacctcttagaagagatgcagtggatggcaaccgattttgcacaggagcggaggtggaaggtggccgctgctaaaaagctggttcgaacagttgtgaggcatcatgaggagaaacagctccgcgaagagagaggtaaaaaggaagagcagtctagattgaggcgtatagcagcgtctactgctcgagagatagagtgcttctggtctaatattgagcaggtggtagaaattaagctccgtgtggaacttgaagagaagcgcaagaaagctcttaatctccaaaaggtgtccaggcgtggcaaggagttacggccaaaggggttcgatgcgctgcaggagtctagcctagactccggcatgagcgggcgtaaacgaaaggccagcatcagccttacggacgatgaggtcgatgacgaagaagaaacaatagaggaggaagaagccaacgaaggcgtggtggatcatcagaccgagctaagcaatctcgcgaaggaagctgagctgcctctgttagacctcatgaaactatacgaaggcgcattcctgccatcatcccaatggccaagaccaaaacctgacggagaagataccagcggagaagaagatgccgatgattgccccggagaccgagaaagcaggaaggatctggtactgattgactccctgttcattatggaccagttcaaagccgcagaacgaatgaacattggaaagccaaacgcgaaggatatcgccgatgtgaccgccgtagcggaggctattctgccaaagggttcagcacgagtcaccacctctgttaaattcaatgcacccagtctcctgtacggggctcttcgggactatcagaagatcggacttgactggctggcgaaattatacaggaaaaaccttaatggtattttagcagatgaggccggacttggaaaaacagtgcagataatcgccttcttcgcccacctggcttgcaacgagggaaattggggtccacacctcgtagtagtgaggtcatgcaatattctgaagtgggagctggagctcaagcggtggtgtccaggcctgaaaatcctgtcctacattggctcacatagggaactcaaggctaaaaggcaggaatgggcggagccaaactcctttcacgtctgtatcacctcctatactcaatttttccggggactcactgcattcaccagagtgaggtggaaatgtttggttattgacgagatgcagagggtcaagggcatgacagagaggcattgggaagctgtctttactctgcagtctcagcagaggctgctcctgatcgacagcccattgcacaatacttttctggaactgtggacgatggtgcacttcttggtccccggtatctctaggccttacttatcctcccccctgagggcacctagcgaggagtcacaggactactatcacaaggtcgtgattcgcctgcatcgggttacccagccctttattctgcgcagaacaaaacgcgatgttgaaaaacaactgaccaagaagtacgaacacgtgctgaagtgtagactaagcaaccgccagaaagccctgtacgaggacgttattctacagcccggtactcaggaagccctaaagagtggacattttgtgaatgtgttatccatcttggtgaggctgcagcgaatatgtaatcatccaggactggttgagccaagacacccagggtcatcttatgtcgccggtccactagaataccctagcgctagcctgatcctgaaggcccttgagagggacttttggaaagaggccgatctgtccatgtttgatctgattggactggagaataagataactcgccatgaggccgagctgctgagcaaaaagaagattccaagaaaactgatggaggaaatctccacgtccgcagcccctgcggctcggcctgctgctgcaaagctgaaagctagtcggctgttccaaccagtgcagtacggccaaaaaccagagggtaggacagtggcctttccatctacccatccaccacgcaccgctgcccctactaccgcctcagctgcgcctcagggacccctcagggggagacctccaatcgctacttttagtgctaaccccgaggccaaagcagcagcggcaccttttcaaacgagccaggccagcgcaagcgctccacgccatcagcctgcatcagcaagcagcaccgccgctagtccggctcatcctgcaaaactcagagctcaaactacagcacaagcaagcacccccggacagccacctccccagccacaagccccttcacatgcggcaggacagtcagctttacctcaacggctggtcctgccttcccaggcccaggccaggttgccgagcggcgaggtggtgaaaatcgcccagctggcctcgattactggcccacagagcagagtggctcagcctgagactcccgtcaccctacagtttcagggatccaagttcaccctgagccattcacagttgcggcagctcacagccggtcagcctcttcagctacaaggctcggtgctgcagatcgtgtctgcccctggacagccttacctgcgggctccgggtcctgtggtgatgcagaccgtgagtcaggctggcgctgttcacggagccctgggaagcaagcctcccgctggcggaccatcaccagccccactgactccacaggtcggtgtgccaggtagagtcgccgtcaacgctctggcggtgggcgagccaggcaccgcctccaagcccgcatccccaatcggcggaccgacgcaggaagaaaagacccgacttctcaaggaacgtcttgaccagatttatctcgtcaatgaaaggcgctgcagccaggccccagtctatggtagagacttgctgagaatatgtgccctcccctcacacggtcgcgtgcagtggcgtggtagtctggacggcaggcgaggtaaggaagccggaccggcacactcgtatacctctagcagcgaatctccctccgagcttatgctgaccttatgccgctgcggagaatcattgcaagacgtcatcgatcgcgtagccttcgtgattcctcctgtggttgccgcacccccttccctccgagtgccaagacctcctcctctgtatagtcaccgcatgaggatacttcgccagggactgagggagcatgccgcaccctactttcagcagctgcgtcagacaacagcccctagactgctacagttcccggagttacgcctggttcagttcgattccggaaagctggaggcactggctatattgctgcagaagctgaaatcagaaggaagaagggtgctgatcttgtctcagatgatcctcatgctggacatcctcgaaatgtttctgaattttcattatctaacctacgtccgcattgatgaaaacgccagctctgaacagaggcaggagctaatgaggagttttaacagggatagacggatattttgtgccattctgagtacccacagccgcaccaccggcatcaatctggtggaggcagatacggtggtgttctacgataacgacttgaacccggtaatggacgccaaggcccaggagtggtgtgatcggatcggccgttgtaaagacatccacatctacaggttggtttcagggaattctatcgaagagaagctgctgaaaaacggaaccaaagacctgatcagggaagtggccgcacagggcaatgattatagtatggctttcctgacacagcgtactattcaggagctttttgaggtgtattcccctatggatgatgctggctttccagtcaaggccgaggagttcgttgtccttagccaggagcccagtgtgaccgagacaatcgcccctaagatagcccgacctttcatcgaggccctgaaatccatcgaatatcttgaggaggacgcccagaaatccgcgcaggagggagtcctggggcctcacaccgatgctctctcttcagattcagagaatatgccgtgtgacgaggagcccagccaacttgaagagcttgccgattttatggagcagctgactccgatcgagaagtatgcattaaattacctggagctcttccacactagcattgagcaagagaaggaaaggaatagcgaggacgctgtcatgacagctgtacgggcttgggaattctggaatcttaaaaccctacaggagagggaggccaggctgaggctggagcaggaagaggcagaacttctaacatacacccgggaggatgcttactccatggagtatgtttatgaagacgtggatgggcagacagaggtgatgcccctgtggacccctcccacccctccccaggacgacagcgacatttatttggacagcgtaatgtgtctgatgtacgaagccacaccaatcccggaagccaagctgcctcctgtttacgtgagaaaggaacgcaagcgtcataaaaccgacccttcagcagcaggtcggaaaaaaaagcaacggcatggagaagctgtggtccccccaagatccctgttcgatcgcgctacgccagggttgctgaagatccggcgagaaggcaaggagcagaagaagaatattctactcaaacagcaagtgccgttcgctaaaccgctgccaacttttgccaagccaacggcagagcctggtcaggacaatccggaatggttgatcagcgaggattgggcgcttctacaagccgttaagcagcttctggagctacctttaaacctcactatcgtgtcccctgcccacacccctaactgggacctcgtctccgacgtggtgaatagctgctctcgtatctatcgatcgtctaagcagtgccgtaacagatacgagaatgtaattattcccagggaagaggggaagtctaaaaataacaggcctctacgtaccagccagatttatgctcaggatgagaacgcgacgcatacccagctgtacacttctcacttcgacctgatgaagatgaccgccggaaagcgatccccgcctatcaagcctcttctcggcatgaatcctttccagaagaacccaaagcacgcttccgtgcttgccgagtccggtatcaattatgataagcccctccccccaatacaagttgcatcccttagagctgagcgcatcgctaaggaaaagaaggccttggccgatcagcagaaagcccagcagccagcggtggcccagcctcccccacctcaaccccagccgccaccacccccacagcaaccacctcctccgctaccccagcctcaagcagcaggcagccagcccccagctggccctccggctgttcaaccgcagcctcagccacagccgcaaacccagccccagccagtccaggcccctgccaaggcacagcccgctattaccactggagggtcggcagctgtactggcgggaaccatcaaaacctctgtgacagggacttctatgcctactggagcagttagcggcaacgtgatagtaaacactattgccggagtgcccgcagcaaccttccagtcaatcaataagcggctcgcatcacccgtggcccctggcgctctcacaactccaggtggctccgcccctgcacaggtggtgcacacgcagccacctcctagggcagtgggatcaccggctactgcaacccccgatttggttagcatggccaccacgcaaggcgtgagagcagtgacgtcagtgacagccagcgccgtcgtgactaccaacctaaccccagtgcaaacgcctgcacgctcactagtgccccaggtgtctcaagccacgggggtgcaattgcctggaaaaaccatcactcctgcccactttcaactcctgcgccagcagcaacagcagcaacaacagcagcagcagcagcagcagcagcaacagcaacagcagcaacagcagcagcagcagcaacagcagactacaacaacttcccaagttcaggtaccacagatccagggtcaggcacagtcccccgctcagatcaaggccgtcggcaagctgactccagagcacctaattaagatgcaaaagcagaagctgcagatgcccccacaaccccctcctccacaggctcagtccgccccacctcagccaacagcccaggtgcaggtacagacgagccagcccccacagcagcagagcccccaactgacgacagtgacggcccctcgtcccggagccctcttgactggcactactgtcgccaacttgcaagtcgccagactgacccgggtcccgacctcacaactgcaggcacaggggcagatgcagacgcaggcaccccagccggctcaggtggccctcgctaaacctccagtcgttagcgtccccgctgctgttgtctcaagcccaggggtcacaaccctgcctatgaacgttgctggcatctcagtcgctattggccagccacagaaagccgcaggccagacggttgtcgcccagccagtccacatgcagcagctattgaaactgaaacagcaagcagttcaacagcagaaggccatccagccccaggccgctcagggtccagcagccgtccagcagaaaattactgctcagcagatcactacaccaggagcacaacagaaagtggcgtacgccgcacaacccgcactgaagacacaattcctgaccacacctatctctcaggcacaaaagctggccggtgctcaacaggtgcaaacccaaattcaggtcgcaaagctcccccaggtcgtgcagcagcagacacccgtagccagcattcagcaggttgcttccgctagtcagcaagcctctccccagactgttgctctgacacaggccacagctgcaggccagcaagtacagatgattcccgctgtgacggccaccgctcaggtggtacagcagaaactaatccagcagcaggtggtgacaaccgcttcagcaccattacagacccccggtgccccaaacccagcccaggtccccgcttcctccgattctccgagccagcagccgaaactgcaaatgagagttcctgccgtgagactgaagacgcctacaaaacctccttgccaatac

SEQ ID NO: 221604 - DNA, 2475 bp, Artificial Sequence
  Description of Artificial Sequence: Synthetic coding sequence
atgcaccatggtaccgggcctcagaacgtccaacaccaactccaacggtcccgggcttgtcccggttccgagggagaggagcagccagcacaccccaatcctcctccttctcccgctgctccttttgccccaagcgcaagtccatctgcgccacagagccctagctatcagatccagcaattaatgaaccggagccccgctactgggcagaacgtcaacattacgctccagtccgtgggaccagtggtgggcggaaaccagcagatcacccttgcccctctccctctcccttccccgacaagtccgggattccagtttagcgcacaacctcgtagattcgagcatggcagtcccagctacatccaagtgacctcccctctgtcacagcaggtccagacccagagcccgacccaaccaagtccaggacccggtcaggcactccagaatgttcgcgctggcgctcccggaccgggactcgggctgtgtagctcctctccaaccggtggttttgttgatgcctctgtcctggttcgccagatcagcctctccccatctagtgggggtcacttcgtgttccaggacggtagcggacttacacagattgcccaaggcgctcaggtgcagctacaacacccgggtacgccaatcacagtccgcgagagacgaccctctcagccccacacacaatctggcggtacaatccatcacttaggtcctcagagtcctgctgctgcagggggagctgggttgcagcccctggcctctccaagccacataactaccgctaacctccctccccagatctcttctatcatccagggccagctggtgcagcaacagcaggtcctgcaggggcctcccctcccccgaccactcggctttgagaggacacccggagttctgctccctggggctgggggtgcagcaggcttcggaatgactagcccccctccacccacctccccatctaggacagcagtgccaccaggtctctcctccctaccgctgacatctgtcggtaacacaggaatgaaaaaagtcccgaaaaagctggaagagataccgcctgccagccccgagatggcccagatgcgaaagcagtgccttgattaccactaccaagaaatgcaagcgctgaaagaggtgtttaaggagtatctgatcgaacttttctttctgcagcatttccagggaaatatgatggacttcctggcttttaagaagaaacattacgctcccttgcaggcctaccttaggcagaacgatttggatatcgaggaggaagaagaggaggaggaagaggaagaagagaaaagcgaggtaattaacgatgagcaggctctcgctggttctctggtcgccggtgccggtagtactgttgaaaccgacctgttcaagagacaacaggcaatgccctcgacggggatggccggagggatgccacctaccccccaggccgctcagctcgccggacaacgccagtcccagcaacaatacgatcccagtaccggccctccggtgcagaatgcagcctcccttcacacacccttgcctcagctgccagggagactgccaccagcaggagtaccgaccgccgcactcagctcagcactccagtttgcacaacaaccccaggttgtggaggcacagacccagctccagattcctgtaaagactcagcagcccaacgtccctatccccgcacctcctagcagtcagctgcccatccctccctcacaaccggctcagctggcccttcacgtcccaaccccaggtaaggtgcaagtgcaagccagccaactgtctagtctcccacagatggttgcaagcacccgtttgccagtggaccccgctcccccttgccccaggccactgccaacctcctccacgtcaagtctggcacctgtgtctggaagcgggcctggtccatcaccagccaggtccagcccagttaatcgccctagctcagcaaccaataaggcgctgagccccgtcacatccagaacccccggtgtagttgcaagtgcacccactaaacctcagagcccagctcagaatgcaacttcgtcccaagacagcagtcaagataccttaacggaacagataacactggagaaccaggtccaccagcgaatcgctgagttacgtaaggctgggctctggtcccagaggcgtctacctaagctgcaggaggcccctaggccgaagtctcattgggactacctgctggaggaaatgcagtggatggctactgacttcgcacaagaaagaaggtggaaggttgcggctgcgaaaaagctggtgcggactgtggtacgacatcatgaggagaagcagcttagggaagaacggggaaaaaaggaggagcaatctcgcttgcggaggatagccgcttcgaccgcccgagagatcgagtgtttctggagtaatattgagcaggttgtcgagatcaaactgcgagtggaactggaatag

SEQ ID NO: 221605 - DNA, 9371 bp, Artificial Sequence
  Description of Artificial Sequence: Synthetic coding sequence
atgcaccatggtaccggacctcagaatgtgcagcaccagctacaaaggtctagagcatgtcccggatccgagggcgaagagcaacctgcacatcccaaccccccaccctcgcccgcagccccttttgccccttccgcttccccatcagcccctcagtccccgtcttatcagatacaacaactgatgaataggtcccctgcgaccggtcaaaacgtgaatattacattgcagagcgtcggtccagtagtcggtggtaatcaacagatcaccttggccccacttcccctgccaagtcctactagccccggattccagttttcggctcagccacgacggttcgagcacgggagtcccagctacattcaggtgaccagtcccctgtcacagcaggtccagacgcaaagtcccactcagcctagtccaggcccaggacaggctcttcagaatgtccgggctggagcgcctgggcctggcctggggctctgtagttctagtcccaccggaggcttcgtggacgcctcggtgctcgtgcgacagatctcactatctccatctagtggaggccactttgtgtttcaggatggtagcggccttacccagatcgctcagggggcacaggtgcagctacagcaccccggtaccccaatcactgtcagagagcgtcgccctagtcagcctcacacccaatctggagggactatacaccacctcgggcctcagagccccgcagccgctgggggagccggtctccaaccattggctagccccagccacatcaccacggctaatctgccacctcaaatttccagcattatccagggacaactcgtgcaacagcaacaagtgctccagggtcctcccctgccacgaccactgggatttgaaagaaccccaggggtgctgcttcctggagccggtggagcagccggatttggcatgacaagcccaccccctccaacatccccatcacggacagccgttccgcctggattatcctccctcccccttacaagcgtggggaatactggcatgaagaaggtcccaaagaaactggaggaaatacctccagcctccccagagatggcccagatgcgaaagcaatgcctggattaccattatcaagagatgcaggccctcaaggaagttttcaaggagtatctcatagagctgttttttctgcagcatttccagggcaacatgatggatttcttagcttttaaaaaaaagcactacgctccccttcaagcatacttgaggcagaacgacctggacatagaggaagaggaggaggaagaggaggaagaagaggagaagagcgaggtgatcaacgacgaacagcaagcactagcagggagcctggtcgccggagccggttcaacagttgaaaccgacttgttcaagagacaacaggctatgccctcgactggaatggccgagcagtcgaagagacccaggctcgaagtgggccaccagggcgtggtgttccagcaccctggcgctgatgctggagtgcctctgcagcaacttatgccaacggctcagggaggaatgcctcctaccccacaagctgcccaactagccggtcagcgccaatcccaacaacaatacgacccctccactgggcctcccgtccagaacgcagcctctcttcataccccactcccccagctgcccggtagactccctcccgctggagtcccaacagccgcactgtcctcggcactgcagttcgcccaacagcctcaggtcgtggaggctcagacgcagctccagatccctgtcaaaacccagcaaccaaatgtccccatcccagctcctccctcatcccaactgcccatccccccttcccagccagcccaactggctctccatgtgccaactcctggcaaggtgcaagtgcaagcctctcagctgtcctcattgcctcaaatggtggcttcaactcggctgcccgtagatcctgccccaccttgcccacgtcccctccctacgtcttcaacaagctcactcgcccctgtgtctggctctggccctgggccatccccggcacggagctcccctgtgaacaggcccagttctgctacaaataaagctttgtcacctgtgacctccagaacccccggtgttgtggcctccgcaccaaccaagccccagtctcctgcccagaatgcaactagttcccaggactcctcccaggacacactgactgaacagattactcttgaaaaccaggtccatcagcgcattgctgaattgcggaaggcgggtttatggagccagcgcaggctgccaaaattacaggaggctccgcgaccaaaatcacactgggactatctgctcgaagaaatgcaatggatggcaacggatttcgcccaggagcgccgttggaaagtggccgcagctaagaagctggtgagaactgtcgttcgtcatcacgaggaaaaacagctgcgtgaggagagaggtaagaaggaggaacagtcgaggctgaggcgaattgccgctagtacagcgagggagatcgagtgtttctggagtaatattgagcaggtcgtggagatcaagctgcgcgttgagcttgaggagaagcgcaagaaggctttaaatctccaaaaggtttcccggaggggcaaggagctccgccctaaagggttcgatgcgttacaggaaagctctctggattccggaatgagtggcaggaagagaaaagcttccatttccctgacagacgacgaggtggacgacgaggaggagactatagaggaagaagaggctaacgagggcgtggtggaccatcagacagagctaagtaatctggcaaaagaagccgagctgcctcttctggacttaatgaagttgtacgaaggggctttccttccttctagccagtggccccgtcctaaaccagacggggaagatacatccggggaggaggacgccgatgattgtcctggggatcgggaaagtaggaaggatttagtcttgatagactccctgttcatcatggaccagtttaaggctgctgagagaatgaacatcgggaaaccaaacgccaaagatatcgcggatgtcacagccgttgccgaagctatcctgccgaaaggctccgcacgcgttacaacttccgtgaaattcaacgcaccatctttactgtacggagcgctgagggattatcagaagattggtctggactggctggccaagctgtacaggaagaacctgaacggaattctggccgacgaggctggattggggaagaccgttcaaatcatagcgttttttgcgcatcttgcatgtaacgaggggaattgggggcctcacctggttgtagttagatcttgcaatatactgaaatgggaattggagctgaaaagatggtgtcccggtttgaaaattctgagttacattggctcccatagggagctgaaagccaaacggcaggagtgggcagagcccaattctttccacgtgtgcattacgtcctatactcaatttttccggggtttgaccgctttcacgagagtgcgctggaaatgccttgtgatcgacgaaatgcagagggtgaaaggaatgacagaaagacactgggaagccgtgtttacactgcagtctcagcagagactgctgctcatcgattccccccttcataataccttcctggaattatggaccatggtccacttcttagtccctggtatatcccggccatatctgtctagcccattaagggctccaagcgaagaaagccaggattactatcacaaggtcgtcattcgcttacatcgagtgacccaacccttcatcctcagacgcactaaaagagacgtggaaaaacaactgaccaaaaaatatgaacatgtcttaaaatgcaggctctcaaaccgacagaaagctctgtatgaagatgtgatcctgcagcctggaacccaggaggccttgaaatccgggcattttgtgaacgttctcagcatcctggttcgcttgcagagaatctgcaatcaccctggtctggtggagccaaggcatcctgggagctcatatgtggccggtccactagagtacccgtccgcgtccctaatattgaaggccctggaacgggacttttggaaagaggccgaccttagtatgtttgacctgataggattggaaaataagatcactcgacatgaggcagaactcctgtctaaaaagaagatacctcgaaaactgatggaggagatctcaacatcagcagccccagcggctcgccctgctgccgcaaaactcaaagcatcgcgtctgtttcaaccagtgcaatacgggcagaaacctgaggggcgaacagtcgcctttcccagcacccaccccccaaggactgcagccccaacaacagctagcgccgcacctcaggggccattacgagggagacccccaatcgcaacgtttagcgccaatcccgaggctaaggcggctgccgctccgttccagacaagtcaggccagtgcatcagcacccagacatcagccagccagtgcaagctccactgcggcatcccccgctcatccagcaaagctaagagcacaaacaacggctcaagctagtaccccagggcagcctcctccgcagccgcaagccccaagccacgcggcaggtcagtctgcccttccacaaagactggtgttacccagccaggcccaagccagactcccatccggcgaagttgttaaaatcgcgcagctcgcttctattactggccctcaatcaagagtggcacagcctgagactcccgttacgcttcaattccagggatccaagtttactttgagccacagccaacttcgtcagctgacagctggtcagccactgcaactgcagggatccgttcttcagatcgtctcagcccctgggcagccatacctgcgcgcaccgggacctgtggtaatgcaaaccgtgagtcaggctggagccgttcatggggcactgggtagtaagcctcccgcaggagggcctagccccgctcccctcaccccacaggtgggtgtccctggacgggtcgctgtgaacgccctcgcggtcggggagccagggacagccagtaagcctgccagcccaataggcggtccgacccaggaagagaagaccagattgctgaaagagaggctagatcagatctatttggtgaacgagcgacggtgttcccaggcgccagtatacggacgggatctcctccggatctgcgcgctgccaagccacggtcgggttcagtggagaggatccctggatgggagaagaggcaaggaagcagggcctgcgcattcctataccagctcgtccgagtcgcctagcgaactcatgctgactctttgtaggtgcggggaaagtctgcaagacgtgatcgaccgggtcgcatttgtcattccccctgttgtggccgcacccccttcgcttagggttccccgtcctccacctctgtatagtcatcgcatgagaattcttagacaggggctgcgcgagcacgccgcaccttatttccaacagctccggcaaacgaccgctcctcgcctcctgcagtttcctgagctacggctggtgcagttcgactctggaaagttggaagcactggctatactcctgcagaaactaaaaagcgagggtagacgagtcctaatcctgtctcagatgatcctcatgctggatatcttggagatgtttctgaacttccactatctgacctatgtcaggattgatgagaatgcttccagcgagcagaggcaggaactgatgcgatcctttaatagagaccgcaggatcttttgtgcgattttgagcacacactcacggacgactgggattaacctcgtggaagccgatactgttgtgttctatgataacgatctgaatccagttatggatgccaaagcccaggagtggtgcgatcggattgggagatgcaaggacatccacatatatcggttagtctctggtaattcaatcgaggaaaaactgttgaagaacgggacaaaggatttgatcagagaagtagcagcccagggcaatgactattccatggcatttctgacgcagcggacaatccaagaattgttcgaggtgtactccccaatggacgacgccggttttccagttaaagccgaagagtttgtggtcctgtcacaggaaccaagcgttaccgaaactatcgccccaaagattgccaggccctttatcgaagcgctgaagagcattgaatacctcgaggaggacgcccaaaaatctgctcaagagggagtgcttggtccccatactgatgcccttagcagtgattctgagaacatgccttgcgacgaggagccgtcacagctggaggagctggcggacttcatggaacaactgacaccgatcgaaaagtatgccctgaactacttggagctcttccacactagcattgaacaagagaaagagcggaactccgaggacgctgtaatgaccgcagttagggcttgggaattttggaaccttaaaacactgcaggagagagaagcacgcctgaggctggagcaagaggaggcggagctgttaacgtacacaagagaggacgcttactccatggagtatgtgtacgaagatgtcgatggccagacagaggtaatgcctctctggacccctcccacacctccccaggatgactccgacatttatctggattccgtaatgtgcctcatgtatgaggcaacaccgatcccagaagcaaaattgccaccggtgtatgtgagaaaggagcggaaaagacataaaacggacccctccgcagctggacgtaagaaaaaacagcgtcatggggaggcggtagtgcctcccaggtcgctttttgaccgtgctacgcccggtcttctgaaaattaggcgagaaggtaaggagcagaaaaagaatatcctcctcaaacagcaggtgcctttcgcgaagcctctccctaccttcgccaaacccaccgccgagcctggccaagacaaccccgagtggctcatttcagaggactgggcactactgcaggctgtaaaacagctgttagaactgccgttgaacttaactattgtatctccagcgcacactcccaactgggatcttgttagtgatgttgtgaattcttgtagcaggatctacagaagttccaagcagtgtcgcaatagatatgaaaacgttatcatccctagggaggagggaaagagtaagaataatcggccactgcgtaccagtcagatctacgcacaggacgaaaatgcaacccacacacaattgtatactagccattttgacctcatgaagatgacagcaggcaaacgtagtccccctattaaaccactgctgggtatgaaccccttccagaagaatcctaaacacgcaagcgtactcgctgaatcaggtatcaactacgataaacccttaccacctatacaagtggcaagcctccgagctgaacgcattgcaaaggagaagaaggcattagctgaccagcagaaggctcagcaaccagctgttgctcaacccccaccgccacaaccgcaacctccccctccgcctcagcagcccccacccccactgccacagccccaggctgcgggaagccagcctccagcaggccctcccgctgtccaacctcagccacaaccccagcctcagacccagcctcagcccgtccaagccccagccaaagcccaacccgctatcacaacgggtggttctgctgcagtactcgctggcaccatcaagaccagtgtcaccggtacctctatgcccacaggagccgtttccggcaatgtgatcgtaaacactattgccggtgtccccgcagccacctttcagagcatcaacaaacggctggcaagccctgtggcgcctggtgcacttaccacacctggcggttccgctccagcccaagtcgtgcatacgcagccccctcccagggcagttggttctcctgctacagctacacccgacttagtgtcgatggccacgactcagggggttcgggcagtcaccagcgtcacagcttctgccgtggtcaccaccaacctcaccccggttcagacccctgcgcgttctctcgtccctcaggtgagtcaagcgaccggggttcagcttcctgggaaaacaatcacacccgcacacttccaactactcagacaacagcagcaacagcagcagcagcagcagcagcagcaacagcagcagcagcaacagcagcaacagcaacagcagcagcagcagcagacaactacaacatctcaggtgcaggtgccacaaattcaaggtcaagcccagtcaccagctcagattaaggccgtgggaaaattgactcctgaacatctgattaagatgcagaagcagaaactacagatgcccccacaacctccgcctccgcaggcacagtccgctcctccacaaccaacagcccaggtgcaggtccaaactagtcagccacctcagcagcagtctccgcagctgacgacagtcacggcaccaaggccgggagctctcctgaccggcaccacagtggcgaatttgcaggtcgcaaggctgacacgagtgcccacttctcagcttcaagcccagggacaaatgcagactcaggcccctcagcccgctcaggtggctttagccaaacctcccgtggtcagcgtgccggctgccgtagtcagtagccccggagttactactttgcccatgaacgtcgcaggcatatctgtggcgattggacaaccacagaaagcagcaggtcagaccgtggtagcccagcctgtccacatgcaacagctgctgaagctgaagcaacaagcagttcaacaacaaaaggccatacagccgcaggcggctcagggccctgccgcagtccagcagaaaatcacagctcagcaaatcactacacctggcgcacagcaaaaggtggcatacgccgctcagccagctcttaaaacccagtttttgaccaccccaatctctcaggcgcagaaacttgccggagcacagcaagtccagacacagattcaggttgccaaactgccccaagtagtgcagcagcagactcccgttgcttccattcagcaggttgcatccgcgtctcagcaggcaagcccccagacagttgctttaactcaggccaccgccgcaggccagcaggttcagatgatcccagctgtgacggccacagctcaggttgttcagcagaaactcatccagcaacaagtggttactaccgcttcagctccactccagacaccaggggctcctaaccccgctcaggttccggcatcatccgatagtcctagtcaacaaccgaaattgcagatgagggtccctgctgtgaggctgaaaacaccaaccaaaccaccttgtcagta

SEQ ID NO: 221606 - DNA, 1314 bp, Artificial Sequence
  Description of Artificial Sequence: Synthetic coding sequence
atgctgcaaggccctagggcgttggccagtgctgccggacagacaccaaaagtcgtgcctgccatgtcaccgaccgaactgtggccctctggactgtccagcccacagctctgcccagccacagccacttactatacaccactgtatccacagacggccccacctgctgctgccccaggcacatgcctcgacgctacgccacacggacctgaagggcaggtggtgaggtgtctgcctgcgggtcggctcccagccaagagaaagctggacttggaaggaattggccgaccagtggtgcccgaattccctacccctaaaggaaaatgcatccgggtggacggacttccaagccccaaaacacccaagtcgccgggtgaaaaaacgaggtacgatacgtcgctgggactgctgaccaagaaatttatctacctgctttcagaaagcgaggacggggttctcgatctaaactgggccgcagaggttctggacgttcaaaaacggagaatatacgacataaccaatgtgctagaaggaatacagctcattcgaaagaaggctaaaaataatattcagtgggttggcaggggcatgtttgaagatcccactagaccgggaaagcagcagcagttgggtcaggagttgaaagagctgatgaacaccgaacaggcactcgatcaacttattcagagctgtagcctcagcttcaagcacctgaccgaagataaggctaacaaacgccttgcctatgtgacgtaccaagacattcgcgctgtaggaaattttaaggaacaaactgttatagctgtgaaagcaccacctcagactcggcttgaggtccctgatagaacagaagataacctgcagatttatctcaaaagcactcaggggcctatcgaggtctacctgtgccccgaggaggtccaggaacctgattcgccatccgaggaaccactcccttcgactagcactctgtgcccgagtccagactccgcccaaccctctagcagcactgacccatccatcatggagccgactgcttcatcagtcccggctcccgcacctacgcctcagcaggcgcctccgcctccctctctcgtccctctggaagcaaccgacagcctcttggagctgccccaccctctgcttcagcaaaccgaagatcagttcttgtcccctacactggcatgtagcagccctttgatttccttctccccctctctggaccaagatgactacctttggggcttggaggcaggggaagggatttcagaccttttcgacagttacgatcttggggatttgttgattaactag

SEQ ID NO: 221607 - DNA, 1398 bp, Artificial Sequence
  Description of Artificial Sequence: Synthetic coding sequence
atgcgtaaaggcatacaaccggctttagaacagtacctggtgactgccggtgggggagagggtgccgcagttgtggctgctgccgctgccgcaagtatggataaacgcgctctactagctagtcctggtttcgcggctgcggctgccgcagccgctgcgccaggtgcttatatccaaatactgacaactaatacctccacgacctcttgttccagctcattgcagtcaggcgctgtggcagccggaccgttactgcccagtgccccaggagccgaacagaccgccggatctcttctgtacacaacaccacacggtcccagttcgagggcaggcctgctccagcagcccccagccttaggccgtgggggttccggcggagggggaggacctccggctaaacgcaggctggagctcggagagtccgggcatcagtatcttagcgatggactgaaaacacctaaagggaagggcagagccgcactgaggagcccagactctcctaagacacccaaaagcccttccgagaagactcgctatgacacaagcttgggcttgctgacgaagaagttcatccagctgctgtctcaatcacccgacggcgtgctggatttgaacaaggccgctgaggttttaaaagtacagaaacgcaggatctacgatatcaccaacgtgttagaaggaattcacctcataaagaagaaatctaagaataacgttcagtggatgggctgcagcctgtctgaggatggaggaatgcttgctcaatgccaaggactgtccaaagaggtgacagaattgtctcaggaggaaaagaagttggacgagctcattcaatcatgtactctcgatctgaaactcctcactgaggattcagagaatcagaggctggcatatgttacgtaccaggacatccgcaaaatatctgggctgaaggaccagacagtgatcgtcgtcaaagcaccccctgaaacgcgtctcgaggtgccggactccattgagtcattacaaatacaccttgcaagtacccagggccctatcgaggtttacctttgccctgaggaaaccgagactcactctcccatgaagactaacaaccaagatcacaatggcaatattcccaaacctgccagcaaggatctggcgtcaacaaatagcgggcattccgactgttccgtgagcatgggcaatctcagtcccctggcttctcccgcaaacctcctgcagcagacagaagaccaaatccctagcaacctggagggacccttcgtgaacctcctccctcccctgctccaggaggattatctccttagcctgggtgaggaggaaggaatatccgatctgtttgacgcgtacgacctggagaagttgccgttagtcgaagacttcatgtgttcctag

SEQ ID NO: 221608 - DNA, 387 bp, Artificial Sequence
  Description of Artificial Sequence: Synthetic coding sequence
atggacaagcgggctctcctcgcaagtggagggggtggaggtccgcctgcaaagcgcagactggagcttggagagtccggccatcagtacctgagtgacggcctgaaaaccccgaaggggaagggcagggctgccctccgctcacccgattcccctaagaagaagacccgatatgacacatcgctcggtcttcttacaaaaaaatttatccagttgctgagtcagtctccggatggggtcctggacttaaacaaagcggcagaagtgctgaaggtacagaagcggcgaatctatgacatcaccaatgtgctcgaagggatcagtgacctgttcgatgcatacgatctggagaagcttccactggttgaggactttatgtgttcatag

SEQ ID NO: 221609 - DNA, 1005 bp, Artificial Sequence
  Description of Artificial Sequence: Synthetic coding sequence
atgccactgcagcagcaggctaaaaggcggctagagttaggggagagcggccaccagtatttgtcagatgggctcaagacccctaaaggtaaggggagggccgcactgcgctcccctgatagccctaagaagaaaacccgctacgataccagcctcgggctgctgactaaaaaatttatccagctgctgtcccagagcccagacggggtactcgatttaaacaaggctgccgaggtgcttaaggtacagaaaaggcggatctacgacattaccaatgtactggagggaatccacctgataaagaaaaaatctaagaataatgtccagtggatggggtgttcgctgagcgaagacggaggcatgctggcccagtgccaagggctgagcaaggaggtaaccgagctcagtcaagaggagaaaaagctggatgagctaatccagagttgcactttagacctcaaactgctgactgaggattcagagaaccagagactggcctacgtcacatatcaggacattcggaaaatctcaggactcaaggaccaaaccgttatcgtggtcaaggcccctcccgaaacccgattggaagttcccgattcaatcgagagcctgcaaattcacctggcatcaactcaggggcctattgaggtttacttgtgccctgaggagactgagactcattctcccatgaagaccaacaatcaagaccataatgggaacatacctaagcctgcttctaaggatcttgcttctacaaattcaggccacagtgactgttcagtctctatgggcaacctgagccctctggccagtcccgcaaatcttctccagcagaccgaagaccaaatcccgagcaatttggaaggacctttcgtgaacctcctgcctcctttacttcaagaggactatctcttgtccctgggcgaggaagaaggtatctccgatctttttgacgcgtatgatctggagaagctacctctggtggaagactttatgtgctcctag

SEQ ID NO: 221610 - DNA, 2736 bp, Artificial Sequence
  Description of Artificial Sequence: Synthetic coding sequence
atggaagtgaattgtctgacgctgaaagatcttatttcaccgagacagcccagactcgactttgccgtggaggatggggagaatgcgcaaaaggaaaacattttcgtggatagaagccggatggcaccaaaaactcctatcaagaacgaacccattgacctgtccaagcagaagaagtttactcccgaaagaaatcctatcactcccgttaaattcgtggacagacagcaagctgaaccctggaccccgacagccaatctcaaaatgctcatcagcgccgcatcaccagacatccgagatcgggaaaagaaaaagggcttgttcagacctatcgaaaataaagatgacgcatttacagacagcctgcagctggatgtggtgggcgacagcgcagtggatgagtttgagaaacagcgaccgagccggaagcagaagagcctgggcctgttgtgccagaaatttctcgcgagatatccatcataccccctgtctacagagaagacaactatcagcctagatgaagtcgccgtatccctcggtgtggagcggaggaggatttatgacatagttaatgtgctggagagtctccatctggtatccagggtagcaaagaaccagtatgggtggcacggtcgtcattcactacccaagaccctgcgaaacctgcagcgtctgggagaggaacagaagtacgaggagcaaatggcgtacctgcagcaaaaggagctagatttaattgactacaagtttggtgagcgcaagaaggacggtgatcccgattcccaggagcagcagttacttgatttttcagaacctgattgtccatccagttcagccaacagccgcaaggacaagtccctgagaattatgtcccaaaagtttgtgatgctcttccttgtgtccaagaccaaaatcgtgaccctggacgttgccgctaagattttgatcgaggagagtcaggatgctcccgatcatagtaagtttaagactaaggtcagaaggctctatgacatagcaaacgtcctaacatcgcttgcactaataaagaaggtgcacgtgacggaggagcgcggtcgcaaacccgcatttaagtggattggcccagtagatttcagttcttctgacgaagaattggtcgatgtgtctgcctcagtgctcccagagctaaaacgagaaacgtatggacaaattcaagtgtgtgccaagcagaagctggcacgacatggctcctttaatactgtccaggcttctgagcgcattcagcggaaggtgaacagtgaaccctcgtccccctatcgcgaggaacaggggtctgggggatactcacttgagatcggctctcttgctgctgtctaccgtcagaaaattgaagataattcccaaggaaaagcttttgcaagtaagagggtcgtgcctccgtcctcttctctggaccccgtggctcctttccctgtgctttccgtggatccagagtactgcgtcaatcctcttgcccaccccgtcttttctgtcgcacagaccgatctccaggctttttcaatgcagaatgggcttaatggacaggttgacgtgagccttgcctcagcagccagcgcggtcgaaagcttgaagccagccctgctggccggacagccacttgtctatgtcccaagtgccagtctgttcatgctgtacgggtcgctgcaagaagggcctgcatctggatccggctcagagcgggatgatcggagttcggaagcacctgcgacagtcgagctgtcgagcgccccaagtgctcaaaaacggctgtgtgaagaacggaagccccaagaggaagacgagcccgctaccaagcgccaatcaagggaatatgaggatgggccactgtccttggtcatgccaaagaagccttccgactctacggatctcgcaagtccaaagactatgggcaaccgggctagcatcccacttaaggatattcacgtgaacggacagctcccggcagcagaggaaatctccggtaaggcgactgccaactcactggtgtcatccgagtgggggaaccctagcaggaatacagatgtggagaagcctagcaaggaaaacgagtcaaccaaagagcccagccttctgcaatacctgtgcgtgcagtcccccgcagggctcaatgggtttaacgtactcctctcggggtcccaaaccccacctaccgtcggaccttcctccggacagctgccatccttttcggtaccttgtatggtgctgcctagccccccacttggcccatttcccgtgctctatagtccagccatgccgggtcctgtgtcatccactctgggggctcttcccaacaccggcccagttaatttctctctccctggacttggctcaatcgcgcagttgctggttggccctactgcggtggttaaccctaagagttccaccctcccttccgctgatcctcagctgcagtcacagcctagtttgaacctgagcccagtcatgagtcgctcgcattccgtggtgcagcagccagagagtccggtttacgtaggccacccggtttcggtggtgaaacttcaccagtcgccggtgcctgtgactcccaaatctattcaaaggacacaccgtgaaacatttttcaaaacgcccggtagcttgggggatccagttctcaaacgtcgggagaggaaccagtcacgtaacacttcctcagcacaacggagattggaaattccttcaggaggagccgactag

SEQ ID NO: 221611 - DNA, 1149 bp, Artificial Sequence
  Description of Artificial Sequence: Synthetic coding sequence
atgcaaaacgggctaaatggccaggtggatgtcagcctagcatctgctgcttcagctgtggagtccttaaaaccggcattgctggccggacagcctctcgtgtatgtcccctcggcttcactctttatgctttatggatctctgcaggagggacctgccagtggttccggctctgaaagagatgaccgttcctctgaagccccagccaccgtggagctctctagcgcgccatcagcgcagaaaagattgtgtgaagagcggaagccacaggaggaggacgagccagcgacgaaacggcagtcacgggagtatgaggacggacctctttcgctggttatgcccaaaaaacccagcgattctacagatcttgccagccccaagactatgggtaatagggcttcaatccctctgaaagacatccacgttaacggtcagctccctgctgccgaggaaatcagtggaaaggcaactgcaaattccctcgtaagtagcgagtggggtaacccttcccggaacaccgacgtggaaaagccttcgaaggaaaatgaatctacaaaggagccaagtttgctgcaatatctgtgtgtccaatcaccggcaggcttgaacggtttcaacgtcctactctcaggatcgcaaaccccacccacagtgggcccatcttctggccaactcccttcttttagtgtgccgtgcatggtcctaccatcacctccactgggcccattccctgtactctacagccctgccatgcccggacccgtttccagtaccttgggctcaatagcccaactgttggtcggacctacagcggtggtgaatcctaagtctagcacccttccctcagctgatcctcagttgcagtcacaacccagcctcaacttaagtcccgttatgtcaaggagtcacagtgtcgtacagcaacctgaaagccccgtgtacgtggggcacccagtgtctgtagtcaaactccatcagagtccagtcccagtgacaccaaagtcaatccagaggactcaccgtgagacttttttcaaaacccctggttcactgggtgaccccgtgcttaagcggcgagagcggaaccagtcgagaaacacaagctcagctcagcgaaggctggagatcccctctgggggagcggactag

SEQ ID NO: 221612 - DNA, 2187 bp, Artificial Sequence
  Description of Artificial Sequence: Synthetic coding sequence
atggaggtgaactgcctcactctgaaagacctgatcagcccacgccagcccaggttagattttgcggtagaggacggtgaaaatgcccaaaaggagaatatatttgttgacaggtcacgcatggctcccaagactcctataaagaacgaaccaatagaccttagcaagcagaaaaagtttacacccgaacggaatccgatcactccagtgaagttcgtggaccgccagcaggccgagccttggactccaacagcaaatctcaaaatgctaattagcgccgcttctccggacatccgggacagagaaaagaagaaaggcctgttccgaccaattgaaaacaaggacgatgcctttactgattccctccagctcgacgtggtcggcgatagtgccgtggatgaatttgagaagcagcgtcccagccgcaaacagaagtccctaggcttactgtgccaaaagtttttagctcggtatccgtcttaccccttgagcaccgagaagaccacgattagtctggacgaagttgccgtttcactgggagtggagcgtcggagaatctacgatatcgtgaacgtgctggagtcgctgcatcttgtgagtagagtcgcgaagaaccagtacggctggcacgggcgtcacagccttcccaagacactgaggaacctgcagagattgggagaggagcagaaatacgaggaacaaatggcctatcttcagcagaaggagttggacctcattgattacaaatttggggaaagaaaaaaagacggagacccagactctcaggaacagcagctgctggacttttcagaaccagattgtccatcctcatcggcaaattcccgtaaagataagtccctgagaatcatgagccaaaagttcgtgatgttgttcttagtttctaaaacaaagatcgtcaccctggatgtggctgctaagattttgatcgaagagtcgcaggatgccccagaccattccaaatttaagactaaagttcgccgattatacgacattgccaacgtacttacgtctctggcattaatcaagaaagtccacgtgacagaggagcgcggacgcaagcccgcattcaagtggatcggcccagtggacttctccagttcagacgaggaactggttgatgttagcgcctccgtcctgcctgagctcaaacgcgaaacttatggtcagattcaggtgtgtgccaagcaaaagctagctcggcatggctcgttcaatacagtccaggccagtgagagaatccagcgaaaggtcaactctgaaccttcgtccccatatcgagaggagcagggctcgggagggtacagtctcgaaatcggctctctggcagccgtctaccggcagaaaatcgaggataactctcagggaaaagcatttgcctccaagagggtcgttcccccaagcagctccctggatccggttgcgccatttcctgttttgagcgttgatccggaatattgcgtgaatcccttggcccatcccgtgttcagcgtggcccagaccgatcttcaggcattttccatgcagaacggcttgaacggccaggtggacgtttctctggcttcagccgcttctgcggtcgaatccttaaaaccagccctcctggccggacagcccctggtttacgtgccaagcgcatcactattcatgctgtacggcagcctccaggagggccctgcaagcggaagtggcagcgaacgggatgatagatcgtcagaggctcctgccactgtggaattgagttctgcccctagcgctcagaagcgcctgtgcgaggagagaaaaccacaggaagaggacgagccagcaactaagagacagtcccgcgaatatgaggatggcccattatccctcgtgatgccgaagaagccatctgactctactgacctggcctctcctaagacaatggggaaccgcgcatccatacccctgaaagacatccacgtaaatgggcaattacctgccgctgaagagattagcgggaaggccacagctaatagcctggtgagctctgagtggggaaaccccagcaggaatacagatgtcgagaagccctctaaggagaatgagagtaccaaggaaccatcccttcttcagtacctatgcgtccagtctccagccgtcacaagttcctccgatccccaggaacaccctactcacacatcctag

SEQ ID NO: 221613 - DNA, 348 bp, Artificial Sequence
  Description of Artificial Sequence: Synthetic coding sequence
atggaggtcaactgcctcacgctgaaagatctgatcagcccacgacagcccaggttggatttcgccgtcgaggacggagaaaatgcccagaaggagaatatctttgttgatcgtagccggatggcccctaagactcccatcaaaaacgaacccatcgacctgtcaaaacagaagaaattcacgcccgagcgaaaccccatcacacccgttaaatttgtggataggcagcaggccgaaccatggacacccacggcgaatctcaagatgctgatatcagctgcttctcctgatatcagagatagagagaagaagaaggggctattccgcccaattgagaataaagactag

SEQ ID NO: 221614 - DNA, 2604 bp, Artificial Sequence
  Description of Artificial Sequence: Synthetic coding sequence
atggaaaacgagaaagagaacctgttttgcgagcctcataagaggggcctaatgaagacccctttgaaggagagcacaacagcaaatatagtgctggctgagatacagcctgactttggacctcttactacacccaccaagccaaaagagggcagccagggcgagccctggacccccacggctaatctgaaaatgctgatctcagcggtttctcctgaaatacgcaaccgtgaccagaaacgcggtctgtttgataaccgctccggcctgcctgaagctaaagactgtatccacgaacatttgagtggtgatgagtttgagaaatcccagccgtcacgaaaagagaagtcattggggctgctgtgtcacaagtttctcgctcgctatccaaattaccccaatcccgcagtgaataacgatatctgcttggatgaagtcgccgaagagttaaacgtcgaacggcgacggatttacgatatcgtgaatgtgttggagtccctgcacatggtgagtcgactggccaaaaaccgttacacttggcacggtaggcataatctgaacaagactctgggcacactgaaatctatcggagaggaaaacaagtacgctgaacaaattatgatgattaaaaaaaaggaatacgaacaggaatttgatttcatcaagtcttactcaatagaggatcatattattaagtccaatacgggaccgaatggccaccccgatatgtgttttgtcgaactgcccggagtcgaatttagggcagcatcagtcaatagtcggaaggataagtccttaagagtgatgtctcaaaagttcgttatgctttttcttgtgtccacccctcagattgtctctttagaggtggccgcaaagatccttattggcgaggatcacgtcgaagatcttgacaagagtaagttcaaaactaagatccggagactttatgatattgccaacgtcttatctagtctggatctgatcaaaaaggttcatgtgaccgaggagaggggaagaaaaccagcatttaagtggacaggccctgagatctcccctaacacttctgggtcctcacctgttatccacttcacccccagcgatcttgaagtgaggcggagcagcaaagagaactgtgctaaaaacctattctccacacggggtaaacccaacttcactcggcacccatctctgatcaagctcgtcaagtctattgagtccgacagacggaaaattaattccgcaccttctagtccaataaagactaataaagctgagagctcccagaactcagctccctttccctcgaagatggcgcagttagccgctatctgcaaaatgcaactggaagaacagtcttctgagagccgccaaaaggttaaggtgcagctggctaggagtggaccttgcaaacccgtggctcctcttgatcctccagtgaacgctgaaatggagcttaccgctccaagcctcatccagccactgggcatggtccctctgataccatctcctttgagtagtgccgtgccccttatactgccccaggccccatcagggccttcatatgccatttatttacaaccaacacaagcgcatcagtcggtaacacctccgcagggcctgagtccaaccgtctgtacgactcattcatccaaagcaaccggatctaaggactccaccgatgccacgacagaaaaagctgcaaacgatacctccaaggccagtgcctccacacggcctgggagtctgctgcctgctccagaacgtcagggcgctaagagccggactcgggagcctgccggagagcgtggatcgaagagggctagcatgctagaagactccgggtccaaaaagaaatttaaagaggatctaaaaggcctggagaatgtgtcagcaacactgttcccaagcggataccttattccactgacccagtgttcttctctgggcgcagaatctatcctgagtggtaaggagaacagctcagccctgagtcctaatcaccggatctactccagcccaatcgcaggggttatacccgtgacatcaagtgaactgacagctgtcaactttccatctttccacgttactcctctgaaactgatggtgtcaccaacctcagttgctgcggtcccagtaggaaattccccagccttagcctcgagccatccagtaccaatccagaatccatctagtgccatcgtgaatttcacccttcagcaccttggtctaatctctcctaatgtgcaattaagtgcatcacctgggtccggcattgtgcccgtctcccccaggattgagtcagtcaacgttgcaccagagaatgcgggaacccaacaaggacgtgcaaccaactatgacagtcccgtccctggtcaaagccaacccaacggccagagtgtggcggtcacaggagcgcaacaacccgttcccgtgacccctaagggctcacagctcgtcgcagaatcattttttcgcaccccaggcggacctacaaaaccaacttctagttcctgtatggatttcgaaggagcgaataaaacttctttgggaacactgttcgtgccccaacgtaaattagaggtctccaccgaggacgtgcattag

SEQ ID NO: 221615 - DNA, 2604 bp, Artificial Sequence
  Description of Artificial Sequence: Synthetic coding sequence
atgcagaagaaaaaggaaaacctgttctgtgagccccacaagcgcggacttatgaagacacctctgaaagagtccacaacagccaatattgtacttgcagagatccagcctgactttgggcctttaactactccgaccaaaccgaaggaaggttcacagggcgagccatggaccccaacagctaatttgaagatgctgattagtgcagtgtcacccgagatccggaatagagatcagaagcggggactgtttgataacagaagtggcctccctgaagccaaggactgcatccacgaacacctgtcaggggacgagttcgaaaaatcgcagccgtccaggaaagaaaagtcccttggtctattatgccacaaatttctggctcgctacccgaattatcccaacccggctgtgaataatgacatatgtttggacgaagttgcggaggagctgaacgttgaacgtcgcagaatttacgacattgtgaatgttttggagtctctgcacatggtctctcgcctcgccaagaacagatacacctggcatgggcgtcacaacttgaacaaaacactggggactctgaagagtattggcgaggaaaataagtacgccgagcaaattatgatgattaaaaagaaggagtacgaacaggagtttgacttcatcaaatcttactccatcgaggaccacataatcaagtccaatacaggcccaaacggccatcccgacatgtgcttcgtggagttgcctggagttgaattcagagcggcttctgtgaacagccgcaaggataagagcctgcgggtcatgagccagaagttcgtgatgctgttcctcgtgtctaccccccagattgtatctttggaggtggcagctaaaatactgatcggcgaggaccacgtggaagacctggataaaagcaagtttaaaaccaagatacgcaggctgtatgatattgcaaacgtacttagctcccttgatcttatcaagaaagtgcatgtgactgaggaaagaggacggaaacctgctttcaagtggactgggccagagattagcccaaatacatcaggctcttcccctgtcatccatttcacaccttctgatctggaagtgcgtagatcctccaaggagaactgtgcaaagaatctgttttcaacacggggaaaacctaactttacaaggcacccgagcctgattaagctggtcaaaagtatagaatcggatcggagaaagattaattccgcaccaagctcgccaatcaagactaacaaggccgagagtagccaaaacagtgctccatttccgtctaagatggcccagttagcagctatatgtaaaatgcaactggaggagcagagctcagaatcaagacaaaaggtgaaagtccagttggctaggtctggtccttgtaagccagtcgcccctctcgatcccccagtgaatgctgagatggagctgactgctccgagcctcattcagcccctcggcatggtccccctgattcccagcccactgtcctctgcagttccgctgattctgccccaggccccaagcggccctagttacgccatctatcttcaacctacacaggcccaccaatccgttactccccctcagggactgagtcctacagtgtgtacaacgcattctagcaaggctactggatcaaaggactctacagacgccaccactgagaaggccgctaacgacacttcaaaggctagtgcctccacccggcctggcagcctgcttcccgctcccgagagacagggagctaaatcaagaacacgggaacccgctggggaaaggggtagcaaaagagcttctatgcttgaggatagcggcagtaagaaaaaatttaaagaagatctgaaaggactggagaatgtctcggccacgctgtttccatcagggtacctgattcccctgacacagtgttccagcctcggagccgaatctattctcagcggcaaggagaattcatctgcgctgtcccctaaccataggatatattcttctcccatcgctggagtaatccccgttaccagcagtgaacttaccgcagtgaacttccctagctttcacgtcaccccactgaaattgatggtaagtcctactagcgtcgccgctgtcccggtggggaactctcccgcactggcttctagccacccagttcctattcagaatccaagcagtgctattgttaatttcaccttgcagcatctgggattaatcagtcctaacgtgcagttgagcgcatcccctggtagcggcatcgtgccagtgtctcctcgaattgaatcggtgaacgtggcaccagagaatgccggaacacaacaggggcgtgcaaccaactacgatagcccagtccctgggcagtcccagccaaatggccaatctgtggctgttacgggtgcccaacagccagtgcctgtaacacccaaaggctcgcaactcgtggcagagtcatttttccggactccaggcggaccgacaaagcctacctcatcctcatgcatggactttgagggcgcaaataagacctccctaggcacactattcgttccccagcggaagctggaagtttcgactgaggatgtccactag

SEQ ID NO: 221616 - DNA, 2604 bp, Artificial Sequence
  Description of Artificial Sequence: Synthetic coding sequence
atggaaaacgagaaggagaacttgttttgtgagcctcacaagcggggactgatgaaaacccctctgaaggagagtaccacggccaatatagtcttggcagagatacagcctgacttcggaccactgaccaccccaactaaaccaaaagaagggtctcagggggagccatggacccccacggctaacctgaagatgctgatcagtgcagtctctccggaaatccgcaacagagatcagaagcgcggtctctttgacaataggagcggcttgccggaggccaaggactgtatccatgagcacctgtctggggatgagttcgagaagtctcagccttctcgcaaggaaaagagcctcggtttgctgtgccataaattcctggcaaggtatccaaactacccaaacccagctgtgaataacgatatatgtttggacgaggtggcggaagaactgaatgttgagaggcggagaatctacgacatcgtcaacgtcctcgagtccctgcatatggtctctcggcttgcgaagaaccgatacacgtggcacggaaggcataacctcaacaaaacactgggaacccttaagagcattggcgaagaaaacaagtacgctgaacagattatgatgattaagaagaaggaatacgaacaggaatttgacttcataaagtcctacagcattgaggaccatattataaaatcaaataccggacccaacggccatccagacatgtgcttcgtagagttaccaggggtggaatttagggccgctagtgtgaattcgcgcaaagataaaagcctgagggtgatgtcgcagaaatttgttatgctctttctcgtgtcaactcctcagattgtcagtctagaggtggccgcaaagattctgataggcgaagaccatgttgaagatctcgataaatccaagttcaaaacgaagattagaaggctgtatgacattgccaatgttctatcttcgctcgatctgattaagaaagtgcatgtgacagaggagcgtgggaggaagcctgcattcaaatggactggcccagagatatctcccaatacctctggctcgtccccggtgattcattttaccccttcagatttggaagtgcggcgttcctccaaagagaactgcgctaagaaccttttctccaccagaggcaagccgaactttacgagacacccttcacttattaagctggtcaagagcattgagtcagacaggcggaagatcaacagtgctccaagctcgcctatcaagactaacaaggctgagtccagccagaattctgcaccctttccaagtaagatggcccaactggctgcgatctgtaagatgcagttggaagagcaatcttcagagtctagacagaaggtgaaagtacagctcgccagaagcgggccttgtaaaccagtcgctccgctcgatccgcctgttaatgcagagatggaactgacagctccctcactgatccaacccctagggatggttccactgattccttcacctctgtctagtgccgtgccactgattctgcctcaggctcccagtgggccaagctatgcgatctacttgcagcccacacaggctcatcagtccgtgacacccccacaggggctgagtcctacagtgtgtacaacacatagcagcaaggctaccgggtctaaggattccaccgacgctacgaccgaaaaggccgctaacgacacctcgaaagccagtgcctcaactagaccgggatccctgctgccagccccagagcgccaaggcgcaaagtctcgaacccgcgaacccgctggagagaggggtagcaaacgcgcttctatgctggaggattcaggctcgaaaaaaaaatttaaagaagatctgaaaggactggaaaacgtctctgccaccctttttccttccggttatttgatccccttgacccagtgctcttccttgggagccgaatcaatactaagtggcaaggagaatagcagcgctctttcccctaaccacagaatttacagtagtccaatagcgggtgtgatccccgtgacgtcgtcagagctgacagccgttaacttcccctcgttccacgtcacaccactgaaactgatggtgagccccactagcgtggctgccgttccagtgggcaattccccagccctggccagtagtcatcccgttcccatacagaatccgagttccgccatcgttaatttcacattacaacatctgggcctaatcagcccaaatgtgcagctctccgctagtcctggtagtgggatcgtccctgtctcgccgcgtattgaatccgtcaatgttgccccagagaacgccggaactcagcaaggtagggctaccaactacgacagtcctgtgccaggtcaatctcagcccaatggtcagagcgtcgctgtgaccggcgctcagcaaccagtccccgtgacgcccaaaggatcacagctggtggcagagtctttttttagaacccctggtgggccaactaagccaaccagtagctcttgtatggattttgagggggctaataagacctctctgggcacactgtttgtgccgcagcgaaagctggaggtgtccaccgaggatgtgcactag

SEQ ID NO: 221617 - DNA, 2355 bp, Artificial Sequence
  Description of Artificial Sequence: Synthetic coding sequence
atggagggcgcaatggccgtacgggtaacagcagcacacacagcggaggctcaagctgaggcgggacgagaagctggcgaaggagccgtggcagcagttgccgcagcgctggcgccttccggcttcctgggtctgcccgctcctttctctgaggaggacgaagatgatgtacaccggtgcggacgctgtcaggccgagtttactgcgttagaggacttcgtgcaacacaagatccagaaggcttgccagagagcgcctcccgaggcattacctgcgacacccgcaaccacggcgttgctgggacaggaggtcgtgcccgcagctccaggacctgaggaacccataactgtggctcacatagtggtcgaggccgctagccttgccgcagatatcagccacgcctccgatctcgtgggaggaggtcacatcaaggaagtcattgtggcggcagaagcggagctgggagatggtgaaatggccgaagccccaggctcaccgcgacaacagggactcgggctggccggtgagggtgagcaggcacaggtcaaactgctcgtcaacaaagatggtcgctacgtgtgcgccctttgtcacaagacctttaagacagggagtattctgaaagcccacatggttacccattctagtcggaaggatcatgaatgtaaactgtgcggagcaagcttccgcactaagggaagcttgatcaggcaccatcgccgacacactgatgaaaggccatacaaatgctcgaagtgtgggaagtcttttcgggaaagcggggcactgacacgccatctgaaatcgctgacgccctgcacagagaaaatcagatttagcgtatccaaagatgtcgtcgtctccaaggaggacgcgagagcaggatcaggggcaggggctgccggtctagggaccgcgacgtctagcgtaacaggagagcccatcgagaccagtccagtgattcacctagtgacagacgccaaaggcacagttatccatgaggtccatgtgcaaatgcaagaactgtcccttggcatgaaggccctcgcccctgaacccccagtgagtcaggagttgccttgcagctcagagggctccagagagaatctcctgcatcaggctatgcagaatagcggcatcgtactagagagagctgctggcgaggaaggcgcacttgagcctgcccctgccgcaggttcgtctccccaacctctcgccgtagccgctcctcaactgccggtcctcgaggtacagccgttagagacccaggtcgcctctgaggcatccgccgtacccaggacccatccatgtccgcaatgcagtgaaacttttcccacggctgccactcttgaggcacacaagaggggccacacaggtcccagaccctttgcttgcgctcagtgtgggaaagcttttcctaaagcatacctgctgaaaaagcatcaggaagtgcatgtcagggagcggagattcaggtgtggagactgtgggaagctctataagaccattgcccacgtacggggacaccggcgtgtacattctgatgagagaccttacccttgtcccaagtgtggcaagcgctacaaaacaaaaaacgcccagcaggttcactttcgcacccacctggaggaaaagcctcacgtgtgccagttctgttccagaggtttcagagagaagggatccttggtacgccacgtgcggcaccatacaggcgagaagcccttcaaatgctataagtgcggacgcggtttcgcagagcatggcaccttgaatcgccatctgaggactaagggaggctgccttttggaggtcgaagagttgctcgtatctgaagactctcccgctgcggcaaccaccgtgctgactgaagatccccatacagtgctcgtggagttctcctcagtggtggcagatacacaggaatatattattgaggccactgctgacgacgcagagacatcagaggctactgagatcatcgaaggcacccagactgaagtggattcccatataatgaaggtagttcaacagatcgtgcaccaagcttccgccggacaccagataatcgttcaaaatgttaccatggacgaggagaccgctctaggacctgaagctgccgcagctgataccatcactattgccacgcccgagtcactgactgaacaggtggcaatgacattagccagtgcaatctcagaaggcactgtccttgcagcaagagccggaactagcgggaccgaacaggccacagttacaatggtttctagtgaagacatcgaaattctggaacatgcaggagagctggtgattgcgagccccgaaggacagctggaagtacagactgtgattgtttag

SEQ ID NO: 221618 - DNA, 1047 bp, Artificial Sequence
  Description of Artificial Sequence: Synthetic coding sequence
atggccgctacgtgcgagatttctaatatcttctccaattacttcagcgccatgtactcttctgaagattctacactggcaagcgtccctccagcggcaaccttcggcgctgatgacctggtgctgaccctctcaaacccacagatgtcattagagggcaccgagaaggcctcctggctaggggagcagccacaattctggtctaaaacccaggttctggattggataagttaccaggtggagaagaataagtacgatgccagtgctattgactttagcaggtgtgatatggacggtgctacattgtgtaattgtgcgcttgaggagctccggcttgtcttcggtcccctcggggatcagctccatgctcagctcagggacctgacttcatcctccagtgacgagctatcttggattattgagttgttagaaaaggacggtatggcctttcaggaggccctggatcctggaccatttgatcaggggagcccttttgcgcaggagctgttagacgatgtttcaacggccggaactggcgcatctcgttcttctcattctagtgatagtggaggttctgatgtagacctggaccccactgacgggaaactgttcccctccgatgggttccgggactgcaaaaaaggagacccaaagcacggcaaacgaaaacgcggacgccctaggaaactgtcaaaagagtattgggattgtctggagggcaaaaaatcaaagcacgctccccgaggcactcacttgtgggaattcataagagacatactaatccaccccgagttaaacgaaggacttatgaaatgggagaaccggcatgagggggtgttcaaatttctgcgctccgaagccgtcgcgcagctttgggggcagaagaagaaaaacagtaacatgacttatgaaaagctaagccgggcaatgcggtactactacaaaagggagattctggaacgtgttgacgggagacgccttgtctacaaattcgggaaaaattccagtggctggaaggaagaggaggtcttacagtccagaaactag

SEQ ID NO: 221619 - DNA, 1116 bp, Artificial Sequence
  Description of Artificial Sequence: Synthetic coding sequence
atggccgcaacatgtgaaatctctaatatcttcagcaactatttttcagccatgtactcctcggaggatagtactctggcctcagtcccgccagcggctacctttggagcggacgatctggtcctgacactttctaaccctcaaatgtctctagagggtacggagaaggcatcctggctcggcgagcaacctcagttttggagtaagacacaggttctcgattggatctcttatcaggtcgaaaaaaacaagtatgatgccagcgccatcgacttcagccgatgcgacatggatggagctacgctttgtaattgtgccctcgaagagcttcggctggtgttcggaccactgggtgaccagcttcatgcccagctgagagatcttacgtccagttctagcgacgagctttcttggataatcgaactgctggagaaggacggcatggcattccaggaggctctggaccctggcccattcgatcagggcagcccttttgcgcaagagctgctcgacgatggtcaacaggccagcccataccatccaggcagctgtggggctggagctccaagcccaggaagcagcgacgtgtccaccgcaggaaccggagcatctcggtcgagccactctagtgacagtggcggatccgacgtggatcttgatccgacagacggcaaactgttccctagtgatggctttcgtgattgcaagaagggggatccaaaacatggaaagaggaaaagagggaggccaaggaagttgtctaaggaatactgggactgccttgaaggtaaaaaatcaaagcatgcccctagggggactcacctgtgggagttcatccgagacatcttgatccacccagaactgaatgaagggctcatgaaatgggaaaatcgtcatgagggggtgttcaaattcctgcgttccgaagccgtcgcacaactctggggccagaagaaaaaaaacagcaatatgacctatgagaaactttcccgggcaatgcggtactattacaaacgtgagatcttggagcgggtcgacggaaggcggctcgtatataagtttggcaaaaactcctccgggtggaaagaggaagaagtactccagagccgaaattag

SEQ ID NO: 221620 - DNA, 1116 bp, Artificial Sequence
  Description of Artificial Sequence: Synthetic coding sequence
atggcagccacatgtgaaatttccaacatcttttccaactacttcagtgccatgtactcaagcgaggactccacactcgcatcggtgccaccggcagccacttttggcgctgatgaccttgtgctaactttatctaacccccagatgagtttggagggtacggagaaggcatcatggctgggcgagcagccacagttttggtccaaaacccaggtgctggactggatatcctatcaggttgagaagaacaagtacgatgccagcgccatcgattttagccggtgcgatatggatggtgctactctgtgcaactgcgctctggaggagctaaggctagtctttgggcctctgggtgaccagctgcacgcacagctgagggatctgacttcttcttcctccgatgaactatcgtggatcattgagttgttggaaaaggatggcatggcatttcaagaagcgctcgatcccggaccgttcgaccaggggtcccctttcgcccaggagttactggatgacgggcaacaggctagtccctaccaccctggctcttgcggggcaggtgctcccagtcccggaagtagcgacgtgtcaacagccggaacaggtgcgtcgcggtcgtcccattcctcagattccggtgggtcagacgtcgacttagacccaactgacggcaaattatttccaagtgatggcttccgagactgcaaaaaaggagaccccaaacacggaaaacgcaaacggggacgccctcgaaaactttccaaggaatactgggattgtctggagggaaaaaagagcaaacacgctccaagagggacacatctgtgggaattcattagggacattcttatccaccctgagcttaacgagggcctgatgaagtgggagaaccgccatgaaggtgtgttcaagttcttgcgctctgaggctgttgctcagctctgggggcaaaaaaagaaaaattctaatatgacgtacgagaaactttcccgggctatgcggtactactacaaaagggagattctggagagggtcgacggtcgcaggctggtgtacaaattcggcaagaatagctccggatggaaagaggaggaagtgctacagagccgcaactag

SEQ ID NO: 221621 - DNA, 1116 bp, Artificial Sequence
  Description of Artificial Sequence: Synthetic coding sequence
atggcggctacttgcgaaatttctaacatcttttctaactacttcagcgccatgtattcctccgaggattctaccctcgccagcgtgcctccagccgctacattcggggctgatgaccttgtcctcactctctcgaatcctcaaatgtccctggaaggcactgagaaagcctcttggttaggggagcagcctcagttttggtccaagactcaggtgctcgattggatctcgtatcaggttgaaaagaataagtacgatgcctccgcaatcgatttcagtaggtgtgacatggacggtgcaacgttatgcaactgtgcgctagaggagctaagactggtcttcggccctcttggagaccagttgcacgcccagctgcgagatctaacgtcgtcttcaagtgacgagctttcttggatcattgaactcctggaaaaggacggaatggcgttccaggaggctttagatccagggcctttcgatcagggcagtcctttcgcacaggaactcctcgacgatggacagcaggcgtccccctaccacccaggcagctgtggcgcaggggctcccagcccgggaagtagcgacgtctcgacagctggaacaggagcttcgaggtcgagtcactccagtgactcaggaggcagcgacgtggatctggatccgacagatgggaagctgtttccaagcgacggcttccgggattgcaaaaagggggatccaaagcatggaaagcgtaagcggggtaggcccaggaaactgtctaaagaatactgggactgtctggaaggtaaaaaatccaagcatgcccctcgcggaacacatctttgggagtttatccgcgacatcttaatccatccggaactcaacgagggactcatgaaatgggagaataggcacgagggcgtgttcaaattcctccgaagtgaagccgtagcccaactatggggtcagaaaaagaagaacagcaacatgacttacgagaaactaagcagagctatgagatattattacaaacgtgagatactcgaacgggtggacggaaggcggctagtttacaagttcggtaagaattcttccgggtggaaagaggaggaggtgctacaatctcgtaattag

SEQ ID NO: 221622 - DNA, 699 bp, Artificial Sequence
  Description of Artificial Sequence: Synthetic coding sequence
atggccgctacgtgtgagatttctaacatttttagtaactactttagtgctatgtactcttctgaggatagcaccctggcatcggttccacccgctgctacctttggcgctgacgatctcgtgctgaccctgagcaatcctcagatgtcgctggaagagaaggcatcctggctaggggaacagccccaattttggtccaagacccaagttctggactggattagctatcaggtcgaaaaaaacaaatatgacgcatccgctattgatttttctaggtgtgacatggacggggctaccctgtgcaattgcgctctggaggaactccgcctggttttcggccctctcggggatcaactccatgcacagctacgggatctcacctcatctagcagtgatgaactgtcctggataatcgagctgctggagaaggacgggatggcattccaagaggccctggaccctggacccttcgaccaggggtccccctttgctcaagaactgttagacgacggtcagcaggccagcccttaccaccccggatcttgcggagccggagctcccagccctggttccagtgatgtgagtactgctggtactggggcaagccgcagttcccattcaagcgacagcggcggtagcgacgtggatctggatccaactgacggcaagttgtttccctccgacgggttccgagattag

SEQ ID NO: 221623 - DNA, 1992 bp, Artificial Sequence
  Description of Artificial Sequence: Synthetic coding sequence
atggccatcactctacagcccagtgatttaattttcgagttcgcctccaatggcatggacgacgatattcaccagctagaggaccccagcgtttttcccgcagtcattgtggagcaggttccttaccctgacctgttgcacctctactctggccttgaattggatgacgtgcataacgggataatcaccgatggaaccctttgcatgactcaggaccaaatccttgagggtagcttcttgctgacggatgataatgaggccacttcccatacaatgtcgaccgctgaggtgctgttgaacatggagagtccatcagacatactggacgaaaagcagatctttagtacctccgaaatgctcccagattccgatcctgcgcctgcagtgaccttacctaattacctgttccctgcatccgagcctgatgccttaaacagggctggcgatactagcgaccaggagggccacagcttggaagaaaaggctagtcgagaggaatcggccaaaaaaactgggaagtctaaaaaaagaataagaaagacgaaaggaaatcgaagcaccagcccagtcaccgatccctcaatacccatccgtaaaaaatctaaagatggcaaaggttccaccatatatctctgggaattcctgctggctctactacaggatcggaacacatgtccgaagtacatcaagtggacccaacgggaaaagggtattttcaagctggtggactcaaaagccgtctcgaagctttggggcaaacaaaagaataaacccgatatgaactacgaaactatgggcagagctctcaggtattattatcaacgtggtatcctggccaaggtcgaaggacagagattggtgtaccagttcaaagagatgcctaaagatttggttgtgatcgaggacgaagacgagtcctctgaggccaccgccgctccccctcaagccagtacagcctctgtcgcctcagctagcacaacccgacggacttcttcccgagtgtcctccaggtctgctcctcagggcaaaggatcctccagctgggagaaaccaaaaattcagcacgtgggactgcagcccagcgccagtctggagctgggaccatccttggacgaggagataccaaccactagcacaatgctggtctcccctgctgaggggcaggtgaagctcacaaaggcggtttccgcttcgagcgttccctctaacatacatttgggagtcgcgccagttgggagtgggtctgctctgaccctgcagacaattccacttaccactgtgctgaccaacggcccacccgcttctacaactgcgcctacacagctcgtgctgcagtcagtgcctgcagcgagcacctttaaggacactttcaccctgcaggcctcattcccattaaatgcgtccttccaggacagccaggttgcggctcctggagccccactgattttgtcgggcctgccacagctcttggcaggtgccaatcgtcccactaaccctgcaccgcctaccgtgaccggcgcagggcctgctggaccaagtagccagccacccggtactgtgattgccgctttcatccggacatccggtactacagcagctccacgcgtaaaagaaggtccgcttcgaagcagttcttacgttcagggcatggtgacgggagctcccatggaaggacttttggttccagaggaaacgttgagagagttgctccgagatcaagcacatctgcagccactacccacacaggttgtaagccggggaagccacaatccctctttgctcggaaatcagaccctgagtcccccaagcagaccaaccgtcgggctaacacccgtggctgaattggaactgtccagcgggtcagggtcattactcatggcggagccctccgtaaccacttctggcagtctgctgacaaggtccccaacccccgctcctttctcgccatttaatccaacgtctctgatcaagatggaaccccatgatatatag

SEQ ID NO: 221624 - DNA, 1992 bp, Artificial Sequence
  Description of Artificial Sequence: Synthetic coding sequence
atggcaatcactctgcaacccagcgaccttattttcgagtttgcttcaaacgggatggacgacgacatccatcaacttgaagatccttcagtttttcctgctgtcatagtggagcaggtgccatatcccgatctgttgcatctgtattcagggttggagctagacgatgtccataatggcattatcactgatggtaccctgtgcatgacccaagaccaaattctggaaggaagtttcctgctgactgacgacaacgaagctacaagccacacgatgtcaacagccgaggtgcttcttaatatggagtccccctcggacatactggatgaaaagcaaatttttagcaccagtgagatgctgcctgatagtgatcctgcacctgcggtcaccctgccaaattacttgtttcctgcctcagaacctgatgccctcaatcgggctggggacacgtctgaccaggaaggccactccttggaggaaaaagcaagcagagaagagtccgccaagaaaacaggaaagagtaaaaaacgtattcgcaagaccaagggcaacagatccacatcacctgtcacagatccttcaatccccatacggaagaagtctaaggatggtaagggatctacaatttacctctgggagtttttgctggcccttctgcaggatcgtaacacgtgtccgaaatacataaaatggacccagagagagaaggggatctttaagcttgtggactctaaagccgtctccaagctatggggcaagcaaaagaataaaccagacatgaattatgaaaccatggggagggccttgcgctattactaccagaggggaatcttggccaaagttgaggggcaacgactggtgtatcaatttaaggagatgccgaaggatttggtcgttatcgaggatgaagatgaaagttcagaagccaccgcggctccacctcaagcatccaccgcatctgtcgcctctgcttccacaacccgcaggacctctagccgggtgagtagtaggtccgcccctcagggaaaaggctcctcaagttgggaaaagccaaaaatacagcacgtggggcttcaacccagcgcctcactggagctgggcccaagtctcgatgaagaaattccaaccacatctaccatgctggtgagcccagcagagggacaagtcaagctaaccaaggcagtctccgccagctctgtgccttctaacatccatcttggagtagcgcctgtcggatctgggagcgccttgaccctacagactattcccctgaccactgtactaacgaacgggcctccagcctctacaaccgcaccaacacaattggtgctacagtcagtgccagctgctagcacttttaaggataccttcactctgcaggctagcttccctctcaacgcctcattccaagactctcaggtcgccgctcccggagctccactgattctgtcagggctcccccagctactggcaggtgccaaccgtcctaccaaccccgctcctcccaccgtcacaggagccggacccgctgggccatcatcacagccccctggcacagtcatcgccgcattcatcaggacttccgggactacagctgctcctcgggtaaaggagggcccactgcgcagcagtagctatgtccagggaatggtaaccggagcacccatggagggcctgctcgtgcctgaggaaacgttgcgcgagctgctaagagatcaggcccatttgcagccactgccaacccaggtggtgagcaggggaagccataacccgtccctgctgggcaaccagaccttgtcacccccaagtcggcctactgtgggactaacaccggtggcggagctggaactctccagtggatccgggtcactgctgatggcagaacctagtgtgaccacctcagggagcctgctgacacggagtccgactccagccccttttagtcccttcaatcccacgagcctgataaaaatggagccacatgatatctag

SEQ ID NO: 221625 - DNA, 234 bp, Artificial Sequence
  Description of Artificial Sequence: Synthetic coding sequence
atggacgatgatattcatcagctggaagaccccagcgtcttcccagccgtcattgttgaacaagtcccctaccctgaccttctacatctgtactcaggtctggaattagacgacgtgcataacggcattattaccgacggaaccctgtgcatgacacaggaccagattctagagggcagtttcctcctgacggacgacaacgaagccacttctcacacaatgagtacggcatag

SEQ ID NO: 221626 - DNA, 768 bp, Artificial Sequence
  Description of Artificial Sequence: Synthetic coding sequence
atgctcgacagcgtcacccacagtacattcttacctaacgcgagcttctgtgatcccttaatgtcttggaccgaccttttttcgaacgaagagtactaccccgctttcgagcatcagacggcatgtgacagctactggacaagcgtgcatcctgagtattggacaaaacgacatgtgtgggagtggctacagttttgttgcgaccagtataagctcgatacgaactgtattagcttctgtaatttcaacatttcaggactccagctgtgctcgatgacgcaggaagaatttgtggaggccgcaggcctctgtggcgagtatctctatttcatactccagaatatccgcacccaaggttacagtttttttaatgacgcggaggagtccaaggcaacgatcaaggactatgccgactccaactgtttaaagacgtcaggtataaagagccaggactgtcattcacactcccgcacgtctctccagtcctcgcacctctgggagttcgtacgtgaccttttattatcccctgaagaaaattgtggcattctggaatgggaggatcgggagcagggtattttccgcgtcgtgaaatcagaggccctggccaaaatgtgggggcaacgcaaaaagaatgatcgcatgacttatgagaagttatcgcgcgcactgagatattactacaaaactggcatcttggaacgcgttgaccgacgcctagtgtacaagttcggtaagaatgcccacggatggcaagaagataagctctag

SEQ ID NO: 221627 - DNA, 798 bp, Artificial Sequence
  Description of Artificial Sequence: Synthetic coding sequence
atgccctcgctcccacatagccaccgagtgatgctcgatagcgtgacacactcaacttttctgccgaatgcttctttctgcgatccattaatgagctggaccgacctcttctcaaacgaggagtattacccagcttttgagcaccagacagcctgtgacagctactggacttccgtgcacccagagtactggactaagaggcacgtgtgggagtggctacagttctgctgtgatcagtataaactagatactaactgtatttccttttgtaactttaacatatcaggtctgcaactgtgttctatgactcaagaagagtttgttgaggctgccggtttgtgtggggaatacctgtactttattctacaaaacatccgcacccagggctacagcttctttaacgatgctgaagagagtaaagctaccatcaaagactacgccgactccaattgcttgaagacctctggcattaagtcacaggattgtcatagccactccaggacctctttgcagtcctcccacttatgggagttcgtgcgcgatctgttgctcagtcctgaagaaaactgcgggatcctggaatgggaagatagagaacaagggattttccgggttgtcaaatccgaagctcttgccaagatgtgggggcagcgcaagaagaatgatagaatgacttatgagaaactgtctcgggctctgcgttactactataagaccggcatcctagaaagggtggacagacgcctggtgtacaaattcggtaaaaatgcgcacggctggcaggaagataaattatag

SEQ ID NO: 221628 - DNA, 483 bp, Artificial Sequence
  Description of Artificial Sequence: Synthetic coding sequence
atgttagacagcgtcacccactctaccttcctgcctaacgcgtcattctgcgatcctttgatgtcatggaccgatttgttctccaacgaagaatattatcctgcattcgagcaccagacagacgcagattcaaattgcttgaagacgtctggcatcaaatctcaggactgccatagtcacagccgaaccagtctccaaagctcgcatctgtgggagtttgtgcgagacttgcttctaagcccagaggaaaactgcgggatcctggagtgggaagatcgggaacaaggaattttccgggtagtcaaatctgaagctctggcgaagatgtggggccagcgcaaaaagaacgacagaatgacttatgaaaaacttagcagagcattgcgctactactataaaactggcattttggaaagggtggatcggcgactcgtttataagttcgggaaaaatgctcacggctggcaggaagacaaactgtag

SEQ ID NO: 221629 - DNA, 1728 bp, Artificial Sequence
  Description of Artificial Sequence: Synthetic coding sequence
atgttcgggattcaggataccctgggtcgcggaccaactctcaaagagaagagcctgggagccgagatggattcagttcgtagctgggtcaggaacgtgggtgtcgttgatgccaatgtggccgcacaatcaggggtcgctctcagcagggcacattttgaaaagcagccaccgagcaacctacgtaaatctaattttttccactttgttttggccttatacgatcgccaaggacagcctgtggaaattgaaagaactgcgtttgtagacttcgtggaaaacgataaagaacagggcaacgaaaagactaataacggaactcattacaaactgcagctcctctatagcaacggtgtgaggaccgaacaggacctgtacgtacgcctgatcgattccgtgacgaaacagcccatcgcctacgagggacagaataagaatcctgagatgtgcagggtgctgctgacacacgaagtgatgtgctctcgctgctgcgaaaaaaaaagctgcggaaaccggaacgagacacctagcgacccagtcattatcgacaggttcttccttaagtttttcctgaagtgcaaccaaaattgcctgaagacggctggtaaccctcgggatatgagacgattccaggttgtactgtccacaaccgtcaacgtggatgggcacgttttagctgtgtctgacaatatgttcgttcacaataactccaagcatgggagacgcgctagaagactggatccatcagaggccacaccctgcattaaggccataagtcccagcgagggctggacgacaggcggagcaatggtcataattatcggagataacttttttgacggccttcaagtggtatttggcactatgctggtgtggtcggagctgattactccccatgcaatccgcgttcagacccccccaaggcatataccgggagtcgtcgaggtgacactgtcctataaatctaaacagttttgcaagggagctcccggaagattcatctacacagccctcaatgagcctactatcgactatggtttccaacggctgcagaaagttatccccaggcacccgggagatcctgaacgcctggcaaaggagatgctcctgaagagagcagccgacctcgtcgaggccctatacggtaccccacacaataatcaggatatcatcctgaagcgagccgctgacatcgcagaggcgctgtattcagtcccccgtaacccttcccagcttccagcattgtcctccagtcctgcgcattctgggatgatgggaatcaacagctacggtagccagctgggggtcagcataagcgagtcgacccaaggtaacaatcagggctatatcagaaatacatccagtatctcaccgagaggctattcttccagctcaaccccacagcagtctaactattccacctctagcaactccatgaatggatattctaacgtgccaatggctaacctcggagtgccaggctcaccagggttcctgaacggttcccccacaggcagcccttacggcatcatgtcatcatccccaaccgtgggaagtagctccacaagcagcatcctgccgttcagcagttctgtttttcctgctgtcaagcaaaaatcagcatttgcaccagttatcaggcctcagggctccccatctcctgcatgttcctcgggaaacggcaatgggttcagagcaatgacgggacttgtggtgccccctatgtag

SEQ ID NO: 221630 - DNA, 795 bp, Artificial Sequence
  Description of Artificial Sequence: Synthetic coding sequence
atggttataatcatcggagataacttcttcgacgggcttcaggtggtgttcggaactatgctggtgtggtctgaacttatcacccctcacgccatccgtgtgcagacgccccctagacatattcctggagtcgtggaggtgactctgagctacaagagcaaacaattttgtaagggggctccaggtagattcatctacacagctttgaacgaacccacaatagactatggattccagcggctgcagaaggtaatcccaaggcacccgggagatccagagcgtctggctaaggagatgcttctgaaacgcgctgctgacctcgtggaagccctctacggcacaccccacaacaaccaggatatcatcctaaaacgcgcagccgacattgctgaggccctgtattctgtcccacgaaaccctagccagctcccagccttgagcagcagccccgctcattctggaatgatggggatcaatagctacgggagtcagctgggcgtttctatctcagagagtacacagggaaacaatcaaggctacattaggaatacctcttcaatcagccctaggggttattcctcaagtagtacacctcagcagagcaactattccacgtcctccaatagcatgaacggctactcgaacgtccccatggccaatctcggagtgcctggtagtccaggatttctgaacggaagccctaccggctcgccttacggtaccggcttgtggcttacatggcttctgaaggccttttggggcaagaagagaatcgagaccatcccatttctttag

SEQ ID NO: 221631 - DNA, 1791 bp, Artificial Sequence
  Description of Artificial Sequence: Synthetic coding sequence
atgtttggcatccaggaaaatattcccagggggggtacaaccatgaaagaagagccgctcggaagtggtatgaaccccgtgaggtcatggatgcacaccgccggagtcgttgatgctaataccgcagctcagtcaggcgtggggctggcccgagcacacttcgagaaacagccgcctagtaatctccgaaagtcaaatttctttcactttgtgctggccctgtacgataggcagggccagcccgtggagattgagaggaccgccttcgtggactttgtggagaaagaaaaggagcccaataatgagaaaaccaataatggaattcactataaactccaactgttgtactcgaatggcgtaagaacggaacaggatctctatgtgcggctgatcgactccatgacgaaacaggctatcgtttatgaaggacaggacaagaatccagaaatgtgccgagtgctgctaactcatgaaattatgtgttccaggtgctgcgacaaaaagtcttgtggaaacagaaatgagaccccaagcgaccccgtcatcatagataggttctttctgaaattcttcctaaagtgcaatcaaaactgtttaaagaacgccggaaatcccagagatatgaggcgcttccaggtagtggtgagcacgaccgtgaacgtcgacggacatgtgttggctgttagcgataacatgtttgtgcacaacaactctaagcacgggagacgcgcacggagactggatccttccgaaggcaccgccccttcttacctggaaaatgctaccccctgcatcaaagcaatttcaccgagcgaaggctggactaccggaggcgcaacagtcatcatcataggggacaacttcttcgatgggctgcaggtggtgttcggtactatgttggtctggtctgagctgattacaccccatgcaatccgggtccagacaccccctcggcacattcccggagtagtggaggttactctgtcctacaagtctaaacagttctgcaaaggagccccaggtcggtttgtgtacaccgccctgaacgaacctacaatcgactacggatttcaaagactccagaaggttattccacggcatccaggcgacccggagcggttacccaaagaagtgttgcttaaaagggccgcagacctagtcgaagcactgtatggaatgccacacaacaaccaggaaataatcttaaaacgagcagccgatatcgcagaggctctgtactctgtcccaaggaaccacaatcagattcctaccttgggtaataacccagcccatactgggatgatgggtgtgaactcttttagcagccaactggcagtcaatgtatctgaaacatcccaggccaatgaccaggtggggtattcgcgaaacacttcttcagtgtcacctcggggatatgtcccttcttcaacaccccagcaatccaactacaacacggtgagcacctccatgaatgggtatggttccggagcaatggcctccctaggtgtccccggtagcccaggcttcctgaatgggagcagtgccaattccccttatgggattgttcctagttctcccaccatggcagcgagctccgtcacacttccttcaaattgcagttccacacacggtattttttctttctcgcctgctaacgtgattagtgccgttaagcagaaaagcgccttcgcacctgtcgtgaggccgcaggcctccccccctcccagctgcacgtcagccaatggcaacggccttcaagccatgtctggtctcgtagtgcccccaatgtag

SEQ ID NO: 221632 - DNA, 1656 bp, Artificial Sequence
  Description of Artificial Sequence: Synthetic coding sequence
atgtttggaattcaggagaatatccccagagggggtacaactatgaaagaggagcctctcggaagcgggatgaaccctgtgagatcgtggatgcatacggccggagtggtcgacgccaacacagcagctcaatccggagttggccttgctagagcccacttcgaaaaacagccaccatccaaccttagaaagtcaaatttcttccactttgttctcgcactctatgatcgacagggtcagccggttgaaattgaacgtaccgctttcgtggattttgtagaaaaagagaaggagccaaacaatgagaagacaaataacggtattcattacaaactgcaactcttgtactccaatggtgtgcgcacagaacaagacctctacgtcagactgatcgacagcatgactaagcaagctattgtatacgaaggacaagataagaatcctgaaatgtgtcgcgtattactcacccacgaaatcatgtgttcgaggtgctgtgacaagaagtcttgcggaaaccggaacgagacacccagcgaccccgtcattattgatagatttttcctcaagttcttcctcaagtgcaaccagaactgtctgaaaaatgctggcaatccaagagacatgcggagatttcaggtcgtcgtcagcacgactgtgaatgtcgacggacacgttctagcagtctctgataacatgttcgtgcataataattcgaagcatggtaggcgcgctagacgcctggaccctagcgaggcaaccccctgtattaaggctatatctccgagcgaggggtggaccacaggaggtgctacagtgattataattggcgataatttcttcgacggacttcaggtcgtgttcggaaccatgcttgtgtggtcagaacttatcacccctcatgccattcgcgtacaaactcccccacggcatattccaggtgttgtggaagttactctttcttacaaaagtaagcagttttgcaaaggcgctcccggtcggtttgtgtacacagccttgaatgaaccaactatcgactatggctttcaaaggctgcaaaaggtgatccctcgacatccgggagacccagagcggctcccaaaagaggtcctgctcaagagggccgctgacctcgtggaagccctgtacggtatgcctcataataaccaggaaataatattgaaaagagcagcggatattgctgaagcactgtatagtgtgcctcggaatcataaccagatacccactttgggcaacaaccccgcacacacaggcatgatgggcgttaattccttttcttcacagctggcagtgaacgtctccgagacgtctcaggctaacgaccaagttggctacagcaggaacacttctagcgtgagtcctagaggatatgtgccctcaagcacgccccaacaaagtaattataatactgtgagcacttctatgaatggctatggaagcggagccatggccagcctcggtgtgccagggagcccaggctttctcaatggcagttcagcaaattctccatatggcatgaaacaaaaaagcgcctttgccccagttgtgaggccacaggcttctcctccgccaagttgtacatctgccaatgggaacgggctgcaggccatgtcggggctcgtggtgcccccaatgtag

SEQ ID NO: 221633 - DNA, 576 bp, Artificial Sequence
  Description of Artificial Sequence: Synthetic coding sequence
tagttttcctcacagttagctgtcaatgtgtcagaaacatcacaagctaacgaccaagtgggctactcaaggaacacatcatccgtgagcccccgtggctacgtcccgtctagcactccccaacaatccaactacaatactgtatctacctctatgaatggttacggcagtggggcaatggcctcactgggagtgcccggatcaccgggatttctaaatggcagcagcgcaaactctccttacgggatcgtaccctcttccccaacaatggcggcttcgagtgtcactttaccctctaactgcagttcaacacacggtatcttctccttttcacccgcaaacgtcatcagcgcagtcaaacaaaagtcagcatttgcacctgtggtacggccacaggctagcccccctccatcctgcacatccgccaatggaaacggcctgcaagggtccctgctaggggcagaagacgtggccgctgagaagaccaattggcctttttgcgaggtaggtggaatttttcatttcgacgagctgatgctgaaaaagggcactggcaagttatgcctggggtggtag

SEQ ID NO: 221634 - DNA, 1809 bp, Artificial Sequence
  Description of Artificial Sequence: Synthetic coding sequence
atgttcccagcgcaagatgctctacccaggtctgggctgaatttaaaggaggaacccctgttgcctgccggattgggctccgtgagatcttggatgcaaggagccggaatcttggacgcttctactgccgcacagtctggagtaggactggccagagctcatttcgagaagcagcccccttcaaatctgcggaagtccaatttcttccacttcgtgcttgccatgtacgacaggcagggccagcccgtggaggtcgaacggactgcctttattgacttcgtggaaaaagaccgcgaacccggagccgaaaagacaaacaacggaatccactatcgccttcgactagtgtacaataatgggctgcggacagaacaggacctatatgtccggcttatagattcaatgtctaagcaggccatcatctacgagggacaggacaaaaacccagaaatgtgccgcgtactgctcacccacgagatcatgtgtagccgctgctgcgaccgcaaaagctgcggcaataggaacgagacgccatcagatcctgtgatcattgacagattcttcctaaaatttttccttaaatgtaatcagaattgtctgaaaaatgccggtaatcccagggacatgcgtcggttccaagtggtcgtctctaccacggttagcgtcgatggacacgtgctggctgtgagcgacaacatgttcgttcataataactccaagcacggaaggagggcacggaggctcgaccccagtgaggcagcgacaccttgtatcaaggcgatttcccccggagagggctggaccacgggaggcgcaaccgtgattgtaattggtgataatttttttgatggccttcaggtcgtgttcggaaacgtgctggtctggtctgaacttataaccccacatgctatcagggtgcaaacgccacctcggcacatccctggggttgttgaagtcactctttcttacaagtctaaacagttctgtaagggctgtccaggaaggttcgtgtatacagcactcaatgagccaaccatcgattatgggtttcagcggctgcaaaaagtaattccgcgacacccaggcgatcccgaacgactgcctaaagaggtgctgctaaagagggctgccgacttagccgaggccctgtacggtgtgccgggttccaaccaggagctgcttctgaaacgagccgctgatgtagcagaagccctgtacagcactcccagagctcctgggcctcttgcccctctggcgccaagtcacccgcacccggcagttgtcggcatcaacgccttctcgtcaccgcttgcaatcgcggtgggcgatgccactcccggtcctgaacctggatacgccaggtcctgttcaagtgcctctcctagggggtttgcacctagtccagggagccagcagtcaggatatgggggaggactgggagctggccttggcggatatggtgcacctggagtggccggattaggcgtgccagggtcccccagctttctaaatggaagcaccgccacaagcccctttgctattatgccatcctcacctccgctggctgctgcctcctcgatgtctctgcccgcagccgctcccaccacctcagtgttctccttctcgccagtgaacatgattagcgccgttaaacaacggtcagcgtttgcccctgtgctgaggccgccaagcagccccccacaggcatgccccagagcccatggagagggcctcccggaccaaagttttgaagattcagacaaattccattcaccagcccgtggcctgcaaggtttggcatattcctag

SEQ ID NO: 221635 - DNA, 1797 bp, Artificial Sequence
  Description of Artificial Sequence: Synthetic coding sequence
atggacgccttaccccgaagtggactgaacctgaaagaggagcctcttctgcctgccggactaggctccgtacgaagctggatgcagggtgctggcattctggatgcttccacagctgcgcaatcgggcgtgggactggcaagagcccacttcgagaaacagccgccatccaatctgcggaaatcaaatttttttcatttcgtactcgcaatgtacgatcgccaaggccagcccgtcgaggtcgaaaggaccgctttcatagacttcgtggaaaaagatagagagcccggagccgaaaagacaaacaacgggattcattataggctgcgcctcgtgtacaataacggactcaggactgaacaagacttgtatgttcgcctcatagactcgatgtctaagcaagcaattatatacgaaggtcaagataaaaaccccgagatgtgtagagtgctgttgactcatgaaatcatgtgcagcaggtgctgcgaccgaaagtcatgcggcaaccggaatgaaacaccctccgaccctgtgataattgataggttcttcctgaagttctttctcaaatgcaaccagaattgcctgaaaaatgcaggcaatcccagagatatgaggcgcttccaggtggtggttagtaccacagtgagtgtggatggccacgttctcgctgtctccgacaacatgtttgtccataataattccaagcatgggagacgagcacgcagactagatccatcggaggccgctaccccgtgcatcaaggcaattagtcccggagaaggttggaccactggcggtgcgactgtcatcgtgatcggggataatttttttgacggcctccaagtggtgttcggcaacgtattggtttggtcagaactcattaccccacacgctattcgtgtgcagaccccccctcggcatatccccggagtagtggaggtcacactctcttacaagagtaagcagttctgtaaaggctgtcctggccgtttcgtttacaccgcgcttaatgagcccactattgattatggcttccagaggcttcagaaggtcattcctcgccaccccggtgatccagaacgactgcctaaggaagttcttttgaaaagagcagccgatctggccgaagcactgtatggagtgcccggaagtaatcaagaacttctgctgaagcgcgctgcggacgtggccgaagctctgtactctactccgagggcccctggacccctggctccactggccccatcccacccacatcctgcagtagtcgggatcaacgcgttctcatcccccctagcgatagccgtaggggatgcgactcctggcccagagcctgggtatgccagatcctgctccagtgcctcaccaagaggtttcgccccttcccctggttcccaacagtcaggttacggcggagggctgggggctgggcttggaggctacggagccccaggcgtggccggactgggggttccaggctcaccctctttcctgaacggtagcactgcaacaagcccttttgccatcatgccttcctctccacctttggcggctgcctcctcaatgtcgttgccagcagccgctccaacgacgagcgtcttttctttttccccggtgaacatgataagcgcagtcaaacagaggtccgcattcgccccagtgctgcgccctcccagctcacctccccaggcgtgtccaagggcacatggagagggtctccccgatcagtccttcgaagatagtgacaaatttcattcaccagcccgtggtctgcaagggctcgcctacagctag

SEQ ID NO: 221636 - DNA, 555 bp, Artificial Sequence
  Description of Artificial Sequence: Synthetic coding sequence
agggggtcagtgcagcaccctccagttgtcggtattaatgctttttcttccccacttgcaatagctgttggcgacgcaactccgggtccagagcccggatacgcacggtcttgcagttccgcatctcccaggggctttgcaccttcaccaggatcccaacagtccggatatggcggaggccttggagctggcctggggggatacggtgcgcctggcgtggctgggttaggggtcccgggatccccctcatttctgaatggatcaacagccactagtccctttgccattatgccctcttcacccccactcgcagccgcttcatccatgtccctgcccgctgctgccccaaccacttctgtgttctctttcagcccggtgaacatgatctcagctgttaagcagcgcagtgcattcgccccagtcctgaggcccccttcctcccctcctcaggcctgtccccgtgctcatggagagggactgcccgaccaatcgttcgaagactccgataaatttcactctccagcaaggggtctccaggggttggcatattcgtag

SEQ ID NO: 221637 - DNA, 1632 bp, Artificial Sequence
  Description of Artificial Sequence: Synthetic coding sequence
atggcagccgctaaagccgagatgcagcttatgtccccccttcagatctctgatccattcggatctttcccccactccccaacaatggacaattacccaaagctcgaggaaatgatgctgctgagtaatggcgctccccagtttctgggcgcagcgggtgccccagagggtagcggaagtaactcaagttccagttcttctggcggaggcggaggaggaggcggagggagtaatagtagttcctcttcgagcacatttaaccctcaggcagacaccggagaacagccttacgaacatctgactgcagagagttttcctgacatctccctgaacaatgagaaggtgctagttgagacgtcctacccctcccagacaacgaggctcccccctatcacctataccggaaggttctcgcttgagccggcacctaactcgggtaacactctgtggcctgaacccttattctcactggtttctggacttgtaagcatgacgaaccccccagcaagcagtagttccgctccctccccagcagcctcatcggcatccgcatctcagtcccctcctctcagctgcgcagttccctcgaatgatagcagccctatttatagcgcagccccaacgttcccaacacccaacacagatatctttcctgaaccccagagtcaggcatttcctgggagcgccggtaccgcattgcagtacccgccacctgcttaccccgctgctaagggaggcttccaggttcctatgatccccgattatctttttcctcagcagcagggggatctggggctgggcacgccggatcagaagccgttccagggtctggaatcaagaacccagcagcccagcctaacaccattatcgaccatcaaggcctttgcaacccaatctggttcccaagacctcaaagccctgaatacctcttatcagtcccagctgattaagccatcccggatgcgtaagtaccccaatcgcccatccaaaacgccgcctcacgaaagaccttacgcctgtcccgtcgagtcatgtgatcgtaggttttcccgatccgatgaactgaccagacatatccgaattcacacaggccagaaaccctttcagtgccgcatttgtatgcgaaacttctctaggtccgatcacctgacaacacacatacgcacacacaccggggaaaaaccattcgcatgtgatatttgtggcagaaaatttgcaagatccgacgagcgcaagcgccacaccaagatccatctgcgtcaaaaggacaagaaggctgacaaaagcgtggttgcctcaagcgccacctccagcctgtcctcatacccctcccctgtggcaaccagctacccatcacccgtgacaacttcctatccaagccccgctactacaagctaccccagccccgttcctacttcgttttcatccccaggctccagcacatatcccagccctgtccatagtggcttcccaagcccctcggtcgctaccacgtattcttctgtgcccccagctttccccgcacaggtgagcagctttccttcctcagccgtcactaattccttttcagcctccactggtttaagtgatatgactgctacatttagcccaaggacaatcgagatctgctag

SEQ ID NO: 221638 - DNA, 603 bp, Artificial Sequence
  Description of Artificial Sequence: Synthetic coding sequence
atggctgccgcaaaggccgagatgcagttgatgtctcctctgcaaatctcagatcccttcggctcttttcctcattcccccactatggacaattaccccaagctcgaagaaatgatgctgctgtccaatggagcgcctcagttcctgggagctgcaggcgctcccgaaggctcaggctccaattcttcttctagctcgtctggcggtgggggtgggggaggaggcggatccaacagttcctccagctcctcaacgtttaatcctcaggctgacaccggcgaacagccctacgagcacctcaccgccgaatcctttccagacatctcactgaataacgagaaagttctggtggagactagttatccgtctcagactacaaggctgcctccaatcacctacactgggagattttcgctggaaccagcacctaattccgggttcccttctccatctgtcgctaccacttattcctctgtgccaccagcctttcccgctcaggtttctagcttcccctcatctgccgtgaccaactccttcagcgccagcaccgggctctccgatatgaccgctacattttcccctaggacgattgaaatatgttag

SEQ ID NO: 221639 - DNA, 699 bp, Artificial Sequence
  Description of Artificial Sequence: Synthetic coding sequence
atggcagcggcaaaagcggagatgcagttaatgtctccactccagattagcgacccattcggatcatttcctcacagtcctacaatggacaactacccgaaactcgaggaaatgatgcttctgtcgaatggggcaccacagtttctgggggcagccggagcccctgaggggtcaggcagtaacagctcctcttcaagttccggcggtggtggaggagggggtggaggcagcaactcatcctcgagtagcagcaccttcaatcctcaggctgatacaggagaacaaccatatgagcatctgaccgccgaaagcttccccgatatttctctgaacaacgagaaagtcctcgtcgaaacgtcgtatccgtctcagaccactaggctccctccgattacgtatacaggtcggttctccctggaaccagctccgaattctggaaacactctgtggcccgaacctctgtttagccttgtgagtggactagtatcaatgacaaatcctccagccagctcctctagcgccccatctcctgccgcttcatccgcttctgcttcccagagccccccactcagctgcgcagtccccagcaacgacagctcccccatttatagcgcagcccctacttttcctacacccaataccgatatcttccccgaaacagccatgagcaagttctttacaagtatccaaaggacatag

SEQ ID NO: 221640 - DNA, 1431 bp, Artificial Sequence
  Description of Artificial Sequence: Synthetic coding sequence
atgatgacagccaaagctgtggacaaaatccccgtcacactgagtgggtttgtacaccagcttagcgacaacatttacccggtggaggatctggcagcaacctccgtcacgatcttccctaacgctgaattgggtggtccatttgatcaaatgaatggggtggctggcgacggtatgatcaacattgacatgaccggggaaaagagaagtttggatcttccatatcccagcagcttcgcgcctgtgtccgcacctcgcaaccaaaccttcacgtatatggggaagttttccattgaccctcagtatccaggcgctagttgctacccggaaggaatcattaacatcgtgagcgcagggatattgcaaggggttaccagcccagcctccaccacagcctccagcagcgtgacatctgccagcccaaaccccctggccactgggcctctgggcgtctgtaccatgtctcagactcaacctgatctcgatcacttgtacagccccccaccgcctccaccaccctattcaggatgtgccggtgatctgtatcaagatccctcagccttcctgagtgccgcaactacttcaactagctcatccctggcataccctccgccacccagctacccatccccaaaacccgctaccgatcctggactgttccccatgattccggactaccctggtttcttccctagtcagtgccagagggacctacacggcacagccggaccagatcgtaagcctttcccgtgtcccctggatacccttagagtaccccctccattgaccccactatccaccatccgcaactttaccttgggtgggcctagcgccggtgtgacagggccaggagctagtggagggtccgagggccctcggctgcctgggtcctcttcagctgctgcagctgctgccgcagccgctgcctataatccccatcatttacctcttcggccaattcttcgaccgcgaaaatatccaaatcgcccttctaagacgcctgtacatgagaggccttacccttgtcctgctgaaggctgtgaccgacgattcagtaggagcgacgagctgacccgccacattcggatccacacgggccataagcctttccagtgcagaatttgcatgcggaacttttcgaggagtgatcatttaacaacacatattcgcacacacaccggcgagaaaccgtttgcttgcgattactgtggacggaaattcgcccgatcagacgagaggaagcgtcatacgaaaattcacttaaggcagaaggaacgcaagtcctcggcaccttcggctagcgtgcctgccccatctaccgccagttgctccgggggagtacagccagggggtactttatgttctagtaatagttcctctctgggagggggacccctggctccctgttctagccgcacccgtacgccgtag

SEQ ID NO: 221641 - DNA, 1281 bp, Artificial Sequence
  Description of Artificial Sequence: Synthetic coding sequence
atgaacggtgtcgctggagacgggatgatcaacattgacatgacaggggagaaaaggtcgctagacctgccttacccatctagcttcgcccctgtatccgcacccaggaaccagaccttcacttacatgggtaaattctctatagatccacagtatcctggcgcatcttgctatcccgagggaatcattaacatcgtctccgcaggaatcttgcagggcgtgacatcacctgcctccacaacagcttctagtagcgttacgtcagcaagcccaaaccccctggctactggccctctcggcgtctgcactatgagccagacccagcccgatctggatcacctgtacagcccccctccccctcccccaccgtacagcggatgcgccggagatttgtatcaggacccttctgcttttctatcagctgctaccacaagcacgtccagtagcttagcataccctcctcctcctagttacccgagcccgaagcccgctaccgatcccggactatttcctatgatacccgactaccctggtttttttccaagccagtgccaaagagaccttcacggaactgccggaccagataggaagccgtttccctgtcctcttgataccctacgtgtaccgcctccgctcaccccactgtctacgattcgcaactttacccttggaggacccagcgctggggtgactggccctggggcatccgggggttccgagggacctcgtttacctggatcttcatccgcggcagccgcagcggcagctgccgctgcctataaccctcatcacctcccgctgcgtccgatcctgcggcctaggaagtaccccaaccgcccatcaaagacccccgttcacgagaggccgtacccctgcccggcagagggctgtgaccgccgttttagcaggagtgacgagctcacaaggcacattcggatccacacaggtcacaagcctttccagtgtaggatttgtatgagaaacttctcgcggagcgaccacttaacaacccacatccggactcacaccggtgaaaaaccatttgcatgtgattactgcggaaggaaatttgctcgcagcgatgagaggaaacgccacacaaaaattcatcttcgtcagaaggagcggaaatcatctgcccctagtgctagcgtgcctgcaccctcaacagcttcttgtagcggaggtgttcagcccggaggaacactgtgcagcagcaattcctcgagcctgggtggagggcctttggcgccatgctcatctaggaccagaacaccttag

SEQ ID NO: 221642 - DNA, 786 bp, Artificial Sequence
  Description of Artificial Sequence: Synthetic coding sequence
atgagagtgggactgccctcagaagcctcatcctgcccctggagcgccaggggacccagagatcctcctgagcgcagacggtcgggactcgcccacgtgttatcggataatatttatccggtagaggatctagctgcaacgtccgtgacaattttcccaaacgcagaactagggggtccatttgatcaaatgaacggggtggcaggcgacgggatgatcaatattgacatgacaggagaaaaaagatccttggacctgccatacccctcctccttcgccccagtctcagcccctcgaaatcagacgtttacatatatgggtaagttctccatcgaccctcagtatcccggagcttcctgctaccctgagggcatcattaacattgtgtcagcaggtattttacagggcgtgacttccccagcgagcacaactgcatcctcttccgtgacgtccgcgtcccctaacccactagccacaggtccattaggggtgtgcacaatgagtcaaactcagcccgatctcgaccacttatatagccctccccctccaccccctccgtattcaggctgtgccggagacttgtaccaagacccctccgcctttctgtccgccgctactacaagcacgagcagcagcctggcctatccaccaccgccaagctacccaagtcccaaacctgtggaggcagccagggaccccggatgtctggttgccgcacagcagcaacagcagcctcctcccccacctcccatcacacacacaacttgtcactgcggtccattttag

SEQ ID NO: 221643 - DNA, 1431 bp, Artificial Sequence
  Description of Artificial Sequence: Synthetic coding sequence
atgatgacggctaaagctgtcgataaaatcccggtgacactctctggatttgtgcaccagctcagtgacaacatctatccggttgaggatcttgcagcgacttccgtgaccatatttccaaatgccgagttgggagggccttttgatcagatgaatggcgtcgccggtgacgggatgattaacattgatatgacaggtgagaagaggagcctggatttgccctacccatcatctttcgccccagtatcagcacccagaaaccagacctttacttatatgggaaagtttagtatcgacccacaataccccggagcttcgtgctaccccgaggggattatcaatatagtatcagctggtattctccaaggagtgacaagtccggcatccaccacagccagctcctcagtgacaagtgcatccccaaatccacttgctaccggccctctcggagtgtgtactatgagccaaacacagcccgacttagaccacttgtacagtccacctcccccacctccaccctacagtgggtgtgcaggagacctttaccaggatcctagtgctttcctgagcgccgcaacaaccagcacatcctcaagtctggcatatccacctcctccatcataccctagtccgaaacccgcaacagacccgggtctgtttccaatgataccagattatcctggtttttttccatcacagtgccaaagggatttacatggtacggccggacctgaccgaaaacctttcccgtgcccactggatacgcttagagtccctccccctcttacccccctctccactataaggaatttcacacttggagggccatccgcaggcgtcaccggcccaggagcctccggaggcagcgaaggcccaaggctcccgggatcatctagcgccgcagcagcagcggctgctgccgctgcatacaatccgcaccatcttcctctccggcctatactccggcctcgcaagtacccaaataggcccagcaaaacccccgtacacgaaagaccttatccatgtcccgctgaaggatgcgaccgaagattctccagaagtgacgagctcacccgccatattcgtatccatacaggtcataagccatttcagtgtcggatatgcatgagaaacttctcacgaagtgatcatctgacaacacatattcgcacccataccggtgaaaaaccattcgcctgtgactactgtggcagaaagttcgcgaggagcgatgaaaggaagcgacatactaagatccacctgcgtcagaaggagcgaaagagcagcgccccttccgcctctgtgccagctccttcgaccgcctcatgtagtgggggagtgcaaccgggagggactctgtgctcatctaactcctcctcacttggcggaggtccgctcgctccttgctcttctagaactaggacgccttag

SEQ ID NO: 221644 - DNA, 1461 bp, Artificial Sequence
  Description of Artificial Sequence: Synthetic coding sequence
atgctgcacctaagcgaattttctgagcccgacgccctgctagtcaagtcaaccgaagggtgctgcgccgagcccagcgcagaactccctagattgcccgcacgcgacgccccagccgcaaccggctacccaggcgctggggatttcctgagttgggccttgaatagctgcggagcaagtggtgacttggccgacagttgtttcctagagggtccagcccctaccccaccacctggtttgagctactcaggcagcttttttatccaggcagtcccagaacatccccatgacccagaagcgctttttaatttaatgtctggaattctgggtctggcccctttccccggaccggaagccgctgcttccagatcacccctcgatgcacctttccccgcaggatctgatgccctgttgcccggacccccagatctctatagcccggatttaggagctgcgccttttccggaggccttctgggaggcttcaccgtgtgccggtgccccttcccaatgcttgtatgagccccagttgtcacctccagatgtgaagccaggcctaagagccccacccgctagcccggctcttgacgccgtgtccgcatttaaaggaccctatgctccttgggagttgctgtccgtaggtgcccctggaaactgtgggagccagggcgattatcaagccgcacctgaggccagatttcccgtaatcgggacaaaaatcgaagatctgctctccatctcgtgccctgccgagttaccagccgtccccgctaaccgattgtatccatccggtgcatacgacgcttttcctctagccccaggggacctgggagagggggctgaagggctcccgggactgctgacaccaccctccggtgaagggggatcaagtggtgatggaggggaattccttgctagcactcagcctcaactatcgcccctgggactgagaagtgccgctgccgcagacttccctaaacctctcgtggctgatatccccggaagctctggagttgcagctcccccagttccacctccacctcccacccctttccctcaggcaaaagccaggcggaagggacgccgaggcggaaaatgctctacgagatgtttctgccctcgccctcatgcaaaggcttttgcctgcccagtggaaagctgcgtgaggtcttttgcacggagcgatgaacttaaccgccaccttcggatccacaccgggcataaacctttccagtgcaggatctgcctgcggaatttcagcagaagtgatcacctcacaacacatgtgaggacccatacaggcgaaaagcccttcgcctgcgatgtttgtgggagacgctttgccagatctgacgagaagaaacggcacagtaaagtccacttgaagcagaaagctcgtgcagaagagcggctcaaagggctggggttctactccttgggcttgtcctttgcatccctctag

SEQ ID NO: 221645 - DNA, 1770 bp, Artificial Sequence
  Description of Artificial Sequence: Synthetic coding sequence
atggccgttgccaggggggttgggtcccctgagcccgcacccccacaactgtataagtggggcggatgtggcctaggagagcctggatctgccctagaaaggaggggagcagcagctcggggacgctgcggccgagctcgagcgcctaggctgcccgacagttttccccgaggagaatgccctaaacctggagcacgcgctccacgctcagtgcgctgtggtgagcccctgcccccagccagtcccccacccgcaagaccccaggcacagcgtgctcggcctagggctccacactcacgaaggcgagccatgcttcacctcagcgaattttccgaaccggatgcgcttttggtgaaatcaactgaagggtgctgcgcagaaccttccgcagaactccctcgcctgccagccagggatgccccagctgcaactggttatcccggtgcaggcgacttcctatcttgggctttaaacagctgcggtgccagcggagacttggcagactcttgctttctggaaggaccggcacctacaccaccacccggtctctcttacagtggatccttctttattcaggccgtcccagagcacccacacgaccccgaggctctttttaatctcatgtcgggaattcttggtctggcaccctttcccggacctgaagccgcagcgtccaggagcccgctcgacgctccttttccggctggatcggatgctttactccctggacctccagatctgtactcccccgatttgggagcggcaccattccctgaggccttctgggaagcaagtccctgtgctggggctccttcacagtgtctctatgaaccccagctcagcccacctgatgtcaaacccggactccgcgcaccaccagcgagccctgcgctcgatgctgttagcgcattcaagggcccttatgctccttgggaactgctttctgtcggcgcaccaggaaactgcggttctcaaggcgattaccaggctgctcccgaggccagattccccgtgataggcaccaagattgaagacttgctgtccatctcctgcccagctgaattgcccgcagtgccagctaatcgtctatacccctctggagcctacgacgccttccctctggcccctggcgacctgggggagggcgctgagggactgcccggactgctgacccccccatcaggcgagggcggatcctcaggtgatggcggagaatttttggcatccacgcaaccacagctttcccccctgggcctccgttctgcagccgcagcagattttcctaagccactggtggcagatatccccggaagcagtggggttgcggctccacctgtgcctcctcctcctcccactccttttcctcaggctaaggctagaaggaaaggccgtcggggtggaaagtgcagcactcgctgtttttgtccccgacctcatgctaaagcattcgcatgccccgtggagagttgtgtgaggtccttcgcaaggtcagatgaactgaaccgacatctccgcatccatacagggcataagcccttccagtgcaggatttgtcttagaaatttttcaaggtccgatcacctcaccactcatgttcggacacacacaggtgagaagccctttgcgtgcgacgtctgcgggcgtcgattcgctcgctctgatgagaaaaaacgccacagcaaagtgcacctgaagcagaaggcccgtgcggaggaaagactgaaaggactcggcttttactccctgggactctcctttgcctccctctag

SEQ ID NO: 221646 - DNA, 921 bp, Artificial Sequence
  Description of Artificial Sequence: Synthetic coding sequence
atggacaccccaccactgtcagatagtgagagcgaatctgatgagtctctggtgacagaccgagaattgcaggacgccttctccagggggttgctcaagcccggattaaacgtcgtcctcgaaggcccaaaaaaggccgtcaatgatgtcaacgggttgaaacagtgcctcgctgaattcaagagagatctggagtgggtcgaaaggcttgatgtgaccctcggacctgtgcccgagatcggagggagtgaggccccagcccctcagaacaaagaccagaaggctgtcgacccagaagacgacttccagcgggagatgagtttttatcggcaggcgcaggcagccgtcctggcggtcctgccccgactacatcagttgaaagttccaactaagaggcccaccgattatttcgcagagatggcaaagagcgatctgcagatgcagaaaatacgccagaaactccagacaaaacaggccgctatggagcgatctgagaaggccaagcagttgcgggcactgaggaaatatggaaaaaaagtgcaaaccgaggtacttcagaaaagacagcaggaaaaggctcacatgatgaatgcaatcaagaagtaccaaaagggcttctcggacaagttagatttcttggagggtgatcagaaaccgctcgctcagcggaagaaggctggcgctaagggccagcagatgaggaaaggtcctagtgctaaacgccgatacaagaaccaaaagtttgggtttggagggaaaaagaaggggtcaaagtggaacaccagggaatcatacgacgatgtgtcaagctttcgcgctaagacagcccatggccgtggtctcaagcgtcctggtaaaaagggtagcaataagagacctggaaaacggacccgcgagaagatgaagaacagaacccattag

SEQ ID NO: 221647 - DNA, 1086 bp, Artificial Sequence
  Description of Artificial Sequence: Synthetic coding sequence
atgtatccagaggctctccccgtgggcatccttagcaaccccgatacgttcaagcgcagatccggcagttactctaatgacaagcctgaggtgtggtttgcggcaggaagcggtagtccaaaccagaaactgtcatctagctgcgtcggcagggcctgtggtgaaatggacacacccccattaagtgattccgaatcagagtccgacgaatccctggttaccgatcgcgagcttcaggatgccttttcccgtgggctgcttaagccgggactcaatgtggttcttgaagggccaaaaaaggctgtgaacgacgtaaacggacttaaacagtgcctagccgagttcaagcgcgatttggaatgggtggagagactggatgtgactttggggcctgttccagagattgggggatccgaggcgccagcacctcagaataaggaccagaaagccgtggatccagaggatgactttcaaagggagatgtcattctacaggcaggcccaggcagccgtgctagcagtccttcctcgcttgcaccagctgaaggtgcctaccaagcggcctactgattattttgccgaaatggccaagtcggatctgcagatgcagaagatccggcagaaattgcagacgaagcaggccgcaatggagcgctcagagaaagcgaaacagctccgcgctcttcggaagtatgggaaaaaagtacagaccgaggtcctgcagaagagacagcaagaaaaggcacatatgatgaacgctattaagaagtaccaaaaagggttctcagataagctggattttttagagggcgaccaaaagccactggcccagcggaagaaggcaggcgcaaaaggtcagcaaatgcgaaaaggtccaagtgcgaagaggcggtacaaaaatcagaaattcggcttcggcggaaagaaaaaggggagcaagtggaacaccagggaatcgtatgacgacgtgtcttctttccgagcgaagacagcacacggacgagggctgaaacgcccaggaaaaaagggctcaaacaagagaccaggcaaaagaacgcgcgaaaagatgaagaacagaactcactag

SEQ ID NO: 221648 - DNA, 2448 bp, Artificial Sequence
  Description of Artificial Sequence: Synthetic coding sequence
atggaggatggctttagcagctactcatccctgtacgacactagctctcttctgcagttttgcaacgatgatagcgcgtcagcagccagttcaatggaagtcactgatagaatcgcgtctctggagcaaagagtccagatgcaggaggatgatatccagctgctgaagtccgccctggcggacgtggtgaggcgcctgaatattactgaggagcagcaggccgtactgaataggaagggtcctaccaaggctcgcccactaatgcagacgttgccgctgcgaaccaccgtaaacaatgggaccgttctgcctaaaaagccaactgggtctctaccatcaccttccggtgtgaggaaggagaccgccgtacccgctacaaaatccaacatcaagagaacatcctcttcagagcgcgtctctcccggtggccgaagggaatctaacggcgattcccgcggaaatcggaataggactgggagcacgtcctcctcttcttctgggaaaaagaactctgagagcaagcctaaggaacctgtgttttcagctgaggagggctacgttaagatgttcttacggggtcgtcccgtcaccatgtacatgcctaaagaccaggtggattcttactcccttgaggccaaggtggaactccccaccaagcgactgaaactggaatgggtgtacggctaccgagggagggactgtcggaataatctttatttactccccaccggagaaacagtctatttcattgcctccgtggtggtgctctacaacgtggaagagcaacttcagcggcactacgccggtcataatgatgatgtaaagtgtctggccgttcatccagaccgaatcactattgctaccgggcaagtggcgggaactagcaaggatggaaagcagctgccaccgcatgtgcggatttgggatagcgtcacgcttaatacattacacgtgatagggataggcttcttcgaccgcgctgtgacttgtatcgcgttcagtaaatcaaatggagggacaaatctgtgtgccgttgacgactctaacgaccatgtgctgtctgtttgggactggcagaaagaagagaaacttgcggacgtgaaatgctccaacgaggccgtgttcgccgctgactttcaccccaccgatacaaatattatcgtaacgtgtggcaagagccatctgtacttctggacactggagggtagcagcctcaacaaaaaacagggactgttcgagaagcaagaaaagccaaaattcgtgctttgcgtcacatttagcgagaatggggacaccataactggcgacagcagcggcaacatcttggtgtggggcaaagggactaataggatcagttacgcagtgcagggggctcacgaagggggtatatttgccctgtgcatgctgagggacggcaccctggtgtccggaggcggaaaggaccgcaagctgatcagctggtcagggaattaccaaaaacttcggaaaaccgagatcccggagcagtttggaccgataagaacggtcgccgaggggaaaggcgatgttatccttattggcacgacacgcaatttcgttctacagggtaccctatccggagacttcacccctatcactcaggggcacaccgacgagctttgggggctcgccatccacgcttcaaaatctcagttcttgacctgcggacacgataagcacgctacactgtgggatgccgtcggccacagacccgtttgggacaagattatcgaagatcctgcgcagtcctctggctttcatccttctggaagcgttgttgcggtcggtaccctcaccggccgatggttcgtgtttgacacagagactaaagatcttgttacggtgcatactgacgggaatgagcagctgtccgtaatgagatacagcccggatggtaacttcctggccataggaagtcatgataattgtatctacatctatggagtgagcgacaatggaagaaagtatacccgcgtcggcaagtgctccggccactccagtttcattacgcacctcgattggtcagttaactctcagttcttagttagtaacagtggtgattatgagatcctgtattgggtgccatctgcctgcaagcaggttgtaagtgtggaaaccacccgtgacatcgaatgggccacctacacatgtaccttgggcttccacgtgttcggggtctggcccgagggttcagacggtaccgacatcaacgctgtctgtcgggcacacgaaaaaaaactattgagtaccggggatgactttggcaaagtgcacctcttttcttatccctgctctcagttcagggccccatctcacatctatgggggtcacagtagtcatgttacaaatgtcgattttttatgcgaggactcccatctgatttcgactggcggaaaggataccagtattatgcagtggcgcgtgatatag

SEQ ID NO: 221649 - DNA, 2505 bp, Artificial Sequence
  Description of Artificial Sequence: Synthetic coding sequence
atggaagacggtttttcctcctatagctccttgtacgacacgagctccttactccagttttgcaacgatgatagtgctagcgccgcttcatccatggaagtcacggatcgaatagcatctctggagcagagagtgcaaatgcaggaggacgatatacagttgttaaaatccgctttagctgacgtcgtgcggcgactcaacattaccgaggaacagcaggccgttctcaacagaaaaggtcctacaaaagcccgacctttgatgcaaactcttcccctgagaaccacagtgaataacggaaccgtcctgccaaaaaagcctaccgggtcactgcctagccctagcggagtgcgtaaagagacagcagtgcctgcaaccaagaggctcaaccgatcagtgtctctccttaacgcctgcaagttgaacaggagtacaccgagcaatatcaaacgtacctcatcatcagagagggtcagccctgggggacgtcgcgaatccaatggggactccaggggaaacagaaaccggactggctccacctccagctcctcaagcgggaagaaaaatagtgagtccaaacccaaggaacctgtgttctccgccgaggaaggatacgtgaaaatgtttttgcgcggacggcctgtgaccatgtacatgccgaaggaccaagtggacagttactctctggaagctaaagtcgaattgccgactaagcgactgaagctggagtgggtgtacgggtaccggggacgggattgcaggaataacttgtaccttctgcccaccggcgagacagtgtactttatcgcatccgtggtggttctgtacaatgtggaagagcagctgcaaaggcactacgctggccacaacgacgacgtgaagtgtttggccgtacaccccgatcgcattacaatcgccacaggccaggtcgctggcacgtctaaggatgggaagcagctgcctccacacgtgagaatctgggactccgtcactctcaacaccctgcacgttatagggatcgggttttttgaccgggctgtaacttgtatcgcattctcaaaatcaaacggcggtaccaacctctgcgctgtggatgattctaatgaccacgtcctgtccgtgtgggattggcagaaggaagaaaagcttgcagatgtgaaatgctccaatgaggccgtgtttgccgctgactttcatcccacagatacaaacattatcgtgacctgcggtaagtcccacttatacttctggacactggaagggagctcgctcaataaaaaacagggactgttcgagaagcaggagaagccaaaattcgttctctgcgttaccttctcagaaaatggtgataccattacgggcgacagttccggcaacatcttagtgtggggcaagggaactaatcgaatttcctacgccgtgcagggagcacacgaagggggaatctttgcactctgcatgctgagagatggaactcttgtgagcggtggtggcaaagatcgcaagctgatcagttggagtgggaattatcaaaaactgaggaagacggaaatcccagaacagttcggcccaattaggacagtagctgaggggaagggtgacgtgatcctcatcgggaccacccgcaatttcgtccttcaaggtacgctgagcggagacttcaccccaatcacccaaggccacactgatgagctctggggcctcgcaatacacgccagtaagtcacagtttctcacctgcgggcacgacaagcacgcaaccctgtgggatgctgtcgggcaccgaccagtgtgggataagattatcgaggatccagcacagtccagcggctttcacccgagcggatcagtagtcgcagttggaacattaaccgggcgttggtttgtcttcgacactgagaccaaagacctcgtcaccgtgcacacggacggtaacgaacagttaagtgttatgagatactcccctgatggcaacttcctggccataggttctcatgataattgcatctatatctacggcgtgagcgacaatggaaggaaatacactagagtgggaaaatgctccggccacagtagttttattacacacctcgactggtctgttaattctcagtttctcgtgagtaatagtggggactacgagatcctatactgggtaccatcagcctgcaagcaagtcgttagcgtcgaaacaacacgggacatcgagtgggccacctacacttgcacactcggcttccatgtgtttggagtctggccggagggttccgacggtaccgatattaatgccgtgtgcagggcgcacgagaagaaattgctgagcaccggcgatgactttggaaaggtacacctcttctcatatccgtgctctcagttccgggctcccagccacatctatggcggacactcatcacacgtcacaaacgtggatttcctctgcgaggacagccatttaatcagcacaggcggtaaggacacctcaattatgcaatggagagtgatctag

SEQ ID NO: 221650 - DNA, 2505 bp, Artificial Sequence
  Description of Artificial Sequence: Synthetic coding sequence
atggaggacggcttttcatcatatagttccctgtatgacacgagctctctgctgcagttctgcaacgacgattcagcaagtgccgcttccagcatggaggtgacggatcgcatagcgtccctggaacagcgggtccagatgcaagaagatgacattcagctgctgaagagtgctctggcggatgttgtcagacgtctgaacatcacggaggagcagcaggcagtcctaaaccgcaaaggccctactaaggcccgacctcttatgcagacgctccccttacgtacaacagttaacaatggaacagtgttgcccaaaaaaccaaccgggagtctgcccagcccgtctggcgtgcgcaaggaaactgccgtaccagcaactaaaagacttaatcgaagtgtctccttgctcaatgcctgtaaactgaatcgtagtacacctagcaacatcaagcgcacgtcttcttccgagagggtgagtcctgggggacgtagggagtctaatggcgacagtaggggaaatcgcaatcgtactggtagtacaagctctagctcttccggcaaaaagaactctgagagcaaaccaaaggaaccagtgttttctgcagaggaaggctatgtaaagatgttcttgagaggccgacctgtgaccatgtacatgcctaaggaccaggtggacagttattccctggaggctaaggtggaattgcctaccaaaaggctcaagctagagtgggtatacgggtaccgcggtagggactgcagaaacaacctctacctgctccccacaggagaaaccgtgtattttattgcttcggtcgtcgtcctgtacaacgtcgaagagcaactgcagcgccactatgctggccacaatgacgacgtgaagtgcttggctgttcatccagaccggatcacaatcgccaccggccaggttgcaggcacatctaaggatggtaagcagctacctcctcacgtgcggatctgggactccgttactttaaatactttgcacgtaatcgggatcggtttcttcgatcgggctgtcacctgtatagccttctccaaaagtaacggaggcacaaatctttgcgccgttgatgactccaatgaccatgtgttgagtgtgtgggattggcaaaaagaggagaaactcgcagatgtgaagtgctccaacgaggccgtgttcgccgctgactttcaccctaccgacaccaatattattgtgacatgtgggaaatcacacctttatttttggactctcgagggatcttctctcaataagaagcaagggctcttcgagaaacaggagaagcccaagtttgtactctgtgttactttcagtgagaatggagacaccatcacaggcgactcaagtggcaatattctggtgtggggtaaaggaaccaatcgaatctcttatgcagttcaaggcgcacacgaaggtgggatatttgctctgtgtatgctaagggacgggacgttggtgtcgggtggcggaaaggatagaaaactcatctcctggtctggaaattaccagaaactgcgtaagaccgagattccagaacaatttggccctattcgtaccgtggcagaaggcaagggtgatgtcatattaatcggcacaacacggaacttcgtgctgcagggaaccttatctggggactttactcctattactcaggggcatacagacgagttgtggggcttagcgatccatgcttctaaatcacaattcctcacttgcggacacgataaacatgctacgctatgggatgccgttggccataggcccgtgtgggacaaaatcattgaggaccctgcccagtcctccggcttccatccttccgggtcagtcgtcgccgtcggaaccctcacaggtcgatggttcgtgttcgacaccgaaactaaggacctggtgacggtacacaccgacggcaacgaacagttatcagtcatgcgatactcccccgacggaaactttctggcaataggatcacatgacaactgcatctacatctacggagtaagcgataacggccgaaaatataccagggttggcaagtgctctggacacagctcattcatcactcacctcgactggtccgtgaattcacagttcttggtgtccaatagcggtgactacgagattctgtattgggtcccttctgcatgcaaacaggtagtctccgttgaaacgacacgggatatcgagtgggccacttacacttgcacgcttggtttccacgtgttcggggtctggccagaggggtcagacggcacagatattaacgccgtgtgcagggcccacgaaaagaaacttctgtccacaggggacgatttcggtaaggtgcacttattctcctacccttgcagccagtttcgcgctccaagtcacatttacggtggccacagcagccatgtgacaaatgtggactttttgtgcgaggactctcacctcatcagcactggcggtaaagacacgtcaatcatgcagtggcgcgtcatctag

SEQ ID NO: 221651 - DNA, 2946 bp, Artificial Sequence
  Description of Artificial Sequence: Synthetic coding sequence
atggatggcttcgccggatccctagatgacagcatatcagccgctagcacctctgacgttcaggatcgcctttcggcgttagagagccgcgtccaacaacaagaggatgagattactgtactgaaggcagcactggctgatgtcctacggaggctggccatttccgaagatcacgtggccagcgtgaagaagtcagttagttccaagggccagccctccccacgtgcagtcatcccaatgtcctgtatcacaaacgggtctggtgcgaataggaagccatctcacaccagtgctgtgtcgattgcgggaaaggaaaccctttccagcgcagctaagtctggcacggagaagaaaaaagagaagccccaaggtcagagggaaaagaaggaggagtctcacagcaacgaccaatccccccaaatccgagccagcccaagcccccagcctagtagccaaccgctacaaatacaccggcagacgcctgagagtaaaaacgctaccccgacaaagtccataaagcggcctagcccagctgagaagagccacaatagctgggagaacagtgacgactctcggaataagctctccaaaattccaagcaccccaaaactcatcccaaaggtgacaaagactgctgacaagcacaaagatgtgatcatcaaccaggagggggagtatatcaagatgttcatgcggggaagaccaatcacaatgtttatcccttcggacgtggataattatgacgacatccgcaccgaactgcccccagagaaactgaagcttgaatgggcttatggataccggggaaaggactgccgcgctaatgtgtacctccttcccactgggaagatcgtgtactttattgcatcagttgttgtcctctttaattatgaggagcgcacacaacgacactacttgggccatactgattgcgtaaagtgcttggccatacacccagacaagattaggattgctaccggccagatcgcaggcgtggataaggatgggagacctttacagccccacgtccgtgtgtgggattctgtgactctctccaccctccagataattgggcttggcacgttcgagagaggcgtaggctgtctcgacttctcgaaagccgactcaggagtccatctatgtattatcgacgactcaaacgaacacatgctgacagtgtgggattggcagaagaaggccaagggagccgaaattaagactaccaatgaagtcgtcttggcagtggagttccaccccactgacgcaaatactattatcacttgtggtaagtctcatatctttttttggacctggtccggtaatagcttaacaaggaaacagggaatcttcgggaagtacgaaaaacctaagttcgtgcagtgcttggcttttctaggtaacggcgacgtcctcacaggcgacagcggcggagtaatgctcatctggtctaaaaccacagtggagcctaccccagggaaaggccctaaaggcgtttatcagatttctaaacaaatcaaggcacatgacgggtccgtgtttacgttgtgccagatgagaaacggcatgctgttaaccgggggaggcaaagatcgaaagatcatcctgtgggaccatgacctcaatcctgagagagagatcgaggtcccagatcagtatggcacaatcagggccgtagcagagggaaaagctgaccaatttctagtcggaacgtcaagaaacttcatcctgcgtggtacattcaacgacggattccagattgaggtccaagggcatactgacgaactgtgggggttagcgacacacccctttaaagatcttctgttaacctgtgcccaggaccgtcaggtgtgtctttggaatagcatggaacacagactcgagtggaccagactggtggacgagcccggacactgcgccgatttccacccctctggtaccgtcgtcgcaattgggactcactccggcagatggtttgtgctggacgccgagacccgggacttagtgagtattcacaccgatggcaacgagcagctgtctgtgatgagatattccatagacgggacatttctcgccgttggttcacatgataacttcatttatctgtatgtcgtgtccgaaaatgggaggaaatattcccgctatggacgatgtactggacatagttcttacatcacacatctggactggtcgcctgataacaagtacattatgtccaattctggcgactacgagattctgtattgggacatacctaatgggtgcaaacttattcggaatcggagcgattgcaaggacatcgactggacaacctatacgtgtgtgcttggctttcaggtctttggtgtctggccggaaggatccgatgggacagacataaatgcactagtgaggtcccacaatagaaaagtgatcgctgtggcggatgatttttgcaaagttcacctctttcagtacccttgctctaaggctaaggcccctagtcacaaatactccgcccactcttcccacgtaaccaatgtcagcttcacccacaatgacagtcacctcatttccactggcggaaaagatatgtcaatcatccagtggaaattggttgaaaaactatcactgccccaaaacgagaccgtagccgacacaacattgaccaaggcgccagtcagcagtacagagagtgttatccagagcaacacccccacccccccaccatcccaaccattgaacgagacggccgaggaggaaagccgaataagttcaagccctacgctgttagaaaattcgctggagcagactgtcgagccctcagaagaccacagcgaggaagaatcagaagagggatccggcgacctgggcgagcccctctatgaggagccttgcaacgaaattagtaaggagcaggcaaaggccacactcctcgaggaccagcaggaccctagcccttcttcatag

SEQ ID NO: 221652 - DNA, 738 bp, Artificial Sequence
  Description of Artificial Sequence: Synthetic coding sequence
atgtctaattcaggagactatgaaatcctgtactgggacattcccaatggctgtaaactgattcgaaaccgttcggactgcaaagatatcgattggactacctacacgtgcgtcttgggcttccaggtgtttggcgtgtggccagaggggagcgatgggaccgacataaatgcactcgtgcggagccacaacaggaaagtcatcgcggtcgccgatgatttttgcaaggtgcacctgtttcagtacccctgctctaaagccaaagcccctagccacaagtactcggcccacagcagccacgtgacaaacgtgagcttcacgcataatgactcccacttgatttctaccggagggaaggatatgtcgattattcaatggaagctcgtggaaaaactgagtctcccccaaaacgagaccgtcgctgacaccaccttgaccaaagctccagtgtcaagcaccgaatcggttatacagtctaacacgcctactcccccaccctcccagcccctgaacgagaccgcggaagaggaatcacgtatctcctcctcacccactctgcttgagaactctctcgaacagacagtggagccttctgaagatcactctgaggaagagtcagaggagggatccggcgatctgggagagcccttatatgaagaaccctgtaacgaaatttccaaagagcaagcaaaagccaccctgctggaggaccagcaggacccatcaccaagttcatag

SEQ ID NO: 221653 - DNA, 2772 bp, Artificial Sequence
  Description of Artificial Sequence: Synthetic coding sequence
atggacggatttgccggatccttggacgactctatttctgccgcaagcactagcgatgtccaggatcggctgagtgcccttgagtctagggtacagcaacaagaggatgagatcacagtgctaaaagccgctttggccgacgtgctaagacggttggcaatcagtgaggaccacgtggcctctgtgaagaaaagcgtctcctctaaaggccagcctagccccagagcagtcatacctatgtcttgcatcactaatgggtccggagcaaatcgaaagccttcccatacctcagccgtttccattgccggaaaagaaaccctgtcgagcgcagccaaaagcatcaagaggccctctccggctgagaaaagccataactcctgggagaacagcgatgatagccgcaataagttgtcgaaaattccatccaccccaaaactgatccctaaggttaccaagactgctgataaacacaaggacgtgattattaatcaggagggggagtatataaagatgtttatgcgaggcagaccgatcactatgttcatccctagtgatgtcgataactacgacgacatccggacagagctacctcccgaaaagttgaagctggaatgggcgtacggataccggggaaaggattgccgcgcaaacgtgtacctgcttccaaccggaaagattgtatactttatcgcatctgtagtggtactgtttaattacgaggaaaggactcagaggcattatctgggtcacaccgactgtgtaaagtgtctggcaattcacccagacaaaatacggattgcaacaggccagattgccggagtcgacaaggacggaaggcctcttcagccacacgtcagagtttgggactcagtgacactaagcaccctgcaaataatcggccttggcactttcgaaaggggtgtggggtgtttagactttagcaaggctgactcaggcgtacacctgtgtattatcgacgattcaaatgagcatatgttaaccgtgtgggactggcagaaaaaagccaaaggggctgaaattaagacaaccaacgaagtggttctggcagtcgagtttcatccaacagacgccaacaccattatcacatgtggcaagtcccatatcttcttctggacctggagcggaaattcgttgacccgcaaacaaggcattttcggtaagtacgaaaagcccaaatttgtgcagtgcttggcttttctaggaaacggagacgtacttacaggagattccggcggtgtcatgctcatttggagtaagaccacggttgaacccacccctgggaagggccctaagggtgtgtatcagatctcaaagcagatcaaagctcacgatggttcagtgtttaccctctgccagatgagaaatggtatgctgcttacggggggtggcaaggaccgtaaaataatactgtgggatcacgaccttaacccagaacgcgaaattgaggtccctgaccaatatggcacaataagggcagtggccgaaggcaaggccgaccagttcctcgtgggaacatctcgtaatttcatcctgaggggtacttttaacgacggcttccagatcgaggtacagggccacacagatgagctctggggactggccacgcatccctttaaagatcttctgttgacatgcgctcaggaccggcaggtatgtctgtggaactccatggaacataggcttgagtggaccaggttagtggacgagcccggtcattgcgctgattttcacccttccgggaccgtggttgctattgggacgcattctggacgctggttcgtgctggatgcggagacaagggatcttgtatccatccatacagatggaaatgagcagctgagtgtcatgagatattcaatagacggtacgtttctggcggtaggcagtcacgataacttcatctacctttacgttgtcagcgagaatggaagaaagtactcccgatacggcaggtgcaccggccattcaagttatattacccatctcgattggtcgcccgataacaaatatattatgtccaattctggagattacgagattctgtattgggatattcctaacgggtgcaagttgataaggaatagatccgactgcaaggatatcgattggacaacctatacttgcgttctgggattccaagtgtttggcgtctggccagagggctctgacggcaccgacatcaacgctctggttagatcccataatcgcaaagtgattgccgtggctgatgacttctgtaaagtgcatctctttcagtacccctgctcaaaagcaaaagccccatcacataaatactcggcccatagctctcacgtgaccaacgttagctttacacacaacgactctcacctcatatccacaggaggcaaagatatgagcatcattcaatggaaactggtggaaaagcttagtctccctcaaaatgagactgtggccgatacgacactgacaaaggccccagtgtctagtaccgagtcagtcatccagagcaacacccctacgccaccaccaagccagccactgaatgagacggcggaagaagaatcacggatttcttcttcccctactctgttagaaaactctctggagcagaccgtggagccatccgaggaccattctgaggaggagtcagaggagggttcaggagatctcggagaacccttgtacgaagagccctgtaacgagatcagtaaggagcaggcaaaagcaaccctgctcgaggatcaacaggaccccagccctagttcatag

SEQ ID NO: 221654 - DNA, 780 bp, Artificial Sequence
  Description of Artificial Sequence: Synthetic coding sequence
atgcttcttcggtcttggtttggaaacaaagacttccaagccttgcctatccttgcaaggctgccatctatgcctaccgacatggagcacactggacattatctgcaccttgcctttttaatgaccacagtgtttagcctgagccccggaacgaaggctaattacacacgcctgtgggcaaactcaacgagttcctgggacagcgtgatacagaataagaccggccgaaaccaaaacgaaaacataaacaccaatccgattacgcctgaagtggattacaaggggaactccaccaacatgcccgagacgtcccacatcgtcgcgcttacctctaagtcagaacaggaactttacatccccagcgttgtgtctaattcgccttcaaccgtgcagtccattgagaacacgtcaaagtcccacggagagatatttaaaaaagacgtctgtgccgagaataacaataacatggccatgctcatctgcctcattatcattgccgtgctgtttctgatttgtacctttctgttcctatctacagtggtgctggccaacaaggtgtcttccctgcggcgatcaaagcaggtaggcaaaagacaacctcgatccaatggcgacttcttagcgtccgggctgtggcctgcggaatcagatacctggaaaaggacaaaacaacttaccggccctaacttggtgatgcagtccactggggtgctcacagcgacgcgcgaacggaaggatgaagaggggaccgaaaaactgactaataagcaaatcggatag

SEQ ID NO: 221655 - DNA, 711 bp, Artificial Sequence
  Description of Artificial Sequence: Synthetic coding sequence
atgcccaccgatatggagcataccgggcattacctgcacctggcctttttaatgactacagtcttttcactcagccccggaactaaagcgaactacaccagactgtgggcaaactctaccagctcctgggacagtgttattcaaaataaaaccggccgaaatcagaacgaaaatatcaacacaaatcccatcactccagaagtggactacaagggcaacagtacgaacatgcccgagactagtcacatcgtggcgctgacgtcgaagagcgagcaagagttatatatccccagcgtggtctcaaattcccccagcacagtccagagcattgagaacacgagcaagtcccacggggagatcttcaagaaagacgtttgcgctgaaaacaacaataacatggccatgcttatctgtttgataatcattgcagttctgtttctcatttgcactttcctgtttctgagcacggtggtgctagcgaacaaggtgtcctctctgcggagaagcaaacaagtaggtaaacgccagcctcggagtaacggcgatttcctggccagcggattgtggcctgctgagtccgatacctggaaacggaccaagcagctcaccggtccaaatctagtcatgcagagcacgggggtcctcacagccacaagggagagaaaggacgaggaggggaccgaaaagctcactaataaacaaattgggtag

SEQ ID NO: 221656 - DNA, 711 bp, Artificial Sequence
  Description of Artificial Sequence: Synthetic coding sequence
atgcctactgacatggagcacaccggccactacttacacctagccttcctgatgactacggtgttcagtctgtcccccggtactaaggccaattatacacgcttgtgggccaatagcacctcatcttgggacagcgtgatccaaaacaaaaccggcaggaaccagaatgaaaatataaacaccaacccaattacccccgaagtggactacaaagggaattcaaccaatatgcccgagacaagtcatatcgtggctctcaccagcaagagcgaacaggaactctacataccaagcgttgttagcaacagccccagcacagtccagtcaatagaaaatacatctaagagccatggagagatattcaaaaaagacgtgtgcgcggaaaataacaacaacatggctatgctgatctgcctgatcatcatagccgttctttttctgatctgtacgttcctgttcctgtcaacggtcgtacttgcaaataaggtttcctccctgcgacgatccaagcaagtgggcaagaggcagcccagatccaacggcgatttcttagcctccggactgtggccagcggagagtgacacctggaagagaaccaaacaactgaccggtcctaacctggtgatgcagtcaaccggagttctgaccgcaacccgagagagaaaagacgaggagggcaccgaaaaactaacaaacaagcagatcggctag

SEQ ID NO: 221657 - DNA, 699 bp, Artificial Sequence
  Description of Artificial Sequence: Synthetic coding sequence
atggagcatacggggcactaccttcacctcgcatttctgatgacaacggtgtttagcctttcacctgggacaaaggcaaactacacacgcctgtgggccaattccacctcttcttgggactctgtgattcaaaacaagaccggacggaatcagaatgaaaatattaacaccaatccaataacacctgaggtggactacaaggggaattctactaacatgcccgagacgtcacatatcgttgccctgacatccaagagcgagcaagagctttacattccctctgtggtgtccaactccccgtccactgttcaatcaattgaaaatacctctaagtcccatggcgagatttttaagaaggatgtgtgcgctgagaataacaataacatggccatgctgatttgccttatcatcatagcagtgctttttctgatttgcacatttttgtttctctctaccgtggtgcttgccaacaaagtgtccagccttagacgcagtaaacaggttgggaagagacagccccgttctaacggggacttcttggctagcggactgtggccagcggagtcagacacctggaagcgcaccaagcagttgacagggccaaacctggtcatgcagtcaacaggcgtgctgacagccactagagaaaggaaagacgaggagggaactgagaagctaactaacaagcaaattgggtag

SEQ ID NO: 221658 - DNA, 1347 bp, Artificial Sequence
  Description of Artificial Sequence: Synthetic coding sequence
atggatcctaagtacttcatcctcattctcttctgtggccacctaaacaatacattcttcagcaagactgagacaatcactaccgaaaagcagagccagcctactctttttacatcatccatgagtcaggtcctggcgaattctcagaacactacaggcaatccgctgggtcagccgacccagttttcagacacttttagtggccagtccatttcgcctgctaaggtgaccgctggccaacctactcctgccgtctacacaagcagcgaaaaaccagaggcccacacatccgcgggacagccacttgcctacaacaccaaacagcctacaccgattgccaatacatcaagccagcaggccgtgtttaccagcgccagacagttgccctccgccagaacgagcaccacccagccgcctaaatcttttgtgtacacctttacacagcaatcctccagcgtgcaaattcccagccggaaacagataaccgtgcataacccctctactcaacctacatctactgtgaagaattctcctcgctctacaccgggttttatactggacacaactagcaataagcagactccccagaagaataactacaacagcatcgctgccatccttataggagtgttgctgacttcgatgctggttgccatcatcattatcgtcctgtggaagtgcctacgcaagccagtgctgaacgaccagaattgggcgggacgaagcccttttgccgatggcgaaactcccgatatctgtatggataacatacgggagaatgagatttctaccaaacggacttcaatcatttcccttaccccttggaaaccctctaaatctactttgttagctgacgacctcgagatcaaattgttcgaatcttcagagaatatagaggattccaacaatcccaaaacggagaaaatcaaggatcaggtcaacgggacctccgaggacagcgctgatgggagcacagtcggtactgccgtgtcgtctagcgacgatgcagacttgcccccacccccaccactgttggatctggaagggcaggagagcaaccagtctgacaaaccaacaatgactattgtgagccccctaccaaacgatagcacttcactgcccccatccctcgactgtttaaatcaggattgcggggatcataagagtgagattatccagtccttccccccacttgatagcctgaacttgcccctacccccagttgatttcatgaagaatcaggaagatagtaacctggaaattcagtgtcaggagttcagcattccacctaatagcgatcaggacctgaatgagtcgctgccccctccccctgccgagctgctgtag

SEQ ID NO: 221659 - DNA, 1392 bp, Artificial Sequence
  Description of Artificial Sequence: Synthetic coding sequence
atgctgtttcgatacgccgagaagattacccgtaaatactcagagatggatccgaaatacttcattcttatcctgttctgcggccatcttaataacacgttcttctctaaaacggaaactatcacaacggagaaacagagtcagcccactctcttcacgtccagcatgagccaggtgctggcaaacagccagaacaccactggtaatcccctgggccaaccaacacagttctctgacacatttagcggccagtccatcagtcccgctaaggttacggctggccagcccaccccagctgtgtatacgtcctctgagaagccagaggcacatacatcagccggtcagcccctcgcttataatactaaacaacccacccctattgccaatacaagcagtcagcaggcagtcttcacttccgctagacagctgccctcagctagaacttctaccactcaaccgccaaaatcctttgtatacacgttcacacaacagtcaagctcagttcagatccccagccgcaaacagattacagtgcacaaccccagcacacagcctacctccacagtgaagaactctccgaggtcaactcctggatttatccttgacactacctcaaataagcaaacaccacagaagaataattacaattctatcgccgctattctcattggcgtgttactgacatctatgctggtggcaatcattataatagtgctatggaaatgcctgaggaaacctgtgctgaatgaccaaaattgggccggtcgcagcccattcgccgacggggaaactcctgatatatgcatggacaacattcgagaaaacgagatttctaccaaaagaacctccattatctctctcacaccctggaaaccctctaagtcaactctcctcgcagatgatctggagattaagttgtttgaaagcagcgaaaacatcgaggattccaataaccccaaaaccgaaaaaatcaaagaccaggttaatggcacgagtgaagactcggctgacggcagcactgtgggaacagccgtctcatcatcagacgacgcagacctgccaccaccccctccactgttagatttagagggtcaggaatcaaaccagtctgacaaacccactatgaccattgtatctccattaccaaatgacagcacctccttgcctccctcactggactgtctcaatcaggactgcggcgaccataaaagtgagatcattcagtccttccctcccctcgatagcctcaacttgccactgccccctgtagattttatgaaaaaccaggaagactctaatctggaaatccagtgccaggagttttccatcccacccaattccgatcaggatcttaacgagagccttcctccacctcctgcagaactattgtag

SEQ ID NO: 221660 - DNA, 924 bp, Artificial Sequence
  Description of Artificial Sequence: Synthetic coding sequence
atgaaccaggcagagctcatgcagctagacatggaaggtatgttacagcactttcaaaaggttatcccccatcagttcgacggagtgcctgacaagcttattcaggccgcataccaggtaaagtataacagtaaaaagatgaagaagctggaaaaagaatacactactataaagaccaaggagatggaggagcaggtggaaatcaagaggcttcgcaccgagaatcggctccttaagcagcgcatagagaccttagaaaaagagtctgcatccctcgctgaccgcttaattcaggggcaagtgacccgagcccaggaggccgaagaaaactacttaattaaacgcgagctcgcgacaattaaacagcaatccgacgaagccagcgcgaagctggaacaggccgagaacactattcgtaaacttcaacaccagcagcagtggcacaaatgttctagcaactataacgaggatttcgtacttcagttggagaaagaactggtgcaggcacgactgtccgaagccgagtcccagtgtgcgcttaaagaaatgcaggataaggttctggacatcgagaaacggaataatagcctgcccgatgaaaataacatcgctcgactacaggaagagctgatagcagtcaagcttcgagaggctgaggccatcatgggactgaaggagttacggcagcaggtgaaggatctagaggagcattggcagcgtcacctggcccgaacaacaggtcgttggaaggacccaccgaaaaagaatgccatgaatgagctgcaagatgaacttatgacaatcagactccgggaggcagaaacacaggcagaaattcgcgagataaagcagagaatgatggagatggagacccaaagtggaacttgcggaccactgctgaaaatcattttcttcaacgcctag

SEQ ID NO: 221661 - DNA, 2433 bp, Artificial Sequence
  Description of Artificial Sequence: Synthetic coding sequence
atggtgacaaacaagatgacagccgctttcagaaatcccagcggaaagcaggtcgccacggataaggtggcagaaaaactctcatctaccctctcttgggtcaaaaatacggtctcccacaccgtttcacaaatggctagtcaggtggcgagcccgagcacttctcttcacacaacgagtagtagcacaactctgtccacgccggctttgagcccaagcagtcctagtcagctgagccccgacgacctggaacttctcgcaaagctggaggagcaaaaccggctgctcgagaccgacagcaagtcacttcgtagtgtcaacggatctcggagaaactcaggtagctcactcgtcagctctagtagcgcatcctcaaacctgagccatctggaagaggacagctggatcttgtggggcaggattgttaatgagtgggaggatgttaggaaaaagaaggaaaagcaggtcaaagagctcgttcataaagggatcccacaccatttccgggcaatagtgtggcagttactgtgctcagcacagtcaatgcccatcaaggatcagtattccgaattgctcaaaatgacaagcccatgcgagaagttaattcggagggatatcgctagaacgtatcctgagcacaattttttcaaggagaaggacagcttgggacaagaggtgttattcaacgtgatgaaagcctactcgctggtggacagggaggtgggctattgtcaaggctcagcctttatagtgggtctcttgctgatgcagatgcctgaagaggaagctttctgcgttttcgtcaaactcatgcaggactatcgcctcagggaactcttcaaaccctccatggctgaactggggctgtgtatgtaccaatttgagtgtatgatccaggagcacttaccggagttgtttgttcactttcagagccagagcttccacaccagcatgtatgcttcctcctggttcttgacaatttttcttactacattccccttgcctattgccactcgcatttttgatatatttatgagcgaagggctagaaattgtgtttcgggtggggctagcactgctgcagatgaatcaggccgaactcatgcagctcgacatggagggaatgctccagcactttcagaaggtgattccacaccagttcgatggcgtgcccgacaaactcattcaggccgcttatcaagtgaagtataactctaaaaaaatgaagaagcttgagaaggagtacactacaatcaagactaaggagatggaggaacaggttgagataaaacggttacggactgaaaatcggctactgaaacagagaatcgaaacactggaaaaacacaaatgtagttccaactacaatgaagattttgttctgcaactggagaaagagttggtgcaggcgagactttccgaggccgaatcccagtgtgcactgaaggagatgcaggacaaggtgttagatatcgagaaaaggaataatagcttgccagatgagaataatatcgcgcgtctgcaggaggagctcatcgctgttaagctgcgtgaagctgaggcaatcatggggctgaaggagcttagacaacaggtgaaggacctggaagagcactggcagcggcacctcgcacggactaccgggagatggaaggatccccctaagaagaatgccatgaatgagttacaggacgagctgatgacaattcgccttagagaggcggagacccaggccgagatacgcgagatcaagcagcgtatgatggaaatggagacgcagaatcagatcaacagcaatcacctgaggagagcagagcaggaagtgatttctctccaggagaaggttcagtatctctcagcccaaaataagggcctgcttactcaactaagtgaggcaaagcggaagcaggccgagatcgaatgcaaaaacaaggaggaggtgatggctgtgcggctgagggaagccgacagtattgctgctgtcgccgaactgagacagcacatcgctgaattggagatccagaaagaagagggcaagctgcagggccagctcaataagtccgattctaaccaatacattggtgagttaaaggatcagattgcggagctaaatcacgaactgaggtgtctgaaggggcagcgtgggttttctggccagccgcctttcgacggaatccacatagtaaatcatctcatcggagacgacgagagtttccatagttcagatgaggactttatcgacaactccctacaagagacaggtgtgggcttcccgctgcatggtaaaagtggcagcatgtccctcgaccccgctgttgctgatggcagtgagtccgagaccgaggattcagtgctggagaccagggaatcaaaccaggtcgtgcagaaggagcgtccaccacgccgtagggagagctatagcacgactgtgtag

SEQ ID NO: 221662 - DNA, 2433 bp, Artificial Sequence
  Description of Artificial Sequence: Synthetic coding sequence
atggtaacaaacaaaatgaccgcggctttcagaaatcccagcggaaagcaggtcgccactgacaaggtcgcagagaaattgtcttcaacactttcttgggtgaagaatactgtcagtcacacagttagccagatggcctcccaggtggcttcgccctcaaccagtctgcataccacgtcatcctccacaacacttagcacgcccgctttgagccctagctccccctcccagctttcccccgacgaccttgagctactggctaagttggaagagcagaacagactgctggaaaccgactccaaatctctcagatcagtgaacggatcacgccgaaactcaggttctagtttggtaagctctagctccgccagctccaatctctcgcatctcgaggaggattcctggatactttggggacggattgtaaatgaatgggaagatgtgcgcaaaaaaaaggaaaagcaggtgaaggaattagttcataaggggatcccacatcattttagagctatcgtatggcaattactctgttcggcccagagcatgccgatcaaggatcagtatagcgagcttctcaaaatgacaagcccgtgcgagaaacttatccgaagagatatagccagaacgtacccagaacacaatttctttaaagagaaggatagtctcggccaggaggtcttgtttaacgtgatgaaagcttatagcctggtagatagggaggtcggatactgccagggatcagcttttatagtcggccttttattaatgcagatgccggaggaagaggctttttgcgtgttcgtaaaactgatgcaggactatcggttgcgggaattgtttaagccttccatggctgaactggggctgtgcatgtatcaattcgagtgtatgattcaagagcacttacctgagttattcgtccacttccagtcccaatccttccacacctcaatgtatgcatcctcctggtttttgaccattttccttacaaccttcccgctgcccattgctacacggatctttgatatattcatgtccgaggggttagagatagtttttagagtcggccttgctttgttacaaatgaaccaggccgaactcatgcagctggacatggagggaatgctccagcacttccagaaagtcatcccacaccagtttgacggagtgcctgataagttgatccaggccgcttatcaggtgaagtataacagtaaaaaaatgaagaagctcgaaaaggagtacacaacgatcaagacaaaagaaatggaggagcaggtcgagattaagagacttagaacagagaatcggctgctcaaacagcggatcgagacactggaaaagcacaagtgctcaagtaactacaacgaggacttcgtgctgcagttagaaaaagaactggttcaagctagactgtccgaagctgagagtcaatgcgcgttaaaggagatgcaagacaaagttctagacattgagaagcggaacaattcattgcccgacgagaataacatcgcaaggttgcaagaggaactgatagccgttaagttaagggaagccgaggctatcatggggttgaaggagctgcgccagcaggtgaaagacttggaggaacactggcaaaggcatctcgcaaggactaccggtagatggaaggacccacccaagaaaaacgcaatgaatgagttgcaggatgaactaatgactatccggcttagagaggccgagacacaggcggagatcagggagatcaagcagaggatgatggagatggaaactcagaatcagatcaattccaaccatctaaggcgagcagagcaggaagtgatcagtctccaagagaaagtgcagtacctctcagcacaaaacaagggcctacttacccaactatctgaggcaaaaaggaagcaggcggaaatcgaatgcaagaacaaggaggaggtcatggccgttcggcttagagaggcggacagtattgccgctgttgcagagctgaggcaacacatcgccgaacttgaaatccagaaggaggagggaaaacttcagggtcagctcaataaatctgatagcaaccagtacatcggggaactgaaggaccaaattgctgagctcaaccacgagctgaggtgcctgaaagggcaaagggggttttctggacagcccccattcgatggaatacacattgttaatcatctgattggagacgatgaaagcttccattctagtgatgaagatttcattgacaatagcttgcaggaaaccggagttgggtttcccttgcacgggaaatcggggagcatgtcgctcgatcccgcagtggcagacggctctgaaagtgagaccgaggactctgtcttggaaacgagggagtcaaaccaagtagtccagaaggaacgcccacctcggaggcgagaaagctactccactactgtttag

SEQ ID NO: 221663 - DNA, 2466 bp, Artificial Sequence
  Description of Artificial Sequence: Synthetic coding sequence
atggttactaataagatgacagccgcttttaggaatccgtcaggcaagcaagtggctaccgacaaagttgcggagaagctcagctccacactatcatgggtgaaaaacacggtgtcccacaccgtgagccagatggcatcccaagtcgcgtctccttccacatctttgcacacaacctccagttccaccaccctgtcaactcccgcactttccccatcgtcccccagccagcttagccccgatgaccttgagctgctcgctaaactcgaagagcagaatcgcctcctggagaccgattctaagagcctgcggtctgtcaacggctcacggaggaacagcgggtcctctctggtctcttcctcatcggcttcctccaacttgtcgcacctggaggaggactcctggatcctgtggggccgaatagtgaacgaatgggaagacgtccggaagaagaaagagaagcaggtgaaggaacttgtccataaaggcattcctcaccacttcagggccattgtgtggcagcttctctgctccgcccaaagtatgcctatcaaggaccagtatagcgagctgctaaaaatgacatctccttgcgaaaagcttataagaagagacattgcacggacgtaccctgaacacaactttttcaaagaaaaggacagtctcgggcaggaagttctgtttaatgtgatgaaagcatactcgctggtggatcgagaggtgggctattgccagggctccgccttcattgtagggctgctcctcatgcaaatgccagaggaggaagccttctgcgttttcgtgaaattaatgcaagactataggctccgcgagctgtttaaaccttccatggctgaattggggttgtgtatgtaccaattcgagtgtatgattcaggaacacctacctgaactgttcgtgcatttccagtctcaatctttccacacgagcatgtacgcaagttcttggttcttgaccattttcttgacgaccttccctctgcccatagccactcggattttcgacattttcatgtcagaaggtctggagatcgtgttcagggtgggtctggcactccttcagatgaatcaagcagaattaatgcagctcgatatggagggcatgctgcagcacttccaaaaggtgataccacatcagttcgatggtgtgcccgataagttgatccaggccgcttatcaggtcaaatacaattccaaaaaaatgaaaaagctagagaaggagtataccacaatcaaaaccaaggaaatggaggaacaggtggaaataaaaaggctccgcaccgagaataggctgttgaagcaacggattgagaccctcgagaaggaatccgcttctctggcagacaggctgattcagcacaagtgctcttctaactataatgaagactttgttcttcaactggaaaaggagctggtccaggcgaggctcagtgaggctgaatcacagtgcgccttaaaggagatgcaggataaagtgctcgacatcgagaagcgcaataactctctaccagatgagaataacatcgcacgacttcaggaggaactgatagcggtgaaactgcgcgaggccgaggcgattatgggactgaaggagctgaggcagcaagtcaaagatctggaggaacactggcagcgccatctggcgagaactactggacggtggaaggaccccccaaagaagaatgccatgaacgagttgcaggatgaattaatgactatcaggttgcgggaggcggaaacccaggctgaaattagggaaatcaagcagcggatgatggagatggagacgcaaaatcagatcaatagtaatcacctgagacgtgcggaacaagaagttatttccctccaggagaaagtgcagtacctgtccgcccaaaataaagggctgctgacgcagctcagtgaagccaagcggaagcaggccgagatcgagtgcaagaacaaggaagaggttatggccgtaagactccgcgaagcggatagtatcgcggctgtcgcagaactgagacagcacatcgcggagctggaaatccaaaaggaagaaggtaaacttcagggccaattaaacaagagtgactctaatcaatacatcggcgagttaaaagatcagatcgccgagcttaatcacgagctgaggtgtctgaaaggacaacgcggattctccggacagccaccattcgacggtatccacatagtgaatcatctgataggagacgatgagagctttcactcgagcgatgaagatttcattgacaattccctacaggaaaccggagttggcttccctctccatggcaagtctgggtccatgagcttggacccagctgtagcagacggatctgagtcggaaacagaggatagcgtgcttgagactcgagaatctaatcaggtagtgcagaaggagcggcctcccaggagacgcgaatcttacagcacaaccgtctag

SEQ ID NO: 221664 - DNA, 891 bp, Artificial Sequence
  Description of Artificial Sequence: Synthetic coding sequence
atgagctgggtccaggcaacgttgctagctaggggcctttgccgggcttggggcggaacatgtggcgcagcgctgactggcacgagcatttcccaggtccctcgtagactcccacgcggtttgcattgctcagccgcagcccattcctcagagcagtcattggtgccctctccacccgagccgaggcagaggcctacgaaggctctggtcccattcgaggatctcttcggtcaagcgcctggcggagagcgggataaggctagtttcctgcaaaccgttcagaagttcgcagagcactccgttaggaagagagggcacattgacttcatttatttagccctgaggaagatgcgggagtacggagttgagcgcgacctggcggtgtacaatcagttgttgaatatcttccctaaagaggtttttaggcctcgcaacatcattcagaggatcttcgtacactatcctagacagcaggagtgtggaatcgctgtcctggagcagatggaaaatcacggcgttatgcccaacaaagagacggagtttctccttatccagatattcgggagaaaatcctatcctatgttaaagcttgtgagactcaaactctggtttcctaggtttatgaatgtaaaccccttccctgtcccaagggatctgcctcaggaccctgtggaattagcaatgtttgggctgcggcacatggagcccgatctttccgctagagtgactatctaccaggtgcccctgcccaaggacagcacaggcgcagccgatcctcctcagccacatattgttggcagcggacgggacgccggaggcgtagaacctctgctgcctgacgccgctggccctggtgtctgtgaggagtggctggggcagctgagggtttag

SEQ ID NO: 221665 - DNA, 1296 bp, Artificial Sequence
  Description of Artificial Sequence: Synthetic coding sequence
atgagttgggtgcaggcgaccctgctagcgagaggtctgtgccgcgcatgggggggtacttgcggggcagctctgactgggaccagtattagtcaggttccaaggcggttgcccagaggcctccattgttcagcagccgcacactcctcggagcaaagtctggtgccctcccctcctgagccacggcaaaggcctactaaggcactggtgcccttcgaggatctttttggccaggcccctgggggtgaaagagataaggcctcatttttgcaaaccgtccaaaaatttgcagagcattctgtccgtaagcgaggccacatcgactttatctatttagccttacgaaagatgcgggagtacggggtagaaagggacctcgcagtatacaatcagctactgaacatcttccctaaggaggtgtttcgcccacgcaacatcattcagcggatattcgtgcattatcctcggcagcaggagtgcggcatagccgttcttgagcagatggagaatcatggggtcatgcctaacaaggagaccgagttcttgctcattcagattttcggtaggaagtcttatcccatgttgaagcttgtcagactgaaattatggttccctaggttcatgaatgtgaaccctttcccggttccaagggacctcccgcaggatcccgtggagctggctatgtttggtttacgacacatggaacctgatctgtctgcacgggtcacaatttatcaagtccccttgccaaaggactccacaggggctgcagacccgccacagccgcacatcgtgggcatccagagtcccgatcaacaagctgcccttgccagacacaaccctgcaagaccagttttcgtggaggggccatttagcctgtggttacgcaacaagtgcgtctattaccatatactgagagcagatctcttacccccagaggaaagagaggttgaggaaacgccagaggagtggaacctgtactaccctatgcagcttgacctcgaatacgtaaggtcgggttgggataattacgagtttgacataaatgaggttgaagagggcccagtttttgccatgtgcatggcgggagcacacgatcaagccacgatggcaaagtggatccaagggctccaggaaactaaccccacactggcacaaatccccgtcgtctttcgacttgctgggagcacgagggaattgcagacgtcctccgcagggctggaagagccacctcttcccgaagaccaccaggaggaggacgacaacctgcagagacaacagcagggacaaagctag

SEQ ID NO: 221666 - DNA, 654 bp, Artificial Sequence
  Description of Artificial Sequence: Synthetic coding sequence
atgagttgggtgcaagccactctgttagctcgtgggctgtgccgagcctgggggggaacgtgcggcgctgcgttaacaggtacttcgatttcacaggtgccgctgccaaaggactctaccggagcagctgaccccccacagccacacatcgttggcattcaatcccctgatcaacaggccgctctggctcggcataaccctgcgcgacccgtttttgtcgagggcccattcagtttgtggctcagaaacaagtgtgtctattatcacattctcagggctgatcttcttccacccgaagagagggaagttgaggagacacctgaagagtggaacctgtactaccctatgcaattggatcttgaatacgttaggtccggttgggacaattacgaatttgatattaacgaggttgaggagggtccagtcttcgccatgtgcatggcaggcgctcatgatcaagccaccatggccaagtggattcagggcctccaggagacaaatccaacccttgcccagatcccagtagtgtttagattagccggtagcacccgagaactgcagacaagcagtgcgggactcgaagagcctcccttgcccgaggaccaccaggaagaagatgataatttacaacggcagcagcaagggcaatcttag

SEQ ID NO: 221667 - DNA, 891 bp, Artificial Sequence
  Description of Artificial Sequence: Synthetic coding sequence
atgtcttgggtgcaggctacattactcgccaggggactttgtagagcttggggcggaacctgcggagcagcgctcaccggcacatccatctctcaagtaccacggagactgccccgaggcctgcactgctccgcagcagcccactcatcagaacagagtctggttccttccccaccagagcctcgccagcggcctaccaaagccctggtgcccttcgaggacctttttggccaggcaccaggtggcgagagagataaggccagctttcttcagactgtgcaaaagttcgctgagcactccgtgagaaaaagggggcatattgattttatctacctcgcacttaggaagatgcgggaatacggagttgagcgggacctcgccgtttataaccagctgctgaatatcttcccaaaggaggtctttcgtccacgtaatatcatccagcgaatctttgtgcattacccacgccagcaggaatgcggaatagcggtcctagaacagatggaaaatcatggtgtaatgccaaataaagagacagagttcctcctgattcagatctttggcagaaagagttatcctatgctcaaactcgttcggttaaagttgtggttcccccgatttatgaatgtgaatccgtttcctgtgcccagagatctgccccaagacccagtcgagctggctatgtttggtctgagacatatggagcctgacctctctgcccgtgttaccatttaccaggtgcccttaccgaaggattccacaggagcagcggaccccccacagccccacatcgtggagctgacgtgttgccccaggcggagaggaaagtggaagcggaggcggaggtccggcacatcaaccaccaggtgttcttggacttggagtatgtag

SEQ ID NO: 221668 - DNA, 1770 bp, Artificial Sequence
  Description of Artificial Sequence: Synthetic coding sequence
atgagcgtctcggtgcacgagaaccgcaagtccagagcctcatcaggtagcataaacatatacctttttcacaaatcatcatacgccgacagcgtactcacccacctgaacctgttacggcagcagagactgttcaccgatgtcctgttacacgcgggtaatagaacattcccctgtcaccgagccgtgctggcagcttgctcccgatatttcgaggccatgttctccggcggacttaaagagtctcaggactcagaagtgaactttgacaattcaatccacccggaagtactggagctgctactggactatgcatatagttcaagagtgataattaacgaggagaacgcagagtctctactagaagccggagatatgctcgaattccaggatatacgagacgcttgtgcggagtttctagaaaagaacttgcaccctaccaattgtctgggaatgctgctgctgtccgacgcacaccagtgcacaaagctctatgaactcagttggcgtatgtgtttgtccaattttcagactatacgcaagaacgaggactttctgcagctcccccaggacatggtggttcagctgttgagctccgaggaactggagactgaggatgagcgcctggtatacgagtctgccatcaactggatttcttatgacctgaaaaaaagatactgttatctcccagagctgctgcagacagtgcgactcgccctactgcccgcaatctatttgatggaaaacgtggccatggaggaactcatcacaaaacaacgcaagtctaaagaaattgtcgaagaggcaattaggtgcaagctgaagatcctacagaacgatggtgttgtgacttccctgtgcgcccgtccaaggaagaccggccatgctttattcctgttaggcggtcagaccttcatgtgcgataaactctacctggtagaccagaaggccaaggaaattattccaaaagccgacataccttcaccaagaaaggagttttcagcatgcgcaatcggatgcaaggtctacattacggggggacgcggttctgagaacggcgtgtctaaagacgtctgggtgtacgatactttgcatgaggagtggtccaaagctgccccaatgctggtcgctagatttggacatggttcggcggagctcaagcattgcttgtatgttgtgggcggacacaccgctgccaccggatgtctcccagcctctccgtccgtgagtcttaagcaggtggagcattacgaccctactataaataagtggaccatggtggcccctctgcgggagggtgtcagcaacgcagccgtggtgagcgctaagctaaagctgttcgcctttggcggtaccagcgtcagccacgataaattaccgaaagtccagtgttatgatcaatgtgaaaatcgttggacggtgcccgctacttgcccccagccttggaggtacaccgccgcagccgtgctggggaatcaaatttttatcatgggtggagacacggagttttccgcctgtagtgcctataagtttaactctgaaacctatcagtggaccaaagtaggcgacgtgactgctaaacggatgagctgccacgcagttgcttctggcaacaagctttacgtggtgggcggttacttcggaatacagcggtgcaagactctggattgttatgatccgactttggacgtatggaactccatcactactgtgccttatagcctgatacccactgcttttgtgtccacttggaaacacctgccaagttag

SEQ ID NO: 221669 - DNA, 153 bp, Artificial Sequence
  Description of Artificial Sequence: Synthetic coding sequence
atgagcgttagtgtgcatgaaaatcggaagtcccgagcaagctcagggtcaattaacatctatctgttccacaaatccagttacgccgattcggttctcacacaccttaatctgctgcgacagcaaagactgttcacagatgtccttctctag

SEQ ID NO: 221670 - DNA, 15 bp, Artificial Sequence
  Description of Artificial Sequence: Synthetic coding sequence
atgtcggtgagttag

SEQ ID NO: 221671 - DNA, 1770 bp, Artificial Sequence
  Description of Artificial Sequence: Synthetic coding sequence
atgagcgtctccgttcatgagaacagaaagagccgggcttcctcaggctcgattaatatctatttgttccataaatcgtcttatgccgacagcgtgttgacccatttgaacctcctgcggcagcagaggttattcaccgacgtcctgctgcatgctggtaacagaactttcccttgccacagagcagttttggccgcttgttctcgctattttgaagcaatgttctcgggcggtctgaaggaatcacaggatagcgaggtgaactttgacaactccatccatcctgaggtactggaactgttattagactacgcttattcaagtcgggtgataatcaacgaggaaaatgcagagtccctgctcgaggccggagatatgttggagttccaagatatcagggatgcatgcgccgagttcctggagaaaaatttgcaccctaccaactgtctgggaatgcttttattatcagatgctcaccagtgtaccaagctctatgaactatcgtggaggatgtgtctctccaattttcagactatccgcaagaatgaagactttttgcagttgcctcaagacatggtcgtgcagctcctaagtagtgaggagctagagaccgaggatgagagactcgtctacgagagcgcaattaattggatcagttatgacctcaaaaaacgctactgctacctccccgaactgttacagactgtgaggttagccctgttgccagcaatatatctaatggagaatgtggccatggaggaactaattaccaagcagaggaagtccaaggagattgtggaagaggccatcaggtgtaagctgaaaatcttgcagaacgacggagtagtgacaagtctgtgcgctcgccctagaaagacaggacacgcactctttctactgggaggccaaacattcatgtgcgataagctctatctggtcgatcagaaggccaaggagatcattccaaaagccgacatcccctcccccaggaaggagttcagcgcttgtgctatcgggtgtaaggtttacattacggggggaagaggatcagaaaatggtgtttctaaagacgtttgggtgtatgacaccctccatgaggagtggtctaaggctgctcccatgctggtagctcggtttggtcatggctccgccgaactgaagcactgtctgtatgtggtaggcggtcatactgccgctacggggtgtctcccagccagccccagcgtgagccttaaacaggtcgaacactacgacccaaccatcaataagtggaccatggtcgcgccactgagagaaggtgtgtcaaatgccgctgttgtatcagcaaaactgaaactgttcgccttcgggggaacatccgttagtcatgataaactgccaaaggtccaatgttatgatcagtgcgaaaacaggtggaccgttccagccacatgcccgcagccttggcgctatactgctgccgctgttctgggcaatcagattttcattatgggcggtgatactgaattttcagcatgtagcgcctacaagttcaactccgaaacgtatcagtggacaaaggtgggcgatgttactgcaaagaggatgtcctgtcacgccgttgcctctggaaacaaactgtacgtggtcggtggatatttcggaattcagcggtgcaagactctggactgctacgatccaaccttggacgtgtggaattccataactactgtgccttacagtcttattcctaccgcatttgtgagtacgtggaaacaccttccatcctag

SEQ ID NO: 221672 - DNA, 1551 bp, Artificial Sequence
  Description of Artificial Sequence: Synthetic coding sequence
atgttctctggaggattaaaggagtctcaggatagcgaggtaaacttcgacaacagtatccatcctgaggtgctcgagctgctgcttgattatgcttattcttctagggttatcataaacgaggagaacgctgaatcactcctcgaggcgggagatatgctcgaatttcaggatataagagatgcctgcgccgagtttcttgaaaagaacttacacccaactaattgtctggggatgctgctgctgtcagacgcacatcaatgcaccaagctgtacgaactgagttggcggatgtgtctatccaatttccagaccatacgcaagaacgaagacttcttacagctgccacaagatatggtcgtccaactgcttagctctgaggaattagagactgaggatgagcgcctagtgtatgaaagtgctattaattggatctcgtatgacttgaaaaagcgatactgttacctccctgaactgctacagactgtacgcctcgcactgctccccgcaatctatctgatggaaaatgttgcaatggaagaactgatcacaaagcagcggaaatctaaagagattgttgaggaagcaattcgttgtaagctcaaaattttacagaatgacggcgtggtcacatcactttgtgccaggcccagaaagactggacacgctttgtttcttttaggcggacagacattcatgtgcgacaaactgtacttagtcgaccagaaagctaaggagatcatccccaaagctgatatcccctctccacgaaaagagttcagtgcctgcgcaatagggtgtaaagtgtatataactggcggaagaggaagcgagaatggggtgtcaaaagacgtctgggtatatgatactttgcacgaggagtggagcaaagctgctcctatgctggtcgcgaggtttggtcacggaagcgccgagctcaaacactgcctctatgtggtcggtgggcataccgctgccaccggctgcctgccagcctctccgtccgtctcgttgaaacaggtcgagcattacgatcccaccattaataaatggacaatggtggcccctctgcgggaaggcgtgagcaatgctgcagtagtgtcggcaaagctcaaactgttcgcattcggtggaacctctgtcagtcatgacaagttgcccaaggtgcagtgctatgatcagtgtgagaaccggtggactgtcccagccacctgcccacagccctggagatacaccgccgcagctgtcttgggaaatcagatctttattatgggcggtgacacggagttctctgcttgcagtgcttataaatttaattctgaaacataccaatggacgaaggtgggcgacgtaaccgcaaagagaatgtcctgccatgctgttgcttcgggaaataaactgtatgtcgtaggcggatatttcggcattcagagatgcaaaaccttagactgctacgaccctactcttgacgtgtggaactctataacaaccgtcccttactccctgatacccacagcgttcgtctccacttggaaacaccttccctcctag

SEQ ID NO: 221673 - DNA, 1932 bp, Artificial Sequence
  Description of Artificial Sequence: Synthetic coding sequence
atggtggacgcagggggagttgagaacattacacagttgccccaggagttgccccaaatgatggcagccgcagccgacggcttagggagcattgccattgatacgactcagctgaatatgtccgtgaccgaccctaccgcatgggccacggcgatgaacaacttaggaatggttccggtgggtttgcccggtcaacagctcgtatctgatagtatctgcgttcccggttttgatcctagcctgaatatgatgaccgggattactccgataaaccctatgatccctggcttaggactggtgccgccaccccctcccacagaggtcgccgtggttaaggaaatcattcactgtaagtcatgcactctgtttccacagaaccctaatctgccccctccatccaccagggagagaccaccgggatgcaagacagtctttgtggggggactgcccgaaaacgccaccgaggagataatccaggaagtgttcgagcaatgcggagatatcacagccattcgaaagtccaaaaaaaatttctgtcacatcagattcgctgaggagtttatggtggacaaggctatttaccttagtgggtatagaatgcggctgggcagcagcaccgataaaaaggattcaggtagactccacgttgatttcgcccaggctcgcgacgacttctatgaatgggaatgcaaacagcggatgcgagccagggaggagcgccacagaaggaagctcgaggaggaccgactgaggccaccctctcctccagcgataatgcactattccgaacacgaagccgctcttctcgcagaaaagctcaaggatgactcaaagttctctgaggcgattactgtgctgttgagttggatagaaagaggagaagtgaatcggcgatcagctaaccaattctattccatggtacagtctgcgaacagccatgtgcggagactgatgaacgagaaagctacccatgagcaggagatggaggaagcaaaagaaaattttaagaacgcactcactggcatcctcactcagttcgagcagatcgtggcagtgtttaatgcgtccacaaggcagaaagcttgggaccatttttccaaagcacagcgaaagaacattgacatctggcgaaagcactcagaggaactaagaaacgcccagagcgagcagcttatgggaatacggcgtgaggaggagatggagatgagtgatgacgaaaattgtgactccccgactaaaaagatgcgggtcgacgagagcgccttagcagcacaagcctacgcactcaaggaagaaaatgactctctccgctggcagttagacgcttaccgcaacgaagtcgaactcctgaagcaggaaaaagagcagctgttcaggaccgaggaaaacctgacaaaggatcaacagctgcagttcttacagcaaactatgcaaggcatgcaacagcagcttctgaccatccaggaagagcttaacaataagaaatctgaacttgaacaggccaaagaggagcaaagtcacactcaggccctgcttaaggtgctccaagaacagctgaaaggaaccaaagaactggtggaaactaacggtcactcacatgaggattcaaacgaaataaacgttctcaccgttgctctagtgaaccaggaccgtgagaacaacatcgaaaaacggtcccagggcctcaaaagcgagaaggaggccctgctgatcggcattatttctactttcctgcatgttcacccgtttggagccaacatcgagtacctgtggtcatatatgcagcaacttgatagtaaaatctcagcgaacgaaattgagatgctcctgatgaggttgcctcgcatgttcaagcaggagtttacaggagtcggagctacactggaaaagaggtggaagctatgtgcctttgaaggcatcaagactacctag

SEQ ID NO: 221674 - DNA, 1932 bp, Artificial Sequence
  Description of Artificial Sequence: Synthetic coding sequence
atggtggacgccggtggcgtcgaaaatattacccagctccctcaggaactaccccaaatgatggccgctgcagccgacgggctcgggtcaatcgctatagatacgacccagctcaatatgtccgttactgaccccactgcgtgggccacggccatgaacaacctggggatggtcccagtagggctccctggccaacagctagtgagtgacagcatctgcgtacccggatttgatccctccctcaacatgatgaccggcataactcctatcaacccaatgatccctggcctggggctggttccccctccccctccaacagaggtcgcagtcgtgaaggagatcatccattgcaaatcatgcactttatttccccagaaccctaatctgcctcccccatcaacgagggagcggcctcctggttgtaagaccgtctttgtgggcggactcccggagaatgcgacagaggaaatcatccaggaggtgttcgagcagtgcggggacatcacagcaattagaaaatccaaaaaaaatttttgccacatccgctttgccgaggagtttatggttgacaaggccatctatttaagcggctataggatgcggctagggagctcaaccgacaagaaggattccggacggcttcacgtggactttgcacaagcacgggatgatttctacgagtgggagtgtaaacagcgcatgcgggcaagagaagaaagacataggcgaaagctggaggaggatagacttcgccctccttcgccgccagccattatgcactattcagagcacgaggctgcactgcttgccgaaaagctgaaggatgacagcaagttttctgaggccattactgttctgctcagttggatagagaggggtgaggtgaaccgtcgttctgcaaatcagttctattcaatggtccagagcgccaacagtcacgtgagacgactgatgaacgaaaaggctactcacgaacaagaaatggaagaggcaaaggagaacttcaaaaacgccttgacaggaatccttacccagttcgagcaaatagtagctgttttcaacgcttccacacgccaaaaggcctgggatcacttttccaaagcccagaggaagaacattgatatttggcggaaacacagtgaagaactcagaaacgcgcagtctgagcagttgatgggcatcaggagagaagaagagatggagatgtcggacgacgagaactgtgactcacctaccaaaaagatgagagtggacgagtctgccctggctgcccaggcttacgccctaaaagaagagaatgattctctgaggtggcaactggatgcttataggaatgaagtggaacttcttaagcaggaaaaggagcagttgttccgaaccgaggaaaatctcaccaaagaccaacagctccaattcctgcagcagactatgcaaggaatgcagcagcagctcctcactatccaggaagaactgaacaacaagaaatccgaactcgagcaagccaaggaggaacagtctcatactcaggctctcctaaaagtactgcaggagcaactaaaaggaaccaaagagctggtggagacaaacggccattcacatgaagacagtaacgagattaacgtcttaacagtggccctagtgaaccaagaccgcgagaataatatcgagaagcgtagccaaggtctcaaatctgagaaagaggctctactcattggtataatcagtacgttcctgcacgtccacccctttggcgcaaatatcgaatatctatggagttatatgcagcagctagattctaagattagcgctaacgaaatcgaaatgctcctgatgcgactgcccaggatgtttaagcaggaatttaccggtgtgggagctacactcgagaaacgatggaagctgtgcgctttcgaaggaatcaagacaacttag

SEQ ID NO: 221675 - DNA, 708 bp, Artificial Sequence
  Description of Artificial Sequence: Synthetic coding sequence
atggtggacaaggccatctacctctctggataccgcatgaggctaggctccagcactgacaaaaaggatagcggacggttacatgtagactttgcccaagcccgtgatgacttctacgagtgggagtgcaagcagcggatgagagcccgagaggaacgccacaggagaaaacttgaagaagacagattgcgccctccttcaccacccgcaatcatgcactactcagagcacgaagccgcactgctcgctgagaaactgaaggacgattccaaatttagtgaggccatcaccgtgctcttgtcctggatagaacgaggtgaggtgaaccgacggtccgccaatcagttttactccatggtccagtccgctaacagtcacgtgaggcgccttatgaacgaaaaggccacccacgagcaagagatggaggaagcaaaggagaattttaagaatgcgctgacgggcatactcacacagtttgaacagattgtcgccgtctttaacgcatctacacggcagaaggcctgggaccatttcagcaaagcccaacggaaaaatatcgacatttggagaaaacactccgaggaattgcgtaatgcccagtctgaacaactgatggggatccggagagaagaggaaatggagatgagtgacgatgaaaattgcgacagtcctactaagaagatgagagtggatgaatccggggcatag

SEQ ID NO: 221676 - DNA, 1833 bp, Artificial Sequence
  Description of Artificial Sequence: Synthetic coding sequence
atgcaacgagatttcaggtggctgtgggtgtatgagataggttacgcagctgacaattccagaactctgaatgtcgactctactgctatgactctgcctatgtcagaccctaccgcctgggccacggcaatgaacaacctcggaatggcccctcttggtatcgccggacagccaattcttcccgatttcgaccctgctttggggatgatgactggcatcccccctattaccccaatgatgcctggtctcgggatcgttccaccacccatcccccctgatatgcccgtcgttaaggagatcatacattgcaaatcctgcaccctgttcccacccaaccccaacctcccgcctcctgccacgcgggagaggccacccggatgcaagaccgtgtttgtcggagggctccctgaaaacggcactgagcagatcatagtggaggtattcgaacagtgcggagagattatcgctattagaaaatccaaaaaaaacttttgccacatccggttcgcagaggaatacatggtggataaggcgctgtacctgagcggctaccgcattcggcttggctcttcaacagataagaaggataccggcagactgcatgtggacttcgcccaagcccgtgacgacctgtatgagtgggaatgtaagcaacggatgcttgctcgggaggagcgtcatcgtcgacgaatggaagaggaacgtcttcggccacctagccccccacccgtggtgcactacagtgatcatgagtgttctatcgtggcggagaagctgaaagatgatagtaagttttcagaggccgttcaaacgttgctgacctggatcgaaagaggagaggtaaatcgcagaagcgcaaacaacttctactccatgatacagagcgccaactcacacgttcgacgcctagtgaacgaaaaagctgcccatgagaaggacatggaggaagctaaagagaagttcaagcaggcgctgtctgggatcctgatccaattcgagcagattgtggccgtataccacagcgcaagtaaacagaaggcatgggatcacttcactaaggcccagcgcaaaaatatttccgtctggtgtaaacaagccgaggaaattaggaatattcataatgatgagcttatgggcattcgaagggaggaagagatggaaatgagtgatgatgagattgaagagatgaccgagacaaaggaaacggaagaatcggctctggtgtctcaggccgaggccctgaaggaggaaaacgattctctaaggtggcagctggacgcctaccgaaacgaggtggaactgcttaagcaggagcaaggcaaagttcaccgcgaggatgacccaaataaagagcaacagctcaaactgctacaacaggcactgcagggcatgcagcagcacctgctgaaggtccaggaggagtataagaagaaggaagccgaactagagaagctcaaggatgacaagttacaggttgagaagatgctggagaatctgaaagagaaggagagctgcgcctccagactgtgcgcttccaatcaggatagtgaataccctctggaaaaaaccatgaattcctcaccgattaaatctgaacgcgaggccctcttggttgggattatatcaacatttttgcacgtgcatccgtttggtgcatccatcgaatatatctgctcatacttacatagactcgacaacaaaatttgtacatcagatgtcgaatgcttgatgggaagactccaacacacctttaagcaggaaatgactggggtgggggctagtctggagaagagatggaaattctgtggatttgaggggctgaagctgacatag

SEQ ID NO: 221677 - DNA, 1917 bp, Artificial Sequence
  Description of Artificial Sequence: Synthetic coding sequence
cttccattcgaccccgcaaataacaatgagccactgcagttcggctccgcttccggaccgctggtaactgaaggattgattgagaacggtggggaatcttcaaaaaagcgtaaacgtacaaacacacctagcgcagacaactctcgcacactgaatgttgacagtaccgcaatgactttgcctatgtccgatccaacggcatgggcaacagccatgaacaatctgggaatggcccctctgggaatcgctggccagcctatcctgcctgacttcgacccagccctgggaatgatgactggtatccctcctatcactcccatgatgccaggcctcggaatcgtaccgcctcctatccctcctgatatgccggtagtgaaagaaatcatccactgtaaatcatgtaccttgtttccccctaatcccaatctgcctccccctgccacccgagaaagaccccctggctgcaagacggtgtttgtcggaggtctacccgaaaatggcacagagcaaataatagtcgaggtgtttgagcagtgcggggagatcattgccattagaaaatctaagaagaacttctgccacatccgtttcgccgaagaatacatggtggacaaagccttgtatctcagtggatatcgcatccgcctgggctcgagtacggataaaaaagataccggcagactgcacgtagacttcgcccaggccagggacgacctgtatgagtgggaatgtaagcagaggatgctcgcccgtgaggaacgccatcggagaagaatggaggaggaacggttacggccaccgtcccctccaccagttgtccactacagtgaccatgagtgctctatcgtagctgagaaactaaaagatgacagcaagtttagcgaagccgtgcagaccctcttaacctggatagaacgcggtgaggtgaaccggcgatctgctaacaatttctattccatgatccagtcagccaactcgcatgtgcggagattagttaacgaaaaggctgctcacgagaaggacatggaggaagccaaagagaaatttaagcaagccctgtcaggtatcttgatccagttcgaacagatcgtggccgtgtatcactctgctagcaagcagaaagcctgggatcacttcactaaagctcagcgcaagaatatttctgtgtggtgtaagcaggccgaagaaatccggaacatacataatgatgaactgatgggcattcggagagaggaggagatggaaatgtctgacgatgagattgaagaaatgacagagaccaaagagaccgaggagagtgctttggtgagtcaggccgaggccctgaaagaagaaaacgattctctccggtggcagctggacgcctacaggaacgaggttgagttgctcaagcaggaacagggcaaagtacatcgtgaggacgaccctaacaaagaacaacagctgaagctgctgcagcaagccctgcagggaatgcaacagcatctgctgaaggttcaggaagaatacaaaaagaaggaggccgagctggagaagctgaaagatgataagttgcaagtagaaaagatgctggagaatctcaaggaaaaagagagctgcgctagtagactctgcgccagtaaccaggatagtgaatatccgttggaaaaaaccatgaactccagccctattaagtctgaaagggaagcacttttggtgggaatcatcagcacattccttcatgtccaccctttcggagccagcatcgagtacatttgttcctacctccatcgcctggacaataagatatgtacctccgatgtggaatgcctcatgggcaggttgcagcacacttttaagcaggagatgacaggcgttggcgcttccctggagaagcggtggaaattttgtggctttgagggcctgaagctcacatag

SEQ ID NO: 221678 - DNA, 1833 bp, Artificial Sequence
  Description of Artificial Sequence: Synthetic coding sequence
atgcaacgtgatttcagatggctgtgggtgtacgaaattgggtacgccgctgacaattcacggacgctgaacgtcgacagcaccgccatgacactcccaatgtcagatccgacggcctgggctaccgctatgaacaatttgggaatggcaccactcggcattgctggccagccaatcctcccagattttgacccggcactgggaatgatgaccggtattcccccaatcacacccatgatgcctggtcttggcattgtacctcccccaattccacctgatatgcctgtagtaaaggaaattatccattgcaaaagctgcaccttattccctcctaatcctaacctcccacctcccgcaacccgtgagaggcccccaggctgcaaaacagtgttcgtcggcggactgcccgaaaacggtacagagcagatcatcgttgaggtgttcgagcaatgtggcgagataatcgctattcgaaagtcaaagaaaaacttttgccatattcggttcgccgaagagtatatggtggataaggcactttatctgagtggatatagaatcagacttggatcaagtaccgacaaaaaagacactggcaggcttcacgtggattttgcccaggctcgagacgacttgtatgagtgggagtgcaaacaaaggatgctcgcgcgtgaggaacgccatagaaggaggatggaagaagaacgattgcgcccaccgtcgcccccacctgttgtccattattcagaccacgaatgttcgattgtggcagagaaacttaaagacgattccaaattctctgaggccgtccagacactcctgacttggatagagagaggcgaggtgaataggcgatcagcaaataatttctatagtatgattcagtctgcaaattctcacgtccggaggctagtgaacgaaaaggcggctcatgagaaggacatggaggaagcaaaggaaaagttcaaacaggccctatctggaattttgattcagtttgagcagatagtcgctgtctatcactccgcatccaaacaaaaggcctgggaccacttcactaaagcccagcgaaagaacatttcagtttggtgcaagcaggccgaggaaattcgcaacattcacaatgacgagctgatgggcatcagaagagaagaggaaatggagatgagcgacgatgagatcgaagaaatgacagaaacaaaggaaacagaggagtcagctcttgttagccaagcagaagccttaaaggaggagaacgatagcctaagatggcaacttgacgcctaccggaacgaagtagagctcctaaagcaggaacaaggtaaggtccatagagaagacgatcccaataaggaacagcagctgaaactcctgcaacaagccctgcaaggtatgcagcagcatcttctgaaagtgcaggaagagtataaaaagaaggaggctgaactcgagaaactcaaagacgataagttgcaggtggagaagatgctcgaaaacctgaaggaaaaggagtcctgtgcaagcagactgtgtgcttccaaccaggacagcgaataccctctggagaagaccatgaattcctctcctattaaatcagagcgtgaggcattgttagttggcattattagcacgttcctccacgttcaccccttcggggcatctatcgagtatatctgctcctacctgcacagacttgataataagatttgtactagcgacgttgagtgtctgatgggacgcctccagcacacctttaaacaggaaatgactggggtcggtgcttcactggagaagagatggaaattttgcggcttcgaaggactgaagttaacttag

SEQ ID NO: 221679 - DNA, 1746 bp, Artificial Sequence
  Description of Artificial Sequence: Synthetic coding sequence
atgaccctccccatgagtgatccaaccgcctgggccaccgctatgaacaacctaggaatggctcccttagggatcgctggccagccaatccttcctgactttgatcccgcactgggaatgatgactgggatacctcctattacccccatgatgccagggttaggaattgtgcctccccctatccccccagatatgcccgtcgttaaggaaatcatacattgcaagtcatgcacgctatttccacctaaccctaatttgccaccaccagctacgagggagcgtcccccagggtgcaagactgtattcgtgggaggccttcctgaaaatggcaccgagcagatcattgtcgaggtgtttgaacagtgcggtgagatcatcgctattagaaagagtaagaaaaatttttgtcacatacgcttcgcggaagaatatatggttgataaagccctctatttgagtgggtaccgaatcaggctagggtcatcgacagataagaaggacactggcaggctgcatgtggactttgcacaggctcgtgatgatctttatgagtgggaatgtaaacagcgtatgcttgcacgggaagaacgccatcgtcgcagaatggaagaggagaggctgagaccaccttcacctccgcctgttgtgcactactcagaccacgagtgctccatcgtggcagaaaaactaaaagatgactccaaattttctgaagcagtgcagacactgttgacctggatcgagcggggtgaagtgaatcggaggtctgccaataacttttactccatgattcagagcgcaaactcgcacgtcagacgcctggttaacgagaaagccgcacacgagaaagacatggaggaggcaaaagaaaaatttaaacaggccctgtctggcatcctgatacaattcgaacagatcgtggctgtgtaccattccgcgagtaaacagaaagcctgggaccattttaccaaggcccaacggaaaaatatctccgtatggtgtaagcaagcagaagaaatccgcaacatccacaatgacgagctaatggggatccgcagggaggaagaaatggaaatgtccgacgacgaaattgaggagatgaccgaaaccaaggagactgaggaatcggcgctcgtctcacaggcagaagccctcaaggaggagaacgacagcttaaggtggcagttagacgcttacaggaacgaggttgagctgctgaagcaggaacagggcaaagtgcacagagaggacgatcccaacaaagagcaacagctgaagttacttcagcaagcactgcagggcatgcagcagcacctccttaaagtacaggaagagtataaaaagaaagaggctgaactggaaaaactcaaggatgataagctgcaggtggaaaagatgttggaaaacctgaaggaaaaagagagctgcgcgagccgactctgcgctagcaatcaagatagtgaatatcccctggaaaagacaatgaatagctccccaatcaagtcggagcgggaggccctgttggttggaataatctctacgtttctccacgtccacccctttggagctagtatagagtacatctgctcctacctccacagattggacaacaaaatttgcactagcgatgtagagtgtctcatgggacgattacagcacacattcaaacaagagatgactggggtgggcgcaagtctagagaaaaggtggaagttctgcgggttcgaaggactcaaactcacctag

SEQ ID NO: 221680 - DNA, 1746 bp, Artificial Sequence
  Description of Artificial Sequence: Synthetic coding sequence
atgactctgcccatgtccgaccccacagcttgggccacggccatgaacaatctgggcatggccccactggggattgcagggcaacccattctcccagactttgatcctgcactcgggatgatgaccggtatcccccctataacaccaatgatgccgggtttggggatcgttccaccccctattcctcccgacatgccagtggtcaaagagataattcattgcaaatcctgtacgctgttccccccaaatcccaacctccccccacctgccactagggagcggccacccggttgtaagactgtgttcgtcggcggattgcctgagaacgggaccgaacagattatagtggaggtgtttgagcagtgtggggaaatcattgccatccggaagagcaagaaaaacttttgtcacatcaggtttgccgaggagtatatggtggacaaggcgctgtacctcagcgggtaccgaatcaggcttggaagctcgacagacaagaaggatacagggcgtctccacgtcgactttgcgcaggccagagatgacctctacgaatgggagtgcaagcagaggatgcttgcccgagaggagagacaccggagacggatggaagaagagcggttgcggccaccatcaccacctccagtcgttcattatagcgaccacgagtgttccatagtggctgagaagctgaaggacgacagtaagtttagtgaagcagtacagaccctgctgacctggattgagcgaggcgaggtgaaccggcgttcagccaacaacttctactccatgatccaaagtgcgaactcccatgtcagaagattagtgaatgagaaggcagcgcacgagaaggatatggaagaggctaaagagaagtttaagcaggctttatctggaattttgatccagtttgagcaaatcgtggccgtttaccactcagccagcaagcagaaagcctgggatcacttcacaaaggcacagcgcaagaacattagcgtgtggtgcaagcaggcggaggagattcggaatattcacaatgacgagctgatgggaattaggagagaggaggagatggagatgtcagatgacgagatcgaagaaatgacagagacaaaagagactgaagagagcgctctagtttcccaagcagaggcgctgaaagaggagaatgatagccttaggtggcagctcgatgcttacaggaacgaagtggagctcctgaagcaggaacagggcaaggtccatcgagaggatgatcccaataaagagcagcagctcaagctgctacagcaagccctgcaggggatgcagcagcacctcctgaaagttcaagaagagtataaaaagaaggaagctgaactcgaaaagcttaaggacgacaagctgcaggtggagaagatgctggaaaacctcaaggagaaggagagctgtgcaagtcggctgtgcgccagtaaccaagattccgaatatccgctggagaagaccatgaattcttctcctattaagagcgagcgcgaggccctccttgtaggcataatctcaactttccttcacgtgcatccatttggagcctcaattgagtatatctgttcatatctacatcgcctggataacaagatttgcacaagtgacgttgagtgccttatggggagactgcagcacacttttaagcaggagatgacgggggtgggcgcaagcctggaaaaaagatggaaattttgcggctttgagggccttaaactgacatag

SEQ ID NO: 221681 - DNA, 1131 bp, Artificial Sequence
  Description of Artificial Sequence: Synthetic coding sequence
atgacacttcctatgtccgacccaactgcctgggctaccgctatgaacaatctgggaatggcccctctgggcattgcgggtcagcccattcttccagactttgatccagcccttgggatgatgacggggattccacccatcaccccgatgatgccgggtctcggcattgttccacccccaatacccccagatatgcccgtcgtgaaggagattatccactgtaagtcttgcacactgtttcctcctaaccccaacctaccccctccagccactcgagagcgcccacctggctgtaagaccgtgttcgtagggggtctgccggagaatggcactgagcagatcatcgtcgaggtgtttgaacaatgcggcgaaattatcgctatcaggaagagcaagaagaacttctgtcacatccgcttcgctgaagaatatatggttgacaaggcactgtacctcagcggatataggataaggctggggtctagtaccgacaagaaagatactggtcgactgcacgtcgattttgcccaggccagagacgatctgtacgagtgggagtgcaagcagaggatgctggccagggaagagcggcaccggagacggatggaggaggaaaggctgagaccaccatctccaccgcctgtggttcattacagcgatcacgaatgctctatcgtcgccgaaaaattgaaggacgatagcaagttttccgaggccgtgcagacccttctgacatggatcgaacgcggtgaagtgaatagaagaagcgccaacaatttctactcaatgatacagtctgccaactctcatgtgcggaggctggtgaacgaaaaggccgcacatgagaaagacatggaagaggctaaagagaaattcaaacaggccctcagcggcattctgatccaattcgaacagatcgtggcagtttaccactctgcgtcaaaacagaaggcttgggaccactttacaaaggcgcagcgaaagaacatttccgtgtggtgtaagcaggccgaggaaatcaggaatatccacaacgacgagctcatgggtattcggagagaagaagagatggaaatgtctgatgatgaaatagaggagatgactgagacgaaagaaaccgaggagagctag

SEQ ID NO: 221682 - DNA, 1407 bp, Artificial Sequence
  Description of Artificial Sequence: Synthetic coding sequence
atgacactgcccatgagtgatcctactgcatgggccacagctatgaataatctcggcatggcccctttggggattgcaggacagccaattttgccagatttcgaccccgcactgggtatgatgactggtattccgccaattacccccatgatgcctgggcttggaattgtgccccctcccatcccaccagacatgccagtcgtgaaagagataattcactgcaagagctgcacgctgttccctccaaatcccaatttgcctccacctgctacacgggaaagaccccctggctgtaaaacagtgtttgtcggcggactgcctgagaacggaaccgaacagataattgtagaggtcttcgagcagtgtggggaaatcattgccatcagaaagtccaaaaagaatttttgtcacatcagatttgccgaagagtacatggtggacaaggccctatatctgtcgggctatcggatccgtttgggatcatctaccgataaaaaagatacagggaggcttcacgtcgactttgcccaggcgagagacgatctgtatgaatgggagtgcaaacagcgtatgttggccagggaggagcggcacagacgcaggatggaggaggagagacttcggcctccatcaccccctcctgtggtgcattattcagaccatgagtgttcaatagtcgccgaaaaactgaaagatgactcaaagttcagtgaggctgtgcagaccctattgacctggattgagcgcggtgaagtcaatagaaggtcggctaataacttttatagcatgattcaaagcgctaactcacacgttagaagactcgtcaatgagaaggcggcacatgagaaggatatggaagaggctaaagagaagttcaaacaggccctgagcggcatccttatccaatttgagcagatcgtggctgtttaccattccgctagcaagcagaaagcatgggaccattttaccaaggctcagcgaaaaaacatctcggtatggtgtaagcaggccgaagaaatccgcaacatccataatgacgaactcatgggaatccgtagagaagaggagatggaaatgtccgatgacgagatcgaggagatgaccgaaaccaaggagaccgaagaatcagcccttgtgagccaggctgaagccctgaaggaggagaacgactcattaaggtggcaactagatgcataccgcaacgaggtggaactgctgaagcaggaacagggaaaggtgcatagggaggacgaccccaacaaggaacagcagctgaagcttctgcagcaggccctgcaaggaatgcagcaacatctgttgaaagtgcaagaagagtacaagaaaaaggaagcagagctcgagaaactgaaagatgacaagcttcaggtggaaaagatgaagaagtag

SEQ ID NO: 221683 - DNA, 1119 bp, Artificial Sequence
  Description of Artificial Sequence: Synthetic coding sequence
atggaatccgaagagcttgcagaccgtgtgctcgacgtggtagagaggtcactctccaattatccattcgacttccagggcgcaaggattattacaggccaagaggagggagcatacgggtggatcacaataaattatttgcttggcaaattctcccagaaaacccggtggttctctatagtgccttatgagactaacaatcaagaaacatttggggcactggatttgggaggagcaagcactcaggtgacctttgtccctcagaatcagactatagagagcccagataatgctctccagtttaggctgtatggcaaagactataacgtgtatacccactccttcctgtgctacggcaaagaccaggccctgtggcagaagttagcgaaggatatacaggttgcaagcaacgagatattgagagacccctgcttccatcctggttataaaaaggtagtgaacgtgagtgacctttacaagacaccctgtaccaagcgcttcgaaatgacactgcctttccagcagttcgaaatccaggggataggtaattaccagcaatgtcatcaatctatcctggaacttttcaatacaagttactgtccttattctcaatgtgctttcaacggaatcttcctcccgcctcttcagggtgactttggggcattctccgctttttatttcgtcatgaagttcctgaacctgacatcagagaaggtgtcacaggaaaaggtcacagagatgatgaaaaagttctgcgctcagccatgggaagagataaaaacgtcatacgccggagtgaaggagaagtacctgtctgagtactgcttctccggaacctacatcctatcactgctcttgcagggctatcacttcacggctgattcttgggaacacatccatttcatcggtaaaatccaaggctctgacgcgggatggacactgggttatatgttaaatctgacaaacatgattcctgctgaacaaccccttagcactcccctcagtcattcaacctatgtcttccttatggtgcttttctcactcgtcctgttcactgtggcaattatcggtttgctgattttccataaacctagctacttctggaaagacatggtatag

SEQ ID NO: 221684 - DNA, 1533 bp, Artificial Sequence
  Description of Artificial Sequence: Synthetic coding sequence
atggaagatacaaaggagagtaacgtcaagacattctgtagtaagaacatcctggccattcttggcttttcatcaatcatagctgtaattgctctgctcgccgtggggctcactcagaataaggccctgcccgaaaatgtgaagtatggtatcgttcttgatgctggctctagccatacctctctttacatttataagtggccagccgaaaaagagaacgatacaggagttgtgcaccaagtggaagaatgccgggtgaaaggtccgggtattagcaaatttgtacagaaagtgaacgaaattggcatttacctgactgattgcatggagcgtgctcgcgaggtgattcctcgtagtcagcaccaggagacccctgtctatctgggggctactgctggtatgcgcctcttgcgtatggaaagtgaagaactggctgaccgcgtgctggacgtggtcgagcggtccctttctaactatccttttgatttccaaggtgctcggatcattaccgggcaggaggagggggcttacgggtggattactataaactatctgttggggaaattttctcagaagactcgctggttttcgattgttccctacgaaacaaataatcaagaaactttcggtgccctggacctgggcggagccagtacacaggttactttcgtgcctcagaatcagacaatcgaaagccctgacaacgctttacagtttagactctacggaaaagattacaacgtatatacccactccttcttgtgctacgggaaggaccaggccctatggcagaaactcgccaaagatatccaggtcgcctcgaatgaaatcctccgcgacccttgctttcatcctgggtataagaaagttgtcaatgtgtctgacctttacaagacaccttgcaccaagaggttcgagatgactttgcccttccaacagttcgagatacagggtattggcaattaccaacaatgtcaccagtctatactagaactcttcaacacgtcttactgcccttactcccagtgtgctttcaatggcatcttcctcccacctctgcagggagatttcggagcattcagcgccttttattttgtgatgaaatttctgaatctgactagcgaaaaagtgagtcaggagaaggttacggaaatgatgaagaagttctgcgcgcaaccatgggaggaaataaaaaccagctatgccggagtgaaggagaagtacctaagcgaatactgcttttccggcacgtacatcctgagcttactgttacagggctatcattttacagcagatagttgggagcatattcatttcataggtaagatacaggggagcgatgctggctggacacttggatatatgttaaaccttacaaacatgattcctgccgagcagcctctttcaactcctctctctcactctacctacgtttttcttatggtactctttagccttgtactgttcacggtcgctataattggtctgctgattttccacaaaccatcttacttctggaaggatatggtgtag

SEQ ID NO: 221685 - DNA, 921 bp, Artificial Sequence
  Description of Artificial Sequence: Synthetic coding sequence
atgaaggggaccaaggatctaactagtcagcagaaggaatcaaatgtgaaaactttctgctcaaaaaacattttggctatcctggggttcagttcaattatagccgttatcgccctgctggctgtgggtctgacgcagaacaaggccctccccgagaatgtgaagtatggcatcgtgttggacgctggaagctcacatacctctctttacatttacaagtggcccgctgaaaaggaaaacgataccggagtcgttcaccaggtggaggagtgtcgagttaaaggtccaggaatcagcaaattcgtgcagaaggtgaacgaaattggcatctatctgaccgattgcatggaaagggcgagagaggtcatccctcgatctcagcaccaagagacgccagtctatctcggggctactgctggaatgcggttactcaggatggagtccgaagaactggccgacagggttctagatgtggtcgaacggtctcttagtaattacccgttcgactttcaaggagccagaattattaccggacaagaggaaggggcatacggctggattacgataaactacctgttgggcaaatttagtcagaagacacgatggtttagtatcgtgccatacgagacaaataaccaggagacttttggggcattggacctgggcggagccagcacacaggtcacattcgtgcctcagaaccagacgatcgagtccccggataatgccctgcaatttcgcctgtacggaaaagactataatgtgtacacacactcgttcctgtgttacggcaaggatcaggccctctggcaaaagctcgccaaggacatccaggcgtccatcacacagtcccgcccagcaccattcacatctgcgcctcctgcacccacatcttgttgcttccttttccagatccagtag

SEQ ID NO: 221686 - DNA, 1569 bp, Artificial Sequence
  Description of Artificial Sequence: Synthetic coding sequence
atgggaagggaagagcttttcctcaccttctctttctctagcgggtttcaggagtccaacgtgaaaaccttctgctcgaagaatatattagccatcctcggcttttccagcattatagcagtaatagcgttacttgctgtaggactgactcagaacaaagcactgcctgagaatgtgaagtatggcatagttctggatgctggctcgtcacacacgtctctctacatttacaaatggcccgctgagaaagagaacgataccggagtggtgcaccaggtagaagaatgccgcgtaaagggccctggaatcagtaagtttgtacagaaggttaatgagattgggatctatcttaccgactgtatggaaagggccagagaagttatcccaaggtcacagcaccaggagacccctgtgtatttaggcgcaaccgcagggatgcgcctcctgaggatggaaagtgaagaattggctgatcgggtactggacgtggtcgagaggtccctgagcaattatccattcgatttccagggggcaaggattataaccggtcaggaggaaggagcatacggatggattaccattaattatttgctggggaaattctcacaaaagacccgctggttctccatcgttccttacgagactaataaccaggagactttcggggcactggacttaggaggcgcatctacccaggtaacttttgtgccgcagaatcagactattgagtcacccgacaatgctctccaatttagactctacggcaaggattacaatgtctatacacactctttcctgtgctacggcaaggaccaggctttgtggcagaagcttgccaaggatattcaagtggcttcgaacgagattctcagagacccatgcttccatccaggctacaagaaagtggtaaatgtgtcggacctttataaaaccccttgtaccaaacgatttgagatgacactaccgttccagcaattcgagattcagggcatcggtaattaccagcagtgtcaccagtccattcttgagctgtttaatacctcctattgcccatacagccagtgcgccttcaacggaattttcttgccgcctttgcaaggtgatttcggggcatttagcgccttttacttcgtcatgaagttcctgaatttaacttccgagaaagtttcacaagagaaagtaacagaaatgatgaagaaattctgcgcccagccttgggaggagataaagacctcctatgcaggggtcaaggaaaagtacctctcagagtactgttttagtggaacatacattttatctttgttgctccagggctaccactttaccgctgacagctgggagcacattcacttcattggaaagatacagggctcagacgctgggtggactctcgggtacatgcttaacctgacgaacatgattccagcggaacagcctctgagcactcccctatcacactctacctacgtctttttgatggtcctgttcagtctagttttattcaccgtcgcaattatcggcctactcatcttccacaaaccgtcctatttctggaaagacatggtttag

SEQ ID NO: 221687 - DNA, 1554 bp, Artificial Sequence
  Description of Artificial Sequence: Synthetic coding sequence
atgaagggcacaaaagaccttacaagtcaacagaaagagtccaacgtgaagaccttttgctctaagaacatactggccattctggggttctctagtatcatcgctgtgatcgcactgttggccgtgggactcactcaaaacaaagcactgcctgaaaatgtgaaatacgggatagtcctggacgctggatcttcacacacgagcttgtacatctacaaatggccagccgagaaggagaatgacactggcgttgtgcatcaggtcgaggagtgccgggtcaaaggacccggtatctcgaagttcgtgcaaaaggtcaacgagattggtatttacctgactgactgcatggaacgagcccgagaagttattccacgaagccagcaccaggaaactccggtatacctgggcgcaactgccggaatgcgcctcctgcggatggaatctgaagaactcgctgacagggtgctggatgtggtggagagaagtctgagtaactaccccttcgattttcagggcgctcgtattattacagggcaggaggagggtgcgtatggctggattacaattaattatctactggggaagttctctcagaaaactaggtggttctctattgtgccctacgaaactaataaccaggaaacgtttggggctctggaccttggcggagctagcacccaggtgacctttgtccctcaaaaccagacgatagaatccccagacaacgctctgcagtttaggttatatggcaaggattataacgtgtatacccacagtttcctatgttatggaaaagaccaggccctctggcagaaactcgctaaagatatccaggtggcctctaatgagattctgagagatccttgtttccaccccggatacaagaaagtggtgaatgtctctgatctctataaaactccatgtaccaaaaggttcgagatgaccctcccttttcaacagttcgaaatccaaggaattggcaattatcagcagtgccaccaaagcatattggagctgtttaacacatcctattgtccctatagccagtgcgcttttaatgggattttcctccctcctttgcagggcgattttggcgctttcagtgcgttctacttcgtgatgaagtttctcaatcttacctcagagaaagtaagccaggaaaaagtgactgaaatgatgaagaaattctgcgcccaaccatgggaggagatcaagacctcttatgctggggtcaaagagaaatacctcagtgagtattgcttcagcggaacatatatcctgagtctgctcctacaggggtaccactttacagccgattcctgggagcacatccacttcatcggaaaaatccaggggagcgatgcaggctggactctgggatacatgctgaacctcaccaatatgattcccgcagaacaaccactatcgacgccactctctcacagtacatacgtgtttctgatggtcctgttcagcctggtcctgtttaccgtagccattataggccttctgatatttcacaagccctcttacttttggaaggatatggtgtag

SEQ ID NO: 221688 - DNA, 1119 bp, Artificial Sequence
  Description of Artificial Sequence: Synthetic coding sequence
atggaatccgaggaattggctgatagagttctggacgttgtcgaacgtagtctcagtaattaccccttcgatttccaaggtgcacggataattactggccaggaagagggggcttacggctggatcactataaactacttactgggcaagtttagccaaaagacacgctggttctctatcgtgccctacgagaccaataaccaggagacctttggtgccctggatctgggtggtgccagtacacaggtcacatttgtgcctcagaatcaaacaattgaatcccctgacaatgcgctccagttcaggctctacgggaaggattacaatgtatatacacactcgttcctctgctatggcaaggatcaggccctatggcagaagctagccaaggacatacaggtggcatcgaacgagatccttagagacccgtgtttccatcccggttataagaaggtcgtgaacgtatccgacctgtacaaaaccccctgcaccaaacggtttgagatgacgctgccttttcagcagttcgagattcagggaatcggaaactaccagcaatgtcaccagtccatccttgaattgttcaatactagttattgcccctacagccagtgtgcttttaacgggatattcctgcctcccctgcagggggatttcggagcgttttccgccttctactttgttatgaaattcctcaatctgactagcgagaaggtgtcacaggagaaagttactgagatgatgaaaaagttctgcgcccagccctgggaggagatcaagacctcctatgccggagtgaaggaaaagtacctctcggaatactgcttcagcgggacatacatcctcagcctactcttacaaggttatcatttcacagccgatagttgggagcatatccacttcatcggcaagatccagggttctgacgccggatggactttgggctatatgctgaacctcacaaatatgatacctgccgaacaacccctgagcacccctttaagccatagcacctatgtgtttctcatggtcctattttccttggttcttttcactgtggccatcatagggttactgattttccataagcccagctatttctggaaagacatggtttag

SEQ ID NO: 221689 - DNA, 1209 bp, Artificial Sequence
  Description of Artificial Sequence: Synthetic coding sequence
atggagcgcgctagggaagtgatccccaggtcccagcatcaagaaacaccagtgtatctgggtgccactgccggtatgcgcctgctccggatggaaagcgaggaactcgccgatcgggtcctggatgtcgtggagcgatcactgagtaattacccctttgactttcagggggctaggatcataaccggtcaggaagagggcgcttacggctggattacaatcaactacctgcttgggaagttcagtcagaagacacgttggttctcgatcgtgccctatgagacgaataatcaagagacgttcggagccctggatctcggtggcgcatccactcaggtgaccttcgtcccccagaatcagactatcgaatcacccgataatgcattacagttccggctttacgggaaagactacaacgtgtatacacacagttttctttgctatggaaaggatcaggctttgtggcagaagctcgctaaggacatccaggtcgcctcaaacgagatactacgggacccctgttttcaccctggatacaaaaaggttgtgaacgtgagcgacctgtacaagaccccctgcactaagaggtttgaaatgactttgccctttcagcagtttgagatccaggggatcgggaactaccagcagtgtcaccaaagtattctcgagttgtttaacactagttattgcccatattcgcaatgcgccttcaacggaatctttctcccacctctccaaggcgatttcggggctttctctgcattctacttcgttatgaaatttttgaacttgacaagcgagaaagtttcccaggagaaggttacagagatgatgaaaaagttctgcgcccagccttgggaagaaatcaaaacgagctatgctggggtgaaggagaaatacctttctgaatattgtttctctggcacgtacatcctcagcctcctgctccaaggatatcatttcacagcagactcgtgggagcatattcatttcattggaaaaattcagggcagcgatgccggatggacactgggatacatgcttaaccttaccaatatgattcccgcagaacagccgctgtcgacccccctttctcattctacgtacgtgttccttatggttctgttcagtctggtgctcttcaccgtcgccataatcggcttactaatattccacaagccttcctatttttggaaagatatggtgtag

SEQ ID NO: 221690 - DNA, 1419 bp, Artificial Sequence
  Description of Artificial Sequence: Synthetic coding sequence
atggccggtaaggtcaggtctctcctccctccgctcttacttgcagccgctgggcttgctggcctactgctgctatgtgttcccacccgcgatgtgagagagcctcctgcccttaagtacggtattgtgctcgacgcaggctcttcccacacctctatgtttatttataagtggccagccgacaaggagaacgacaccgggatcgttgggcaacatagctcctgtgacgtgccagggggtggtatttcgagctacgcagacaacccgtccggtgctagccagtcactggttggttgtctggagcaggctctgcaggacgtacccaaggagaggcatgcaggcacaccactctacttaggagccactgcaggcatgagactgctgaatctgacaaatcccgaggcaagcaccagtgtactgatggcagtgacacatactctgacgcagtaccccttcgattttagaggcgctcgtatcttgagcgggcaagaggagggcgttttcggttgggtgaccgcgaactatctcttggaaaatttcattaaatatggttgggtgggtagatggtttagaccaagaaagggaaccctgggagccatggacttgggaggcgctagcacccagattacgtttgagacaaccagtcccgctgaggatcgggcatctgaggtgcaactgcacctgtacgggcaacactaccgagtgtatacacactcatttctatgctatggcagggatcaggttttacagcgcctcctggccagcgccctgcagacccatggattccacccatgttggccacggggattctccacacaagtgctgctgggcgatgtgtatcagtccccttgtactatggcccaacggcctcagaacttcaactctagtgccagagtttctctgagtggatcctcagatccccatctatgccgggatctagtgagcgggctgttcagtttctcaagctgtcccttctctcggtgttccttcaatggggtgtttcagcctccagtggccggaaactttgttgccttctctgcttttttctatacagtggacttcctgaggacctctatgggtcttcctgtggccacattgcagcagctcgaggcagccgcagtgaatgtgtgtaaccagacttgggctcagcagctcctgtcaagaggatacggattcgacgaacgggcatttggaggtgtgatctttcagaagaaggccgcagacacggcagtcggttgggcccttgggtatatgttgaacctgaccaacctcatcccagctgaccccccaggcctgagaaaaggtactgacttcagttcctgggttgtcttgctcctcttatttgcctccgcgctgttggcagctttggttcttttgttaaggcaggtgcacagcgctaagctgccgagtactatttag

SEQ ID NO: 221691 - DNA, 1488 bp, Artificial Sequence
  Description of Artificial Sequence: Synthetic coding sequence
atggctggcaaagtccgatccttactcccgccattgttacttgccgcagctggactggcaggactgttacttctatgcgtccctacgcgggatgtaagagaaccgcctgctcttaagtatggcatcgtgctggatgccggatcctcacacactagcatgtttatctacaagtggcccgcagacaaggaaaatgatacaggcatcgtgggtcagcatagcagttgcgatgtgccaggaggcggaattagtagctatgcagataatccttctggggctagtcaaagcctcgtgggctgcctggagcaagcactccaggatgtccccaaggagagacacgcaggcacacccctttacttaggtgctactgctgggatgcggcttttaaacctcactaatcctgaggcgagtacatccgttcttatggccgtgacccataccctgactcaatatccgttcgatttccgaggggcacgtatcttatcaggccaggaggagggcgtgttcggatgggtcacagcaaactacctgctggagaatttcattaagtacgggtgggtaggacgctggtttaggccaaggaaggggaccttaggtgctatggacttaggcggagcgtccacacagattacatttgagactaccagtccggctgaggacagggcctctgaggtccagctacatctgtacggacagcactaccgcgtatatacccactctttcctctgttacggcagggatcaggttctacagcggctgctggcttcagcactgcaaacgcatggatttcatccctgctggccgagagggttttctacacaggtgctgctaggagatgtgtatcagagtccctgtactatggcccagcgcccacaaaacttcaacagcagcgcgagggtgtctctttccgggagcagcgacccccatctttgtagggatttggtctccggcctcttttcattttcttcctgcccattcagccgctgttcctttaatggcgtttttcagccccctgtagccggtaactttgtagctttttcagcgtttttttataccgtagactttctacgaacttcgatgggactgccggtcgcaacacttcagcaactggaagcggctgcggtgaatgtatgtaaccagacctgggctcagctccaggcgagagtgcctggccagcgtgctcgcctggctgattattgcgctggggctatgttcgtacagcagttgttgtctcgaggctacgggttcgacgagcgggcatttggaggcgtaattttccagaaaaaggccgcagacactgcagtcgggtgggccctgggctatatgctgaacttaactaacttaatccccgcagatccaccgggattgcgcaagggtaccgacttctcaagttgggtggttttgttgctcctttttgccagcgctcttctggccgcactggtactgctgcttaggcaggtccacagcgcaaaactgccctccacaatttag

SEQ ID NO: 221692 - DNA, 1590 bp, Artificial Sequence
  Description of Artificial Sequence: Synthetic coding sequence
atgtttacagtcttgacccggcagccctgtgaacaggccggactgaaggctctgtataggacccctactattattgctctggtggtcctcttggtgagcattgtggtcctggtctcgatcacagttatacagatacacaagcaagaagtcctgccacctggtctaaagtacgggattgtcctcgatgccggttccagcagaactacagtgtacgtttatcagtggcctgcagagaaagagaataacaccggcgtggtctcgcaaacgttcaagtgtagcgtcaagggcagcgggatatcttcctacgggaacaatccccaggatgtccctcgtgccttcgaggagtgtatgcagaaggttaagggccaagtgccttcacatctgcacggcagcacgcctattcatttaggggctacggctggcatgagactgttgcgcctgcaaaacgaaacggccgcaaatgaggtcctggaatctatccaaagctacttcaagtcccagccattcgacttccggggtgcccaaatcatctctggccaggaggaaggggtctatggctggattacagctaactatctgatgggtaacttcttggagaaaaacctgtggcatatgtgggtacacccccacggagtggagactacaggcgctttagatctcggaggggcttctacacagatcagttttgtggccggagagaagatggaccttaatacatccgacattatgcaggtcagtctgtatggctatgtctataccttgtacacacattccttccagtgctacggacggaatgaagccgaaaaaaagtttctggctatgctactccagaactctccaaccaagaatcacctgaccaatccatgttaccccagggactattctatatcatttacaatggggcacgtgtttgattcactgtgcaccgtcgatcagaggccagaatcttataatcccaatgatgttataacatttgaaggaacaggcgatcctagcctttgtaaggagaaggttgcatccatctttgactttaaagcctgtcacgatcaggagacttgcagctttgacggagtctaccagcctaaaattaaaggccctttcgtcgcgtttgccggtttctattacaccgccagcgcgttaaacctgtctggaagttttagcctggacacattcaatagctctacttggaacttttgttcccagaattggtcacaactgccgcttctactacctaaatttgacgaggtgtatgcacggtcttattgcttctccgcaaattatatctaccatctattcgtgaacgggtacaagttcacagaggagacgtggccccagattcactttgagaaggaggttggcaatagctcgattgcatggtctctcggctacatgctatcccttaccaatcagattccagctgagtcccccttgatccgcttgcctatcgagccaccggtctttgtagggacgctggcttttttcaccgcagctgccttgctgtgtcttgcctttttggcatacctctgttccgctacgagaaggaagaggcatagtgagcatgcgttcgatcatgctgttgactctgactag

SEQ ID NO: 221693 - DNA, 1590 bp, Artificial Sequence
  Description of Artificial Sequence: Synthetic coding sequence
atgttcacggtcctgaccaggcaaccttgcgaacaagccggtttgaaggcattgtaccggacgcctaccattatagccttagttgtgctgctggtctccatagttgttctcgtgagcatcacagtcatccaaatacacaagcaagaggtgctgccacctggcttgaagtacggtatcgtgctcgatgctgggtcttcacggaccaccgtgtacgtgtatcagtggccagcggagaaggagaacaacactggagtcgtttcccaaacattcaaatgcagtgtgaagggctcaggcattagtagctatggcaacaacccccaggatgtgccacgtgctttcgaagaatgtatgcagaaggtgaagggacaagtgcccagtcacctccacggttctaccccgattcatctcggcgctactgctggaatgagactgcttcgactgcagaacgagactgctgcaaacgaagtgctcgagagcatacaaagctattttaaatctcagcctttcgattttaggggagcccagatcattagcggacaggaagagggggtctacggatggattacagcaaactacctgatgggaaacttcctggaaaaaaatctttggcatatgtgggtgcatccccatggtgtcgagaccacaggcgctctcgacctggggggagctagcacccagatatcctttgtggccggtgagaaaatggacctgaataccagcgacatcatgcaggtgtcattgtatggctacgtatatactctgtacactcacagctttcagtgctacggccgaaacgaggcagagaagaagttcctcgctatgctgctgcagaattcgccaactaagaaccatctcaccaatccctgctacccacgagactacagcatttcctttaccatgggccacgttttcgactccttgtgcaccgtggatcaacgtcctgagagttacaatccaaatgatgttataacgttcgaggggactggggacccaagtctgtgtaaagagaaggtggccagcatctttgacttcaaggcctgtcacgaccaggaaacatgctcctttgatggcgtataccaaccgaaaatcaagggtccattcgtcgccttcgctggcttctattacacggcctctgccctgaacctcagtggcagtttctccctcgatacatttaatagcagcacgtggaacttttgctcccaaaattggtcccagttgcctctacttcttcccaagtttgatgaggtgtacgctcggagttattgcttttccgccaattatatctaccatttattcgtcaacggctataaattcaccgaagagacctggccacaaatccacttcgagaaagaggtgggcaattcctcgattgcatggtcattgggctacatgcttagcctgactaatcaaattccagctgagagtcccttgatcaggctccctattgagcctccagttttcgtggggaccctagctttcttcaccgcagctgccctgctgtgcctggcttttctcgcttacctatgttccgctacaagacgcaaacggcactctgagcatgcatttgatcacgcagtcgattcagactag

SEQ ID NO: 221694 - DNA, 1287 bp, Artificial Sequence
  Description of Artificial Sequence: Synthetic coding sequence
atggctacttcttggggcactgttttttttatgcttgtggtaagctgtgtctgtagtgcagtttcccaccgtaatcagcagacctggttcgagggcattttcctgtcatccatgtgccccattaatgtcagcgcatccacattatacgggattatgtttgacgccggatccaccggcaccagaatccatgtctatacttttgtgcagaaaatgccagggcagctcccaatcctggaaggggaggtctttgattctgtgaaaccgggactttcagcttttgtggaccagcccaagcagggagccgaaacagtccaagggctgcttgaagtggcgaaggactccatccccagatcgcactggaaaaaaactcctgtggtgctgaaggctaccgctggattacgcctcctaccagaacataaagccaaagccttgctgtttgaagtgaaggagatcttccggaaatctccatttctggtgcctaaaggaagcgtgagcatcatggacggaagcgacgagggcatactggcatgggtcaccgtgaacttcctcaccggtcagctgcatgggcatcggcaggagaccgtgggcacgctggacttgggaggagcatcgacacagatcacttttctgccccaattcgaaaagaccctggagcaaactcctagaggctacctgactagcttcgaaatgttcaatagtacctataaattgtacacccattcttacctgggctttggcctcaaggctgccaggctcgcgacacttggagccctggagactgagggtacagatggccacaccttccggtcagcttgcctgccgagatggttagaagccgagtggattttcggcggtgtgaagtaccagtacgggggaaaccaggagggcgaagtgggcttcgaaccatgttacgccgaggttctgcgtgttgtgagaggtaaactccatcagccagaggaggttcagagaggttcattctacgcctttagttactattatgacagagctgtcgataccgacatgattgattacgaaaaaggcggaatactcaaagtcgaggacttcgagcgcaaagctagggaggtgtgtgacaatctggaaaacttcacctcgggtagtccgtttctgtgtatggatctgtcttacatcacagccctgcttaaggatggcttcggctttgcagattctaccgtcttgcagctgactaaaaaagtcaacaacatagagaccggatgggcacttggagctacctttcacttgctccagtctctcgggatcagccactag

SEQ ID NO: 221695 - DNA, 1404 bp, Artificial Sequence
  Description of Artificial Sequence: Synthetic coding sequence
atgcagccacagcatgggccatggcagacccgtatgagaaaaatcagcaaccacggaagccttcgggtcgccaaagtcgcatatccgctgggcctctgtgtaggggtttttatatatgttgcttatatcaagtggcaccgcgctacggctactcaggcatttttctctattacccgtgccgcaccgggtgcaaggtggggccagcaggctcatagtccattgggcaccgctgccgacgggcacgaagtcttctacgggattatgtttgatgccggtagcactgggacgagggttcatgtcttccaattcacacggcctccgagggaaacacctaccctgactcatgaaacctttaaggctctaaaaccaggactgagtgcttacgctgacgatgtcgagaagtctgcccagggaatacgggagctactcgacgtggcgaagcaggacattcccttcgatttttggaaagcgacccctcttgtgttaaaggccactgccggattgaggctgttacctggcgagaaagcacaaaagctgctgcagaaggtgaagaaagtgttcaaggcctcccccttcctcgttggggacgactgtgttagcataatgaacgggactgatgaaggagtgtccgcctggattaccattaattttttgacagggagcctcaaaacacccggagggtcatctgtgggaatgctggacctgggtggcggatctacccagatagcctttctccctcgagtcgaaggcactctccaagcctcccctccaggctacctaaccgcccttagaatgtttaataggacatataaactgtactcctatagttacctgggactgggactgatgtccgctagattagccatccttgggggagtggaaggccagccggcaaaagatggaaaagagcttgtctcgccctgcctgtctccctcatttaaaggggagtgggagcacgcagaagtgacataccgcgtgtctggacaaaaggctgccgcttcactccacgaactttgcgctgctagggtgtccgaggttctccagaatcgcgtacaccggactgaggaagttaaacacgtagacttttatgctttttcttactattacgatctggccgcaggtgtcggactaattgatgccgagaagggcggttccctggtggtgggggattttgaaatcgcagcaaaatatgtgtgtcgcaccttggagacccagccccagtcttccccctttagttgtatggaccttacttacgtgtctttactactgcaagaatttggctttcccaggtcaaaggtgctcaagctgaccagaaaaattgacaacgtggaaacatcgtgggccttaggcgctatcttccactacatcgatagcctcaatcgtcaaaagtcgccggcttcctag

SEQ ID NO: 221696 - DNA, 1452 bp, Artificial Sequence
  Description of Artificial Sequence: Synthetic coding sequence
atgaaaaaaggcatcaggtatgagaccagccgaaagacatcctacatatttcagccccagcatggcccttggcagactagaatgcgtaagatcagcaaccatggatctctcagagttgccaaagtcgcttaccctctgggcctgtgtgtaggggtctttatctacgtggcatatatcaagtggcacagagccactgctacccaggcctttttcagcataactcgagcagcaccaggtgccaggtggggacagcaggcccatagccccctgggaactgccgcagacggtcatgaagtgttctatggcattatgtttgatgcaggatcgacagggaccagggtgcacgtatttcagttcacgagacccccaagggaaacccccaccctgactcacgagactttcaaggcactgaaacccggactatcagcatatgccgatgacgtcgagaagagcgcacagggaatccgagagctgttggacgtggccaaacaggatatcccttttgatttttggaaggctacacccctggtgctcaaggctacggccggtcttcgcctgctgcctggggagaaagcgcagaagttgctgcaaaaagttaaaaaagtgttcaaagccagtcctttcctggtcggcgacgattgcgtgtcgattatgaacggaacagatgaaggggtttctgcatggataactatcaattttctcacgggatctctcaagacccctggagggtctagtgtaggtatgctcgacctcgggggaggcagtacacaaatcgccttcctacctcgcgttgaaggcaccctacaggcatctcccccaggctacttgacagccctgagaatgttcaaccggacctataagctgtattcctacagttacctggggctgggattaatgagcgccagactggctatcctgggaggtgtagaggggcagcctgctaaggatggaaaggagcttgtttccccgtgcctgagtcccagctttaagggagaatgggaacatgccgaagtgacctacagggtcagtggccagaaagccgctgcaagcctccacgaattatgtgccgcaagggtctcagaagtgctgcagaacagagtgcatagaactgaggaggtcaaacacgtggatttctatgcctttagctactattatgacctggcggctggagttggcctgatcgatgccgagaaggggggaagcctggtggtgggagacttcgagatcgcggctaaatacgtgtgcaggaccttagaaacacaaccacagtcttcaccgttcagttgcatggacctcacctatgtcagcttactactgcaggagtttggctttcctcggagtaaagtgttgaagctaacccgtaagatcgataacgtggagacctcttgggccctcggagcaatttttcattacattgactcactgaaccggcagaaatcccccgcatcctag

SEQ ID NO: 221697 - DNA, 1104 bp, Artificial Sequence
  Description of Artificial Sequence: Synthetic coding sequence
atgtttgatgcaggatccacaggcacccgggtgcacgtgttccagtttacacgcccacccagggaaactcccacgttgacgcacgaaactttcaaggctctcaagcctggactgagcgcctacgccgacgatgtggaaaaaagcgctcaggggatcagggagctgctcgatgtcgctaaacaggatatcccattcgatttctggaaagcgactccacttgtgctgaaagcaacggctgggttgaggctgctaccaggtgaaaaggcccagaagctgctccaaaaagttaaaaaggtgttcaaagcttccccatttctggtgggggacgactgtgtaagcataatgaacggcactgatgagggcgtatctgcctggattactatcaactttctgaccggtagtctgaagacgccaggcggtagcagcgtcggaatgctggatctgggaggaggcagcacgcagatcgcttttctgccacgggtcgagggcactctccaggccagcccaccaggctacctaactgctctgagaatgtttaatcgcacatacaagctctatagctacagttatttgggcctcgggttgatgagtgcaaggctcgccatcctgggcggagtggagggccagccggcaaaagacgggaaggaactggtgtccccttgcttatcacctagttttaaaggcgaatgggaacacgcagaggtcacatatcgggtgtcaggccagaaggctgccgcttcccttcatgagctttgtgcggcaagagtgtccgaggtactgcagaacagggtacaccggactgaagaggtaaaacacgtagacttttatgcattttcctattactacgatctcgccgcaggcgtgggactgattgatgctgaaaagggaggctcactggtggtgggcgacttcgagatcgcggctaaatacgggggaagtcatctcgagagagaaggcacgtgtctcatccccagcgtgagtgatcccggtgacacagcagctgaacaacctctgttgatgcatgggccacacctgcgccagccggcaaccccaggcgtccgcctcagtcaagagcagagcgcagaggctcactcagagaattag

SEQ ID NO: 221698 - DNA, 1455 bp, Artificial Sequence
  Description of Artificial Sequence: Synthetic coding sequence
atgaagaaagggatcaggtatgaaacatccaggaaaactagctatatttttcaacagccgcaacatggcccatggcagaccaggatgagaaagattagcaatcacgggagcttgagggttgccaaagtggcataccctttggggctgtgtgttggcgtttttatctacgtggcttacattaaatggcacagggcgacagccacacaggctttctttagtattacacgcgctgcccctggagctcgctggggccagcaggcacatagtcctttgggaacagctgccgacggccacgaggttttttacggcataatgttcgatgccggatcgaccgggactcgtgtgcacgtatttcagttcaccaggccacctcgcgaaacgcccacactgacacatgagacattcaaagccttgaaacccggtctgagtgcttacgcggacgatgtggagaagagcgctcagggaataagagagctcctggacgtggccaagcaagacatccccttcgacttttggaaagccactcctttagtgttaaaagccaccgctggcctccggctgctgcctggcgaaaaagcgcagaaactgctacaaaaggtgaagaaggtgttcaaagcctctccatttctcgtcggggatgactgcgtcagcattatgaacggcacggacgaaggcgtcagtgcctggatcaccatcaatttcctgaccgggagcctcaaaacaccaggcggttcctccgtgggcatgttagacctgggtgggggatctacgcaaatcgcgttcctgccaagagtggaagggacattacaggcttcccctcccggatatctgaccgcgctgcgcatgtttaatcgtacctacaagctgtactcctattcctacctagggctcggactcatgagcgcgagactggctattcttggcggtgtcgaaggtcagcccgcaaaggatggtaaggaattagtgtcaccttgtctcagtccaagcttcaaaggcgagtgggaacacgccgaagtgacttaccgggttagcggacagaaggccgctgcctctttacacgagctgtgcgcagccagagtttccgaggtgttgcaaaatagggtgcatcggacggaggaggtgaagcatgtggatttctacgcatttagctattactacgacctcgccgctggcgttgggttgatcgacgccgagaagggaggtagtctggtcgttggcgattttgagattgccgctaagtatgtatgcaggacgcttgagacacagccccagtcctcccctttctcttgtatggacctcacttacgtcagcctgttgctgcaggaattcggatttcccaggtccaaggtcctcaaactgacccgaaagattgacaatgtggaaactagttgggccctgggcgctatttttcattatatcgactctctgaacagacagaaaagtcccgctagctag

SEQ ID NO: 221699 - DNA, 888 bp, Artificial Sequence
  Description of Artificial Sequence: Synthetic coding sequence
tgagtgctcaaagcaactgcagggttgaggctcttgcccggagaaaaggcccagaaattgcttcagaaagtgaaaaaagtgtttaaggcatccccgtttcttgtgggcgacgactgcgtgagtatcatgaatggcacggatgaaggggtctccgcctggataaccattaacttcctgactggaagcttgaagaccccaggcggtagctctgtgggcatgcttgatctgggcggaggatctacgcagatagccttcttacctcgcgttgagggaaccctacaggctagtcctccaggctacctgacagccctgaggatgtttaatcgcacgtacaaactgtattcttactcgtacctggggctgggcctgatgagcgctcggctggcaatactaggcggtgtggagggacagcccgctaaagatggcaaggagctagtgtccccctgtctctctccctcttttaaaggggaatgggagcacgccgaagtcacataccgggtctcgggtcagaaggctgccgcttcgttgcacgaactctgtgcagcacgcgtttctgaggttcttcagaaccgcgtccacaggaccgaagaggtaaagcacgtcgacttttatgccttttcctattactacgatctggccgctggtgtcggcctgatagacgcagaaaaggggggtagcttagtggtcggtgatttcgagatagcggcaaagtacggcggttctcatttggaacgggaggggacctgcttaatcccgagcgtgtcggatccgggtgatacagccgcagagcagccgctgcttatgcatggccctcacctgagacagcctgccacacctggggtgcggttaagtcaggaacagtccgcggaggcacactctgaaaactag

SEQ ID NO: 221700 - DNA, 681 bp, Artificial Sequence
  Description of Artificial Sequence: Synthetic coding sequence
atgcctcagcacggcccttggcagacacgcatgcgcaagataagtaatcatggatctttgagagtcgccaaggtggcctatccactgggcctctgcgtcggcgttttcatttatgtggcgtatatcaagtggcaccgggcaaccgctacacaggctttcttcagcatcacaagggccgcacccggtgcgcgatggggccagcaggcccactctcctctcggcactgccgctgacggccacgaagtgttttatggcatcatgttcgacgctggctctaccgggacccgcgtccacgtcttccagtttacaagacctcctcgggaaaccccaaccttgacccatgagacattcaaagccctcaagcccggattatctgcctacgcggacgatgtggagaaagttaagaaagttttcaaggctagcccttttttggtgggtgatgattgcgttagcatcatgaacggcacagatgagggagtgagcgcctggatcacaatcaactttctgaccggttccctgaaaacaccaggcggaagcagcgtcgggatgctcgatctcggcggagggtccactcaaatagcctttcttcccagggtggaaggaactctgcaggctagccccccagggtaccttaccgcactcaggatgttcaatcgaacatacaagctgtactcatactag

SEQ ID NO: 221701 - DNA, 588 bp, Artificial Sequence
  Description of Artificial Sequence: Synthetic coding sequence
atgcagccgcagcacggaccctggcagacaaggatgagaaagatttctaatcatggatccctgcgagtggctaaggtggcttaccctttgggactgtgtgtgggcgtgttcatatacgtggcatatataaagtggcaccgggcaacggcaacgcaggcctttttctctattacaagagcggcaccgggagctcggtggggtcaacaggcccacagcccgcttggaacggccgcagacggccacgaggtcttctatggtattatgtttgatgctggctctaccggaacccgagttcacgttttccagttcacaaggccgcctagagaaacgcccacactgacccatgagacatttaaggccctcaaacccggactgagcgcttacgcagacgacgtcgagaaggtaaaaaaggtgtttaaagcatctccttttttggtcggggatgactgtgtctctatcatgaacgggactgatgagggcgtgtccgcttggatcacaatcaactttttgaccggttcactcaaaactccaggaggatcgtccgtgggcatgctggatctcggtggcggatcaacacagatcgcgtag

SEQ ID NO: 221702 - DNA, 903 bp, Artificial Sequence
  Description of Artificial Sequence: Synthetic coding sequence
atgaaaaaggggattcggtatgaaacttctcgtaagacctcttatattttccaacagcctcagcacggaccctggcagacacgaatgcgaaagattagtaaccacggtagtctccgggtggccaaggtggcttatcccctggggctctgcgtcggagttttcatctacgtggcttacatcaagtggcacagggcgaccgcgacacaagccttcttcagcatcactcgcgcagcgcctggcgcacgctggggtcagcaggcccactccccgctcgggactgccgcagacgggcacgaagtgttttatggaattatgtttgacgccggttccaccggcactcgggtccatgtgtttcagttcacacggccacctagagagacaccaactctgacccacgagacctttaaggcactaaagccgggtctgtctgcctatgcggacgacgttgaaaaagtaaagaaggtctttaaggcaagtccatttctcgttggcgatgattgcgtctctattatgaacgggacagatgaaggggtgtccgcctggattacgattaactttttaacggggtcgttaaaaacccccggaggcagtagcgtcggcatgctggacctggggggaggttctacccagatcgcctttctgccacgggtggagggcaccctgcaagccagccctcccggatacctgacggccctgcggatgtttaatcgaacctataagctgtattcatatagttaccttgggctcggtctgatgtccgcccgtttagctatactaggtggggtagagggtcagccagccaaggacggcaaagaattagtgagtccatgtctgtccccgagtttcaaaggggaatgggaacacgccgaagtaacttatcgggtcagcggtcagaaggcgtag

SEQ ID NO: 221703 - DNA, 453 bp, Artificial Sequence
  Description of Artificial Sequence: Synthetic coding sequence
taacccggacggggatctcccaaggaccggctgcctccagcccctcgcaagagggccctcgttagcgttggcgtggccgagagggccgtccatgagactcccaccctcacacacgagaccttcaaggcacttaaacccggtctatctgcatacgctgacgacgttgaaaaagtgaagaaagtattcaaagctagtcctttcctggtcggagatgattgtgtctccattatgaatggcaccgatgagggggtgtctgcctggataactataaacttccttactgggtctctgaagacgcccggaggctcatcagtcggaatgctcgatctggggggtggcagtacgcaaatcgcgtttctgccacgcgttgagggcaccctccaggcatcgcctccaggctacctgactgctctcagaatgttcaacagaacctataaactgtatagttattag

SEQ ID NO: 221704 - DNA, 1314 bp, Artificial Sequence
  Description of Artificial Sequence: Synthetic coding sequence
atgaaaaagggcattcggtacgaaacttcgcggaagacttcctacatattccagcagcctcagcatggcccttggcagactcggatgcggaagatctccaaccatggttccctccgagtggccaaagttgcatacccgctggggttatgcgttggggtgttcatctacgttgcctatatcaaatggcatcgggcaacagcgacgcaagcgttcttctcaatcaccagggccgctcctggagccaggtggggacagcaggctcactctccccttggaaccgctgcagacgggcacgaagtattttacggtatcatgtttgacgcaggctcgacgggaacacgagtgcatgtctttcagttcacacggccaccgagagagacccctaccctcactcacgagaccttcaaggccttgaaaccgggactctccgcttatgccgatgacgtcgaaaaatctgcacagggcattcgggaacttcttgatgtcgcaaagcaggacattccatttgatttttggaaggctacacccctcgttcttaaggccactgcgggactgcgactcctgcccggtgagaaagcccagaagttgttacaaaaagtgaagaaggtctttaaggcctcaccgtttctggtcggcgatgattgtgtcagcatcatgaacggtactgatgaaggcgtgtccgcttggattaccatcaattttcttaccggctcactgaaaacgcccggtggcagtagcgtcggcatgctggacttggggggaggaagtacccaaattgcctttttgcccagagtggagggcactctgcaggcaagccctcctggctacctcaccgccctccggatgttcaatcgcacttacaagctgtacagctactcatacctgggactagggctgatgtcagctcgtctggccattctgggaggggtggaggggcaacctgctgcttctctacacgaactgtgtgccgcaagagtttcggaggtgctccaaaatcgggtgcaccgcaccgaagaggtgaagcacgtagatttttacgcttttagttactactacgacttggccgcaggtgtgggccttattgatgccgaaaagggcggttccctagtcgtgggggacttcgaaattgctgccaaatacgggggttcacacctggaacgggagggcacctgccttattccctcggtgtctgaccctggagacacagccgctgagcagccccttctgatgcacggacctcacctaaggcagcccgcaacacccggagtacgcctcagccaggaacagagtgctgaggcccatagcgagaattag

SEQ ID NO: 221705 - DNA, 945 bp, Artificial Sequence
  Description of Artificial Sequence: Synthetic coding sequence
taaaacagaggtgttgtgagccggggatggaggcccggatggcgccgtccagggagagggtcccctaaggatcgactgccgcctgctccacgaaagcgggcactagtatctgtaggcgtggccgagcgtgccgttcacgaaactccaactcttactcatgaaacatttaaagcgctgaagccgggactgtccgcgtacgcagacgacgtcgaaaaatccgcccagggtattagagaacttcttgacgttgccaaacaggacatccctttcgacttctggaaagccacacctctcgtgctgaaagccaccgctggtctgcgcttactaccaggcgaaaaggcccagaagctccttcagaaagtcaaaaaggtatttaaagcttcccccttcctcgtgggcgacgactgcgtgtctatcatgaacggcacggacgagggagtgagtgcgtggatcactatcaacttcttaactggatcgctcaaaacccccggagggtctagtgtcggtatgctggacctgggcggaggctctacgcagattgccttcctcccccgtgttgagggtactttgcaagcaagcccgcctgggtacctaactgctctgcgaatgttcaatagaacttacaaactttattcatattcctatttggggctgggcttgatgtctgcacgactcgccattctcggcggtgtggaaggacagccagcgaaagatggtaaagagctggtctctccatgcctgtcacctagtttcaagggcgaatgggaacacgccgaggtgacatacagggttagcgggcagaaggcggctgcctctttgcacgagctgtgtgctgccagagtgtcagaagtgttacaaaaccgggtacacaggacggaagaagtgaagcacgtggacttctacgccttctcttattactatgatttggctgcgggagtgggatag

SEQ ID NO: 221706 - DNA, 567 bp, Artificial Sequence
  Description of Artificial Sequence: Synthetic coding sequence
atgaagaagggtatccggtatgagaccagcaggaagacctcctatatctttcagccacaacatggcccttggcagactcggatgcgcaaaatcagtaatcacggctcccttagggtggccaaagtcgcctaccccctcggcctgtgcgtaggtgtctttatttacgttgcttatataaagtggcacagggcaacggctacccaggcctttttcagcataaccagagctgcccctggggcaagatggggccaacaagcccactcccctctcggtacagccgctgatggccatgaggtgttttacggtattatgttcgacgcgggttcaacagggacgcgggttcacgttttccaattcactcgtccacctcgagagactcctacactgacacacgagacattcaaagcgttaaaaccaggtctttctgcctatgccgatgacgtcgagaagagtgcccaggggatccgtgagctgctcgacgtcgctaagcaggacatacctttcgatttttggaaggcaacccccctcgttctgaaggccacagcgggactgcgcctcctcccctag

SEQ ID NO: 221707 - DNA, 891 bp, Artificial Sequence
  Description of Artificial Sequence: Synthetic coding sequence
atgcctcagcacggaccatggcaaacgagaatgcggaaaatatctaatcatgggtctcttcgtgtcgcaaaagttgcttacccgttaggcctgtgcgtaggggtgttcatttacgtagcctacatcaaatggcaccgtgctactgctacccaggccttcttctcaataacaagagccgctcccggtgctaggtggggccagcaggcacattcgccccttgggactgcggcagacggacatgaggtgttctacggtatcatgttcgacgcaggttctacaggaacgcgggtccatgtcttccaattcaccaggccaccgagagaaacccctacactcacacacgaaacctttaaggccctgaagcctggcctgtcagcctacgcagacgatgtcgagaagtccgcccaggggatccgcgagctgctcgacgtcgccaaacaggatattccatttgacttctggaaggctacacctctggtactgaaggccactgctggactacgcctcttacccggagagaaggcgcaaaagctgttgcagaaggtcaagaaggtgttcaaagcatccccgttcctggttggcgatgattgtgtgagcatcatgaacggcacagacgaaggtgtgagtgcttggatcacaataaattttttgacaggctccctgaaaacccccggagggagcagtgtggggatgctcgatctagggggtgggagcactcagatagccttcctccccagagtggaaggaacattgcaagccagccctccgggatatctgaccgcgctgcggatgtttaatagaacctataaactgtatagctactcctatctgggcctgggcctgatgagtgccaggctcgccattttggggggtgttgagggtcagccatag

SEQ ID NO: 221708 - DNA, 936 bp, Artificial Sequence
  Description of Artificial Sequence: Synthetic coding sequence
tgaggctcgaccggcacacgcgtgcatgtgttccaatttacccggccaccacgggagactccgactctgacccatgagacgttcaaagcccttaagccagggttgtcggcatacgcagatgatgtggagaagagcgcgcaaggcatccgcgaacttttagatgtggctaagcaggacataccatttgacttttggaaagctactcccctggtcctgaaggcaaccgcaggactgcgcctgctgcccggagaaaaggcgcaaaagctgctccaaaaagtgaaaaaggttttcaaggcttccccattcctggttggagacgactgtgtgagcattatgaacgggactgatgaaggggtgtccgcctggattacaatcaatttcttgacagggagcctgaagacccccggtggcagcagtgtaggcatgctggatctgggcggaggctccactcaaattgcatttctgcctagagttgaagggacccttcaggcctcccctccagggtacctgactgctctccgtatgtttaaccggacctataaactatacagctattcttaccttggtctcggcctcatgagcgcgagacttgctattcttggcggtgtggaggggcaacctgccgctagtctgcatgagctgtgcgctgctagagtttccgaagtgttgcagaatcgggttcatcgcaccgaagaagtgaagcacgtggatttttacgcttttagttactactatgaccttgcagctggtgttggcctaatcgatgccgagaagggtggatcattagtggtgggagattttgaaattgccgctaagtatgtgtgtcgcaccctggagactcaacctcagtccagccctttctcctgcatggacctaacttatgtgagcctgctgctgcaggagttcggcttccccaggagtaaggtgcttaagtag

SEQ ID NO: 221709 - DNA, 942 bp, Artificial Sequence
  Description of Artificial Sequence: Synthetic coding sequence
aacagaggagttgtgtcacgcggttggcgccctgggtggagacgccctggtcggggaagccctaaagatcgtctgccacccgctcctcgcaagagggctctggtatctgtgggagtggcagagcgcgcagtgcacgagactcctaccttgacacacgagacatttaaggccctgaagcccggacttagcgcatatgccgatgatgtggagaaatctgcccaggggattagggagctgctggatgtggccaaacaggacataccattcgacttctggaaagccaccccgttggtccttaaggctaccgcaggattacggctcctcccaggagaaaaggcccagaagctcctgcagaaggtgaaaaaagtttttaaagcatctccttttcttgtgggggatgactgtgtttcaatcatgaacggcactgatgagggggtgtccgcttggataactattaatttcttgaccggatctctcaagactcctggcggatcatcggtgggtatgttagatttgggagggggatctacccagatagcctttcttccacgcgttgagggaacactgcaggcttccccgcctggctacctgaccgcattgagaatgtttaataggacctacaagctttacagttatagctatctcggcctaggcctgatgtccgccaggcttgcaattctgggcggtgtcgagggccagcccgctaaagacggcaaggagttggtgtctccctgtttgagtccaagctttaagggagaatgggaacacgctgaggtgacataccgggtgagcggtcagaaagcagcagcatccctgcatgagctttgcgccgctagagtctccgaggtactccaaaatagggtgcaccgaacagaggaggttaaacacgtcgatttttacgccttcagttattactacgacctggcagctggagtcggatag

SEQ ID NO: 221710 - DNA, 2778 bp, Artificial Sequence
  Description of Artificial Sequence: Synthetic coding sequence
atggaaagggatggatgtgccggagggggaagtcgaggtggggaggggggacgggcaccaagagagggtccagccggaaacggacgcgatagagggcgaagccacgccgctgaagcgcctggagaccctcaagccgctgcctcgctccttgccccaatggacgtgggggaggaacctctagagaaggcggcaagggccaggaccgctaaagatccgaatacatacaaggtattgtctctcgtactcagtgtgtgcgtgctcacaacaattttaggatgcatttttgggttgaagccttcctgtgccaaggaggtgaagtcatgtaaaggccgttgcttcgagagaactttcggaaattgcaggtgtgatgctgcctgtgtggagctgggcaattgctgcctcgattaccaggagacctgtatcgagccagaacacatttggacatgcaataaatttagatgcggtgagaagcggttgacaagaagcctgtgtgcctgctccgacgattgcaaagataagggggactgctgtataaattatagctcagtatgtcaaggagagaagagttgggtcgaggagccctgtgagtcaattaatgagcctcagtgtcctgcaggcttcgaaacaccccctactttgctcttctccctggacggctttcgagccgaatatctgcacacttggggcggacttctccctgtgatttcaaagctgaagaaatgcggcacctacacaaagaacatgcggcctgtgtacccgactaagacatttccaaatcactactccattgtgaccgggctctatccagaatcacatggaattatagataacaaaatgtatgatcccaagatgaacgctagcttttcccttaaatcaaaggagaaatttaatccagagtggtacaaaggcgagcccatttgggtgactgcaaagtaccaaggtctgaagagtggtaccttcttctggcccggatctgacgtcgagattaacggcatctttcccgacatttataagatgtataatgggtccgtaccattcgaggagagaatactcgcggtgcttcaatggttgcagttacccaaagacgaacggcctcatttctacacattatatctcgaagagcccgatagttcagggcattcttacggcccagtttcttcggaagtcattaaggctcttcagagagtcgacgggatggtgggtatgctcatggacggcctgaaagagctcaacttacaccgttgcctgaaccttatcctgattagcgatcacgggatggaacaaggctcctgcaagaaatatatatatttaaacaagtatctgggggatgttaaaaatatcaaggtaatctatggtccagccgcaaggctgcggccttccgacgttcctgacaagtactacagtttcaattatgagggaatagcccgaaatctgtcctgccgtgagccgaaccaacatttcaagccatacctaaagcacttccttcccaagcgactccattttgccaagtcagatcgcatcgagccattgaccttctatctcgatccgcagtggcagttagctctcaacccaagtgagagaaaatactgtgggtccggattccacggaagcgataatgttttttccaacatgcaggccctgttcgttggttatggtcccggatttaaacacggcatcgaggcggacacctttgaaaacattgaagtgtataatctcatgtgcgatttgcttaatcttacccctgcgccaaataatggcacccatggttccctcaatcaccttctcaaaaaccctgtgtataccccaaagcatccaaaggaagtgcatcctcttgtgcagtgtccattcactcgcaatcccagagataatctggggtgctcatgcaatccatcaatcctgcctatcgaagacttccagacacagttcaatctgaccgtcgctgaagagaaaatcataaaacacgagactctgccttacggccgtcccagggtcctacaaaaagagaacacaatctgcctgctgagccagcaccagttcatgagtggctattctcaggacattctgatgcccctgtggaccagttacactgtggaccgaaatgatagtttcagcaccgaagatttttcaaactgcttgtaccaggatttcagaattcccctcagccccgtgcataagtgtagtttctataaaaacaatacgaaagtgtcttacggttttctgtcccctccacagcttaacaagaattcatccgggatttatagcgaggccctattaaccacgaacatcgtgcctatgtatcaatcttttcaggttatttggcgttacttccacgatacactgttgcgcaaatacgctgaggaacgcaatggagtgaatgtcgtttccggacccgtgtttgactttgattatgatggtcggtgtgactctctggagaatctgaggcagaagagacgggtcatacgcaaccaggaaatcctgatccccacacacttttttattgtcctgacaagctgcaaagacacttcccagacacctctgcattgtgagaacctggataccctggcgtttatattgcctcacaggaccgataacagcgagagctgtgtgcacggcaaacatgacagttcatgggtggaagagctgctcatgttgcaccgagcacgcattaccgatgttgagcacattacgggtttatccttctatcagcagcgcaaggaacctgttagtgacatccttaagctgaagacacacttacccaccttctcccaagaagactag

SEQ ID NO: 221711 - DNA, 2592 bp, Artificial Sequence
  Description of Artificial Sequence: Synthetic coding sequence
atggcaagacggagtagtttccagagttgtcaaattatcagcctattcaccttcgcagtgggcgtgaatatctgtttggggtttacagcccacagaatcaagcgcgctgaaggatgggaagaggggcctccaaccgtactgtctgacagcccgtggaccaacatttctggatcttgtaaggggaggtgcttcgaactgcaagaagctgggcctcccgattgccgctgtgataacctctgcaaaagttataccagctgttgccacgattttgatgaattatgcttgaaaaccgctcgaggctgggaatgcaccaaggacaggtgtggcgaggtgcggaacgaagagaacgcatgccactgttccgaggactgtctcgccaggggcgactgttgcactaattatcaggtcgtatgtaaaggggagtcacattgggtggacgacgactgtgaggagattaaagcagccgagtgcccggctgggtttgtgcgccctcctctgataatattttccgttgatgggtttagggccagctacatgaagaagggctctaaagtgatgcctaacatcgagaagctgcgctcttgcggcacacacagcccttacatgaggcctgtttatcccaccaagacctttccaaacttatataccttggctacaggcttatatcctgaaagtcacggtattgttgggaacagcatgtatgaccccgtttttgacgcaacctttcacctgcgcggtcgagagaagttcaatcacagatggtggggtggccagcccctgtggattacagctacaaaacagggagttaaggccggaacattcttctggagtgttgtaattccccatgaacggaggatcctcaccattctgcagtggctgactctgcctgaccatgaacgcccttcagtgtatgccttttactccgagcaacccgacttcagcggccacaagtatggccctttcggcccagagatgacgaatcctctgcgcgagatcgacaaaatcgtgggtcagttaatggacggcctcaagcaactgaaactgcatagatgtgtgaatgtcatcttcgtcggtgaccatggcatggaggacgtgacttgtgaccgtaccgaatttctgtctaactacctgactaatgttgacgacataactctggtccctggcaccttgggcagaatccggagtaaatttagtaataatgccaagtatgatcccaaagcgatcatcgctaacctgacctgcaagaagccagaccagcactttaagccttatttaaaacagcacctgccaaaacggctgcattatgcgaataaccggagaatcgaagacatccatctgctggttgagaggcggtggcacgtggccaggaaaccactggacgtgtacaagaagccctctggaaagtgcttttttcagggggaccacggatttgacaacaaggttaattcaatgcagaccgttttcgtaggatacggctcaaccttcaagtacaaaacaaaagtgccacctttcgaaaacatcgagctgtacaacgtcatgtgtgatttgctgggcctcaagcccgcacctaacaatggtacccacggctccttgaatcatctcctgagaactaatacttttagaccaacaatgccagaagaggttacaagacccaattatcctggcatcatgtatctccagagcgactttgaccttggctgcacttgcgatgataaggtcgagccgaagaataagctagatgagttaaataaacggctgcatacaaaaggttccaccgaagaacggcacttgctgtatgggagacctgcggtgttgtatcggacaaggtatgacattctgtaccacacagatttcgagtccgggtactccgaaatcttccttatgccactgtggacctcttataccgtttctaagcaggccgaagtgagtagtgttcctgatcatctaacgagctgcgttagacctgacgttagagtgtcaccatcctttagtcagaattgcctggcttacaaaaacgacaagcaaatgagctacgggtttctcttcccaccctacctgagcagctcgcccgaggcaaaatacgacgccttcttagtcaccaatatggtgcccatgtatcctgcttttaaacgagtttggaactatttccaacgggtcctggtcaagaaatatgcttctgaaagaaatggagtgaatgtgatcagtggcccaatttttgactacgattatgatggacttcatgatacggaggataagatcaagcagtacgttgaggggagttctatcccagtcccaactcactactactccatcatcacaagctgcctggacttcacccagccagctgacaagtgcgatggaccgctgtctgtgtcatccttcatcctgccgcaccggcctgacaatgaagagtcgtgtaacagtagcgaagatgagagcaagtgggtcgaggaactcatgaagatgcacactgcgagggtgagagacatagagcatcttacctcgctggacttcttccgaaagaccagtcgttcttatcctgagatcctgacgttgaaaacatacttgcatacatacgagagtgagatctag

SEQ ID NO: 221712 - DNA, 2748 bp, Artificial Sequence
  Description of Artificial Sequence: Synthetic coding sequence
atggcacgacgcagcagctttcaaagctgtcagattatttccctgtttaccttcgcagtcggcgtgaatatatgtctgggcttcaccgctcaccgcatcaaacgggcagaggggtgggaagagggccctcctactgtcttatcagatagtccttggaccaacattagtggcagctgtaaagggcgatgctttgagctgcaggaagccggtcccccagactgtagatgtgacaatctgtgcaagtcttacacaagttgttgccatgattttgatgaactgtgtcttaaaacggctcgcggatgggaatgcaccaaagataggtgcggcgaggtgcgaaacgaagaaaatgcctgtcattgctccgaggattgtcttgctcggggagattgttgcaccaactatcaagtagtgtgtaaaggcgagtcacattgggtggatgatgattgcgaggagatcaaggccgcagaatgccccgctgggttcgttcgacccccactcatcatctttagtgtggatggatttcgggcaagctacatgaagaaggggtctaaggtgatgccaaacattgaaaagttgcgctcttgtggcacccacagtccctatatgaggccagtgtatcctactaaaacctttcctaatttgtatacactggctacagggctctacccagagtcacacggcatcgtcgggaactccatgtacgatcccgttttcgacgcaacttttcatctgaggggcagggagaagttcaaccaccgttggtggggaggtcagcccctctggatcacggccaccaagcaaggtgtcaaagctggcacttttttctggagcgtcgtgatcccccatgagagacgcatcctcactatactgcagtggctaacactgcccgaccatgagaggcctagcgtctacgctttttattcggagcagcctgacttcagtggacacaaatatggtccatttggacctgaggaatcaagttacggctctcccttcacccctgcaaagcgccctaaaagaaaagttgcacccaagcggagacaggagcgtcccgtggcgcctccaaagaaaagaaggcggaagattcatagaatggaccattacgctgccgagacccggcaagataaaatgaccaaccctctgcgcgagatagacaaaatagttggacaactcatggatgggcttaagcagctgaagctgcatcgctgtgtcaacgtcatttttgtgggtgaccatggaatggaagacgtgacctgtgataggacagagttccttagtaattacctgaccaacgtggacgacatcacactggtgcctggcacgctgggcagaatcagatctaagttctcaaacaatgccaaatatgatcccaaagccatcattgcaaatcttacctgcaagaaaccggatcaacactttaagccctacctgaagcagcatttacctaagcggctgcattatgccaacaatcgacgtattgaagacatacatttactggttgaaagacgctggcacgttgcgaggaagccattggatgtgtacaaaaaaccaagtggcaagtgtttttttcagggagaccatggatttgacaacaaagtaaactcaatgcagactgtcttcgtgggttatggcagtacctttaagtataagacaaaggtgcctccgtttgaaaatattgaactatacaacgtcatgtgcgaccttttgggcctgaaaccggctccaaacaatggcacacacggctccctgaaccatctgctacggacgaacacctttaggcccacaatgcctgaagaagtcacccggcctaattatcccggaattatgtacctgcagagtgacttcgatctgggttgtacttgcgatgataaagtagaacccaagaataagttagatgaacttaataagcggttacacacaaaggggagcacagaggagcgccacctgctctacggaagaccagcagtgctctataggacccgatacgacattctctaccacactgacttcgagtcaggatacagcgagattttcctcatgccactgtggacctcgtacactgtgtcaaaacaagccgaggtttcatcggttcctgatcatttaacaagttgtgtcaggccggacgtcagagtgagtccttcgttttctcagaattgcttggcctacaaaaacgataagcagatgtcttacggtttcttgttccccccttatctttctagcagccccgaggcaaagtacgatgcattcctggtgacaaacatggtcccaatgtaccctgccttcaagagagtgtggaattatttccagagagtactggtcaaaaaatacgcaagcgaaaggaacggggttaacgttataagtggccctatctttgactacgattacgacggactccacgatacagaggacaaaatcaagcaatacgtggaaggctcctctatcccagtgccaactcactactattccatcatcactagctgtctcgacttcacacaacccgctgataaatgtgacggtccactgtctgtcagctctttcattctgccgcatagacccgacaacgaggagtcttgcaacagctcagaagacgaatccaagtgggtggaggagctcatgaaaatgcatactgccagggtgcgggatatagagcatttgacttctcttgactttttcagaaaaaccagcagaagttacccggaaattttaaccctgaagacttacttgcacacttacgaatctgagatctag

SEQ ID NO: 221713 - DNA, 2667 bp, Artificial Sequence
  Description of Artificial Sequence: Synthetic coding sequence
atggctcgacgaagtagtttccagagctgccaaatcattagcctgttcacattcgcagtgggggtcaacatttgcctgggtttcaccgctcatagaattaagagagccgaaggttgggaggagggccctccaacggtgctgagcgattcgccttggactaacatttccgggagttgcaaggggcgatgcttcgaactgcaggaagctgggcctcccgactgtagatgtgacaatctttgcaagtcatatacctcttgttgtcatgattttgatgaactttgtctcaagacagctcggggatgggagtgtactaaggataggtgcggagaggtgcgcaatgaggagaatgcttgtcactgttcagaggattgcctcgcccgaggcgattgttgtaccaattaccaggttgtctgtaagggtgagagccactgggtggacgacgattgcgaggagatcaaagcggctgagtgtcctgctggtttcgtcagacctcccctgattatattctcagtggacggattcagagcatcgtacatgaaaaagggatccaaggtcatgcctaatatagaaaaactgaggtcatgtggcacccattcaccatacatgcggccagtttatcccactaaaaccttcccgaacctctatacactggctaccggattgtatccggaatcccatgggatagtgggtaactcaatgtacgatcctgtttttgatgctacgttccacctgcgcggtagggaaaagtttaatcacagatggtggggtggccagcctctgtggatcacagctaccaagcaaggagttaaagccggaacgtttttctggtctgtggtaattcctcacgagagaaggatccttacgatcttgcaatggctcacacttccggaccatgagcggccatctgtctatgcgttctactccgagcagccggatttctccggccacaagtatggaccttttgggcctgaaatgaccaacccccttcgggagatcgacaagatcgttgggcaattgatggacggcctgaagcagctgaagctccataggtgcgttaacgttatttttgtcggcgatcacggcatggaggacgtcacatgcgaccgtaccgaatttctgtcaaactaccttacaaacgtagatgacatcacgctcgtacctggcacactgggcagaatcagaagtaagttcagcaataacgccaagtacgatcctaaagccattattgcgaatctaacgtgcaagaagcctgatcaacatttcaagccctacttaaaacagcatctccctaaaagattgcactacgccaacaatcggaggatagaggacatccacttactggttgagcgcagatggcatgtcgccagaaaaccactggacgtctacaaaaaacccagtggaaagtgttttttccaaggcgaccacgggtttgataataaggtgaatagtatgcagacggtctttgtgggatacgggagcacctttaaatacaagactaaggtgcctccgtttgagaacatcgagttatacaacgtcatgtgtgatttgctcggcctcaagccagctccaaacaacggcacgcacggatccctcaatcacttacttagaacaaacaccttccgccctactatgccagaggaggtgactagaccaaactaccccggtataatgtatctgcagtcagatttcgatctcggctgtacatgcgatgacaaggtggagccaaaaaacaagctcgacgagctgaataaaagactgcacacgaaaggtagcaccgaagcagaaacgcggaaattccgtgggagccgtaacgagaacaaagagaacattaatggaaattttgaacccaggaaggaacggcacctactttatggccgtccggctgtcctctatcgcacaaggtatgatatcttgtaccacacagacttcgagtccggatactccgaaattttcctcatgccgttatggacctcgtacactgtgtctaaacaggctgaggtgtccagcgtccccgaccatcttacctcatgcgtgcgacccgatgtgcgggtcagtccaagcttttctcaaaactgtttagcctacaaaaacgataagcaaatgtcctacggattccttttcccaccatacctcagcagctcccccgaggcaaaatacgacgcttttttggttactaatatggtcccgatgtaccccgcatttaaacgtgtctggaattactttcagcgagttctggtcaagaagtacgctagcgagcgcaacggtgttaacgttatcagcgggcctatcttcgattacgactatgatggacttcacgataccgaggacaaaataaaacagtatgttgagggcagcagcataccagtgcccacacattactacagcatcattacatcgtgtctcgattttacccagccagctgacaaatgcgacgggccactgtcggtatcttcctttattttgcctcatcggccagacaacgaggagagctgtaactcctctgaggacgagagcaagtgggtcgaagagctaatgaagatgcataccgcaagggtccgcgatattgaacacctgaccagcctggatttcttccggaagacctctcggtcctacccagagattttaactctaaagacatacctgcacacctatgaatccgaaatctag

SEQ ID NO: 221714 - DNA, 2628 bp, Artificial Sequence
  Description of Artificial Sequence: Synthetic coding sequence
atggagagcactctgactcttgctacagagcagcccgtgaaaaagaacaccttaaagaagtacaagatcgcatgcattgtacttctcgccctcctcgtcataatgtctctgggactggggctgggcctggggctccgaaagctggaaaagcaggggtcttgcagaaaaaagtgcttcgacgccagttttcgcggtctcgagaactgccgatgtgacgtggcttgtaaagataggggggattgttgctgggactttgaggatacatgcgtagagagtacaagaatttggatgtgtaataagttcagatgcggtgagacccggttagaagcctctttgtgcagctgctctgatgattgtctgcagcggaaagactgctgtgctgattacaagtctgtatgccagggagagacctcttggttagaggaaaattgcgatactgcgcaacagtctcagtgcccagaagggtttgacttgccaccggtcattctgttttcaatggatggattccgcgcagaatatctgtatacatgggacaccttgatgcctaacattaataagctgaagacctgtggcattcattcgaagtacatgcgagccatgtaccccactaagacatttcccaatcactacaccatcgtgaccggattgtatccagagtcacacggaattatcgacaataacatgtacgatgtaaatcttaacaaaaactttagcctgtcttccaaagagcagaataaccctgcctggtggcacggacagccgatgtggctgaccgctatgtatcagggactcaaagcagccacatatttctggcccggttctgaggtagccattaatgggagcttcccatctatctacatgccatacaatggtagcgtaccttttgaagagcggatctctactctacttaagtggctcgatctgcctaaagccgagcgacctcgcttttatacgatgtattttgaggagccagattcctcagggcacgctggcggtcccgtgagtgcaagggtcatcaaggctttgcaggtggtggaccacgcctttggtatgctgatggaaggcttaaagcagcggaacctgcacaattgcgtcaatatcattctgctggcagatcacggaatggatcaaacatactgtaacaagatggagtatatgaccgactacttccccagaatcaacttcttttacatgtacgaaggacctgcacctagaatccgggctcataacatcccacacgactttttttctttcaactcggaagagatcgtgcgcaatttgagttgtaggaaacccgaccaacactttaaaccctacctcacacctgatttgccaaagcggttgcattatgctaagaatgtgcgcatcgacaaggtgcatctatttgttgaccagcagtggctggcagtgaggtcaaaaagcaacactaactgtggaggtggtaaccacggttataacaatgagttccgatctatggaagctatattcttggctcacggtcctagcttcaaggagaagacagaggtggaaccattcgagaatatcgaggtctacaaccttatgtgtgacctgctgcgaattcagcctgcccctaataacggtactcacggtagcctgaatcacctgcttaaagtacccttctacgaacctagtcacgcagaggaggtgagtaagttctccgtgtgtggattcgccaatcccttgcccactgaaagtctggattgcttctgtcctcacctgcagaactcaacccagctggaacaggtgaatcagatgctgaatcttacacaagaagagatcacagcaaccgtgaaggtaaatctcccattcggccgtcccagggttttacaaaagaatgtagaccactgcctgctctaccaccgcgagtatgtgtctgggttcggcaaagcaatgaggatgcctatgtggagttcctacacagtcccccaattgggcgacacctctcccctgccacccacagttccagactgtttgcgcgcagacgtgcgggtccccccaagcgagtctcagaagtgcagtttctatcttgccgataaaaatatcacacatggttttctttacccaccggcatcgaaccgcacaagcgactcccaatatgatgcgctgatcacctccaacctagtccctatgtacgaggagttccgaaagatgtgggattacttccattcagtcttgctgataaagcatgcaacggagcgtaatggagtcaacgtggtcagtggtcccatctttgactacaactacgatggacatttcgacgcacccgatgaaatcacaaagcacttagccaataccgacgtccccatcccaacccactactttgttgtgctgaccagctgcaaaaacaagagccacacacctgaaaactgtccaggctggctggatgttctgccctttatcattccgcaccgacctaccaacgtggagtcctgcccggaggggaagccagaagctctgtgggtcgaagagcggttcaccgctcatatcgctcgcgtccgagacgtagaactcctaactggccttgatttttaccaagataaggttcagcctgtttccgaaattttacagctgaaaacgtaccttccaaccttcgagaccaccatctag

SEQ ID NO: 221715 - DNA, 1992 bp, Artificial Sequence
  Description of Artificial Sequence: Synthetic coding sequence
atggagagcaccctgactctggccaccgagcagcccgtgaaaaaaaacacattgaaaaaatacaagattgcctgcatcgtcctgttagccttactcgtcatcatgtccctaggactgggcctgggcctggggctgcgaaagctagagaagcagggttcctgcagaaagaagtgttttgatgcctcatttaggggtctcgagaactgccggtgcgacgtggcttgcaaggacaggggcgattgctgctgggactttgaagacacatgcgtcgagtcaacacggatttggatgtgcaacaagtttcgctgcggagagacgaggcttgaagctagtctgtgctcatgctccgacgattgtctccagagaaaagactgttgtgctgactataagtctgtatgccagggggagacaagctggttggaagagaattgcgacaccgctcagcagtcacagtgccccgagggattcgacctgccgccagttatactgttcagtatggacggctttagggcagagtacctatacacttgggacactctgatgcctaatatcaacaagcttaagacctgtggcatccacagcaagtacatgcgggctatgtatccgacaaagacattccccaatcattatacaattgtaacaggtctgtaccctgagtcccatggaatcatcgacaataacatgtacgacgtgaacctgaacaagaattttagcctttcctccaaagagcaaaacaatccagcatggtggcatgggcagccaatgtggcttaccgcaatgtaccagggcctgaaagctgccacatatttctggccaggctcggaagtcgcgattaacgggtcattcccctcaatctatatgccctacaacggatctgttccttttgaagaaaggatttccactttactgaagtggctggatctaccaaaggccgaacggccaagattttacaccatgtacttcgaggaacctgattccagcggacacgccggtggcccagtgtccgccagggtaatcaaagcgctgcaggtggtagaccacgcctttggcatgttaatggagggcctaaagcagcgaaatctacacaattgcgtgaatatcattcttctggcagaccacggcatggatcaaacctattgtaacaaaatggagtatatgacagattattttccaaggatcaatttcttctacatgtatgaggggccagctcccaggatacgtgcacacaatatcccccacgacttcttcagtttcaactcagaagaaattgtcaggaacctgtcatgcaggaaaccagaccagcattttaagccatatctgacccccgatctgccaaagcggcttcactatgctaaaaatgtaagaattgataaagtgcaccttttcgtcgaccagcagtggctcgccgtgcgatctaaatctaatacaaactgcggcggtggaaatcacggttacaacaacgagttcagatccatggaggctatcttccttgctcatgggccttccttcaaagaaaaaaccgaggtggagccattcgaaaacattgaggtatacaacctgatgtgcgacctcctaagaatccaaccggctcctaataacggcacgcacggttctctgaatcatcttctgaaggttccattttatgaacctagccatgccgaggaggtgagtaaattctcagtgtgcggcttcgctaacccgcttcccaccgaatctttagactgcttctgcccacacctacagaattctacccagttggagcaggtgaatcaaatgctcaacctgactcaggaagagatcacagccaccgtcaaggtcaatttgccctttggacgcccaagggtgctgcaaaagaatgtggaccactgccttctgtaccacagggagtatgtgagtggtttcggcaaggctatgaggatgccaatgtggagtagctacaccgttccgcaactgccagccatcgagcaccagatagcaaacatgatgttgtag

SEQ ID NO: 221716 - DNA, 2628 bp, Artificial Sequence
  Description of Artificial Sequence: Synthetic coding sequence
atggagagtaccctcactctggctaccgaacagcctgtgaagaagaatacactgaagaaatataagatagcatgtatagtccttttggccttgctcgtgattatgagtttagggctcggactgggcttggggctgcgtaagcttgaaaagcaaggctcgtgtaggaaaaagtgctttgatgcctctttcagaggattggaaaattgtaggtgcgatgtagcgtgcaaagaccggggtgactgttgctgggatttcgaggacacatgtgtggagagtactcgaatatggatgtgcaacaagttcaggtgcggcgaaacaaggctggaggccagtctgtgctcttgttccgatgactgcctgcaacgcaaggattgttgcgcagattacaagtctgtctgccagggtgaaacaagctggctcgaggagaactgtgatacagctcagcagtcgcaatgccctgaaggtttcgatctgcctccggtaatccttttttcaatggatggatttcgagccgagtatctgtacacctgggacaccctgatgcctaatatcaataaactgaaaacctgtggcatccatagcaaatatatgcgagccatgtaccccacaaagaccttccccaaccactacactatcgtgacagggctctatccagaaagccatgggatcatcgacaataatatgtacgatgttaatctgaataagaacttttccttgtcatctaaagaacagaacaatccggcatggtggcacggtcagccaatgtggctgactgccatgtatcagggcttgaaggcggcaacctacttttggccaggaagcgaagtagccatcaatggcagtttccccagcatctacatgccttacaatgggagcgtaccttttgaggagcgcatatccacactgttgaagtggctcgatttgcctaaagccgaacggcctagattctataccatgtactttgaggaacctgactcctcaggacacgctggcggtcctgttagcgccagggtcattaaggctctccaggtcgtggaccatgccttcggcatgctcatggagggcctgaaacagagaaacctacacaattgcgtgaatattatcttgctcgccgaccatgggatggaccaaacatattgcaacaagatggagtacatgaccgattattttccgaggatcaactttttttacatgtacgaagggcctgccccaagaattagagcccataacatacctcatgactttttctctttcaatagcgaagaaatcgtccggaacttgagttgcaggaaacctgatcagcacttcaaaccctaccttacacccgatcttcctaaaagactgcattacgctaaaaatgtgagaatcgacaaagtccacctgttcgttgaccaacagtggctggctgtgaggtctaagagcaacacgaattgcggcggaggtaatcacggttacaacaatgagtttcgctctatggaagccatattcctggctcatgggccatcatttaaggaaaagacagaggttgagccctttgagaacattgaggtttacaacctcatgtgcgatctgctgagaattcagcccgctccgaacaacggaactcatggatccctcaatcatctgctcaaggtgcctttctatgagcctagccacgcagaggaggttagtaagttttccgtatgtggcttcgctaaccctctccctaccgagtccctggactgcttttgccctcacctccagaactccacacagctggagcaggtcaatcagatgctgaacttaactcaggaggaaataaccgcaacagtgaaggtcaacctgcccttcggtcggcctcgggtcctgcagaaaaacgtcgatcactgcttgctgtatcaccgggaatacgtcagcggttttggaaaggctatgcggatgcccatgtggtcttcgtatactgtcccacagttgggtgatacttcacccctgccacccaccgtgccagactgtcttcgcgctgatgttcgcgtgcctccatcggaatcgcaaaaatgttctttttatctggctgacaagaacattactcatggtttcctgtacccacccgcttcgaaccgcaccagcgactctcagtatgatgccctgataacgagcaatcttgtgccaatgtatgaagagtttaggaaaatgtgggactacttccacagtgttttactgattaaacatgcgacggagcgaaacggcgtgaacgtggttagcggcccaattttcgattacaactacgatggccacttcgacgcccctgacgaaatcactaagcatctggctaacactgatgtaccgattccaacccactatttcgtggtgcttacatcttgtaaaaataagagccacacacctgagaactgcccaggttggctggacgttttgcccttcatcattccccaccgtccgacaaacgtggagagttgtccagaggggaagccggaagctttgtgggtggaggaacggttcaccgcacatattgcaagagtcagagatgtggaacttcttacaggattagacttttaccaggacaaggtacaaccagtctcagagatcctgcagttgaagacttaccttcctacctttgagactactatatag

SEQ ID NO: 221717 - DNA, 765 bp, Artificial Sequence
  Description of Artificial Sequence: Synthetic coding sequence
atgtctcttggtctaggcctgggcttaggacttcgaaagctggagaagcaggggtcttgtagaaagaagtgtttcgacgcctcatttaggggcctcgagaactgtcgatgtgatgttgcttgcaaagataggggtgactgctgttgggatttcgaagacacatgcgtggagtcaacccggatctggatgtgtaataagttcaggtgcggagagacaagattagaggcctcattatgttcctgttccgatgattgtttgcaacgcaaagactgctgcgcagattataagtcggtttgccaaggcgaaacatcctggttggaggagaattgtgataccgctcagcagtctcagtgtccggagggttttgacttaccacctgtcattttattctcaatggatgggtttagggccgagtacctatacacttgggacacccttatgcccaatataaacaagctgaagacgtgcgggatccattctaagtacatgagggcaatgtatccgaccaagacatttcctaaccattatactatcgttaccggtctgtatcccgagtcacacggcataattgacaataacatgtacgatgttaaccttaacaaaaacttttcattaagctccaaagaacagaataaccctgcctggtggcatggacagcccgtgtgcagtattctgcatgtagcaaccgaggtgacatccatatcacagtgcgacagacggaccttattctccttatcaggggcttcaagtatgtcacctatttag

SEQ ID NO: 221718 - DNA, 774 bp, Artificial Sequence
  Description of Artificial Sequence: Synthetic coding sequence
atgagccttggcctgggcctcggtctcggcttacggaaactagagaagcaggggagttgtagaaagaaatgttttgacgcgagttttcgtggcctcgagaactgtagatgtgacgtagcctgtaaggacagaggagattgctgctgggacttcgaggacacctgcgtggagtccacccgaatttggatgtgtaataagttcaggtgtggtgaaacccgccttgaagcatctctgtgcagctgcagcgatgactgtctgcagcggaaagattgttgcgctgattataagtccgtgtgccagggtgagacaagttggctggaagaaaactgcgataccgcccaacagagccagtgtccagaaggattcgatctaccgccagtgattctgttctctatggacgggtttagagccgaatacctttacacctgggatactttgatgcccaatatcaacaagctgaagacatgtggcattcacagtaaatatatgcgggctatgtacccaactaagacctttccaaaccactataccatcgtaaccgggctgtatcccgaaagtcacggtatcattgacaacaatatgtatgatgtgaacttgaacaagaacttttccttgagcagcaaagagcagaataacccagcctggtggcacggacagccgatgtggctaactgcgatgtaccaaggcttgaaggccgctacatatttttggcctggatccgaagtggccattaatggcagtttcccttccatctatatgccctacaacggttag

SEQ ID NO: 221719 - DNA, 1200 bp, Artificial Sequence
  Description of Artificial Sequence: Synthetic coding sequence
atggccagccctggaaaacctggcgcagacgaggctcaggaagaagagggcgagctcgaaggaggctccgccggtcctcgggcagccattttagagcaggctgaggagctcttccttttgtgcgataaagaggccaaggggttcatcacaaagcacgacctccaaggactgcagtcagacctgcctctaactccagagcagctggaggccgtcttcgagagtttggatagagctcacacaggctttctcactgccagagaattctgcctgggcctcggtatgttcgttggggtcgctagcgcccagggggcaaacccttgccgtacaccggaggaaacatttgaaagcgggggtttagacgtccaaggcaccgcaggctcattggacgaggaggaagaagaagaagagaggttccacaccgtcctcgagcagctgggtgtggcccctgtgttgggcaaacaacgggcagtcagaaccctgtgggccagattgcaaagagagcggcctgaactcctcggcagcttcgaagatgtcttaattagggcttccgcctgtctggaggaggccgcacgcgagagagacggtctggaacaggccctgcggaggagagaaagtgagcatgaaagagaggttcgtgctctctatgaggagacagaacaactccgtgaacaaagtcggcgtcccccaagtcaaaactttgcacggggagaacgccgaagtcggttggagttggaacttcagtcccgggagcaagacctcgagcgcgcagggcttcggcaaagagaactcgaacagcagctgcatgcccaggccgctgaacatctggaggcacaggcccagaacagtcagctctggagagcgcatgaagcactgagaacccagcttgaaggtgctcaagaacaaatcaggaggcttgaaagcgaggccagaggacgccaggagcagactcaaagggacgtagtggcggtgagccgaaatatgcagaaggagaaggtgagtcttctgcggcagctcgagctgctccgggagctcaatacacggctaagggacgaccgggatgcctgcgaagccagaagagccggatcatcttgtcggaaggctttaactaccgctcggctcccagggccaacctgctgttgctgctgctgctgggcacgaccccctaggaggggaagcgggcacctgcccagcgctcgctag

SEQ ID NO: 221720 - DNA, 885 bp, Artificial Sequence
  Description of Artificial Sequence: Synthetic coding sequence
atggcaagtcccggaaagccgggagcagatgaagcccaggaggaggaaggggagttggagggaggctccgcgggacctcgcgctgccattttagaacaagctgaggagctctttttgctctgcgacaaagaggccaagggatttattaccaagcacgatttacaggggcttcagtctgacctgcccttgacaccagaacaactggaggcagtctttgagagtctggatagagctcatacaggttttctcaccgccagagagttctgccttggcctcggtatgtttgtgggcgttgcttctgcgcagggggctaacccctgtcgaacaccagaggagaccttcgagagcgggggattggacgttcaaggcacagccggttcacttgatgaggaggaggaggaggaagagcggttccacactgtcctggaacagctcggggtggcacccgttcttggtaaacagagagcagtgcgaactttatgggcgcgtttgcagagggagcggccagaactcctgggatctttcgaggacgtcctgatcagggccagcgcttgtttggaggaagcggctagggaaagggatggactggagcaggccctgcgtaggcgggagtccgagcacgagcgggaggttcgcgcactgtacgaggaaaccgaacaactacgggaacagtcacgaagaccgccatcccagaacttcgcgagaggggagaggaggtccagactggaactggaactgcagtcccgggagcaggacctggaacgggcaggtctgcgtcagcgggaaaggcgagggagacgtctgcaggagcacgcagagagagagagccagcctgctaccgccacaggagctgctcagggagccgagtacaccgccgctggctag

SEQ ID NO: 221721 - DNA, 267 bp, Artificial Sequence
  Description of Artificial Sequence: Synthetic coding sequence
atggcgtcaccgggaaaacccggagcagacgaagctcaagaggaggaaggggaactggagggcggatcagccggacccagggctgcaatcctggagcaggcagaagagcttttcctcttgtgtgataaggaggctaaaggattcataacaaagcacgatctccagggcctgcagtccgatctcccgctgacgccggaacagttggaggccgtgttcgagagtttggaccgagcgcatacgggctttttaacagcccgagagttttag

SEQ ID NO: 221722 - DNA, 105 bp, Artificial Sequence
  Description of Artificial Sequence: Synthetic coding sequence
atggccagccccggaaaaccgggagccgacgaagcacaggaggaggaaggagaacttgaaggtggtagcgcaggtccccgtgctgcaattttggagcaggcgtag

SEQ ID NO: 221723 - DNA, 885 bp, Artificial Sequence
  Description of Artificial Sequence: Synthetic coding sequence
atggcttccccaggcaagcccggagctgatgaggcacaggaagaagagggcgaactcgaggggggatccgcagggcctcgtgccgctatccttgagcaggcagaggagcttttcctgttgtgtgataaagaggcaaagggattcattaccaagcatgacctacagggccttcagtctgacctgccattaacacccgagcagctggaagcagtgttcgaaagcctggatcgggctcacacaggtttcctgacagccagggagttctgcctcgggctcggcatgtttgtgggggtcgctagtgcacagggcgctaacccctgccggaccccagaagaaactttcgagtcaggagggttggatgtacaggggactgccggttccctggatgaagaggaggaggaggaagaaagattccacactgtgctggaacagcttggcgttgctccagtgctggggaagcagagagctgtccgaacgttatgggcgagactgcagagagagagaccggagctgctaggcagcttcgaggatgtgctgatccgggcttccgcatgcctggaagaagccgcacgagagcgtgacgggttggagcaggccctccgcagaagagagagcgaacacgagcgagaagtgagggcattatacgaagagacagaacagctgcgtgagcagtctcggaggcccccttctcaaaattttgccaggggcgaaaggcggagtaggctggagctggaactgcagtctcgcgagcaggatttagaacgagctggacttagacagcgggagcgcagaggcagacggcttcaagagcacgccgagcgcgagtcccaacctgctacagcgacaggcgctgcccagggcgcagaatataccgccgctggatag

SEQ ID NO: 221724 - DNA, 162 bp, Artificial Sequence
  Description of Artificial Sequence: Synthetic coding sequence
atggcctcccctggcaaaccgggagcagacgaggcacaagaggaagagggagagcttgaaggcggaagcgcaggcccacgcgcagctatcctggagcaggcagaggaactgttccttttgtgcgacaaggaggccaaaggcttcataactaaacacgactag

SEQ ID NO: 221725 - DNA, 246 bp, Artificial Sequence
  Description of Artificial Sequence: Synthetic coding sequence
atggcaagcccaggcaagccaggagcagatgaagcccaggaggaggaaggtgagctcgagggcggaagtgcgggacccagagccgcaatccttgagcaagccgaggagcttttcctcctgtgcgataaggaagctaagggtttcatcactaagcacgatctacagggcttacaaagtgacttgcccctcactccagagcagctcgaagcagtattcgaatcactagacagagcccatactgggtag

SEQ ID NO: 221726 - DNA, 1188 bp, Artificial Sequence
  Description of Artificial Sequence: Synthetic coding sequence
atggctgcgcctgatggaagggtggtgagccgaccgcagagactggggcaaggaagtggccaaggcccaaaaggcagtggcgcatgcctacatcctctggatagcttggaacagaaggaaactcaggagcaaacatctgggcaactggtaatgctgagaaaggcccaagagtttttccagacatgcgacgccgagggcaaagggttcattgcaaggaaagacatgcagaggttgcataaagaactccctttaagcctggaagagctcgaggacgtgtttgatgcactcgacgctgatggaaatggatatctgactcctcaagaattcactactgggttctctcatttctttttcagccagaacaatcccagtcaagaagacgccggagagcaggtggcccagaggcacgaggagaaggtctatctgtccagaggggacgaggacctcggcgacatgggcgaggacgaggaggcacagttccgtatgttgatggaccgactgggagctcagaaggtgcttgaagatgagtcagatgtgaagcaattgtggctgcagttaaagaaagaggaaccccatttgctgtctaactttgaggacttcttaacccgcatcatctcacaactccaggaggctcatgaagaaaaaaatgaactggaatgcgcactcaagaggaagattgcagcatacgacgaagaaattcagcacctatatgaggagatggagcagcagattaaatctgagaaggaacaattcttactgaaagatacagagcgattccaagcacgcagccaagagttggagcagaagcttttgtgtaaagaacaggaactcgagcagctcactcagaaacagaagcgcctggagggtcagtgcaccgcactgcatcacgacaaacacgaaacaaaagctgagaacaccaaactgaaattgacaaatcaggaactggcccgagagctagaaagaacctcatgggagctgcaggacgcccaacagcagcttgaaagtctccaacaagaggcctgtaaattgcatcaggagaaggaaatggaagtgtatagggtaactgaatctctacagagagaaaaagccggtctgctgaagcagctggactttctgaggtgtgtgggcggtcattggcctgttctcagagctccccctcgcagcctggggtctgaaggtcccgtgtag

SEQ ID NO: 221727 - DNA, 2196 bp, Artificial Sequence
  Description of Artificial Sequence: Synthetic coding sequence
atggcagctcccgatggcagggtcgtgtcccggccacaaagactcggccaaggttccggacagggtccaaaaggctcaggcgcttgcctgcatccccttgactccctcgaacagaaggagacccaggaacagaccagtggccagctggtgatgctcagaaaggcccaggagtttttccagacctgcgatgccgaaggaaaaggctttatcgcccgtaaggatatgcagcggctgcacaaggagttaccacttagtctggaagagctggaagacgttttcgatgcactagacgctgacggcaacggatatcttacaccccaagagtttactactggattctcacactttttcttttcccagaacaatccttcacaggaggacgctggcgagcaagttgcccagcgccacgaagagaaggtatatctcagtcgcggtgacgaagacctgggtgatatgggtgaagacgaggaagcccaattcaggatgctgatggaccggctgggggcacagaaagtgctcgaagacgaatccgacgtaaaacagttgtggctgcaattgaagaaagaagagccacatctattgtccaacttcgaagattttcttacgcgaattatatctcagttgcaggaggcgcacgaggagaaaaacgagttggagtgtgctcttaagcgcaagattgcagcatacgatgaagagatccaacacctgtacgaagaaatggagcagcaaatcaaatccgagaaagaacagttccttcttaaagatacagaacgttttcaagcccgaagccaggaactggagcagaagctgctgtgtaaggagcaagagctggaacagctcactcagaagcagaaaagactggaaggccagtgcacagctctccaccatgataagcacgagacgaaggccgagaataccaaactcaaacttaccaatcaggagcttgccagggagttagagagaacgagctgggagctgcaggatgcccagcaacagctggagtctctccagcaggaggcttgtaagcttcatcaggagaaggaaatggaggtgtacagagtcaccgaaagcctgcagagggagaaggccggtctcctgaaacagttggacttcctccgcgagagaaataaacacctcagagacgagcgggacatctgctttcaaaagaataaggcagcaaaggcgaacacggccgctagtcgcgcaagttggaagaaaagatcgggatcagttattgggaagtacgttgattctcgaggaatccttcggtcccaatcagaggaagaggaagaagtcttcgggatcccgcgacgttcttcactgggcctgagcggttacccacttactgaggaggaacccggaaccggtgaacccggacctgggggtccgtatcccagaccgctccgccgaatcatttccgtcgaggaagacccactcccacaactcctggacggtgggtttgagcagcccctgtcaaaatgctcagaggaggaagaggtgagcgatcagggcgtccagggacagatccctgaagcaccacccctcaagctgacacccacttcccccagggggcagccggtgggcaaagaggcactctgcaaagaggagagctctccctccgcacccgacagattgtttaaaatcgtattcgtcgggaatagcgcggtgggcaaaaccagcttcttgaggcggttttgtgaggatcgattcagtcccggtatggccgcaaccgtaggaatcgactacagagtgaaaacactcaatgtggataactcacaggtggccttgcagctctgggacacagcaggtcaggagcgatacaggtgcatcacccagcaattcttccgcaaggccgacggagtgatagtcatgtacgacttaacagataaacagagcttcctgagcgtgcgcaggtggttatccagtgtggaggaagctgttggagaccgcgtgcctgttctgcttcttggcaacaagctcgacaatgagaaagaaagggaagttccccgaggactgggggagcaactggccaccgaaaacaatctgattttctacgaatgctctgcttatagtgggcataatacgaaagagagcctgctccatcttgccagatttctcaaggagcaggaagatacagtaagggaggatactatccaagtaggtcatcccgcaaagaaaaaaagctgttgcgggtag

SEQ ID NO: 221728 - DNA, 1389 bp, Artificial Sequence
  Description of Artificial Sequence: Synthetic coding sequence
atggctgcccctgacggccgagtcgtgtctcgtccacagcgccttgggcagggcagtggacaggggccaaagggaagcggagcctgcttgcaccccctagattctctggaacaaaaggaaacacaggaacagacatccggccagctggttatgttacgcaaggcacaggaatttttccagacatgtgatgcagaaggcaagggcttcattgcgagaaaggacatgcagaggctacataaagagctgccactgtcacttgaggagctagaagacgttttcgatgctctggatgccgacgggaacggctacctgacccctcaggagtttactactggcttcagccatttcttctttagtcagaacaacccaagccaggaagatgctggcgaacaggttgcccagcgtcatgaggagaaggtctacctctcccggggtgacgaagatctcggagatatgggcgaggacgaagaggcacagtttcgaatgctcatggacaggctgggcgctcaaaaggtactagaagatgaaagcgacgttaagcagctttggctgcagctcaagaaagaggagcctcaccttctcagcaacttcgaggacttcctcactaggatcatttcccagctccaggaggcacatgaagagaaaaatgagttagagtgcgcgctgaagagaaaaattgcagcgtatgacgaagaaattcaacacctgtatgaagagatggagcagcagattaaaagtgagaaggagcaattcctattgaaagatacggaacgcttccaagcacgcagccaggagctcgaacagaaactcttgtgcaaggagcaggaactggagcagttaacacagaaacagaagaggctcgagggccagtgtaccgctcttcaccatgacaagcatgaaacaaaggctgaaaacaccaagctgaagctgactaaccaggagctggccagagaattagagaggacttcctgggaactgcaggacgcccagcagcaattagaatctctgcaacaggaggcttgtaagttgcaccaggagaaggagatggaggtgtatcgggtgaccgagtctctacagagggagaaagccggtctcctgaagcagttggattttctgcgcgaacggaataaacaccttagggatgagcgagatatctgcttccaaaagaacaaggcagccaaagccaatactgcagcctcccgggcaagttggaaaaagcggtcaggctcagtcattggcaagtatgttgattcccggggaatactgaggcgatggccacagagagacagaggaatccctactctccaatatcagacacagcgggatctggaagattgcaagcatgaaatgaagaaaatctgcaaagcggaggtaacattggagatgtag

SEQ ID NO: 221729 - DNA, 357 bp, Artificial Sequence
  Description of Artificial Sequence: Synthetic coding sequence
tgagagaaggaaatggaggtctacagggtgaccgagtccctacagcgggaaaaagcaggcttactcaaacagctcgacttcctgagagagcgtaataagcatctgcgtgatgaaagggatatttgcttccagaagaacaaagccgctaaagcgaacaccgcagcctcacgggctagctggaagaaacggtctggatctgtgattggaaaatacgtggactcccggggtatactgcggaggtggccccagcgcgacagaggcattcctactcttcagtatcaaacccaaagggacctcgaagattgtaaacacgagatgaagaaaatctgcaaggccgaggtgacattagagatgtag

SEQ ID NO: 221730 - DNA, 1923 bp, Artificial Sequence
  Description of Artificial Sequence: Synthetic coding sequence
atggtgagcaaccctgtacacgggctgcccttccttcccggaacctcatttaaggactcgacgaaaacggccttccaccgctctcagacactgtcataccgaaacggatatgccatcgttcggaggcccaccgtcggcatcggcggagaccgcctgcaattcaatcagctgtcccaagcagagttagacgaactggccagcaaggcgcctgtactgacatacggtcagcctaaacaggccccacctgccgacttcattccagcccatgtagcgtttgacaagaaggtcttgaaatttgacgcgtatttccaagaggacgtaccaatgagtaccgaagaacagtaccggattcggcaggtcaacatctactattatctcgaggacgattctatgagcgtcatcgaaccggtcgtcgaaaatagtggaattctgcagggtaagctcatcaagagacaaaggctggctaagaacgaccggggtgaccactaccactggaaggatcttaatcggggaatcaacattacaatttatggcaaaaccttccgtgtcgtggactgcgaccagttcacacaggtgtttttggagagccaggggattgagctgaaccctcccgaaaagatggcgctggacccttacaccgaactgcgtaaacagcccctgcgtaaatacgtcacaccaagcgacttcgaccaactgaagcagtttctgacctttgacaagcaggtgttacggttttatgcaatctgggatgatactgactctatgtacggtgagtgccgcacctatattattcactattatctgatggatgacaccgtcgagataagggaagtccatgagcgcaacgacggtagggatcccttcccactgctgatgaacaggcagcgggtgcctaaggtcctggtcgaaaatgccaagaattttccacagtgcgtcttggagatttccgatcaggaagtccttgagtggtacaccgcaaaggattttattgttggtaagtctctaacgatattgggaagaacattttttatctacgattgtgacccgtttactcgtcgctattacaaggaaaagtttgggataacagatctgccacgcatcgacgtttctaagagagaacctccacccgttaagcaagagctccccccttacaatggcttcggtttggtggaggacagtgctcagaactgttttgccctgataccaaaggcccctaagaaggatgtgattaagatgctggtcaacgacaacaaggtcctgcggtatctggctgtgctggagtcacctattcccgaggacaaagacagaagattcgtcttcagctacttccttgctacggatatgatatccatcttcgaacctccagtgcggaattccggcataatagggggtaaatatttgggacggaccaaagtggtgaagccatacagcaccgtcgataatccggtctattacggaccttcggatttttttattggagccgttatcgaggtctttggtcaccggttcattattctggacacagacgaatacgtgctaaagtacatggagtcaaacgccgcacagtactcgccagaagctctggcgtcgatacagaatcacgttaggaagcgcgaggcgccagctcccgaggcggaatcaaaacagaccgagaaggatcctggcgtgcaggaactggaggcacttattgatactatacagaagcagctgaaagatcactcctgcaaggacaatatcagagaagcattccagatatatgataaagaggcctctggctatgtggatagagacatgtttttcaagatttgtgagtctctaaatgttcctgtggatgatagcttagtaaaggagctgatcaggatgtgttcacacggtgaggggaaaatcaattattacaacttcgttagggcattctccaactag

SEQ ID NO: 221731 - DNA, 1653 bp, Artificial Sequence
  Description of Artificial Sequence: Synthetic coding sequence
atgtcctggcctgtcctcaagttcgacgcatacttccaggaggacgtgccaatgtccactgaggagcaatatcggatccgacaggtgaatatctattattacctcgaagacgattccatgagtgtcattgagcccgtggtggagaactcagggatcctgcagggaaaactgattaagcgccagcgtctcgctaaaaatgataggggggaccactaccattggaaggaccttaatcgaggtatcaacattaccatttatggcaagaccttccgcgttgtcgactgtgatcagtttacacaagtgtttctggaatcacagggtatcgagctgaatccccctgagaaaatggctttagacccatacactgagctgcggaagcagccgctccgaaagtacgtgacaccttcggatttcgaccagctgaagcagttcctgactttcgacaagcaagttctgcgcttctacgctatttgggacgataccgacagtatgtatggagaatgtagaacttatattatccactactatctgatggacgataccgtggagataagagaagtccacgagaggaacgacggacgggaccctttcccattattaatgaaccggcagcgggtcccaaaggttcttgtggagaatgctaagaactttcctcaatgcgtactggaaatttctgaccaggaggttcttgagtggtataccgcaaaggatttcattgtcggtaagtctctgacaatcctgggaagaactttttttatatacgactgcgacccttttacacggcgatactacaaagagaagttcgggatcaccgatttacctcgaattgatgtgtccaaaagggagccaccccctgttaaacaggaactccccccatacaatggctttggactcgttgaagattcagcacaaaattgctttgctcttataccaaaagcccctaagaaagacgtgattaagatgctggtgaatgataataaagtcctacgatacctggccgtgctagagtcccctatacctgaagacaaggatcgcagattcgttttttcgtactttcttgccaccgacatgatcagcatcttcgaaccaccggttcgcaatagtgggattattgggggaaaatatctaggcagaaccaaggtggttaagccctattccaccgttgataaccccgtgtactacggacccagtgattttttcattggggcagtaatagaggtctttggccacaggtttataatcctcgatacggacgagtacgtactgaaatacatggagtcaaacgctgcgcaatactctcccgaagccctcgctagcatccagaaccatgtcaggaaacgcgaagcgccagctcctgaagcagaatcaaagcaaactgagaaagatccgggtgtacaggagttagaagctttaattgatactattcaaaagcagttaaaggaccactcgtgtaaggacaatattcgcgaagcctttcagatttatgacaaggaagcatctggttacgtggaccgagacatgtttttcaaaatctgtgagagcctaaatgtccctgtggatgactcgctggttaaggaggtgacttgcaagaggctcctgctgcccgcattcacttttccaagtccagtttggattcccctgtgcggtctgtag

SEQ ID NO: 221732 - DNA, 1866 bp, Artificial Sequence
  Description of Artificial Sequence: Synthetic coding sequence
atgttgaaaactgcatttcataggtcacagacactctcttaccggaacggctatgctattgtgagaagacctaccgtgggcatcgggggtgatcgcctgcagtttaatcagctctcccaggcggagctggacgagctcgcctctaaggccccagtgttaacctacggccagcctaagcaggcgcctcccgctgatttcatccctgcccacgtggccttcgacaagaaagtgctgaagttcgatgcttactttcaggaagatgtgccaatgtctactgaagagcagtacagaatcagacaagtgaatatatactactatctggaagacgactccatgtccgttattgagccggtggttgaaaatagcggtattctgcagggtaagcttatcaaaagacagcgtttagcaaagaacgatcggggagatcactaccactggaaagatctgaaccggggaattaacattactatttacggaaagaccttcagggtggttgactgcgaccagtttacacaagtctttctggagtcccagggaatcgagctgaatcctcctgagaagatggccctggacccctacactgaactgaggaagcagcctctccgtaaatatgttaccccctctgactttgatcagctgaaacaatttctgacgttcgacaaacaggtgctacggttttatgcaatttgggacgacaccgactccatgtacggcgagtgccgcacatacataattcactattacctgatggacgacaccgtggaaataagagaggtgcacgagcgcaatgatggtcgcgatccattccctctattgatgaacagacaaagagtcccaaaagtgctcgttgaaaacgctaagaactttcctcagtgtgtgttggaaatcagtgatcaggaagtcctggaatggtacactgccaaagactttatcgtggggaaaagcctgaccatcctagggcgtacctttttcatatacgactgcgaccccttcacacgcaggtactataaggagaaatttgggatcacagacttgccgaggatcgatgtctcgaagagggagccaccccctgtgaagcaggagctgcctccctacaacggatttggcctggttgaagactctgctcaaaactgttttgccttgatcccgaaggcccctaagaaagatgtgattaaaatgcttgtcaacgacaataaggtgctgcgctacttagccgtcctggaatcccccattccagaagataaggacaggcgcttcgtgtttagttattttctcgccaccgatatgatatccatctttgagcctccagtgcgcaattctgggattattggaggcaagtacctcggacgtaccaaggtggtgaagccttactctaccgtggacaaccccgtgtattacggaccttcagatttctttataggggcagtaattgaggtttttggacatcgattcatcatcctcgatacagacgagtacgtcttaaaatatatggagtcaaacgccgctcagtactccccagaggcgctggcctctattcagaaccatgttaggaagagagaggctcccgctcccgaggcagaatcaaaacagacggagaaggatccgggagttcaggagctggaggctctgatcgataccattcaaaagcaactcaaagatcattcctgcaaggataatatacgcgaagccttccaaatctacgacaaggaagcatcaggctatgtggacagggacatgttttttaagatctgtgagagcctgaatgttccagtggacgattcgctcgtgaaagaactgatccgtatgtgttcacatggcgaggggaagatcaactactataatttcgttcgtgctttttccaactag

SEQ ID NO: 221733 - DNA, 2250 bp, Artificial Sequence
  Description of Artificial Sequence: Synthetic coding sequence
atggcccttcctctgctaccgggtaattctttcaatagaaacgttgggaaggagaagttccacaagagccaacactgggggttttgtaataacgtaatgatgctggtgtccgatgagaagccagggattggaggggaaccgcttttgggtcagaaaatcaaacccaaatgtagcatatatcctaaaggtgacggctctgatgtccccagttgggtcgccttcgataagcaggtgctctcttttgacgcctatctcgaagaggaagtgcttgataagtcacagacaaactatagaatcaggtactataaaatttatttctaccccgaagacgataccatacaggtgaacgagcccgaagttaagaactctggcttgctgcaaggaacgtctatacgcagacaccgcattaccttgcctcctcccgatgaagaccagttctataccgtttaccacttcaacgtggggaccgaggtcgtgttctacggcagaacatttaaaatttacgattgcgacgctttcacccgcaattttctgcggaaaattggcgtgaaggtaaatcctcccgtccagtgcccagaggatccttatatgaaaattcgtagggaggtagtagagcatgtcgagccgctccgaccttatgagagcctggacaccctcaagcagtttctgcaataccatggcaagattctatgcttcttttgcttatgggatgacagcgttagcatgttcggggataggagggagcttatcctccattatttcctgtgcgacgacaccatagagatcaaggagcttctgcctcattccagcggtcgggatgctctgaagatgtttttgaggcgttcaaagctgcctaaaaactgcccaccaagagtgtaccagcctggacagatcacggatagggcagtcctgaattcgtacggcgacttcattaaaaaccaggccgacgggtacctgttcgacagatataaactaggtaaggtggatcaggaattctacaaagactctgatttatccttaggcgttactattaatgtctggggaaggaaggtgttgttatacgactgcgacgagttcactaagagttactacaagagcaagtatgggatcgaaaacttcacttccgtgagctgcaagccccctagtcccccaccaaaaatcgagcggaagttccctccgtataatggatttggctccgaagaagacagcctgcgcaactgcatcgatttaaagccaaccccacatcggaggaactttaagaaatttatggagaaagatagctacggctcgaaaagtaacatactcagattttttgccaaactggtgaccgataaatgtgttgatctggacagaatgttcgtaatttcttactatctaggagacgatacaatttcggtatttgaaccaattgaacgcaatagcggtattgctggcggtatgttccttaagcgatcgagagtgaagaagccaggtcaggaggtgttcaaatctgagctgagtgagtacatcaaggccgaggaattgtatattggagttaccgtaaatgttaacggatacctcttccggctactgaacgccgatgagtatacactgaattacatggagcagaataccgataaatacccattttctaatttgaagctcgctttacaaaaactaaaacaggaggaaggcaagagtcgagagctaaagcaggtctttaaagcggcagattctaagcatacaaacatggtggactacaacacattccgagacatcctgatgagtcttaccgtcggtaaccttgctgagcaggagttcgtgactatcgctcgccactatagagtacctgaggggacttgttctgatatggacttcctgattgctttggctcacgaaaagtttaagaagaacatgtttgagaactttgacacatttatttatagctgtgtgtatgaggatcgcgaaaaaaagaatgtcctccccaccaaggatatcaaacggctgtgcaagtccagcagattgcctttaagcgacgatttgttggaatccctgctgtctcgatttgaggattcggagaaacagattgactacaaatccttcttttcagctcttaactggagaaagaatccagttcctgaactgcagccagcctcttacctgaaggagcgctgcgaagacgtgtggctcggcatgccaagccctatccctgcaaaatacatagactactggacatttctcaaggatgcttttgggttggaggaggagtag

SEQ ID NO: 221734 - DNA, 489 bp, Artificial Sequence
  Description of Artificial Sequence: Synthetic coding sequence
atgtctttaaccgtgggaaatctggcagaacaggaatttgtgacaatcgccagacactacagagtccctgagggaacgtgctctgacatggattttttgattgcactggcacacgagaaattcaagaagaatatgtttgaaaattttgatacattcatatattcttgcgtctacgaagatcgcgagaaaaagaacgtgctgccaacgaaagatataaagaggctgtgcaagagtagtaggctgcctctgtccgacgacctgctggaatccttactctctagatttgaggactccgagaagcagattgattataagtcatttttcagcgctctgaactggcgcaaaaatccggtccctgagctgcagcccgcaagctacttgaaggagcggtgcgaagacgtatggctgggcatgccgagtcccataccagcaaaatacattgactattggaccttcctgaaggatgcctttgggctcgaagaagaatag

SEQ ID NO: 221735 - DNA, 753 bp, Artificial Sequence
  Description of Artificial Sequence: Synthetic coding sequence
atgaaaattcgtagagaagtggtggagcacgtcgaaccccttaggccatacgagagtctcgacacccttaaacagttcctccagtaccatgggaaaatattgtgttttttttgtctttgggatgacagcgtctccatgttcggggaccggagggagctcatcttgcactacttcctctgtgacgacaccatcgaaatcaaagagttattaccacactcttcgggcagagatgctctcaaaatgttcttgagaagaagcaagctgcccaaaaattgcccgcctagggtctaccagccaggccagattaccgatcgggctgtgctgaacagttacggagatttcattaagaatcaggccgatgggtacttgttcgaccggtacaagcttggaaaagtcgatcaggaattttacaaagactctgatctgagcttgggagttacaatcaacgtctgggggcgtaaggtcttgctctacgattgcgacgagttcacaaagtcatactataaatccaaatatggtatagaaaacttcacttcagtcagctgtaaaccgccttctcctcctcccaaaatcgaaagaaagtttcccccatacaatggattcggctcggaggaggactccctgcgcaactgtatcgacttgaaacccaccccccatcgccgtaattttaaaaaatttatggagaaagattcctatggctcaaagtcaaatatactgtttttttgcaaaacatcccatcgtcagatgtgttag

SEQ ID NO: 221736 - DNA, 2334 bp, Artificial Sequence
  Description of Artificial Sequence: Synthetic coding sequence
ggcggtcagactacccgaccaggcggagcagccgcatgccgcgcactctcctcgggaaccctggactttcgcaccctgtctgctatggcactccccctgctccctggcaatagtttcaatagaaacgtagggaaggagaagttccataagagtcagcattgggggttttgcaacaatgtgatgatgctcgtgtctgacgaaaagccagggattggcggtgaacccctactgggccagaagatcaaaccaaaatgcagtatttatccgaaaggggatggaagcgatgttccatcatgggtggctttcgataagcaggtactgagttttgacgcctatctggaggaagaagtacttgacaaaagtcagacaaattatcgcatcaggtactacaagatttacttttatccagaggacgatacaatccaggtgaatgagcctgaagtcaagaatagcggtctcctgcagggtacctcaatccggcgacacaggatcaccctgcctccaccagatgaggatcagttctacactgtgtatcactttaacgtgggtacagaggtggttttttatggcagaacctttaagatctacgattgcgatgctttcacccgaaactttcttcgtaaaatcggggtaaaagtgaatcctcctgttcaatgcccggaggacccctatatgaagatccgacgcgaagttgttgagcacgtggagccactgcgaccatacgagagcttagacactttgaagcagttccttcaatatcatggcaaaattctgtgttttttctgtttgtgggatgactcggtctcgatgtttggggaccgcagggagctgatcctgcactactttctctgcgatgacacgatagagattaaagagctattgccacacagttctgggagggacgcgctgaaaatgtttctgcgaaggagtaaactccccaagaactgcccaccaagagtataccagccaggtcagattactgatagagccgtgctgaactcttatggcgatttcattaaaaatcaggccgacggctatctctttgatcgctataagctcggaaaggtggaccaggaattttataaagattccgatctatcacttggcgtcacaatcaacgtttggggtcgaaaagtgctgctgtatgactgtgacgaattcacaaagtcatactacaaatcgaagtacggaattgaaaattttacaagcgtctcttgtaagcctccctcccctccccctaagatagagaggaagtttcccccttacaatgggttcggttcagaagaggattctttgcgaaattgcatcgacctgaagcccaccccacaccggaggaattttaaaaagttcatggaaaaagactcctacggtagtaagagtaacattctgcggttcttcgcgaagcttgtcactgacaaatgtgttgatctggatagaatgttcgtcatttcctattatctcggcgacgatactatctcagtgtttgagccaatcgaacggaactctggtatcgcgggtggtatgtttctgaaaaggtcaagggtgaagaaacctggtcaagaagtgtttaagagtgaactatccgagtacatcaaagctgaagagctgtatatcggagtgacggtaaatgtcaatgggtacttatttcgattgctgaacgcagacgagtatacactgaactacatggagcagaacactgataagtatccatttagtaacctgaaactggccctgcagaagttgaaacaggaggagggtaagtcgagggagctgaaacaggtgtttaaagccgctgacagcaagcatactaatatggtggactacaacacatttcgcgacatacttatgagtcttacggtggggaacctagccgagcaggagtttgtgactatcgccagacattacagagtccccgagggcacatgtagtgatatggacttcctaatcgccctggctcatgagaagtttaagaagaatatgttcgagaatttcgataccttcatttactcttgcgtatacgaggatcgcgaaaaaaagaacgttctgccaacaaaggacatcaaaagactgtgcaagtcatctaggctacctctaagtgatgatttactcgagagcttattgtcaagatttgaagatagtgaaaagcagattgactataagtcgtttttttccgctctcaattggcggaagaatcccgtgcccgagctccaacctgcatcttacttgaaagagaggtgcgaagacgtgtggctaggaatgccctcgccgattcccgctaaatacatcgactattggacatttcttaaggatgcttttggactcgaggaggagtag

SEQ ID NO: 221737 - DNA, 2193 bp, Artificial Sequence
  Description of Artificial Sequence: Synthetic coding sequence
tgaaacaacaccgccggtcgtagacggtgcctgccgggacccctattttgggatcctggcttttccgacaccgagaggcatggaccggctagcgctgccggacaacagctacaacctcaacgggagaaaggagacggttctgacgttcccagttgggtggccttcgacaagcaggtattgtcgtttgacgcctacttggaggaagaggtcctggacaaaagccaaacaaactacagaattaggtactataagatctatttttatcccgaagatgatacaatacaggtgaacgaaccggaggtaaagaattctgggcttttgcagggcacttctattcgtcgccatcgaattacgctaccccctcccgacgaagaccagttttacactgtgtaccattttaatgttgggacagaggtagtcttttatggaagaacatttaaaatatacgactgcgacgcttttactcgcaatttcttacgcaaaattggcgtaaaggtgaaccctcccgttcagtgtccagaggatccctacatgaaaatccgcagggaggtcgttgagcatgtcgaacctttgcgcccatatgaatcactggacaccttaaagcaattcttgcagtaccacggaaagattctgtgcttcttctgcctgtgggatgacagcgtgtctatgttcggggatagaagagagcttatcctgcattattttctctgcgatgacacgattgagataaaggaacttctaccccacagttccggaagggacgccctcaaaatgttcctcaggcggagtaagctgccaaagaattgcccccctcgagtctaccagcccggacagatcaccgatagggcagtcctcaacagttacggagattttataaaaaatcaggccgatgggtatttgtttgaccgttataagttgggaaaggtagatcaggagttttacaaggattcagacctgagtctaggggtgacaattaatgtctgggggagaaaagtgctcttgtatgattgtgacgagtttaccaagtcttactacaagtctaagtacgggatcgaaaatttcacatcggttagctgtaaaccaccaagcccccctccgaagatcgagcggaaatttcccccatataacgggtttggaagtgaagaagacagcttacgaaattgtatcgacctgaaaccaacaccacataggcgcaattttaagaagttcatggagaaggactcttatggtagcaaaagtaacatactgcggtttttcgctaagctcgtgactgacaaatgcgtcgatttggaccgcatgttcgtcatctcatactaccttggtgatgataccatatctgtctttgaacccatcgagcgcaactctggcatcgctgggggtatgtttttaaaacgttctagagttaagaagccaggccaggaggtcttcaaaagcgagctcagtgaatatatcaaagcggaagaactttacattggagtaaccgtgaacgtgaacgggtacttgttccgcctcctgaatgccgatgaatatacattgaattatatggaacagaataccgataagtatcctttctccaacttgaagctcgccctgcagaagctcaagcaggaagaggggaagtcgagagaactcaagcaagtttttaaggcggctgattccaagcataccaatatggtcgattacaacacatttcgggacatcctcatgtcactgactgtaggaaatttggccgagcaagagtttgtgaccatcgcacggcattatcgcgtgcccgaagggacctgcagtgatatggattttctgatcgccctggcacatgaaaaattcaagaagaacatgttcgagaatttcgatacatttatttatagctgcgtctacgaagatcgcgaaaaaaaaaacgtgctgcctaccaaggatataaagaggctgtgcaaatccagccgtctgccactgtctgatgaccttctggaatctctgctgagccgcttcgaggattccgaaaagcagatcgattataaaagtttcttcagcgccctgaattggcgcaagaatcccgtgcctgagctgcaaccagctagctacttaaaagaacggtgcgaggacgtgtggctggggatgccctctccaatcccagccaaatatatcgattactggacctttctgaaggacgccttcggcctcgaggaggagtag

SEQ ID NO: 221738 - DNA, 720 bp, Artificial Sequence
  Description of Artificial Sequence: Synthetic coding sequence
atggcgtccgaggagctggcctgcaaactggagagacggctacgtagagaggaagctgaggaaagtggtccccagttggcccctctcggcgcacccgctccggaacctaagccagagccagaaccccctgcaagagcccctaccgctagcgccgatgcagaactcagcgcacaactctcgcgccgactggacatcaatgagggcgctgccagaccccgacgctgtagggtgtttaacccatatacggagttccccgaattcagccggagactcataaaggatctggagagtatgttcaaactgtatgacgccggacgagacggattcatagacctgatggagctcaagctcatgatggaaaaattgggagccccacaaacccatctcggtctgaaaagcatgattaaagaggtcgatgaggactttgatgggaagttaagcttccgcgaatttctactgatttttcataaggccgctgctggagagctgcaggaggattcaggtctcatggccctcgctaaattaagcgaaatcgacgttgcactggaaggagtgaaaggggctaagaatttctttgaggctaaggtccaggccctgtcaagcgcctctaagttcgaagcggagctaaaagccgagcaggacgagcgaaagcgggaggaagaggaacgcaggctgagacaggccgcttttcagaagctgaaggccaacttcaacacatag

SEQ ID NO: 221739 - DNA, 432 bp, Artificial Sequence
  Description of Artificial Sequence: Synthetic coding sequence
atgggggagctccagtatgatgccggtcgggacgggttcatcgacctcatggaactgaagctaatgatggagaaactcggcgctccccagactcatctgggtctgaagtctatgattaaggaggttgacgaggacttcgatggcaagctgagctttagggagttcttattgatttttcacaaggccgcagccggagagttgcaggaggacagtggtctgatggcccttgccaagctgagtgaaattgatgtggctctggagggagtcaaaggcgcaaaaaactttttcgaggcaaaggtgcaggctttgtcgagcgcgtccaagttcgaggccgaactgaaggctgaacaagatgaacgcaagcgagaggaggaggagagacgtttgcgccaggcagctttccaaaagcttaaggcaaattttaacacctag

SEQ ID NO: 221740 - DNA, 384 bp, Artificial Sequence
  Description of Artificial Sequence: Synthetic coding sequence
atggaactcaagctcatgatggaaaagctcggcgctccacagacccacttgggcctgaagagtatgattaaagaggtggacgaggattttgatggcaagcttagttttagagagtttctacttatttttcacaaagcagcagccggagagttgcaggaggatagtggcctgatggccttagccaaattgtccgagatcgatgtagcactggagggagtaaagggtgccaaaaactttttcgaagccaaagtccaggccttgtcaagcgcttcgaaattcgaggctgaattaaaggccgagcaagatgagcgtaagcgagaagaagaggaaagacgcttacggcaagccgctttccagaagctgaaagcaaactttaatacttag

SEQ ID NO: 221741 - DNA, 384 bp, Artificial Sequence
  Description of Artificial Sequence: Synthetic coding sequence
atggagctgaagctgatgatggaaaaactcggcgcacctcagacacacctgggtctaaaatccatgattaaggaggttgacgaagattttgatggaaaactgtcgttcagagagtttctgctgatctttcataaggccgctgcaggtgagctacaggaagactctgggctaatggctctagccaaactgtccgagatagacgtggccctcgaaggggtcaagggagccaagaatttcttcgaggctaaggtacaggcactctcttctgcttctaagttcgaagccgaactaaaggctgagcaggatgagcgcaaacgcgaagaagaagaacggagactgcgccaggccgcatttcagaagttaaaagctaactttaacacttag

SEQ ID NO: 221742 - DNA, 429 bp, Artificial Sequence
  Description of Artificial Sequence: Synthetic coding sequence
atgttcaaattgtacgacgcagggcgagatggattcatcgacctcatggaactcaagctgatgatggagaaattaggagcaccccagacacacctcggccttaaaagcatgatcaaagaagtcgacgaagacttcgacgggaagctgagctttcgtgaatttctcctaatttttcacaaagccgctgctggagagctgcaggaagatagtgggctgatggccctggcaaagctttccgaaattgatgtcgccctcgaaggcgtgaagggtgccaagaacttcttcgaagccaaagtccaggctctgtccagtgctagtaaattcgaggccgaacttaaggccgaacaggatgagcggaagcgcgaggaagaggagcggaggctgcggcaggcggcatttcagaagctcaaggctaatttcaatacttag

SEQ ID NO: 221743 - DNA, 2466 bp, Artificial Sequence
  Description of Artificial Sequence: Synthetic coding sequence
atgcccacacgcgtttgctgctgctgcagcgccctgagacctcgctacaagcgcttagtcgacaacattttccccgaagacccgaaggatggactcgtgaagaccgacatggagaagctgacattctacgctgttagcgcacccgagaaactggatcgtatcggatcttacctggctgaacgcctttcgcgggacgtagttcggcatcggtccggctatgtcctgatcgctatggaagccttagatcaactgctgatggcatgtcatagccagtctataaagccattcgtggaaagcttcctccatatggtggctaagctactagagagcggggagccaaagcttcaagtcctggggaccaactccttcgtcaagtttgcgaacatcgaggaggacaccccaagctaccatcgacgttacgatttctttgtttctagattcagtgccatgtgtcattcctgccactccgatcccgagatcagaacagaaattcgcatcgctggcattcgcggtattcagggcgtcgtgagaaagaccgttaatgatgagctacgcgctactatttgggagccccaacacatggacaagatcgtgcctagcctgctgttcaatatgcaaaagatcgaggaagtcgacagccggataggtccaccatcatcacccagtgccacagacaaagaggagaacccggctgtactcgctgaaaactgcttcagggagttgctgggcagagcaacgttcggcaacatgaacaatgcagtccggccagtgtttgctcacctggaccaccataaattgtgggaccctaatgagttcgctgtgcactgctttaagattattatgtattccatacaggcacagtacagccatcacgtaatccaggagatccttgggcacctggatgccagaaaaaaggatgcacctcgggtccgggctggtatcatccaggtgctcttggaagcagtcgcaattgctgccaaaggatccatcggaccgacagtcctggaggtcttcaacacactgctgaagcacctcaggctgtctgtggaattcgaggcaaatgacctgcagggaggatcagttgggagcgtgaatcttaacaccagtagcaaggacaatgacgagaagattgttcaaaatgccattatccagacaatcggctttttcggaagtaacttacctgattaccagaggagcgagatcatgatgttcataatggggaaggtccccgtgtttggcacctcaactcacacactggacatatcccagttaggcgatttaggcacaaggagaattcagattatgctacttagatctctcctgatggttacatccggatataaggcgaagactatcgtgacagctctccctggcagtttcctcgatcctttgttgtctcccagtctgatggaggattacgagctgcgccagcttgtgctggaagtgatgcacaatttgatggatcgccacgacaacagggctaaactcaggggcatccgcattattccagatgttgcagatctgaagatcaagagggagaaaatatgccggcaggacacaagttttatgaaaaaaaatggccagcaactctataggcacatttatctcggatgtaaggaagaggataacgtgcagaaaaactacgaactgctgtataccagtctcgccctgataactatcgagctggcgaacgaagaagtggtgattgacttgataaggttagccatcgccttgcaggactcagccatcattaatgaggacaaccttccaatgttccacagatgcgggatcatggcactggttgctgcctatctgaacttcgtgtctcagatgatcgcagtgccagccttttgtcagcacgtctctaaagtgatcgagatcagaaccatggaggctccatattttctgcctgagcatattttccgtgataagtgcatgctgcctaagagcctggaaaagcacgagaaagacctgtacttcctgaccaacaaaatagccgagagcctagggggatcaggatacagcgtagaacggctgagcgtgccatacgtgccccaggtgactgatgaggacagattgagccgccgtaagagcatcgtggacaccgtttccatccaggttgatattctatcaaataacgtcccttccgatgacgtggtctcgaataccgaggagattacctttgaggcgttgaaaaaggccatagatacaagcggcatggaggagcaggaaaaggagaagcggcgactcgttattgaaaagttccaaaaagcccctttcgaagagatcgccgcacagtgcgaatctaaggcgaatttgctgcacgacagactagcccagatcctggaactgaccattaggcctccacccagtcctagcggcaccttgaccattacctccgggcacgcacagtaccagtcggtgcctgtatatgagatgaaattcccggatctgtgcgtctactag

SEQ ID NO: 221744 - DNA, 2466 bp, Artificial Sequence
  Description of Artificial Sequence: Synthetic coding sequence
atgaagagtagggtatgctgctgttgtagcgctctgcggccacggtataaaaggctcgtcgacaacatctttccagaggaccctaaggacgggctggtgaaaacagacatggaaaagctgacattctacgcagtgagcgctccggaaaagttggatcggattggaagctacctggctgaaaggctgagccgtgacgtggtgcggcacagaagcggatatgtgctgattgctatggaagcgctggatcagctactgatggcttgtcacagtcagagcataaaacctttcgtagaatccttcttacacatggtagccaaattgctggagtccggggagcccaaactacaggtgctgggcacaaactcattcgtgaagttcgccaatatcgaagaggatactccaagctaccacagaaggtacgacttctttgtttcccgtttctcagcaatgtgtcactcttgccacagtgacccagaaatcagaacagagattcgtattgcaggcatccggggaattcagggggttgtgaggaaaactgtcaacgacgagctgagagccacgatttgggaaccacagcacatggacaaaatcgtaccaagccttctgttcaacatgcagaagattgaggaggttgatagtcgaataggcccacccagttctccctcagccaccgataaggaagagaacccagcagtactcgctgagaactgcttcagagaactgctgggacgagctaccttcggaaacatgaacaatgccgtgcgaccagtcttcgcacacctcgaccaccacaaattgtgggaccctaatgaatttgctgttcattgcttcaagattatcatgtactccattcaagcccagtatagccatcacgttatccaagaaattttaggtcacctcgatgcgaggaaaaaagacgctccgagggtgcgagcagggatcatccaagtgttactggaagcggttgctattgctgccaaagggtcaatcggacccactgtgctcgaggtgttcaataccctcctgaaacatctgagactatccgtagaattcgaggccaacgatctgcagggcggttccgtcggctccgtgaacttgaacacctctagcaaggacaatgatgagaagattgttcagaatgctataattcaaactatcggattctttggctcaaatctgcccgactaccagcggtcggaaattatgatgtttatcatgggaaaagtgcctgtgttcggcacttctactcataccctcgacatctcccagctgggggatctaggcacgagacggatacagatcatgctcctgcgttctctgctgatggttacatcgggatacaaggccaagaccatcgtgaccgctctgcccggttctttcctggatcctcttttgtctcctagtttgatggaagactacgaactcaggcaactggttctggaagtgatgcataacttaatggacagacacgacaaccgcgctaagctgcgaggcataagaatcattcccgacgtagccgatcttaaaattaagagagagaagatttgccggcaggacaccagctttatgaaaaagaacggacagcaactctatagacacatctacctcgggtgtaaggaggaagacaatgtgcagaagaactatgaactgctctatacgtccctggccctgattacaattgagttggctaatgaggaggtcgttatagacctgatcaggttggcaatcgccttgcaggactccgcaatcatcaatgaggataatctgcctatgttccataggtgcgggataatggccctcgtggccgcttatctgaacttcgtttcacagatgatcgccgtccccgctttctgccaacacgtctctaaagtcatcgagattagaaccatggaggccccatatttcctacctgagcacatattccgagacaagtgcatgctgcctaagtccctcgagaaacatgagaaggacttatactttctaaccaataagattgcagagtcactagggggtagcggttattccgtggaacgcttgagcgtgccctatgttcctcaagtgacagacgaggaccgcctaagccgacgtaaaagtatcgtcgacacagtgagcatccaggttgacatcctctcaaataacgtcccaagcgacgacgtggtttcgaatacagaggagatcacatttgaggcgctgaagaaagccatagacacttcaggcatggaagagcaggagaaggaaaaaaggagactcgtgattgaaaaattccagaaggccccattcgaggagatagccgcacagtgcgagagcaaggcaaacctgctgcatgatcggcttgctcagatcctggaacttacgattaggccaccccctagtccatcaggcaccctgaccatcacgagtggccacgcccagtaccagtcagtccctgtgtacgaaatgaaattcccagacctgtgcgtgtattag

SEQ ID NO: 221745 - DNA, 2334 bp, Artificial Sequence
  Description of Artificial Sequence: Synthetic coding sequence
atgcccaagggggtgtgctgctgttgcagtgccctcaggccacgctacaagagactagtggacaacatattccccgaagaccctaaagacggtctggtgaaaactgatatggagaaactcacattttacgctgtctcagccccagagaaactcgaccgcattggttcctacctagccgagaggctcagccgggatgtggtcaggcaccgcagtggctacgttttaattgctatggaagcacttgatcagttactcatggcgtgtcattcccaatctatcaagccattcgtcgagagcttcttgcacatggtcgctaagcttttagaatccggggagccaaagctgcaagtccttgggacaaatagctttgtgaagttcgccaacatagaggaggatacccccagttaccatcgcagatacgattttttcgtgtcgcgattctccgccatgtgtcacagctgccattctgatccggagattcggactgaaatccgcattgccggtattcggggtatccaaggagtcgtgcggaaaaccgttaacgacgaactgcgggcaaccatttgggagcctcaacatatggacaaaatcgtacctagcctactctttaacatgcagaagattgaagaggtggattccaggatcggccctccctcgtcccccagtgctaccgataaagaagagaatcctgcagtgcttgcggaaaactgcttccgcgagctgctgggccgagccactttcggcaacatgaataatgccgtaagacccgtcttcgctcatctggaccatcacaagctgtgggacccgaatgagtttgcagtccactgctttaagatcatcatgtacagtattcaagcacagtacagccaccatgtgatacaggagatcctgggtcacctcgacgctcgtaaaaaggacgctcccagagtgagggctggcatcatccaggttttactggaagcagtggcaatcgccgctaagggatccattggccctacggtgctggaagtgttcaacaccctgcttaaacatctgcgcttaagtgtagagtttgaagcaaatgacctccagggaggaagcgtcgggtcagtgaatctgaatacatcctccaaagataacgatgaaaagatagtccagaacgctataatccagacaatagggttttttggttctaatctgccggactatcagagaagcgagattatgatgtttataatgggcaaagtaccagttttcggcacatccactcatactctggacatcagtcaattaggggacctgggtacaaggcgcattcaaataatgcttctgcgaagcctgttgatggtgacgagcggctacaaagcgaagacaatcgttactgccttgccagggtccttcctggatcccctgctttctccaagccttatggaagattacgagctcaggcagctggtgcttgaagtgatgcataacttgatggatcgtcacgacaaccgggcaaaactgcggggtatacgcattatccccgatgtggctgacttgaagatcaagagagaaaagatatgcaggcaggatacctcgtttatgaaaaaaaacggccagcagttgtacagacacatctacttaggctgcaaagaagaggataatgttcagaagaactacgaactgctgtacacttcactagccctgatcaccatcgagcttgccaacgaggaagttgttattgaccttattcgccttgctatcgcactacaggattctgctataatcaacgaagacaacctcccgatgttccaccgttgcgggattatggcccttgttgccgcttatctcaatttcgtcagccagatgattgccgtgccagctttttgccacaaaatcgctgagtctctgggaggcagtggttacagcgtggagcggctgagtgtgccctatgtcccacaggtcacagatgaggacagactgagtaggcgcaaatcaattgtggatacggtctccattcaggtcgatatcctgtccaacaacgtcccctctgacgacgtagttagtaacacagaggaaatcacttttgaggctctgaagaaggccatcgataccagcggcatggaagagcaagaaaaagaaaagcgcaggctagttatagagaagtttcagaaagcgcctttcgaggaaattgctgctcagtgcgagtcaaaggctaatctgctacacgatcggttagcacaaatcctcgagttgaccatccgaccacctcccagcccctccggcacgctgaccattacttcagggcatgctcagtatcagagtgtaccagtctatgaaatgaagttccctgatctgtgcgtctactag

SEQ ID NO: 221746 - DNA, 603 bp, Artificial Sequence
  Description of Artificial Sequence: Synthetic coding sequence
atgctcgcccgactgctgaaatttgaagaggctccatactttctgccggaacatatttttcgcgacaaatgtatgctgcctaagtccctcgagaagcacgaaaaggatctctacttcttgaccaataagatcgccgaaagccttggcggttcgggttacagtgtggagcgcctgagtgttccctatgtgcctcaagtgacagatgaggacagactgtccagacgcaagtctatcgtggatactgtctcaatccaggtagacatattgtcgaacaacgtgccttctgatgacgtcgtgtctaacacggaggagattaccttcgaagcacttaaaaaagctatcgacactagtggtatggaagaacaggaaaaggaaaagcgacggcttgtcatcgagaagttccagaaagccccatttgaagagattgcagcccagtgtgaaagtaaagccaacctgctccatgaccgcctcgctcaaattctcgagctcacaatccgccctccaccctccccgagcggaaccttgactatcacctccggacacgctcagtaccagtcagttcccgtgtacgaaatgaagttcccggacctgtgcgtatactag

SEQ ID NO: 221747 - DNA, 2358 bp, Artificial Sequence
  Description of Artificial Sequence: Synthetic coding sequence
atggagaagctcacattttacgctgtgtcggctccagaaaagctggacagaataggttcttaccttgccgaacgcctgagccgggacgtggtcagacataggagcggctatgtgctcatagcaatggaagccttggaccagctgttaatggcttgtcattctcagtcgatcaagccttttgtggaaagttttctgcacatggtggccaagttgctcgagagtggtgaacccaaactgcaagtgcttggcactaattcgtttgtgaaattcgcaaatatagaggaagatacccctagttatcatcgcaggtacgacttctttgtgtccaggttctctgccatgtgccacagttgtcatagtgaccctgagattagaaccgagatccggattgctggaatcagggggatacaaggcgtggtgcgcaagacagttaacgacgagttacgcgctaccatctgggagccccagcatatggataaaatagtacccagcctgctcttcaatatgcagaagattgaggaagtcgacagccgtatcgggcctcctagttcaccatccgcaacagacaaagaagagaaccctgccgttctggcggagaattgtttccgggaactgcttggtcgggctaccttcgggaacatgaacaatgctgtgcgaccagtttttgctcatctagaccaccacaaactgtgggatcctaacgaatttgctgtccactgcttcaaaatcataatgtactccattcaggcccagtacagccatcacgtgatacaggaaatcctggggcacctagacgcccgaaagaaggacgccccaagagttcgcgcaggcataattcaggtcctgctggaggctgtcgctatcgcagcaaagggcagtattggcccaactgtgttagaagtgtttaacaccttgctcaaacatctcagactgagcgtggagttcgaggccaacgacctgcaggggggatccgtcggcagcgtaaacctgaataccagttccaaggataatgatgagaaaattgtgcagaatgctataatccagactatcggttttttcggctctaaccttcccgactaccaacgatcggaaattatgatgtttatcatgggaaaggtgccagtgttcggaacctcgacacatactctagacatatctcaactcggagacttgggtactaggagaatacagatcatgctgctgcgcagtttgcttatggtgacgtccggctataaggccaaaaccatcgtgacggcactacccggatccttcttagaccccttgctgtctccaagccttatggaagactacgagctgagacagctggtgctcgaagtgatgcacaatctgatggatcggcacgataaccgcgcaaagttacggggtattcgcataatacctgatgttgccgatttgaagatcaaaagggaaaaaatctgtaggcaagatacgagcttcatgaagaaaaacgggcaacagctttaccgccacatctacctgggatgcaaagaggaggataacgtgcagaagaactacgaactattgtatacgagcttggcccttattacaatagagttagctaatgaggaagtggtaatcgacctcatccgtctagccatcgctcttcaggacagtgccatcataaatgaggataacctacctatgttccaccgttgtggcataatggcactcgtggccgcatatcttaactttgtgtctcagatgatcgccgtgccagctttctgccagcacgtgtctaaggtgatagaaatcagaaccatggaagcgccatacttcctgcccgagcatatattcagagacaagtgcatgctacctaagtcactggaaaagcatgagaaagatctgtacttcttgactaataagatagcggaaagtctgggaggatcaggttacagcgttgagcgcctgagcgttccctacgttccacaggtcaccgatgaggatcgtctgtctcgcagaaagagtatcgttgatacagtgtctatacaggtggacatcctttccaacaatgtgccatccgatgacgtcgtctctaacaccgaggagataacgttcgaggcattgaaaaaggccatcgatacatcaggaatggaggaacaagagaaagagaaacgcaggttggtaatcgaaaagttccagaaggccccatttgaagagatcgcggcacagtgtgagtccaaggccaacttactccatgataggctggctcaaatcctagagctcaccattcgacccccaccctctccatctgggacactgaccataacttcaggccacgcccagtaccagtccgtgccagtctacgagatgaagtttccagacctgtgcgtctactag

SEQ ID NO: 221748 - DNA, 1482 bp, Artificial Sequence
  Description of Artificial Sequence: Synthetic coding sequence
atgttgaaagcactgtttttgaccatgctcactcttgccctggtgaagagtcaggacaccgaggagaccattacatacactcaatgtaccgatggttatgagtgggatcccgtgcgccaacagtgcaaagatattgacgaatgcgacattgtgccggacgcttgcaagggtgggatgaagtgtgtgaaccactatggcggttacttgtgcctaccaaaaacagctcaaattatcgtcaataacgagcagccccagcaggaaacacagccagcagagggaaccagtggggcaacaacgggcgttgtggccgctagttccatggccacgtcgggtgtcttgcccggtggaggctttgttgcttctgcagcagccgtggccggacctgaaatgcagactggacgcaacaattttgtgattagacgcaatcccgctgacccccagagaattccctcaaatccatcccatcgtattcaatgcgctgctggttacgagcagtccgagcacaacgtatgtcaggatatcgatgagtgcacggccggaacacataactgccgagcagaccaggtgtgcattaacctgcgtggcagttttgcctgtcagtgccccccaggctatcaaaagcggggtgaacagtgtgtggacatcgacgagtgcaccatcccgccttactgccaccagcgctgtgttaatactcctgggtctttctactgtcagtgctccccaggctttcagctagcggctaataactatacctgcgtggatatcaatgagtgcgatgccagtaaccagtgcgcgcagcagtgttacaatattctgggaagctttatatgtcagtgtaatcagggatacgaactcagttcagaccgtctgaattgcgaggacatagatgagtgcaggacatctagctacctgtgccaataccaatgcgtgaatgaacccggaaaattcagctgcatgtgtccacaaggctatcaggtagtacggagcagaacttgtcaggatattaatgaatgtgagaccaccaatgaatgcagagaagatgagatgtgctggaactaccacgggggttttcgctgttacccgcgaaacccgtgtcaggacccgtacattctgacacccgagaatcggtgcgtgtgtcccgtgtccaacgccatgtgtcgggaactcccacagtccatcgtgtataaatatatgtcaataagatcagatcgctccgttccctctgacattttccagatccaagccacaacaatctatgctaacacgatcaacacctttaggataaagagtgggaacgaaaacggtgaattctacctgcgccaaacgagtcccgtcagtgcgatgcttgtgctggtaaagagcttaagcgggcctcgggaacatatcgtagatctcgagatgctgactgtttccagtatcgggactttccgcaccagctctgtccttcgacttaccatcatagtcggcccttttagcttctag

SEQ ID NO: 221749 - DNA, 1482 bp, Artificial Sequence
  Description of Artificial Sequence: Synthetic coding sequence
atgctcaaggccctctttcttacaatgttaacgctcgccttggttaagagtcaggacacagaggaaacgatcacatatacccaatgcaccgacggatatgagtgggacccagtccgacagcagtgtaaggatatcgatgaatgcgatatagttccagatgcatgcaaagggggtatgaagtgcgtcaatcactatggcggatatctgtgtttacccaaaacagcccaaattatcgttaacaatgaacaacctcaacaggagactcagccagccgaaggtacttccggggctaccacgggcgtggtggcggcttccagtatggccacatcgggagttctaccaggcggtggattcgtggcaagcgccgcagccgtggccggaccagagatgcagacggggaggaataacttcgtgatcagacgtaatccagcagatcctcagagaatcccaagcaatccatcccaccgcattcaatgcgcagcgggatatgagcagagcgagcataatgtttgtcaggacatcgacgaatgcacagcgggtacccacaactgtcgagcggatcaagtgtgcattaatctacgagggtcttttgcctgccagtgtccaccgggatatcagaaacggggagaacagtgcgttgacatcgacgagtgtacaatcccaccttattgtcatcagcgttgcgtgaacaccccagggagtttctactgccagtgttcaccaggctttcagctcgctgctaacaattacacttgcgtggacatcaatgagtgcgacgcctccaaccaatgtgcccagcagtgctataatatcctcggatctttcatatgtcaatgtaatcaggggtatgagctctcgtccgaccggttgaactgcgaggacatcgacgagtgccgcacgtcatcttatctatgtcagtaccagtgtgtgaacgaacccggaaagttttcctgtatgtgtcctcaggggtaccaggtcgtgagatcccgtacctgtcaagatattaatgagtgcgagaccacaaacgaatgcagagaggatgaaatgtgttggaactatcatgggggatttcggtgttacccaagaaatccatgccaagacccttacattctcaccccggagaatcggtgcgtatgtccagtgagcaacgccatgtgcagggaactcccacagtcaattgtgtacaagtacatgagcataaggtcagaccgatccgtaccatccgacattttccagatccaggcaacaaccatctatgccaacactatcaatacctttcgtatcaagtccgggaatgagaacggtgagttttatctccgccagactagccctgtgtctgccatgctggtccttgtgaagagtctcagcgggcctagagagcatatcgtggacctggagatgctgaccgtttcttctattgggacatttcggacatcgtccgtcttgcggctgacaatcattgttggcccattttcgttttag

SEQ ID NO: 221750 - DNA, 1482 bp, Artificial Sequence
  Description of Artificial Sequence: Synthetic coding sequence
atgcttaaggctctgttcctcacaatgctcacccttgctctagttaaatctcaggacacggaggaaaccattacgtacacgcaatgcaccgatgggtacgagtgggatccggtgagacagcagtgtaaagatattgatgagtgtgacatcgtgcccgacgcctgcaagggcggaatgaagtgcgtcaatcattacgggggatatctgtgcctaccgaaaaccgcccagatcattgttaataatgagcagccacagcaggagacacagccagccgagggcacctctggggcaaccactggagtggtggctgccagctcgatggcaaccagcggcgtgttacctggcggaggctttgtagcctccgctgccgcagtagccggacctgagatgcagacgggacgcaataacttcgtgatccggagaaacccagccgatcctcagagaatcccttctaacccgtctcatcgtatccagtgcgccgcagggtacgaacagagcgagcataatgtgtgccaagatatagacgaatgtaccgcgggaacacacaactgccgcgctgaccaggtttgtatcaacttacggggaagtttcgcctgccagtgccctcccggttatcagaagagaggcgaacagtgtgtggacatagatgaatgcacaatcccaccttactgtcatcagcgctgcgtcaatactcccggatcattttactgtcagtgcagccctggatttcagcttgcagctaacaactatacttgcgtggacatcaacgagtgcgacgcctctaaccagtgcgctcagcagtgttacaatatacttgggagtttcatttgccaatgcaatcaaggctacgagcttagttctgaccggctgaattgcgaagacattgacgagtgtcgcacctcatcctacctgtgccagtaccaatgtgttaatgagccaggaaaattctcttgtatgtgcccacaggggtaccaggttgtacgctcaaggacttgccaggatataaatgaatgtgagacaacaaacgagtgccgggaagacgaaatgtgttggaactatcacggaggcttcaggtgttatccacgtaatccttgtcaggacccctatatcctcacaccagagaatcgttgcgtgtgtccagtttctaatgctatgtgccgcgagctccctcagtcaatagtctacaagtacatgtctatcaggtctgaccgaagtgtgcctagcgacattttccagattcaggccaccaccatatatgccaacaccatcaatacatttcgaataaaatcgggaaacgaaaacggagaattttacttacgccagacttcacccgtgtccgccatgcttgtccttgtaaaatctctgtccggtccccgtgagcacatagtagatctggagatgctgacggtgtccagcatagggacatttcggacctcctccgtacttcggctaacaattatagtcgggcctttttccttttag

SEQ ID NO: 221751 - DNA, 1050 bp, Artificial Sequence
  Description of Artificial Sequence: Synthetic coding sequence
atggaggataccagcgcctttcgcaagcagcccagattgttgtccatcatgaactccttgagtagcgaacataatgtttgtcaggacatcgacgagtgcacggccggaactcataactgtagggccgaccaggtgtgcataaatctgcggggttcatttgcttgccagtgtccacccggttaccaaaagagaggagagcagtgtgtcgacattgacgaatgcactattccaccctactgtcatcagcggtgtgttaatactccgggaagcttttattgccagtgtagccccggtttccaactagctgccaacaactacacctgcgtcgatatcaatgagtgcgacgcgagcaaccagtgcgctcaacagtgttacaacatcctcgggtccttcatttgtcagtgcaaccagggttacgaactgagcagtgacaggcttaattgcgaagatattgatgagtgccgcacttcttcctacttatgccagtaccagtgtgtcaatgagccgggaaagttctcttgcatgtgcccacagggctatcaggtggtgcggtcccggacatgccaggatattaacgaatgtgagaccacaaatgagtgtagagaagatgaaatgtgctggaattaccacgggggttttcgttgctatcctcgtaatccttgtcaagacccctacatactgacacccgagaataggtgtgtgtgccccgtgagcaatgcaatgtgcagggagctcccccagagcattgtgtacaaatatatgtcgatccggtcagatcggagtgtgccatcggacattttccaaatccaggcgaccaccatttacgctaataccataaatacttttcggattaagtcgggtaacgaaaatggagaattctacttgaggcaaacctcacctgtgagcgccatgcttgttttagtaaaaagtttgtctggtcccagagagcacatcgtggacctggaaatgctgacggtgtcatcaatcggcacgttccggaccagctccgttctgcgactgactataatagttggcccattctccttttag

SEQ ID NO: 221752 - DNA, 159 bp, Artificial Sequence
  Description of Artificial Sequence: Synthetic coding sequence
atgctgaaggcgctcttcctcacaatgttaactctcgcactggtgaagtcccaggatacagaggaaacgatcacctacacacagtgtaccgacggatatgagtgggaccccgtgcggcagcagtgcaaggacattgacgaatgtgacatcgtgccatag

SEQ ID NO: 221753 - DNA, 84 bp, Artificial Sequence
  Description of Artificial Sequence: Synthetic coding sequence
atgcttaaagcgctgtttcttaccatgctaaccctggctcttgttaagagtcaggacacagaggaaactatcacgtatacatag

SEQ ID NO: 221754 - DNA, 1068 bp, Artificial Sequence
  Description of Artificial Sequence: Synthetic coding sequence
atgaaatgtgtcaatcattatggaggctatctgtgtctgccgaagactgctcagatcattgtgaataacgaacagcctcaacaggagactcaaccagctgaaggcacatccggggcaacgactggtgttgtggccgcaagcagtatggctacctccggagtcttacctggaggaggatttgtggcctctgccgctgccgtcgctggccctgaaatgcaaactggacggaacaatttcgtgattcggaggaaccctgctgatccacaacggatcccctctaatccaagccaccggattcaatgcgcagctgggtatgaacagtccgagcacaacgtctgtcaagacattgacgagtgcacagccggaacacacaattgccgagcagatcaggtttgcataaacctccgcggaagcttcgcgtgtcagtgcccaccaggctaccagaagaggggagaacagtgcgttgatattgatgagtgtcgaaccagtagctatctatgccagtaccagtgtgtgaatgaacctggtaagttcagctgcatgtgccctcaaggctaccaagtggtgaggtcacgcacatgtcaggatatcaacgaatgtgagaccacaaacgaatgtagagaagatgagatgtgttggaactatcacggcggattcaggtgttatccccgaaatccatgccaggatccatatattttgacgccggagaaccggtgcgtgtgtcccgtgagtaatgctatgtgtcgtgagctcccccagtccatcgtctacaagtacatgagcatcagatccgaccgtagcgtgccgtcggacatctttcagattcaggctacgactatttatgcaaataccatcaacactttcagaatcaaaagtggcaatgagaatggcgagttctacttaagacagacaagcccagttagtgctatgctggtactggttaagtcgctgagtggtccaagagagcatatcgtggacttggaaatgctgacagtatcatccatcggtacctttcgcactagctccgtgctgagattgaccatcatcgttgggcctttttctttctag

SEQ ID NO: 221755 - DNA, 264 bp, Artificial Sequence
  Description of Artificial Sequence: Synthetic coding sequence
atgctcaaggccttatttctcacgatgctgacattagctttggtaaaatcacaggataccgaggagaccattacatatactcagtgcacggacgggtacgagtgggatcccgtccggcagcagtgtaaggacattgatgagtgcgatattgttcccgatgcctgtaaaggcggaatgaagtgtgttaatcactacggcggttatctctgcctccccaaaactgcccagatcatcgtcaacaacgaacagccacaacaggagtag

SEQ ID NO: 221756 - DNA, 519 bp, Artificial Sequence
  Description of Artificial Sequence: Synthetic coding sequence
atgttgaaagccttgtttctgacaatgctgaccctcgcactcgttaaatctcaggatactgaagagactataacatatactcagtgcacagacgggtacgagtgggatcccgtgcgccagcagtgcaaagatattgacgaatgcgacattgtacccgatgcctgtaaggggggaatgaagtgcgtgaatcattacggcggatatctgtgcctgccgaagacggcccaaataatcgtcaataacgaacagccccaacaggaaactcagccagcagaaggcacaagcggcgctacgaccggggtggttgcggcttctagtatggccacgtcaggcgtgttacccggtggcggttttgtggcatcggcagccgcagtcgcaggtcccgagatgcagactggacgtaacaactttgttatccgccgaaaccctgctgacccacagcggattccatctaatccatcccaccggatccagtgtgccgctgggtacgagcagagcgaacacaacgtctgccaatag

SEQ ID NO: 221757 - DNA, 360 bp, Artificial Sequence
  Description of Artificial Sequence: Synthetic coding sequence
atgctaaaagccttgtttttaacaatgttgacgttggcattggtgaagtcacaggacacagaggagaccattacttatacccagtgtactgacggctatgaatgggacccggttagacagcagtgcaaggacatcgacgaatgcgacattgtgcccgacgcctgcaaaggtgggatgaaatgcgttaaccactacgggggttacctgtgtctgccaaagaccgcccagataattgttaacaatgaacagcctcagcaggaaactcaacctgctgaaggaactagtggggctaccacgggcgtcgtggctgcatcgtctatggctacgagcggagtgctccctggaggaggctttgtctag

SEQ ID NO: 221758 - DNA, 321 bp, Artificial Sequence
  Description of Artificial Sequence: Synthetic coding sequence
atgttgaaggctctattcctgacgatgttgactctggccttagtaaagtctcaagacacggaagagactatcacctacacgcaatgcacagatggatacgaatgggaccccgtgcggcagcagtgcaaggacatagatgagtgtgacatcgtgcctgacgcctgtaagggaggaatgaagtgcgtgaaccattatgggggttacctgtgcctcccaaagacagcccagatcatagttaacaacgagcagcctcagcaagaaactcagcccgctgaggggactagcggagcaaccactggcgtggtggcagcgtcctcatag

SEQ ID NO: 221759 - DNA, 189 bp, Artificial Sequence
  Description of Artificial Sequence: Synthetic coding sequence
atgttaaaggcactgttcctcactatgctgactcttgcccttgtaaagtcacaggataccgaggaaactatcacgtacacacaatgtaccgatggatacgagtgggaccctgtccgccagcagtgtaaggatatcgacgagtgtgatattgtccctgatgcttgtaaagggggtatgaagtgtgtctag

SEQ ID NO: 221760 - DNA, 1332 bp, Artificial Sequence
  Description of Artificial Sequence: Synthetic coding sequence
atgctgccatgcgccagctgtctgcccggatcactccttctttgggcgctgctcctgctgctccttgggtcagcatctccacaagactctgaagaaccagattcatacaccgagtgtacagacggctacgagtgggaccctgacagtcagcactgccgggacgtgaacgagtgtctgacgattcctgaagcatgcaaaggggagatgaaatgcattaatcattacgggggttatctgtgtctacccaggtctgccgcagtaattaatgacctccatggagaaggtccccctccccctgtgccacctgcgcagcacccaaacccttgtcctcctgggtacgaacccgacgatcaggatagttgtgtcgacgtggacgagtgcgcccaggcactccatgattgccgtccctcacaggactgtcacaacctgcctggctcataccagtgtacctgcccagacggctacagaaagatcggcccagagtgcgttgacatcgacgaatgccgctaccggtactgtcagcaccgttgtgtgaacctgcctggcagtttccgatgccaatgtgagccagggttccagctgggccctaataacaggtcctgcgtcgacgtcaatgagtgcgacatgggtgccccttgtgaacaacggtgctttaattcctacggtacctttctttgccgttgccatcagggatacgaattacatcgcgatggattttcatgttcggatatagatgaatgctcatacagtagctatctatgccagtatcgctgcatcaatgaaccaggcagattctcctgccattgtccgcaggggtatcagcttctcgctacccgactctgccaagacatcgatgagtgtgagtccggcgcacaccaatgttccgaggctcagacgtgcgtgaactttcatggaggttacaggtgtgtggacactaatagatgcgtcgagccatatattcaggtatctgagaataggtgcctgtgccctgcttccaatccactgtgccgggaacagccaagctccattgttcatcggtacatgaccatcacctctgagcgctctgtgcccgcagacgtcttccagatccaggccacaagtgtctacccaggagcttacaatgcctttcaaattcgcgctggcaactctcaaggagacttctatattagacagataaacaacgtatctgctatgctggttctggccaggcctgtgacaggacctagggaatacgtgttggacctagagatggtcacaatgaactcattaatgtcatatagagcaagttcagtgttgcggctgacagtgttcgtgggcgcatacacgttctag

SEQ ID NO: 221761 - DNA, 609 bp, Artificial Sequence
  Description of Artificial Sequence: Synthetic coding sequence
atgctcccatgtgccagctgtctgccaggctcgctcctgctttgggcacttctcctgttgcttctcggctccgcaagtcctcaggactcagaagagcctgactcatacactgagtgcaccgatggctatgagtgggaccctgactcccaacactgtagagatgtgaatgaatgtctgacgataccggaagcatgcaagggagagatgaagtgcattaaccactacgggggttacctatgcctcccgagatccgccgctgtgataaatgatctccatggcgaagggcctccgccacctgtccctcccgcacagcatccgaacccctgccctcccggatacgagcccgacgatcaggactcctgtgtcgacgtggacgagtgtgctcaggccctgcatgactgccgcccttcccaggattgccataacctcccgggaagttaccagtgcacttgtcccgacggatatagaaaaatcgggccagaatgcgtagacatagacgaatgcaggtaccgctactgccagcacaggtgtgttaacctgcctggttcttttagatgccagtgcgaaccaggctttcaactgggacctaataatcggagctgcgtctag

SEQ ID NO: 221762 - DNA, 552 bp, Artificial Sequence
  Description of Artificial Sequence: Synthetic coding sequence
atgttgccctgtgctagctgcctccccggatctctgcttctgtgggcactcctactactgctgcttggctcagcttcgcctcaggattcagaggagcctgactcctataccgagtgtactgacggttacgaatgggatccggactcacagcactgtcgcgacgtgaatgaatgcctgaccatccctgaggcttgcaaaggagaaatgaagtgcattaaccactacggcggttacctgtgtcttccccgttcggcagccgtgattaacgacctgcatggggagggtcccccaccccctgtgccaccagcccagcaccctaatccttgcccccctggatatgaaccagatgatcaggacagctgtgtggatgtggacgagtgtgcacaggccctacacgactgcagaccatcgcaagactgccacaacctgccaggttcctaccagtgtacctgtcccgatggttatagaaaaatcggaccagagtgcgtagatatcgacgagtgcaggtacagatactgtcagcacaggtgtgtcaacctccctgggagttag

SEQ ID NO: 221763 - DNA, 1332 bp, Artificial Sequence
  Description of Artificial Sequence: Synthetic coding sequence
atgctgccatgcgcaagttgtctgcccggatccttattgctctgggctctgctgctgcttctgcttggcagcgcttctccacaggacagtgaagagccagattcctacaccgaatgcacggacggatacgaatgggatccagatagccagcattgccgggacgttaacgaatgtttgaccatccccgaagcttgcaagggcgagatgaagtgcatcaatcactatggaggctatctctgtttaccaaggagcgcagccgtcattaacgatctacatggtgagggcccaccccctcctgttccacccgctcagcaccctaacccctgtccccctggatatgaacctgacgaccaggatagctgcgtcgatgtggacgagtgcgctcaagccttgcacgactgtaggccctcacaggactgccataaccttccaggctcttatcagtgcacctgcccagatggatacaggaagatcggacccgaatgcgtcgatatcgacgaatgccgctatagatattgtcaacaccggtgtgtgaacctgccaggatcgttccgctgccaatgcgaacctggatttcagctaggtcctaataacaggtcctgtgtggatgtcaatgaatgtgacatgggtgcgccatgtgaacagcggtgctttaactcatatggaaccttcctgtgcagatgtcaccaaggttatgaactgcatagagacgggttctcctgctctgacattgacgagtgcagctattcctcttacctgtgtcagtataggtgtatcaatgaacctggcaggttttcttgccattgcccacagggatatcaattgctggccactcggctgtgccaggacatcgacgagtgtgagtcaggtgcccaccagtgcagcgaggcccagacctgtgtcaacttccatggcggatacagatgcgtcgacaccaaccggtgtgtggagccttatatccaggtgtccgaaaataggtgcttatgtcccgcaagcaatccgctgtgcagagaacagccatcttccatcgtgcatcgttacatgaccatcaccagcgagagatccgtccctgcagatgttttccagatccaggcaacaagcgtctatccgggagcttacaacgcctttcaaattcgagcaggtaactcgcagggagatttttacattcgtcaaatcaataacgtgtcagccatgcttgtgctggcccgacctgtgaccggcccaagagagtacgtgctggatttagaaatggtgaccatgaacagtcttatgagctatcgcgcatcttccgtgctcaggctgacggtgtttgtcggggcatataccttttag

SEQ ID NO: 221764 - DNA, 2466 bp, Artificial Sequence
  Description of Artificial Sequence: Synthetic coding sequence
atgcggggatttaatctgctgctgttttggggctgttgcgtgatgcacagttgggaaggtcacatcagaccaacacgcaaacccaataccaagggaaacaactgtagggacagtactttatgcccggcttatgccacctgcactaatactgttgactcctactattgtgcttgtaaacaaggctttctctccagcaacggacagaaccacttcaaagatcctggggtgcgctgcaaggacattgacgaatgcagccagagtccgcaaccctgcggacctaacagctcctgtaaaaacctgagtggcaggtataagtgctcctgtttagacgggttctcatcccctaccgggaacgactgggtccctggaaagcctgggaacttctcatgtacagatataaatgaatgcttgactagtagcgtgtgtcctgagcactcagactgcgtcaattctatgggatcttacagttgttcgtgtcaagtcgggtttatctcgaggaacagtacatgcgaggacgtcgacgaatgtgcagaccctagagcgtgtcctgagcacgccacctgcaataatacagtgggcaattactcgtgtttttgtaacccagggttcgagagcagctctggacatttgtctttccagggactgaaggccagctgtgaggatattgacgaatgcactgagatgtgcccaataaattcaacttgcaccaatactccaggaagctacttttgtacgtgccacccaggatttgcgccttctaacggtcagctaaacttcactgatcagggagtggagtgccgcgacatcgatgagtgcagacaggaccctagtacttgtggaccgaacagtatttgcacaaatgccttgggcagctacagttgtggatgcatagccggtttccatcccaatcccgaaggcagccagaaggacggaaattttagttgccagagagtcctctttaagtgcaaggaggatgtgatccccgacaataaacagatccagcagtgtcaggagggcacagcagttaagcctgcttacgtgtctttttgcgcccagataaacaatattttctctgttcttgacaaagtctgtgagaacaaaactactgtggtgagccttaaaaacactactgagagctttgtgccagtcctaaaacagatttcaacctggacgaagttcacgaaagaggagacttcctcactcgcgaccgtattcttagaatccgttgaatctatgacacttgcaagcttctggaagccgtccgccaatattactccagccgtgaggaccgaatatctcgacatcgagtccaaagttataaataaggagtgcagcgaggaaaacgtcacactcgatctcgtggccaagggcgataagatgaagatcggttgcagtaccatagaggaatcagagtctactgagactaccggggtggcattcgtcagttttgtggggatggagtcggtcctcaatgaacggtttttcaaggaccaccaggcccctctgaccacatctgaaatcaagcttaaaatgaactccagagttgtgggaggtataatgacaggggagaagaaagatggcttttcagacccaattatttataccttagaaaacatccagcctaagcagaaattcgaacgtcccatctgcgtgagttggagtacagatgtaaagggcggacggtggacctctttcggatgtgtgatcctcgaggcctcagaaacatacaccatatgcagttgcaatcagatggctaatctagccgtgataatggccagcggcgagctaacaatgggctgtgctatcatcgccggattcctccattatctgttccttgcatgtttcttctggatgctagtggaagccgtaatcctgtttttaatggtgcggaacctgaaagtggtcaactacttttctagcagaaacataaaaatgcttcatatatgtgcctttggctatgggctgcctatgctggtggtcgtaattagtgcatccgtgcagccccagggatacggtatgcataacagatgctggctcaacactgaaaccggatttatatggtcgttcctggggccagtctgcacagtcatcgtcatcaactcgctgctcctgacatggacgttatggatactgaggcagcgtctttcctcagtgaatgctgaggtgagcactcttaaggacacccgactcctgacctttaaggcattcgcacaactctttatcctcgggtgttcttgggtgctgggaattttccagatcggaccggttgccggagtgatggcatatctgttcactataatcaactcactccagggggctttcatctttctgatccactgcctattgaatggccaggtccgcgaggaatacaagaggtggattaccgggaaaaccaaaccgtcttcacagtctcagacctcgcggatcttattgtcttctatgccctcggccagcaaaaccggttag

SEQ ID NO: 221765 - DNA, 2661 bp, Artificial Sequence
  Description of Artificial Sequence: Synthetic coding sequence
atgaggggatttaatctcctgttattctggggatgctgcgttatgcactcttgggaagggcatattaggcccacacggaaacctaatactaagggtaataattgccgcgacagtacgctgtgccccgcttacgcgacttgtaccaataccgtcgacagttattactgcgcttgtaaacagggctttctctcgtctaacggccaaaaccattttaaggacccaggggtcaggtgcaaagatatcgatgagtgctcacagtctccccagccctgtggaccgaattcttcgtgcaaaaatctgagtgggagatacaaatgcagttgcctggacggtttttctagccctacaggtaatgactgggtcccgggtaagcccggaaacttcagctgcaccgacattaacgaatgtctgacaagctctgtctgccccgagcactccgactgcgttaactctatgggctcctattcatgctcatgccaggtgggcttcatctcacggaactccacctgtgaggatgtggatgaatgcgcagatccgcgagcctgccccgagcatgcaacttgtaataacaccgttgggaactacagctgtttttgcaatccgggtttcgaaagttcaagtggccacctgagctttcaggggctgaaggcttcctgcgaggacattgatgagtgtactgagatgtgtccaattaattccacctgcaccaacacacctgggtcctacttctgcacttgccacccaggcttcgctccctccaatggccagctgaacttcactgatcagggagtggagtgccgggatattgacgagtgcaggcaggatccttccacttgcgggccaaatagcatttgtaccaacgcattggggtcgtattcatgcggatgcatcgccggattccaccctaatcctgagggatcacagaaagacggcaatttttcatgtcagcgagtgcttttcaagtgcaaggaagatgtgatcccagacaacaagcagatccagcagtgccaggagggcacagcggtgaagcctgcttacgttagtttctgcgcgcagataaataacatattctctgtgctggataaagtctgtgaaaataagactacagtagtgtccctcaagaacactaccgaaagcttcgtgcccgtcctgaagcaaatttccacctggactaagttcaccaaggaggagacttctagcctggcgaccgtatttttagagtctgtggagagcatgacgttagcgtcgttctggaaaccatccgctaacatcacacccgcagttcgcaccgaatatttagatatcgagtcaaaggtgatcaacaaagagtgctcagaagagaacgtgacactagatttagtggcaaaaggagataagatgaagatagggtgtagtactatcgaagagagtgaaagcaccgagacgaccggggtggcctttgtaagcttcgtaggcatggagtcagttttgaatgagagatttttcaaggatcatcaggccccactaacaacgagtgaaataaagctcaaaatgaactcacgggtggtcggagggatcatgacaggagagaaaaaggacggattctctgatcccatcatctacacacttgagaacattcaaccgaagcagaagttcgaacggcctatttgcgttagttggagtacagatgtaaagggagggagatggacatcctttggctgcgtgatcctggaggcatccgagacctacaccatatgctcctgtaatcaaatggccaatttggctgtgataatggcttctggcgagctgaccatggatttctcactgtatattatctcccacgtgggcataatcattagcttagtgtgtctcgttttggccattgctacctttttgctgtgcaggtccatccgtaaccacaatacctacctgcacctgcacctctgtgtgtgcctgttactggcaaagactctgttcctagcgggaattcataaaacggacaacaagatggggtgtgccatcatcgctggtttcctccattaccttttcctggcctgctttttttggatgctcgtggaggccgtgatactttttttgatggtgagaaacctgaaagtggtgaattattttagctctagaaacattaaaatgctccacatatgcgctttcggatacgggctcccaatgcttgttgtcgtgatatctgccagtgtccagccccaggggtacggtatgcacaaccggtgctggctcaatactgaaactggcttcatctggtcctttttgggacctgtttgcacggtgattgtgataaactccctccttctgacatggaccctttggattctccgccagcgtttgagctccgtaaatgctgaagtgagcacgcttaaggacacgcgcttgctcacctttaaagcctttgcacagctattcattttaggctgtagctgggtgcttgggatctttcagataggccctgtggctggagtcatggcatatctgttcaccatcataaactctctccagggagcatttatatttctcattcactgtctattgaacggacaagtacgagaggaatataaacggtggattaccggaaagactaagccttcgtcgcagtctcaaacatcacgcatcctcctgagtagcatgccttccgcctcaaagaccggatag

SEQ ID NO: 221766 - DNA, 2604 bp, Artificial Sequence
  Description of Artificial Sequence: Synthetic coding sequence
atgaggggctttaatctcctgcttttttgggggtgttgtgtgatgcatagttgggagggacacatccggccaaccagaaaaccaaacactaaaggaaataattgtagggactctaccctgtgcccagcttatgctacctgtaccaacaccgtggacagctactactgtgcctgcaagcagggcttcctttcttctaatggccagaaccacttcaaggaccccggagtgaggtgtaaggacatcaatgagtgcctgacctcctctgtgtgccccgagcacagtgactgcgtcaactcaatgggaagctactcttgcagctgccaagtgggttttatcagccgaaatagtacttgtgaggatgtggacgaatgcgctgatccccgagcatgtcccgaacatgcaacgtgcaacaatactgtaggaaactactcctgcttttgcaaccccggatttgaatcaagctccgggcacttgagcttccagggactgaaggcatcatgcgaggatatagatgagtgcacagaaatgtgtcctattaacagtacatgcactaacacccctgggagctacttttgcacctgccatccaggatttgcaccgtccaatgggcagcttaatttcaccgatcaaggagttgagtgtagggacatagatgagtgtcgccaagatcctagtacatgtggcccaaactccatatgcactaacgcgctgggaagctattcctgcgggtgcattgcgggattccatccaaatcccgaaggcagccagaaggacggaaatttttcttgtcagagggtcctgttcaaatgtaaggaagacgtgatacctgacaacaagcagatccaacagtgtcaggagggcacagccgtaaagcccgcttacgtgagtttctgtgcccagatcaataatatcttttccgtcctcgacaaggtatgtgaaaataaaacgaccgtggtgtcccttaagaacaccacagagagcttcgtgccagtacttaagcagatcagtacgtggacaaaatttactaaagaggagacttcttccctcgccacagtcttcctagaaagcgtggagagtatgaccctcgcaagcttctggaagcctagtgccaatatcaccccagccgtcagaaccgagtacctggatatcgaaagcaaggtgatcaataaagagtgttctgaagagaacgtgactctggacctggtagcgaaaggagacaagatgaagattggatgcagcacgatcgaagagtctgagtcgacagaaaccaccggcgtcgcatttgtatcttttgtggggatggaatctgttctcaatgagcgcttttttaaagaccaccaggcaccactgacgacaagcgagatcaagctcaagatgaattcaagggtggtggggggaatcatgactggcgagaagaaagacgggttctcagatcctattatctacaccttggagaacattcagccaaagcaaaagttcgagcgcccaatttgtgtcagttggagcacagacgtgaaaggaggcagatggaccagcttcggctgtgttattcttgaggcatcagaaacctatactatctgctcttgcaaccagatggcgaatttggcagttattatggcttctggcgaactgaccatggacttctccctttacattatctcacacgtcggtataattattagcctggtgtgcctggtgctcgcaatcgcaacttttttgctgtgccgctccattaggaaccacaacacatacctgcatctccacctgtgtgtttgcctgttgttagccaaaacactgtttttggcaggtatccataagactgataacaaaatggggtgtgccataatcgccggtttcttgcactatctgttcctggcctgttttttttggatgttagtggaggccgtcatcctttttctgatggtacgcaaccttaaggtggtcaattacttcagcagcaggaatatcaagatgctgcacatttgcgcctttggttacggcctacctatgttagtcgttgtaataagtgctagcgtgcagcctcagggctacggaatgcataaccgatgttggctgaacaccgagaccgggtttatttggtctttcctgggcccagtgtgcacggttattgtcgtgagcaagtactataactccctagcaaaatgcgtactcaaagaggagcagggcgacctgagagatctagaattcccagggacatgcgcagcggaaaggataaacagcctgcttttgacctggactctctggattttgagacagagactatcaagtgtcaatgcagaagttagcacattaaaggatacccgtctactgacattcaaagcctttgcccagctattcatcttgggctgctcatgggtgttggggatttttcagatcggccctgtggccggtgtgatggcatacctcttcaccattatcaactcactacagggggcattcatctttctgattcattgtctgctgaatgggcaggttcgcgaggagtacaagaggtggatcaccggcaagacgaaaccctcttcccaaagccagacgtcccggattctgctgtctagcatgccgtccgcaagcaagaccggatag

SEQ ID NO: 221767 - DNA, 2238 bp, Artificial Sequence
  Description of Artificial Sequence: Synthetic coding sequence
atgcggggattcaacctgctgctcttttgggggtgctgcgtcatgcacagctgggaaggccatattcgcccaacaaggaaacctaacactaagggtaacaattgtagggacagtacactatgtcccgcatacgccacatgtactaacacagtggattcctattattgcgcctgcaagcaaggatttctatctagtaatggacaaaaccatttcaaagatccaggcgtccggtgtaaggatattgatgaatgcacagagatgtgccccataaactccacttgtactaatactcccggatcttacttttgcacatgtcacccaggttttgcccctagtaatggtcagctgaattttacggaccagggagttgaatgccgtgacatcgatgaatgcagacaggatcccagtacatgtggccctaacagtatatgcaccaacgccctgggcagctacagttgcggctgcatcgccggttttcaccccaaccccgagggtagccagaaggatggcaatttttcttgtcagcgcgtgctctttaaatgtaaagaggacgtgattcctgacaacaaacagatccagcagtgccaggagggaactgcggtcaagccagcatatgtgagtttttgcgctcagattaacaatattttcagcgttctggataaagtctgcgagaataagaccactgtcgtgagcctgaagaacaccacagagtccttcgtgcccgtactaaaacaaatatcgacttggaccaaattcacaaaagaggagacgtcaagtcttgccactgtcttcctcgaatctgtggagtctatgactctagcatccttttggaaacctagtgccaacattactcccgcagtgcgtaccgagtacttggatatcgaaagcaaggtgattaataaagagtgcagtgaggagaacgtcacacttgaccttgtggccaagggcgataagatgaaaatcggatgttccacaatcgaggaatctgaaagtactgagaccactggggtcgcctttgtatccttcgttggtatggagagcgtgcttaacgagcggtttttcaaagatcatcaggccccacttaccaccagcgagatcaaactcaagatgaactcacgggtggtaggtgggattatgaccggagaaaagaaagacggcttctctgaccccattatctacaccctcgaaaatatccaaccaaagcagaagtttgaacgaccaatatgcgtgtcatggagtacagatgtgaaagggggacgatggacctctttcggctgcgtgatattggaggcgtccgagacatatactatatgctcctgcaaccaaatggcgaatctggctgttattatggcaagtggggagctgaccatggattttagtctgtatattatcagccatgtgggcataataataagcctggtctgcctggttttagctatcgccaccttcctcttatgcaggtccatacgaaaccacaacacatacctccatttacacttgtgcgtgtgtctactcctcgccaaaactctgtttcttgccggaatccacaagactgataataagatggggtgcgccataatcgccggttttctgcactatctgtttctggcttgctttttctggatgctcgtcgaggctgtgatactctttctgatggtgcggaatctcaaagttgttaattacttctcttctagaaatatcaaaatgctgcacatttgtgccttcgggtacggcctccccatgttggtggtggtaatttccgcctccgtgcagccacaggggtatggaatgcacaatcgctgttggctaaatactgagaccgggttcatctggagttttttaggaccagtgtgtacagttatcgttatcaacagcctcctgctcacatggacattgtggatactgcggcagaggctctcgtcggtcaacgccgaagtttccaccctcaaagatacgagactgttgacctttaaggcattcgcccagcttttcatcttggggtgttcctgggttctcggtattttccaaatagggcctgtggctggagtgatggcataccttttcaccatcattaactctctgcagggcgctttcattttcctcattcattgcttattgaacggtcaggtccgggaggagtacaagcgctggataaccgggaaaacgaaaccaagcagtcagtcccagactagccgaatcctgttaagcagcatgcccagtgcttctaagacaggctag

SEQ ID NO: 221768 - DNA, 2130 bp, Artificial Sequence
  Description of Artificial Sequence: Synthetic coding sequence
atgcgcggtttcaatctgctgctattctggggttgctgcgtcatgcatagctgggaagggcacatccgcccaactagaaaaccgaatacaaagggaaataattgtcgggactcaacgctgtgtcccgcatatgctacatgtacaaacactgtggactcatattactgtgcttgtaaacagggcttcctgtctagtaatggtcaaaaccactttaaagaccctggcgtccgctgtaaggacatcgacgagtgctcccagagtcctcaaccctgtgggccaaatagcagctgcaaaaacctgagcggacgttataaatgctcatgcctcgatggcttctcctctcctacagggaatgattgggtcccgggaaagcccggtaatttctcctgcaccgatatcaatgagtgtctcacatcaagggtgctctttaagtgtaaagaagacgtgatacctgacaacaagcagattcaacagtgtcaggagggcactgccgtgaagcccgcttacgtatccttctgcgcccagatcaataatatcttctccgtccttgataaggtgtgcgaaaataagactaccgtcgtgtccctgaaaaataccaccgaatcattcgtgcctgtcttaaaacagatctccacttggacaaagttcacaaaagaggaaacttctagtctcgcaacagtgtttcttgagtccgtcgagagtatgacacttgcctcattctggaaaccatctgctaatatcacgccagcggtgaggaccgagtatctggatatcgaatccaaggttataaacaaggagtgttccgaggagaacgttaccctggatctggttgcgaaaggggacaagatgaagatcggttgctcaaccatcgaggagtccgagtccaccgaaacaactggggtcgccttcgtaagtttcgtggggatggagtccgtccttaacgagcgctttttcaaagaccaccaggctcctctcaccacctctgagatcaaactgaagatgaacagcagggtggtggggggaattatgaccggcgagaagaaagatggattctccgaccccattatttacaccttggagaatatacagccaaagcagaagttcgaacggcctatctgtgtgtcctggtcaacagacgtcaaaggtggccgttggacaagttttggatgcgtgatcctggaggcctcagagacgtataccatctgtagctgcaaccaaatggcgaatctggctgtgattatggctagtggtgagctgaccatggacttcagtctttatataatctcccacgttggaatcatcattagcttggtctgtctagttctcgcgattgccacattcctgctgtgcagatctatccggaatcacaacacatatctgcatttgcacctttgcgtgtgccttttattagccaagaccctttttctggcaggcatacataagaccgacaataaaatggggtgcgcaatcattgccggattcctgcactacctgtttctagcatgcttcttctggatgctagtggaggctgtcatcctattcctcatggtgaggaacctgaaagtagtaaactacttctcatccaggaatatcaagatgttacacatttgcgccttcggttatggacttcctatgctcgtcgttgttatctcggcctccgttcagccccaaggctacggcatgcacaaccggtgctggttaaatacagagaccgggttcatctggtcgttcctcggtccagtgtgtacagttatcgtgatcaactccctactgctcacatggaccttgtggatactcagacagaggctatcatccgttaacgccgaagtgtctactttaaaagacacccggttgctcacatttaaagcttttgcacaacttttcattctcggctgctcatgggtcttgggcatctttcagattggcccagtggccggagtgatggcctacctctttacaattattaattcactccagggcgctttcatcttcctaatccactgcctgctcaatggtcaagtgagagaggaatacaaaagatggataacaggcaaaacaaaaccatcctctcagtcgcagaccagccggatcctattaagtagcatgccgtctgcctccaaaaccggatag

SEQ ID NO: 221769 - DNA, 2466 bp, Artificial Sequence
  Description of Artificial Sequence: Synthetic coding sequence
atgaggggtttcaatctgctgctgttttggggctgttgcgtgatgcatagttgggaagggcatatccggcctacacggaaaccgaatacgaaggggaataactgcagggactctacgctctgtccagcctatgccacctgcacgaataccgtcgacagctattattgcgcctgcaagcaaggctttttaagctctaatggccagaaccatttcaaggacccgggtgtgcggtgtaaagacatcgatgagtgcagccaatctccccagccatgtggcccaaattctagctgcaaaaacctaagcgggaggtacaagtgttcttgtctggatgggttttcatcacctaccgggaatgattgggtacccggaaaaccaggaaacttctcttgtaccgacatcaatgaatgcctcacctcgagtgtgtgtcccgagcactcggattgcgtcaacagcatgggatcctacagttgttcctgccaagtaggattcatctcccgcaactctacgtgcgaagatgtcgacgagtgtgctgatccgagagcctgtcccgaacatgctacctgtaacaatacagtgggaaattattcttgcttctgcaatcccggtttcgagagttcttccggacaccttagctttcaagggctgaaagccagctgcgaagacattgacgagtgtactgaaatgtgtcccatcaactccacctgtaccaacacccccggatcctatttttgcacttgccatccaggctttgcaccttctaacggtcagttgaactttaccgaccagggggtggagtgcagggatatagacgaatgtcgccaggacccaagtacttgtggccctaacagcatctgcactaatgcactcgggagttactcctgtggctgcattgcagggtttcatcccaaccctgaaggttctcagaaagatgggaatttcagttgtcagagggtgttatttaagtgtaaggaagacgtgattcctgacaacaaacaaatccagcaatgccaggaaggtaccgcagtgaaacccgcttacgtatctttttgtgcacagataaataatatatttagcgttctggacaaggtgtgcgaaaataagaccaccgttgtgagcctcaagaacacaactgagagcttcgtacccgtgctcaagcaaattagtacgtggacaaaatttactaaggaagaaacgagctccctagcgacggtctttttggagtctgtagaaagtatgaccctggcctccttttggaagccatcagccaatataacaccagcggtgaggacagagtaccttgatatcgaatctaaggtcattaataaagagtgctccgaggaaaacgtgacactagacctcgttgccaaaggcgacaaaatgaaaatagggtgtagtaccattgaggaaagtgaatcgaccgaaactactggggtggcatttgtgtccttcgtgggaatggaaagcgtgctaaatgagcggttcttcaaagatcatcaagctcctctgacaacctctgagatcaaacttaaaatgaactcccgagtggtgggagggattatgaccggcgagaaaaaggatgggttctccgatcctattatttacactttggagaacatacagcctaagcagaagttcgagcgtccaatttgcgtcagctggtccacagatgttaaaggaggacgttggacaagcttcggatgcgtcatcctggaagcctccgaaacttacactatttgttcatgtaatcagatggctaatctcgcagttatcatggccagcggagagctgaccatgggttgtgcaattatcgcgggtttcctacattacctgtttcttgcatgctttttttggatgctcgtggaggctgttatcctgttcctgatggtgagaaatctcaaagttgtcaactacttcagttcaaggaacatcaagatgctccatatctgcgctttcggctatggcctacccatgctcgtcgtcgttatatcagcttctgtgcaacctcaaggctacgggatgcacaataggtgctggctgaataccgagacaggattcatctggtcttttctcggacccgtgtgcaccgtcatagtgatcaattctctcttgctcacttggacactctggattttgagacagagactgtcttccgtgaacgcggaggtttcaacgctcaaagacacgcggctactaacttttaaagcatttgcccagcttttcatcctgggctgcagctgggtccttggaatattccagattgggccagtagccggagtgatggcctacttattcactatcatcaatagtctccagggtgcatttattttcctgatccattgtctgctcaacggccaggtccgggaagagtacaaacgctggattacagggaaaacaaagccatcaagccaaagccagacttctagaatacttttgtcctccatgcctagtgcgtctaaaaccggatag

SEQ ID NO: 221770 - DNA, 1662 bp, Artificial Sequence
  Description of Artificial Sequence: Synthetic coding sequence
atgcctctgccatggagtttggctctcccactgttacttagttgggttgccggtggattcggcaatgctgcctctgccagacatcatggcttactagcctcagccaggcagccaggcgtttgccactacggaactaaactggcttgttgttacgggtggaggcgaaactcaaagggtgtttgcgaggccacctgcgagcccggttgcaagtttggggagtgcgtggggcctaataaatgcagatgttttcctgggtataccggcaagacctgcagccaggacgtcaatgaatgcggaatgaagcccagaccatgtcagcaccggtgtgtgaatacccatggatcctacaagtgcttctgcttgagcggacacatgctgatgcccgacgccacttgtgtgaactctcggacctgcgctatgatcaattgccaatattcatgcgaagacactgaagaaggccctcaatgcctgtgtccatcttctgggttgcgactggcacctaatggcagagattgtctggatatcgacgaatgcgctagcggcaaagttatttgcccctataatcgcaggtgtgtgaacacgtttggctcatactattgcaagtgtcacatcggtttcgaactgcagtatatatccggaaggtacgactgcatagatattaacgagtgtacaatggattctcacacatgtagtcaccacgcaaactgtttcaacacccaggggtcgtttaaatgcaaatgcaagcaaggctataaagggaacggcttgagatgtagcgccatcccagaaaattcggtaaaagaagtattgagggcccctgggactatcaaggacagaataaagaaactgcttgctcataagaattccatgaagaaaaaagcgaaaattaaaaatgtcacccctgagcctaccagaacccccacccctaaagtgaacctgcagccatttaattacgaagaaatcgtgtcacggggtggaaacagtcatggcggaaaaaagggaaacgaagagaagatgaaagaggggctggaagacgaaaaaagagaggaaaaagcccttaagaatgacattgaggagcggtctctccgtggggacgtttttttccctaaggtgaatgaagctggtgagttcgggttaatactagttcagcggaaggcactgaccagtaagctggagcacaaagacttgaacatctctgtcgactgcagcttcaaccacggtatatgtgactggaaacaggacagagaagatgacttcgattggaacccagccgacagggataatgccattgggttctacatggcagttcccgctttggccggacacaagaaagacatcggaagactaaaactcttgttgcccgacctgcagccgcagtccaacttctgtctcttatttgactaccgtttagcgggagacaaagtaggtaaactgagggtgttcgtaaaaaactccaataacgcattggcatgggaaaagaccactagtgaggacgagaagtggaagacggggaagatccagctgtaccagggcacagacgcgaccaagagtattatttttgaggctgagcgaggtaaggggaaaacgggcgaaattgctgtggacggagtgttgctcgtaagcggactatgccccgactccctgttgtctgtggacgattag

SEQ ID NO: 221771 - DNA, 1665 bp, Artificial Sequence
  Description of Artificial Sequence: Synthetic coding sequence
atgcctttgccatggtcgcttgctttgcccttgctgctatcgtgggttgccggagggtttggcaacgcagcctctgctaggcaccatggattgctggcgtctgcacggcagccaggcgtgtgtcactatgggaccaaactcgcctgctgttacggctggaggagaaactctaagggcgtgtgcgaggcaacttgcgaacctggttgtaaattcggggagtgtgttgggcctaataaatgccgctgtttcccaggctacacaggaaaaacatgctcacaagatgtgaacgagtgcgggatgaagccaagaccctgtcagcatcgctgcgtgaacactcatgggagctataagtgtttttgtctcagcggacatatgttgatgcctgacgcgacatgcgtgaattctcgcacatgtgctatgatcaactgccagtattcctgcgaagacacagaggaagggcctcagtgcttgtgcccctcgagcgggctgcggttggcgcctaatggaagggattgtctggacatcgatgagtgtgcctccggcaaagtcatttgcccctacaaccgcaggtgcgtgaacacgtttggcagctactactgcaaatgtcacattggtttcgaactacaatacatctcaggacgttacgactgcatcgacatcaacgagtgcaccatggatagccatacttgttcacatcacgctaattgttttaatacccaaggttcctttaaatgtaagtgtaaacagggttataaggggaatgggctgaggtgtagcgctatccccgagaactctgttaaggaagtccttagggcgcctggtaccatcaaagatcggatcaaaaaattgctcgcgcacaagaattcaatgaagaaaaaagccaaaatcaaaaacgttaccccagaacctacccgcactcctactcccaaagtcaacctccagccgtttaattacgaggaaatagtttctcgcggaggcaatagccacgggggaaagaaaggcaacgaagagaagatgaaggaaggactcgaggacgaaaagagagaggaaaaagcgctgaagaatgacatcgaagagaggtccctgcggggagacgtattttttccaaaggttaatgaagcgggagaattcggcctgatactggtacagagaaaagccctgacgtccaagttagagcataaagccgacctgaatataagcgtggattgctctttcaaccacggtatctgtgactggaaacaggacagagaggatgatttcgactggaatccggcagatcgagataacgccatcggcttttacatggctgtccccgctctggccggtcacaagaaggacattggaaggctgaaacttttgttaccagatctgcaaccccagtccaatttctgcctcctcttcgattacaggttagcaggagacaaggtggggaaactgagagtgtttgttaagaatagcaacaacgccctagcatgggagaagaccaccagcgaggacgaaaaatggaagactggtaagattcagctgtaccagggcactgacgccaccaagagcattatttttgaggcagaacgtggaaaaggcaagacgggtgaaatcgcggtggacggggtcctgctggtcagcggcctctgccctgatagcctgctgagtgtcgatgactag

SEQ ID NO: 221772 - DNA, 822 bp, Artificial Sequence
  Description of Artificial Sequence: Synthetic coding sequence
atgcgtggatcacaggaagtgcttctcatgtggttacttgtgctggctgtggggggtacagagcacgcctacagacctgggaggagagtctgcgcagtgagggcccacggtgatcccgtaagtgaaagctttgtccagagagtgtatcagcctttcttgacaacttgcgacgggcatagggcctgtagcacctaccgaactatttataggaccgcctataggcgctcccccggactggctcctgctcggccaaggtatgcctgctgccctggttggaagagaaccagtggcctgccaggagcatgtggagccgctatctgtcaacctccttgccgaaatggcggttcctgcgttcagcctgggcgatgcaggtgtccggctggttggagaggagatacatgccaatccgacgttgacgaatgtagcgctaggcgcggaggttgcccacaaagatgtgtgaataccgccggtagctattggtgccagtgctgggagggtcactccctcagtgctgatggcaccctgtgcgtaccaaaggggggtccgccacgcgtggcgccaaacccgactggggtcgactccgccatgaaagaggaggttcagcgactccagtccagagtcgaccttctggaggaaaagctccagctggtgctcgccccactgcacagtctggcatcccaggcattggaacacggcctgccggatccaggctctcttctggtccacagcttccagcaactgggccgtatcgatagcttgtccgagcagatttctttcttagaagaacaattggggagttgtagctgtaaaaaagattcctag

SEQ ID NO: 221773 - DNA, 822 bp, Artificial Sequence
  Description of Artificial Sequence: Synthetic coding sequence
atgagaggctcccaggaagttctcctaatgtggctcctagttttggctgttggaggaaccgaacacgcgtacaggcctgggagacgcgtatgtgctgttagagcgcacggcgatccagtgagtgagagtttcgtacaacgggtttatcagccattcctcacaacctgtgacggccaccgggcatgctcaacataccgtacaatttaccgcactgcatatcggagatccccgggactcgccccagctagaccaagatacgcttgttgcccaggctggaaacgtacgagtgggcttcctggcgcttgtggagccgctatatgccaacctccctgtagaaacgggggatcctgcgttcaacctgggagatgccgctgtcccgctggttggaggggcgacacgtgtcagtcagacgtcgatgagtgttctgcacggaggggaggctgtcctcagcgatgcgtcaacactgccggttcgtactggtgccagtgctgggaaggacacagtctgtctgcagacggtacattatgcgtgcctaagggcggtcccccaagggttgcccctaacccaacaggggtagattccgccatgaaagaggaagtgcaaaggctccaatcccgggtcgatctgcttgaggagaagctgcagctggttctggctccacttcattctctggcctctcaggccctggagcatggactccccgacccgggttccctgctggttcactcgtttcagcaactggggaggatagattcattaagtgagcaaatcagcttcctcgaggagcagctggggtcatgctcctgcaagaaggacagctag

SEQ ID NO: 221774 - DNA, 822 bp, Artificial Sequence
  Description of Artificial Sequence: Synthetic coding sequence
atgaggggcagccaagaagtgctgcttatgtggctcctggttctcgccgtgggcggaaccgaacacgcttacaggcctggccgtcgggtatgcgcagtgcgggcacatggggatcctgtctcagaaagctttgttcagcgggtgtaccagccctttctgacaacctgcgacggccacagggcctgttcaacataccggaccatttaccgcactgcttaccgacggagtccaggacttgcccctgctcgccctcgatatgcctgctgcccaggttggaagaggacatcaggactacccggagcatgtggtgcggcaatttgccagcctccttgcagaaacggaggatcctgtgtgcagccgggacgatgcaggtgtccggcaggatggagaggtgacacgtgtcagtctgatgtggatgagtgctccgctcgcagaggcggatgccctcagcggtgtgtgaacacagccggatcctactggtgccagtgctgggagggacactcattgagcgccgatggcaccctgtgcgttcctaagggagggccacccagggtagcacccaacccgactggcgtagacagcgctatgaaagaagaggtacagcgccttcagagtcgcgttgacctgcttgaagagaagctgcagctggtgcttgcacccctccattcgttagcaagccaggccctcgagcacggactgccagacccaggctcattactcgtgcattcgtttcagcagctcgggagaattgattcactctctgagcagatcagcttcctagaagagcaactcggaagttgttcatgtaagaaggatagttag

SEQ ID NO: 221775 - DNA, 822 bp, Artificial Sequence
  Description of Artificial Sequence: Synthetic coding sequence
atgagaggatctcaggaggtacttcttatgtggctgttagtgttggccgtgggcggtacagaacatgcatatcgcccaggtcgccgagtgtgcgctgtgcgggcacacggcgaccccgtctctgaatcattcgtccagagggtctatcagcctttcctcaccacctgtgacggccaccgagcttgctcaacatataggacaatctatcgcactgcttaccgcagatctcctggactagcccctgcacggccacgctacgcttgttgcccgggttggaagcgaacatccggactcccaggagcctgtggtgcggcaatctgtcagccaccttgccggaatggaggttcatgtgtgcaaccaggtaggtgccgctgtcccgcaggctggaggggtgatacttgccaaagtgatgtggacgagtgctctgcacggcgtggcggatgccctcagcggtgcgttaacaccgcgggatcatactggtgccagtgttgggaaggccactccttaagtgcagacggcacactttgcgtgcccaaaggagggccacccagggtcgcgccaaatcctaccggagtagactcagctatgaaggaagaggtgcagaggctgcaatctcgggtcgacctcctcgaggaaaaactccagctggtccttgctccactgcatagcctcgccagccaggccctggagcatggactaccggatccgggaagtttactggtccacagcttccagcagctggggcgaatcgactcactgtccgagcagatctctttcctggaagagcagctgggctcttgtagttgtaagaaagatagttag

SEQ ID NO: 221776 - DNA, 882 bp, Artificial Sequence
  Description of Artificial Sequence: Synthetic coding sequence
atggggtcgcgggcagagttgtgtacactcctgggcggattttctttccttctcttgctgatccccggtgagggcgcaaaaggtggcagcttaagagaatctcaaggcgtgtgctcaaaacagactctggtggtacctctgcattataatgagtcgtactcccagccagtttataagccctacctcacactgtgtgctggtcgtagaatttgtagcacatacagaactatgtatagggtaatgtggcgtgaggtgcgacgggaggtgcaacagacacacgccgtctgctgccagggctggaaaaaaaggcacccaggagctctcacatgtgaagccatctgcgccaagccatgtctgaacggtggagtctgcgtaagacctgaccagtgtgagtgtgcacccggttggggcggtaagcactgccacgtcgacgtagacgagtgccggacctcgataactctgtgttctcaccactgtttcaacacggctggaagtttcacttgcggctgtccccacgatttggttctgggagtcgatggacgcacttgcatggaggggagccctgagccacccacatctgcatctatcctgagtgtggctgtgagggaggcagagaaggacgaacgagcactcaaacaggaaatccacgagctacggggaagattggagcgcttggaacaatgggccggacaggcaggcgcttgggtccgagccgtccttcctgtcccacctgaagagttacagccagaacaggtcgccgagctttggggtcggggtgacaggatagagagtctatcagatcaggtgcttctgctggaggagagattaggcgcatgctcttgtgaagataatagccttggcctaggagtcaatcaccgctag

SEQ ID NO: 221777 - DNA, 882 bp, Artificial Sequence
  Description of Artificial Sequence: Synthetic coding sequence
atgggaagccgggcagagctgtgcaccctcctgggcggtttctcgtttcttctgctcctgatcccaggtgaaggcgctaagggcggttccctgagggagtcccagggcgtgtgcagcaaacaaaccctggtggtcccccttcattataatgagagctatagccagccagtgtacaagccatatctgacactctgtgctggcaggcgaatttgtagtacgtaccgcacaatgtatcgtgtgatgtggcgggaagtgcgacgggaagtgcagcagacccacgctgtctgctgccaaggctggaagaaacgccaccctggagcactgacctgcgaggctatctgtgcaaagccatgtctgaacggaggagtgtgtgtaaggccggaccaatgtgagtgcgcccctgggtggggtgggaaacattgccatgtagatgtcgatgagtgcagaacatccattaccctgtgctcacaccactgcttcaacacggcgggaagtttcacctgcgggtgcccacatgatctcgtgctcggcgtcgatgggagaacatgtatggaaggctctccagaaccacctacctctgcctccattttaagtgtggcggtgagggaggccgagaaggacgagcgtgctctcaaacaggaaatacacgagctgagaggtagacttgaacgtctggagcaatgggccggacaggcaggggcttgggttcgggcagtgctgcctgtcccacctgaagaactgcagccggagcaggtagccgagctttggggtagaggcgatcgcatcgaatctcttagtgaccaggtcctactcttagaggaacgcctcggcgcatgttcttgtgaggataattctctgggattgggagtaaatcatagatag

SEQ ID NO: 221778 - DNA, 882 bp, Artificial Sequence
  Description of Artificial Sequence: Synthetic coding sequence
atgggatcccgggctgagctttgcaccctgctcgggggatttagttttctgctcttgctgatccccggtgagggcgctaaagggggatccctgcgcgaaagccaaggcgtttgcagcaaacagactctggtggtccccctgcactacaacgaatcctactcacagcccgtgtacaaaccatacctcactctgtgtgccggtcggagaatttgttcaacctaccgaacaatgtaccgggtgatgtggagagaagtgaagagggaagtccagcagacgcacgcagtctgctgtcagggctggaagaaaagacaccccggagctttaacctgcgaagccatctgtgctaagccttgcctgaacggaggtgtctgtgtccggcctgaccagtgtgaatgtgcccctggctggggaggcaaacactgtcatgtagacgtagacgaatgccggacgagcataacactctgtagtcatcattgttttaatacagcgggtagcttcacttgtgggtgcccccacgacttagtactgggggtcgatggacgaacctgcatggaaggctctcccgagcctccaactagtgcctccatcttgtcagtggccgtcagggaggctgagaaggatgaaagagcgctgaagcaagagatccacgagctaagaggacggttggaaaggctcgaacagtgggccggacaagcaggcgcatgggttagagccgtgctgccagtgcctcccgaggagctccagccagaacaggtggccgagctgtggggtcgaggcgacagaattgagtctctctctgaccaagtcctgctactggaagagcggctgggcgcttgtagctgtgaggacaatagcctcggcttgggggtgaatcaccgttag

SEQ ID NO: 221779 - DNA, 777 bp, Artificial Sequence
  Description of Artificial Sequence: Synthetic coding sequence
atgggctcaagagctgaattatgtaccctgcttggtggattttcatttctgttactgctaattcctggcgagggtgcgaaaggcggttctcttagggagagccagggagtctgcagcaaacagacgttagtggtccctctgcactacaatgaaagttatagtcagcccgtttacaaaccttacctgacactgtgtgcaggcagacgcatatgtagcacctaccgaactatgtaccgcgtgatgtggcgggaggtaagacgcgaagtgcagcagacccacgcagtctgttgccagggatggaaaaagcgccatcccggtgccctgacgtgtgaggccatttgcgccaagccttgccttaacggcggtgtatgtgtccgcccagatcagtgtgaatgtgcgccaggatggggcggtaagcattgtcacgttgggtcctttacctgtggctgcccacacgacttggtgctgggggtggacggcaggacatgcatggaaggaagccccgagccccctaccagtgcgagtattctgtcagtggccgtgagagaggcagagaaggatgagagagctctgaagcaagagattcatgaactgagagggaggctcgagcgacttgagcaatgggctggccaggccggagcatgggttcgggcagtgctccccgtccctcctgaggagctgcaaccggagcaagtggctgaactttggggaagaggcgaccgaatagagtctttgtcagaccaagtactgctgttagaagaacggctgggtgcatag

SEQ ID NO: 221780 - DNA, 882 bp, Artificial Sequence
  Description of Artificial Sequence: Synthetic coding sequence
atgggatcccgggctgaactgtgcacactgctgggtggtttcagcttcctcctattactgatacccggagaaggagcgaagggcggaagcctgagagagagtcagggggtctgctcaaaacagaccttggtggtacccctgcattataatgagagctactcccaaccagtctacaagccttacttgaccctgtgcgcaggtcgcagaatctgtagtacataccgcacgatgtaccgtgttatgtggagggaggtgaggcgcgaggttcagcagacacatgccgtctgctgtcagggatggaagaagcgtcaccctggcgctctgacttgcgaggccatctgcgccaaaccatgtctgaacggaggcgtctgtgttcgaccggaccaatgcgagtgtgccccagggtggggtggaaaacactgccacgtggatgtcgacgagtgccgcacctccatcaccctttgctctcatcattgcttcaacaccgctggctcctttacctgcggatgtcctcacgacctagtgctcggagttgatggccgaacctgcatggagggatcgccagaaccaccaaccagcgcgtccatcctgtcggtagccgtgcgcgaagccgaaaaagatgaacgggcactgaagcaggagattcatgaactacgcggaagactggagcgcctggagcaatgggctggccaggccggagcttgggtacgcgctgtgctccccgtcccaccagaagagctccaacctgagcaggtcgccgagctctggggacggggagacaggattgagagtctctcagaccaggtgttgctccttgaggaaaggttgggcgcttgctcttgcgaggacaactctcttggcctgggcgtcaaccaccggtag

SEQ ID NO: 221781 - DNA, 882 bp, Artificial Sequence
  Description of Artificial Sequence: Synthetic coding sequence
atgggctctagagccgagttgtgtaccctgctggggggattcagtttcctgctcctgctcattccgggagaaggtgctaaaggcggatccctgagagagtcccagggcgtctgctctaagcaaacgctcgtggtcccactgcactacaacgagagttacagtcagcctgtgtataagccctatttgacactgtgtgcagggcgtcggatatgtagtacctaccgaacaatgtacagggttatgtggcgggaagtgcgcagggaagtgcaacagacgcacgctgtctgctgtcagggttggaagaaacgccaccccggagcccttacttgcgaggcaatttgcgccaagccctgcctaaatggcggtgtgtgcgtcaggcctgatcagtgcgaatgcgctccgggatggggaggcaaacattgtcacgtggacgtggatgagtgtcgaacctctatcaccctatgctctcaccactgttttaacactgccggaagcttcacgtgtggctgcccccacgacttggtactgggggtggatggcagaacatgtatggaaggatcaccggagccccctacaagcgctagtatcttatctgttgctgttcgggaagcggagaaggatgagcgagcgctgaagcaggagattcatgagttgcggggacggctagaacggctggagcagtgggccggacaggccggtgcctgggtgcgggcagtgctgcccgtgcctcctgaggaacttcagccagaacaagtggccgagttgtggggaaggggtgatcgcatcgaatcactttctgatcaggtgctgctgctcgaggagagattgggagcctgtagctgcgaagacaacagtttaggcctgggtgtgaatcataggtag

SEQ ID NO: 221782 - DNA, 882 bp, Artificial Sequence
  Description of Artificial Sequence: Synthetic coding sequence
atgggatcccgggctgagctttgcactctgttagggggattctcattcctgttgctgctaattccgggtgagggggctaagggtggatctttaagggagtctcagggagtgtgcagcaagcaaactctggtggtgccattgcattataacgagtcgtactctcagcccgtgtataaaccctacctcaccttatgcgctggtcgcagaatctgctccacttatagaactatgtaccgtgtgatgtggcgagaggtgaggcgggaagtgcaacagacacatgcggtgtgctgccaaggctggaaaaaaagacacccgggtgctctgacttgcgaggccatctgtgcaaagccctgccttaatgggggagtgtgcgtgcgtcctgaccaatgcgagtgtgccccaggctgggggggaaagcactgtcacgtagatgtggatgagtgccgaaccagtatcacactgtgtagccaccactgtttcaacaccgcaggaagttttacctgtggctgtccccacgatctagtgcttggagtggatggcagaacctgcatggaaggtagcccagagccacccactagcgccagtattctttccgtggctgtcagggaagccgaaaaggacgagagagctcttaagcaagaaattcatgagctgcgcggacgactggagcgacttgagcagtgggcgggacaggctggcgcatgggttagagcagtgctgccggtacctcccgaggaactccagccagagcaggtcgccgagttgtggggacggggagacagaatcgagtcgctgtccgatcaggtgctattattggaagaaagactcggcgcatgtagctgcgaagataatagcttgggactgggagtgaaccaccggtag

SEQ ID NO: 221783 - DNA, 777 bp, Artificial Sequence
  Description of Artificial Sequence: Synthetic coding sequence
atggggtcgagagccgaactgtgcaccctgttagggggattctcatttctgctcttgcttattcctggggagggcgcaaaaggtgggtctctgcgggagagccaaggggtgtgctctaagcagacactagttgttcctctgcactataatgaaagttactcacagcccgtctataagccctacctgacactttgtgctggacgccgtatttgcagtacatacagaactatgtatcgagtgatgtggagggaagtcaggagggaggtccaacagacgcatgccgtatgctgccagggctggaagaagaggcaccctggggctctaacatgtgaggccatctgtgctaagccatgccttaacggcggtgtgtgtgtgaggccagatcaatgtgagtgtgccccaggatgggggggtaagcactgtcacgtcgggagctttacatgtggttgccctcatgacctagtcttgggagtagatgggaggacctgcatggagggatctcctgaaccaccaacaagtgcctcaatactttctgtggccgtgagggaagccgagaaggatgaacgggcactgaagcaagagatccacgaactgcgaggcaggctggaacggttagaacagtgggcagggcaggccggagcgtgggtacgagccgtcttgccagtcccacctgaagaacttcagccagaacaggtggctgaattgtggggacggggagatcggattgagagcctgtctgatcaggtgctgctactcgaggaaagactgggcgcttag

SEQ ID NO: 221784 - DNA, 777 bp, Artificial Sequence
  Description of Artificial Sequence: Synthetic coding sequence
atgggtagccgcgctgaactgtgcacacttcttggaggtttctcctttcttttgttactcatccctggcgaaggagcgaaagggggttcgctgagagagtcacagggtgtctgttcaaagcagaccctggtggtccctttacactataacgagtcttactctcagcctgtgtacaaaccctacctgacactgtgtgctggccgaagaatctgttccacatacagaactatgtaccgggtgatgtggagggaagtgagaagggaagtgcaacaaacgcacgccgtgtgctgtcaaggttggaagaaacgccatcccggagccctgacatgcgaggccatatgcgctaaaccctgtctgaatggcggagtgtgtgtgcgtcccgaccagtgtgaatgcgcaccaggctgggggggtaagcactgtcacgtcggatcttttacctgcggctgcccgcacgacctcgtattgggagtggatggcagaacctgtatggaggggtcacctgaaccacccacctctgctagcattctctcggtggctgtgcgcgaagccgagaaggatgagcgagcactgaaacaggaaatccacgagctgcgaggacgcttggagcgcctggagcagtgggcaggccaagctggggcttgggtgagagctgtgcttcccgtgccgcctgaggagttgcagccagaacaggttgccgaattatggggtcgcggagacagaatagaaagcctttctgatcaagtgctgctccttgaggagagactgggcgcttag

SEQ ID NO: 221785 - DNA, 777 bp, Artificial Sequence
  Description of Artificial Sequence: Synthetic coding sequence
atgggctctcgcgctgaactgtgcacacttcttgggggttttagcttcctgctgctgttgatacctggggaaggtgctaaggggggatccctacgcgaatcgcagggagtgtgctccaagcaaactctggtagtgccactgcactataatgagtcttattctcagcccgtgtacaagccctatctgacactttgcgcaggacgcagaatctgtagcacttaccgcaccatgtatcgcgtcatgtggcgggaggtaaagcgggaggtgcaacagacccacgccgtgtgttgtcagggctggaagaagcgacacccaggggcactgacatgtgaagcaatatgcgcaaaaccgtgcttgaatgggggtgtttgcgtccggccagaccagtgcgaatgcgctccgggttggggaggcaaacattgccatgttggcagcttcacctgcgggtgtcctcacgatctggtgttgggagttgacggcaggacctgcatggagggaagtcctgagccacctacatctgcgtcaatcttgtctgttgctgttagagaagctgagaaagatgaacgtgcacttaagcaggaaatccacgagctgcgcggtcggctcgagcgccttgagcaatgggctgggcaggctggagcctgggtgcgggcagtgctccccgtcccaccagaggagctgcaaccagagcaggttgcagagctttggggcagaggggaccgcatcgagagtctctccgatcaggtcctcctactggaagaacgattaggggcatag

SEQ ID NO: 221786 - DNA, 882 bp, Artificial Sequence
  Description of Artificial Sequence: Synthetic coding sequence
atggggtctcgggctgagttatgcactctcctagggggttttagttttctgcttctgctaattcctggggagggcgcaaagggagggtctctgcgcgaatctcagggggtgtgctctaaacaaactctggtcgtgcctctgcactataatgaatcatactctcaacccgtctataagccctacctcaccctgtgcgctgggagaagaatctgcagcacttatcggaccatgtacagggttatgtggcgggaagtgagacgcgaagtgcaacagacacatgctgtgtgctgtcaaggctggaagaagcggcaccctggtgccctcacctgtgaggccatttgtgccaaaccctgcctgaatggtggggtgtgtgtgaggcctgatcagtgtgagtgtgcccctgggtgggggggtaagcactgccacgttgatgtggatgagtgtcggacttctattaccctctgttcccatcactgctttaacaccgccggaagcttcacttgcggatgtccccacgatctagtgctgggcgtcgacggcagaacatgtatggaaggctctccggagccccctacctcagcatctatcctctccgtggcagtgcgcgaggccgaaaaagacgagagagctctcaagcaggagattcacgagctccggggtcgactggaacggcttgaacagtgggcagggcaggcgggagcgtgggtgagagccgtgctgcctgtgccacccgaagagctgcagcccgaacaggtcgccgagctgtggggacggggagaccgcatcgaaagtctatccgaccaggtcttactcctggaggaaagactgggagcatgttcttgtgaggataattccttaggactgggtgtgaaccaccggtag

SEQ ID NO: 221787 - DNA, 882 bp, Artificial Sequence
  Description of Artificial Sequence: Synthetic coding sequence
atgggcagcagggccgagttgtgcaccctactcggcggattcagctttctgctgctgttaatcccaggagagggcgctaaagggggtagtctccgtgagagtcagggggtttgtagtaaacagacactggtagttccgctccattataatgagtcatatagtcaacccgtatataaaccatatctgaccctatgcgccggtaggagaatctgcagcacctatcggactatgtaccgcgtaatgtggagagaggtacgcagggaggttcagcagacccatgccgtttgttgtcagggatggaagaaacgacacccaggcgcactcacctgcgaagctatttgcgccaagccatgcctgaatggtggggtgtgtgtacgaccggatcaatgtgagtgtgctcctggctggggagggaagcattgtcacgtggacgtcgacgagtgccggacatctattaccttgtgcagtcatcattgcttcaatacagccggttcattcacttgtggctgtccacacgatctagtactcggagtcgacggtagaacctgtatggagggcagccccgagcctcccactagcgcttccatcctttcagtcgcagtccgcgaagctgagaaagatgaaagagcgttgaaacaggaaatccacgagctcagaggcagactggagaggttggaacagtgggcaggccaggctggtgcctgggtgagggcggtccttcccgtgcctcccgaagagttgcagcccgaacaggtggctgagctctgggggaggggcgacagaatcgaaagcttatctgatcaagtcctgttactcgaggagcgcctcggtgcgtgcagctgcgaggataattcactgggtctcggcgtaaaccacaggtag

SEQ ID NO: 221788 - DNA, 882 bp, Artificial Sequence
  Description of Artificial Sequence: Synthetic coding sequence
atgggctcgcgagcagaattatgtacgttgctgggcggattctcctttctattgctgttgattcctggggagggagccaaagggggatcactgcgggaatctcagggggtctgcagcaagcagaccctggttgtgccactgcattacaacgagagctacagccagccagtctacaagccctacctgacgctctgcgcaggacggagaatttgttcaacctaccgcactatgtacagggtgatgtggcgggaagtaagacgtgaggtgcagcagacgcacgctgtgtgttgtcaggggtggaagaaaaggcaccccggagctctgacatgcgaggctatatgtgctaagccctgcctgaacggaggagtgtgtgtccgtcccgaccagtgcgaatgtgctccgggttgggggggtaagcattgtcatgtggacgtcgatgaatgccggacatcaatcacgctttgttcacaccattgctttaacactgccggttcatttacctgcggctgtccccatgaccttgtgctcggagtggatggacgtacatgtatggaggggtctcctgagcccccaacttctgcaagtattctgagcgtcgcagtcagagaggcagaaaaagacgagagggcattgaaacaggaaatacacgaattgagaggccgacttgaaagacttgagcagtgggccggacaggcaggggcttgggtgcgggcagtgctgccagtgccgccagaggagcttcaacccgaacaggtggccgagctgtggggcaggggcgaccgaatagagagtctgagcgaccaggttttgttactggaagaaagactcggcgcttgtagctgcgaggacaacagtctggggctgggagtgaatcatcgttag

SEQ ID NO: 221789 - DNA, 882 bp, Artificial Sequence
  Description of Artificial Sequence: Synthetic coding sequence
atgggttctcgggcagagctgtgcacgttgcttgggggattcagcttcctcctgctccttatccctggcgagggcgctaagggtggctcactgagggaaagtcagggcgtctgctctaagcagaccctggtggtgccgcttcattacaatgaatcgtatagtcagccagtttacaagccttacttaactctgtgcgccggtagaaggatctgtagcacctatagaaccatgtatagagtcatgtggcgagaggttaaaagagaagtacagcagacccatgcagtttgttgccaggggtggaagaaacggcaccccggagctctcacgtgcgaggccatctgtgccaagccgtgcttaaacgggggagtgtgcgtgagaccagaccaatgcgaatgcgctcctgggtggggcggtaagcattgtcatgttgatgtggacgagtgtaggacaagtatcactctgtgtagccaccattgttttaatacagctggatcattcacgtgcggctgtccacacgaccttgtgctaggcgtcgatggcagaacctgtatggaaggttctcccgagccaccaacatcagcgtcaatcctcagcgtcgccgtgagggaagccgaaaaagacgagcgggcattaaagcaagagattcatgagctgagaggccgtttggagaggctcgaacagtgggccggacaagccggtgcgtgggttagggccgtgctgcccgtcccgccagaggagttgcagcccgagcaagtggccgaactgtggggaaggggggatcgcatagaatccctaagtgatcaggttctgcttctggaggagaggttgggagcgtgcagttgcgaggataattctctgggcctgggggtgaaccatcgctag

SEQ ID NO: 221790 - DNA, 882 bp, Artificial Sequence
  Description of Artificial Sequence: Synthetic coding sequence
atggggagccgtgcggaactgtgtacccttctcggcggattttcatttttacttcttttgattccgggtgaaggcgctaagggcggttcgttgcgggagtcacaaggagtctgcagcaagcagacactagtggtgcctctgcactacaacgaatcatactctcagcccgtgtataaaccatacctgacattatgtgccggacgcaggatatgttccacctaccgtactatgtacagagtgatgtggagggaagtcagaagagaggtacagcagacccatgccgtgtgctgtcaaggttggaaaaaacgccatcctggagccctgacatgcgaggccatctgcgcaaagccctgcttgaatggaggagtgtgtgtgagaccggaccagtgtgagtgcgcacctggctgggggggaaaacactgtcacgttgacgtggacgaatgtcgtacgagcattacgctctgctcccatcattgtttcaataccgctggttcgttcacttgcgggtgcccccatgatcttgtgctgggcgttgacggcagaacctgtatggaggggagtccggaacctcccacatcagcctccattctctccgtagccgtgagagaagcggaaaaggacgagagggctctgaagcaggaaattcacgagctaaggggcagactcgaaaggctcgagcagtgggccggtcaggctggcgcttgggtccgagcagttctccccgtgcctcccgaagaactgcagccagagcaggtcgcagaattgtggggacggggtgatcggatcgagtcgctctccgatcaggttctcctattggaggagcgtctgggagcctgttcatgcgaggataactccttgggacttggagtaaatcataggtag

SEQ ID NO: 221791 - DNA, 882 bp, Artificial Sequence
  Description of Artificial Sequence: Synthetic coding sequence
atggggtcccgggctgaactgtgtactttattggggggtttttcattcctcctgctcttgatccccggagagggggcaaaaggtggctctcttcgggagagtcagggtgtctgcagtaagcagacactcgtcgttccactacattataatgagagttattcccagccagtgtacaaaccctacctgacgttatgcgccggtcgccgaatttgttccacatatcggacgatgtacagagtgatgtggagagaggtgagaagagaggtgcagcagacacacgccgtttgttgccagggatggaagaagcgacatcccggagcgttaacatgtgaggccatctgcgccaaaccctgcttgaacggaggtgtgtgtgtcagacccgatcaatgtgagtgcgctccagggtggggaggcaagcactgccatgtcgatgtggatgagtgtagaacaagcatcacactgtgttctcaccactgttttaataccgctggaagtttcacctgtggttgtcctcacgacttggtcctgggcgtggatggcagaacttgcatggagggtagcccagaaccgccaacttcagcatctattttaagcgtggccgtgcgggaggctgagaaggatgagcgggcacttaaacaggagattcacgaactgcggggaaggctggaaaggctggagcagtgggctggccaggccggagcttgggtgcgagccgtgttgcctgtgcccccagaagagcttcagcctgagcaggtcgccgaactttggggcaggggagacaggattgagtccttgtctgaccaggtgctactgctggaggaacgtctgggggcatgcagttgtgaagacaattcactgggtctcggagtgaatcatcgatag

SEQ ID NO: 221792 - DNA, 882 bp, Artificial Sequence
  Description of Artificial Sequence: Synthetic coding sequence
atgggttcccgggctgaactgtgcacactgctgggtggatttagcttcttacttctgctcattcccggagagggggcaaaaggcggtagcttgcgggagtcacagggagtctgctccaaacagacgctagtcgtgcctttgcactacaatgaatcttacagccaaccagtctacaaaccgtatctcaccctttgcgcagggaggcgaatctgcagcacctaccggactatgtaccgcgtgatgtggcgcgaggtgagacgagaagtgcagcagacgcatgccgtctgttgtcagggatggaagaagagacacccaggtgcattaacttgtgaagccatctgtgctaaaccttgtctgaatgggggtgtgtgtgtgagacctgatcagtgtgagtgcgcgcctggttggggcggtaagcactgccatgttgatgtagatgagtgtcggacatctatcaccctatgctctcaccattgctttaacaccgctgggtctttcacatgtggctgcccccatgatctagtgctgggggtggatggcagaacctgtatggagggctcacccgaacccccaacttctgcatctattctgagcgtggccgtaagagaggccgagaaggatgaacgggcattgaagcaagaaatccatgagctccggggaagactagagcggttagagcagtgggctggtcaggcgggtgcatgggtccgtgcagtgctgcccgtccctcctgaagaattacagcccgagcaggtagccgaactatggggcaggggagaccgcattgaaagtctgtctgaccaggtcctgttactcgaagaacgcctgggggcttgctcctgtgaggacaattctctgggccttggcgtgaaccatcggtag

SEQ ID NO: 221793 - DNA, 777 bp, Artificial Sequence
  Description of Artificial Sequence: Synthetic coding sequence
atgggatcgagagccgagctttgcaccctgttggggggttttagctttctactcctgctgatccctggagagggcgctaaggggggaagtttgcgggaaagccagggagtttgcagtaaacaaaccttggtggtgccccttcactacaacgagagctattcccagcccgtgtataaaccttacctgaccctttgcgctggacgtaggatttgttcaacttataggaccatgtacagggtgatgtggagggaagtaaggcgggaagtccaacagacgcacgccgtttgttgtcaagggtggaaaaaacgccacccaggcgctctgacctgcgaggccatctgcgcgaagccatgcctgaacgggggtgtgtgcgtgaggcctgaccagtgcgagtgtgccccaggatggggcggtaagcattgtcacgttggctcttttacttgcggatgcccgcacgacttggttctcggggtggacggtcgtacctgcatggaggggagtcctgagcctccgacatcggcctctatactgagtgtggctgtgagagaggccgagaaagacgaacgcgcactgaagcaggagatccatgagctaaggggcaggctggaacgcttggaacaatgggccggacaggccggtgcttgggtcagggcagttctgcctgtgcctcctgaggagttgcagccagagcaggtcgctgagttgtgggggcgtggcgaccgcatcgagtctttatccgaccaggtcctcctgctagaagaacggctgggcgcatag

SEQ ID NO: 221794 - DNA, 882 bp, Artificial Sequence
  Description of Artificial Sequence: Synthetic coding sequence
atgggatcccgggctgagttgtgtacactcctcggaggcttttcctttctgctcctcttgattcccggtgaaggggctaagggcggatctcttagagagtctcagggcgtgtgcagtaagcagaccctcgtggtgccactccactataacgagtcttatagccagcccgtgtacaaaccatatctaaccctctgtgccggacgaaggatctgcagcacttaccgcactatgtaccgagtcatgtggcgtgaggtgcgtcgggaggtccaacaaacgcacgccgtttgttgtcaaggatggaagaaacggcatcccggagcacttacctgcgaggcgatttgtgcaaagccttgtttaaatggtggagtctgcgtccggccagaccagtgtgagtgtgcgccaggttggggcggtaagcactgccatgtagacgtcgatgaatgtcggacaagtattactctgtgctcacaccactgttttaatacagccggttcatttacctgcggatgcccccacgacctggtactgggagtagacggcagaacctgcatggagggttccccagaacctcccacatcggcaagcattctcagcgtcgcagtgagagaggcagagaaagacgagagagctctgaagcaggagattcatgagctcaggggaagactggaaaggttggaacaatgggctgggcaggctggtgcttgggtccgagcagttctccccgtgcccccagaagaactgcagcccgagcaggtggccgagctgtggggcagaggagataggatagaaagcctgtcagatcaagtcctgctgctggaagaacggctcggggcatgttcatgtgaggataattccctggggctgggggtgaaccaccgctag

SEQ ID NO: 221795 - DNA, 1281 bp, Artificial Sequence
  Description of Artificial Sequence: Synthetic coding sequence
atggctaacgactcaggtggacccggaggaccatcaccttccgaaagggatagacagtactgcgagctgtgcggcaaaatggaaaaccttttaaggtgcagccgatgtcgctcgtctttctactgctgcaaggagcaccaaaggcaggattggaagaaacacaagctggtgtgtcaaggatcagaaggtgccctggggcatggagtcggtcctcatcagcactctggccctgcacctcctgctgctgtcccacctccgagggcaggcgctcgggaaccaagaaaagccgcagctcgcagagataatgcctccggagatgccgcaaagggcaaggtgaaagctaaaccacccgctgaccccgcagccgcagccagtccttgtagagctgctgccggtggacaggggtctgcagtagcggcagaagcagaaccaggaaaagaggagcccccagcacggtcctctcttttccaggaaaaggctaacctctatcccccatccaatacccctggagacgcacttagccctggcggagggctccgaccaaacggccagacaaagccgcttcccgcattaaaactggccctcgagtacatcgtgccttgcatgaacaaacacggcatttgcgtcgtcgacgactttctgggcaaggagaccggacagcagataggcgacgaggttcgggctctacacgataccggtaagttcaccgacgggcagttggtttcgcagaagtcagacagcagcaaggatatacggggagacaaaattacttggatcgaagggaaagagcctggttgtgagaccattggcctcctgatgtcatccatggatgacctaatcagacactgtaatggaaagttgggatcctacaagatcaatggacggactaaggctatggtcgcgtgttatccgggaaacggaactggctacgttaggcatgtagacaacccgaatggagatggcagatgcgtgacctgcatctattacctgaataaggactgggacgctaaagtttctggcggaattctgcgaatctttcccgaaggcaaagcccagtttgctgatatagaaccaaagttcgatcgattgttgttcttttggtccgacagacggaatcctcacgaggttcagcccgcttacgccacacggtacgcaattactgtgtggtactttgatgctgacgaacgtgctcgagccaaagtgaagtatctgactggcgagaaaggtgtccgagtggaactcaataagccatccgattctgtggggaaggacgtcttctag

SEQ ID NO: 221796 - DNA, 216 bp, Artificial Sequence
  Description of Artificial Sequence: Synthetic coding sequence
atgaataaacatggaatctgtgttgtggatgactttctggggaaggagactggtcagcagattggggacgaggtgagggcactacacgacacaggaaagtttactgacggttcttggtccgccaggagggtgacacgacccagaaccagtgaggccattcgctcccctgggagtagagctaggtctcctgccgctaagcctcttggatgcagctag

SEQ ID NO: 221797 - DNA, 1224 bp, Artificial Sequence
  Description of Artificial Sequence: Synthetic coding sequence
atggacagtccctgtcagccccagcctttaagtcaggctctaccacagctgccaggctcatcttcagaaccgctcgaacccgagcccggacgcgctcggatgggcgtggaaagttatctcccatgcccattgcttcctagctatcactgccctggggttcctagcgaagcctctgcagggagcggcacacccagagccacagctacctctaccactgccagcccacttcgagacgggtttggaggtcaggacggcggagaacttcgtcccctgcagtcagagggtgccgcagccctcgtcacgaaaggatgccagcgtcttgccgcacagggcgctagacccgaggctcctaagagaaagtgggcagaagatggaggagatgctccctccccatccaagaggccatgggcaagacaagagaaccaagaagccgaaagagaaggaggcatgagctgcagctgctcctcaggcagcggagaagcttccgccggtttgatggaggaggccttaccatccgcacccgagcgactggccctggattacatcgtaccttgcatgcggtattacgggatttgtgtaaaggactccttcctcggagccgctctgggcggacgggtgctggctgaggtggaggcactgaaaagagggggtagactgcgagacggtcagctagtaagtcagcgagccattccacccaggtcaataagaggcgaccaaattgcctgggtagagggccacgagcccggttgcaggtctattggggcacttatggcccacgtcgatgctgtgatcagacactgcgctggtcggttgggtagttatgtcattaatggcaggacaaaagctatggttgcctgctatcccggtaatggcctcgggtacgtgcgccacgtggacaacccgcacggggacggtcggtgtattacgtgtatttactatctgaatcagaattgggacgtcaaggttcacggcggattactccaaatattccccgagggacggcctgtcgtagctaacatcgagcccctctttgacagactgctgattttctggtctgaccggcgtaacccccacgaggtgaagcccgcatatgccacaagatacgctatcaccgtgtggtacttcgatgcaaaggagcgagccgcagccaaggacaaataccagctcgcttctgggcagaagggcgtccaggtcccagtgtcacaaccgcctacgccgacatag

SEQ ID NO: 221798 - DNA, 1224 bp, Artificial Sequence
  Description of Artificial Sequence: Synthetic coding sequence
atggattctccttgtcagcctcaaccgctctctcaggcgttaccacaattgccaggctccagttccgaaccccttgaacctgaaccagggagggctcgaatgggggtcgaatcatatctgccctgtccgttactgccatcctatcattgtcccggagttccatcggaggccagcgcaggttctggcacccccagggccaccgccaccagcactactgcttcaccgttacgcgatggtttcggaggacaggacggtggggagttgcgtcccctccaatccgagggggcagccgcactggtcaccaaaggttgccagaggcttgcagctcagggagctaggcccgaggccccaaagcgcaagtgggctgaagacggaggagacgccccatctccttcaaaacgcccttgggcacgacaggaaaatcaggaagctgagcgcgagggaggtatgtcctgctcatgcagttcaggctccggggaggcttcagctgggcttatggaggaggcactcccctccgctcctgaaaggcttgccctggactatattgtaccttgtatgcggtactacggcatatgcgtcaaagattctttccttggggctgctctagggggaagagtgctggcagaggtcgaagcactgaagcggggagggaggttgcgagatgggcagttggtgtcgcagagggcgattccccctcggtctatacgtggcgatcagatcgcttgggtcgaaggacacgaaccaggttgccgaagcataggagctctgatggcccatgtagatgccgtgatcaggcactgtgccggaaggctggggagctacgtgattaatggacgcacaaaagccatggttgcttgctaccctgggaatgggctgggctatgtaaggcacgttgataatccgcacggtgacggcaggtgcattacgtgtatttactatcttaatcaaaactgggacgttaaggtgcacggcggtctgctccagatctttcctgaaggccgtcctgtcgtggcgaatattgaacctctgtttgaccgcctcttgatcttctggtcagaccggagaaatcctcatgaggtgaaacctgcttacgcaacacgctacgctataaccgtgtggtacttcgacgccaaagaaagagcagcagccaaagataaatatcaattagcctctggacagaaaggcgttcaggtaccagtcagccagcctcctaccccaacatag

SEQ ID NO: 221799 - DNA, 720 bp, Artificial Sequence
  Description of Artificial Sequence: Synthetic coding sequence
atgcctcttggacacattatgaggttagacctggagaagatcgcacttgaatacattgtcccctgcctgcacgaagtgggcttctgctacctggacaattttctgggcgaagtcgtgggtgactgtgtgttagaacgagttaaacagctacactgcaccggcgcactcagagacggtcagctcgctggccctcgcgctggagtctccaagagacatctgcgcggagatcagatcacctggatcggaggcaacgaagagggctgcgaggcaattagcttcttgctcagtcttattgacagattagtgctctattgcggttcccgattagggaaatactacgttaaggagagatctaaggcaatggtcgcatgctacccagggaacggaacagggtacgtgcggcacgtggataaccccaacggcgatggacgttgcatcacatgtatctactacctgaataaaaactgggacgccaaactgcatggtggcattctcagaattttccccgaggggaaatcgttcatcgccgatgtggaaccaattttcgacaggctattatttttctggagtgaccgcagaaacccacatgaggtgcaaccctcctatgcaacccggtatgcaatgaccgtttggtattttgacgccgaggaacgggctgaagcaaagaagaaatttagaaacctgactaggaaaaccgaatctgctctgaccgaagactag

SEQ ID NO: 221800 - DNA, 720 bp, Artificial Sequence
  Description of Artificial Sequence: Synthetic coding sequence
atgccactgggacacataatgagacttgacctcgagaaaatagccctggagtacattgtgccatgtctgcacgaggtggggttctgttacctagacaacttcttaggcgaagtcgtcggtgattgtgtgctggagcgggtcaagcagctacactgcacaggtgcccttagagatggccagttggccggtccacgagctggcgtaagcaagagacacctgcggggagatcagatcacttggatcggcggaaatgaggaagggtgcgaagctatctcatttctcctgtctcttatcgaccgtctggttctgtactgcggatcccggctggggaaatactacgtaaaggaacgatccaaggccatggtagcctgttaccccggtaacggcactgggtatgtgaggcacgtggacaacccaaacggtgatggcaggtgcataacctgtatctactacctcaataagaactgggacgcaaagctgcacgggggtatcctgcgcattttccctgagggaaagtctttcattgccgatgttgagcccatatttgacagactcctctttttttggtccgaccgtcggaaccctcatgaggtccagcctagttacgcaacgaggtatgctatgaccgtatggtattttgatgcagaggaaagagcggaagccaagaaaaaatttcggaacctcacgcgtaagacagagtccgccctaaccgaagattag

SEQ ID NO: 221801 - DNA, 1605 bp, Artificial Sequence
  Description of Artificial Sequence: Synthetic coding sequence
atgttctcgtgggtgagcaaggacgccaggagaaagaaagaacccgaactctttcagaccgtcgctgagggattgagacagctgtatgcacagaaactgctgcctctggaagaacattataggtttcatgaattccacagtccagccctcgaggacgcggacttcgacaataaacccatggtgttgttggtgggacagtattccactggaaagaccacctttattcggcatttgatcgagcaggatttccctggaatgagaattggtccagaaccaacaacggatagcttcatagccgtgatgcatggccctaccgaaggcgtagtgcctggtaatgccctcgtggtagatcctaggcgcccttttagaaaattaaatgcattcggcaatgcatttctgaatcgctttatgtgcgcccagctgccaaatcctgttcttgattccatctcaatcattgacaccccaggaattctcagtggcgagaaacaaaggattagccggggatacgactttgcggctgtactggagtggtttgccgaacgagtggaccgaataattttgctgttcgatgctcataaattggacatctccgatgaatttagtgaagtcattaaagccctgaagaaccacgaagataagattcgagtggtgttaaacaaggctgaccaaatcgagacccagcagttgatgagggtgtacggcgctcttatgtggagtctgggcaagataataaacacccccgaagtggtgagagtttatatcggaagcttttggagccaccctttgcttatccctgataacagaaagctctttgaggccgaggagcaggacctctttaaggatatccagagtttgcctcgcaacgccgcactccgcaaactcaatgatctgattaagcgggcaaggctcgccaaggtgcatgcttatatcatttccagtttaaagaaggagatgcctaacgtcttcggaaaagaatctaaaaagaaagaattagtaaacaatctgggcgagatctaccagaaaatcgagcgcgagcaccagataagtccaggagactttccaagcctgaggaaaatgcaggagctgttacagacacaggacttttccaagtttcaagcactcaaaccaaaactgttagacacggtggacgacatgttggctaacgacatcgcaagactaatggtgatggttagacaggaggaatcactgatgccctcccaggtggtgaaaggcggtgccttcgacggaaccatgaacggaccattcggccacggctatggggagggtgctggcgaaggaatcgacgacgttgaatgggtcgtcggaaaggataaacccacttacgacgagatcttttacaccctttccccagtaaatggcaagataactggggctaacgcaaaaaaagagatggtgaaatccaagctgcctaacaccgttctgggcaaaatctggaaactcgccgacgtcgacaaggatggtcttctggatgacgaggaatttgcgctagcaaatcacctaataaaagtgaagctggagggccacgagctacccgcagatctgccaccccacttagtgcccccaagtaaacggcgtcacgagtag

SEQ ID NO: 221802 - DNA, 1605 bp, Artificial Sequence
  Description of Artificial Sequence: Synthetic coding sequence
atgttttcctgggtatcaaaagatgccaggaggaaaaaagagccagaattgtttcagactgtagccgagggccttagacaattgtatgcccagaaactgttacccctggaggaacattatagattccacgaatttcactctcccgcactggaggatgcagattttgataataagccaatggtccttttggtgggccagtactctacagggaagaccacattcattcggcacctaatcgaacaggactttccgggtatgagaataggacccgagcccaccacggacagcttcatcgccgttatgcatggaccaaccgagggagttgtgcccggtaatgctctcgtggtcgatccccgtcgacccttcagaaagctcaacgccttcgggaacgccttcctaaaccggttcatgtgcgcacaactccccaacccagtgctggacagtataagcatcattgataccccgggtatcctctctggtgaaaagcagcggatcagtcgaggctacgacttcgcagccgttttagaatggttcgccgagcgggtcgacaggattattttattgtttgacgcccataagctcgacatatccgacgagttctccgaagtgattaaggctctgaagaatcacgaggacaagatcagggttgttctcaataaagcggaccagatcgagacccagcagttaatgcgggtgtacggtgccctgatgtggtcgcttggtaagattattaacacacctgaggtggtgagggtgtacattggaagcttctggagccaccccctgctgatccctgacaatcgaaagttgttcgaggccgaggagcaggaccttttcaaggatatccaatctcttcccaggaacgccgcactgaggaaattgaatgatttgatcaagagggccaggctcgctaaagtccacgcttacattatctctagcctgaagaaggaaatgcctaacgttttcggcaaggagtcaaagaaaaaggagctggtcaataatttaggcgagatctaccaaaagatcgaacgggagcaccaaattagccctggagattttccaagcctgcgtaaaatgcaggagttgcttcagacccaagatttctctaaattccaagccctgaagcccaagttgctggacaccgtagacgatatgctggccaacgacatcgctcgcctgatggtgatggtgcggcaggaagaaagcttgatgccaagccaagtcgttaaggggggagcttttgatggaactatgaacggcccattcgggcatgggtacggtgagggagcgggtgagggtattgatgacgtcgagtgggtggtggggaaagacaaaccgacttacgacgagatattttataccctcagccctgtaaatggaaagataacaggggcaaatgctaaaaaggaaatggtgaagtccaagctgcccaataccgtcctaggaaaaatatggaaactggccgacgtagacaaagatggacttctggacgatgaagagttcgctctcgctaatcacctgattaaagtgaaattggaagggcacgaattgcctgctgatctgccccctcacttggtgcctcctagcaagcgccgacatgagtag

SEQ ID NO: 221803 - DNA, 438 bp, Artificial Sequence
  Description of Artificial Sequence: Synthetic coding sequence
atgtttagctgggtgtcaaaggacgctcgaaggaaaaaggaaccagaactttttcagaccgtggccgagggtctccgccagctgtatgctcagaaactcttaccattggaggagcattacagattccacgaattccactctcctgccttggaagacgccgactttgacaacaaaccgatggttctgcttgttggccagtactcaacaggtaaaacaacctttatacggcacctcattgagcaggacttccccggaatgagaatcggacctgagcccacaaccgactctttcattgcagtgatgcacggtccaaccgaaggcgtcgtccccggaaacgcacttgtggtggatcccaggaggcccttccggaagctgaacgcgttcggaaatgcctttcttaacaggtttatgtgcgcacaactgccgaacccagtttag

SEQ ID NO: 221804 - DNA, 1296 bp, Artificial Sequence
  Description of Artificial Sequence: Synthetic coding sequence
atggagcagccagggaccgcagcatctcccgtgtctggtagtatgttctcctgggtgtctaaggatgccaggcgcaagaaggaaccggagctttttcaaacggtggcagaaggactgcgccagctctacgctcagaagttgctgcccctggaagaacactataggtttcacgagtttcactcgcccgctctggaggatgccgactttgacaacaaaccaatggttctcctggtagggcaatattctacggggaagaccacattcatccgacacctgatcgagcaggacttccctggcatgcggattggcccagagcctacgaccgacagtttcatagccgtcatgcatggcccaaccgaaggagtggttcccggtaacgccctcgtcgttgacccacggagaccgttccgcaagctgaatgcttttgggaatgccttcctaaatcgcttcatgtgcgcccagctgcccaacccggtgctggactccatctctattatcgatacccccggtatcctgagcggggaaaagcaacggatctctagaggctatgacttcgctgccgttctagagtggttcgccgaaagagtggaccgtataatcctgttatttgacgcccataagctcgacattagtgatgaattttcggaggtgatcaaggccttgaaaaaccatgaggataagataagggttgtgttgaataaggcagatcaaatagagacgcagcagcttatgagagtgtatggagccttgatgtggtccctggggaaaataatcaataccccagaggtggtaagggtgtatatcggcagcttttggtcccatcctttactaatccccgacaaccgcaaactgtttgaggctgaagaacaggatttattcaaggacatccagagcttgccaagaaatgccgcactgcggaagctcaacgacctcatcaagcgggctagactcgcaaaggtgcatgcctatatcattagttccttgaagaaggaaatgcctaacgtgttcgggaaggaatcaaagaagaaagaattggtgaataatctcggagaaatttatcagaaaatcgagcgggaacaccaaatctcccctggtgatttcccctccctcaggaaaatgcaggaacttctccagactcaggatttttccaagtttcaggccctaaagcctaagctactggatgatgaagagttcgctctcgctaaccatctgatcaaggtcaaattggaaggacacgaactgccagctgatctaccccctcacttagtgcctcctagcaaaaggcgccatgaatag

SEQ ID NO: 221805 - DNA, 447 bp, Artificial Sequence
  Description of Artificial Sequence: Synthetic coding sequence
atgttctcgtgggtgtcgaaagatgctcggaggaaaaaagagccggaattgtttcaaaccgtagctgagggcctgcgacagctgtatgctcagaaactgctgcctctggaagaacattatcgctttcacgaatttcattcgccagctctggaggacgccgattttgataacaagccaatggttctactcgtgggacaatatagtacaggaaagacaacatttattagacacctgattgaacaggactttccaggaatgaggatcggccctgagcccaccaccgattctttcatagccgtcatgcacggcccaacggagggggttgtaccagggaatgctctggtcgtggaccctcgtcgcccttttcgcaagctaaatgcctttggtaacgccttcctgaaccggtttatgtgtgctcagttaccaaatccagtccttgacagttag

SEQ ID NO: 221806 - DNA, 1533 bp, Artificial Sequence
  Description of Artificial Sequence: Synthetic coding sequence
atgttttcctgggttagtaaagatgctcgtcggaagaaagagcactacagattccacgaatttcactccccagcgctggaggacgccgacttcgacaataaacccatggtattgttggtgggacagtatagtacaggtaaaaccactttcatccggcatttaatcgagcaggactttccgggaatgcgaatcggtccagagcccacgactgactcctttatagcagtgatgcatggccctacggaaggggtcgtacccggaaatgccctcgtcgtagatccacgcaggcctttccggaagcttaacgccttcggtaacgctttcctgaaccgtttcatgtgcgcccaattacctaaccccgtgctggacagcatctctataatcgacacacccggaatactgtcaggggagaagcaacgtatcagcagaggatatgacttcgccgcagtcctggaatggttcgcagagcgcgtggatcgaatcatattgctatttgacgcgcataaattagacatctctgacgaattttctgaggtcatcaaagccctgaaaaaccatgaggacaaaattagggtggtgctgaataaggctgaccagattgagacccagcagctgatgagggtgtatggcgctcttatgtggtcgctgggaaaaatcattaatacaccggaggtcgttcgcgtgtatattgggtcattctggtcacatcccctgctgatccctgataatcggaaactcttcgaggcagaagaacaggatttattcaaagacatccagagcctgccaagaaatgccgctttacgtaagctcaacgacttgatcaaacgcgctagattggcaaaggtccatgcgtatattatatccagcctgaagaaagaaatgcccaacgtgtttggcaaagagtctaagaagaaagaactggtgaataatctgggggaaatttatcagaagatagaacgagaacaccagatttcacccggtgacttcccctccctgagaaaaatgcaggaactgttgcaaacccaggacttcagcaaattccaggctctgaagcctaaactgttggatacggtcgatgacatgctcgcaaatgacattgcccgtctcatggttatggttcgccaggaggagagcctcatgccgtctcaagtggttaaaggcggagccttcgatggcactatgaacggcccattcgggcacggctacggcgagggtgctggcgaaggaatcgatgacgtagagtgggtggtggggaaggataaacctacctacgatgagattttttatacattgtctccagtgaatggtaagattaccggtgctaatgccaagaaggagatggtgaaatcgaaactgcccaatactgttctgggcaagatctggaagctggccgatgtagacaaagatgggcttctggatgacgaagagtttgccctagccaaccacttaataaaggtcaagctggagggccatgagctgccagccgacctccccccacatttagtgccaccttccaagcgaagacacgagtag

SEQ ID NO: 221807 - DNA, 1632 bp, Artificial Sequence
  Description of Artificial Sequence: Synthetic coding sequence
atgttctcctggctaaaacgcggaggggcacgagggcagcagcccgaagcgattcggactgtgaccagcgcccttaaggaactgtaccggacgaagctgctccctttagaagagcattacaggttcggggcattccattcccccgcattagaagatgccgactttgacggcaaacctatggtgttagttgcaggccagtattcgactggcaagaccagctttatacagtacctgcttgagcaggaggttcccggatcgagggtaggccctgaacctacaacagactgctttgtggctgtgatgcacggggacacggaggggacagtacccggaaacgccctcgtggtggatccggacaagccctttcggaagctgaatccattcggaaacacttttttgaatcgcttcatgtgtgctcagctacccaaccaggtgctcgaaagcatctccatcatagacacacctgggatcctaagtggagctaagcagcgagtaagcaggggatatgatttcccggcagtgctacggtggttcgccgagagagtcgatctcatcattcttttgttcgacgcccacaagctggaaatttcagacgaattctccgaagcaattggtgcactacggggtcacgaagacaaaattagagtcgtgcttaacaaagcagacatggtagagacacagcagctaatgcgggtctatggggcattaatgtgggctctggggaaggtcgttggcactcccgaagtacttagggtttatatcggatcattctggtcccagccccttctcgtcccagacaaccgcagactgtttgagcttgaggagcaagacttgtttcgggacatccaaggattgccacgtcatgccgcactgcgcaagctcaatgacttggttaagcgggcaaggctggtgagagtccatgcatacatcataagctacctgaaaaaggaaatgcctagtgtttttggaaaggaaaacaaaaaaaaacagcttattttgaagttacctgtgattttcgccaagattcaactcgagcatcacatctccccaggcgattttcctgattgccaaaagatgcaagagttgctcatggcgcatgattttacaaagtttcatagcctgaagccgaagttgctggaagcactggacgagatgctaacacatgatattgcgaagttgatgcccctgctgcgccaagaagagctggagtctaccgaagttggtgtccaaggtggcgcttttgaaggaacacacatggggccatttgtcgaacgcggaccagatgaagcaatggaagacggggaagagggttccgatgatgaagcagagtgggtcgtgaccaaggataagagtaagtatgacgagatattctataacctggcaccggctgacggaaaactttccggtagcaaagccaagacatggatggtcggaaccaagctgcccaactccgtgctgggaaggatctggaaactttccgatgtggaccgcgatggaatgctcgacgacgaagaattcgctcttgcaagccatctcatcgaggccaagctggagggacacggtctgcctgcaaacttaccgaggagattggtgcctccatccaaacgtcggcataagggctccgccgagtag

SEQ ID NO: 221808 - DNA, 516 bp, Artificial Sequence
  Description of Artificial Sequence: Synthetic coding sequence
atgcctagtgttttcggaaaggaaaacaaaaaaaagcagctgatcttgaagctacctgtcatcttcgcgaaaattcagctggagcaccacatttcacccggagacttcccggattgtcagaaaatgcaggagctgttgatggcccacgactttactaagtttcacagtctgaaacccaaactccttgaggcgttggatgagatgctgacacacgatatcgccaagcttatgcctcttctgcggcaggaggaactagaaagcactgaggtaggcgtgcagggaggcgctttcgaggggacccatatgggcccatttgttgaacggggacctgacgaggctatggaagaccaggggcaggttcagatccggagagacctcttacagcccggagcttgcaggcgacaagccgagcgcctgcagggtcaggatctggatggaggtgaccaggctccacagctgtctgcaggagcccatctcgaggcacaacggtgcggtcctcgcaggcatgcaggatag

SEQ ID NO: 221809 - DNA, 1224 bp, Artificial Sequence
  Description of Artificial Sequence: Synthetic coding sequence
atgtgtgcccagctgccgaatcaggttcttgagtctatctctatcatcgacacccctggtattcttagcggagctaagcagcgagtgagcagaggatatgacttccccgcagttctgcggtggttcgccgaaagagtcgatctgataatcctcttgttcgacgcccataaactggagatctctgatgaattctcagaggccatcggagccctaagggggcacgaggacaagatcagggtggtactcaataaagcagacatggtcgagacccagcagttgatgagagtgtatggggcattaatgtgggcattaggaaaggtggtaggcacccctgaggtcctgcgtgtgtatatcggatctttctggtcccagcctctgcttgtgcccgataaccgcagactgtttgaactcgaagagcaggatctttttcgcgatatccagggcttaccccgacacgcagcgctgcgaaaactgaatgacctggtgaagagggcccgacttgttcgagtgcacgcttatattatctcataccttaagaaggaaatgccttccgtttttgggaaagagaataagaaaaagcagctgatcctcaagctacctgtgatcttcgctaagatacagttggaacaccatatctcacccggtgactttcctgactgtcagaaaatgcaagagctacttatggcccatgacttcactaaatttcactctctcaagcctaagttgctcgaagccttagatgaaatgcttacacacgatattgcaaaattaatgcccctgctgagacaggaagaactcgaaagtacggaggttggagtgcagggtggagcattcgaaggcactcacatgggaccattcgtagagcggggtcccgacgaggccatggaggacggcgaagagggcagtgatgacgaggccgaatgggtggtcaccaaagataaatcaaagtacgatgagatcttttataatctcgctcccgcagatggaaagttgtcaggctctaaggcaaagacgtggatggtgggtacgaaactaccaaactctgtactgggaagaatttggaagctgtctgacgtcgacagggatgggatgctcgacgatgaagagtttgcgttagcctcccacttgatagaggcaaaattggaaggccacggtctcccggctaatctgcctcgccgtttggtgcctccttcgaagcgtcgacataagggcagcgctgaatag

SEQ ID NO: 221810 - DNA, 1242 bp, Artificial Sequence
  Description of Artificial Sequence: Synthetic coding sequence
atgttcagctggcttaaacggggaggcgcacgcggtcagcagccagaagcaatccggaccgtaacttccgcattaaaggagctttacagaaccaagcttctgccactcgaagagcactatcggttcggtgctttccactctcccgcactcgaagatgcagatttcgacgggaaaccaatggtgctggtggctggtcagtacagtacaggcaagacatcgtttatacagtacttattggagcaggaagtgcccggatcccgcgtcggaccggagcccacaaccgactgcttcgtcgccgtcatgcacggtgacacagagggtaccgtgcccggaaacgctctggttgtggacccagataaaccctttcggaagctcaatccttttgggaacacctttctcaaccgcttcatgtgcgcgcagctaccaaaccaagtgcttgaatcaattagtataattgacacccctggaatactctcaggagctaagcagagggtcagtcgcggatacgacttccctgctgtgcttcggtggtttgcagaacgggttgatctcataattctgctcttcgatgcccacaagctggaaatctcagatgagttctccgaagccatcggcgcactccggggtcacgaggacaagattagagtggtgcttaataaagccgatatggtcgagacccagcagttaatgcgtgtgtacggggctctaatgtgggcacttggtaaggtggtaggtacccccgaggtcctgcgcgtgtacattggtagcttttggtcacaaccacttttggtgcctgacaaccggaggcttttcgagctcgaggaacaggatctgttcagagatatccagggcctccccaggcacgctgccctgcgtaagctgaatgatttagtcaaacgggcaagattggtgagagttcacgcgtacatcatcagctacctcaaaaaggagatgccctccgtgttcggtaaagaaaacaagaagaagcagcttattttgaaattgccggtgatctttgcaaagattcagcttgagcatcatatctccccgggagacttccctgattgccagaaaatgcaggagttacttatggctcatgactttacaaaattccactctctcaaaccgaaactgttagaggctttggatgaaatgctgacacacgatatcgctaaactcatgccactcctgcgacaggaggaattggaatcctcccccgtggctgagatgacttcacgctag

SEQ ID NO: 221811 - DNA, 1602 bp, Artificial Sequence
  Description of Artificial Sequence: Synthetic coding sequence
atgttttcctggcttaaaagagggggagcacgcggtcagcagcctgaggcaattcggacagtgacttctgctctgaaggagctgtaccggacaaaactactgcccctcgaagaacattaccgctttggagcctttcatagccccgcattagaagacgccgactttgacggaaaacccatggtgctagtggccggtcagtactcaacaggcaaaacatcttttattcagtacctcttggagcaggaagttcccggttcacgggttgcagttatgcacggggacactgagggaactgtgccaggtaatgctctcgtcgtggatcctgataaaccctttcgcaagctgaatccttttggcaacaccttcctgaacagattcatgtgcgcgcaattacctaatcaggtattagagagtatttctatcattgatacccctggtatcctaagtggcgcaaagcagcgagtgagtaggggctacgattttccagctgtactgcgttggttcgctgagcgcgtggacctgatcatactactattcgacgctcacaaattggagatctcagatgagtttagcgaggccattggtgctcttagggggcacgaggacaagatccgagtagtgctcaacaaggccgatatggttgagacgcagcagctcatgcgggtttacggtgctctgatgtgggcattgggcaaggtggtcggaacgcctgaggtattgagagtttacatcggatcattttggtcgcaacctttgctggtgcctgataaccgtaggttattcgaacttgaggaacaggaccttttccgtgacatccagggtctgcctagacatgccgctctccgcaagctgaatgaccttgtgaagagggcaaggctggtcagagtgcacgcatacataatctcttatctgaagaaggagatgccttctgttttcggtaaggagaataaaaagaaacagctgattctgaagctgccagtcatctttgccaagattcagctcgaacaccacatcagcccaggcgatttcccagactgccagaaaatgcaagagttgttgatggcccacgatttcactaaatttcacagtctcaagcccaaactcctggaagcactggacgagatgctcacccacgacatcgccaagttaatgcctctgctgaggcaggaggagctggagtctacagaggtgggcgtgcaggggggtgcttttgagggaacgcacatggggccttttgtggaacgaggacccgacgaggcaatggaagatggggaggagggctctgacgatgaggccgagtgggtggttacgaaagacaagagcaaatatgacgagattttctacaacctggcccctgccgatgggaaactatcaggcagcaaagcaaaaacctggatggtcggcaccaaactgcccaattccgttctagggcgtatctggaagctgtccgacgttgatcgggatggaatgctggacgatgaggaattcgcccttgcgtcgcacctgatcgaagccaagctggagggtcacggtctcccagcaaacctgcctcggaggcttgttccaccttctaagagacgacataaggggtctgccgagtag

SEQ ID NO: 221812 - DNA, 681 bp, Artificial Sequence
  Description of Artificial Sequence: Synthetic coding sequence
atgccaagcgtgttcggtaaagagaacaagaaaaaacaactcatccttaaactgcctgtgatctttgccaaaattcagttggagcatcatatctcacctggcgattttccggactgtcaaaagatgcaggagctcctgatggcgcacgattttactaaatttcactccctgaagccgaagctgctggaagcactggacgaaatgttgacacatgacatcgccaagttgatgccactcctccggcaggaggagctggagtctaccgaggtgggtgttcagggtggggcattcgaaggaactcacatgggacccttcgtagagaggggacccgacgaagccatggaggatggagaggagggcagcgatgacgaagcagagtgggtggttactaaggataaatctaaatatgacgaaattttctacaacctggccccagctgatggcaaactgtctgggtctaaagccaagacatggatggtcgggaccaagttgccaaactccgtgttggggagaatttggaagctcagtgacgtggacagggacggaatgcttgacgacgaggagttcgcattggcatcccaccttattgaggcaaagcttgaaggccatgggctgcccgcaaacctccccagaaggttagtgcccccatctaagcggcgacacaagggttcagccgaatag

SEQ ID NO: 221813 - DNA, 1608 bp, Artificial Sequence
  Description of Artificial Sequence: Synthetic coding sequence
atgttctcttggcttgggactgatgatagaagacggaaggatcctgaggtgttccagacagtcagtgaaggattgaagaagctctacaagtcgaagctacttcctctcgaagagcactaccgtttccatgagtttcacagcccagccctcgaagatgctgatttcgacaataagcctatggtgcttctcgtggggcaatattccactgggaaaacaacctttattcgctatctgctcgagcaagactttcctggaatgcggattggccctgaacctaccacggactccttcatcgcagtgatgcagggagacatggaggggatcatccccggtaatgctcttgttgtggaccccaaaaagccatttcggaagctcaacgccttcgggaacgcatttctaaaccgcttcgtgtgtgcacagctgcccaacccagttctcgagagcattagcgtgatcgacacccccggtatcctgagcggagagaaacaaaggatcagtcgcggttacgacttcgcagctgtgctagagtggtttgcagagagagtggatcggataattctgctgttcgacgcccataaactcgacatcagtgatgagttctctgaggtcatcaaggctctcaagaatcatgaggacaaaatgcgggtggtgttgaacaaagctgatcagatcgaaacccagcaattgatgcgcgtgtacggagcactgatgtggagtctaggtaagatagtgaacaccccagaagttatccgggtatatattggttccttctggtctcaccctctgttaatcccagataaccggaaattgttcgaggctgaagagcaggacctcttccgggacattcaaagtctaccacggaatgccgctctgaggaaactaaatgatctaattaagcgtgccaggctggccaaggttcatgcctatattatctcatctcttaaaaaagaaatgcctagcgtctttggaaaagacaataagaaaaaagaactggtcaataatttagcagaaatttacgggcgaattgagcgcgagcatcaaattagtcccggtgattttcctaacttaaagagaatgcaagaccagttgcaagcgcaggacttttccaaattccaacccctgaaatctaaactcttggaagtggtcgatgacatgttggcacatgacatcgctcaactaatggtgctcgtgaggcaagaagaaagtcaaagacctatccagatggtcaaggggggagccttcgagggcacattgcacggacccttcggacacggatacggcgagggcgctggggagggcatcgacgatgcggaatgggtggtcgcccgagacaagccgatgtacgatgaaatcttttacacgttatcccccgttgatgggaagataaccggagccaacgccaagaaagagatggtgcgaagcaagctgccaaacagcgtgctcggcaaaatctggaagctggcggacatcgacaaggatggcatgctcgacgatgacgagtttgccctggcaaatcatttgatcaaagtgaaattggagggccatgagctgcccaacgagctcccagctcatttactgccgccatctaagcggaaagtggcggagtag

SEQ ID NO: 221814 - DNA, 528 bp, Artificial Sequence
  Description of Artificial Sequence: Synthetic coding sequence
atgttttcttggttagggaccgatgaccggcgaagaaaggatcccgaggtgttccagacagtgtctgaagggctcaagaagctgtacaaatcaaagctcctcccattagaagagcactatcggttccacgagttccactctcctgcattagaagatgcagatttcgataataagccaatggtgttgctcgtgggacagtactccaccggtaagactacttttattaggtatttgctggagcaggactttccgggtatgcgaatcggcccagaacctacaacggactctttcattgctgtaatgcagggggacatggagggaatcatccctggcaacgcgctcgtggtggatcccaaaaaaccattcagaaagctgaatgcttttggcaatgcctttctgaaccgattcgtttgtgcgcagcttcctaatcctgtgttggaatctatcagtgtcatcgacactccgggtatcctctccggcgagaagcagcgaatctcccggggtcctgcagccggtccagggttgtag

SEQ ID NO: 221815 - DNA, 4086 bp, Artificial Sequence
  Description of Artificial Sequence: Synthetic coding sequence
atgggtgcagcagggaggcaggactttctgttcaaagcaatgctgacgattagctggctgacactgacttgttttcctggcgctacttccaccgtcgccgcaggatgcccagaccaatctccggaattgcagccgtggaacccaggtcacgaccaggatcatcatgttcatattggtcaggggaaaaccctgctactaacatcatctgcaacggtgtatagcatccacatttccgaggggggtaagttggtcattaaagaccatgacgaacccattgtattgcggacgaggcacatactgattgacaacggaggtgagcttcatgcaggctccgccctgtgcccattccaggggaacttcacaatcatcttgtatggcagggccgacgaaggaatacagcctgatccatattatggcttaaagtacatcggggtcggaaaggggggagcccttgagctccacggccagaagaagttgtcatggaccttcctgaacaaaaccctgcacccaggcggaatggccgagggcggatatttcttcgagagatcctggggacaccggggtgtgattgtccacgtcattgacccaaagagcgggaccgttattcactccgacaggttcgacacataccggagcaaaaaggagtccgaacgtctggtccagtacctgaatgctgtgcctgacggccgaatattatccgttgctgttaatgacgagggctctcgaaacctggacgatatggctagaaaggccatgaccaagctggggtccaaacacttcctgcatctaggattcaggcacccctggtcctttctgactgtcaaagggaatccgtcctcgagcgtggaggaccacatcgagtatcatgggcataggggttcagcagctgcccgagtcttcaagctttttcagacagagcacggtgagtactttaacgtgtcactctcgtccgagtgggtgcaggatgtagagtggaccgagtggttcgaccacgacaaggtatcacagacgaaaggcggtgaaaaaatttctgatctgtggaaagcccaccccggaaaaatttgtaatcggccaatcgacatccaggctaccactatggacggagtgaatctgtctactgaagtagtgtacaaaaagggccaggactataggtttgcttgctatgaccgtggaagggcttgccgttcctatagagtcaggttcctttgtggaaaacctgtccggcctaagttaaccgtgaccatcgataccaacgtgaacagtaccatcctaaacctcgaggataatgtacaaagttggaagcccggagatacccttgtgattgcttctactgactactccatgtatcaagccgaggaattccaggtccttccctgtaggtcttgcgcaccaaaccaggtcaaggtggccggaaaacctatgtaccttcacattggcgaggagatagatggcgttgacatgcgcgctgaggtcggtctgctcagccgtaacataatcgtgatgggtgaaatggaggataagtgttacccttaccgcaaccacatctgtaatttttttgactttgatacgtttggcggacacataaagtttgccctcggctttaaggctgcacacctggagggaaccgagctcaagcacatgggtcaacagctcgtaggacaataccctatccacttccatctggccggagacgtcgacgaacgaggcggatacgatcctccaacatacattcgagacctctctattcaccacacctttagtaggtgcgtgaccgtgcacggctccaacggattgttaataaaagatgtggtcgggtacaattcactaggccactgcttcttcacggaggatggccctgaagagaggaacacctttgatcactgcctgggcctgttggtcaagtccggcaccttattaccatccgacagggattcaaaaatgtgcaagatgattactgaagacagttatccgggttatatccctaagcccagacaggactgtaatgccgtcagcacattctggatggccaatccaaacaacaatcttatcaattgtgcagccgctggatctgaggagactggcttctggtttatattccaccacgttcctaccggaccatcagtgggaatgtacagcccaggatacagcgaacacatcccactgggcaagttttacaataatagagctcattctaattaccgggctgggatgattatcgataatggtgtgaagacaacggaggcttccgctaaggacaagaggccctttctgtccattatttccgcaagatattctccacaccaagatgctgacccccttaagcccagggaacctgctattattcgccattttatcgcttacaaaaatcaagaccacggggcatggcttagaggaggagacgtatggctggattcgtgccgcttcgcagacaacgggatcggactgactctagcaagtggaggcacgttcccttacgatgatggatcaaaacaggagataaagaactctctcttcgtgggtgaaagcggtaatgtcggcaccgagatgatggacaaccgaatctggggcccaggcggactggatcattctggcagaacgctacccatcggccagaattttcctattagaggaatacagctgtatgacgggcctattaacatccaaaactgcaccttcagaaagttcgtcgccttagaaggaaggcatacaagcgctctggcgtttcgtcttaataacgcatggcagtcttgcccacataataacgtcacgggaatagcgttcgaggacgttcctatcacctcgagagtgtttttcggtgaacccggaccatggttcaaccaacttgacatggatggcgataaaacttcggtgtttcatgatgttgacggctcagtgagtgagtatcccggttcataccttacaaaaaatgataactggttagtccgccatcccgactgcattaacgtgccagactggcgcggagccatttgctctgggtgctatgcccagatgtacatccaggcctacaaaacctccaacctgaggatgaagattatcaagaacgatttcccaagtcatccactttatctggaaggcgcactgacaagatctactcattaccaacaatatcagcccgttgttacattgcagaagggatataccattcactgggatcaaactgctcccgctgaactcgcgatttggcttatcaacttcaacaagggcgattggattcgcgttgggctgtgctacccccgagggaccacattctcaattctttcggatgtgcataacaggttattgaagcaaaccagcaaaactggcgttttcgtgagaaccctccagatggacaaagtggaacagagctacccagggagatcccactattactgggatgaggatagtggtttgctgttcctaaaactaaaggcacagaacgagcgggagaagtttgccttctgctccatgaagggctgcgagagaataaaaatcaaggctttaatccccaaaaacgccggagtgtctgactgtactgcaacagcttatcccaagtttacagagagggccgtggtggacgttcctatgcctaaaaaactatttggtagccagctcaaaacaaaggaccactttctagaagtgaaaatggaatcctcaaagcagcatttctttcacttatggaatgatttcgcctacattgaggtggacggtaaaaaatatccatccagtgaggacggaattcaggtggtggtaatagatgggaatcagggacgcgtggttagccacacatcttttagaaattctatactgcagggcattccatggcaactgttcaactatgtggccacgatccccgacaacagtatcgtgctgatggctagtaaggggaggtatgtctcacggggtccatggaccagggtgctggagaaactcggcgctgacagggggttgaaactaaaggaacagatggcctttgtgggcttcaagggctcctttcgccctatctgggttacgcttgataccgaggaccacaaggccaaaattttccaagtggtaccaatcccagtggtcaagaagaaaaagttgtag

SEQ ID NO: 221816 - DNA, 1092 bp, Artificial Sequence
  Description of Artificial Sequence: Synthetic coding sequence
atgtctatggacgtcacgtttctaggaacaggcgcagcctaccccagtccgacccgcggagccagtgccgttgtgctcagatgcgagggcgaatgctggctttttgactgcggtgaggggacacaaacacagctgatgaaaagccagctcaaggccggtcggattaccaagatatttatcacacacttacatggggaccatttctttggcttgcccggactcttgtgcactataagtttacagtccgggtctatggtgagcaaacagcccatcgagatttacggtccagttggcctgcgcgacttcatctggcggaccatggagctgagccacaccgagctggtgttccattacgttgtgcacgagctggtccccaccgcagaccaatgcccagcagaggagctgaaggagtttgcacacgtgaacagggccgactctcctcctaaggaggagcagggaaggaccatccttcttgacagcgaggaaaacagttacctgctcttcgatgatgagcagtttgtcgtcaaggcctttaggctcttccataggatcccctcgttcggtttcagtgtggtagagaagaagagaccgggaaagctcaatgcacagaagctaaaggacctgggtgtgcctcctggtccagcgtacgggaagttgaagaacggtatctctgttgtgcttgaaaatggcgtcactatcagtcctcaggatgttcttaaaaaacccatagtaggacgcaagatctgtatacttggggactgttctggggtagtgggcgacgggggagtcaagctgtgctttgaagccgacctgttgattcacgaagctacgctggacgacgcgcagatggataaggccaaagaacacggccatagcaccccccagatggcagccacttttgctaagctgtgtagggccaaaaggctcgtgcttacacatttctcacagagatataaacctgtggccctggcccgagagggtgaaacagacggcatcgcggagctgaaaaagcaggcagagtccgtcttggacctccaggaagtgacactcgcagaagatttcatggtgattagtatcccaattaaaaagtag

SEQ ID NO: 221817 - DNA, 2481 bp, Artificial Sequence
  Description of Artificial Sequence: Synthetic coding sequence
atgtgggcgttgtgttcccttctgcggagtgctgctggcaggacaatgagccagggccgaactataagtcaagctccagccagacgggaacgtccgcgaaaagatccactccggcacctccggacccgcgagaagcgtggtccctcagggtgtagtggcggacccaatacggtctacctacaagtggtagcggcaggatcacgcgattccggcgcagcactctacgtgtttagcgaattcaacagatatttgttcaactgcggagagggggtgcagaggctcatgcaggaacacaaacttaaagtggctagactcgacaacattttccttactcggatgcattggtccaacgttggcggtctctcgggcatgattctcaccctgaaagagaccgggctccctaagtgtgttttgtccggcccacctcagctagagaaatacctcgaggcgatcaagatattcagtggaccactgaagggcatagaactggccgtgaggccgcactccgcaccagagtacgaggatgaaacaatgaccgtatatcagatcccaattcattctgagcaaaggagggggaaacatcagccctggcaatctccagagaggcctctgagccgtctaagtccagagcggtcctctgacagcgagagcaatgaaaacgaaccacatctgccacacggggtctcacagagacgcggagttcgggactctagtttagtggtggctttcatctgtaagctgcacttgaaacggggtaacttcctcgtactcaaggcgaaggagatggggctacccgtaggtaccgctgccatcgcgccaatcatagccgcagttaaggacggcaagagcataacacatgaggggagggaaattttggcggaagagctctgcaccccacccgacccgggtgccgctttcgtggtggtcgagtgccctgacgaaagtttcattcagccgatttgtgagaatgcaacgtttcagagataccaggggaaagcagatgcgccagttgccctggtagtccatatggcccctgctagcgtgctggttgattctcgctaccaacagtggatggaaaggttcggaccagacacccagcatctggtgttaaacgagaactgcgccagtgttcataacctcaggagccacaagattcaaacccagcttaatctgatacatccagatatcttccccctgttgacgtcgttcaggtgcaaaaaagaaggtccaactttatccgtcccaatggtgcagggagaatgcctgctgaagtatcaactcagaccaaggcgagagtggcagcgggacgctatcattacctgtaacccggaggagttcatcgtggaagccctgcagcttcccaacttccagcagagtgtacaggaatatcgcaggtctgcacaggatggtcctgcacccgctgaaaagcggagccagtaccccgaaatcatctttcttgggacgggaagcgccatcccaatgaaaattaggaatgtgagtgcaaccctcgtcaatatctcaccagataccagcctcctcctggactgtggtgagggaacatttggtcagctctgccgccactatggggaccaagtggaccgtgtgctgggaaccctcgcggctgtatttgtctcacacctacatgccgatcatcataccgggctgccatctattcttctgcaacgagaacgggctttggcttctctgggtaaacccctgcaccctttacttgtcgtggctccaaatcagctcaaagcttggcttcaacagtaccacaaccaatgccaagaggtgttacaccacatcagcatgatccccgctaaatgccttcaggagggggctgagatctcgtcgcccgcagttgaacgcctgatctccagcttgctgcgcacgtgcgatctggaggagtttcagacttgtctggtccgccattgtaagcacgcttttggctgcgcactggtccatacaagcggttggaaagttgtgtatagcggagacaccatgccttgcgaagccctggtgaggatgggcaaggacgccacactgctcatccatgaggcaaccctggaggacggattggaggaggaggctgtggaaaaaactcattctacaaccagtcaagccatctctgtggggatgcgaatgaatgctgagtttatcatgctcaaccatttcagtcagagatatgccaaggtgccgttattttcacccaacttttccgagaaagtgggggtagcttttgatcacatgaaagtctgtttcggagatttcccaacaatgcctaagctgatcccacctctcaaggcactctttgctggtgacatcgaagagatggaagaacgcagagaaaaacgtgagttgagacaagtaagagctgctctgttaagtcgagaacttgctgggggtctcgaagatggagaaccgcagcagaaacgggctcacacagaggagccacaggccaagaaggtgcgggcacaatag

SEQ ID NO: 221818 - DNA, 2424 bp, Artificial Sequence
  Description of Artificial Sequence: Synthetic coding sequence
atgtgggcgctctgcagcttgctccgttctgctgctgggagaaccatgtcacaaggcagaacaatctcacaagcacccgctagaagagagaggcccagaaaggacccattgagacacctccgcactagggaaaagaggggcccttcaggatgttctggtgggccaaataccgtttatcttcaggtcgtggcagccggttcccgagactcaggtgtgcagagactcatgcaagaacacaaactcaaggtggccagattggacaatatttttcttactaggatgcactggtccaatgtcggcggactctcaggcatgatcctcaccttaaaagaaacgggcctacctaagtgcgtgctgagcggtccaccccagttggagaaatacctcgaagcaattaagatctttagcggacccctcaaagggatcgagttggcggtcaggccccatagtgcacctgaatacgaagatgaaaccatgaccgtgtaccaaatccccatccacagcgagcagagacgcggaaagcaccagccatggcagagccctgaacgacccctttcccgtctgtctccggaacgttcaagcgacagcgaatccaatgaaaacgagcctcatttgccccacggggtgtcacagaggcgcggagttcgagacagctcattggtagtggccttcatatgcaagctccacctgaaacggggtaactttttggtgctgaaagctaaagagatgggactaccagtgggcacagctgccatcgcccctatcatagctgccgtcaaagatggcaagtcgattacccacgaagggagagaaatcctggcagaagagctgtgcactcctcccgatccgggagcagctttcgtcgtggtggagtgtcccgacgagtcttttattcagccaatttgcgagaatgccacatttcagcggtaccagggtaaggctgatgcaccagtcgcgcttgttgtccacatggctcccgcaagcgtcctcgtagactcgcgctaccagcaatggatggagaggtttggccctgacacacagcatctggttctgaatgagaactgcgcctcagtacataacttacgctctcacaagatccagacccagctgaacctgattcacccagatatcttccctttgctgacatccttcaggtgtaaaaaggaaggaccaactttatctgttcccatggtgcagggcgaatgtctgctcaaatatcagcttagacctaggagagagtggcagcgcgacgcgatcatcacctgtaaccccgaagagttcattgtggaggcactccagctacccaattttcaacagtccgtgcaggagtataggcggagcgcacaggacgggcctgctcccgcagagaagcggtcacagtatcccgaaattatctttctcgggaccgggtcagctatccctatgaaaatcagaaacgtgagcgcgactctcgtgaatatctcccctgatacctccctgctgctagactgcggcgaggggacatttgggcaactttgccgccactacggggaccaagtcgatcgggtgcttgggacgctggccgctgtctttgtttcccacctccatgccgaccaccacacagggctccccagtatcctccttcaacgagaacgggctctcgctagccttggcaagcccctgcaccccctgctagtggtcgctccaaatcagctcaaggcgtggctgcagcagtaccataatcagtgccaggaggttctccaccatatcagcatgattcccgcaaaatgcctccaggaaggcgcagagatttcttctcccgcagtggaacgcctcatctcctcattactgaggacctgcgatctggaggaattccagacttgcttggttcgacactgtaagcacgcattcggctgcgctcttgtgcataccagtggttggaaagtggtgtattctggtgacactatgccctgcgaagctctcgtcaggatgggcaaggacgccaccttgctgatccatgaggccacactggaggacggcctggaggaggaggctgtggaaaagacacatagcacgacctctcaggccatcagcgtgggcatgcgcatgaatgccgaatttatcatgctgaatcatttctcccagcgctatgccaaagtgccactcttttcccctaacttttcagagaaggttggggtcgcctttgatcacatgaaggtgtgcttcggggactttcccactatgccgaaactgataccccctcttaaagctctcttcgcaggcgatattgaagagatggaagaaaggagagagaaaagggaattgaggcaggtacgagccgctctgctgagccgtgagctggcaggaggactggaggatggcgagccccagcagaagagagcacacaccgaggaaccgcaggcaaagaaggttcgagcacaatag

SEQ ID NO: 221819 - DNA, 2361 bp, Artificial Sequence
  Description of Artificial Sequence: Synthetic coding sequence
atgtgggctctgtgttctctgctaagaagtgccgctggtcgcactatgagccagggcagaacaatttctcaggccccagcgagacgtgaaaggccacggaaggatccgcttcgacacctacggaccagagagaagcgcggtccgtcggggtgtagtggaggcccaaacactgtatacctgcaggtggtcgccgcaggtagccgcgatagtggcgcagccctgtacgtcttcagcgagttcaatcgttatctttttaattgtggggaaggggtgcagcgccttatgcaggaacataagctgaaggtggcgcgattggataacatctttctaacccgcatgcactggagtaacgtgggaggcctttccggaatgattctgacccttaaagagaccgggctccccaagtgtgtactttcgggcccaccccagcttgagaaatacttggaggccatcaagatcttttcaggccctcttaaaggcatcgaactagctgttaggccacattcggctcccgagtacgaagacgaaacgatgactgtttatcagattcctattcactcagtaagccaacggagaggcgtgagagactcgtcattggttgtggctttcatctgcaagttgcacctgaagcgtgggaattttttggtgctgaaagccaaggagatgggcctcccagtggggaccgctgccattgccccaataatagctgcagttaaagacggaaaatcgattacgcatgagggacgcgaaattctcgccgaggaactctgcaccccacctgatcccggtgccgcttttgtggtggtcgagtgcccggacgagtccttcattcagcccatttgcgaaaatgccaccttccaacgctaccaagggaaagccgacgctccagtggcgctggttgtccatatggccccagcttcagtgctcgtcgactctcggtatcaacagtggatggagcgattcggccctgatacccaacacctggtcctaaatgagaactgcgcctctgtgcacaatctgcgttcgcataagatccaaacacagctgaatctgatacatccagatattttcccactcctgacatcgttccggtgcaaaaaagagggcccaaccctcagcgttcccatggtgcagggtgagtgcctccttaaatatcagctcagaccccgacgggagtggcaaagagacgccatcatcacctgcaacccagaggagtttatagtggaggctctgcagctcccaaacttccagcagtccgtgcaagagtatcgcaggtccgctcaggatggtccagcacctgcagagaaaagaagccagtatcccgaaattatcttcttgggcacaggatctgcgattcccatgaagatccgcaacgtgagtgccacattggttaatatcagccctgatacttcgctcctgctcgattgcggagaaggcacattcgggcagctgtgtagacattacggtgaccaagttgacagagtgctggggaccctggctgctgtcttcgtgagtcacttgcacgcggaccatcacaccggcctgcccagcatcctgctccaaagagaacgggctttggcctcccttgggaagccgctgcatccactacttgtcgttgctcctaaccagctcaaggcttggttacagcagtaccataatcagtgccaggaggtgttgcaccatatatcgatgatccctgctaaatgcctccaggagggggcagaaatcagctcacccgcagtcgaaagattgatttctagcctgttacgcacatgcgatctcgaggagttccagacatgtctggtgcgacactgtaagcacgcctttgggtgcgcacttgtacacaccagtggatggaaggtggtgtatagtggcgacacaatgccctgtgaggcattggtgagaatgggcaaagatgctaccctgctaatccacgaggcaacacttgaagatgggctggaggaggaagccgtcgagaaaacacacagtactacaagtcaagcaatctctgtgggaatgcgcatgaatgcagagttcatcatgctgaatcatttctctcagcggtatgctaaggtgccactcttttctcccaacttctcagagaaagttggagtcgctttcgaccatatgaaggtttgttttggggactttccaaccatgccaaaactcataccacctctgaaagccttgttcgccggagatatagaggagatggaagagcgaagagagaagcgggaacttagacaggtcagagccgctcttctgagcagggagttagctggaggcctggaggacggggagccccaacagaagcgtgcacacacggaggagccccaggccaaaaaggttagagcccagtag

SEQ ID NO: 221820 - DNA, 861 bp, Artificial Sequence
  Description of Artificial Sequence: Synthetic coding sequence
tagccacatggggtgtcacagaggaggggagtccgcgatagctcacttgtagtggccttcatctgcaagctgcatttgaagcgaggcaatttcctggtgctaaaggccaaggagatgggccttcccgttggcaccgctgctatcgcccctatcatcgcggcagtaaaggacggcaagtccattactcacgaagggcgagaggtcctccaaatcctggctgaagagctttgcacgccacccgatccaggagctgcctttgtggtggtggagtgtcctgacgagtcttttattcaacctatctgcgagaatgctacctttcaaagataccaaggtaaggctgacgcacccgtggcgctagtagtacacatggccccagcctccgttctggtggattctcgatatcagcagtggatggaaagattcggccctgacacccagcatctggttttgaatgagaattgcgcgagcgtccacaaccttagatcccataagattcaaacgcagttaaacctcatacatccagacatattcccactcctcacaagttttcgatgcaagaaagagggacctacactgtccgttcccatggtgcaaggagaatgccttctgaagtaccaactgcgcccacggcgtgaatggcagcgagacgctatcatcacatgtaacccagaagagtttatcgtcgaggccctacagcttcccaacttccagcagtctgtccaggaatacaggaggtcagctcaggatgggcctgcacccgcagaaaagcgaagtcagtaccctgagatcatcttcttagggactggttctgccatccccatgaagattagaaatgtgagtgccacacttgtgaatatatag

SEQ ID NO: 221821 - DNA, 837 bp, Artificial Sequence
  Description of Artificial Sequence: Synthetic coding sequence
atcctcgccgaagagctgtgcaccccacctgatcctggtgctgcttttgtggttgtggagtgcccagacgaatcctttattcagcccatatgcgagaatgctacgttccagcgttttggccctgacacgcagcatctggtcttaaacgagaattgtgcttctgtgcacaacttgaggtctcacaagatacagacccagctgaatctgatacatcccgatatctttcccctgctgacctcttttaggtgtaaaaaagagggccctacgctctccgtgcctatggtgcagggagaatgcctcctcaaatatcagctccgtcctcgacgagaatggcagagagatgcaatcatcacctgcaacccggaagaattcattgtcgaagcgttgcaacttcccaatttccaacagtctgtacaagagtatcggagatctgcccaggacggccctgcgcctgcagaaaaacgtagccaatacccagaaatcattttcctggggaccgggtccgcgattcctatgaagatacgtaacgtctccgcaacactggtgaatatctctccggacactagtcttttattggattgcggcgaggggacttttggacaactgtgccggcactatggagatcaggttgatcgcgtgcttgggacccttgccgcagttttcgtgagccatctgcacgcggaccaccatacgggactcccatctatacttctacagagggagcgggctctggctagcctgggcaagcctcttcatccgcttttggtggtggctccaaaccagcttaaggcctggctgcagcagtatcacaatcagtgtcaggaagtcctgcactag

SEQ ID NO: 221822 - DNA, 804 bp, Artificial Sequence
  Description of Artificial Sequence: Synthetic coding sequence
atgaccctgggacgcagacttgcttgtttatttctggcctgcgtgctgccagctctcctgcttggtggcaccgccctggcatcggagattgtaggcggaaggcgagccagaccacacgcatggccttttatggtgtcattacagttacgcggtggccacttttgcggcgctacactgattgcccctaactttgttatgtctgccgcacactgcgtagccaatgttaacgtgcgagctgtgagggtcgtgctgggagcgcataatcttagtaggagggaaccgacgcgtcaggtgtttgccgttcagcggatttttgagaatggctacgatcccgttaaccttctaaatgatatagtgattcttcagctgaatggttcagcaactatcaatgccaacgtgcaggtcgcacaactccccgcacagggacgacgactgggaaatggagtgcagtgtctggccatgggttggggtttactggggcgaaatcggggaatagcttcagtcctccaggagctgaatgttacagttgttaccagcttgtgtcgcaggagcaacgtctgtactttggtccgaggacgtcaggccggagtgtgtttcggggactcgggatccccactggtttgcaacggcctcatccacggaattgcgtccttcgtacggggtgggtgcgcctccgggttgtacccggacgcgtttgccccagtggctcagtttgtaaactggattgatagcatcatacagcggagcgaagataatccatgtcctcaccccagggaccccgacccagcatcccgaacacattag

SEQ ID NO: 221823 - DNA, 804 bp, Artificial Sequence
  Description of Artificial Sequence: Synthetic coding sequence
atgacattgggacgaagactcgcttgcctattcctagcctgcgtgcttccggctctcctgctcggcggtacagcgcttgctagtgagattgtcggcggtagaagagcccgaccgcacgcctggcccttcatggttagcttgcagctgagagggggtcacttttgcggagccacactcattgccccaaattttgtgatgtccgccgctcattgcgttgctaacgtgaacgtccgcgcagtccgggtggtcctcggcgctcacaatctctctagacgtgaacccaccagacaggtcttcgccgtgcagcggatcttcgagaacggctacgaccctgttaatctgctgaatgatatagtgatacttcagcttaacgggtcagcaacaatcaatgcgaatgtccaggtggcacagctgcctgcacagggcagacggctcggaaatggtgtacaatgcttggccatgggctggggcttgctgggacgtaatagggggattgccagcgtcttacaagagttaaatgtaactgttgtaacttccctatgtcgtcgatccaacgtgtgcacccttgtcagaggcagacaggccggtgtgtgcttcggggatagcggatcccctctagtgtgcaatggacttatacacggaattgccagcttcgtaaggggaggatgtgcttccggcttataccccgacgctttcgcccctgtcgctcagttcgtcaactggatcgactcaatcatacagagatcagaagacaacccctgtccccacccacgggacccagatcccgcttcacggacacattag

SEQ ID NO: 221824 - DNA, 3051 bp, Artificial Sequence
  Description of Artificial Sequence: Synthetic coding sequence
atggcacctcgtacattatggtcatgttacctatgctgtttgctgaccgccgcagcaggagccgcatcatacccccctcgagggttcagtctatatacaggttcctctggcgctctctcccccggtggtcctcaggctcaaatcgccccaaggcctgccagtagacatagaaattggtgtgcgtacgtcgtcacacggaccgtgtcctgcgtgttggaagacggcgtggagacgtatgtcaaatatcagccttgcgcgtggggccagcctcaatgcccccagtcaatcatgtataggaggtttttgaggccccgatacagagtagcctataaaacagtgacagatatggagtggcgctgctgtcaggggtatggcggagacgactgtgccgaatcccccgctccagccttagggcctgcttcctcaacgcccagaccattggcccaacctgcacgccctaaccttagcgggtcctctgccggatccccgctctccggtttagggggtgaaggcccaggcgaatcggagaaagtgcagcaattggaggagcaagtccaaagtctcacaaaagagctgcaggggttgcgtggcgtcctgcaaggcttgagtggaaggctggctgaagacgtgcaacgcgcagttgagaccgccttcaatggcaggcagcaaccggctgatgccgcagccaggccaggtgtgcacgagacactgaacgaaattcagcaccagttgcagcttctggatactcgggtaagcacccacgatcaggaactggggcacttaaataaccaccatggtggctccagcagctctggcggttcaagagctcctgcccctgcctctgcaccacctgggccatcagaggaactattacgccaactggaacaacgcttacaggagagttgttcggtgtgcctggccggtcttgatggatttcggcgtcagcagcaagaagatcgggagcgcttacgggcaatggaaaaacttctggcctccgtagaggaaaggcagcgacacttggcagggctggccgtgggtagaagacccccacaggaatgctgtagccccgagcttggcaggcgacttgctgaactggagagacgcctggatgtggtcgccggttcagtcacagtgctgagcggtcgcaggggaactgaactcgggggtgccgctgggcagggcggacatcctcctggttatacttcactcgccagcaggctctctcgcctagaggaccgcttcaactcaaccttagggccatccgaagagcaggaggaatcttggccaggggcacctggcggtctgtctcattggctgcctgctgctcggggtcgcctggagcagcttgggggactcctggccaatgtgtcaggtgagctgggcggacgtctggacttgttagaagagcaagtggcaggcgcaatgcaggcgtgcggtcagctctgcagcggggctcccggagaacaggactcacaggtctcagaaatcctgtctgccctcgagaggcgcgtgctggacagcgaaggtcagctccggctggtcggatctggattgcacaccgtcgaggctgcaggagaagccagacaagccactttagagggcctgcaggaagtcgtgggtagactccaggatcgggtggacgctcaggatgaaacggccgcagagttcaccttaagactcaacttgaccgccgctcgactaggacagctcgaaggcctactgcaggcccacggcgatgaggggtgcggcgcatgcgggggtgtgcaagaggaactgggcagattgcgtgatggtgttgagcgctgtagttgccctctgctccctccgaggggaccgggtgccggaccaggcgtaggcggaccgtctcggggacccctcgatggcttctcagtgttcggcggatccagcggaagtgcgctacaggcattacagggagagttatccgaagtgattttaagtttcagtagtcttaacgactcccttaatgaattgcagacgaccgtggaaggacagggggctgacctggctgatctcggagcgacgaaggatcggatcatttccgagattaatagacttcagcaagaggctaccgagcatgctaccgaaagcgaggaaaggttccgcggactggaggagggacaggctcaggccggacagtgtcccagtctagagggcagactcggccgacttgagggagtttgcgaacgcctggacactgtcgctgggggactacagggcttgcgcgagggactctccaggcatgtcgctggtctttgggccggattgagagagaccaataccacatcgcagatgcaggccgctctgctcgaaaagctggtcggtggacaggccggacttgggagacgtctcggggctctgaacagcagtctccaacttctggaagaccggttgcatcagttgtccctgaaagatctgactggacctgcgggagaggctggcccacctggcccacccggactgcaagggccacccggacccgctggaccgccaggaagcccagggaaagacgggcaggagggaccaattggaccgccaggaccgcagggcgagcagggggtcgaaggagccccagctgccccagttccccaggtagcatttagcgctgctctatctttgcccagatcagagcccggaacagttcccttcgacagagtgctcctgaacgatggcggatactacgatcctgaaacgggagtcttcacggccccactcgcaggtcggtacctgttatctgcagtgctgaccggccatagacatgaaaaagtggaggctgtattgtcaaggagtaaccagggagtcgcaagggttgattcaggtggctacgagccagaaggcctggagaacaaacctgtggctgagtctcagccgagcccaggtactctgggcgtgtttagcctaatccttcctcttcaggcaggtgatactgtctgcgtggatttagttatgggacagctcgcacattccgaagagcctctgacgattttttcaggggctctgctatatggagatccggagctggaacacgcttag

SEQ ID NO: 221825 - DNA, 1044 bp, Artificial Sequence
  Description of Artificial Sequence: Synthetic coding sequence
atggccgatctgggtgccactaaggacaggatcatcagcgaaattaatcgtttacagcaggaggcaaccgaacacgcgactgagagcgaagaaagattccggggactggaagagggacaggcccaggcgggacagtgcccatctcttgaagggagattggggcgattggagggcgtgtgcgagcgcctcgacacagtcgccggaggacttcagggcctgcgtgaggggctatctaggcacgtggcgggtctatgggcgggtctccgggaaactaacacgacttctcagatgcaggccgcactgctggagaaactggtggggggacaggccggattgggcaggcgcctgggtgccttgaatagctccctccagttactggaggatagactgcaccagttgtctttaaaggaccttaccggcgaaggcacaaaggggcctgccggagaagctggtccgcctggaccaccagggctgcagggtccgccaggaccagcaggcccaccagggtcacccggaaaggacggccaggaaggcccaatcggccctcctggtcctcaaggagaacagggggttgaaggcgcacccgctgctccagtccctcaagtggcatttagcgctgccctgagcttacctaggtccgaaccagggacagtcccattcgaccgagtgctgttaaatgatgggggatactacgaccccgaaaccggagtgttcaccgccccactcgcgggacgctatctcctgtccgcagtgctcaccggtcaccggcatgagaaagtggaggccgttcttagtcggtcaaaccagggggttgcgagggttgactctgggggatacgaacccgaagggctcgagaataagccagtagctgagagtcagcctagtcccggtacacttggtgtgttctcactgatactgcccttgcaggctggcgatactgtctgcgtggatctagtgatgggacaacttgcacatagcgaggaaccactgacgatctttagcggtgcacttttatacggagatccagaattggagcacgcttag

SEQ ID NO: 221826 - DNA, 1062 bp, Artificial Sequence
  Description of Artificial Sequence: Synthetic coding sequence
atgggttctgggggtaggagcgcccaggtgtctacaggacagcgggcatggctgctgccctgccgcttcctcaagaacacaatgagcaatggatatgaagatcatatggctgaggattgtagaggggacatcgggaggacgaatctgatcgtcaattacctgcctcagaacatgacccaggacgagctgcgatccctcttcagctcaatcggggaagtagagagtgctaagctcatacgggataaggttgcagggcactcacttggttacggctttgtaaattacgtcaccgccaaggatgcagagagggctatcaataccctgaacggcttgaggctgcagtctaaaactattaaagtgagttacgccagacccagctccgaagttatcaaggatgctaatctctatataagcgggctgccccgtacaatgacgcaaaaagacgtggaagatatgttctctcggtttggcagaatcatcaattctagagttctggttgatcagacaacgggactgtcccggggagttgcatttattagattcgataaacggagcgaagcagaggaggccattaccagttttaatggccataaacccccaggttcgtcagaacccatcaccgtcaaattcgccgctaacccaaaccagaataagaacgtcgccctcctgagtcagctgtaccatagcccagcacgcagattcggcggtccagttcatcaccaggcgcagcggttcagattctcccccatgggcgttgatcatatgtccggtctgtccggggtgaatgtgccaggaaatgccagctcgggatggtgtatcttcatttataatctcggacaagacgccgacgagggtatcttgtggcagatgttcggtcccttcggtgccgttaccaatgtgaaggtaattagggactttaacacaaataagtgcaaggggtttgggttcgtcacaatgacgaattatgaggaggctgccatggccatcgcctccctgaacggttacaggctaggagataagatactgcaagttagtttcaagacaaacaagagtcacaagtag

SEQ ID NO: 221827 - DNA, 981 bp, Artificial Sequence
  Description of Artificial Sequence: Synthetic coding sequence
atgagcaatggctacgaagaccacatggccgaggattgtagaggtgacatcggaaggacaaacttaattgtgaattacctgccccagaacatgacacaggatgagctccgatccttgtttagttctatcggcgaggttgaatccgcaaagctcattagggacaaagtcgcaggtcacagtttgggctatggattcgtaaattacgttaccgctaaggacgcagagcgtgctatcaatactctgaacggcttgcggctccagtctaagactatcaaggtttcgtatgcccgaccctcgtcagaggtgatcaaagacgcaaatctgtacatctctggccttcctcgcactatgacacagaaggacgtggaggatatgttttcccgtttcggtcggataatcaatagccgtgtgctggttgatcagactaccggcttgtccagaggggtggccttcattaggttcgataagcggagtgaggcggaagaggctataacctctttcaacggacacaagccaccaggtagctctgaacccataacagtgaaattcgccgcaaacccaaatcaaaataaaaacgttgctcttctcagccagttgtaccacagcccagccaggagatttggtggtcctgtgcaccatcaggcgcaacgattccgatttagcccaatgggcgtggaccatatgtctgggctctcaggcgtgaacgtacccggtaacgcatccagcgggtggtgcatcttcatttacaatttaggtcaggatgctgacgaaggcatcctctggcagatgtttggcccattcggagcagtaacaaatgtgaaggttatcagagactttaacactaataagtgcaaaggttttggattcgtcacaatgacaaattacgaggaggctgctatggctattgcctcgttgaatggctatagactgggtgataagatcttgcaggttagttttaaaaccaataagagtcacaagtag

SEQ ID NO: 221828 - DNA, 828 bp, Artificial Sequence
  Description of Artificial Sequence: Synthetic coding sequence
atgtccagtctgcacaagtcgaggattgctgactttcaggatgttttgaaagaaccttccatcgctctcgaaaagctgcgagagctgagtttctccgggatcccctgtgaaggtgggctgcgttgcctctgttggaaaatcctgttaaactatctcccgctggagcgggcatcctggacgtctattctggccaagcagagggagctgtacgcgcagttcctccgcgagatgatcattcagcccggaatcgccaaggctaacatgggggtgagtagggaggacgtgacctttgaagatcaccccttaaatcctaatcccgactcacggtggaatacctattttaaggataatgaggtcctgcttcagatagacaaggacgtgaggagactctgtccagacatctcattttttcagcgtgctacagactatccttgcctgctcatcttggatccgcagaacgaatttgaaaccctgagaaagcgtgtcgaacagactaccctgaaaagccagactgtggctcgaaataggtccggagtgacaaatcaggaacagaatattaagccacagttttttgccttcagatggctgaccctcctcctatcccaggagtttctccttcccgacgttattaggatttgggattcactgtttgccgatgacaatcggttcgacttcctgctgctagtctgttgtgccatgctgatgctaatcagagagcaactcctcgaaggcgactttacagtgaacatgcgcctgctccaggactaccctatcacggacgtgtgccagattctgcagaaagccaaagaactccaggactcaaagtag

SEQ ID NO: 221829 - DNA, 1164 bp, Artificial Sequence
  Description of Artificial Sequence: Synthetic coding sequence
atggccgtgcgactctgtgacgtcgcgagtcttttacggtctggcagctgggccgcagaaccttggaccggtgtgattgctgctatggaaactcagctgtccaacgggcctacctgtaataacacagctaacgggccaaccacgatcaataacaactgcagctcgcccgtggactccggcaacactgaagactccaagactaaccttatcgtgaactacctgccacagaatatgactcaagaggaactgaagtctttgtttgggtctatcggagagattgagagctgcaaattagttcgcgataaaatcacagggcaatccctggggtatggtttcgtgaattatatcgatcccaaggatgccgagaaagccatcaatacgttgaacggcctaagattgcagactaagacaattaaggtgagctatgcacgaccatcgtccgcctccatccgggatgctaacttgtatgtgtcaggtttaccgaaaactatgacccaaaaagagttggagcaactgttctcgcaatatggtcgtatcattacttctcgaatcttagttgatcaagttacgggcatatccaggggggtgggtttcatcaggttcgacaaacggatcgaagcagaggaggcaattaagggcctgaatgggcaaaagcctcccggagccacagaaccaattaccgttaagttcgctaataaccctagtcaaaagacaaatcaggcaattctgtcccagctttaccagagccccaataggcgatacccagggccactcgcccaacaggcccagcgattccgccttgataacctcctgaacatggcctacggggtcaagcgcttttctcccatgactattgacgggatgaccagcctcgccggaatcaatatacccggtcatcctggcacaggctggtgcattttcgtttataatttagcccctgatgcggatgaatcaatcctgtggcagatgtttggtccctttggggcagttacaaacgtgaaagttatcagggactttaataccaacaagtgtaagggatttggctttgtgacaatgacaaactacgatgaagccgcaatggccattgcctcattgaatgggtaccgcttaggggacagagtgctccaggtaagcttcaaaacaaacaaaacgcacaaagcctag

SEQ ID NO: 221830 - DNA, 1041 bp, Artificial Sequence
  Description of Artificial Sequence: Synthetic coding sequence
atggaaacacagttaagcaacggtcctacctgcaacaacactgctaacgggcctactacgattaataataactgttcctcaccggtagattctggcaacacagaagacagcaagacaaatttaatagtgaactatctcccccagaacatgacccaagaggagctcaagagcctttttgggtcaatcggagaaatcgagtcttgcaaactggttcgagacaagatcacagggcagagcctcggctacggatttgtcaactacattgatcctaaggacgcagagaaagccatcaataccctgaatggtctccgcctgcagacgaagaccataaaagtctcctacgcacggccttcctcagccagtatccgtgacgccaatctctatgtcagcggattaccaaagacgatgacacaaaaggagttagagcagctgttttcccaatacgggcgtatcataacctccaggatcctggtggatcaagtgacgggcattagccgtggcgtggggtttattagattcgacaaaagaatcgaggccgaggaggccattaagggtctgaatggccagaaaccccctggagccacagagccaatcaccgtgaaattcgctaataatcctagccagaagaccaaccaggcaatcctgagccaactttaccaatctccaaatcgacggtatccaggtcccttagcacagcaagctcaacgtttcagatttagcccgatgacaattgacggaatgacttcactggccggaatcaacattcctggacatccaggaacagggtggtgtatattcgtgtacaaccttgcaccagacgcagatgaatccattctctggcagatgttcggtccgttcggagccgtgactaatgtaaaggttattagggattttaacaccaacaagtgcaaaggatttggcttcgtgacgatgaccaactacgatgaggctgccatggctatagcctccttaaacggttacaggctgggcgaccgcgtgctgcaggtttctttcaagacaaacaaaacccataaggcctag

SEQ ID NO: 221831 - DNA, 1080 bp, Artificial Sequence
  Description of Artificial Sequence: Synthetic coding sequence
atggagactcagttgagtaatggtcctacttgcaacaatacagcaaacgggccaactacaataaacaacaactgcagctcaccagtagactcaggtaacactgaagactctaaaacaaatttgattgtcaactacttgccccagaacatgacacaagaggaactaaaaagcctattcggctccatcggggaaatagagtcttgtaagctggtgcgggacaaaatcaccgggcagagtctgggctacggattcgttaattacatcgaccccaaggacgctgagaaagccatcaacaccttgaacggtctccggttgcaaaccaagaccattaaagtgagctatgccaggccctcctccgcatcaattcgtgatgccaatttatacgtgtctgggctgccgaagacaatgacacagaaggaactggagcaactattctcccagtatgggaggattatcaccagcagaatcctagttgatcaggttacagggatcagccgtggagttggcttcatcagatttgataaacggatcgaggccgaagaggccatcaagggattgaatggccagaaaccgcctggagcaacggaaccaataaccgtgaagttcgccaataaccccagtcagaagacgaatcaggcaatcctttctcagttgtaccagtccccgaacaggcggtatcccggaccactcgcccagcaggcacaaagattccgccttgataacctcctcaacatggcttatggcgtcaagagattttcaccgatgacaatcgatggcatgacatctctggctggcatcaatatcccgggacaccctggcaccggttggtgcattttcgtgtataatttggcacctgacgcagacgaatcaattctctggcagatgtttggaccatttggcgctgtgactaatgtgaaagtcatccgcgatttcaacaccaataaatgtaaaggtttcggcttcgtgaccatgaccaactatgacgaagcagcaatggcgatcgcctcgctcaatgggtacagactgggtgatagagtgttgcaggtcagctttaaaacgaacaagacccacaaggcctag

SEQ ID NO: 221832 - DNA, 1080 bp, Artificial Sequence
  Description of Artificial Sequence: Synthetic coding sequence
atggagacgcaattaagcaatggacctacctgtaataatacagcgaacgggcctaccacaataaataacaactgcagctcccctgtggactccggaaatactgaagattccaagactaacctgatcgtgaattatctgccccaaaacatgacccaagaggaactcaagtcccttttcggtagcataggtgaaatcgagtcatgcaagctggtccgtgacaagatcacaggacaaagcttaggatatgggttcgtgaactacatcgatcctaaggacgccgagaaggctatcaacacactgaacggtctgaggctgcaaaccaaaacgattaaggttagctacgctcggccttcttcggcctctatccgagacgccaacctgtatgtgtctggtctgcccaagactatgacccagaaagagctcgaacaactgttcagccagtacggcagaatcatcacgtcccggatcctcgtggatcaagttactggcatttctcgtggcgttggatttatccgctttgacaagcggatcgaggccgaggaggctattaagggcctgaatggccaaaaacctccgggagctacagaacccatcactgtgaaattcgctaataaccctagccagaagacgaaccaggctatactctctcagctgtaccaatcccctaaccggcgttacccagggccattagctcaacaggcccagcggtttcgtttagataatctcctaaacatggcttacggagtgaagagattctctcctatgaccatagacggcatgacttctttggccggaatcaatattcccggacaccctggaactggatggtgtatattcgtgtataacctggctcctgatgcagacgagtctatcctgtggcagatgtttgggccatttggggctgttactaatgtgaaagtcatcagagatttcaatactaataagtgcaaggggttcggcttcgtgacaatgaccaactatgacgaagcagctatggcaatcgccagcctcaatggctaccgactgggggatcgcgtcctccaagtgtcctttaagactaacaaaactcacaaagcatag

SEQ ID NO: 221833 - DNA, 273 bp, Artificial Sequence
  Description of Artificial Sequence: Synthetic coding sequence
atgactcaaaaggaactggagcagcttttctcccagtatgggcgtatcattactagcagaattttagtcgatcaggtcaccgggataagtaggggggtgggattcatacgttttgacaaacgcattgaggccgaggaggcgatcaagggactaaatggccagaagcctccaggtgctacagagccaatcactgttaaatttgcgaacaacccaagtcagaagacgaaccaagccatcctcagtcagctgtaccagtcgccaaaccgtcggtag

SEQ ID NO: 221834 - DNA, 570 bp, Artificial Sequence
  Description of Artificial Sequence: Synthetic coding sequence
atggaaactcagctgtccaacggccctacatgcaataacaccgctaacgggcctaccactatcaataacaactgctcctcgccagtcgacagcggcaataccgaggactcgaaaaccaatctcatcgtcaattatctgccccaaaatatgacacaagaagagctcaaatcattgttcggttccatcggcgaaattgagagctgcaagttagtccgtgacaaaataaccgggcaaagccttggctatggatttgtcaattatatagacccaaaagatgcagaaaaggctattaatacattgaatggcttgcggctccagacgaaaactatcaaagtgtcatacgctcggccttctagcgcaagtataagggacgccaacctatatgtttccggtctccccaaaactatgacacaaaaagagctggaacagctcttttcccagtacgggaggatcataacttctaggattctcgtagatcaggtaactgggatcagcaggggtgtcggcttcattcgttttgataaaaggattgaagcagaggaggcaataaaaggcctcaacggccagtag

SEQ ID NO: 221835 - DNA, 1080 bp, Artificial Sequence
  Description of Artificial Sequence: Synthetic coding sequence
atggagacacagctctcaaacgggcctacttgcaataataccgcaaatggcccaacgacaattaataacaactgctcgagccctgtagattcaggaaatactgaagacagcaaaacaaatctgatcgtcaactatctccctcagaatatgacgcaagaggagttgaaaagcctcttcgggtccatcggcgagatcgaatcttgtaagctggtccgggataagataaccggtcaaagtctgggttatggattcgtgaactatattgatcccaaagatgcagagaaagcgatcaatacactaaacggtttgcggctccaaacaaaaactataaaagttagctatgctcgcccaagctccgcatctatcagagatgctaatctctatgtctcgggactgcccaaaaccatgacacagaaggaactggagcaattgtttagccagtacggccgaatcatcacctctaggattctcgtagaccaagtgacaggaatcagtcgtggtgtgggctttataagatttgacaagaggatagaagccgaggaggcaattaaaggtctcaatggtcagaagcccccaggcgcaaccgagccaattaccgtgaaattcgcaaataacccgtctcagaagacgaaccaagccatactttcccaactgtatcaaagcccaaatcgacgctatcccggtccactcgctcaacaagctcagcgcttccgcctcgacaatctcctcaatatggcctacggagtgaaacgcttcagtcccatgaccatcgacggcatgacctctctggcgggaattaatatacccggacatcctggtaccggctggtgtatctttgtctacaatctggcccctgacgcggatgagagcatcctctggcagatgttcggtccctttggcgctgtcacgaacgtgaaagtcatcagggatttcaatacaaacaagtgcaagggctttggctttgttaccatgacgaactatgacgaggcggctatggctattgcctcacttaatgggtacagactgggcgaccgggttctgcaggttagtttcaagacaaataagactcataaggcatag

SEQ ID NO: 221836 - DNA, 1104 bp, Artificial Sequence
  Description of Artificial Sequence: Synthetic coding sequence
atggttacccaaattttaggcgcaatggagtctcaggtggggggtgggcctgcaggccctgcactgcctaatgggcctctgctggggacaaacggcgctaccgatgactcgaagactaacctcatcgtcaactacctccctcaaaacatgacacaggatgaatttaagtccctgtttggctcaatcggagacatcgagtcatgtaagctggtgcgggataaaatcacaggacagtcacttggatatggctttgtgaactactctgaccccaacgacgcagataaggctatcaatacactcaacgggttaaagctgcagactaaaaccattaaggtctcatatgccagacctagctctgcatcaatcagagacgcaaacctgtatgtatctgggctgcccaaaactatgtcacagaaagaaatggagcagctgttcagtcaatacggtcgcatcatcactagccgaattcttgtggaccaggtcactggggtcagcaggggggtgggcttcattagatttgacaaaagaattgaggctgaagaagcaatcaagggcctgaacgggcagaagccattaggcgcagcagagcccatcactgtcaaatttgcaaataacccgtctcaaaagacaggacaagccctgctgacacacctgtatcagtcctccgccagacgctacgctggccctctccaccatcagactcagaggtttcggctcgacaatctcttgaatatggcttacggggtgaaatccccactctcccttattgccagattctcccccatagcaattgatggcatgtccggactggccggagtgggtctgtccgggggagctgcaggggctgggtggtgcatcttcgtttacaatcttagtccggaggccgatgagagcgtgctttggcagctgtttgggccttttggcgcagtgacgaacgtcaaggtgatacgagattttactacaaacaagtgtaagggattcggctttgtgacaatgacgaattacgatgaggctgccatggcgattgccagtttaaacgggtaccgactgggcgaacgggttttgcaagtcagcttcaagacttcaaaacaacataaagcctag

SEQ ID NO: 221837 - DNA, 1083 bp, Artificial Sequence
  Description of Artificial Sequence: Synthetic coding sequence
atggtgacccagatcctcggggcaatggagagccaggtggggggtggcccagcaggacctgctctgcctaatggcccacttctggggaccaatggggctactgacgactccaaaacaaatctcatcgtcaattatttgcctcaaaatatgacacaagatgagttcaaaagtctcttcggctcaataggggacatcgaatcgtgtaagctcgttcgggacaagataaccggacagagcctgggttacggattcgtgaactattcagatccgaatgacgccgacaaggccattaatactttgaacggacttaagttgcagacaaaaacaatcaaagttagctacgctcgcccatcctcagcctcaataagagacgctaacctatacgtatctggccttccaaaaacaatgtcacagaaagagatggaacaactgttcagtcagtacggacgaataattacatcgcggatcctggtcgaccaggttacaggggtatcacgtggggtgggtttcataagatttgacaaaaggatagaagccgaagaggcgatcaagggtcttaacggacagaagcccttgggggctgccgagcctataactgttaagttcgcaaacaatcccagccaaaagaccggtcaggctctgttaacacacctctaccagagtagcgccaggagatatgctggccctttgcatcaccagactcagagatttagactggataatctgttgaatatggcctatggcgtgaagaggttttctccaattgcaatcgacggcatgtccggactggccggagtgggcctgagtgggggagccgctggcgctgggtggtgtatattcgtatacaatctttctcccgaggctgacgagtctgtgttgtggcagctgtttggtccttttggtgcagtcacaaatgttaaggttatacgggacttcactaccaacaagtgcaagggattcggcttcgtcactatgaccaattatgacgaggcagccatggcaatcgccagccttaatgggtaccgtcttggagaacgagttctccaggtgtccttcaaaaccagcaaacagcataaggcctag

SEQ ID NO: 221838 - DNA, 1152 bp, Artificial Sequence
  Description of Artificial Sequence: Synthetic coding sequence
atgcggctgttactcttacgcgaaattgtgattaacgaatcaaggaattgctcttttatgatcatctcaaccatggaacctcaggtgtcaaatggcccaacctccaacacaagtaacggaccatcgagcaataaccggaattgcccctcccccatgcagacaggcgctaccaccgatgactctaagacaaatcttattgtaaattatctgccacaaaacatgacccaggaggagtttcgttccctattcggatctattggcgagatcgagagctgtaagctggtgcgggacaagattactggccagtctctggggtatggatttgtgaattacattgaccccaaagatgctgaaaaggccatcaacacgctaaacggccttagactgcagaccaagaccattaaagtgtcttacgccaggccttcatcggcttcaattagagacgcaaatctgtacgtctcaggacttccaaagaccatgacacagaaagagctggaacagcttttctcacaatatggccgaataataacatctcggatactggtagaccaggtgacaggggtcagcagaggagtgggttttatccgattcgataagagaatcgaagccgaagaggctatcaaggggctcaatgggcagaagccatctggagctacggaacccataaccgtaaaattcgctaataacccctcccagaaatcctctcaggccctattatcacagctttaccagagccccaatcgcaggtaccccggacctttgcatcaccaagcacagagattccggttagacaatctattgaacatggcgtacggtgttaagagattctctcccatcacaattgacggcatgacaagccttgtgggcatgaatattcccggacacactggaactggctggtgtatctttgtctataacttgtctccagatagcgacgagtcagttctgtggcaactctttgggccatttggcgcagtgaataatgtgaaggtcattcgcgatttcaacaccaataaatgtaaaggatttggatttgtgaccatgacaaactatgatgaggccgcaatggcaatcgccagcttaaatggataccgcctcggtgacagagtattgcaggtcagcttcaaaacaaacaaggctcataagagctag

SEQ ID NO: 221839 - DNA, 1116 bp, Artificial Sequence
  Description of Artificial Sequence: Synthetic coding sequence
atggagtggaacggcctgaaaatgatcatctcaacaatggagccacaagtgtccaatggacccacatctaatacctctaatggaccatcttcaaataatcggaattgcccgtcccctatgcaaacgggtgctacaactgacgattcgaagaccaaccttatcgtgaactacctgccccagaacatgacacaagaagagtttcgctccctgttcggatccattggagaaatcgagtcttgtaagctggtacgcgacaagatcaccggtcaatctctggggtatggctttgttaattatatcgaccccaaggatgccgagaaagcaatcaacacgctaaatggactgagactccagacgaagactattaaggtgtcctacgccaggccgagttcggcaagcatacgggatgccaacctgtatgtctccgggctcccaaaaaccatgacacaaaaggagcttgagcagcttttctcacagtatggcagaattattacatcacggattctggtcgaccaggtgactggtgtaagcagaggcgttgggtttatacggttcgataagcggattgaggctgaggaagctattaagggcctcaacggacaaaaaccttccggcgcaaccgagccaattacagtcaagttcgcaaacaatcccagtcaaaagtctagccaagcattgctctcccagttgtaccagtcgcctaatagaaggtacccaggcccactccatcatcaagcccagcgcttccggctagacaacttgctgaacatggcatacggtgtgaagcggttcagccccatcaccattgacggcatgacatcgctagtgggcatgaacatccctggacacactggaacagggtggtgcattttcgtctacaatctgagtcccgacagtgacgagagtgttttatggcaattgttcggtcctttcggcgctgttaacaatgtcaaagtcatccgcgactttaacacaaataagtgtaaggggttcgggtttgtaacaatgaccaattacgacgaagccgcaatggcaatagcctcactaaatgggtacaggctaggagacagggtgctccaggtgagtttcaaaacgaacaaggcccataaaagttag

SEQ ID NO: 221840 - DNA, 1158 bp, Artificial Sequence
  Description of Artificial Sequence: Synthetic coding sequence
atggagtggaacggattaaaaatgattatctctactatggagccccaggtgtcgaatggcccaactagcaacacttctaacgggccatcatcaaacaatcggaattgtccctcgcccatgcagacgggcgctaccacagatgattctaagacgaacttgattgtgaattaccttcctcagaatatgacccaggaggagttccgctcactcttcgggtccatcggagagatcgagtcttgtaagctggtccgtgacaagatcacaggccaatcccttggatacgggtttgtaaactatatcgaccccaaagacgccgagaaggctataaacacattaaacgggttgcggcttcaaaccaaaaccatcaaagtgtcatacgctcggccaagcagcgccagcattcgggacgccaacctttatgtctctggcttgcctaagacgatgacccagaaggagttagaacaactgttctcccagtatggccgaattatcaccagcaggatcctcgtggaccaagttacgggagttagtagaggggttgggtttattcggtttgataagcgtatagaagccgaggaggccatcaaagggctgaacggccagaaaccctccggcgcaaccgagcccattacagtgaaattcgctaacaaccctagtcagaaatcaagccaggcattactgagccagttgtaccaaagtcccaaccggagataccccggtcccctgcaccatcaggctcagagattccggcttgacaacctgttgaacatggcctacggggtgaaacgcttgatgtcaggccctgtgcctccctccgcgtgcccacctaggttctcccccataactattgatgggatgacgtcactcgtgggaatgaatattccaggacacaccggcactggatggtgtatctttgtgtataacctgagtccagactcagatgaatccgtgctatggcaactgttcgggcctttcggcgcagttaataatgtgaaggtgatccgggatttcaacacaaataaatgtaagggctttggattcgtgacaatgaccaactacgacgaggccgctatggccattgcctccctgaacgggtatcgattaggtgaccgcgttctgcaagtctcatttaagacaaataaggcccataagtcctag

SEQ ID NO: 221841 - DNA, 1143 bp, Artificial Sequence
  Description of Artificial Sequence: Synthetic coding sequence
atggtgatgattatcagtactatggagccccaggtgtctaacgggcctacttcaaacacctcaaatggcccttcgtctaacaatagaaattgtcccagtccaatgcagacaggggctacaaccgatgattcaaaaaccaaccttatagtgaactacttgccacagaacatgacacaggaagaatttagatccctgttcggttccataggcgaaattgagtcttgtaaattggtgcgtgataagataacgggtcaatcactggggtacgggttcgtcaactatattgatcctaaggacgctgaaaaagcaattaatacattaaacggactgcggctgcagacgaaaaccattaaggtgagttacgccagaccttcatcagcaagcattagggacgccaatctctatgtgtctggcctgcctaagaccatgactcaaaaagagctggagcaattgttttcccagtatggcagaattattacctctcggatcttggtagatcaggtgacgggagtgtcgcggggagtgggtttcatccgcttcgacaaaaggatcgaagccgaagaggcaattaagggtctgaatggtcagaagccaagcggtgccacagaacccataacagtgaaatttgctaacaatccttcacagaaatcttcccaggcactccttagccagttgtaccagagtcctaatagacggtaccccggacctctccatcaccaggcccagcgttttcggttggataatttacttaatatggcgtacggcgtcaaaaggctgatgagtggacccgttccaccgtcggcttgtcccccacggttttcacccattaccatcgatggcatgacatcattggtcggcatgaatatcccagggcacaccgggactgggtggtgcatcttcgtttacaacctctcacccgattctgacgaatcggttctgtggcagctgtttggcccttttggggctgtgaacaacgtgaaggtgatccgggactttaacactaacaaatgtaaggggtttggattcgtcaccatgacaaattatgacgaggcagcgatggctatagcttcgctgaatggctatcgccttggagatcgtgtcctgcaggtgtcattcaaaactaacaaagctcacaagtcctag

SEQ ID NO: 221842 - DNA, 1101 bp, Artificial Sequence
  Description of Artificial Sequence: Synthetic coding sequence
atggtgatgattatcagcacaatggaacctcaggtctctaatggtcctacttctaacacttccaatggtccatcctcgaacaatcgcaattgtcccagccctatgcagacgggagcaacgaccgatgactcaaaaacaaacctgatcgtgaattatttaccccagaatatgacccaagaggaatttaggtccttgtttggaagcataggcgaaattgagtcttgtaagctggtccgggacaagatcactggccagtcccttggatacggctttgtgaactatatagatccgaaggacgccgaaaaagcaatcaacaccctgaacgggcttcggctgcaaacaaagacaattaaagtgtcctatgcccgtccgtcatcagcgagtatccgcgacgccaacttgtacgtaagtggtttgcctaagacaatgacccagaaagaacttgagcagttattctcccaatacggaagaataatcaccagccgcatccttgtggatcaggttacgggcgtgtcacgtggggttggtttcatccggttcgacaaacgaatagaggccgaggaagccattaaagggcttaacggccagaagccaagcggggctacagagccaattaccgtgaagttcgccaataacccctcccagaagtcttctcaggccctcctctctcagctttatcagagccctaatcgcagatatccaggccctctgcaccaccaggcccagagatttcgtctggataacctgcttaacatggcatacggggtgaaaaggttttccccaattactatagacggaatgaccagcttagtcggaatgaatattccagggcacaccgggactggatggtgtatcttcgtgtataacttgtctcccgactccgacgagtccgtgctatggcagcttttcggaccttttggggcagtgaataatgtgaaggttattagggatttcaacacaaataagtgcaaaggctttggttttgtgacgatgactaactatgatgaagccgctatggctatcgcatcactgaacggatatagactcggggacagagtgctccaggtctcatttaagactaataaggctcataagtcgtag

SEQ ID NO: 221843 - DNA, 1101 bp, Artificial Sequence
  Description of Artificial Sequence: Synthetic coding sequence
atggagcagataataagcactatggagccccaggtcagcaatggaccaacaagcaacacttctaatgggccaagctccaacaataggaactgcccttctcctatgcagacgggagcaacaacagacgatagcaagacaaatctcattgtcaactacttgcctcaaaatatgacacaggaagagttccgctccctgttcggttcaattggtgagattgaatcttgtaaattagtgagggataaaatcaccggacagtcactgggctacgggttcgtgaattacattgaccccaaggacgctgaaaaggccataaacacattgaacggcctacgcttgcagacaaagactatcaaagtatcctacgccagaccttcatccgcctcaattcgagacgctaacctctacgtgtcagggcttccaaagaccatgactcagaaagagctggaacagttgtttagccagtatggcaggattataacttcgagaatcctcgttgaccaggtgaccggcgtgtctcgcggtgtgggcttcatcagattcgataaacgcatcgaggctgaggaagcgatcaaaggcctgaatggtcagaaaccctccggcgctacagaaccaattactgtgaagtttgccaacaatccctctcaaaagtcaagccaggctctcctgagtcagttgtatcagtcccctaatcgacgctacccgggaccactccaccaccaggcacagcgctttcggttagacaacctgttgaatatggcctatggggtgaaacgtttcagtccgatcaccatcgacggtatgaccagcctggtgggaatgaacatccctggacacaccgggacagggtggtgcattttcgtgtataacctgagccctgatagcgatgaatcagtgctgtggcagctgtttgggccattcggcgctgttaataatgtaaaggtgattcgagactttaataccaataagtgtaaaggctttggcttcgtgactatgacaaattatgatgaggcggcaatggccatagcctctttgaatggttataggttgggcgatcgggtcttacaggtaagctttaaaaccaataaggctcacaaatcttag

SEQ ID NO: 221844 - DNA, 1110 bp, Artificial Sequence
  Description of Artificial Sequence: Synthetic coding sequence
atgagacttaaaaatcagattatctctactatggaaccccaggtctctaacggtcccacctcaaatacttccaatgggcctagctccaacaaccggaactgcccgtcccctatgcagactggcgcaacaacagacgactccaaaaccaatctgatagtgaattacctgccacaaaacatgacccaggaggaatttaggagtctttttggtagtattggggagatagagagttgcaaacttgtccgcgataagatcacaggccagtctctggggtatgggttcgtgaattatattgatcctaaggacgcagaaaaggccataaatacccttaacggcctccgactgcaaactaagaccatcaaagtcagctacgccagaccctcatccgccagtattagagacgccaacctgtatgtctccggattgcccaagaccatgactcagaaagagctggaacaactgttttctcagtacggcagaatcataacaagtcgaatactggttgatcaggtgaccggggtgagccgcggagtagggttcattaggtttgacaaaagaatagaagccgaagaggcaatcaaggggctcaacggtcagaaacccagcggggcaaccgagccaattacagtgaaattcgcaaataaccccagccagaagtcttctcaggccctattgagccagctgtatcaatctccgaatcggcgatacccaggaccgctgcatcaccaagcccagagatttcgactggacaacctccttaatatggcctacggcgtgaagcggttctctcccattacaatcgatggcatgacctccctcgtgggaatgaacataccgggtcacacaggcacagggtggtgtatatttgtgtacaatctgagtcccgactcagatgaatccgtactgtggcagctgtttggaccctttggagcggtgaacaatgtaaaagtcattcgggacttcaatactaataagtgcaagggatttggattcgtgaccatgaccaactatgacgaggccgcaatggctattgcctccctgaacggctatcgcttgggcgatagggtgttacaggtttcattcaagaccaacaaggcccacaagtcttag

SEQ ID NO: 221845 - DNA, 855 bp, Artificial Sequence
  Description of Artificial Sequence: Synthetic coding sequence
atgtttagagcagcagccccagggcagctacggagagctgtcgcccaggatctatgtaaagtagctggcatcgctaaggtcttggtagcccagcacgatgtatacaagggcctgctgcctgaggagcttacaccgttgattcttgccacccagaagcaatttaactatacgcacatttgtgccggtgcaagcgccttcggtaaaaatctgctcccacgagtggccgctaagcttgaggtggcaccgatttcggacatcatcgcaattaaatcacctgacaccttcgttcggaccatttacgctggaaacgccctgtgcacagttaagtgtgatgagaaagtgaaagtcttttctgtgcgaggaacctcatttgacgcagcggcaacatccggagggtccgcatcttctgagaaggccagcagtacaagcccagtcgagataagtgagtggctcgaccagaagctcacaaagagtgatcggcctgagttaacaggggctaaagtagtggtctccggaggtcggggactgaagagcggggaaaacttcaaactgctctacgatctggctgaccaacttcatgctgccgtgggtgcatctcgggctgccgtggacgcaggtttcgtgcctaacgacatgcaagttggacagactgggaaaatcgtcgcacctgaactctacattgctgtcggcattagcggcgcaatacagcatctcgccggtatgaaggacagtaagacaattgtggcaattaataaagacccagaggctcctatcttccaggtcgccgactacgggatagtggcagatctgtttaaagtggtcccagagatgacggagattctgaaaaagaaatag

SEQ ID NO: 221846 - DNA, 1002 bp, Artificial Sequence
  Description of Artificial Sequence: Synthetic coding sequence
atgtttagagcggctgccccaggccaactccggagagcggcttccctactacggtttcagtcaacactggtcattgccgagcacgccaacgatagcctggcacccatcacactgaacaccattactgcagccacaagactgggaggcgaagtgagctgcctggtggcaggaacaaagtgcgacaaggtggcccaggacctgtgtaaagtggcaggcatagcaaaggtactggtggcccaacacgacgtgtacaaaggactcctgccagaggagttgactccactcattctggccacacaaaagcaattcaactatacgcatatctgtgcaggtgcttctgccttcggaaaaaacctgctgcctcgcgtggctgctaaactggaggtagccccaatctctgatatcattgccattaaatctccagatacgtttgtccgcaccatctatgcgggaaatgctctgtgcaccgtgaagtgtgatgaaaaggtaaaagtttttagcgtgcggggtacctcgttcgatgctgctgcaactagtgggggttccgccagctcggaaaaggcctcttctactagccccgtagagatcagcgaatggcttgaccagaagctaaccaagtccgacaggccagaactcaccggcgcaaaagttgtggtctcaggcggacgcggactgaaatccggcgagaattttaaactgctgtatgatcttgccgatcagctccacgcggctgtcggggcatctagagcagccgtcgatgccggattcgtacctaatgatatgcaggttggacaaactggcaaaatcgtggcccctgaactgtacattgcagttggtattagcggtgccattcagcatttggcagggatgaaggacagtaagaccattgtggcgattaacaaggaccccgaggcaccaatcttccaagtagctgattacgggatcgtggccgacctttttaaagttgtacctgaaatgactgaaatcttaaaaaagaagtag

SEQ ID NO: 221847 - DNA, 768 bp, Artificial Sequence
  Description of Artificial Sequence: Synthetic coding sequence
atggctgagctgcgggttctggtagccgtgaagagagtgattgattatgctgtgaaaattagggtgaagcctgacagaactggagttgtgaccgacggcgtgaaacacagtatgaatcctttctgcgagatcgccgtcgaagaagctgtgagacttaaggaaaaaaaactcgtgaaagaggtgatcgcggttagttgcgggccagcacagtgccaagagactataagaacagccctggctatgggagccgatagaggaatccatgtggaagtgcctccagcagaggctgaaaggctcggccctctgcaagttgcaagggtattagctaagctggctgagaaagaaaaggtggatctggtcctactaggtaagcaggctatcgacgacgattgcaatcagactgggcagatgactgccggtttcttggattggccgcaagggaccttcgcaagtcaggtcaccctggaaggtgacaagttgaaggtggaaagggaaatagatggagggctggagaccctccgtcttaagctgccagctgtcgtgacagctgatttaagacttaacgagcctcggtatgctaccctacccaatatcatgaaggcgaagaagaaaaagatcgaagtaattaagcccggagatttaggtgtggacctcacctctaagctatctgtcatttcagtggaagaccctcctcagcgtaccgcaggcgtaaaagtggaaacgaccgaagatcttgtggccaaactcaaggaaatcggccgaatttag

SEQ ID NO: 221848 - DNA, 1041 bp, Artificial Sequence
  Description of Artificial Sequence: Synthetic coding sequence
atgtacctttccctgtgggtgacgatcaatacggtaaacctccgcaatactctctccggactgaggggggctgtgactactgtcggaatgatcaaaagtgacgtccccggtacccaagaatggctggacgagcgacgtcgccagggcgacttgcctttgcccaccaattcaaaccctgtgctttcactggagctgtgtgacccgggacaggggccagcaccttttcaggccgtagtggtactgattcaaccagggcgtgggctggccctgcgcccacccccatcatgcctgtttccccctgaccctaccccgagccccccagccggtcagatcagagtgaagcccgatcggacaggggtcgtaactgatggcgttaagcactcaatgaatcccttctgtgagattgccgtggaagaggccgtccggctgaaagagaaaaagctggtgaaggaggtaatagccgtatcctgtggccctgctcagtgccaggagacaatccggacagccctggcaatgggcgcagatcggggaatccacgtagaagtcccaccagctgaagccgaacggctcggcccactgcaagtggcccgtgtgcttgcaaagctggctgaaaaagaaaaagtggaccttgtcctcttaggaaagcaggccattgatgacgattgcaatcagactggacagatgactgccggatttctagactggcctcaaggaactttcgcgtctcaggtaaccttagaaggcgataagctgaaggtggagagagaaattgatgggggactagagacgctccgcctcaagttacctgctgttgtaacagctgatctgagactgaacgaacccaggtatgcaactctgcctaacattatgaaggctaaaaaaaagaaaatagaagtcattaagcccggagatctgggggttgacctcacatcaaaactgtctgtgatcagtgtcgaggatcctccgcagcggacagctggggtgaaagtcgagaccaccgaagatttggtcgctaaactgaaggagataggcaggatttag

SEQ ID NO: 221849 - DNA, 1713 bp, Artificial Sequence
  Description of Artificial Sequence: Synthetic coding sequence
atgttggtgccgctggcaaagctgtcgtgtttgggcgttaacatggagcgattcgcggaggaagccgatgtggtcattgtcggcgctggtcccgcaggcttgtctgctgcggttagattaaaacaattggcagtcgcccacgaaaaagacataagggtctgtttagtggaaaaggctgctcagatcggggctcacactctttccggcgcatgcctggatcccggagctttcaaagagctgtttcctgactggaaggagaaaggcgctccgctgaacacccccgtcacagaggaccgctttggcatcctgaccgaaaaatatcgaattccagtgccaattcttcctggcctgcccatgaacaatcacgggaactatattgtcaggctcggccatctcgtgagttggatgggagagcaggccgaggctttaggggtggaagtttatccaggttacgcggctgccgaggtgctatttcacgatgacggtagcgtgaagggaatcgcgacgaacgatgttggtatccagaaggacggggctccaaaagcaaccttcgaaagaggactggaactgcacgccaaagtgaccatttttgccgaggggtgtcacggacacctggccaaacagctgtacaagaagtttgacttacgggcaaactgcgaacctcaaacctacggtattggactgaaagagctctgggtcatcgacgagaaaaactggaaaccaggtcgggtggatcatacagtagggtggcctctggatcggcacacttatggaggttccttcctctaccacctgaacgaaggtgagccacttgttgctctgggccttgtggtcggtcttgattaccagaatccttacttgtcccctttcagggagtttcagcggtggaagcaccatccttccatccgcccaaccctcgagggcggaaagcggatagcttatggagccagagctcttaatgaggggggatttcagtccatccccaagctgacttttcccggaggactcctcatcggttgtagcccgggattcatgaacgtgccaaagatcaagggcacacatacggcaatgaaatcagggattctagcagctgagagcatatttaaccagctcacttccgagaacctccagagtaaaaccattggactgcacgtcaccgagtacgaagataacttgaaaaacagctgggtctggaaggagttatatagcgtacggaatattagaccttcctgccacggtgtgctgggggtctacggcggtatgatctacaccggtattttctattggattctgagaggtatggagccgtggacactgaagcacaaggggtcggatttcgagagattaaagcccgcaaaggactgcaccccaatcgaatatcccaaaccagacggtcagatatcgttcgatctgctatcatctgtcgcccttagcgggaccaatcatgaacacgatcagccagcccaccttacactgagagacgactctattcccgtaaacagaaacctgagtatttacgatggtcctgagcagcgcttctgcccggctggcgtatacgagttcgtccctgtggaacaaggggacgggttccggcttcagatcaatgctcagaactgcgtgcattgtaagacgtgcgatatcaaagaccctagccagaacatcaactgggtcgtaccagagggaggagggggaccagcatataatggcatgtag

SEQ ID NO: 221850 - DNA, 1854 bp, Artificial Sequence
  Description of Artificial Sequence: Synthetic coding sequence
atgctggtcccattagcaaaattgagctgccttgcttatcagtgttttcacgccctgaagataaaaaagaactatctgcctctgtgtgctacacgctggtcgtccacctccaccgtacctagaatcaccacccactacaccatctatccaagagataaagataaaagatgggagggcgtgaatatggagaggttcgctgaggaggctgatgtagttattgtgggggctgggcctgccggattatccgctgcggttaggcttaagcaattggccgtcgcccacgaaaaggacatccgggtctgccttgtggagaaggccgcacagatcggtgcacacactctgagcggtgcctgcctggatcccggtgcattcaaagaactgtttcccgactggaaggaaaagggggcacctttgaataccccagtgactgaggatcgctttgggatcctgactgaaaagtacagaataccagtccccatcctgcccggattgccgatgaataaccacgggaactatatcgttaggcttggacaccttgtgagttggatgggcgagcaggcagaagccctcggcgtggaagtttatccaggttacgctgctgccgaggtcctgtttcacgacgatggctcagtgaaaggtatcgcgaccaatgacgtcgggatccaaaaggacggggctcccaaggccactttcgagcgaggcctggagcttcatgcaaaagtgacaatcttcgcagagggatgccacggccatttggctaaacagctatacaagaagttcgacctgagggcgaactgcgagccacagacatatggcataggtctcaaagagctgtgggtcatcgacgagaagaactggaaacctgggagagtggaccacaccgtcggatggcccctggatagacacacctatgggggtagttttctctaccatctgaatgagggagaaccgctagtagctcttggcctagtagtggggctagactatcagaatccgtacctctccccatttagggaattccagcgctggaagcatcaccctagcattaggcccactttagagggaggtaagcggattgcctatggcgctcgagccttgaatgaaggagggtttcagtcaattcccaagttaacctttcccggaggcttgctgattgggtgctcacctggcttcatgaacgtacccaagattaaggggacacatactgcaatgaagagcgggatcttggcagctgagtcgatcttcaatcaacttacctctgaaaatctgcagtcaaaaactattggcctgcacgtgactgaatatgaagacaacctcaagaactcctgggtgtggaaagaattatattcagtccggaatatccgtcccagctgtcacggggttttgggggtatatgggggaatgatttacaccgggatattttactggattctacgcggaatggagccctggaccctgaagcataagggctccgactttgagcggttgaaacctgcgaaggactgtaccccaattgagtaccctaagccagacgggcagatctcatttgatttgctgagttcggtggccttgtctggtactaaccacgagcacgaccagccagcacatctgaccctaagggacgactccatccccgttaacaggaacctgtccatatacgatggcccagagcagcggttctgcccagctggagtctacgaattcgttccggttgagcagggagacgggtttcggctccaaattaacgctcagaactgtgttcattgcaagacctgcgacatcaaagacccatcacaaaatatcaactgggtggtacctgagggtgggggaggtcctgcttataatgggatgtag

SEQ ID NO: 221851 - DNA, 1287 bp, Artificial Sequence
  Description of Artificial Sequence: Synthetic coding sequence
atggacccctctgttacactgtggcaatttctgttacaactcttgagagagcaagggaacgggcacattatttcctggaccagtagagacgggggtgaatttaaattggtggacgctgaggaggttgctaggctgtggggactgcggaagaacaagacaaacatgaactatgataagctatcacgagccttaagatattattacgacaaaaatatcatccggaaagtgtctggacagaagttcgtctataagttcgttagctacccagaggtagctggttgctccacagaagactgccctccccagcccgaggtcagtgtgacctccaccatgcccaacgtggcacccgctgcgatccacgcggctcccggtgacacagtgtcaggcaaaccgggaacacccaagggcgcaggcatggccggaccgggaggtctagcacggtcctcacggaacgagtatatgcggagtgggctgtattcaactttcaccattcagtcactgcagcctcagcctccaccacatccacgtcctgcagtggtgctgccttcggccgcaccggctggcgctgctgcccctccctccggctctcgcagcacctcacctagcccactggaggcctgtcttgaagcggaggaagccggactgcccttgcaagtgatcctgacaccacctgaggctccgaaccttaagtctgaggagctgaatgttgaacctggattgggtagagctcttcctccagaggtgaaggtcgagggtccgaaagaagaactagaggtggccggagagagggggtttgtgcccgagacaactaaagcggagccagaagtccctccgcaggaaggcgtgcctgcaagactgcccgcagtggtgatggacaccgcaggccaggcgggagggcacgccgcttcttccccagagatctcccagcctcagaaggggcgtaaacccagggatttggagcttcctttatctcctagtctactggggggacccggacccgagagaaccccaggcagtggatctgggtcggggttgcaggcccctggccctgcactgaccccctcacttttgcccactcatacccttacacctgttttactgacaccctcctccctccccccttccatccatttctggagtaccctgagccctatcgctccaagatcccctgcaaaactcagctttcaatttccgtcatccggaagcgcccaggtgcacatcccttccatctctgttgacggactgtcaacccctgttgtcctttcaccaggacctcagaagccttag

SEQ ID NO: 221852 - DNA, 1836 bp, Artificial Sequence
  Description of Artificial Sequence: Synthetic coding sequence
atgcctgagatcgttgacacgtgctctcttgcgagcccagcttccgtctgccgaaccaagcaccttcacctgagatgcagtgttgattttacaagacgtaccttaacggggaccgccgctcttactgtgcagtcccaagaagacaacctgcggagcctggtgttggacacgaaagaccttacaatagaaaaagtggtgatcaacggacaggaagtgaagtatgctctcggtgagaggcaatcttataaaggatctccaatggagattagtcttcctatcgctctgtcaaaaaaccaggaaatcgtgatcgagattagctttgagacgtctcctaaatcgtctgcgctacaatggttgacaccagaacagacaagcggcaaagagcatccttaccttttcagccaatgtcaggcaatacactgcagagctattctaccttgccaggacacccccagtgtcaagctgacatacactgcagaagttagcgtgcccaaagagctggttgctctgatgtctgccatccgggacggggaaacacccgatcctgaagaccctagtagaaaaatctacaaatttatccagaaggttccaataccatgttacttgattgcactcgtagtaggggctctcgagtcgaggcagataggtcccaggaccctggtatggagtgaaaaagagcaggtcgaaaagtccgcttacgagttcagtgagacagagagcatgttgaaaatcgcagaggatctcggcggaccatacgtctggggacagtacgatctcctggtcctaccccctagtttcccttatgggggaatggagaacccttgcctgacatttgtcacaccaacactccttgccggagacaaaagtctctcaaatgtgattgcacacgagatcagccacagctggacaggcaatctcgtgactaataagacctgggatcatttttggttgaatgaggggcatacagtttatctggaaagacatatttgtggtcgactcttcggggaaaagttcaggcatttcaatgccctggggggatggggtgaactacagaacagcgtgaagacttttggtgagacacacccttttaccaaactagttgtggacttgacagatatcgacccagatgtggcctatagtagcgtgccgtatgaaaagggattcgctctattattttatctcgagcagttgctgggcggtccagaaatcttcctaggcttcctaaaggcatacgtagaaaagttctcatacaagtctatcacaacagatgattggaaggacttcctgtattcctatttcaaagacaaggtggacgtgttgaaccaggtcgactggaatgcttggctgtattcccccggactgccccctattaagccaaactatgatatgaccttgacaaacgcctgtattgctttgtcccaaaggtggatcaccgcaaaggaggatgatctgaacagctttaatgccaccgacttgaaggacctcagctctcaccagttgaacgaatttcttgctcagacactgcaaagagctccgctgccactcggtcacattaaacgcatgcaggaggtttataatttcaatgctatcaacaactcagagatccgttttcgctggctgcggttgtgcatccaatctaagtgggaagatgccattccattggctctgaagatggccacagaacagggcagaatgaaatttacccgcccactcttcaaggacttggctgcattcgataagagtcacgatcaagcagtgagaacctatcaggaacacaaagctagcatgcacccagttacagcgatgctggtgggaaaagacctcaaagttgactag

SEQ ID NO: 221853 - DNA, 117 bp, Artificial Sequence
  Description of Artificial Sequence: Synthetic coding sequence
atggagtcagctattaccctgtggcaattcctgctgcaattgctcctagatcagaagcatgaacatctcatttgctggacttccaatgacggggagtttaaattacttaaggcttag

SEQ ID NO: 221854 - DNA, 483 bp, Artificial Sequence
  Description of Artificial Sequence: Synthetic coding sequence
atggaaagtgccataactctttggcaatttcttctgcagcttcttctcgatcagaagcacgaacacttaatttgctggacaagtaatgacggagaattcaagctgttgaaggctgaggaagtcgcaaaattgtggggattgagaaagaacaaaacaaacatgaactatgacaagctgtcccgggctctgaggtactattatgacaagaacattattaaaaaagtgatagggcagaagtttgtgtacaagttcgtgagctttcctgagattctcaagatggacccccacgcagttgagatctcgcgcgagtccctattgttacaggactccgactgtaaggcgtcccccgaagggcgtgaggcccacaaacacggcctcgctgctctccgatccacctcacgcaacgagtacattcatagcggcctctattcttcatttactattaactcgttacagaaccctccagacgcctttaaagcctag

SEQ ID NO: 221855 - DNA, 1218 bp, Artificial Sequence
  Description of Artificial Sequence: Synthetic coding sequence
atggacagcgccatcacgctttggcagttcctcctgcagctgctccagaaacctcagaataagcacatgatctgttggacatccaacgacggacaattcaaactcctccaggctgaagaggtggccaggctgtgggggattcggaaaaacaagcccaacatgaattacgataagctgagtagggcattacgttactactatgtgaagaatataatcaaaaaagtaaatggacagaagttcgtttacaagttcgtttcgtacccggaaatccttaatatggaccccatgacagtcggtcggatcgagggggactgcgaatccctaaatttctccgaggtctcatcgagctcaaaggatgttgagaacggcggtaaagataagccaccacaaccaggagcaaagacaagctctcgaaatgactacatacatagtggtctttacagttcatttaccctcaattccttgaactcttctaacgtgaagttgtttaagctcataaagacagaaaaccctgcagagaagcttgcagagaagaaatctccccaggagccaactcctagcgtgatcaaattcgtgactacaccttccaagaagcctcctgtggagcctgtagccgctactattagtattgggccaagtatctcaccctcctctgaggaaactattcaggctctcgaaaccctggtgtctccaaaactgcccagcctggaagccccaacgtccgcctctaacgtgatgaccgcgttcgcaaccacccccccaattagttccattcccccactgcaggaacctcccaggaccccatccccacctctaagcagccacccagacatagatactgatattgactcagtggccagtcagcccatggagctgccagaaaacctgagcttagagcccaaagaccaggattctgtgctgctggagaaggacaaggttaacaattccagccgatctaaaaaacccaaggggttagaactggctccgaccctggttataacatccagtgacccctcccctctgggaatcctatcccccagtctccctactgccagcttaactcctgcttttttcagtcaggtggcctgctccttattcatggtgtctccgttgctgagcttcatctgtcctttcaaacaaattcagaacctgtatacccaggtctgctttctcttactgcggttcgtccttgaaagattgtgcgtgaccgttatgtag

SEQ ID NO: 221856 - DNA, 1296 bp, Artificial Sequence
  Description of Artificial Sequence: Synthetic coding sequence
atggatagtgcaatcaccttatggcagtttcttctgcaattgttgcagaaacctcaaaataaacatatgatctgctggactagcaacgacggccagtttaagctgttgcaggccgaggaggtggcacgcctttggggcatccgcaagaacaaacctaacatgaactacgataaactttccagggcactacgctattactacgtgaaaaatatcatcaaaaaggttaatgggcaaaaatttgtatacaagtttgtaagttacccagagatcctgaacatggacccgatgaccgttgggcgaatcgagggagactgcgaaagtctaaacttctctgaggttagctcctcctccaaggacgtcgaaaacggcggtaaggacaaacccccacaaccgggagcaaagacgtcatctagaaacgattacatccactctggtctctattcctcctttactcttaacagtctcaactcctcaaacgtcaagttattcaagctgattaaaacggagaaccctgcggaaaaactcgctgaaaagaaatccccccaagaaccgacccccagcgtgattaagtttgtcacaactccttcgaagaagccccctgttgagccagttgccgcaactattagcatcggcccttcaatcagtccttcaagcgaagagaccattcaagccctggagacccttgtgtcccccaagcttccctccctcgaggcgcctaccagtgctagcaacgtgatgactgctttcgccaccacaccccctatatcctcaattccgcctctgcaggagccaccgcgaacaccctccccacccttaagtagtcacccggatattgataccgatatcgatagcgtagcctcccagcccatggaattgcctgaaaatctcagccttgaaccgaaggaccaagactctgtattgttagagaaagataaggttaataacagtagtcggagcaagaaaccaaagggtttggagttagcaccgacgctggtgatcacatcatcagacccttctcccctcggcattctgagtccgtctctgcctaccgcttcactcactcccgcatttttctctcagacacccatcattcttaccccgagcccacttttgagctctatccacttctggtccacactgtcccctgtggcccctctgagtcctgctcgactgcagggtgctaacacactctttcaatttcctagtgtgctaaactctcatggcccttttacattgtctggtttagacggacccagcacccccggacctttcagcccagacttgcagaagacctag

SEQ ID NO: 221857 - DNA, 1566 bp, Artificial Sequence
  Description of Artificial Sequence: Synthetic coding sequence
cggcctcaggatccacgacgacgctgtcgcgtgcggggtcgtggtggcaggggggcacgatcccggggtggcggtcggtgtggccgtctccgcgcacccggaggcctcggcttggcggcagccgcattttatggtagtgccgcaggggtggcagcagcagccgctcccagctcctccttccagcgtgaggaagaggctgaaggcggtgaagcacacagagtccggggaggtgaccggggaggagctccacgtgccgcttccctgattgccatggactctgctatcacactatggcaatttcttttacagctgctccagaaaccccagaataagcacatgatttgttggacttctaacgacgggcagtttaaactgctccaggctgaggaagttgccaggctttgggggatccgcaagaacaaacccaacatgaactatgacaagctgtctcgagcactccggtattactatgtgaagaatatcattaaaaaagtcaacggccaaaaattcgtttataagtttgtgagttacccagaaatcttgaacatggatcccatgaccgtgggcagaatagaaggcgactgtgagtccctgaatttcagcgaggtgtccagctcatccaaagacgttgaaaacggtgggaaggacaaacccccacaacctggtgctaagactagctcacgtaacgactacatacacagcggtttgtactcatcttttactctgaactcactgaattcctctaacgtgaaactcttcaaacttattaagacggaaaaccccgcagaaaaactcgctgagaaaaaatcaccccaggagcccaccccttctgtgattaagttcgtcactaccccatcaaaaaaacctccagtggagcccgtggccgctacaatatctattgggccttcaatcagtccttcctccgaagaaacaatccaggcactcgagacgttggtgtcgcccaaactgccctccctggaggcacctacttccgccagtaatgtcatgacagcatttgccaccactccccctattagctcaatcccaccactgcaagaaccacccaggactccaagcccccctctcagtagccaccccgacatcgacacggacattgattccgtggcctcccagccgatggagttacccgaaaatttgtccctagagcccaaggaccaagattctgtgctgttggagaaagataaggtgaataattcttcgaggtcgaagaagcccaaaggcctggagctggccccaactctcgttatcacaagcagcgacccctcacccctcggcatcctgtccccctctctcccaaccgcaagcctgacccctgccttcttttcccagacccctatcatactgaccccctcacccctgctatcatccattcacttctggtcgactctgtctccggtggcccctctctcccctgcaagattgcagggagccaacaccctatttcagtttccaagcgtgctgaacagccacggaccttttacactgtctgggctcgacggcccatcaacccctgggccattttcccccgacctccaaaagacctag

SEQ ID NO: 221858 - DNA, 807 bp, Artificial Sequence
  Description of Artificial Sequence: Synthetic coding sequence
atgaacggtaccgctaatccactcctggatcgcgaggagcactgcctgcggcttggcgagtcgttcgagaagcgacccagggcctcatttcataccatacgctacgattttaagcctgcatccatagatacctcctgcgagggcgaactgcaggttggaaaaggcgacgaggttacgataaccctgccgcacatccctgggtctaccccccctatgactgtcttcaagggaaacaaacggccataccagaaggattgcgtgttaattataaatcacgataccggagagtacgtgttggaaaagctctccagctccatacaagtaaagaagactcgcgcagagggcagtagtaaaatccaagcccgaatggaacagcagcccacccgcccaccccagacttcccagcctcctcctccccctccaccaatgccattcagggctcctacaaagccccctgtgggaccaaaaacatcccccctcaaggacaatccttcgcctgaaccccagctggatgatattaagcgcgagctgcgggcagaggtcgacattatcgagcagatgagctcttcctctggctcctcatctagcgattccgaatcctcttccgggagcgacgatgacagttcatcctcagggggagaggataacggcccagcctctccaccgcagcccagccaccagcaaccttataacagtaggccggcagtggccaatggtacatccaggccccaggggagtaatcagctgatgaacaccctcagaaacgatctccagctgtcagaatcaggctccgattccgatgattag

SEQ ID NO: 221859 - DNA, 504 bp, Artificial Sequence
  Description of Artificial Sequence: Synthetic coding sequence
atgaaaagtcagctgcattgtcacattagcctggccgaggggtccagcaagatccaagcccgtatggaacagcaacccacacgccctccacaaaccagccagcctccgcctccaccccctcccatgccatttcgtgcacccactaagccacctgttggcccaaaaacctcaccacttaaggataacccgtcccccgaacctcagctcgatgacatcaagcgcgagttgagagccgaggtggacatcattgaacagatgtccagctctagcggctccagctcatctgattcagaatcatcctcaggaagcgacgatgacagtagttcttccggcggagaagacaatggacctgcatctccaccccagccctcacatcagcaaccgtacaattctcggcctgcggttgcaaatggaaccagtcgcccacaggggagtaaccagctcatgaacactctcaggaatgatctgcagctaagtgaatctggatctgactctgacgattag

SEQ ID NO: 221860 - DNA, 2979 bp, Artificial Sequence
  Description of Artificial Sequence: Synthetic coding sequence
atggcgcgagggggagccgcttgtaaatcggacgcaaggctgctgctgggaagagacgccctgcgacctgctcctgcccttcttgccccagcagttctgctcggggctgctctcggactgggcttaggcctgtggctcggctgcagagcgggacggcagcgtacccgccatcagaaagacgatacgcagaacctgctgaagaatctggagagcaacgctcagaccccctctgagaccggctctccttcacgaagacgcaaaagagaggttcagatgtctaaggataaggaggccgtcgatgagtgtgaaccccctagtaactcaaatatcaccgcgttcgcactgaaggccaaagtgatctatcccatcaaccagaagttccgcccattggcagacggctcctccaacccgtccctgcatgagaatctgaagcaggcagtgctccctcaccagcccgtggaagcctcacctagtagtagcctgggttcgctgtcccagggagaaaaggatgattgttcctcaagcagtagcgtgcacagtgccaccagcgacgataggtttttgtcaaggacgtttcttagggtcaatgccttccccgaggtcctggcttgcgagtccgttgatgttgatctgtgcatttattccctacacctgaaggatctgctgcacctggacacagccctgaggcaggaaaagcacatgatgttcattcagatatttaagatgtgtctccttgatctgctccccaagaagaagtcagacgatgaactgtaccagaagatactgagcaagcaggaaaaggatctggaagaactcgagaagggcctgcaggtaaagctcagcaatacagaaatgtctggcgcaggggactccgagtatattactctcgcagatgtggaaaagaaagagagagaatactcagagcagctgattgacaatatggaggcattctggaaacagatggccaacatccagcacttcctcgtggaccaatttaaatgtagctctagtaaagccaggcagctcatgatgacactgactgaaagaatgatcgctgcggaaggactgttgtgtgattcacaagaactgcaagcgttggatgcattagagcggactatggggagagcacacatggcgaaagtaatcgaatttttgaaactccaggttcaggaggagactcgttgcaggctggctgccatctcgcacgggctggaactgctagcaggcgaaggcaagctttcggggaggcagaaggaagagctacttacccagcagcacaaggccttttggcaggaagcggaacggtttagcagagagtttgtgcagcgagggaaggaccttgttaccgcaagcctcgcgcatcaggtggagggaaccgccaaactgaccctggctcaggaggaagagcagaggtcctttcttgcggaggctcaacctacagccgaccccgagaagtttctcgaggcattccacgaagtgctcgagagacagcggctgatgcagtgtgacttggaggaagaagagaatgtgagggcaaccgaggccgtcgtggctctctgccaggagctgtatttcagtacagtagacaccttccagaaatttgtggacgccctgtttttgcagactttacccggtatgacagggctgccacctgaggaatgcgattatctcagacaggaagtgcaggagaacgcagcctggcaactggggaagtctaatcgttttcggaggcagcaatggaagctgtttcaggaactcctcgaacaagaccaacaagtgtggatggaggaatgcgcactcagttccgtgctacagacccacctccgagaagaccatgaaggcacaatccgcggtgtgcttggcaggctggggggtctgacagaggaatcgacccggtgtgtcttgcagggacatgacttattacttcggagtgccctacggaggctggcgctgcgcggaaacgccctggctaccctgactcagatgagactcagcggtaagaagcacttgctgcaggaacttagagagcaacgtgcactggagcaagggtcatcccagtgcctcgatgagcatcaatggcaactccttagggctctggaagccagagtcctggaagaggcaagtcggttagaggaagaggctcagcagacccggttacagctccaacagcggctgctggccgaggcccaggaagtgggtcaattactgcagcagcacatggaatgcgctattggtcaggctctgctggtgcacgcacgaaatgctgcaactaagtctcgagcaaaggacagggacgacttcaaacgcactttaatggaggccgcagtggagtcagtgtatgtcactagcgccggtgtgtccaggctggtgcaagcgtattatcaacagatcggcaggatcatggaagaccacgaagaacggaagctccagcatttgaaaacattgcaaggggagaggatggagaattataaactgaggaagaaacaggaactgtctaatccctcctcaggcagccggacagctggcggagcacatgagacatcacaagccgtgcaccagagaatgcttagccagcagaagagattcctggcccaatttccggtgcaccagcagatgagactccacgctcagcagcagcaagccggagtaatggatcttctcgaggcacagttagagacccagttacaggaggccgaacagaacttcatatccgagctggcagcattggccagagtgcctctggctgagtctaagctactgcccgctaaaaggggcctgctggaaaaaccgctgcgtaccaaaaggaagaagccgttaccccaggagcgaggcgaccttggggtgcctaataatgaagatctcgcgagcggagaccagacctccggatcgctgtcctctaagcggttgagccaacaggagtcagaagcgggtgattccggcaactccaagaagatgcttaagagacgcagcaacctctag

SEQ ID NO: 221861 - DNA, 2979 bp, Artificial Sequence
  Description of Artificial Sequence: Synthetic coding sequence
atggccagaggaggcgctgcttgtaaaagcgacgccaggctgctgctcgggcgagatgccttgaggcccgcacccgctctacttgctccagctgtgctgctaggagctgctctcggcctcgggctcggcctttggcttggctgtcgggctggtcgacagcgcacgaggcaccagaaggacgatacacagaatttgctcaagaacctggagagcaatgcccagacccccagtgaaactggaagcccctcccgacgccgtaaaagggaagtccagatgtccaaggacaaggaggccgttgacgagtgcgagcctccctcgaactccaacattaccgccttcgcattaaaagccaaagtcatttatccaattaatcaaaaattccggccattagctgatggctcttctaatcccagcctgcacgagaatttgaaacaggctgtgctgcctcaccagccggtggaagcttctccgtcgagctcactgggctctctcagccagggggagaaggacgattgctctagctcctcctccgtgcattcagcgacatccgacgaccgtttccttagcagaactttcttgcgcgtcaatgcattccccgaggttttagcgtgtgaatccgttgatgtggacctttgcatttatagcctgcatttgaaggacctgctacatctggatactgccttacgccaggaaaaacacatgatgttcatccagatcttcaaaatgtgcctcctggatcttctgcccaagaagaaatcagatgacgagctgtaccaaaagattctttcaaaacaggagaaagacctggaagaactcgagaaaggcctccaggttaaactgtctaataccgaaatgtcaggtgccggagacagtgagtacatcaccttagcagatgtagaaaaaaaggagcgtgagtattctgaacagctgattgataacatggaagccttctggaaacagatggcgaacatccagcactttcttgtcgaccagttcaaatgttcatcctccaaggccagacagctcatgatgactctgactgagcggatgattgcagccgaaggcctgctgtgcgatagccaggaattacaagctctggatgccctcgaacggaccatgggtcgcgcacacatggccaaggtgattgagtttctcaagctgcaggtacaggaagagacccgctgtcgcctagccgctatttcgcacgggcttgagctgctggctggagagggcaagttgagcggcaggcagaaagaggagctgctgacgcagcaacacaaggccttctggcaggaagccgagcgcttttccagagaattcgtgcagcgaggcaaggacctggtgacagcgtcattggctcaccaggtggagggcaccgctaagctaaccttggcacaagaggaagagcagagatcgttcttggcggaagctcagcccaccgctgaccctgagaagttcctggaagcatttcatgaagttctcgagcgtcaaagactgatgcagtgtgatttagaggaagaggagaacgtcagggcaaccgaggcagtggtggccctttgtcaggaactatatttctcaaccgtggataccttccagaagtttgtggacgccctgtttcttcaaactctgccagggatgactggcctgcctcctgaggagtgtgattatctccgacaggaagttcaggagaacgccgcatggcagctcggaaaatctaaccgattccgcaggcagcagtggaagctctttcaagaacttctcgaacaggatcaacaggtgtggatggaagaatgtgcactgtcgtcagttctgcaaacccatctgcgtgaagatcacgagggcacaatccggggagtgcttggtcggctaggaggtcttacggaagaatccacccgttgcgtactgcaggggcacgacctgctgctgcggagcgcactgcgaagattggcactgcggggaaatgctttagccacactcacacagatgagattgtcgggcaaaaagcatctgctgcaggagctgcgggaacaacgcgcacttgaacagggttcgtctcagtgcctcgatgaacaccaatggcagctcttgagagcgctggaggcgagagtgttagaagaagccagcagactggaagaggaagcgcagcaaacaagactacagttgcagcagcgcttgttagcagaggctcaggaggttggccagttacttcagcagcacatggaatgcgccattggccaagctctcctggtgcacgctagaaacgctgccacaaagagcagggccaaggatcgcgatgatttcaaaagaaccctgatggaagcagctgtggaaagcgtgtatgtaacgtctgccggtgtgtcaaggctagtgcaggcatattatcagcagatcggtcggattatggaagaccacgaagaaagaaaactacagcatctgaaaactttgcagggagaaaggatggaaaactataagcttaggaagaagcaagagctgagcaatccttctagtggctcccgtaccgccggtggcgctcatgagacgtcacaggcagtccaccagcgcatgctctcccagcaaaaacggtttctcgctcagttccctgtccaccagcagatgaggctgcacgcgcaacagcaacaagctggagtcatggatcttctagaagcgcagctcgaaacacagctccaggaggccgagcagaatttcatttccgagctagcagcccttgcacgtgtacccttagctgagtccaaactgctgccggctaagaggggcttgctggagaaacccctcagaaccaagagaaaaaagcccctgccccaggagcgtggcgatctcggcgttcccaacaatgaggatctagccagtggcgaccagacaagcgggagtttgtcatcgaagaggctgagccagcaagagagcgaggcgggtgactccgggaacagtaagaaaatgttgaagcggcgttccaatctatag

SEQ ID NO: 221862 - DNA, 3687 bp, Artificial Sequence
  Description of Artificial Sequence: Synthetic coding sequence
atgatttggcctaaggtcgagtgctgtcacttcaaaaccgctgtagaggctcctttgggtatgaagctggacaagaaaatggaggtgttcattcctctctctacttcagccgcatcttctggcccatgggcccactctttgtttgcatttataccaagttggcccaagaaaaacttgtttaagagggagtctcctataacccaccgcctatacggagacattagtcgcgaagtgcaaggcacatctgaaaatggtgtaatcttccagaaatgcgcactcgtgagtgggagcagtgaagctcagacagctaggatctggctgctagtcaacaacacaaagaccacgtcctctgctaacctgtccgagctccttttgctggactccatcgccggactcacaatatgggattcggtagggaacagaacctccgaggggttccaagcattctctaagaagttcctgcaggtgggggacgctttcgccgtgtcttatgcggctactctgcaggcgggtgatttagggaatggcgaatctctgaaattgcctgcgcaactgacgtttcagagctcttccagaaacagaacccaattaaaggtcttatttagcatcaccgcagaggaaaacgttaccgtccttcctcaccacggcctgcatgccgctggtttttttattgccttcttactgagtctggtgctgacctgggctgctctgttcctaatggttcgctaccagtgcctgaaaggcaatatgctgacccgccatcgcgtatggcagtatgagtctaagcttgaaccactgccgttcaccagcgccgacggagtgaatgaggacctgtcccttaacgaccagatgatcgacattctgagtagcgaggaccctggctccatgctccaagctttagaagaactggaaatcgctactctcaatcgggcagatgcagacctcgaggcgtgccggacgcagattagcaaagacatcatagcgttgctgctaaaaaatctgaccagcagtggccatttaagccctcaagtagagcgcaagatgtccgctgtcttcaagaaacagtttctgttactggaaaacgaaatccaagaagaatacgacagaaagatggtggcgcttacagccgagtgtgacttagagacccggaagaagatggaaaatcagtaccaacgtgaaatgatggccatggaggaagccgaagagctcctcaagagggccggagaacgctcagcagttgaatgttctaacctcttgcggactctgcacgggcttgagcaggaacaccttaggaaaagtttggcccttcagcaggaggaggacttcgccaaggcccacagacaactggcagtcttccagcgcaatgaattgcatagtatcttttttacacagatcaaatctgcaatctttaagggcgagctgaaaccggaagccgcaaagatgctactgcaaaactactcgaagatacaggagaacgtcgaggagctgatggacttcttccaggcaagcaaaaggtatcatctttcgaaaagattcggccaccgcgagtacttggttcagaatctgcagagctccgaaacaagggtccaggggctgctctccactgcagctgcccagcttacgcacctgatccagaagcacgagcgggctggctatctcgacgaggatcagatggagatgctgctcgaacgtgcgcagacagaagtcttcagtatcaagcagaagctggacaatgacttaaaacaggagaaaaaaaagctgcaccagaaactcattaccaagaggcgtcgcgagctgctccagaaacaccgtgagcagcggagagaacaggcttcagtcggagaggcctttcgcactgtagaggatgcaggtcaatacctacaccagaagcgctctcttatggaagagcacggggcaaccctggaagaactacaagagaggctcgaccaagctgcattagatgacctgcggacgctcacccttagtttgttcgagaaggcaacagacgaactcaggcgactccagaactctgctatgacacaagaactcctgaagcgaggagtgccctggttgttcctacagcaaatcctcgaggaacatggcaaagagatggctgccagagctgagcagttagagggcgaagaacgcgaccgcgatcaggagggagtgcaaagcgttcgtcagcgcctcaaagacgatgcaccagaggctgtcacagaagaacaggcagaacttagacgctgggagcacctgattttcatgaagttgtgtagctcagtgttcagcttgtccgaggaggagctcctgcggatgaggcaggaggtgcacggctgtttcgctcagatggataggagccttgccctgccaaagattagggccagagtgctgctgcaacagttccagacagcatggagagaggcagaatttgtgaagctggaccaggctgtggctgcacctgagctacagcagcaatcaaaagtacgcaagtctaggtccaagagcaagtctaagggggaactgctgaagaaatgtattgaagataaaatccacctttgtgaagaacaagcctcagaagacctggtcgagaaagtgaggggagaattgcttcgggaaagggtccagcggatggaggcccaggagggcggatttgctcagagcttggttgccctacagttccagaaggcctcaagggtcaccgaaacgctttctgcgtataccgcgctcttgtccatccaggatctgctgcttgaggagctgtccgcctcagaaatgctgacaaagtcggcttgcactcagatcctggagtcacactctcgtgagttgcaggagctggaaagaaagctcgaggaccagctggtccagcaggaagcagcccagcaacagcaggcactagcgagctggcagcagtgggttgccgatggccctggaatcctcaatgagccgggtgaggtggatagcgagagacaggtcagtacggttttgcaccaggccctctctaaatcacagaccctcctggagcaacaccagcagtgcttgcgggaggagcaacagaactccgtggtgctggaggacctcctggagaatatggaagctgatacattcgcaacattgtgcagccaagaactaaggctggccagttacctggcacggatggccatggtgcctggcgctacgttaaggcgcctgctgtccgtggtcctgccaacagcctcccagccccaactgttggcgctcctagacagcgcaaccgagagacacgtagaccacgcagctgagagcgatggaggagccgagcaggccgacgtgggcaggagacgcaagcaccagagttggtggcaagcgttggacgggaagctcagaggagacctgatctccagaggactggagaagatgctgtgggcacggaagagaaaacaaagcatcctgaaaaaaacatgtctgccattaagagagagaatgatctttagcgggaagggatcatggccccaccttagtctggagcccattggagagctcgcgccagtgccgatcgtaggggctgaaacaattgaccttctaaatacgggggagaaattgttcatattcaggaaccccaaggaacccgagattagcctgcatgtgcctcccaggaagaaaaagaacttcctgaacgctaagaaggccatgagggctctcggaatggattag

SEQ ID NO: 221863 - DNA, 3927 bp, Artificial Sequence
  Description of Artificial Sequence: Synthetic coding sequence
atggacccgagcggaagccggggtagaccaacctgggtcctagctgggggactcctggcggtggcactggcactcggaggacggggttgcctgggcgcatcgagtcggcctcggtggaggccgctcggcgctcaaccaccgagagaccctcaggtggcaccacgcagcggcccaggcctgcggatcccacctggcaggagcggagcaggccctgaatcttcaactcaggatcttccttgtatgatttggcccaaagtcgagtgttgccactttaagacagctgttgaggcccctttgggtatgaagcttgacaaaaagatggaggtgttcatccctctttccacaagtgcggctagctccggaccctgggcccattcattgttcgcatttatccccagttggccaaagaagaatctatttaagagggaatcccccatcacccaccgcctgtatggtgacatttctcgtgaagtacagggaacctctgagaatggcgtcatttttcagaagtgcgcactcgtctctggtagcagcgaggcccaaacggcaaggatttggttgctggtgaacaacactaagacgacgtcaagcgccaaccttagtgagctgctcctgctggattccatcgcaggtcttaccatttgggattcagtaggcaatcgcacgtctgaagggttccaggccttcagcaaaaagtttctgcaagtgggggatgcttttgcagtctcatacgccgcaactctacaggcaggcgatttgggaaacggagagtcattaaagctgccagcccagctgaccttccaaagctcttcccggaaccggacccagttgaaagtgttgttcagcataaccgctgaagagaacgtcacggtgcttccccaccatgggcttcacgccgcagggttcttcattgcctttctgctgtccctggtgttgacctgggccgctttgtttctgatggttcggtaccagtgccttaaaggcaacatgttgacacggcatcgcgtgtggcagtatgagagtaagcttgaacccttgccctttaccagcgcagacggggtcaatgaagatttgtccctgaacgatcagatgattgacatactctcttccgaggacccgggatcaatgctccaggctctggaagagctggagatcgcaacgctcaaccgggcagacgctgaccttgaggcatgcagaacccagatttctaaagacataatcgccttgctcctcaagaacctaacttctagcggacatctaagcccccaagtggagcgaaagatgtccgccgtgttcaaaaagcagttcctgctgttggagaacgaaatacaagaggagtatgaccgtaagatggtggccctgacagcagaatgtgacctggaaacgcggaagaagatggaaaatcaataccagagagagatgatggctatggaagaggctgaggagcttttgaagcgggcaggtgaacgttcagctgtagaatgtagcaacctcctcagaacgttgcatggcctggaacaggagcatctgcggaagtccctggccttgcagcaggaggaagactttgctaaggcccaccggcagttggcagtgttccagcggaatgagcttcattcaatcttttttacccaaattaaaagcgccatttttaaaggcgagctgaaacctgaagctgctaaaatgttgttgcagaattattcaaaaatccaagaaaatgttgaagagctaatggatttctttcaggcctcaaaacggtatcatctctcaaaaagattcggccaccgggagtatttagtacagaacctgcaatcaagcgaaacccgtgtccaaggactcctgtccaccgccgcagcgcagctaacgcacctgatacagaaacacgaaagagccggataccttgacgaagaccagatggaaatgcttctcgagagggcacagaccgaagtgtttagcataaaacagaagttggataacgatttgaaacaagagaagaagaagctgcaccaaaagctgattacgaagcggagaagagagttgcttcagaagcatagagaacaacggcgagagcaggcttcagtgggggaagcgttcaggactgtagaggacgccggtcaataccttcatcagaagcgctcattgatggaagaacacggcgctacactagaagagcttcaagaacggcttgatcaagccgctctggacgatctgcgaacgctcactttgtcgctgtttgagaaagctaccgacgagctaagaaggttgcagaactctgccatgacacaggagcttctgaagcggggagtgccttggctgtttttacagcagatcctggaggagcacggcaaagagatggctgctcgcgcagaacaactagaaggagaggagcgggaccgagaccaggagggcgtgcaatctgtcagacaaaggctgaaagatgatgcaccagaagctgtgactgaggaacaggcggaactccgtcgctgggagcatctgatattcatgaaactttgcagcagcgtgttcagcctttccgaagaagagctgctgaggatgagacaggaagttcatgggtgctttgcgcaaatggaccgaagcttggccctgccaaagattagggccagagtgctattacagcagttccagactgcttggagggaagcagaattcgtgaagcttgatcaagccgtggcggctccagaactgcagcagcagtccaaggtccggaagagtagatccaaatcaaagtcaaaaggcgagttgctgaagaagtgcatagaggataaaatacatctttgtgaggaacaagcatcagaggatctggtggagaaagtgagaggggaacttctacgggaaagggttcagaggatggaggcccaggagggcggtttcgctcagtcccttgtcgcattgcagtttcagaaggcctcacgggttacagagacgctgtctgcatacaccgccctactgtccatacaagacctcctgctcgaagagctatctgcatccgagatgttgaccaagtccgcctgcacacagatcctggaaagtcactcacgcgaactacaggaacttgagaggaaattagaagaccaactggtacagcaggaagccgcacagcagcagcaggccttagcctcatggcagcaatgggtagccgatgggccaggtatactgaatgagcccggagaagttgactccgagcggcaggtctccacagtgctccaccaagcactgtccaagagccagacccttctcgagcagcaccagcaatgcctgagagaggagcagcagaacagcgtggtgttggaagatctgctggaaaatatggaagcagataccttcgctacattatgtagtcaggaattacgcctcgcaagctacctagctaggatggctatggtgcctggcgctaccttgagacgcctgctctccgtggttctccctactgcgtcccaacctcaattgctggccttgctggatagtgccacagagagacacgtggatcacgctgctgagtctgatggcggagccgaacaggcagacgtgggacgccgtaggaaacatcaatcatggtggcaagccctggacggcaagctcaggggggaccttattagcaggggtttggaaaaaatgctgtgggccaggaagaggaagcaatccatcttgaaaaagacatgcctgccactgcgtgagagaatgatcttcagtggaaaaggctcatggccccacctgtccttggaacccattggggagctggcacctgtccccatcgtcggtgcagaaacaattgatctgctgaacaccggcgaaaaactgtttattttcaggaatcctaaggagccagaaatttcactgcatgtgccacccaggaaaaaaaagaatttcttaaatgccaaaaaagcaatgcgtgctctgggtatggattag

SEQ ID NO: 221864 - DNA, 3741 bp, Artificial Sequence
  Description of Artificial Sequence: Synthetic coding sequence
atggatccctctggttccagaggccgaccaacttgggttctcgccggaggccttctcgcggtggcgctggcccttgggggtcgtgggtgccttggtgccagctcaaggcccaggtggcgcccattgggagcccagcctccccgagatccccaggtggccccacggtcgggcccaggcctccggatcccccctggcagatcgggcgctgggccagaaagctccacccaggacctgccctgtatgatctggcccaaagtcgagtgctgccactttaaaaccgcggtagaagcacccctgggaatgaaactggacaaaaaaatggaagtctttattcccctttccacaagcgccgcaagctctggaccgtgggcgcattcactgttcgccttcataccttcttggcccaaaaaaaacctgttcaagcgagaatccccaattacacatcggttatacggggacatttcaagggaagtgcaggggactagcgaaaacggcgtgatctttcaaaaatgtgctctggtttctggttcctctgaagctcagactgcacggatctggctccttgtgaataacaccaagacaacatcatctgctaatctttccgagctgctgcttcttgacagtattgccggtctgacaatctgggattctgtcggcaatagaactagcgagggcttccaagctttctcaaaaaaatttttacaagttggagatgcattcgctgtgtcatacgccgcaacccttcaggccggagatcttggcaatggagagtctcttaagctccccgctcagcttacatttcagtcttcctccaggaacagaacccagctgaaggtcctatttagcataacagctgaagagaacgtgacggtgctgcctcaccacggcctccatgctgctggcttcttcatcgcattccttctttcactcgtgctcacatgggctgcactgttcctgatggtccgataccagtgtctcaaggggaacatgctgacgcgacatcgcgtgtggcagtacgagtctaagctggaaccactcccgttcacgagcgcggacggtgtgaatgaggacttgtcactgaatgatcagatgattgacattctgagttccgaggatcccggtagtatgctccaggctctggaagagttagagatcgccacactgaacagggccgacgccgacctagaggcttgccgtacccaaatttctaaagatatcatcgcgctgttactgaaaaacctgacctctagcggccatctcagccctcaagtggagcggaagatgtctgccgtgttcaagaaacagttcctgctcttggagaatgagatccaagaggagtatgataggaaaatggttgctttgaccgcagagtgtgatctagagactaggaagaaaatggagaatcagtaccaacgggaaatgatggctatggaagaggctgaagagctcctgaagcgggctggcgaacgttcggccgtcgaatgttccaatttgctgaggaccctgcacgggcttgaacaggaacacttgagaaagagcttggctctccagcaggaggaagactttgctaaggcacaccgtcaattagccgtctttcaacggaatgagctccacagcatcttttttacccagattaaaagcgctatcttcaagggggaattgaagcctgaagcggctaaaatgctgctacagaattactccaagattcaggagaacgttgaggaactgatggatttcttccaagcaagcaagcgataccacttatcaaagcgtttcgggcatcgggaatatctagtgcagaacttacagtccagtgaaacaagggtccaaggcctcttaagtaccgctgccgctcagctgacgcatctaatccagaaacatgaaagagccggttacttggatgaggaccagatggagatgctcttagagagagcgcagaccgaggtttttagtataaaacaaaaacttgacaacgacttgaaacaggagaaaaaaaagttgcatcaaaagctgattaccaaacggagacgcgagcttcttcagaaacaccgtgaacagaggcgagagcaagcatccgttggagaagcatttcgcaccgtagaagacgctggtcagtatctccatcagaaacggtcccttatggaagaacacggagcaactcttgaggagctccaggagcgcctggaccaagctgccctcgatgacctccgcactctcacattgagcctctttgagaaggctaccgacgaactgcggagattgcagaatagcgcaatgacccaggaactgttgaagaggggagtgccctggcttttcctgcaacagattctggaagaacacggtaaggagatggcagccagggccgagcagctggagggcgaagagagagatagagatcaagaaggcgtccagtccgtacgtcagcgtctgaaagacgatgctcctgaggcggtcaccgaggagcaggctgaactaaggcggtgggagcaccttattttcatgaaattgtgtagctctgtgttctctctcagtgaggaagaactgctgcgaatgcggcaggaggtccatggatgctttgctcagatggatagatctctggctctccctaagatccgcgcacgagtgctcttgcagcagtttcagactgcctggagagaagctgagttcgtcaagctcgaccaagccgtggcagccccagagctccagcagcaatctaaggttagaaaatccaggagtaagtccaagagtaagggcgagttgctaaagaaatgtatcgaagacaagatccacctctgtgaggagcaggcctctgaagatcttgtggagaaggtcaggggggaacttctcagagaacgggtgcagaggatggaagctcaggagggcggtttcgcccaatctttagtggctctgcagtttcaaaaagcctcacgcgtcacggaaaccctatcagcttacacggcattgttatccatccaggatctgctccttgaggagctgtccgcctcagagatgctgacaaagtccgcatgtactcagatcctggagagccatagccgagagttgcaagaattggagcggaaacttgaggatcagctcgttcagcaggaagctgctcagcagcaacaggccttagcctcctggcaacagtgggttgccgatggcccaggaattcttaacgagcctggcgaggtggactccgaacggcaggtaagtactgtcttacatcaggctctgtccaaatctcagaccctgttggaacagcaccagcaatgtctgagagaagagcagcagaactctgtggtgctagaggatctactggaaaacatggaagccgacacattcgccactctgtgctcacaggagcttcgccttgcatcctatctggcacggatggcgatggtaccaggcgctactctgcgcagactgctgagcgtcgtgttacctacagccagccagccacagcttctggccctactggacagtgccacagaacgtcacgtggatcacgcagcggaatcagatggaggcgcagagcaggcagatgtgggaaggcgtcggaaacaccagtcctggtggcaggccctcgacggcaaactccgcggagacctgatttctcggggactggagaagatgttgtgggcacgaaaacgaaaacagaggtctggcaatcaagaaagcttttggcagtacctagttgggacccccgagatcggccttattgagtggatgtcggagaagtag

SEQ ID NO: 221865 - DNA, 882 bp, Artificial Sequence
  Description of Artificial Sequence: Synthetic coding sequence
atgtttattagtttatgggagttcttttatggtcatttcttccgcttctggatgaaatggctgctgagacagatgaccggcaaatgtgaactacagcggattttcgatacctacgtaggcgcacagcgcacacatcggatcgagaatagtctcacatactctaaaaataaagtgttgcagaaagcgacccacgttgtgcagtctgaagtggataagtacgtggacgatattatgaaagagaagaacattaaccccgaaaaggacgcttcattcaaaatatgtatgaaaatgtgcctgctccaaatcaccgggtacaaacagctttacctcgatgtggagtccgttaggaaacgaccgtacgattctgataaccttcagcatgaggagcttcttatgaaactatggaatctgctgatgcctactaagaaattgaacgctcgtataagtaagcagtgggcagaaatcggctttcagggggacgatcccaagaccgactttagagggatgggcatactcgggctgattaatctggtgtacttctcggaaaactatacgagtgaggcgcaccagatattatctcgctcaaatcatccaaaactgggttattcctatgcaattgtagggataaacttgactgaaatggcctattccctcctaaagagtgaggcactcaaatttcacctctataacctggtgcccggtatccctaccatggaacacttccaccagttctactgttatttagtgtacgagtttgacaagttttggttcgaggaagaaccagaatctataatgtactttaatctgtatcgggagaagttccatgagaaaatcaaaggtctgttgctggactgcaatgtggcgctgacactgaaagtgtag

SEQ ID NO: 221866 - DNA, 507 bp, Artificial Sequence
  Description of Artificial Sequence: Synthetic coding sequence
atgtttatctctctgtgggagtttttttacggccacttcttccggttctggatgaagtggcttcttcgacagatgaccgggaagtgcgagctccaacgcattttcgacacctatgttggggcacaaagaactcatagaattgagaacagtctaacctattccaagaacaaggtactccagaaagccacacatgttgttcagtcagaggtggataagtatgttgatgatatcatgaaggagaagaatattaaccccgagaaggacgccagctttaagatctgtatgaagatgtgcttactccaaataacaggctataagcagctatacctggatgtggaatctgttaggaagcgtccatatgactctgataatctgcaacacgaggaacttctgatgaaattatggaacctgctcatgcccaccaaaaagctgaatgcccgtatcagtaagcagtgggcagaaattggcttccagggagatgatcccaagacagactttagaggctag

SEQ ID NO: 221867 - DNA, 108 bp, Artificial Sequence
  Description of Artificial Sequence: Synthetic coding sequence
atgttcattagtctgtgggagttcttctacgggcacttctttcggttttggatgaagtggctcttgcggcaaatgacagggaaatgcgagctccagcggatcttctag

SEQ ID NO: 221868 - DNA, 1866 bp, Artificial Sequence
  Description of Artificial Sequence: Synthetic coding sequence
atggcggcactgaaggaggatagatcgtatggcttatcatgtggcagggtgtctgacggctctaaggtgtcagtgttccacgttaagctcactgactccgcgctgagagcatttgaatcctatcgggctcgacaggactccgtgagccttcgaccttccatccgtttccagggctctcagggacacatttccatcccacaacccgattgtccagccgaagccagaaccttctcgttctacttgtcaaacatcggacgtgacaaccctcagggcagctttgattgcattcagcagtatgtgagctctcatggcgaggtgcatttagactgtctcgggagcatccaggataaaatcaccgtttgcgctactgacgatagctatcaaaaggccaggcagtccatggcacaagccgaggaagagacaaggtctcgcagcgctattgtgattaaggccggtggtcgctacctcggtaagaaggtgcagtttcggaaaccggcacctggcgcaactgacgcagtgccatcacgcaaaagagcaacaccaatcaacttggccagcgctataaggaagtccggggcttcggctgtgagcggaggctccggggtgtctcagaggcctttccgagatcgcgtcctccacttgctggcccttagaccatataggaaggcagaactgctgctcaggctgcagaaggatggcctgactcaggccgacaaggatgccttggatgggctcctccagcaagtggccaacatgtctgctaaagacggtacttgtaccctgcaggactgcatgtataaagatgtgcagaaagattggccagggtattctgagggcgaccaacaactgttgaaacgagttctagtccgtaagctgtgtcagccacagagcactggcagccttttgggcgaccctgcagctagcagcccacctggagagagagggaggagtgctagccctccacagaagaggctgcaaccacccgatttcattgaccccttggccaacaagaaaccaagaatctcacattttactcaacgagcacagccggcagtcaacggcaagttgggggtgcccaacggaagagaagcccttcttcccactccaggccctcctgcatccactgatactctttcctcatcaacgcacctaccccctcgcctcgaacctccacgcgctcatgatccgttggcggacgtctctaacgacttgggacatagtggcagggactgtgaacatggtgaggctgctgcaccagccccaacagttcgcctaggactccctttgcttaccgactgcgcacaaccttcaaggccccacggctcaccctccagatctaaaccaaagaaaaaatcgaaaaagcacaaggacaaagagcgggctgctgaggacaagcccagggcgcagctgcccgactgcgctcccgcaacacatgctactcctggggctcctgctgatacacccggtctgaacggcacctgctccgtgtcgagtgtcccaaccagtaccagcgagacccccgactatctcctcaaatacgcagctattagcagttccgagcagcgacagtcctacaaaaacgactttaatgctgaatacagcgaatacagggatctacatgctaggattgaacgcattaccagacgatttacgcagctcgacgcacagctgcgacagctttcacaagggtcggaggagtacgagacaactagagggcagatcttacaagaatatagaaagatcaagaagacgaacaccaactattcacaagaaaaacataggtgtgaatacctccatagtaaacttgctcacattaaaagactgatagccgagtacgatcagcgacaactgcaggcgtggccgtag

SEQ ID NO: 221869 - DNA, 90 bp, Artificial Sequence
  Description of Artificial Sequence: Synthetic coding sequence
atacatcggctggttgttgccttccaagatagcgtgtccctgaggccatctatccggttccaggggagtcaaggcgagatgagcctgtag

SEQ ID NO: 221870 - DNA, 1194 bp, Artificial Sequence
  Description of Artificial Sequence: Synthetic coding sequence
atggaggagttacaggaacctctccgaggccagctgcgcctgtgcttcacccaagcagcacggacatctctgctgctgttgcgcttgaacgacgcggcactgcgtgcgcttcaagaatgtcagcggcagcaagtgaggcccgttatcgcgttccagggccacaggggctatctcaggttgcctggccctgggtggagctgcttattttcatttatcgtgagtcaatgctgtcaggagggggctggcggaagcctggacttggtttgccagcgcttcctccgaagcggtcctaacagtctgcattgtctcggttcactccgggagcgcctaatcatctgggcggcaatggactcgatccccgctccgtcgagcgttcagggacacaacctgacagaggatgccagacatccggagagctggcagaataccggcggatatagcgaaggcgacgccgtgagccagccacaaatggcactggaggaagtgtcagtgagcgacccactggcatctaaccaagggcagtccctgcccggttcatctcgagaacatatggcccagtgggaggttaggagtcagacgcacgttcccaatagggagcccgtacaggccctgccttcttccgcatcgcgaaagagacttgacaagaaacgatccgtcccggtggcaaccgtggagctggaggaaaagagatttcgaaccttgcctttggtgccctctcctttgcagggcttgaccaatcaagaccttcaggaaggtgaggactgggagcaggaggatgaggatatggatccccgactggagcactcctcatcagtacaagaggatagcgagtccccatcccctgaagacatcccagattatctgcttcagtatcgcgctattcatagtgccgagcagcagcacgcatacgaacaagattttgagacagattacgccgagtataggatactgcacgctagggtaggcacagcctctcaacgcttcatagaactgggcgcagaaatcaagagggtgcgacggggtacaccggaatacaaagtgctcgaggataaaattatccaggagtataagaagttccggaagcagtaccctagctatagagaagaaaaacggagatgtgagtacctccatcaaaagctaagtcatattaagggtctgatcctcgaattcgaggagaagaaccggggatcttag

SEQ ID NO: 221871 - DNA, 2889 bp, Artificial Sequence
  Description of Artificial Sequence: Synthetic coding sequence
atggacaccgatctgtatgacgagttcggaaactacattggcccagaacttgactctgatgaggatgatgatgagctcggccgagaaacaaaagacctggatgaaatggacgacgatgacgacgacgacgatgtgggagatcatgacgatgatcacccgggaatggaggtcgttctgcatgaggtatacggtcccgaggtagaaacaattgtgcaagaggaagatactcagcccctcacagaacccatcatcaagcctgtaaagacaaagaagtttaccttaatggagcaaacactgccagttacagtatatgaaatggactttctggctgacctgatggataatagcgagctcatccggaacgtgactttgtgcggtcatctccaccatggaaaaacttgctttgtggactgcttaattgaacagacccacccagaaatcaggaaaaggtatgaccaggacctttgctataccgatatcttgttcacagagcaagagcggggagtcgggattaagtctaccccagtgactgtggtactgccggacacaaagggcaaaagttatttgtttaacatcatggatacacctggtcacgttaactttagcgatgaagttacagctgggctgagaatttccgacggagtggttttgttcatcgacgctgccgagggcgtaatgctgaacacagagaggctcatcaaacacgccgtgcaggaacgccttgccgtcacagtctgcataaacaagattgacaggttgatcctcgaactcaagctgcctcctactgatgcgtattacaagcttcgtcacattgtagacgaggttaacgggctcatttccatgtacagtaccgatgagaaccttattctctccccactactggggaacgtttgtttctctagctcccagtatagcatctgcttcactctcggaagcttcgccaagatttatgccgacaccttcggggatataaactaccaggaatttgccaagaggctgtggggcgacatttatttcaaccctaagactcggaaattcaccaaaaaagccccaacatcctcaagccagcgatcctttgtggagtttatactagaaccgctctacaagattttagcccaggtagtgggggatgtggatacttcactccctcgcaccctggatgaattgggcattcatctgacaaaggaggaactgaagttgaatattaggcctctcctgcgtcttgtgtgtaaaaaatttttcggcgagttcacaggcttcgtggacatgtgtgtacaacacattccaagtcccaaggtaggagccaaaccaaagatcgagcacacatataccggcggagtggattccgatcttggcgaggcgatgtcagattgtgatcccgacgggcctctgatgtgtcacaccacgaagatgtatagtaccgacgacggagtgcagtttcatgcatttgggagggtcctgagcggcacaattcacgccggacagccggttaaagtgctcggtgaaaattatactttggaggatgaagaagactctcagatctgtacagtgggcagactctggatatcagtggccagataccatatagaagtgaaccgcgtcccggctggaaattgggtcttaattgaaggcgttgaccagcccattgtaaagacggctacaattactgagccacgaggcaatgaggaggctcaaatcttcaggccactaaagtttaacacgacgtctgtgattaagatcgccgttgagccggtgaaccctagtgaactacccaaaatgctggacggccttcgaaaagttaataaatcttatccctcactgactacaaaggtagaagagagtggcgaacacgtgattctgggaacgggtgagctatatttggactgcgtaatgcacgacttgaggaagatgtattccgaaattgatattaaggtggctgaccctgtcgtgactttttgcgaaacagtagtggagaccagtagcctcaaatgctttgccgagactccgaataagaaaaacaagatcacaatgattgctgagccactggagaagggtctggccgaggatatagaaaatgaagttgtccagataacctggaaccgcaaaaagctgggtgaattcttccagacgaaatacgactgggatctgctcgcagctagatccatttgggcgttcggcccagatgccaccggaccaaatattctggtagacgatacactcccatcagaggtcgataaggcattactgggatcagttaaggacagtatagtgcagggctttcaatggggcaccagagaagggcctctgtgtgatgagctcattcgaaacgtgaagttcaagattctcgatgcggtcgtagctcaagaaccccttcacagaggtggaggtcagataattccaaccgcccgacgcgtggtgtacagtgcatttctgatggctacacctagattgatggaaccctactacttcgtcgaggtccaggcacctgccgactgtgtgagtgccgtctacacagtgctggcccgacgcaggggtcacgtaactcaggatgcgcctattccagggtctcccctgtataccatcaaggcatttatccccgcaatcgatagctttggtttcgagacggacctgcggactcacacccaaggtcaggctttctctctgtcagtcttccaccattggcaaatcgtccccggtgaccccctggataaaagcatcgtcattcgccctcttgagccacaacctgccccacatctcgctagggagtttatgatcaaaaccagaagacgcaaagggctgagtgaggacgttagtatttcaaagttcttcgatgacccaatgctgctcgaactggcaaaacaggacgtggtgcttaactaccccatgtag

SEQ ID NO: 221872 - DNA, 2814 bp, Artificial Sequence
  Description of Artificial Sequence: Synthetic coding sequence
atggatgatgacgacgacgacgacgatgtcggggaccatgatgatgatcacccgggtatggaggtggtgttacacgaggataagaagtactatccgactgccgaagaggtgtacggccctgaagtcgaaacgatagtgcaggaggaggacacgcaaccgctgacggagccaattatcaaacccgtgaagaccaagaagttcactctgatggagcaaactcttccagtgacagtgtatgagatggatttcctggctgatctcatggataattctgaattaatccggaacgtgacattatgcggacatctccatcacggaaaaacctgcttcgtggattgtttaatcgagcagactcacccggaaattcgaaagcggtatgatcaggacctgtgctacacagatatcctatttaccgagcaagagaggggggtagggattaagtccaccccagtgaccgtggtcttaccagacacgaagggcaaaagctaccttttcaatatcatggatactccaggacacgtcaacttctcggatgaagttaccgcagggctccgtatctccgatggcgtagtgctgtttattgatgccgctgaaggggtcatgctgaacacagagcgcctcatcaagcatgccgtgcaggaaagactcgccgttactgtttgcatcaacaagatcgacagactgatcctggaacttaaattgccaccgacagatgcctattataaactgcggcacatagtggacgaggtgaacggcctgattagcatgtactctaccgacgaaaacttgattttgtcacctctcctcggtaacgtatgcttttcaagttctcagtattcgatctgtttcactctcggctccttcgccaaaatctatgccgacacattcggcgacataaattaccaggagttcgccaagcgtctgtggggtgatatatactttaatccaaaaacccgcaaattcacaaagaaagcacccacaagctcatcccaacgcagttttgttgaatttatccttgaaccactgtataaaatacttgcccaggtggttggagatgtcgacacatccctgccgaggacactggacgaacttggaatacacctgacaaaggaagagctgaagctgaacattaggcccctcctgcggcttgtctgtaaaaaatttttcggtgagtttactggcttcgtagatatgtgcgtccaacacatcccaagccccaaagtgggagccaaacctaagatcgaacacacctacacaggtggggttgatagtgatctgggtgaagctatgtcagattgcgaccctgacggaccattgatgtgtcatacaacgaagatgtacagcaccgatgatggagtccagttccacgcatttggacgtgtcctgtcaggcacaatccacgctggtcaacctgtcaaagttttgggcgaaaattatactttagaggatgaggaagacagccaaatctgtactgtcggaagactatggatctctgttgctagatatcacatcgaggtgaaccgtgtgcctgcaggaaattgggtgctgattgagggtgtggatcagcccatcgtcaaaaccgcaaccatcacagagccacggggaaacgaagaggcccagatttttcgacctcttaagttcaatacaacaagcgtgatcaagatcgccgtggagccggtgaatcctagtgaactgcctaagatgttagacgggctaaggaaggtaaataaaagctacccgtccctgacaaccaaggtggaggaaagtggggaacatgtcatcctgggcaccggggagctctacctggattgcgttatgcacgacctaagaaagatgtattcagagattgacattaaggttgcagatcccgttgtaaccttttgcgagaccgtcgtggaaacgtcctctttgaagtgcttcgcagaaactccaaataaaaagaacaaaattacgatgatcgccgagcccctggagaaaggtctggccgaggacatcgaaaacgaagtcgtgcaaatcacttggaaccgcaagaagcttggagagttcttccagacaaagtatgactgggacctgctggccgctaggtccatctgggcgttcggtcctgacgccaccggccctaacattctcgtggacgatacgctcccgagcgaggtagacaaggccctgttggggtccgttaaagactctattgtacaaggcttccagtggggaacgcgggaaggtcccctgtgcgacgagctcatccgcaacgtgaagtttaaaattctggatgccgtcgttgcccaagaaccactgcaccgcggtggaggccaaattattccaacagccagaagagtggtgtattctgcctttctcatggctacacccagacttatggagccatactatttcgtggaggtccaagctcccgcagattgtgtgagtgctgtgtataccgtgcttgctagacgaaggggccacgtaacacaggatgccccaattcccggaagcccactttatactattaaggcttttataccggctattgactcatttgggttcgagacagacctccgaacacacacacaggggcaggcctttagcctctccgtgttccatcattggcagatcgtgcctggcgatccactcgacaagtccattgtgatccggccattggagccacagcctgccccacatctggccagagaattcatgattaaaactcgaagaaggaaaggtctgtccgaggatgtgagcattagtaagttcttcgacgacccgatgctcctggaactggccaagcaggacgtggtgctcaattaccccatgtag

SEQ ID NO: 221873 - DNA, 2919 bp, Artificial Sequence
  Description of Artificial Sequence: Synthetic coding sequence
atggacaccgacctttacgacgagttcgggaattacatcggccctgagctggatagcgatgaagatgatgacgaacttggcagagaaaccaaagatctcgacgaaatggacgacgatgacgatgacgacgacgttggtgatcacgatgacgaccatccaggaatggaggtagttctccatgaggataaaaaatactacccgacggccgaggaagtctacggtccggaggtcgaaaccatcgtgcaagaggaagacacacaaccactgacagaacccatcataaagcctgtaaagaccaagaagttcactttaatggaacagacactgccagtcacagtgtatgagatggattttctagccgatctgatggacaattctgagctcattcggaacgtgacactgtgcgggcacctgcatcacggcaagacttgcttcgttgattgtctgatcgaacagactcacccagagatccgcaagcgctacgatcaagatctgtgttacactgacatcttgtttacagagcaagagaggggcgttgggatcaagtcaactcctgtgacagtggtgctcccggacactaaaggcaagagttatttatttaatattatggatacccctggccatgtcaattttagcgacgaggtgaccgccggattgcggatctcagatggagtggtcctcttcatcgacgctgctgagggcgtgatgctgaacacggagaggctgattaaacatgcagtccaggagagactcgcagtgactgtctgtatcaacaagatagatcgcctgattcttgagttgaagttaccaccaacggatgcttactataagctaagacacatagtggacgaagtcaatggactcattagcatgtatagtactgacgagaatctgattctgtcccctcttctggggaatgtctgtttcagctcctcacaatacagcatttgctttacactggggagctttgcaaagatttatgccgacactttcggcgacataaactaccaggaattcgctaaacgtctgtggggtgatatatattttaaccccaaaacacggaagttcactaagaaggcacctacctcaagttctcagcgttcctttgtggaatttattcttgagccgttgtataaaatccttgcacaggttgtcggggatgtggatacttctctcccccgaacactggacgaactgggaattcacctgaccaaggaggagttaaaacttaatatccgaccactccttcggcttgtgtgtaagaaattctttggcgaatttaccgggtttgtcgacatgtgtgtccagcacatcccatcccccaaggtcggggctaagcccaagatcgaacatacttacacaggcggagtcgacagtgatctcggtgaggcgatgtcagattgtgatccggacgggccactaatgtgccataccacaaagatgtactctacagacgatggagtgcagttccatgccttcggtcgggtgctctctggcacaattcacgcgggtcaacccgtgaaagtgttgggcgaaaattacacactagaggatgaagaagattcgcaaatatgcacagtgggcagactctggataagcgttgccagataccacatagaagtgaaccgcgtgccagccggtaattgggtgttgatagagggcgtggaccagcctatcgtaaagactgcaacaataaccgaaccccgtggcaacgaggaagcacagatcttcagaccgttgaagtttaatacgacttcagtgataaaaatcgcagtggaacctgtaaacccctccgaactgcccaaaatgttggatggcttgagaaaggtgaataaaagttatccgagcttaactacaaaggtggaggaaagcggggaacacgttattttaggcactggagagctatacctagactgtgtcatgcatgacttgcgtaagatgtactcggagatcgacatcaaagtggcagacccagttgttactttctgtgaaacagtggttgagacatcctcgctaaagtgttttgccgagacacctaataagaagaataagatcaccatgattgccgagcccctggagaaggggctggccgaggacatcgagaacgaggtagtgcagatcacttggaataggaagaagctcggggaattcttccagaccaagtatgattgggacctactcgcagcaaggagcatctgggcattcggacctgatgctacaggtcctaatattcttgtcgacgacacactgccctcagaagtggataaggcactgctggggagtgttaaggatagcatagttcagggctttcaatggggcacccgggaagggccactctgtgacgagctcatacgcaacgtaaagttcaaaatcctcgatgccgtagtggcgcaagaaccgctgcatcgcggagggggacagatcataccaactgcccgtagggtggtgtacagcgctttcttaatggccaccccaagactgatggaaccctattacttcgtagaggtccaggcccctgccgactgcgtctcggccgtctacaccgtgttggctcgccgtaggggtcacgtcactcaggacgccccaattcccggttctcccttgtacactataaaagcatttatcccagctattgactcctttgggtttgagactgacctccggactcatactcagggtcaggctttctccttatctgtattccaccattggcagatcgtacctggagatcccctcgacaaatcaatagtcatacggccactggagcctcaacctgccccacacctggcccgtgaatttatgattaagacccgcaggcggaaaggtctgagcgaggatgtgtcgattagcaagttttttgacgatcccatgctcttagaactggctaagcaggatgttgtcctaaattacccaatgtag

SEQ ID NO: 221874 - DNA, 1923 bp, Artificial Sequence
  Description of Artificial Sequence: Synthetic coding sequence
atggcagctggcggtacaggcggtcttcgcgaagaacagcggtatggcctgagctgcggtcgattgggccaggataacattaccgtactgcacgtaaagctcactgaaacagccatccgcgcactcgaaacttatcagtcgcataaaaacttgatcccatttcgaccctccatacaatttcaggggcttcatggcctcgtcaaaattccaaagaacgatcctcttaacgaggttcataactttaatttctatctgagcaacgtgggcaaggacaacccccaggggtcattcgattgtattcagcagacattcagctctagcggagcctctcaacttaactgtttgggctttatccaggataagatcacagtgtgtgccactaacgatagctatcagatgacacgggaacggatgacccaggctgaggaggagagccgcaaccgctccacaaaagtcattaaaccagggggtccttacgtcgggaagcgcgtgcaaatcaggaaagctccacaagcggtatccgatacggtgcctgaacggaagagatccacacccatgaatcccgctaacacgattcgaaagacccattcttcatccaccataagtcagcggccatatcgagatcgcgtgatccacctcctcgctctgaaggcatacaagaagccagagctgctcgctcgcctgcagaaggatggagtcaaccagaaagacaagaattccctgggcgctattctgcagcaggtggccaacctgaatagtaaggatctgtcgtacaccctaaaagattatgtctttaaggaactgcagcgcgattggccgggatatagcgagattgataggaggtctctggagtccgtgctgtcccgtaaactcaatcctagccagaacgccgcaggcaccagccgcagtgaatcaccagtctgtagtagcagagacgccgtttccagtccacagaaaaggttgctcgactccgagtttatcgaccctctgatgaataagaaggccagaatatcccatctgacaaacagggtaccacccaccctcaatgggcatcttaacccaacctctgagaaatcagcggctggccttcccttgccacctgcagccgctgccatccccacacccccacccttaccaagcacatatctgccgatttctcacccgccacagattgtgaactcaaattctaactctccctctaccccggaggggaggggaacccaagacttgcccgtggattctttcagccagaacgatagtatttatgaagaccagcaagacaaatataccagcaggaccagccttgaaacattgcccccaggaagtgtgttgctcaaatgccctaagcccatggaggagaaccacagtatgagccacaaaaagtcaaagaaaaagtccaagaaacacaaggaaaaagatcagatcaaaaagcacgacatcgagacaattgaggagaaggaagaggatctgaagcgagaggaagagatcgccaaacttaacaacagtagtcccaattcaagtggaggcgtgaaggaagactgcacggcaagtatggaaccatctgctattgagctcccagactacctcataaagtatattgccatcgtttcgtatgagcagagacagaattataaggacgacttcaatgcggaatacgacgagtaccgagctttgcacgcaaggatggagaccgtcgccaggcgctttatcaaactggatgcccagcgtaaaagattgagtccaggttccaaagagtaccagaatgtgcacgaggaagttctgcaggaataccaaaagataaagcagagtagtcccaactatcacgaagaaaaatatcgctgcgagtacctccacaataaactggcccatattaaacgcttaattggtgaatttgaccagcagcaagctgagagttggtcctag

SEQ ID NO: 221875 - DNA, 1173 bp, Artificial Sequence
  Description of Artificial Sequence: Synthetic coding sequence
atggccgctggtgggaccggaggcttgcgagaggaacaaagatatggactctcctgcggtaggctggggcaggacaatattacagtgctgcatgtgaaactaacagaaactgccattagagcattggagacttaccagtctcataagaatctcataccctttcgcccatcaatccagtttcaagggctgcacggtcttgttaagatccctaagaacgacccgttaaatgaggtccataattttaacttctatttgtctaacgttggaaaagacaatccccaggggtccttcgattgcattcaacagacgttcagcagttctggtgcctcgcagttaaactgcttgggtttcattcaggataagatcacagtgtgcgcgactaacgattcatatcagatgacaagagaaaggatgacccagattgtcaacagtaattctaattcaccatctacacccgaaggcaggggcacacaggacctgccggtcgatagcttttctcaaaatgattctatttatgaggaccagcaggataagtacactagtcggacctcacttgaaactcttccgccaggatcggtacttctcaagtgtcctaaaccgatggaggaaaaccacagtatgtcccacaagaagtccaaaaagaagagtaagaagcataaagaaaaggatcagatcaaaaaacatgacattgagacaatcgaggagaaagaggaagacctaaagcgagaagaggagatcgcaaaactcaacaatagctcccccaatagctccggtggcgtcaaggaagattgtacagcctcaatggaacctagcgcaatagagctcccagactacctgatcaaatatattgccatagtaagctatgagcaaagacagaattataaagatgattttaatgccgaatatgacgagtaccgggcattgcatgctcgtatggagactgtggccaggaggttcatcaagctagatgcccagcggaagagactgagtcccggatccaaagagtatcaaaacgtccacgaggaagtattgcaggaataccagaagattaaacagagcagccccaattaccacgaggaaaaatacaggtgtgaatacctgcataacaagctggctcacattaaacgcctgattggtgagtttgatcagcaacaggctgagtcttggtcctag

SEQ ID NO: 221876 - DNA, 1644 bp, Artificial Sequence
  Description of Artificial Sequence: Synthetic coding sequence
atgcgccaaaagaggaagggggaccttagccctgccgagctgatgatgcttaccatcggcgacgttataaaacaactgatcgaggcccacgagcagggaaaagacattgatttaaacaaagtgaaaaccaaaactgctgcaaagtacggcctgagcgcccaaccgagattagtggacatcattgcagccgtccctccacagtacagaaaagtgcttatgcccaagctgaaggctaagcctatccggactgcatctggaattgctgtggtcgcagtcatgtgtaagccccacaggtgtccccacattagttttaccggcaacatttgcgtgtactgccccggagggccagatagcgactttgaatactccacccaatcctatacaggctacgaacctacctctatgcgtgccatacgtgccaggtatgacccgtttctgcagacccgccaccgcatcgagcagctgaaacaactcgggcatagcgttgataaggttgaattcattgtgatggggggaactttcatggctttgccagaggagtacagggactactttatccggaacttacatgacgcactgagcggacacacgtccaataatatttacgaagccgttaagtacagcgagcgctctctaacaaaatgtattggaattactattgagacaagaccagactattgcatgaagaggcaccttagtgatatgctcacttacggctgcacccgccttgagatcggagtgcagagcgtgtacgaggacgtggcaagggatactaatagaggccacacagtgaaagccgtttgcgaatcatttcacctggcaaaggacagtgggttcaaggtcgtcgctcacatgatgcctgatctgccgaacgtagggctggagcgggatatcgaacagttcactgaattctttgagaatccagcatttaggccagacggtttaaaattataccctaccctcgtaatccggggtaccggcttgtatgaactgtggaagtccggaagatataagtcctacagtccctctgatctggtcgagttagtcgcacgaatattggcattggttcccccttggactcgagtctatcgggttcagagggatattcccatgcctctggtctccagcggcgtggagcacggtaacctgcgggagctggctctggctaggatgaaggacctaggtatacaatgtcgtgacgtcagaacccgagaggttgggatccaagaaattcatcataaagtgcgaccttatcaggtggagctggtcaggagagactacgtagccaatggcggttgggaaacatttctctcctatgaagacccagatcaagatatcctcataggactactgagactcaggaagtgttccgaagagacattcaggttcgagctgggcggaggcgtgtccatcgtcagagaactgcacgtgtatggatccgtagtgccagtatcgtccagagatcccactaaattccaacaccagggtttcggcatgctattgatggaagaggcagagcgcatcgccagagaggagcatggcagcggcaaaattgccgttatttcaggcgtaggcacaaggaattactaccgcaaaatcggctacaggttacagggtccttacatggtgaagatgctgaaatag

SEQ ID NO: 221877 - DNA, 1368 bp, Artificial Sequence
  Description of Artificial Sequence: Synthetic coding sequence
atgtgtaaacctcacaggtgtccacacatcagctttaccggaaatatttgcgtctattgtcctgggggtcccgactcggatttcgagtactctacccagtcttatactgggtatgaacccacttcaatgagggcaattcgggcaaggtatgatccattcctccagacacggcaccgcatcgagcaacttaagcagctcggccactctgtggacaaagtcgagtttatagtcatgggcggaacattcatggcactgcccgaggaatatcgcgattacttcattcgtaatctccatgacgccctctcgggccacacatccaataatatctatgaagcagttaagtactcggagaggtcattaactaagtgcatcggtatcaccattgaaacccgccctgattactgcatgaagcggcatctttccgatatgctgacctacggatgcaccagattggagatcggtgtccagtcggtgtatgaagatgtcgcccgagatacaaatagaggacataccgtcaaggcagtgtgtgagtctttccatctggcaaaagactcgggttttaaggtggtcgcacatatgatgcctgacctccctaacgtgggtctcgagagagatattgaacagttcactgaattcttcgaaaaccccgcatttcggccagacgggttaaagctgtaccccacgctggtgatccgcggaaccgggctttacgagctctggaagtctggccgatacaagagctactctccatcagacctggtcgagctggtggccaggatcctggccctcgtgcccccttggactagggtgtatagagtgcagcgcgacattccaatgcctcttgtctcctcaggcgtggagcacggaaatttgagggaactcgctcttgcaagaatgaaagacttgggcatacagtgcagggatgtgcggacaagggaggttggaattcaggaaatacaccataaagtcaggccctatcaagtggagctggtacgaagagactatgttgccaatggcggttgggaaacatttctgagctacgaagatcctgaccaggacattttgataggcttacttcgactgcgcaagtgttccgaggagacatttcgattcgagctcgggggaggagtatcaatcgtgagggaattgcacgtttacgggtccgttgtgccagtctctagtcgcgaccctactaagttccaacaccagggtttcggtatgttgctcatggaagaagctgagcggattgcgagagaagagcacgggtcgggaaagatcgctgtcatcagtggcgtggggactcgcaactactacagaaaaatcggctaccggctgcagggtccatacatggtgaaaatgcttaagtag

SEQ ID NO: 221878 - DNA, 342 bp, Artificial Sequence
  Description of Artificial Sequence: Synthetic coding sequence
atgatgctgaccattggggacgtgatcaaacaattaatagaagcccacgaacaaggaaaagatatcgatctgaacaaagtgaagacaaaaacggcagccaagtatgggctgtcggcccagccaagacttgttgacattatcgccgctgtcccaccccagtaccgtaaagttctgatgccaaagctgaaggccaagcccataaggaccgcttccggaatcgcagtggttgccgtaatgtgcaagccccaccgctgtcctcacatttcttttaccggaaatatttgtgtctactgtccagggggacccgattctgactttgagtacagcacgcagtcatattag

SEQ ID NO: 221879 - DNA, 1602 bp, Artificial Sequence
  Description of Artificial Sequence: Synthetic coding sequence
atgatgttaacaatcggcgacgtgatcaaacagcttattgaagcacatgaacaggggaaggacattgatctgaacaaagtgaagacgaagacggccgctaaatacggcctctctgctcagcccagacttgtggatattatcgcggcagttccaccccagtacaggaaggttttgatgcctaagttgaaggccaaacctatcagaaccgccagcggaattgccgtggtggcagtgatgtgcaaaccacataggtgtcctcatattagttttacaggcaatatttgcgtgtactgtccgggtggccctgatagcgatttcgagtattctacacagtcttatactggatatgagcctacatctatgcgggctataagagcacgttacgacccatttctgcagacacgtcacaggatcgaacagctcaagcaacttggacactccgtcgacaaagtggagttcatcgtgatggggggaacgtttatggctctgcctgaggagtatcgagactattttattagaaatttacacgatgccttaagcggtcacacgtctaacaatatctacgaagctgtaaagtatagtgaacgcagcctgaccaagtgtattgggatcaccattgagacaaggccagactattgcatgaaaaggcatctgagtgatatgcttacttacgggtgtacccgtctggaaatcggagtccagtccgtgtatgaagatgtggcccgagacaccaaccgcggacataccgtgaaggccgtctgtgagagtttccacttagcaaaggattcaggatttaaggtagtggcccacatgatgcctgacttgcctaatgtggggcttgagcgggatatcgagcagtttacggaattctttgagaaccccgcatttcgaccagatgggctgaaactctaccctacactggtgatccggggtacaggcctatacgaactgtggaagagcggcaggtataagtcatacagtcctagcgaccttgtcgagctggtcgcccgaatactggctttagtacctccttggactagagtgtaccgcgtgcagagggacataccgatgcccctggtaagctcaggcgttgaacacggcaatttgcgcgagctggcactggcgaggatgaaggacttaggcatacaatgtcgcgacgtgcggacacgcgaggtgggcatacaagagattcatcacaaagtcagaccgtaccaagtcgagcttgtgcgcagggattatgtggccaatgggggttgggagacgtttctgtcatatgaggacccagaccaggatatcctgataggtctattacggttaagaaaatgctctgaagagacatttaggttcgaattaggcggaggggtgagcattgtccgggagctgcacgtgtatggcagcgtcgtccctgtcagttcaagagaccccacaaaattccagcatcagggcttcggaatgttactcatggaggaggcagaacgaattgcacgtgaggaacacggcagcgggaaaatagccgtgatctccggagttggaacgaggaattactaccgcaagattggttaccgcctccaggggccttacatggtaaagatgctgaaatag

SEQ ID NO: 221880 - DNA, 576 bp, Artificial Sequence
  Description of Artificial Sequence: Synthetic coding sequence
atgatgctgaccatcggcgacgtcatcaagcagctgattgaggctcatgaacaaggcaaagatatcgatttgaataaggtaaaaacaaaaactgcagccaagtacgggctttccgcccagccacggttggtggatatcattgcagctgtgcccccacagtataggaaggtgctgatgccaaaacttaaggctaagccgattcgcactgctagcgggattgccgtcgtggcggttatgtgcaagccgcacaggtgcccacatatttcttttacaggaaacatttgcgtgtattgtcctgggggaccggactctgacttcgagtattcaacacagtcctacacaggatatgagcccacgtcgatgagagccattagggccaggtacgaccctttccttcagaccagacacaggatagaacagcttaagcagcttggtcattcagtcgacaaagtggagtttatcgtcatgggaggaacattcatggcccttcctgaggaatacagggactattttatccgaaatctgcacgacgcactttccggccacactagcaataacatttatgaggccgtatag

SEQ ID NO: 221881 - DNA, 1287 bp, Artificial Sequence
  Description of Artificial Sequence: Synthetic coding sequence
atgtctacccaccagttttacagaaaatacatgtgcccaactagcatgcgcgcaatccgggctaggtatgacccatttttgcagactagacatcggatcgagcaactgaagcagctgggccacagtgtggataaggttgaattcattgtcatgggaggcacattcatggcacttcctgaagagtatcgtgattacttcatccggaacctccacgacgcattgtccggccacaccagtaacaacatctatgaggcagttaaatattccgagcggtctctaacaaaatgcattggtataaccattgaaactaggcctgattactgcatgaagcgccatcttagtgacatgctaacgtatggctgcacaagactggagatcggcgtgcaatctgtatacgaggatgttgcgcgagataccaaccgagggcatactgtcaaagctgtgtgtgaatcatttcatcttgccaaggacagtggattcaaagtagtggcacacatgatgcctgatttgcctaacgtaggactcgaaagagacattgaacagttcaccgaattttttgagaatccagcgtttcggcctgatggattgaagctctatcctacgctggttatccgcggaacgggcctctatgaattatggaaaagcggtcggtataaatcctactctccgtctgatctggtcgagctggtggccagaatccttgccttggtcccaccttggacacgcgtttaccgtgtgcaacgggacattcccatgcctctagtcagctccggagtggagcatggaaatctgagagaattagctctggctcgaatgaaggacctgggaattcagtgtagagatgttcgcacccgggaggtcgggattcaggaaattcaccacaaagtgaggccctatcaggtggagttggttcggagagattacgtggctaatggaggctgggaaactttcttaagctacgaagatcctgaccaggatattctgatcggacttctgcgactgagaaaatgtagtgaagagacctttcgcttcgagttggggggtggtgtgagcattgtcagagagctccatgtttacggaagtgttgttccagtcagctcaagagatcccaccaagttccaacatcagggattcggcatgctgctgatggaggaagcagagcgtatcgctcgcgaagaacatggaagcggcaagattgccgtgatttctggcgtcggcacaaggaactattatcggaagataggatacaggcttcagggaccatacatggttaagatgctcaaatag

SEQ ID NO: 221882 - DNA, 1257 bp, Artificial Sequence
  Description of Artificial Sequence: Synthetic coding sequence
atgtgcccgacctctatgagagcgattagggcccgttacgacccattcctccagacgaggcacaggattgagcagctgaaacagctgggtcattccgttgacaaagtagaatttatcgtaatgggcggaacttttatggccctgcctgaagagtacagggactatttcattagaaatctgcatgatgcattgtccgggcatactagcaacaatatttacgaggcagtgaagtattctgagcgatctctcactaagtgcatcggcatcactattgagacccggcctgattactgtatgaagcgtcatctctccgatatgttaacctatgggtgtacacgcttggagatcggggttcagagcgtttacgaggacgtggcaagggacacaaacaggggtcacaccgtaaaagcggtctgtgagtctttccacctggccaaagatagtggcttcaaggtggtcgcacacatgatgcctgaccttccgaatgtcggcttggaaagagacattgagcagttcactgagttctttgaaaaccccgctttcagacctgacggcctgaagttgtaccctaccttagtgatccggggaactggcctgtacgagttgtggaagagcggtcggtacaaatcctacagccccagtgatctggtggaactggtggcgagaattctcgcactggtgccaccctggacccgggtctaccgcgtgcagcgtgacatcccgatgccactagtgagcagtggggtagagcacgggaacctgcgcgagcttgccttagccaggatgaaagatctgggcattcagtgtcgggacgtaaggaccagggaggtggggattcaggagattcaccacaaggtgagaccttaccaggtagagcttgtgagacgggattatgtcgcaaatgggggttgggagactttcctttcatacgaggaccctgaccaggacatccttatagggctcttgagactgcgcaagtgttccgaagagacttttagattcgagctgggcggaggagtctccatagttcgagagttgcacgtctatggaagcgtagttccggtcagctcacgggaccctacaaagtttcagcaccagggcttcggaatgctacttatggaggaggccgaacggattgcgagggaggaacacggaagcggaaagattgctgttattagtggtgtaggtacaaggaattattaccgcaagattggctacaggctccagggaccctatatggttaaaatgttgaagtag

SEQ ID NO: 221883 - DNA, 1275 bp, Artificial Sequence
  Description of Artificial Sequence: Synthetic coding sequence
atggccgctgttgcaacctgcggctcagtggccgcatcaacaggtagcgccgtcgcaaccgcttctaagtctaatgtcacgtcttttcagaggcgcggaccgagagcgtcagtgacaaacgacagtggccctcgtctggtaagcatagcgggtacaaggccatcggttaggaacggccagcttttggtttcaacaggcctgccagccctggaccaattgctcggcggtggtctcgccgtcggcacggtgctgcttattgaagaagacaagtataacatctatagccctttactgtttaagtactttcttgctgaaggcattgtcaatggacacactttacttgtagcttctgctaaagaagatcctgccaatattctacaggaattaccagccccactgctggacgataagtgtaaaaaagagtttgacgaagacgtatacaatcacaaaacccctgagagcaatatcaagatgaaaattgcttggcgatatcagctactcccaaagatggaaattggccctgtttcttccagtcgcttcggacattattacgatgcgtccaagagaatgccacaagagcttatcgaggctagcaattggcacggcttctttctgcccgaaaaaattagtagtaccctgaaagttgaaccctgctctctgaccccaggatacaccaaactccttcagttcatacaaaatataatttacgaggaaggattcgacggctctaaccctcagaagaagcagcgcaatattttgcggatcggaatacaaaacctagggtctcctctttggggcgatgatatctgctgcgcggaaaacggtggcaactcccactcccttaccaagtttctctatgtccttcgtggtctgcttaggacctccctgagcgcgtgcattatcactatgccaactcacctaatccagaataaggcgataatcgccagggttacgaccctgtccgacgtcgtggtcggcctggagtcgtttattggcagtgagcgggagacaaacccactctataaagattaccatggcctcatccatatcagacaaatcccccgactgaataatttgatttgcgacgaaagcgatgtcaaagacctcgcttttaaactgaagagaaagctgtttacaatcgagaggctgcacttaccaccagatctgtccgatactgtttctcgttccagcaaaatggacctcgccgaaagtgccaagcggttggggccaggctgtggcatgatggccggtggaaaaaagcacctcgacttttag

SEQ ID NO: 221884 - DNA, 1431 bp, Artificial Sequence
  Description of Artificial Sequence: Synthetic coding sequence
atggctgctgtggccacatgtgggagcgtggccgctagcacaggctccgccgtggcaaccgccagcaaaagcaatgtgacttcattccagcgccgaggccctcgagcatcagtcaccaacgatagtggtccacggcttgtgtctattgccggtactcggccatctgtcaggaatgggcagctgctggtttctaccggactgccagcacttgatcaactgcttgggggagggcttgccgtcggcaccgtactgctaattgaggaagacaaatacaacatttattcaccgctcttatttaagtacttcctcgcagagggcatagtgaatggtcacacgctgctggtggcctcagctaaagaggatcctgcaaatattctccaggagctccctgcgcctctgctggacgacaagtgtaagaaggagtttgacgaagatgtctacaaccacaaaaccccggagtcaaacattaagatgaaaatcgcatggcgctatcagttacttcccaagatggaacagattggtcctgtgtcgagcagcagattcggccattattacgatgcttcaaaacgaatgccacaggaactgatcgaggccagtaattggcacggtttcttccttccagagaaaatctcttccacactgaaggtggaaccctgctcattgacacctggctataccaagctcttacagttcatccagaatattatttacgaggagggctttgacgggagcaacccccagaaaaagcagcgtaacattctgaggatcgggatacagaacctaggctcacctttatggggggacgatatttgctgcgctgagaatggagggaactctcactctttaaccaagttcctgtacgtacttaggggcctgttgcgtaccagtttatctgcctgtattatcacaatgccaactcacctaatccagaacaaagcaatcattgcacgagtgactaccctgtcggacgtggttgtcggtcttgaaagctttattgggtcggagagggagacgaacccactgtataaggattaccatggcctcattcatatccggcagattccaagacttaataatctgatctgcgatgagagtgatgttaaggacctagcctttaagctaaagcgcaagctgttcaccatcgaatgggttcaggacaactatctgcggcaggagagaaatatctatcccccagggttctcctatttgctcaaacaaaaggatagcgcttggggggagggatccttacaacactctacctttttaatgtcattccttgcaaaggccaccgctttcgccagtcgactggtgcggcattcagagcctctcaagcagaacggcagcgggagaatcaggcaggccgctggccctcgtctgtggcacgacggtaggaggcaagaggctcccggactgctcgggattccgccttag

SEQ ID NO: 221885 - DNA, 1608 bp, Artificial Sequence
  Description of Artificial Sequence: Synthetic coding sequence
atggcagcggtggcaacctgcggtagcgtggccgcaagcaccggaagcgccgtcgctacagcgtcgaaatccaacgtgacctcatttcaacggcgtgggccaagggcgtcagtaaccaacgattctgggcctagactggtgagcattgccggaactcggccaagtgtccggaacggacagttacttgtgtcaactggactgcctgcactggatcagctgctggggggaggcctggcagttggtacagtgttacttattgaggaggataagtataacatttactccccactgctgttcaagtactttttagccgaagggattgttaatggtcacactttactggtggctagtgccaaagaagatccagccaacattctccaggagcttccagctcctcttctagacgacaagtgtaaaaaagaatttgacgaagacgtttacaaccacaaaactccagagtccaacattaagatgaagatcgcctggaggtaccagcttctgcccaagatggagattggcccagttagctcttcacgattcgggcattactatgacgcctcgaaacgaatgccacaggagttgattgaggcctcgaattggcacgggtttttcctgccagagaaaatctcatccaccctgaaggtggaaccttgttcacttacccctggctataccaagctgctacagttcatccagaacataatctacgaagagggcttcgacggatctaatccacaaaagaaacagaggaacatcctcaggataggtatccagaacttgggaagtcccttgtggggcgacgatatctgttgtgcagagaatggaggcaattcccacagcttaacaaagtttttgtatgtactgagaggactgttacggacttctctgagtgcctgtattattacgatgccaacgcacctcattcaaaataaagccataatagcacgagtaactacattatctgacgtagtggtagggttggagagcttcatcggaagcgagcgcgaaaccaatccgctgtataaagactatcatgggcttatccacatccgacaaatcccgagactcaacaatctcatctgtgacgaatcagacgtcaaggacctggctttcaaactgaaacgcaaactgttcacgatcgaggcgggagtgcagtggcatgacctgggatcccgacaaccacgactgctgggttcttctaacagccccgctagtgcctctctggtggcaggtatcaccggtgcccaccaccacacccaattaattttcgtgttccttgttgagatgggcttccaccatgtgggtcaagccggacttgagctgcttacctctggcgacagttccgcgagcgctagtcagtcagctggcatcaccggcatgtcctatcgggctcgcccacgggctctctactttaaagagaataaatctaaggtgggcgctagacagctgctggaaactagagaagaacacctctcgagccggctgctgatcctgacccaggccgagagattatgtatgggcagacgctttttcacagcatttcacatctttaatgagctgccttgcaaaggtgactgcatctgcctgcagacgtgccaaacacagtag

SEQ ID NO: 221886 - DNA, 840 bp, Artificial Sequence
  Description of Artificial Sequence: Synthetic coding sequence
atggaggccgtggtgaacctgtatcaggaagttatgaaacatgcggacccccgtatccaggggtacccccttatgggctcacccctgcttatgacatcgatactgctgacctacgtgtactttgtcctctctctcggaccacgcattatggcaaacaggaagccctttcagctcaggggttttatgattgtctataacttcagtctcgtggcattatcattatatatcgtctacgagttcttgatgagcggctggctgtcgacttatacctggagatgtgatcctgttgattattcgaacagccctgaggcactccgtatggtgcgcgttgcatggctattccttttctccaaattcatcgaactgatggacaccgtgatctttattctcaggaagaaagacgggcaagtgacctttcttcatgtatttcaccattccgtcctgccatggagctggtggtggggggtcaaaattgcacctgggggaatgggtagcttccacgcgatgattaattcctctgtacacgtgattatgtatctgtattatggtctttccgcttttggacctgtggctcaaccatatctgtggtggaaaaaacacatgactgcaattcagcttatccagtttgtgttggtctcccttcatatatctcagtactatttcatgagttcatgtaactaccaatatccagtcattatccacctgatctggatgtacggtaccatcttttttatgctgttctccaacttttggtatcattcgtatactaaaggtaagcgccttcccagggcactgcagcagaacggcgcaccgggtattgccaaagtgaaagctaactag

SEQ ID NO: 221887 - DNA, 759 bp, Artificial Sequence
  Description of Artificial Sequence: Synthetic coding sequence
atggaggctgtggtgaatctctatcaagaggtgatgaagcacgccgatcccaggatccaaggctatccactgatggggagtccgcttcttatgacatctatcttgctcacttacgtgtattttgtgctgtcactgggtcccagaatcatggctaaccgcaagcccttccagctgcggggttttatgatcgtgtataacttctctttggtagcactgtccctgtatatagtgtatgaaatggtgcgggttgcttggctgttcctcttctctaaatttatcgagctgatggacactgtgattttcatactcagaaaaaaggatggccaggtaacctttctacatgtgtttcaccacagcgtgctgccctggtcttggtggtggggtgtgaagattgcgcctggtggaatgggtagcttccatgcaatgatcaatagtagcgtgcatgttattatgtacctgtattatggactttctgccttcggccctgtagctcagccgtatctgtggtggaagaagcatatgactgcgatccaactgatccagttcgtgctggtgagtctgcacatcagccagtattatttcatgagttcctgtaactaccagtatccagttatcattcatttaatatggatgtatggcacgatatttttcatgttgtttagcaacttttggtatcactcctacaccaaaggtaaaagactgccacgggcacttcagcagaatggggctccagggatcgccaaggtaaaagccaactag

SEQ ID NO: 221888 - DNA, 891 bp, Artificial Sequence
  Description of Artificial Sequence: Synthetic coding sequence
atggagcatcttaaagcgtttgacgacgagatcaatgcatttctggataacatgtttgggccacgcgacagcagggtccgcggttggtttatgctcgactcctacttaccaaccttcttcctcactgtgatgtacctgttgtctatatggttgggcaataagtacatgaaaaacagaccagcactgagccttcgcggtatcctgacactctacaaccttggcataaccctgctgtctgcttatatgcttgcagaactgattctgtccacctgggaaggaggttataatctccagtgccaggacctaacatctgctggcgaggcagacatcagggttgcgaaagtgttatggtggtattacttcagcaagtccgtggaatttcttgataccattttctttgtactcagaaaaaagactagccagatcacttttctgcatgtttaccatcatgcttccatgtttaatatctggtggtgcgtgctcaattggataccatgcggccagtctttctttggacccactctcaacagcttcatccatatcttgatgtattcgtactatggattgagcgtcttccccagtatgcataaatatttgtggtggaaaaagtatctcacccaagcccagttagtacaattcgtcctcaccataacccatactatgtccgctgttgtgaaaccgtgtggattcccattcgggtgcttaatctttcagtcatcctatatgttgactttggtaattttgtttttaaacttctatgttcagacctaccgaaagaaacccatgaaaaaagacatgcaggaaccgcctgcaggcaaggaagttaaaaatggattcagcaaagcatattttaccgccgctaatggggttatgaataaaaaggcccagtag

SEQ ID NO: 221889 - DNA, 813 bp, Artificial Sequence
  Description of Artificial Sequence: Synthetic coding sequence
atggtgactgccatgaacgtcagccacgaggtgaaccagctctttcagccctacaacttcgagctgagtaaagatatgcggcctttcttcgaggagtactgggcaacttcctttcccatcgccctcatctatctggtcttgatcgccgtggggcaaaattacatgaaagaaaggaagggattcaacttgcaaggcccattaattctctggagcttctgtcttgccatctttagcatcctcggagcagttcggatgtggggtataatgggcaccgtactcctgaccgggggactcaagcagaccgtctgcttcattaacttcatcgataactctacagtgaaattctggagctgggtgtttctcctttcgaaggtcatagagctgggcgataccgctttcattatactgcgaaaacgtccgctgattttcatccactggtatcatcattccaccgtgctggtgtatacctcctttgggtataaaaataaggtgcctgccggagggtggtttgtgacaatgaacttcggcgtccacgccataatgtacacctattacaccttgaaggccgcaaacgtcaagccaccaaagatgctgcccatgctgatcactagtctgcagatcctccagatgttcgtaggcgctatcgtatccatcctgacttatatctggagacaagatcaggggtgtcatactactatggaacaccttttttggagttttatactgtatatgacctattttattctgttcgcccactttttctgccagacttatatcaggcctaaagtgaaggccaagacgaagtcccagtag

SEQ ID NO: 221890 - DNA, 945 bp, Artificial Sequence
  Description of Artificial Sequence: Synthetic coding sequence
atgggacttctcgactcagagcctgggagtgtgttaaacgtcgtgtcaacagcattgaacgacactgtggagttctaccgctggacttggtccatagccgacaaacgggtcgagaactggccgctgatgcagtcaccctggcccaccctttctatatctacgctctatttgctgtttgtctggctgggccctaagtggatgaaagatcgggagcctttccagatgcggctggttctcataatatataactttggcatggtgctgctcaacctctttatattccgtgagctgttcatgggtagctacaacgccggttattcttatatttgccagtctgtggactatagcaacaatgtgcacgaagttcgcatcgccgcagctctctggtggtactttgtttccaagggggtcgagtatctggacacagtcttctttatattgcgtaagaagaataatcaggtgtctttcctccacgtgtatcaccactgcactatgtttactctgtggtggataggaattaagtgggttgcaggaggacaggcctttttcggtgcccagctgaacagtttcattcatgtgatcatgtatagctattacggcctgaccgcatttggcccttggatccagaagtacctgtggtggaaacgttatctgaccatgttgcaactcatacagttccatgtgaccatcggccacactgccctgagtttgtataccgactgtccctttcccaaatggatgcactgggccctcatagcctatgcaatatccttcatttttttatttcttaacttttacataaggacctacaaggaacctaagaaaccaaaggccggaaaaactgcaatgaatggtatctccgccaatggagtgagcaagagcgaaaaacagctgatgatcgagaacgggaaaaaacagaaaaacggcaaagcgaagggcgactag

SEQ ID NO: 221891 - DNA, 900 bp, Artificial Sequence
  Description of Artificial Sequence: Synthetic coding sequence
atggagcattttgatgctagtctctcgacttacttcaaggccctgcttggccctagggatacaagagtgaaggggtggtttttacttgacaactatatccctacgttcatctgtagcgtcatttacctattgatcgtatggttaggtcctaaatacatgcggaataaacagcctttcagctgcagaggaatccttgttgtttataaccttggcctgacccttctgagcctctacatgttttgtgaactggtaactggtgtctgggagggcaagtacaactttttttgccaggggacaagaaccgccggagagtcagatatgaagattatacgtgttttgtggtggtactactttagcaagctgatcgagttcatggacactttttttttcattttgagaaagaacaaccatcaaatcactgtcctgcacgtctaccatcacgctagtatgttgaacatatggtggttcgtcatgaactgggtcccctgtggccactcttattttggtgcaacgctgaattccttcattcacgtgctgatgtactcttattatgggctgagtagtgtaccatcgatgagaccctatctctggtggaaaaagtatattacccagggccagctcctgcagttcgtcctaactataattcagaccagttgtggggtgatctggccatgtaccttccctctgggctggctctacttccagatcggatacatgatttcactgattgctctgttcactaacttctacatccagacatacaacaagaaaggtgcatcgcgcaggaaggatcatctaaaggatcatcagaacgggagtatggcagccgtgaatggccatactaattccttctcccccctggaaaataacgtcaagccacgcaaacttagaaaagattag

SEQ ID NO: 221892 - DNA, 267 bp, Artificial Sequence
  Description of Artificial Sequence: Synthetic coding sequence
atggagcattttgacgcaagtctgtctacatacttcaaagccttactaggtcctagaggcatcagctcctccgtcctcagaatggggcctcctctgcacacagttgtcggatggctgcaacagctgcaggcagcccattccgaagaggaagaaaaaatgtttcacctgtgtggcttcaagcacaaagaggtcgtgagccagtcttctctgccggcagttatcccgcaaaatagcctagccaccatcgcttctcatgcgccagcctag

SEQ ID NO: 221893 - DNA, 870 bp, Artificial Sequence
  Description of Artificial Sequence: Synthetic coding sequence
atggagcacttcgacgcctccctgtcaacatattttaaggcgctgctgggccctagagatactagggtcaaaggatggtttctgctggacaattacatccctaccttcatatgcagtgtcatctatctgttgatcgtttggctgggacccaagtacatgagaaacaagcaaccattcagctgcagaggtattttggtggtgtacaagttctgcgagctggttactggggtctgggaggggaagtataactttttctgccagggcacccggaccgctggagagagcgacatgaagataatccgtgttctctggtggtattatttcagtaagctgatcgaattcatggacacttttttcttcattttgcgcaaaaacaaccaccagattactgtccttcacgtgtaccaccatgcctcaatgctcaacatctggtggtttgttatgaactgggtgccatgcgggcactcctacttcggtgcaacactgaacagctttatacacgtcctgatgtacagctattatggcctgtcatccgttccctctatgaggccttacctctggtggaagaaatatattacacagggacaactcttgcaatttgtgctaaccataatacaaacttcatgtggtgttatatggccttgcacctttcccctgggatggctgtatttccagatcggctacatgatctctcttatagccctcttcactaacttctatattcaaacttataataaaaaaggcgcatcacgacgtaaagatcacttaaaggaccatcaaaacggctctatggctgccgtaaacggacacacaaattccttctctcccctcgagaataatgtgaaaccacggaaattacgcaaagattag

SEQ ID NO: 221894 - DNA, 981 bp, Artificial Sequence
  Description of Artificial Sequence: Synthetic coding sequence
atggaacacttcgatgctagcctgtcaacgtatttcaaagctttacttggtccacgcgatacaagagttaagggatggtttctgctcgataactacatcccgaccttcatctgctctgttatttacttactcattgtctggctagggccaaagtacatgcggaacaagcagccctttagttgcaggggaattctggtcgtgtacaacctcggtctgaccctactgtcattatatatgttttgtgaatccaaacgggagcagcctcgcagatctgcttgcgcgtctcggactgatcctagtacccagcagcagctaccagagaatcgcctggtgactggcgtgtgggaaggaaaatacaattttttctgtcaggggactcggacagcaggtgaatctgacatgaaaataataagagtgctttggtggtactatttttctaagttgattgaatttatggacacattcttctttatactccgtaaaaacaaccatcagatcacagtcctacacgtgtatcatcatgcctccatgctgaacatttggtggttcgttatgaactgggtgccctgcgggcacagttactttggcgctacacttaacagcttcatccatgtcttaatgtatagttattatggcctgtcaagtgtccccagcatgagaccttatttgtggtggaagaaatacattacacaggggcagttgcttcagttcgttttgactattattcagacatcctgtggggtgatttggccctgtacgttccctctggggtggctgtatttccagatcgggtacatgatttctctgattgccctgtttaccaacttttatatccaaacatacaataaaaaaggtgcatctaggcgaaaggatcatctaaaagatcaccaaaatggttcaatggctgctgtgaacggtcatactaattctttctcccccctggaaaataatgtgaaacctcggaagctccgaaaggattag

SEQ ID NO: 221895 - DNA, 900 bp, Artificial Sequence
  Description of Artificial Sequence: Synthetic coding sequence
atggagcacttcgacgcctcactctccacatacttcaaggcccttctcggtcctcgggatacacgtgtcaaaggctggtttcttctggacaattatatccccactttcatctgctccgtgatctatcttctcatcgtttggctaggccctaaatatatgaggaacaaacagccctttagttgcagaggcattttggtcgtgtataatctgggcctcacactactttccctgtacatgttttgtgaattggtaactggagtctgggaagggaaatacaatttcttttgccagggcaccaggactgcaggagaaagtgatatgaaaattattagggtgctgtggtggtattacttttctaaactcattgaattcatggacacattcttctttatactgcggaagaataatcaccagattaccgtactgcacgtgtatcatcatgccagcatgttgaatatctggtggtttgtcatgaattgggttccttgcggacatagctactttggcgctacactgaatagcttcatacatgtgcttatgtacagctactatggtctttctagtgtgccgagtatgaggccctacctttggtggaaaaaatacattacccaggggcagctgttacaatttgttctgaccattattcagaccagctgtggcgttatatggccttgcactttcccactgggatggttatactttcagattggctatatgatttctttgatcgccctctttacgaacttctacattcagacttataacaagaaaggcgctagccgtcgcaaggatcacctgaaagatcaccaaaacggaagcatggccgctgttaatgggcacaccaactcgtttagccccctggagaacaacgtgaaacctcgtaaacttcggaaagactag

SEQ ID NO: 221896 - DNA, 798 bp, Artificial Sequence
  Description of Artificial Sequence: Synthetic coding sequence
atgaacatgtctgtgttaacattacaggaatatgaattcgagaaacagtttaacgagaatgaagctatccagtggatgcaggaaaattggaagaaaagtttcctattcagcgccttgtatgctgcattcatatttggtggcaggcatctgatgaacaagcgtgccaagtttgagctccggaaaccgctcgtgttgtggtccctcacgctggcggtgttcagcatctttggagctctccggaccggcgcttatatggtgtatatccttatgactaagggtctgaagcaatcagtgtgtgatcagggcttctacaacgggccagtctccaaattctgggcctacgctttcgttctgagtaaagcgccagaactgggcgatactattttcatcatactgcggaagcaaaagctcatctttttgcactggtaccaccatattacagtccttttgtactcttggtatagctataaagatatggtagctggagggggttggtttatgacaatgaactacggggttcacgccgtcatgtactcttactatgccctgagggccgctggtttccgcgttagtaggaagttcgctatgttcataacgttgagccaaattacccaaatgctcatgggctgcgtcgtgaattacttggtgttttgttggatgcagcacgaccagtgtcattcccacttccagaatatcttttggagctcccttatgtatttgtcctacttggtcctgttttgccacttctttttcgaggcctatatcggtaagatgagaaagacaaccaaagcagagtag

SEQ ID NO: 221897 - DNA, 798 bp, Artificial Sequence
  Description of Artificial Sequence: Synthetic coding sequence
atgaacatgtcagtactcacgttgcaggagtatgagttcgaaaagcagtttaatgagaatgaagccattcaatggatgcaggagaattggaagaagtctttcctctttagtgctctgtacgcagcattcattttcgggggtcgacatctgatgaataagagggcaaaattcgaactccgaaagcctctggtgctttggtctctcacgttagctgtcttttccatattcggagcgctgcgcacaggcgcttacatggtgtatattctgatgactaagggtctgaagcagagcgtgtgcgatcagggtttttacaatggacccgtatctaaattctgggcatacgcatttgtcttgtccaaggctccggagctcggcgatacgatctttattatactgcgtaaacagaaactcatattcctccactggtatcaccatatcacggtgctgttgtattcctggtacagctacaaagacatggtggccggaggtggttggtttatgaccatgaactacggcgtgcatgcagtgatgtacagctactacgcactgagggctgcaggttttagggtctctcgcaagtttgctatgtttatcactctcagccagatcacccaaatgcttatgggctgcgtggtgaattacctcgtcttctgttggatgcagcacgaccagtgtcactcacacttccaaaacatcttttggagctctctcatgtacctctcttacttggtgctgttttgccatttcttctttgaggcatacatcggtaaaatgcgtaaaactacaaaagccgagtag

SEQ ID NO: 221898 - DNA, 327 bp, Artificial Sequence
  Description of Artificial Sequence: Synthetic coding sequence
atgaatatgagcgtccttacccttcaggaatacgagttcgagaaacaatttaatgaaaacgaggccatccagtggatgcaagaaaactggaagaagagtttcctgtttagcgctttgtatgcagcctttatctttggcggtcggcatctgatgaataagagggcaaaatttgaactgcgcaaaccattggtgctgtggagtttgacactggccgtgtttagtatctttggggctttgaggaccggagcatatatggtctacattttgatgaccaagggcctaaaacagagcgtttgcgatcagggtttctacaatgggcctgtgtag

SEQ ID NO: 221899 - DNA, 414 bp, Artificial Sequence
  Description of Artificial Sequence: Synthetic coding sequence
atgaatatgagcgtgcttaccttgcaggagtatgaattcgagaaacagtttaacgaaaatgaagccattcagtggatgcaggaaaattggaaaaagagctttctgttcagtgccttgtatgccgcatttatatttggtggtcggcacttgatgaataagagggcaaaatttgagttgcggaaacctttggtcctctggtctttgaccctggccgtgttttcaatctttggcgcactgaggactggtgcctacatggtatacatccttatgaccaaaggcctgaaacagtccgtgtgcgatcaaggcttctataatggtcccgtttctaaattctgggcctacgcctttgttctttcaaaagcccctgagctgggagatacaatttttatcatcttaaggaaacagaagttatag

SEQ ID NO: 221900 - DNA, 846 bp, Artificial Sequence
  Description of Artificial Sequence: Synthetic coding sequence
atggcttttagcgatctgacttctcggactgtccacctgtacgacaactggatcaaggacgcagacccaagagtggaggactggctgctgatgtcaagccctcttcctcagacaatcctccttgggttttacgtatacttcgtaactagccttggtccaaagctgatggagaaccgcaagccatttgaattgaaaaaggctatgataacatacaactttttcatcgtgctcttttcagtctacatgtgttatgaattcgtcatgtctggatggggcattggatatagcttccggtgtgacatcgttgactattctagatccccgaccgcccttaggatggcaagaacctgttggctatattacttctcgaaatttattgaactcctcgacactatcttctttgtcctgcgaaaaaagaattcccaggtgaccttcctgcacgttttccaccacacaatcatgccatggacttggtggtttggcgtgaagttcgccgcaggaggcctagggacattccacgccttactgaatacagcagtccatgtcgtgatgtacagctactacggcctatcagctctgggcccagcataccagaaatacttgtggtggaagaaatacctgactagcttgcaactggtccagtttgtcattgtggcgattcacatcagccaatttttttttatggaggactgcaagtatcagttcccggtctttgcctgcattattatgtcttactcctttatgtttctcttactgttcttgcatttctggtaccgggcttacactaagggccagcgtcttcctaagactgtgaaaaatggcacatgcaagaacaaagataactag

SEQ ID NO: 221901 - DNA, 846 bp, Artificial Sequence
  Description of Artificial Sequence: Synthetic coding sequence
atggcctttagtgatctcacctcccggactgtgcacttgtacgataactggatcaaagatgcggatcctcgggtggaagattggctactgatgtcctcccccctgccccagaccatcttgctcgggttttacgtgtactttgttactagcctcggacccaaacttatggagaacaggaaaccttttgagctgaagaaggcaatgattacctataacttttttattgttctgttctctgtgtatatgtgctacgagtttgtcatgagcggatggggaatcgggtatagctttcgatgcgatattgtggattactctaggtccccaaccgctcttcgtatggctcgcacctgctggctgtactatttttccaaatttattgaactgctcgacactatctttttcgtgttgagaaagaagaattcccaagttacattcttgcacgtatttcatcacacaattatgccctggacctggtggttcggcgtgaagttcgctgctggaggattgggcacgtttcacgctctgttgaacactgccgtccacgtcgtgatgtattcttactacggcctctccgccctgggtcccgcttaccagaaatatctgtggtggaaaaagtatctcacctcactacagcttgtgcaatttgtcatagtcgcgattcatattagtcagttcttcttcatggaggactgtaagtatcagtttcctgtatttgcctgtattatcatgtcatactcgtttatgtttctgctgctcttcctccatttctggtacagggcatacacaaaagggcaacggctcccaaagacagttaaaaacggcacatgcaagaacaaggacaactag

SEQ ID NO: 221902 - DNA, 498 bp, Artificial Sequence
  Description of Artificial Sequence: Synthetic coding sequence
atggccttcagcgatctaacctctcgtaccgtgcacctgtacgacaattggattaaggacgccgaccctcgagtagaagattggttactgatgtcctcccccctgccccaaaccattctcctcgggttttacgtttattttgttacctccctgggacccaaacttatggaaaacagaaaaccttttgagttgaagaaggcaatgattacctataacttctttatagttctattctcagtatatatgtgttatgaattcgtcatgagcgggtggggtattggctactcgtttagatgtgatatcgtagattacagcaggtccccaactgccttaagaatggcacgaacctgttggctatattatttctccaaatttatcgaactcttagataccatattcttcgtcctccgcaaaaaaaacagccaagtgacattccttcacgtgttccatcacactataatgccttggacgtggtggttcggcgtgaaattcgcctag

SEQ ID NO: 221903 - DNA, 846 bp, Artificial Sequence
  Description of Artificial Sequence: Synthetic coding sequence
atggccttcagcgatctgacttcccgcactgtgcacttgtacgacaactggatcaaagatgccgaccctcgtgtcgaagactggctcctcatgagctcccctctaccacaaacgatcctgctgggtttttatgtgtattttgtcactagtttaggacccaagctgatggagaacagaaaacccttcgagcttaagaaggccatgattacttacaatttcttcattgtgctcttctcagtctacatgtgctacgagtttgtgatgtcagggtggggtatcggctactctttccgctgtgacatcgtggactattctagaagtccaacggccctcaggatggccaggacatgctggctgtactacttttcaaagttcattgagcttctcgacaccatttttttcgtgttaagaaagaagaactcacaggtgaccttcctgcacgttttccatcatactatcatgccttggacctggtggttcggggtgaaatttgctgccggtggtcttgggacattccatgccttactcaacaccgccgtgcatgtagttatgtattcctattacggtctttctgcccttggcccagcctatcagaaatacctctggtggaagaaataccttaccagtctgcaattggtgcaatttgttattgtggcaatacatatctcccagtttttttttatggaagactgcaagtaccagtttccagtatttgcctgcattataatgagctattctttcatgttcttgttgctgtttctccatttctggtatcgcgcatatacaaagggccagcgattgccaaaaaccgtaaagaatggaacatgcaaaaataaagataactag

SEQ ID NO: 221904 - DNA, 498 bp, Artificial Sequence
  Description of Artificial Sequence: Synthetic coding sequence
atggcctttagcgacctgactagtcgcacggtgcatttgtacgacaactggatcaaagatgccgatcctagggttgaagactggctgctgatgtccagccccctccctcagacgattcttctgggtttttacgtgtattttgtcaccagcctgggccctaagctcatggagaaccgtaagccatttgagctaaagaaagcaatgattacttacaatttcttcatcgtattattttccgtgtatatgtgttacgagtttgttatgtccgggtgggggatcggctattcgttcaggtgcgatatcgtggactacagccgtagtcccaccgccctacgaatggccagaacttgttggctgtattacttcagcaagtttatcgaattgctggatacaattttctttgtactccggaagaagaactcacaggtgacattcctgcacgtgttccatcacacaattatgccttggacctggtggtttggggtgaagtttgcctag

SEQ ID NO: 221905 - DNA, 921 bp, Artificial Sequence
  Description of Artificial Sequence: Synthetic coding sequence
atggccgcagcagcggctgccgcagcagcagccggagccgctggcggacggggatctggccctggacgccgacgccatttggtgcctggtgctggcggagaggctggggagggggctcccggtggagctggagactacggcaacggactcgagtccgaagaactggagcctgaagaattgctgctggagcctgagccggagcccgagccggaggaagaaccccctcgccctagggcccctccaggggctcccggacctggccctggctcaggagcaccgggtagccaggaggaggaggaagagcccggattagtggagggcgacccaggagacggggcaatcgaagaccccgaattggaagcaatcaaagccagagtgagagagatggaagaggaggctgagaaactcaaggaactgcaaaatgaggtggagaaacagatgaatatgtctcctcccccaggcaatgccggacccgtaataatgtcgatcgaggaaaagatggaagccgacgcccgatcaatatacgttggtaacgtggattacggggcaactgccgaggagttggaagcccacttccacggctgtgggagtgtgaacagagtaactattctgtgtgacaagttttctggccatcccaagggcttcgcatacatcgagttttctgataaggagtcagttcgaacctcactagctctcgacgaatcactttttagagggagacaaatcaaagtaatccccaagaggaccaaccggcctggcattagtaccactgaccgcggattccctcgcgctagataccgagctagaacaaccaactacaattccagccggagcaggttctactcaggcttcaacagtaggcccagaggcagagtttaccggggtagagccagagctacgtcttggtacagtccctattag

SEQ ID NO: 221906 - DNA, 1407 bp, Artificial Sequence
  Description of Artificial Sequence: Synthetic coding sequence
atggcaatcgcgacttctgtctatgtggtacctcctcctgccagaccctgccccacgagcggaccgccagctggaccttgtccaccctccccagacctgatttacaagatccctagagcgtccggaactcaactggccgctccgagagacgccctggaggtgtatgacgtccccccaactgcccttcgagtgccttcctctggaccatatgactgtcctgcctcattcagccacccactcactcgggttgcccctcagccacccggtgaggatgacgcaccctatgacgtgccattaacacccaagcccccagccgaactcgagcctgacctcgagtgggagggaggcagagagcctggccctccaatttatgccgctccgtcaaatctcaaacgcgcaagcgccttgttgaatctttatgaggcaccagaagagctgctggccgacggtgagggcggaggcactgatgagggaatatacgatgttccacttttgggaccagaagctccaccctcccccgaacctccaggcgctttggcctcacatgatcaggataccctcgcccagctgttagccagatccccgccaccccctcacagacccagactgcccagtgcggaatccttgtctaggaggcctctgcccgcactcccggtccctgaggccccatctccttccccagtgccttcccccgcaccgggacggaagggatcaatccaggatcgcccactgccccctcctcccccacgtctccctggatatgggggaccaaaggtggaaggcgaccccgaggggagggagatggaagacgatcctgccggtcatcacaacgagtacgagggcattcctatggcggaagagtatgattacgttcacctgaaaggaatggacaaggcacagggaagcaggccccctgaccaggcctgcactggcgacccggaactgcctgagcggggtatgcctgcccctcaggaggctttgagtcccggtgagcccctggtcgtcagcacgggcgatctgcaactactgtacttttatgctgggcagtgtcagtctcactacagcgcactgcaagccgcagtggccgctttaatgagtagtacccaagccaatcagccaccccgattatttgtgccccattctaagagggtggtggttgccgcacaccggctggtttttgtaggtgataccctgggccgactggccgctagtgcccctttaagggcccaggtcagggcagcgggaactgcactcggacaagcactgcgcgcaacagtgttggctgtgaagggcgctgcgttaggctacccctcatcccccgcaatacaagagatggtgcaatgtgtcacagaacttgctgggcaggccctgcaatttaccactttgctaaccagcctcgctccttag

SEQ ID NO: 221907 - DNA, 1179 bp, Artificial Sequence
  Description of Artificial Sequence: Synthetic coding sequence
atggccattgctaccagcgtctacgttgtcccacccccagcacgcccttgtcccaccagcggaccacccgctggcccttgtcccccatcccccgaccttatctacaagatcccccgtgcttccgggactcaacttgcggctccaagggatgctctcgaggtgtacgatgtgcctcccaccgcgcttcgcgtgcccagctccggtccgtacgattgtccagccagcttttcccaccccctgacaagagtggccccacagccacctggggaagacgatgctcccccttctccagaaccaccaggcgctctggccagtcacgatcaggacacactggcccagctgcttgcccgttctccgcctcctccccacaggcctaggttgcccagcgctgaaagtctgtcccgcagaccattaccggctcttcctgtacccgaagcccctagtccctcccccgtaccctcccctgcaccgggtaggaagggaagtatccaagacagaccattgccacccccacccccacgtctacctggctacgggggacccaaggtcgagggcgatcctgaaggcagggagatggaggacgacccggcaggacaccacaacgagtatgagggcattccaatggcagaggagtatgattatgttcatcttaagggcatggacaaggctcagggctccaggccacccgatcaagcttgtacaggtgacccagagctgcccgagagaggcatgcccgcaccgcaggaagcactcagtccgggtgagcctctggtagtgtccactggggatctgcagttgctgtacttctacgccggtcagtgtcagagtcattatagcgctcttcaggcggctgtggctgccctcatgagctccacacaggccaatcagccacctcggctttttgtgccccattctaaacgtgttgttgtggccgcacacaggcttgttttcgtgggagacacgttgggtagattggctgcgtccgctccactgcgtgcccaggttagggccgcagggacagccctgggccaggctcttagggcgacagtgctggctgtgaagggcgctgccctcggatatcccagcagcccggctatccaggaaatggttcagtgtgtcactgagctcgcgggacaggccctgcagtttacgactcttctgaccagcctcgccccatag

SEQ ID NO: 221908 - DNA, 1326 bp, Artificial Sequence
  Description of Artificial Sequence: Synthetic coding sequence
atgtccgagagggaggtcagcacagctcctgccggaactgatatgccagctgccaagaagcagaaactgtcgtcagacgaaaactccaaccccgatctaagtggagatgagaatgacgatgccgtgtctattgaatcgggcacaaataccgaacggccagacacacctacaaacacccctaatgccccaggacgtaagtcctggggaaaaggcaagtggaaaagcaagaagtgcaaatattcattcaaatgcgtcaattcactcaaggaggatcacaaccaaccactctttggggttcagttcaattggcactcaaaggaaggagaccccttagtttttgcgactgtggggtccaaccgggtcactctgtatgagtgtcatagtcagggagagatcaggctgctgcagagttatgtcgatgccgacgcggatgagaatttttatacttgcgcctggacttacgactcaaatactagccatcctctcttggccgtggctggctcgaggggtattatcagaatcatcaacccaattaccatgcaatgcattaaacactacgttggtcacggaaatgccattaatgagctgaaatttcacccccgtgatcctaacttactgcttagtgtgtctaaggaccacgccttgcggctctggaatatccagacagatactctggtggccatattcggaggggttgaaggtcatcgcgatgaggtcctgtcggctgactacgatctgctgggggaaaaaattatgagctgcgggatggaccattcactaaagctatggcggataaacagtaagaggatgatgaatgcaattaaggagagctacgattataatccaaataaaactaataggcctttcatttcccagaaaatccatttccccgattttagtactagggacatccacaggaattacgtcgattgcgtgcgctggctgggtgacttaatcttatccaagagttgtgagaacgccatagtctgttggaaacccggaaagatggaagatgatatcgacaagattaagccctccgaatccaatgttaccatcctgggcaggttcgattactcccagtgtgacatatggtacatgcggttcagtatggacttttggcagaagatgttggccctgggaaaccaggttggtaaattatatgtgtgggaccttgaagtggaagacccccacaaggctaaatgtaccaccctcacacaccataagtgcggggctgctattcggcagacttccttttcacgggactcttccattctgatcgccgtatgcgatgatgcctccatctggcgatgggacagattgagatag

SEQ ID NO: 221909 - DNA, 1203 bp, Artificial Sequence
  Description of Artificial Sequence: Synthetic coding sequence
atgagcgagagagaggtgtccaccgccccagccggaactgacatgcctgccgctaagaagcagaagttaagttcagacgagaattccaatcctgacctttctggggatgaaaacgacgacgccgtcagtattgaatccggtacaaacactgaacgccctgatacgccaaccaacacccccaacgctcctggtcggaaatcttggggcaagggaaagtggaaatccaaaaaatgcaagtatagtttcaagtgtgtcaacagccttaaggaagaccacaaccaacctctcttcggagtgcagtttaattggcactcaaaggaaggcgacccattggtatttgcaacagttggttcaaaccgggtgaccttgtatgagtgccactctcagggggagatcaggctcctacagagctatgttgacgctgacgcagacgaaaacttttatacctgtgcatggacatacgacagcaacacttcccaccctttactggccgtagctggaagccgaggaattatccgtatcatcaaccccatcaccatgcagtgtataaagcattatgtcgggcatgggaacgcgatcaatgaattaaagtttcacccccgtgatcccaacctgctgttaagcgtcagcaaggaccacgctctcaggttgtggaatattcagaccgacactctggtggcaatttttggcggagtggaagggcaccgcgacgaagtgctgtctgccgattacgatcttcttggcgagaaaataatgagttgtggcatggaccactctctcaagctctggaggatcaattccaaacgcatgatgaatgccatcaaggaaagttacgattacaaccctaacaaaacaaatcggcctttcatttcacagaagatacattttcccgatttcagcactcgggacatacacagaaattacgtcgattgtgttcggtggctgggggatctcatattatcaaagtcttgtgaaaacgccattgtatgctggaagccaggcaaaatggaagatgacatcgataagataaaaccgagcgaatcaaacgtgacaatactcggacggtttgattacagccagtgcgacatctggtatatgaggttctctatggacttctggcagaaaatgcttgcactcgggaaccaggtcggcaagctgtacgtctgggacttagaagtggaggacccgcataaagccaaatag

SEQ ID NO: 221910 - DNA, 1401 bp, Artificial Sequence
  Description of Artificial Sequence: Synthetic coding sequence
atgagtgaaagggaggtctcaactgctcccgcaggcactgacatgcccgctgctaagaaacaaaaacttagctccgacgaaaattcaaacccagatctatccggagacgaaaatgacgacgctgtgtctatcgagagcggcacgaacacagagcgcccagacactccgaccaatacccctaatgcacctgggagaaaatcctgggggaaaggcaaatggaagagcaagaaatgtaagtactctttcaaatgcgtaaactctctgaaggaagaccacaatcaacccctctttggagtgcagttcaactggcactcgaaggaaggtgatcccttggtgtttgccaccgtgggcagtaatcgtgtaacgctttacgaatgtcatagtcagggcgagattcgcttgttacagagctatgtggatgctgatgcggacgaaaacttttacacatgcgcatggacatatgacagtaacacaagtcaccctctgctggcagtggccggttctcggggaatcattaggattataaaccccatcacaatgcagtgcatcaaacactacgtgggccatggaaatgctataaatgagctgaagttccatcctcgggatcccaatcttctcctgtccgtgagcaaggaccacgcactaaggctgtggaacatccagactgacacgctcgtggccatctttgggggtgtggaggggcatcgagatgaagttctgtctgctgactacgatctgcttggagaaaaaattatgtcgtgcggtatggaccactctttgaaactgtggagaatcaacagcaaacgtatgatgaatgccattaaagagagttacgactataaccccaacaagactaaccgtccttttattagccagaaaattcactttcctgacttcagcactagagatatccatcgcaattacgttgattgtgtgcggtggttgggcgatcttatactatctaaatcaggcagggcaattctgcactcccaccagcagtgcatgagagatccagtgagccctaatctgcgtcagcatctcagttgcgagaacgctatcgtgtgttggaagcctgggaaaatggaagacgacatcgacaagatcaaaccaagcgagtctaatgtgactatcctcggccgtttcgactacagccagtgcgatatttggtatatgagattcagcatggacttctggcagaaaatgttggcattgggaaaccaggttggcaagctgtatgtgtgggacctggaagttgaagatcctcacaaagccaaatgtaccaccctgacccatcataagtgcggcgcagcgatcagacagacctccttcagccgtgattctagtattcttatagcagtctgcgatgatgcttcaatctggaggtgggatcgcctgaggtag

SEQ ID NO: 221911 - DNA, 471 bp, Artificial Sequence
  Description of Artificial Sequence: Synthetic coding sequence
atgtcagaacgagaagtcagcaccgcgccagccggaacggacatgccagctgcgaaaaagcagaagctgtcctcagatgagaactccaatcctgacctgtccggcgatgaaaacgatgacgcggtatctatagaatcaggcaccaataccgagcggccagacacccctacgaacacaccgaacgctccaggcaggaaatcctggggtaagggcaagtggaagagcaagaaatgcaagtatagctttaaatgtgtcaactcactgaaagaggaccacaatcaacccctctttggggtccagtttaattggcattcgaaagagggcgatccactcgtgttcgcaaccgtggggagcaatcgcgtaactctgtatgaatgtcacagtcagggcgagatccgactgctccagagctatgtcgatgccgacgctgacgaaaacttttatacttgtgcctggaagtgttaccaatag

SEQ ID NO: 221912 - DNA, 660 bp, Artificial Sequence
  Description of Artificial Sequence: Synthetic coding sequence
atggataattatgccgacctgagcgacacagaacttactacgctgttacggcgatataatatcccacacggacctgtcgtggacttgaattctacgcgcggagatgcagacatgtacgatttacccaaaaaggaagacgcattgttgtaccagagcaaaggatacaacgacgattactatgaggagagctatttcacaacacggacctatggggaacctgagtccgccggaccaagccgcgctgtgcgacaatccgtaacatctttcccagatgccgatgcgtttcaccaccaagtgcacgacgatgacctattgtcttccagtgaggaagaatgcaaggatcgagagcgacctatgtacggcagggatagcgcctatcagtccattactcactatcggccagtctccgcctctcgcagctctctcgatctgtcatactacccaacaagctcctctacctcattcatgtcatctagcagtagctccagctcctggctgactagacgtgcaattaggcctgagaaccgcgctcctggggctggcctgggtcaggatcggcaggtccccttatggggacaactcttgctctttctggtgtttgttatcgtgctcttctttatctaccacttcatgcaggccgaagagggtaaccccttttag

SEQ ID NO: 221913 - DNA, 765 bp, Artificial Sequence
  Description of Artificial Sequence: Synthetic coding sequence
atggataactacgccgacttgtctgacacggagctaacaaccctccttaggagatacaatattcctcacgggcctgtggtgggttcaaccaggcggctttacgagaaaaaaatattcgagtatgagactcagcgcaggcgcttgtcgccgccatcctcttctgcagcttctagttatagtttcagcgacttgaacagcacccgtggagatgccgacatgtacgacctcccaaagaaagaagacgccctcctatatcagagcaagggttacaacgatgattactacgaagaaagttattttaccacaagaacatacggcgagccagaatcagcaggaccctccagggctgtcaggcagtccgtgacatcgtttcccgacgccgacgctttccatcaccaggtgcacgacgacgacctcctttcctcatctgaggaagagtgtaaagatcgcgagcgcccaatgtacgggagggactcagcataccagagcattacccactatcggcctgtgtccgcttcccgttctagtcttgatctttcctattatcccacaagctctagtacatcgtttatgtcatctagttcctcatcaagttcatggctgacacggagagcgattcgtccagaaaatagggctcccggagctggccttgggcaagaccggcaggtgcccctgtggggccagctactcctgtttctggtgtttgtaatcgtcctttttttcatataccatttcatgcaagctgaggagggtaaccctttctag

SEQ ID NO: 221914 - DNA, 441 bp, Artificial Sequence
  Description of Artificial Sequence: Synthetic coding sequence
atgacgaccaacgccggacctctgcacccatattggccccagcacctgcgtctcgataattttgttccaaatgacagacccacgtggcacatcctggccggactgtttagcgtgactggcgtgctggtagtcacgacctggctcctcagcggccgagcagccgtcgttccattgggaacctggcggagactgtcactatgttggttcgcggtttgtggcttcattcaccttgtgatcgagggatggtttgtgctgtactacgaggacttgctgggagaccaagcttttctgagccagttgtggaaggagtacgctaagggggactcaagatatatccttggagacaatttcactgtatgtatggagacgataacggcttgcctctgggggccattaagtctctgggttgttattgcatttctgagacagcatccactgtag

SEQ ID NO: 221915 - DNA, 483 bp, Artificial Sequence
  Description of Artificial Sequence: Synthetic coding sequence
atgaccacgaacgccggaccattgcatccctattggccacagcatttgcggttagataactttgtccctaacgatcgcccaacgtggcacatcctggccggactgttctctgtgacaggagttctagtggtgaccacttggctcctttccgggagagccgctgtcgtcccgctgggaacatggcgtcggctctctctgtgttggttcgcagtgtgtggcttcatccacctcgtaattgagggttggttcgtgctgtactatgaagaccttctcggcgatcaggccttcctcagccagctttggaaggaatatgctaagggcgattccaggtacatccttggggacaacttcaccgtttgcatggagacaattaccgcctgcctgtggggtccactgtcactctgggttgtaatcgcatttctgaggcagcaccctctccgtttcatcttgcaactcgttgttagcgttggacagatctactag

SEQ ID NO: 221916 - DNA, 693 bp, Artificial Sequence
  Description of Artificial Sequence: Synthetic coding sequence
atgacaacaaatgcagggccattacatccctactggccccaacacttgagattggacaacttcgttcccaacgataggccaacttggcatattcttgccggtttgttctcagtgaccggtgtgctggtagtaacgacatggctactgagcgggcgtgctgccgtggtgcccctaggcacttggcgaaggttgtcactgtgctggttcgcagtatgcggttttatccatctggtgattgaaggatggtttgtgttatactacgaagatcttctcggagatcaggcttttctctcccaactgtggaaggaatacgctaaaggcgatagcagatacatactgggcgacaactttaccgtgtgcatggagaccataaccgcctgcctatggggacccctcagtctgtgggtagtaattgcctttctgagacaacatccactgcgttttattctgcaactagtggtgagtgttggccaaatctacggagatgttctgtacttcctgacagagcaccgcgacgggttccagcatggggagctcggacacccactatacttctggttctatttcgtgtttatgaatgccctctggctggttctgcccggagtgcttgtgttagatgccgtgaagcatcttacccacgcccagagcactcttgatgcaaaagctactaaagcaaaatctaagaaaaattag

SEQ ID NO: 221917 - DNA, 873 bp, Artificial Sequence
  Description of Artificial Sequence: Synthetic coding sequence
atgtgtctggccggatgcaccccgaggaaggccgctgcccctgggaggggagcactgccccgagctcggctcccacgaaccgctcctgctgctgcaaccatgttccaaccagcggctaagcggggtttcacgatagagtccctggtcgccaaggatgggggaacggggggaggaaccggagggggaggtgcaggctcacatctgctcgctgcagccgcaagtgaagagcccctgagaccaactgcacttaactatccccatccaagtgcggcagaggctgcgtttgtgtctgggttccccgcagcagcagctgccggagcgggtcgatcactgtacggcggaccagagctcgtgtttcccgaagcaatgaaccacccagctttgaccgtgcaccccgcacatcaattgggcgcaagccccttgcaaccccctcactccttcttcggcgctcagcatcgcgatcctcttcatttctatccttgggtgcttagaaatcggttcttcggccacaggttccaggcctcagacgtgccccaggatggactgctgcttcacggcccttttgcgaggaaaccaaaacgaattagaaccgccttcagccccagccagttgctgagattggaaagagctttcgagaagaatcactatgtggtgggagcagaaaggaagcagctagctggctctttgtcattgtccgaaacgcaagtcaaggtgtggttccagaaccgaaggacaaagtataagcgccaaaagttggaagaagagggccctgaatccgagcagaagaagaaaggctcccatcacataaaccgctggcggattgcaacaaaacaggccaatggtgaggacattgatgtcacttcgaacgactag

SEQ ID NO: 221918 - DNA, 759 bp, Artificial Sequence
  Description of Artificial Sequence: Synthetic coding sequence
atgttccagcccgctcctaaaaggtgtttcactatcgaatctctagtcgccaaagactcgcctttgccagcctcacgctccgaggaccccatccggcctgcagctctgagctatgccaattcgagtccgatcaatccatttctgaatggtttccatagtgcagccgcagccgcagcgggacgcggagtttactcgaaccccgacctggtgttcgctgaggccgtatcacacccacccaacccagcagtgccggtgcaccctgtccccccaccacacgccctagccgcacatccgctgccctcctcccacagcccacatcccttgtttgccagtcagcagagggatccgagtactttttacccttggctgattcatcgctatcgataccttggtcaccggtttcagggcaacgacacctccccggaaagtttcttactgcacaacgccctggcacggaagcctaaacgaatacggaccgcatttagcccatcgcaattactcaggctcgagcacgcttttgagaagaaccactatgttgttggtgctgaaaggaaacagctagcccacagtctctcactcaccgaaactcaagtcaaggtctggtttcagaacagacggaccaaatttaagcgccagaagctcgaagaggagggcagcgacagccagcaaaagaaaaagggtacccaccacataaacagatggcgcattgctaccaagcaggcctcacccgaagagatcgacgtaacctccgatgattag

SEQ ID NO: 221919 - DNA, 510 bp, Artificial Sequence
  Description of Artificial Sequence: Synthetic coding sequence
atgttccagcctgctccgaaacggtgtttcacgatcgagtccctcgttgcaaaggattctcctttaccagccagtcggtccgaggatcccatacgcccagctgctctatcctatgccaatagctcgccgataaatccttttctcaatggattccattcagctgctgctgccgcagcaggcagaggtgtctattctaaccctgaccttgtattcgctgaggcggttagccaccccccaaatccggcagtgcctgtccaccctgtcccaccaccacatgcactggcagcccaccccctgcctagctcacacagtccacaccctctgttcgcctcccagcagcgggatcccagcacattttacccttggttgatccaccgctacagatacttgggccatcggtttcagggtaaatctatggtttccgaacctaagaacaaagtgcagaaagcagaggctggaggcagaaggcttcgcttcgcgaccaaggagaagcgcgatgccccatactag

SEQ ID NO: 221920 - DNA, 957 bp, Artificial Sequence
  Description of Artificial Sequence: Synthetic coding sequence
atggcgattaagtctattgcctctagactgcgcggttcacgccgatttctgtccggcttcgtcgccggtgctgtggtcggggctgctggagctgggttggccgcactgcaattcttcaggtcacagggagccgagggcgctcttacagggaagcagcccgatggagatgccgatcgtaaacattgtaaatttaagcctgacccgaacataccgcctacgttctctgcctttaatgaggactacgtggggagcggttggtcacgcggacatatggcccctgcagggaacaataagttctcatccaaggcaatggccgaaacattttatctaagtaacatcgtgccccaggacttcgacaacaactctggatactggaacagaatcgaaatgtactgccgcgaactgacggaacggttcgaagatgtatgggtcgtatccggacccctgaccctcccccagacccgtggagacggaaaaaaaattgtcagttaccaggtcattggtgaagacaacgttgctgtgccctctcatctgtataaagttatcctggcccgacggtctagcgtgagtactgagccattggccctcggcgcattcgtggtgcccaatgaggcgattggattccaaccccagttgacggagtttcaggtgagtctgcaggatttggagaaactgtccgggctcgtcttttttcctcacctggacagaacaagcgatatccggaatatttgctctgttgacacctgcaagctcctggactttcaggagttcactctatatttatccacccggaaaatcgaaggggcaagatccgtcctaaggctggaaaaaatcatggagaatttgaaaaacgccgaaatagagcccgacgattatttcatgagccggtacgaaaaaaagctggaggaattaaaggccaaagagcagtctggaacacaaatccggaaaccaagctag

SEQ ID NO: 221921 - DNA, 1107 bp, Artificial Sequence
  Description of Artificial Sequence: Synthetic coding sequence
atggccattaagtctatcgcctctcgcctccgtgggagcagacgatttttgagcggctttgtggccggagcagtcgtgggagctgctggggctggcctggcggctcttcagttctttcgctcccagggggcagaaggagctttgacggggaaacagcctgatggcagcgctgaaaaagccgtgcttgaacaattcggatttcctctgaccgggacagaggcccgatgctacaccaaccacgctctcagttacgatcaggctaaacgtgtgccgaggtgggtgttagagcatatctctaaatccaaaatcatgggggacgctgataggaagcactgcaagtttaaacccgatcccaacattccccctaccttttcagcctttaacgaggattatgtgggatccggctggtcccgcggtcacatggctcccgcagggaacaataaattcagttccaaagccatggcagagaccttctatctgagtaatatcgtgcctcaagactttgataataattccggttactggaaccgtattgaaatgtactgccgcgagcttaccgagcggttcgaagatgtatgggtcgtgtccgggccactgactctgcctcagacaaggggggacggcaaaaaaatcgtgagttaccaggttatcggagaggacaatgtagctgtgccttcccacctgtataaagtgatactggcaaggcggtcctcagtgagcaccgaaccgctcgcgttaggggctttcgttgttcccaatgaagctatcggtttccagccccagctaacggaatttcaggtctccctccaggacctggaaaaactgagcggactcgtgttctttcctcacctggaccggacctccgatatccgcaacatttgtagtgtggatacatgtaagctgctggattttcaggagttcaccttgtacctgagcacccgtaagattgagggagctcgctcggtgctgcgcctcgagaaaatcatggagaacctgaaaaatgcagagatcgaaccagacgattactttatgagccggtatgagaagaaactagaagaacttaaggcgaaagaacagtccgggacccaaatcaggaagccctcatag

SEQ ID NO: 221922 - DNA, 450 bp, Artificial Sequence
  Description of Artificial Sequence: Synthetic coding sequence
atggcgccagccggaaataacaaattttcttctaaggccatggcagaaaccttctacctgagcaacatcgtgccacaagacttcgacaataactccggatactggaaccgcatcgagatgtactgtagagaactgaccgagcgcttcgaagacgtgtgggtcgtgtctggccctctgactctgccccagacaagaggcgatggcaagaaaatcgtcagctaccaggtgattggcgaagataatgtggccgttccttcacacctatataaagaccacgcgggttgttgtgtggaatctcccctggggactagaacttctgaggaagccacggctagaatacaggagcgtgatgatggcggatcagatcagaggtcaggactcgtggaactggggatctacttcgaaggccgtgccaatcgcataagtggacgcattggctgccgagtctag

SEQ ID NO: 221923 - DNA, 819 bp, Artificial Sequence
  Description of Artificial Sequence: Synthetic coding sequence
atgggatattttctgaagctgtacgcttatgtgaactcccattctctgtttgtctgggtctgtgatcgctcctataaacggagcttccgccctatgattctgaacaagattaaagaactttcccgcaatcagtttagcacaatgtcccatctacggaaggactcacagccaagcagtcccggagacgacgcgatggatcggagcggactgcccgatctgcaagggcgatttgaactttctggcaaaaatcgacagtatcctctagatgccctagaaccacagccatccatcggggacattaaggatataaaaaaggcagctaagagtatgctcgatcctgcccataaatcacacttccaccccgtgactccaagcctcgtgtttttgtgttttatcttcgacggcctgcatcaggcacttctgtccgtgggcgtcagcaagcgttctaacactgttgttggcaatgaaaatgaagagagaggaaccccctacgcgagtagattcaaagacatgccaaacttcatagccttagagaaaagtagcgtcctcagacattgttgcgatttacttatcggtatcgcagctgggagctctgacaagatctgcacttcaagcctgcaggtgcagcgcagattcaaggccatgatggcctctattggaaggctgtctcatggtgagagtgcagacctactgatctcatgcaacgccgagagcgccattggttggatcagtagcaggccatgggttggtgaattgatgttcaccctcctgttcggggacttcgaatctcctttacacaagttaaggaagtcatcttag

SEQ ID NO: 221924 - DNA, 894 bp, Artificial Sequence
  Description of Artificial Sequence: Synthetic coding sequence
atgcgggctttgcgcgctggcctgacactggcgagtggtgccggtctcggggcagttgttgaaggatggcggcgtcggagagaggatgctcgggctgcacctggcctgctgggcaggctgcctgtgcttccagttgctgctgctgcagagctaccgccagtgcccggagggccacggggtcctggagagctggcaaaatatgggctacctggactggcccagcttaagtcccgtgagtcttatgtattgtgttacgacccgcgaacccgcggtgcattatgggttgtggaacagctgagacccgagagactgaggggagacggtgataggcgagaatgcgattttcgtgaggacgactctgtacatgcctaccaccgagcaaccaatgccgactatagaggatctgggtttgacagggggcaccttgctgctgcagctaaccatcgttggtcacagaaggcaatggacgacaccttctacctctcgaatgtggccccacaggtgccgcacctgaatcagaatgcttggaacaatttggaaaagtactccaggtcactgacacggtcctatcagaacgtgtacgtgtgcaccggcccactctttctgcccagaaccgaagcagatggtaagtcatatgtaaaataccaggtgatcggcaagaatcacgtggctgtgccaacacatttcttcaaggtacttatactcgaggctgcagggggtcagattgaactgagaacatatgttatgccgaacgctccggtggatgaggcaatccctctcgaacgattcctggttccgatcgaaagcatcgaacgcgcttccggactgctcttcgtacctaacatcctggcgcgtgccggttcattgaaagcaattactgccggaagtaaatag

SEQ ID NO: 221925 - DNA, 2847 bp, Artificial Sequence
  Description of Artificial Sequence: Synthetic coding sequence
atggtcttcctcccactaaaatggtccctggccactatgtccttcctgctctcatcactgttggcgctacttactgtcagcacgccgtcttggtgccagagtacagaagcttctccgaaacggtcggacggaaccccattcccttggaataagattaggctgccagaatatgtgattcccgtccactacgacttgttgatccacgcgaatctaaccacattaacgttttggggaacaaccaaagtggaaataacagcttcccagcctacatctactattattctccactctcaccatctgcagatatcccgcgctaccctgcgtaaaggggctggcgagcgcctctctgaggagccacttcaggtgttggagcatccaaggcaggaacagatcgctctgctggcccctgaaccactactggtgggacttccctacaccgttgtgattcattacgccggaaatctgtcagagacttttcacggattctataaaagtacataccggactaaggaaggggagttgcgcatcctggcttctacacaattcgagcctacggcagccaggatggccttcccttgttttgatgagccagcattcaaagcttcattctcaattaagattagaagggagccacgacatctcgccatcagcaacatgccgttggtgaaaagtgttaccgtggccgagggcctcattgaggatcactttgatgttactgttaagatgtctacttatttagtggcctttattatctcagacttcgagtcagtgtcgaagataaccaagtctggagtcaaagtctctgtctatgctgtgcctgataagatcaaccaggctgattatgccctggacgccgctgtgactttgctggagttctacgaggactacttctctattccgtaccccctgcccaagcaggatctcgccgcaataccagactttcaaagtggtgccatggagaactggggcctgacaacctaccgggaaagcgcactgttgtttgatgccgagaaatcatcagctagtagtaaactcggtattacgatgacagtcgcacatgagctagcccaccagtggtttggaaacctcgtgacaatggagtggtggaacgacttatggcttaacgaggggttcgccaaatttatggaatttgtgtccgtgtccgtcacacacccagagctcaaagtaggcgattacttcttcgggaaatgtttcgacgctatggaggttgacgcactgaactcgagtcacccagtgagtacaccggtggaaaaccccgctcaaatacgtgagatgttcgacgacgtttcctatgataaaggcgcatgtatcttgaatatgctgagggagtacctttccgctgacgccttcaagtccgggatcgttcagtatcttcagaagcactcctacaagaacaccaagaacgaggacctgtgggattccatggcctctatctgccccacggacggtgtgaaaggcatggacggcttctgctctcgctctcagcatagctccagctcgagtcattggcatcaggaaggagttgatgttaaaaccatgatgaacacatggactctacagaaaggattccccttaatcactatcacagtgcggggtcgcaatgttcatatgaagcaagaacactatatgaaaggaagcgacggcgcaccggacactggttatctgtggcacgtccccttaactttcattacttcaaagtctgacatggttcacagattcctcctgaagactaagacagatgttttaattctccccgaggaagtcgaatggatcaagtttaacgttggaatgaatggttactatattgtgcactacgaggacgatggttgggattcgctaaccggcttattgaaagggacccataccgccgtgtcttctaacgatcgagcgagcttaatcaataacgcctttcagctcgtgtccatcggcaagctgagcattgagaaagccctggatttatctctgtacttaaaacatgaaacagagatcatgcctgttttccaaggattgaatgagttgatccccatgtacaaacttatggagaagagagatatgaacgaggtggaaacccaatttaaggctttcctcattaggctacttcgagatctgattgataaacagacttggactgatgaggggtctgtttccgaacgcatgctccgctcccagctgctgctcctggcatgtgtccacaattaccaaccctgcgtccagcgagctgaaggctattttcgaaagtggaaagaatccaacgggaacctgtccttacccgttgacgttacattggcagtgttcgccgtgggagcccagagcacagaagggtgggattttctgtactctaaataccaatttagtttatctagcactgagaagagccagattgaattcgcactttgcaggacacagaacaaagagaaactacaatggctccttgacgagagctttaagggagacaaaatcaagacacaggagttccctcagatcctcactctcattgggagaaatccggtggggtatccactagcttggcaattcctcaggaagaattggaataaactcgtgcagaagttcgaactgggctcgtcgtcaattgcacacatggtgatgggaactactaatcaattcagtactaggaccaggttggaagaagtcaaaggctttttttcctcgctcaaggaaaatggctctcagctgaggtgcgttcagcagacgattgaaactatcgaggaaaacattggatggatggataagaactttgacaaaatacgggtttggttgcagagtgaaaaattagaacatgaccccgaagcagacgccactggctag

SEQ ID NO: 221926 - DNA, 2826 bp, Artificial Sequence
  Description of Artificial Sequence: Synthetic coding sequence
atggtattccttccacttaaatggtcacttgcaacaatgtctttcctccttagctctctgctggctttattgacggtgtccactccatcttggtgccagagtactgaggcatcaccaaaacgaagcgatggaacccccttcccctggaacaaaatccgcctgcccgagtatgtcatccctgtgcattatgatctcctcatccacgcgaacctgacaaccctgacgttttggggcaccacaaaagtggagattaccgcctctcagccaaccagcacaatcatcctccacagccaccatctacagattagcagggcaacgttgcgaaaaggtgcaggggaaaggctcagtgaggaaccgctacaggtcctggagcaccccagacaggagcagatagctctcttagcacccgaacccttactggtgggcctgccctataccgtagtcatccattacgccggtaatctctctgaaaccttccatggtttttataagagcacctaccggacgaaagaaggcgaattgaggatacttgctagtacccaattcgagcccaccgcggctaggatggcctttccctgcttcgacgagccagcctttaaagcctctttttctattaagatcaggcgcgagccccgtcatttagctatttcaaacatgccactggtcaagtcggtcactgttgctgaaggtttaatcgaagatcacttcgatgtcaccgtgaagatgtcgacttacctggtagcattcattatttcagacttcgagagcgtcagtaagatcactaaaagcggggttaaagtgtcggtttacgccgtgccagacaaaattaaccaagccgactatgcactggacgcagccgtaacactactggagttttacgaggattacttctcgattccctaccccttgcctaagcaggacctagccgctatccctgactttcagagcggagccatggagaattggggcctgaccacttatcgtgagtccgcccttctgtttgacgccgaaaagtccagcgctagtagcaaactaggtatcacaatgacagtcgctcatgaactggcacatcagtggttcggaaatcttgtgacaatggaatggtggaatgatttgtggttgaatgagggattcgccaaatttatggagtttgtgtctgtatctgttacacatccggaactgaaagtcggagactattttttcggcaaatgtttcgatgctatggaagtggacgctctcaactccagtcatcccgtcagtactcccgttgagaaccccgcacagattcgggaaatgttcgatgacgtttcttacgacaagggcgcatgcattttaaacatgcttagagaatatctttctgcagacgccttcaagagcgggatcgtccagtacttacagaagcacagttataagaatactaaaaacgaggatctgtgggacagcatggctagcatctgtcctacagacggggtcaagggaatggatggtttctgttcccggagccagcatagttctagctcaagtcactggcaccaggaaggggtggacgtcaagacaatgatgaatacatggacgcttcagaaggggtttccactgattaccataactgttcggggtcggaacgttcatatgaaacaagaacattacatgaaggggtctgacggggctcctgatactggttacttatggcatgttccactgacctttatcacctcgaaatccgacatggtgcataggtttttgcttaaaaccaagactgacgtgctgattctgcctgaggaggtggaatggattaagtttaacgtgggcatgaatggatactatatcgtgcattacgaggacgatgggtgggacagcttaacgggcctgctgaagggcacccatacagcagtgtctagcaatgatagggcatcattgattaacaatgcatttcaactcgtatcaattggcaaattgtccattgagaaagcactcgacctaagcctgtatcttaaacatgagaccgaaatcatgcctgtgttccagggactaaacgagttaatccccatgtataagctgatggagaaacgagacatgaacgaggtggagacacaatttaaggccttcctgatcagactcctccgcgatctcattgacaaacagacatggacagacgaaggcagcgtctccgaaaggatgctgcggagccagttgcttctgctggcttgcgttcacaattatcagccttgtgtgcaaagagcggagggctacttcagaaagtggaaggagagcaacggcaatttgtccctgcccgtcgatgtcacactcgccgtgtttgccgtcggtgcccaaagtactgagggttgggactttctgtattccaaataccaattcagcctgagttccactgaaaaaagccagattgaatttgccttgtgcagaacccaaaataaggagaaactgcagtggctgctcgacgagtcattcaaaggtgataagataaaaacacaagaatttcctcaaatactgacacttattggcaggaatccggttggatacccattggcttggcagttccttcgcaaaaactggaataagttagtgcaaaaatttgaactgggctccagcagtatcgcacacatggtcatgggcaccaccaaccagttcagtaccaggacacgtttagaagaagtcaaagggttcttttcctccctgaaggaaaatggttcccagctcaggtgtgtacagcaaactattgagaccattgaagagaatattggatggatggataagaatttcgataaaatacgggtgtggctgcagagcgagaagctcgaaaggatgtag

SEQ ID NO: 221927 - DNA, 2826 bp, Artificial Sequence
  Description of Artificial Sequence: Synthetic coding sequence
atggtgttcctgcccctgaaatggtctctggctaccatgagcttcttactgagcagtttactagccttattaaccgtgagcactcccagttggtgccaaagtacagaagcatcccccaagcgctctgacggcaccccattcccctggaataaaattcgtttgcctgagtacgtgatcccagtccactacgatctccttattcatgccaatttaaccaccttaaccttctggggcaccacgaaggtcgagatcacagcgtctcaaccaacaagtaccatcatcctccactctcaccatttgcagatttctcgggctactttgcgaaagggggctggagaacggttatccgaggagcctctccaagtcctagagcatcctaggcaagagcagatcgctctgttggctcccgagcccctgttggttgggctgccatataccgtggtcatacactacgctggaaacctaagcgagacttttcatgggttctataaaagtacctatcgcaccaaagagggcgagttgagaatcctcgccagtactcagttcgagccgacggccgcacgcatggcctttccatgctttgatgaacccgctttcaaggcaagcttctctattaagatccgtcgcgaacccagacatttggccatcagcaacatgcccctggtgaagtctgtgaccgtcgccgaagggttaatcgaggaccactttgacgttaccgtaaagatgtctacatacctggtcgccttcattatatcggattttgagtcagtcagtaaaatcacgaaatcgggagtgaaggtgtctgtgtatgctgttccagataagataaaccaggctgactatgctcttgacgcagctgtcacattgttagaattttatgaggactatttctctattccctaccctctccccaagcaagatctggcagctatcccagattttcagtcaggggctatggagaattggggactgacaacctaccgggaaagcgcgctgctgtttgacgctgagaaatcgagtgccagctctaagctcggcatcacaatgactgtggctcatgagctggctcaccaatggttcggcaacctcgttactatggagtggtggaacgacttgtggctaaacgagggcttcgccaaattcatggaattcgtgagtgtatcggtcacacatcctgaattaaaggtgggggactacttcttcgggaagtgtttcgacgcgatggaggtcgatgcactgaattcaagccaccccgtcagcacgcctgttgagaacccagcacagatccgagagatgtttgatgatgtgagttacgataaaggagcctgtatcctcaacatgcttcgagagtacctgtccgcagacgcgtttaagtccggaatagtgcaatacctgcagaaacatagctataaaaatacaaagaacgaagacctttgggattcaatggctagtatttgtcctacagacggcgtcaaaggaatggatggcttttgtagccgcagccagcattctagttcctcatcccactggcaccaagaaggcgtcgacgtgaagacaatgatgaatacctggactctgcagaagggcttcccccttataactatcaccgtgaggggacggaatgtccatatgaaacaggagcactacatgaaaggaagtgacggcgctccagataccgggtatctctggcacgtgcccctaaccttcattaccagcaaatccgacatggttcaccgattcttgcttaagacgaagaccgacgtcctgatcctcccagaggaagtggagtggatcaaatttaacgtgggcatgaacggatattacatcgtgcactatgaagatgatggctgggactccctgacaggcctgctcaaaggcactcacacagctgtgtcctctaatgatcgagcatctctcatcaacaacgctttccagctcgtgtccatcggtaagctctccatcgaaaaagctttggatttatccctgtacctgaagcacgagacggaaatcatgccggtgttccagggtcttaacgaattgataccaatgtacaaactcatggaaaagcgcgatatgaacgaagtggaaacccagtttaaggcatttctcatccggcttctgagagaccttattgataagcagacttggactgacgagggcagcgtttcagagcggatgcttagaagccagcttctcctgctggcttgtgttcataattatcagccatgcgttcagagagccgagggatacttccggaaatggaaagaaagcaacgggaatctgtctcttcctgtggacgtgaccttagcggttttcgcagtgggagcacaatctacggaggggtgggatttcctgtactcaaagtatcagttcagcctttcaagtactgaaaagagtcaaatcgaattcgctctgtgcaggacccagaacaaggagaaactgcagtggctgttagacgaaagctttaagggcgacaaaataaagacacaggaattcccacagatccttacactcattgggcgtaatccggtgggatacccgctcgcgtggcaatttctgcgtaaaaactggaataagttggtccagaagtttgaattgggaagtagctctatagcgcacatggttatgggcactacgaaccagtttagcacgcgtacgcgtttggaggaagtgaaaggtttcttctcgtcccttaaggaaaacggtagccaattgcgctgcgtgcaacaaaccattgagacgatcgaggagaacatcggctggatggataaaaactttgataaaattagagtgtggctgcaatcggaaaagctcgaacgcatgtag

SEQ ID NO: 221928 - DNA, 390 bp, Artificial Sequence
  Description of Artificial Sequence: Synthetic coding sequence
atggtctttctgcccctgaagtggtcactcgccaccatgagctttctcttgtctagcctgctcgctttgcttaccgtttcaacaccctcatggtgccagtccacagaggcgtcacctaaacgatccgatggaactccctttccttggaacaagatccggctgcctgaatatgtgataccagtgcattacgatctactgattcacgccaatctgacaactttgaccttctggggtaccaccaaggtggaaattaccgcctcacagcccacttccactatcattttgcatagccaccatctgcagataagcagagcaacattgaggaaaggcgcaggtgaacgactgagtgaagaacccttgcaggtccttgagcacccacgtcaggagtag

SEQ ID NO: 221929 - DNA, 2748 bp, Artificial Sequence
  Description of Artificial Sequence: Synthetic coding sequence
atgttccattcctctgccatggtgaactcacatagaaagccgatgttcaacatacatcggggtttctattgtctgactgccattttgccccaaatttgtatttgcagccaattttctgttccatcgtcctatcattttaccgaggaccctggcgcattccctgtcgccacaaacggcgagagatttccatggcaggaactcaggctgccgtctgtcgtgataccactccactacgatttgtttgtgcatccaaacctgaccagtctcgattttgtagcatcagaaaagatcgaagttctggtgtcaaatgccacacagttcataattttgcattccaaggatctggagattactaacgcgacactgcagtcagaggaagactccagatacatgaagcccggaaaggaactcaaagtgctcagttaccctgctcacgaacagattgcattactggtcccagagaaactgactccacacctcaaatactacgtagctatggacttccaggcaaaactcggagacggcttcgagggtttttacaagagtacctatagaacactggggggtgagacaagaattctcgcggttaccgacttcgagcccacgcaggccaggatggcgttcccttgctttgacgagcctctcttcaaagctaatttcagcatcaagatcaggcgtgagagtcggcacatagccctgtctaatatgcccaaggtcagtatttacgcctctccagacaaacggaaccagacgcattatgccttacaggccagtctgaagctgctggacttttacgaaaagtacttcgatatatactaccctctgagcaaactcgatctgatcgctattcctgacttcgccccaggtgcaatggaaaactgggggttaattacatatagagaaacctctctactttttgaccctaagacctcttctgctagtgataaactttgggtgacgcgggttatcgcacacgaacttgcacaccaatggtttggcaatctggtcactatggagtggtggaatgatatttggcttaaggaggggttcgcgaaatatatggagctaatagcagtcaacgctacataccctgagctccagtttgatgattactttcttaacgtgtgcttcgaggtaatcacaaaagacagccttaacagcagcagacccatttccaaaccagccgagacccccacccagattcaggaaatgtttgatgaggtgtcctacaacaaaggcgcatgcatcctgaacatgctaaaagactttctgggcgaagaaaagtttcagaaaggcatcatacagtacttaaaaaaattttcctacagaaacgccaagaatgacgacctgtggagctccctgtctaacagttgcctggaatctgattttacgtccggtggcgtgtgccactccgatccgaagatgaccagcaacatgctagccttcctgggagagaacgccgaggttaaagaaatgatgactacgtggaccttacagaaggggatccccctccttgtcgtgaaacaggatggttgctcgttgcgcctgcagcaggaacggttcttacagggggtcttccaggaggaccctgagtggcgagctctgcaggaacggtacttatggcacattccactcacttatagcacatcctcctcgaatgtgatacaccgacacatcctgaaatcgaaaacggacactctggatctacccgagaaaacctcgtgggtcaaatttaacgtggactctaacgggtattacatagtacactatgaaggccatgggtgggatcaactgatcacccagctcaatcaaaaccatactttactgcgtccaaaagaccgcgtagggctgattcatgacgttttccagctcgtaggggctggcagactgaccctggacaaggctctcgacatgacctattacctccagcacgagacatcctcacctgcccttctggagggactgtcatatctggagagcttctaccatatgatggacaggcgcaacatctccgacatttccgaaaacctcaagcgctacctgcttcagtactttaaacctgttattgatcgtcagagttggtcggacaaaggaagcgtgtgggacagaatgctgagatctgccctgctcaagctcgcctgtgatttgaatcatgcgccttgtattcagaaagccgcagagctgttctcccagtggatggagtcctccggcaagctgaacataccaacagacgtccttaagatagtttactctgtgggtgcacagacgacggccggatggaactatctgcttgagcagtacgaactcagcatgagctctgcggagcagaataagatcctgtacgctctctcaacttccaaacaccaggagaaactgttaaaacttatcgagctggggatggaagggaaagtcataaagacgcagaatctggcagctttgctgcatgccattgccagacgcccaaaaggacaacagctggcttgggattttgtgcgcgaaaactggacccatctgctgaaaaaatttgacttaggctcttatgacattagaatgataatctccggcacaactgcacattttagcagcaaggacaaactccaggaggtgaaactgttctttgaaagccttgaggctcagggttcccatctcgacattttccagacagtgttagagacaatcaccaaaaatataaaatggctggagaaaaacctgcctacactgcgcacttggctcatggtgaacacctag

SEQ ID NO: 221930 - DNA, 2883 bp, Artificial Sequence
  Description of Artificial Sequence: Synthetic coding sequence
atgtttcattcgagtgccatggtgaactcgcacagaaaacccatgtttaacatccacagaggattttattgtctcacggccattcttccacaaatctgtatttgttcccaattttctgtgccctcttcgtaccacttcactgaggacccaggcgctttccctgtcgccactaacggtgagaggtttccgtggcaggagcttcgcctgccttcagtcgtgattcccctccactatgacctgttcgtgcaccctaatctgacttccctggacttcgtcgcctccgagaagatagaggtgctggtgtcaaacgccacgcagttcattatcttgcactcaaaggacctggaaatcaccaatgccacattacaaagcgaagaggactctagatacatgaaacctggaaaggagctaaaagtgctgtcttacccggctcatgagcaaattgcgcttctagtcccagaaaagttaaccccacatctgaaatattatgtggctatggatttccaggccaaactaggcgacggatttgagggcttttataagagtacttaccgcaccttaggtggagaaactcgcattttagcggtcaccgatttcgagcccacccaggccaggatggcatttccatgttttgacgagcccttatttaaagctaatttctcaatcaagatccgaagggagtccagacacattgccctttccaacatgcctaaagttaaaaccatagagttggaaggtggcctcctagaagaccatttcgagaccacagtaaaaatgagtacttaccttgtggcctacattgtgtgcgatttccactcactgagcggctttacttccagtggagtcaaggtgtccatttacgcttctccagataaacggaatcagacccattacgcactgcaagctagcctgaagctgctggatttctacgaaaagtacttcgacatatactaccctctaagcaagctagatctcattgccataccagatttcgccccaggtgccatggaaaactggggcctgattacctatagggagacctcactgctcttcgatcctaaaacctcctccgcctcagataagctatgggtgactcgagtgattgcccacgagttagcccaccagtggttcggcaacctggtgaccatggagtggtggaatgatatatggttaaaggagggtttcgccaagtacatggagctgatcgcagtcaatgcgacttaccccgagctgcagtttgatgactatttcctgaatgtttgcttcgaggtgattaccaaagactcccttaattccagcagaccaatctctaaacctgctgaaactccaactcagatacaggaaatgtttgatgaagtgagttataacaaaggtgcatgcatccttaacatgttgaaggattttttgggggaagagaagtttcagaaggggattattcagtacctgaagaagttttcttatagaaatgccaagaacgatgatctgtggtcaagcctgagcaatagctgccttgaaagcgacttcacttctggcggagtttgtcacagcgacccgaagatgacttcaaacatgttggcattcttgggggaaaacgccgaggttaaagaaatgatgactacctggacccttcagaaaggaatcccgttactagtagtgaaacaggatggttgtagtctccgcctgcagcaggagagatttctgcagggcgtgttccaggaggaccctgaatggagggcactacaggaacggtacctgtggcacatccccctaacctacagcacttcgtcgtccaacgtcattcacagacacatcctgaaatccaaaactgacacactcgatctgccggagaagacaagctgggttaaattcaatgtggactctaatgggtattatatcgttcactacgaaggacacggctgggaccagctgattactcaacttaaccaaaaccacacgttgctgaggccaaaggaccgcgtgggtttgatccacgatgtgttccaactggtgggcgctggacgcctcacccttgacaaggctttagatatgacatactacttgcagcatgagacatcaagtccagccctcttggaggggctctcatatctggaatctttttaccatatgatggaccgccgtaatatttccgacatctcggaaaatctgaagaggtatttactgcagtattttaagcccgtgatagataggcagagctggtctgataaaggttcagtatgggaccggatgttacgcagcgccctactcaagttagcatgcgatctgaatcatgcgccttgcattcaaaaagctgccgagttgttttctcagtggatggagtcctccggaaagttgaatatcccaactgacgttctgaagattgtgtattctgtgggcgctcagacgaccgctgggtggaactatctgctggagcagtacgagctcagtatgtcaagtgcagaacagaacaagatcttgtacgctctgtcaacctcgaaacatcaagagaagctgttaaagctgatcgaattgggaatggaggggaaagtgatcaaaacccagaacctggccgcactgctgcacgccattgctagaaggccaaaaggacaacaactggcctgggattttgttagagagaactggacccaccttttgaagaagttcgatctcgggagctatgatatccggatgatcataagtgggacaaccgctcacttttcttccaaagataaacttcaggaggtgaagctcttttttgagagtctggaagctcagggaagccatctcgacatattccaaactgtgcttgaaactattactaagaacatcaagtggctcgaaaaaaatctgcccacgctaaggacttggctgatggtgaatacgtag

SEQ ID NO: 221931 - DNA, 1053 bp, Artificial Sequence
  Description of Artificial Sequence: Synthetic coding sequence
atgtttcacagttcagctatggttaattcacaccgaaagcctatgttcaacatccacaggggtttttactgtctcaccgccatcttgccacagatatgcatatgttcccagttcagcgtgccttcatcctatcattttaccgaggatccaggggcatttcccgtcgccacgaatggtgagcgctttccctggcaggaactgagactgccctcagtagtgatccctcttcactatgatttgttcgtacaccctaatctcacctcacttgatttcgtcgcttctgaaaagatcgaagtgttggtgtctaatgcaactcagttcataatcttgcactctaaagatttggaaattacaaacgctaccctgcagtccgaggaggattcccgctatatgaagccgggaaaagaattaaaggttttgagctaccccgctcatgagcaaatagcacttcttgtgccggaaaaattaaccccccatctgaagtattatgtcgccatggacttccaggctaaactgggcgatgggtttgaagggttttataaaagcacttacaggaccctcgggggtgaaacccggatactggccgtgacagactttgaaccgacccaagcacggatggcgttcccttgttttgatgaacccctgttcaaggccaacttttccatcaagatacggagggagagccgccacatcgccttgtcgaacatgcctaaagtgaaaaccatcgaactggaaggaggcctgttggaggatcacttcgaaaccacagttaagatgagcacatatttggtcgcgtatatagtgtgtgacttccatagcctctctggctttacaagtagcggagtgaaggtttcgatttatgcctctcccgacaaacgcaatcagacacactacgccttgcaagcttctctgaagttactagacttctacgagaaatattttgacatttactaccctctgagcaaattgggtatgtttaaattccatatcattgtgtttatttttgcacataaaacttgctttgacttatttcccctgagcctgtcaatgtag

SEQ ID NO: 221932 - DNA, 2085 bp, Artificial Sequence
  Description of Artificial Sequence: Synthetic coding sequence
atgtttcactcctcagctatggttaacagccacaggaaacccatgttcaacatccaccggggtttttattgcctgaccgccatccttccgcagatttgtatctgcagccaattctctgttccaagctcctatcattttaccgaagatccaggcgctttccccgtggctacaaacggggagagattcccttggcaggaactgaggctgccatcagtggtgattccactgcattacgacctgtttgtacatccaaacctgaccagcttagacttcgtcgctagcgagaagattgaagtactggtaagcaatgccactcaatttatcatcctgcacagtaaagacctggagatcaccaatgcaactctgcagagtgaagaagactctcgttatatgaagcctggcaaagaactcaaggttctgtcatatcccgcacatgagcagattgcacttttggtaccagagaaattgacaccacatctaaaatattatgtcgccatggattttcaggcaaaactgggcgatggatttgaggggttttataagtccacatatcggacactgggaggcgagacacggattctggccgttacagacttcgagccaactcaggcacggatggcgttcccatgcttcgatgaacctctgttcaaggcgaatttctcaataaaaatacgacgagagagccgacatatagcattgagtaacatgcccaaggtgaaaacgatcgagctggaggggggacttcttgaggaccatttcgaaaccactgtaaagatgtctacctatctcgtcgcatacattgtttgcgactttcatagcctctctggctttacaagttccggagttaaagtctcaatatatgcatcaccagataagagaaaccagacccactatgccctccaggcttcactgaaactgcttgacttttacgagaaatacttcgatatctactaccccctgtccaagttagaccttatcgcaatccctgattttgcacccggagctatggagaactggggactcatcacttaccgtgaaacgagtctgctctttgaccccaaaacctccagtgccagcgataaactgtgggtcaccagagtgatcgcccacgagctcgcccaccagtggtttgggaacctggtgacaatggagtggtggaatgatatctggctcaaggaaggctttgctaaatatatggagcttattgccgtgaacgccacatacccggagctgcagttcgacgactattttctgaacgtttgcttcgaggttataaccaaggacagccttaactcttccaggccaattagcaagccagccgagaccccaactcagatccaggaaatgttcgacgaagtatcatataacaagggcgcttgtatactcaacatgctgaaggatttcctgggtgaagagaagttccagaaaggaatcattcagtacctgaagaagtttagctataggaacgcaaagaacgatgacctgtggtccagtctctcaaattcctgcctggagtcagatttcactagcgggggagtgtgccactcagatccgaagatgaccagtaatatgttggccttcctaggggagaatgccgaagtgaaggagatgatgacaacatggaccctccagaaaggcattcccctgttggtggtgaaacaggacggctgttctctaaggctgcaacaggaaagattccttcagggagtgttccaggaggaccccgaatggagggctctgcaggaaagatatctttggcacattcccctgacttactccacgagcagttcaaacgtgattcaccggcacatactcaagtccaagacggataccttagatctacctgaaaagacctcctgggtcaaatttaacgttgatagtaacggctattacatcgtgcactatgaaggtcatgggtgggatcagcttatcacacagctgaaccagaatcacaccttgctgaggcccaaggatcgagttgggctgattcatgacgttttccagcttgtgggggctggacgcctgacactggataaagccctggacatgacctattatctccagcatgaaacctcttctccctag

SEQ ID NO: 221933 - DNA, 1452 bp, Artificial Sequence
  Description of Artificial Sequence: Synthetic coding sequence
atggaggaaggtgggggaggcgtgagaagcctcgtccccggaggtccagttttactagttctgtgcggccttctggaggccagcggcggaggacgggctttgcctcagctgagcgacgacattcctttccgcgtaaattggccgggaacggagttctccctgcccactacaggagttttatacaaagaggacaattacgtgattatgacaacagcccacaaggaaaagtataagtgtattctcccgctcgtcacaagcggggatgaggaagaggagaaggactataagggaccaaatccgcgtgaactactggaaccgcttttcaagcaatcttcatgctcctatagaattgagtcatactggacgtatgaggtgtgccatggcaagcacatccgtcaataccatgaggagaaggagactggccaaaagatcaacatacacgagtattacttgggaaatatgttagcgaaaaacctgctatttgagaaggagagagaggccgaggagaaagaaaagtctaatgaaattccaaccaagaacatagagggacagatgacaccatactatcccgttggcatgggtaacggaactccttgtagcttaaaacaaaataggccacggtcttccacagtaatgtacatctgccatccggagagcaagcacgaaatcctatccgttgctgaagtgacaacatgtgaatacgaggtcgtgatcctcactcctctcttgtgcagtcacccaaaataccgctttagagcttcaccagtcaacgatattttctgtcagagcttacccggaagccctttcaaacctctcacactgagacagctcgagcagcaggaggagatcttaagagtgccttttaggcgaaacaaagaagaggacctccaaagcacgaaagaagaaaggtttcccgcaatccacaagagtatcgctattggtagccagccggtcctcaccgtcggaaccacccatattagtaaactgaccgacgatcagttgattaaggaatttttatccggcagctactgctttcgcggaggcgtgggatggtggaagtacgagttttgttatggtaagcacgtgcatcagtatcacgaggacaaggatagcgggaagacctcggtcgtagtgggtacttggaatcaggaggaacatatagagtgggcaaaaaagaacaccgctagggcctatcacctgcaagatgacgggacccaaacagtccggatggtgagccatttttacgggaatggtgacatctgtgatataacagacaagcctcgccaggtcacggtcaaactaaaatgcaaggagagtgatagtccccacgcagttacagtctacatgctggagccccacagctgtcagtatattctcggagtagagtccccagtgatttgtaaaatactggataccgcagacgaaaatggcctgctgagcctgcctaattag

SEQ ID NO: 221934 - DNA, 1290 bp, Artificial Sequence
  Description of Artificial Sequence: Synthetic coding sequence
atggaggagggaggtggcggagtgaggtctctggtgcccggaggaccggtactcctagttctttgtggcctgctcgaagctagcggcggtggtagagccctgccgcagttgagtgatgacatcccatttcgtgttaattggcccggtacagagtttagccttcccaccaccggcgtcctctacaaagaggataactacgtcatcatgacgaccgcccataaggaaaagtataagtgcatattgccactggtcacctccggagacgaagaagaggaaaaagattataaaggtccaaatcctcgggagctgctggaacccctgtttaagcaatcctcctgctcttaccgtatagagtcctactggacttacgaggtgtgtcacggaaaacatattcgccagtaccatgaagaaaaagagaccggacagaagatcaacatccacgaatattacctcggtaacatgcttgccaaaaacctgctgtttgagaaagagcgcgaagctgaagagaaggagaagtcaaatgaaatccccacgaagaatatcgaaggccagatgactccatattaccctgtcggcatgggaaatgggactccatgtagtctcaagcagaacaggccgagatcaagtaccgtcatgtatatctgtcatccagagagcaagcacgagatcttgtccgtggccgaggtaactacttgcgagtacgaggtcgtaatcctcacgccattactctgctctcatccgaagtaccgattccgggctagcccagtcaacgatatcttctgtcagagtttgccaggctcacccttcaaaccattgactctgaggcagctggaacaacaagaggaaatactgagggtcccctttagacgaaataaggagggggtaggatggtggaagtacgagttttgctatggcaagcatgtccaccagtaccatgaggacaaagactctggtaagaccagtgtggtggttgggacctggaaccaggaagaacacatcgagtgggctaaaaagaacacagcacgggcttatcacctccaggacgacggaacgcagaccgttcggatggtgtcccatttctatggcaatggagacatatgcgacattactgataagcccagacaggtcacggtaaaattgaaatgtaaggagtctgattccccccatgcagtgaccgtatatatgctggagccacattcttgtcagtatattttaggtgttgaaagtccagtcatttgcaagatattagatacagccgatgagaatggcctgttatccctccctaattag

SEQ ID NO: 221935 - DNA, 1374 bp, Artificial Sequence
  Description of Artificial Sequence: Synthetic coding sequence
atggaggaaggtggaggaggggttagaagtctggtgcccggaggtcctgtgcttctggtgctctgtggcctgctggaggcttccggagggggaagagcgctgccccagctgtccgatgatatcccctttcgcgtgaactggcctggcaccgaattctctctccccactaccggtgtgctgtacaaggaggataactacgtgatcatgaccaccgcccacaaagagaaatacaagtgtatcctgcctctcgtcacttctggggacgaagaagaggaaaaggattacaagggccctaatccccgtgagttgcttgaacctctgttcaaacaaagctcgtgctcttatcggattgagtcttactggacttatgaggtctgccacggaaaacacatacgacagtatcacgaggagaaggagactggccaaaaaataaatatacatgagtactatctgggcaatatgttggccaaaaatcttcttttcgagaaggaacgggaggctgaagagaaagaaaaatctaacgaaatacccacgaagaatatcgaaggacagatgacgccctactaccccgtcggaatgggcaatgggaccccctgtagcctcaagcagaatcgaccaagatcaagcacagttatgtatatttgccaccctgaaagcaagcatgagatattatccgtagccgaagtcactacatgcgagtatgaagtggtgatcttgaccccactgctttgtagccatcctaagtaccgctttagagcctccccagtgaacgatatattttgccaaagtcttcctggctcaccattcaagccgttaacgctccgccagcttgagcaacaggaggagatcctccgcgtccccttccgaagaaataaggaggaggacttacagagtacaaaggaagaaagattcccagctatccacaagagtatagcaataggctcccagcccgtcctgaccgttggaaccacacacatcagcaagttgacagacgaccaactcatcaaggagttccttagtgggtcttactgcttccgcggtggcgtgggttggtggaaatatgaattttgctacgggaagcacgtgcaccaatatcacgaagacaaagacagcggaaaaacaagcgtagtcgtgggaacttggaaccaggaggagcacatagaatgggcaaagaaaaacactgctcgggcttatcatctgcaagatgatgggactcagaccgtgaggtgtaaagaatctgactctcctcacgctgtaaccgtgtacatgctggagccacatagctgccagtatattctgggcgtggagtctcctgtcatctgcaaaatacttgacacagcggacgagaacggcctcctctctctgccaaattag

SEQ ID NO: 221936 - DNA, 2715 bp, Artificial Sequence
  Description of Artificial Sequence: Synthetic coding sequence
atggagtggggctctgagtccgctgcggtgaggagacatcgggttggcgtggaacgtagagaaggcgcagctgcggcacctcctcccgagcgggaagcgcgtgctcaagaaccgctcgtggatgggtgttctggcggaggcaggacacgaaagcgctcgcccggaggtagtggaggtgcatcaagaggggcaggtaccggactgagcgaggtgagggctgctttaggcctggccctctatctgatagcactacggaccctcgtgcaactcagcttgcagcagctggtgttgaggggggcagccggtcatcggggtgagttcgacgctctgcaggctcgggattaccttgaacacattacctccattggcccacgtacaacgggttcccccgagaatgaaatccttaccgtgcattacctgctggaacagattaaactgatcgaagtacagagtaactccttgcataagatctctgtcgacgtgcagcgccctacaggcagcttctccattgactttctgggcggatttacttcatattatgataatattaccaacgtagttgtgaagcttgagccacgcgacggcgcacagcacgcagtgctggctaattgtcactttgatagtgtagctaacagtcccggagccagcgatgacgccgtctcatgctctgtgatgcttgaagtactccgcgtactgtccactagttcagaggcgttgcatcacgccgtgatctttctatttaacggagctgaggagaacgttctgcaggcctcccacggatttatcacccaacatccatgggccagcctcatccgcgcttttattaacctagaggcagctggagttggcggaaaggagcttgtttttcagactgggcctgaaaacccctggctcgtgcaggcttatgtgtctgcagctaaacatccatttgcatcagttgtggctcaagaagtgttccagtctggcattatccccagtgacactgactttcgcatctaccgggacttcgggaacatacctggcattgacctggcctttattgagaatggctacatctatcacacaaaatacgacactgccgaccggatcttaaccgactcaatccaaagggcaggcgataacatcttggcagtgcttaagcacctcgctacttcagacatgcttgcagcggcttctaaatatcgacacgggaatatggtgtttttcgatgtactgggtctgttcgtgatcgcatatccttccagaattggctcaatcatcaactatatggtggtgatgggcgtggtactgtacttgggaaagaagttcctgcagcccaagcacaaaaccggaaactataagaaggacttcctgtgcggactgggcatcactcttatctcttggtttacctccttggtcaccgtgctgatcattgccgtattcatctctctgatcgggcagagtttgtcatggtacaaccatttttacgtgagcgtgtgcctctacggaaccgctaccgtagcaaagatcattctgatccacacccttgcgaagcggttttattatatgaacgcatctgcccagtatctgggtgaggtgttcttcgatatctctctgttcgttcactgttgcttcttagtgactttaacgtatcaggggctttgttctgctttcatttccgccgtatgggtggcattccccttgctgaccaaattgtgtgtgcacaaagatttcaagcagcacggagcccagggtaagttcattgctttctatctcctgggcatgtttatcccttacctgtatgccctgtatttaatctgggccgtctttgaaatgtttacaccaattctgggcaggtcgggttccgaaattcctccagatgtcgtgctcgcatctatattggccggttgtaccatgattctgtcaagctacttcattaatttcatttacctggcaaagtcaacaaaaaaaaccatgttaactctgacacttgtgtgtgcgataacattccttttagtttgctctgggacattcttcccctacagttctaaccctgcgaaccctaaacctaagagagtcttcctgcagcacatgacacgcaccttccatgacctcgaggggaatgccgtcaagcgagactcgggcatttggataaatggtttcgactataccggtatcagccacatcactccgcacatcccggagataaacgattctattcgggcacactgcgaagagaacgctcctctgtgcggttttccttggtatttacctgttcactttctgatcagaaaaaattggtatttaccagcgccagaggtatctccgagaaaccccccacattttcgtctgataagcaaagagcagacaccctgggactcaatcaagctgactttcgaggccactggtccatctcacatgtccttctacgtcagggcgcacaaaggctcaaccctgtcacagtggtctctagggaacggcacaccggtaacctctaagggcggagattacttcgtgttctactcacacggactgcaggcaagcgcttggcaattctggatcgaagttcaggttagtgaagaacaccccgagggtatggtaacagtggcaatcgccgcacactacctgtctggggaagacaagcgctcgccccagcttgatgctttaaaggagaagtttccagattggacttttcctagtgcctgggtgtgcacctatgatctgtttgttttttag

SEQ ID NO: 221937 - DNA, 1056 bp, Artificial Sequence
  Description of Artificial Sequence: Synthetic coding sequence
atgctcgaggttctgagggtgctgtctacaagcagcgaggcgctgcatcatgccgtgatttttttgtttaacggtgcagaggaaaatgtgctgcaggcgtcacatggctttatcactcagcacccgtgggccagtttaattagggcctttatcaacttggaggccgcaggcgttgggggaaaggagctggtctttcagacagggccagaaaacccctggctcgtgcaggcctatgtcagcgctgcaaagcatccattcgcaagtgtagtggctcaggaagtatttcagagcggcatcataccctctgacaccgactttagaatctacagagattttgggaatataccaggaatcgacctcgcctttattgaaaatgggtacatttaccatactaaatacgatacggctgatcgaatacttactgacagcatccaacgggcaggggacaatattctggccgttctgaagcacttagccacaagcgacatgcttgccgcagcatcgaagtatcgccacggaaatatggtgttttttgacgtgcttggcctatttgtaatcgcctacccaagtcgtattggaagcattatcaactacatggtggtaatgggcgtggtactgtatctgggcaagaagttcctgcagcctaaacacaaaaccggaaactataaaaaggactttctctgcggcctcggcatcacgctgatatcttggttcacatccctcgttactgtactgattattgccgtcttcatctctttgatcggtcagagcctgtcctggtacaatcacttctatgtttccgtctgcctgtacgggacggcaacagtggctaagattatactcatccacacgctggccaaacgtttttactatatgaatgcgtcagctcagtatctgggcgaggtgtttttcgacattagtctgtttgtacactgctgtttcttggtgacactgacgtaccaaggactctgttccgccttcattagcgcagtgtgggtggcctttccgctgttaacaaagctctgtgttcataaagatttcaagcaacatgattag

SEQ ID NO: 221938 - DNA, 2715 bp, Artificial Sequence
  Description of Artificial Sequence: Synthetic coding sequence
atggaatgggggagtgaatctgcggcagtgcgaaggcaccgggttggcgtagagcgacgggagggcgctgccgctgcgcctccccctgaacgtgaagccagggcccaagagccgttagttgatgggtgttccggcggtggcaggaccagaaaacgatctccaggagggtcgggaggagcatcccgtggcgcagggactggactaagcgaggtgagggctgcactggggctcgcactgtatcttatagccctgcggacgctggtccagcttagtttgcagcagctggttctccggggtgccgcaggacaccggggtgagttcgatgccctgcaggctcgggattatctggaacatatcaccagtattgggcctcggactaccggaagccccgaaaatgagattcttactgtacactatcttctggagcagattaagctcattgaggtgcagtctaattcattacacaaaatttccgtggatgtccagcgccctacaggctcattcagtatcgatttcttaggtggctttactagttattacgacaacatcacgaatgtagtcgtgaagctcgaacctcgagacggggcacagcatgcggttttggccaactgtcactttgactccgttgctaactctccgggtgccagcgacgacgctgtaagctgttccgttatgctcgaggtactgagggtgctgagcacatccagcgaggcactccaccatgctgtgattttcttatttaacggcgcagaagaaaatgtgttgcaggccagccacgggttcattacgcagcacccatgggcatctctcattagggctttcattaacttagaagccgctggggtggggggtaaggagctggtgttccagaccggtccggaaaatccctggctcgtccaggcctacgtgtccgccgctaaacatcccttcgcctctgtggttgcccaagaggtgtttcagtctggaattatcccctctgacacggacttccgcatatatcgggattttggaaatatccctggaatcgatctggctttcattgaaaatggatacatctatcacacaaagtacgataccgccgaccgcatcctaacagactcgatccaaagggctggagacaacattctcgccgtcttgaagcaccttgcaacatcggacatgctggccgctgcttccaagtatcgccacggcaacatggtgttttttgacgtcttgggtctctttgtaatcgcgtaccctagcagaatcggttcaattatcaattacatggtagtaatgggcgtggtgctatacctgggcaaaaaattcctgcagccaaaacataaaactggcaactacaagaaagatttcttatgtggcctgggaattactttgatttcctggttcacatcactcgtgaccgtccttatcatcgccgtgtttatctccctcatcgggcagtctctcagctggtataatcacttttatgtgtctgtgtgcctatacgggaccgcgaccgtggccaaaatcattctgatccatacactggccaagcggttctactatatgaatgccagtgcacagtacctgggagaagtttttttcgatataagcctctttgtgcactgttgttttctcgtaaccctgacctatcagggactgtgtagtgcattcatctctgccgtgtgggtcgcctttccactcctgaccaagctgtgcgtgcataaagatttcaaacagcatggggcacaggggaaatttatcgctttctacctgctgggcatgttcatcccctatctctatgcactttatttgatatgggccgtatttgagatgttcacccccatccttgggcgatcaggttcagagatcccccctgacgtcgtgcttgcctctattctggccggttgtaccatgattctcagttcttatttcatcaatttcatctatcttgctaagagtacaaagaaaacaatgctgacgctcacactggtgtgtgccatcacctttctcctggtgtgtagtggcacatttttcccctactccagtaaccccgctaacccgaaaccaaagagggtatttctccagcacatgaccaggacatttcatgatcttgagggcaacgcagttaaacgagacagtgggatttggatcaacggcttcgattacaccggcatctcacatatcaccccgcacatccccgagatcaatgattctattagggcccactgtgaggaaaacgctccgctgtgcgggttcccatggtacctgccggtacacttcctgatcaggaagaactggtatttgcccgcaccagaggtttcaccacggaatcctccacattttcgccttatcagcaaagagcaaaccccttgggacagtatcaagctgaccttcgaggctactggtccttcccacatgtctttctatgtgagagcccacaaaggttcaacattgtcgcagtggtcacttggcaacgggacgcccgtaacctctaagggcggtgattacttcgtgttctattcccacggactacaggcgagtgcctggcaattttggatcgaggtgcaggtgtctgaggaacaccccgagggaatggtcacagttgccattgctgctcattaccttagcggtgaggataagcgttctccccagctggatgccctgaaagagaaatttcccgactggacattccccagcgcttgggtgtgtacctatgacctctttgtgttttag

SEQ ID NO: 221939 - DNA, 1260 bp, Artificial Sequence
  Description of Artificial Sequence: Synthetic coding sequence
atggtggtgatgggcgtagtgctctatctgggtaagaagtttctgcagcccaaacacaaaactgggaactacaaaaaggacttcctgtgcggcctgggtattaccttaatttcgtggttcacctctctcgtcacagttctgatcattgcagtctttatctcgctgatcggacagagcttgtcatggtataaccacttctacgtgagcgtgtgtctgtatggcacagccacggttgctaaaattatattaatacacaccctcgcgaagcgattctattacatgaatgcctcagcccagtacctgggcgaagtgttcttcgacatcagcctgttcgtgcattgttgctttctggtgactttgacctatcaaggcctgtgttctgcttttatctctgcagtctgggtcgccttcccgcttttgaccaagttgtgtgtgcacaaagatttcaaacaacacggagcacaaggcaagttcatcgcattctacctgcttggaatgttcatcccttatctatatgcgttgtacctcatttgggccgttttcgagatgttcactcccattctgggaagaagtggaagtgagatccctccagacgtggtccttgcatcaatactggctggttgtactatgattcttagctcatacttcattaatttcatctatttggctaagtccaccaagaaaacaatgttaactttgacattagtgtgcgcgattacttttctcctggtgtgctctggcaccttcttcccatatagtagtaatcccgcaaaccctaaaccaaaaagggtatttctgcagcacatgacccgcacatttcacgacctggaaggaaatgccgtgaaacgagactcagggatttggattaatggatttgactataccggcattagccatattaccccgcacattcccgaaattaatgatagcatccgtgcccactgtgaagagaatgcccctttgtgtggattcccatggtacctcccagttcactttctgatccgcaagaattggtatctgcccgcaccagaggtgtccccgaggaatcctccacatttccgcctgatttctaaggagcagactccctgggactctattaaactgacctttgaagcgacagcatgtttgcctatcctgcagatcttggacctccctgccagcactatcatgactaaaccgtacgtattactgtgttctagccctcaaagggtcaacacttttagcgtggtgagctggcaatggcacccctcccacaagtag

SEQ ID NO: 221940 - DNA, 786 bp, Artificial Sequence
  Description of Artificial Sequence: Synthetic coding sequence
atggctgcggcagtacccagagcagcctttctgtctcccctccttccattactgctcggcttcctgcttttatctgctcctcacggaggcagcggtctgcataccaaaggagctcttccactggatactgttacattctacaaggtgattcccaaatccaagtttgtgctggttaagttcgatacccaatatccttacggcgagaagcaggatgaatttaaaaggcttgccgagaactccgcctcgagcgatgacctgctggttgctgaggtaggaatatcggactatggagataaattgaatatggagctgtccgaaaaatacaagcttgacaaggaatcctatcctgtgttttacttgtttcgtgatggcgacttcgaaaacccagtgccatacacaggagccgttaaggtgggggctatacagcgatggctgaaagggcaaggggtgtatcttggaatgcccggttgtctgcctgtctatgatgctttagccggagaatttattcgggctagcggagtcgaagccagacaggctttactcaaacaaggacaagacaacttgagctcagttaaagagactcagaagaaatgggctgaacagtacttaaaaataatgggaaagatactggatcagggggaggacttccctgccagcgaaatgacccggattgctaggttgatagaaaagaataagatgtccgatgggaagaaagaagagttacagaaaagtttgaacatcctcaccgcctttcagaaaaagggagcagagaaagaggaactgtag

SEQ ID NO: 221941 - DNA, 162 bp, Artificial Sequence
  Description of Artificial Sequence: Synthetic coding sequence
atggcagcagccgtgcctcgggcagctttcttatctcccctgcttccactgttgctgggtttcctgcttctgtccgccccacacggaggcagcggcctccacacaaagggggctctaccactggacactgtcacattttacaaaatcatggtcacatcatag

SEQ ID NO: 221942 - DNA, 2925 bp, Artificial Sequence
  Description of Artificial Sequence: Synthetic coding sequence
atgagacgtgcgggaattggagaagattcccggctgggattgcaagcccaaccaggtgcagagccctcacccggtcgggcagggactgagcgatccctcggtggtactcagggtccgggacagccctgttcatgtccaggtgctatggcaagcgctgtgaggggcagcagaccgtggccgcgtctggggctccagttgcagtttgcagccttacttttggggacgttgagccctcaggtgcacacactcagacccgaaaatcttctgctggtctccaccctagatggatctctccacgccctctccaagcagaccggggatcttaagtggacactgcgcgacgacccggtcatcgagggacctatgtacgtcactgaaatggcttttctgagcgacccagccgatggtagcctgtatatcctgggcacacagaaacagcaggggctgatgaaactcccgtttacgatccccgagcttgttcacgcttctccctgtaggtcctcagatggggtgttctacaccggcaggaaacaggatgcatggttcgtggtcgacccagagtcaggtgagacccagatgaccctgaccacggagggcccttcgactccaaggctgtacatcggacgcacgcagtacacagtgaccatgcacgatcctcgcgctcctgcactgagatggaataccacctataggagatatagtgccccaccgatggacgggagcccagggaagtacatgtcccatttggcttcctgtggaatggggttgctcctgacagtcgacccgggttctggtaccgtgctatggacacaggatctgggagtgcccgtgatgggagtatacacctggcaccaggacggtctgcgccagctcccgcacctgaccctagccagggacacactgcactttcttgctctcagatggggccacattcggttgcccgcaagtgggcctcgggacacggcaaccctgttcagcaccctggatacccagctcctcatgaccctgtatgtaggcaaagatgaaaccggtttctatgtctcaaaggccttagtccacaccggtgtagctctagtgccaagggggttaactcttgccccagcagatggcccaactactgacgaggtcacgcttcaggtcagtggtgaaagggaagggagtcctagcacagctgtcaggtacccgtctgggagcgtcgccttgccgtctcagtggctgctgatcggccatcacgaactgcccccagtcttacacactactatgcttagagtacacccaacgctgggaagcgggacggcagagacccgtcctccggaaaatacccaggcgcctgctttctttttggagctcctgtcgctaagccgggagaaactctgggatagtgaactccacccagaagagaagacaccggattcctatttagggcttgggccacaggacttgctcgcagcaagtttaaccgccgtgcttcttggcggttggatcttgtttgtcatgagacaacaacaaccacaggtggttgagaaacagcaggaaactccactggccccagccgacttcgcccatatctcccaagacgcgcaatccttacactccggcgctagccgcaggtcccagaaacgactgcaatccccttccaaacaggcccagccgctggatgaccctgaggcagagcagttgacagtcgtcggtaagattagctttaatcccaaagacgtgctgggccgaggggctgggggaacgtttgtgttccgcggacagtttgagggacgggcagtggctgtaaagcgcctgctccgggagtgtttcgggctggtgcgcagggaggtgcagctgctccaggaaagcgatcggcacccaaacgtactcagatacttttgcaccgagaggggaccacagtttcactatatagcactcgagctttgccgggctagcctccaggagtatgtagaaaaccccgatctggatagaggagggctcgagcctgaagtggtcctgcaacagctgatgtctggactcgctcacctgcatagtcttcacatcgtccaccgggacctcaagcccggaaatatattgattacaggacctgattctcaagggttaggaagagtggtcctttctgacttcgggctgtgtaaaaagttacccgctggccgttgttcttttagtttgcacagtggtattcctggcaccgaaggttggatggcaccggagctgcttcagctgctaccgcctgatagtccaacctcagctgtggacatctttagtgctgggtgcgttttctactatgtgctgagcggtggtagtcacccatttggcgactctctctaccgccaggctaatattctgacaggcgctccatgcctggcccatctggaagaagaagtacacgataaggttgtagcccgagatttggtcggcgcaatgttaagcccactcccccagcctcgaccgagcgcaccgcaggtgctggcccacccattcttctggagcagggcaaaacaacttcaattcttccaggacgtgtccgactggctggaaaaggaatccgagcaggaaccattggtgagggctctggaagccggaggatgcgctgtggttcgagataactggcacgaacacatatccatgcctctgcagacagacctacggaaatttcgtagctacaaaggtacatcagtgagggaccttctacgagctgtgagaaacaagaaacatcactaccgtgaacttcctgttgaagtgcggcaggctttaggccaggtaccagatggcttcgtccagtattttaccaatcggttccccagactcctgttacatacccaccgtgctatgcggtcttgcgcgagtgaatctctatttctgccttattacccacccgacagcgaggccagaagaccttgtccaggtgcaactggtcggtag

SEQ ID NO: 221943 - DNA, 2625 bp, Artificial Sequence
  Description of Artificial Sequence: Synthetic coding sequence
atggcatccgccgtacgcggttctagaccatggcctcgtttaggcctgcagctccagtttgcagccctcctgttagggacattaagcccacaggtgcatacactgcgtcctgagaatctactcctggtgtctacgctggatggaagcctgcatgcactttctaaacagactggcgaccttaagtggactctacgagatgacccagtaatcgaaggacctatgtacgtaaccgagatggcatttctgtcggacccggctgatggctccctctacatcctcggaacccagaaacagcaggggttgatgaaattaccatttacaatccccgaactagttcatgccagcccctgtcgcagtagtgacggtgtattttacaccggtcggaaacaagacgcctggtttgtggtggatcctgagagtggtgagactcagatgacactcaccaccgagggaccatccactccgaggctttacattgggagaactcagtacaccgtgacaatgcacgatccacgcgcaccagctctgcgctggaatacgacataccggcgatattccgcccctccaatggatgggtcaccgggtaagtacatgtctcatttggcttcttgcggaatgggcctgctgttaactgtggatcctggcagtggaacagtgctttggacgcaagatctcggcgtgcctgttatgggcgtctatacctggcatcaggatgggttgcgccagctgccacacctcaccctggccagagacacactgcatttcctggccctgaggtggggtcacatcaggttaccagccagcggaccaagggataccgctacactattcagcacccttgacactcaactgctgatgaccctgtacgtgggaaaggatgagaccggcttctacgtgagtaaagccctcgtgcataccggggtagcattggtccctaggggcctgacgcttgctcccgctgacggcccaaccacagacgaggtgacattgcaggtatccggggaaagggagggcagcccctccactgctgttcgctatcccagcggcagtgtggccctgccctcccagtggctgctcatcggtcatcacgagctcccaccagtgctccatacgaccatgttaagggtgcatccaacccttggctcaggaacagccgaaacacgaccccctgagaacactcaagccccagctttcttcttggagcagcaaccccaggtcgtggagaagcaacaggaaaccccgctggcccctgccgactttgcccacataagtcaggatgcccagagcctccattccggggctagccggcgatctcagaagaggttacaaagtccatcaaaacaagctcagccactggatgaccccgaggccgagcagctgactgtcgtagggaaaatcagtttcaatccaaaggacgtgcttgggagaggtgcgggtggcacttttgtttttcgaggtcaattcgaaggacgggcagtggcagttaaacggctgctccgcgagtgctttgggctcgtgcgtcgggaggtacaattgctgcaggaatccgaccgccacccaaacgtgctgaggtacttttgcaccgaaagaggcccacagtttcactacatagctcttgaattgtgccgcgcatccctacaggaatatgtcgagaaccctgatctcgaccggggaggcctggagcctgaagtggtgctgcagcaattgatgagcggccttgcacacctacactctctgcacatcgtgcatcgcgatctcaagcccggaaacatcctcatcactggccctgacagccagggcttgggcagagtcgtcttgagtgacttcggactgtgcaagaaattgcccgcaggcaggtgttccttttcactccacagcgggattccaggaaccgagggatggatggcccctgagcttctgcagctgctgcctccggacagccccaccagcgctgtcgacattttctctgccggatgcgtgttttactatgtgctgtctggcggtagccatccctttggagattccctctaccgacaggcgaatatacttactggcgctccttgtttggcccatcttgaagaggaggttcacgacaaagtcgtcgcacgcgaccttgtaggtgccatgctttcaccgctgcctcaaccacgcccaagtgcacctcaggttctggcccatccgttcttctggtcccgcgctaagcagctccagtttttccaggatgtgtccgactggctcgaaaaggagagcgagcaagagccactggttcgagcattggaggcaggcggttgcgctgtcgtacgcgataattggcacgaacatatatctatgccccttcagactgatctgagaaaatttcgaagttataagggtacgagcgtgagagacttactgagagccgttcgaaataagaaacaccactaccgcgagctcccagtcgaggtgaggcaggcccttgggcaggtgcccgatggatttgtccaatatttcacgaatcgttttcctcgacttctcctgcatacacaccgagccatgagaagctgtgcatccgagagcctctttctgccttactaccccccagacagcgaagccaggaggccttgccctggtgcaactgggcgatag

SEQ ID NO: 221944 - DNA, 354 bp, Artificial Sequence
  Description of Artificial Sequence: Synthetic coding sequence
atgagccagaaacaggaggaagagaatcctgctgaggagactggagaggagaagcaggacactcaggagaaggaaggaatcttaccagagcgcgcagaggaagcgaagctgaaggctaaatacccctcactcgggcagaagccaggtggttcagacttcctcatgaaacgcttgcagaaaggacagaagtactttgactcaggagattacaacatggctaaagccaagatgaagaataaacagctcccgtcagccggtccagataaaaatctagtcaccggagaccatatccccacccctcaggaccttccccagcggaagtccagcctggtgacgtctaagctggccggttag

SEQ ID NO: 221945 - DNA, 414 bp, Artificial Sequence
  Description of Artificial Sequence: Synthetic coding sequence
atgtcccagaaacaagaagaggaaaatcctgcagaggagaccggggaagagaagcaggacacacaggagaaagaggggattcttccagagagagcggaggaggccaaactgaaggccaaatacccatccctggggcagaagccagggggaagcgacttcctcatgaagcgtctccagaagggggactacaaaagtttgcattggtcagttctgctgtgtgccgacgagatgcagaagtacttcgacagtggcgactataatatggccaaagctaagatgaagaataaacagcttccctctgcaggcccagacaagaatctcgtcaccggtgaccacattcctaccccacaggacctacctcagcgaaagagttctctggtgacgagcaagttggccggtgggcaggtggaatag

SEQ ID NO: 221946 - DNA, 423 bp, Artificial Sequence
  Description of Artificial Sequence: Synthetic coding sequence
atgtcacaaaagcaagaggaagagaaccctgccgaagaaactggggaagagaaacaggacactcaagagaaagaaggtattttaccagaacgggcagaggaggccaagttaaaagccaagtatccttctcttggccagaaaccaggaggaagtgactttctgatgaagcgccttcaaaagggcgtatggggaatcgtatcctaccccctatcgctagaacttaaggaagtcttgaggatgaagtctgtcgagcagaagtattttgattcaggggattacaacatggccaaagcaaaaatgaaaaacaagcaactgccctcggccggtcccgacaagaacctcgtgacaggtgaccacatacctactccccaagacttgccccagcggaagtcctcccttgtgactagcaaactggcaggctag

SEQ ID NO: 221947 - DNA, 354 bp, Artificial Sequence
  Description of Artificial Sequence: Synthetic coding sequence
atggcgggtggcctgggctgtgatgtctgttactggttcgtggaggacacccaggaaaaagagggtatactcccagaacgtgctgaggaggccaagttgaaggccaagtatcccagtcttgggcaaaaaccagggggatccgattttctgatgaaacggctgcagaaaggtcagaagtatttcgattccggcgactacaacatggctaaagcgaaaatgaagaacaagcagttaccgtctgccggacccgataagaatctggtgactggagaccatatccccaccccacaagatttaccccagagaaagagttcacttgtcacatctaaactggcgggtggtcaggtcgagtag

SEQ ID NO: 221948 - DNA, 402 bp, Artificial Sequence
  Description of Artificial Sequence: Synthetic coding sequence
atggctgggggactaggttgtgatgtgtgttattggttcgtagaggatacgcaggagaaagaaggcattctgcccgaacgcgctgaggaagcaaagctcaaggcgaagtatccctccctagggcagaagcctggcggtagtgattttctcatgaagcggctccagaaaggcgactacaagagccttcattggtctgtattgctatgcgctgatgagatgcagaagtacttcgactcgggggactacaacatggccaaagccaagatgaaaaacaaacaattaccgtccgctggcccagataaaaacctcgttactggagaccatatccccacacctcaggacctaccccaacgtaagtcttctctggtgacttctaagctggctgggggtcaggtggagtag

SEQ ID NO: 221949 - DNA, 318 bp, Artificial Sequence
  Description of Artificial Sequence: Synthetic coding sequence
atgtcccaaaagcaagaagaggagaatccggcagaggagacaggggaagagaaacaggatacacaggaaaaggaaggtattctgcccgagcgggctgaggaagcaaagctcaaggcgaaatacccctccctaggacagaagccgggtggctccgactttctaatgaaaagactgcaaaaaggcgtatggggaattgtgtcttaccccctgtctctagagctgaaagaggtgcttagaatgaaaagcgtcgaggtgttgctggacccattcctggaggtcctgctgcttaaccggagcaggggggagtttgagatctag

SEQ ID NO: 221950 - DNA, 435 bp, Artificial Sequence
  Description of Artificial Sequence: Synthetic coding sequence
atgtcccagaagcaggaggaagaaaatccagccgaagagacaggagaggaaaagcaggatacacaagaaaaggagggaattctgcctgagagagccgaggaagccaagctgaaggcaaaatacccatccctggggcaaaaacctggagggtccgatttcttgatgaagaggttgcagaagggtgtttggggaatcgtgtcataccctctctcattagagttgaaagaagtcctgaggatgaagtcagtcgagcaaaagtatttcgacagcggggactacaatatggctaaggctaagatgaaaaacaaacagttgcccagcgccggacctgacaaaaatctggttacaggcgatcacattccaacccctcaagatctgccccagcggaaatcttcgctggttacttctaagttagctggcggacaggttgagtag

SEQ ID NO: 221951 - DNA, 366 bp, Artificial Sequence
  Description of Artificial Sequence: Synthetic coding sequence
atgtctcagaaacaggaggaggagaaccctgctgaggaaaccggggaagagaagcaggacacacaagaaaaagaaggcattctgcccgagagagctgaggaggctaagcttaaggcgaaatatccctccctagggcagaaacccggaggctcagacttcctgatgaaacgccttcagaaggggcagaaatattttgacagcggcgactacaacatggcaaaggcaaagatgaagaataagcagctaccctccgccggacctgacaagaatcttgtgacaggagaccatattccaacgccacaggatttgcctcaacgaaagagctcactggtaacaagtaagttagccggtggacaagttgagtag

SEQ ID NO: 221952 - DNA, 402 bp, Artificial Sequence
  Description of Artificial Sequence: Synthetic coding sequence
atgtcccagaagcaggaggaggagaaccccgcagaagagacaggggaggagaagcaggatactcaggagaaggagggcattctcccggagcgcgctgaagaggccaagctgaaagccaaataccctagtctgggtcagaaaccagggggaagcgatttcctgatgaagcgtttacaaaagggggattacaaatcccttcattggtccgtactactgtgtgctgacgagatgcagaaatactttgactctggggattataacatggcgaaggccaagatgaagaacaaacagctgccttccgccggacccgacaaaaatcttgtgactggcgaccatatacccaccccacaggacctgcctcagagaaagtcatctttggtcacctctaaattagctggctag

SEQ ID NO: 221953 - DNA, 318 bp, Artificial Sequence
  Description of Artificial Sequence: Synthetic coding sequence
atgtctcagaagcaggaggaagaaaaccctgcagaagagaccggagaggaaaagcaggacacccaggagaaagaagggatacttcccgaacgagccgaagaggcaaaactgaaggcgaagtatccatccctggggcagaagccaggaggcagtgacttcctgatgaagaggctacaaaagggcgtttggggtatagtgtcatatcctctgtctctggagttaaaggaggttctccgtatgaagtctgtggaggtcctcctcgacccatttttggaagtgctgttacttaaccgcagtcggggtgagtttgaaatttag

SEQ ID NO: 221954 - DNA, 342 bp, Artificial Sequence
  Description of Artificial Sequence: Synthetic coding sequence
atggcaggcggactcggatgtgacgtctgttactggtttgtggaggatacccaagagaaggaaggtatcctgcccgaaagagccgaggaggccaaactcaaggccaagtaccccagcctaggccagaaacctggtggctctgactttctgatgaaaagactgcaaaaaggccagaagtacttcgactccggcgactataacatggcgaaggctaaaatgaagaataaacagctgccctccgccggaccagacaaaaatctggtgaccggggaccatatccctactccacaggaccttccacagcggaaaagttctcttgttaccagcaagctggcgggttag

SEQ ID NO: 221955 - DNA, 1173 bp, Artificial Sequence
  Description of Artificial Sequence: Synthetic coding sequence
atgatctccctgcccggaccactcgtgactaaccttctccggttcctcttcttaggactgtccgcgctcgctccaccttcacgggctcagctccagttacatctccccgcaaatcgcctgcaagccgtggaaggcggtgaggtcgtgttgcccgcttggtacactctgcacggagaagtgagttcctcacaaccatgggaagtcccttttgtaatgtggtttttcaagcagaaagaaaaggaagatcaggtgctgagctatataaacggtgtgaccacgtcaaagccaggagtgagtctcgtttattccatgccatcccgcaatctttccctgcgcttagaggggctgcaggagaaggactctggaccctattcatgcagtgttaacgttcaggataagcaaggaaagtctcgcggacactctattaaaacccttgagttgaatgttctagtgcctcctgctccaccaagttgcagactccaaggcgtgccccacgtgggcgctaacgtaactctcagctgtcaatccccccgttcaaagccggcagtccagtatcagtgggacaggcagctcccttcctttcaaacctttttcgcaccagcactcgacgtgataagaggttccctgtctttgacgaatctgagttcctcaatggcaggcgtgtatgtttgtaaggcccataacgaggtcggaactgcgcagtgcaatgttacgcttgaggtctcaaccggacccggtgcagctgtggtggctggagcggtagttggaactctggtcgggttgggcctgcttgccggactggtgctcctttaccaccgtcgcggtaaggccttagaggaacctgcaaatgacataaaggaagatgccatcgccccacggactctgccttggccaaagtccagcgacaccattagcaaaaatgggacactgagtagcgtgacttctgctagagctctcagacccccacatggacccccacggcctggtgctttgacgccaaccccgtcactgtcatcacaggccctccctagccccaggcttcccactacagatggcgcacatccccaacccatctctcccatccccggtggggtctctagctcaggcctgagccgaatgggcgcagtgccagtgatggtgccagcccagtcacaggccggttccctagtttag

SEQ ID NO: 221956 - DNA, 426 bp, Artificial Sequence
  Description of Artificial Sequence: Synthetic coding sequence
atgatcagcttgcctggccctctggtgaccaatctcctgcggttcctcttcctgggattatcagccctggacgtgataagaggatcactcagtctgacaaatctctcttcaagcatggcaggagtatacgtatgcaaagcacacaatgaggtcggtacggcccagtgcaatgttaccctggaagtgtctacgggccctggcgctgcagtggtggcaggggcagttgtggggacactggttggcctggggctcctcgccggtctcgtgctgctctaccatcgacgcggaaaggcgctggaggaacccgcaaatgacatcaaggtaaggtcccctctgggactgtcattcagcgccccaaaaatggagtggttgtggaaatggagggatgcccacttctatcgggatagctacctatccaaatggtag

SEQ ID NO: 221957 - DNA, 2613 bp, Artificial Sequence
  Description of Artificial Sequence: Synthetic coding sequence
atgactgccgataaagagaagaagcgatctagttcagagagaagaaaagagaagtccagagacgctgcacgttgccgcaggtcaaaggagacggaagtgttttatgaactggcccacgagttaccgctgcctcactccgtgagtagccacctggacaaggcgagcatcatgaggttggccattagcttcctgaggacacacaaactgttgtcaagcgtctgttcagagaacgagtcagaggccgaggctgatcagcagatggacaatctgtacctgaaggctcttgagggtttcatcgcggtagtcactcaggatggggacatgatcttcctttctgaaaatattagtaagtttatgggcctgacccaggtggaactcactggccatagtatattcgatttcacgcatccttgcgaccatgaggagattcgcgagaacctgtcattaaagaacggatcaggctttggaaagaaaagcaaagatatgagcactgagagagactttttcatgcgcatgaagtgtacagtgactaataggggcaggacagtgaatctcaaatccgctacctggaaagtgctccattgcacaggacaggttaaggtgtacaacaactgcccgccacataactccctgtgtggctataaggaacctctgcttagctgcctcatcattatgtgcgaacctattcagcatccctcgcacatggacattcctcttgatagcaagactttcctgtctagacactcaatggatatgaaatttacttactgcgatgacagaatcaccgagctcatcgggtatcaccccgaggaattactcggccgaagtgcttacgaattctaccacgctctagactctgaaaatatgacaaagagccatcaaaacctgtgcacaaaggggcaagtggtcagcggccaatacagaatgttggctaagcacggcggatatgtgtggctggaaactcaaggcactgtcatctataatcccaggaacctgcagccacagtgcatcatgtgcgtgaattatgttctgtccgaaattgaaaagaatgacgtggtgttcagcatggaccagacagagagtctgtttaaacctcacctcatggctatgaattccattttcgattcatctgggaagggcgcagtgtctgaaaaatcaaacttcctcttcactaagcttaaagaagagcctgaggagctggcccagcttgcgcctactcctggcgatgctatcatctccctagattttgggaatcagaactttgaggaatcaagtgcatatggcaaagctatcctgccaccttctcagccatgggccaccgaacttagatctcattcgactcaatccgaagctggcagtctgccagccttcaccgtgcctcaagccgcagcccctgggagcaccacaccgtctgcaacaagcagctcttcctcgtgcagcacaccgaactcaccggaggattattatactagccttgataacgatctgaaaatcgaggtgattgagaaattgtttgcgatggatacagaggccaaggatcaatgctctacacagactgatttcaatgaactggacctggagacactagcaccgtacattcccatggatggagaggacttccaactgagtcctatctgtcccgaggagaggcttctggccgagaacccacagagtactcctcagcactgcttttccgccatgaccaatatttttcagcctctggcccctgtggcccctcactctccgttcctactggacaagtttcaacagcaactcgagtcaaaaaagaccgaaccagaacacaggcccatgtcttccattttttttgatgccggatctaaagcaagccttcctccctgctgcggacaggctagcactcctctgagctcaatggggggtcggtccaatacccagtggccaccggacccgccattgcactttggccctaccaagtgggctgtaggtgaccaacgaaccgagttcctgggagcagccccactggggcctccagtgtccccaccacacgtctcaacgtttaagacgcgaagtgctaagggatttggtgccagaggcccagatgtgctgtcccctgccatggtcgcactgagcaataagctgaagttaaagcgccagctggagtacgaagagcaggcgttccaggatctgtctggaggagatcccccaggcggttcaacgagtcacttaatgtggaaacgcatgaaaaacttacgaggcggaagttgtccccttatgccggacaaacctttatccgccaatgtccccaacgataagtttacgcagaaccctatgaggggactagggcatcctctccgccatctcccactgccccaaccaccttctgcaattagcccgggtgagaacagcaaatctcgtttcccaccccaatgctacgctacacagtatcaagattactctttatcctccgcacacaaggtgagcggaatggcttcccgtctactagggccttcatttgagagctatctgctgccggagctgacaagatacgactgtgaggtgaacgtgcccgttctaggtagctccacgctattgcagggaggtgacttgctccgggctttggaccaagctacttag

SEQ ID NO: 221958 - DNA, 780 bp, Artificial Sequence
  Description of Artificial Sequence: Synthetic coding sequence
atgactgcagacaaggaaaaaaaaagaagcagcagcgaacggagaaaagagaaaagcagggatgccgcacgctgtcgaaggagtaaggagacagaggtcttctatgagctggctcatgaactgcctctcccacatagcgtgtcctctcacctggacaaagcgagcattatgcgtttggcgatctcgtttctgcgaacccacaaattgttgagtagcgtgtgcagcgagaacgaatcagaagccgaagctgaccaacagatggataacctatacctcaaagcactggaggggttcattgcagtggtcacgcaagatggagacatgatttttttgtcagagaatataagtaagtttatggggctgacccaggtagaacttacgggccacagtatatttgattttacccacccctgtgatcacgaggagattcgcgaaaatctttctttgaagaatgggtccggctttggaaaaaaaagcaaagatatgagtacagagcgggacttcttcatgcgaatgaaatgcaccgtgacaaatcgaggacgcaccgtaaatctcaagtccgctacatggaaagtactacactgtacgggacaggttaaggtgtacaataattgtccacctcataacagtctttgcggttataaggagccattgctctcttgccttatcattatgtgtgagcccatccagcatccttcacatatggacataccacttgacagtaagactttcctcagcaggcacagtatggatatgaaatttacctattgtgacgactag

SEQ ID NO: 221959 - DNA, 537 bp, Artificial Sequence
  Description of Artificial Sequence: Synthetic coding sequence
atggtcagcgtccccactacctggtgttcagtggctctggcgctcctggttgcacttcacgaggggaaaggacaggcagccgcaacactggaacagccagcttcttcctcccacgcacagggcacacacttacgtttgcgccgatgttcctgcagttcctggttggataaagaatgcgtgtacttctgtcatctcgatataatttgggtgaacacacccgaacagacggcaccctacgggctggggaaccccccacgacgacgcaggcgctctctgccccgtagatgccagtgttccagcgcgagggacccagcctgcgcgactttctgcctcagaagaccctggactgaagctggggcagtacctagcaggaaatctccagctgatgtgtttcagacggggaaaacaggggctaccactggcgaactcctgcagcggctgcgggacattagcaccgtgaagtccctgttcgctaagcgacaacaagaggccatgagagaacccaggtctacccacagccggtggcggaaacgctag

SEQ ID NO: 221960 - DNA, 660 bp, Artificial Sequence
  Description of Artificial Sequence: Synthetic coding sequence
atggagcctgggttgtggctgctcttcggtctgacagtcacctcggcagctggttttgttccatgctcccaaagcggcgatgcgggaaggagaggtgtctcccaggcccctaccgccgcaaggagtgagggagattgtgaggagacggtggcgggtccgggagaggaaactgtggcgggacctggggagggcacggtggccccaacagcacttcaaggcccaagtcccggttctccaggccaggaacaggccgctgaaggggctcccgaacaccaccggagcaggagatgcacgtgcttcacctataaggacaaagagtgcgtctattactgtcacctggacataatttggataaatacccccgaacagactgtgccttatggtctctctaattatagaggctcctttcgcggtaaaaggagcgctggacctctgcccggtaacctgcaattatctcaccgcccacatctgaggtgcgcctgcgtggggaggtacgacaaggcatgccttcacttctgtacgcaaacactcgatgtatcttctaatagtaggactgctgaaaaaacagataaggaggaagaaggcaaggtccgcggagccaatcgtggactgtgtcaacgccgtctgaagagcaggaccaataaagcatcccgcctgtag

SEQ ID NO: 221961 - DNA, 717 bp, Artificial Sequence
  Description of Artificial Sequence: Synthetic coding sequence
atggagcccggactttggctgcttttcggcctgaccgttacatctgccgcaggatttgtgccatgctcccagtccggcgatgctgggaggcgcggagtctctcaagccccaactgccgcacggtctgaaggggattgcgaggagacggtggccggaccaggagaggagaccgtggcaggacctggagaagggacagtggctcctacggccttacagggacctagcccgggaagcccgggtcaggagcaggccgctgagggagccccagagcaccaccgcagccggcgttgtacatgcttcacttacaaggataaggagtgcgtgtattactgccatctggatattatttggatcaatacccctgagcaaaccgtaccttacggtctgtctaattacaggggcagcttccgtgggaaacgctcggccggacccctgcccggaaatttacaattgtctcaccgaccacatctaaggtgcgcatgcgtgggtaggtacgataaagcttgcttgcacttttgcacgcagaccctagatgtgtcctcaaactcccgtacagccgaaaagacagataaagaagaggagggaaaagtagaggtcaaggaccagcagtccaagcaggccctcgacctccatcatccaaagttgatgcctggtagtggactggccctggcgccaagtacctgtcctcgctgcctgtttcaggaaggagccccatag

SEQ ID NO: 221962 - DNA, 579 bp, Artificial Sequence
  Description of Artificial Sequence: Synthetic coding sequence
atggaacccggactgtggctgctgtttggactcacagtaacgagcgccgctggctttgtgccttgcagtcagagtggggacgcaggcaggcgaggcgtaagtcaggcccctacagccgctcggtccgaaggtgactgcgaggaaacagtggcagggcctggtgaagagacagtggcaggcccaggagagggaacggtggctccaacggctctgcagggcccttcacccggaagtcctgggcaggagcaggccgctgagggcgcacccgagcatcatagaagtaggagatgtacttgtttcacatacaaagataaggagtgcgtgtactattgtcatctcgacatcatttggatcaacactccagagcagaccgtaccgtacggcttatctaactaccgaggaagtttccgtgggaagcgtagtgccggtccgctgcctgggaatctccaacttagtcatcggccacacctaagatgtgcttgcgtcgggagatacgacaaggcctgcctgcacttctgcacccagaccttggacgtgtcacggctaaagagcagaactaacaaggcatctcggctgtag

SEQ ID NO: 221963 - DNA, 717 bp, Artificial Sequence
  Description of Artificial Sequence: Synthetic coding sequence
atggaacctggcctgtggttgttatttggactcactgtgacctccgcagcgggattcgtgccctgcagtcagagcggggacgctggacgccgtggagtgagccaggcccctaccgccgctagatctgagggcgattgtgaggagaccgtggcgggtcctggtgaagagactgtcgccggtccaggcgagggtacagtggcccctacagccttgcagggaccatcacccggatcccccggtcaagaacaggcagcggagggggctccagaacaccatagaagcaggaggtgcacctgcttcacctacaaggacaaggagtgcgtctattactgccacctcgacattatatggataaataccccggagcagactgtaccttatggcctgtcgaactaccgaggatcctttagagggaaacggtcagccggacctctgcctggaaatcttcagctgtcacaccgaccacacttacgttgcgcctgcgtaggccgatatgacaaggcttgtctgcatttttgcacccaaactttggatgtctcctccaactcccggaccgccgaaaaaacggataaagaggaggagggaaaagtggaagtaaaggatcagcagagtaagcaggcattggacctgcatcaccccaagcttatgccaggttcaggtctggccttagcgccttccacttgtccccgttgtctgttccaggaaggggctccctag

SEQ ID NO: 221964 - DNA, 675 bp, Artificial Sequence
  Description of Artificial Sequence: Synthetic coding sequence
atggagcccggtctgtggctcctgtttggactgactgttacgagtgcagctgggtttgttccgtgcagccaatcaggggacgccggtaggagaggcgtgtctcaggcacccactgccgctcgctccgagggggactgcgaagaaacggtagcaggtcctggagaagagaccgtggccggaccgggtgaaggaaccgtggcgccaactgccttgcaggggcctagccctggcagccctgggcaggaacaggcagcagaaggggcaccggagcaccataggtccagaagatgcacctgtttcacctataaggataaggagtgtgtgtactactgccatctggacattatctggatcaataccccagagcaaacagtcccttatgggttgtcgaattataggggaagtttccgaggtaagcgctccgccggaccattacccggtaacctgcaactgtcacaccggcctcacctcaggtgtgcgtgtgtggggagatacgacaaagcctgtctccacttctgcacgcagacactcgacgtttctcgtcaagtggaagtgaaagaccaacagtctaaacaggccctcgatctgcaccatcctaagctgatgccaggtagtggactggccctcgctcccagcacctgcccacgctgtctcttccaggagggagcaccctag

SEQ ID NO: 221965 - DNA, 2304 bp, Artificial Sequence
  Description of Artificial Sequence: Synthetic coding sequence
atggaggcgctcagagaaagcgtgctgcaccttgctcttcagatgtctacatataagcgcgcaacccttgacgaggaggatcttgtggacagtctgagcgagggagatgcatacccaaacggtctccaagtgaacttccatagtcccagatcgggtcagagatgctgggccgcaaggacacaggtagagaagagactcgtggtcctggtggtcctgctggcagccggtctggtcgcgtgtttggcagccctggggattcaataccaaaccagaagcccttcagtgtgcctatccgaagcctgtgtatctgtcacctcatctatcctgagttctatggaccctacagtggatccatgtcatgacttctttagttacgcctgcgggggatggatcaaggccaacccggttcccgatggacattcccgttggggaacttttagcaatctgtgggaacataatcaggctattattaagcatctcctggaaaatagcaccgcttccgtctccgaggctgagcgcaaagctcaggtgtattacagggcctgcatgaacgagacaagaatcgaggagttgagagctaaaccactcatggaactaatagagagactcggcggttggaacatcacagggccatgggccaaagacaatttccaggacacccttcaggtggtaactgctcactaccgcacaagcccattcttctcagtttatgtcagcgcggatagcaagaactccaatagcaacgtcattcaggtggaccagagcggtttggggcttccctctcgcgattattacctgaacaaaaccgagaatgagaaggtgctgaccggatacctgaattatatggtgcagctgggaaaactgctgggcggaggagacgaggaggcaatacggccacaaatgcaacagatactcgatttcgaaaccgcgctggcaaatatcactataccacaggagaaaagacgcgatgaggagcttatctatcacaaagttactgccgcagaactgcagacactagctccggcaattaactggctcccattcctaaacaccatattttatcccgtcgagataaacgaatcagaacccatcgtggtttacgataaggaatatctggagcagatttccacactgatcaataccactgaccgctgcctcctcaataattacatgatatggaacctcgtgaggaaaacctcatctttcctggatcaaagattccaggacgccgatgagaaatttatggaagtgatgtatggaacgaaaaaaacctgtcttccaagatggaagttctgcgtgtcggataccgaaaataacttggggtttgctctgggcccaatgttcgtgaaggccacattcgcggaggactctaagtcaatcgctacagaaatcatccttgaaattaaaaaagcttttgaggagagcctgagtacgttgaaatggatggatgaagagaccagaaaaagcgcgaaagagaaagccgatgccatttacaatatgattggctatccaaactttatcatggatcccaaggagctggacaaagtctttaacgactacacagctgttcctgacctgtacttcgagaatgctatgagatttttcaactttagttggagggtcaccgccgatcagctgaggaaggcccctaatagggatcaatggtccatgacccctcctatggtcaatgcttactactccccaactaaaaatgagatcgtattccctgcgggaattctgcaggcgcctttctacaccaggtcatctcctaaggctctgaacttcggcggaattggagttgtggtcggacatgaactgacacacgcctttgacgaccaggggcgagaatacgataaagacggaaatctgaggccctggtggaaaaacagctccgttgaagcctttaaaagacagaccgagtgtatggttgagcaatatagtaattacagcgtgaacggagaacccgtgaacggacgccacacactgggagaaaatattgcagataatgggggtctgaaagctgcttaccgcgcttaccagaattgggtgaaaaagaacggcgctgaacatagcctgcctactctgggccttaccaataatcagctcttttttctgggctttgcgcaggtgtggtgttcagtaagaacgccagagagcagccatgaagggctaatcactgatccccactcaccatcccggttccgggtgataggatccctctcaaacagtaaggagttctcggagcattttcggtgtcctccgggaagtcctatgaacccgccacataagtgtgaagtgtggtag

SEQ ID NO: 221966 - DNA, 2277 bp, Artificial Sequence
  Description of Artificial Sequence: Synthetic coding sequence
atgccccttcagggtctggggctgcagcgcaacccatttcttcaggggaaacggggtcccggactgacctcttcgcctccccttctccctccatcattgcaggttaattttcacagcccccgttctggccagcggtgctgggccgctcgcacacaggtcgagaagagactggtggttttagtggtactgctggccgctggcctagtggcctgcctggctgcactgggaattcagtatcagactaggtcacccagcgtatgtttgagtgaagcctgtgtgtccgtaacttcctcaatcttaagctccatggatcctacagtcgatccctgccacgacttcttcagctatgcctgtggcggatggatcaaagcaaacccggtgccagatggacattcccggtggggcactttctccaatctgtgggagcataatcaggcaattatcaagcacctgctggagaacagcacagcgtctgtctccgaagctgaacgaaaggcacaggtgtattatcgcgcttgcatgaacgagacaaggattgaagaactgcgggcaaagcccctgatggaactgattgagcgcctcggtggctggaacattacaggaccctgggccaaagacaattttcaagacacattgcaagtggtcacagcccactaccgcacgtcaccctttttttccgtctacgtgtctgcggattcgaaaaactccaattctaacgttattcaagtggaccaatcaggcctggggctgcccagcagagattattacctgaataagactgaaaacgaaaaagtcctgacagggtaccttaactacatggttcagttaggcaaactgctgggaggcggagatgaggaggccatccgcccacagatgcaacagattcttgatttcgagactgcccttgccaatattaccatcccccaggaaaaacggagggatgaagaactgatataccacaaggtgaccgctgccgaattacagacacttgcccctgccatcaactggctgccattccttaatactatcttctatccggttgagattaacgagtctgagcctatagtggtgtacgacaaagaatatctggaacaaatatcgacactgatcaatacgactgataggtgcctgctgaataattacatgatctggaatcttgttagaaagacatcttcctttctcgatcaaagattccaggatgccgacgagaagtttatggaggttatgtacgggactaaaaagacgtgcctgcccaggtggaagttttgcgttagcgacaccgaaaataatctcgggtttgcacttggccctatgtttgtgaaagccacatttgccgaggactcaaagagcatcgccacagagattatcttagagataaagaaggcttttgaggagagcctgtctactttgaaatggatggacgaggagacacgaaagagcgcaaaagaaaaggccgatgcaatttataatatgatcggatatcctaattttataatggatcccaaagaactggacaaggtgtttaacgactacacagcggtgccggacctttactttgaaaatgctatgcggttttttaacttcagctggagagtgactgccgaccagctgcgcaaggcacctaatagagatcagtggtcaatgacacctccgatggttaacgcgtattacagtccgactaaaaatgagatcgtgttccccgcaggaatcctccaggcgcctttctataccagatcctctcctaaagcgttgaacttcggaggaataggggttgttgtggggcacgagctcacccacgctttcgacgatcaaggtcgagaatacgacaaagacggtaacctccgcccatggtggaaaaactcctctgttgaagccttcaagaggcaaacagagtgcatggtcgaacagtactccaactattctgtaaacggggaacccgtcaacgggaggcatacactcggggaaaatatcgccgacaatggcggactgaaagccgcatatagagcctaccagaactgggtaaagaagaatggggctgagcactccctgcctacccttggcttaactaacaaccaattgttttttctgggctttgcacaggtgtggtgttccgtaagaaccccggagagctcccatgaagggctcatcactgatcctcactcaccaagtcgttttcgcgttattgggagcttaagcaactccaaggaattttcagagcacttccggtgccctccaggctctccgatgaatccccctcataaatgtgaggtctggtag

SEQ ID NO: 221967 - DNA, 2313 bp, Artificial Sequence
  Description of Artificial Sequence: Synthetic coding sequence
atgagaggggtgtggcctcccccagtttcagccctcctttctgcattgggtatgtcgacgtataaacgggcaaccctggacgaggaggacctcgttgactcgctgtccgagggcgacgcttacccaaatggactgcaggttaactttcatagccccagatctggccaacgctgttgggccgcaaggacgcaagtcgagaagaggctcgtggtgttagtagtgctattggccgctgggttggtggcgtgcctggccgctctggggatccagtaccagactagaagcccttctgtgtgtttgagcgaagcctgcgtctccgtgacgtcctcaattctgtctagcatggacccaacagtcgatccctgtcatgacttcttcagttatgcgtgcgggggttggatcaaggcaaatcccgttccagatggccatagccgctggggtaccttctcaaatttgtgggagcacaatcaggcaatcattaaacatctccttgagaactccaccgcaagtgttagcgaagcagagaggaaggcacaggtatactacagggcatgcatgaatgagaccagaatcgaggagctccgggctaaaccactaatggagctcatagagcggttaggcggttggaacatcactggcccatgggctaaggacaacttccaggacaccctgcaggtcgtgaccgctcactatagaacttcaccatttttctccgtttacgtgtctgccgactccaaaaacagtaacagtaatgtgatccaggttgaccagtccggactggggcttcccagcagagactactacttgaacaagaccgagaacgagaaggtgctcacgggctacctgaactacatggttcagcttggaaagctactgggcggtggggacgaggaagcaattcgtcctcagatgcaacagatcctcgatttcgagacagctttggctaatattactattccccaggagaaacggcgtgatgaagagttaatttaccataaggtcactgccgctgaattgcaaaccttagcacccgcaatcaattggcttccattcctcaacaccatcttctatcctgttgaaattaacgaatcagaacctattgtggtatacgacaaggaatacctcgagcagatttccacactgattaacactaccgatcggtgcctgctcaacaactacatgatctggaacctggtaaggaagacaagttcatttttggaccagcgcttccaggatgccgacgaaaagtttatggaggtgatgtatggcactaaaaagacttgcctgcccagatggaagttctgcgtctccgacactgagaataacctgggctttgccctcggccctatgtttgtcaaagcgacatttgccgaggatagcaagtcaatcgccacagaaattatcctggagatcaagaaagcatttgaagagagcctgtctactcttaagtggatggacgaagagacccggaagtctgctaaggaaaaggccgacgcgatttacaacatgattggctatccaaattttatcatggacccaaaggagcttgataaagtgtttaatgattacactgctgtccccgacctgtactttgagaacgcgatgcgattctttaacttctcgtggcgcgttactgccgaccagttacgtaaggctccaaacagagaccagtggagtatgacacctcctatggtgaacgcgtattattctccaactaagaatgaaatcgttttcccagctggcatcctgcaagcacccttttacactaggtccagccctaaggcacttaattttggaggcatcggagtcgttgtcggccacgagttaactcacgccttcgatgaccaaggtcgggagtacgataaggacgggaatttgcgcccatggtggaagaattcgtcagtggaggcatttaaaaggcagacagagtgcatggttgagcagtatagtaactattccgtaaacggcgaaccagttaacggaaggcacacccttggcgaaaacatcgcagacaatggtggcctcaaggcagcctaccgcgcatatcagaactgggtgaaaaagaacggagccgaacactctctccccaccctgggactgaccaataaccagctgttcttcttagggttcgctcaggtttggtgtagcgtgcgtacccctgagagctcacatgagggactgattactgaccctcactcaccaagtcgttttagagtcataggatccctgtctaatagcaaggagttcagcgagcacttccgttgcccccctgggtctccgatgaacccaccccataagtgtgaggtgtggtag

SEQ ID NO: 221968 - DNA, 2265 bp, Artificial Sequence
  Description of Artificial Sequence: Synthetic coding sequence
atgatgtccacgtacaagagggctaccctggacgaggaggatctggtagatagcctgagcgaaggagacgcctatccaaacggcctccaggtgaacttccactctccaaggtctggccaaaggtgttgggctgctcgcacccaggtcgaaaaacgcttggttgtcctggttgtgctccttgcagcaggcttagtcgcctgcttagcggctctcggaatccaatatcagactcgaagcccaagtgtgtgcctgtcggaggcatgcgtgagtgtaacctccagtattcttagtagcatggatccgacagtggatccctgccatgatttttttagctatgcttgcgggggttggataaaagccaacccagtgcccgatgggcactcacgctggggtacattctctaacctctgggagcacaaccaagctattatcaagcatttgctagaaaactctaccgctagcgtcagcgaggcggagcgcaaggctcaagtttactacagagcatgcatgaacgagactcgcatcgaagaattgcgggctaaacctctgatggaactgatagagcgtctgggcggatggaacatcaccggtccatgggcaaaagataatttccaagatacccttcaggtggttaccgcacactaccgcacaagcccatttttttcagtgtacgtgtcagctgatagcaaaaattccaactccaatgtcatccaggtggaccagtctggcctcgggctgccatccagggattactatcttaacaaaacagagaacgagaaggtcctgaccgggtacttaaactacatggtgcagcttgggaaactccttggtggcggtgacgaggaggctataagaccccagatgcaacaaattctggacttcgaaacagcacttgccaacattaccatacctcaggagaagaggagagacgaggaacttatctaccacaaggtgacagccgcagagctgcagactctggcaccagccataaactggctgccttttttgaataccatattttacccagtcgaaattaatgaatcagaacccatcgtggtttacgacaaagaatacctggaacagattagcacgttgatcaatacgactgacaggtgtctcttaaacaattatatgatctggaacctggtccgcaaaacatcctcatttttggaccagaggtttcaggatgccgacgagaagttcatggaagttatgtacggaacaaaaaaaacctgcctgccacggtggaaattttgtgtgagcgacaccgagaacaacctaggtttcgcactaggacctatgttcgttaaagcaaccttcgccgaggattctaagagtattgccacagaaataatattggaaatcaaaaaggctttcgaggagtccctatccactctcaaatggatggatgaggagacccgcaaatctgccaaagagaaggctgacgctatttacaacatgatcggctaccctaatttcatcatggatccaaaggagctggataaggtttttaacgattatactgccgttcctgacctgtattttgaaaacgcaatgcgctttttcaacttctcatggcgggtcaccgccgatcaacttagaaaagcgccaaaccgtgaccagtggtccatgactccgccaatggtcaacgcttactactcccccacaaaaaatgaaatcgtgttcccagccggaatattgcaggcccctttctacacgaggtcatctcccaaggccctcaatttcggcggtattggggtggtggttgggcacgaactgactcacgcattcgacgaccaggggagagagtatgacaaagatggcaatttacggccatggtggaagaatagtagtgttgaagctttcaagcggcaaactgaatgcatggtcgagcagtacagtaactacagtgtcaatggagagccggtcaatgggagacataccctgggcgagaacatcgcagataatggaggtcttaaagcggcttatcgtgcctaccagaactgggtgaagaagaatggagccgagcacagcctgcccacactcgggctgacaaataatcaactgttcttcttaggctttgcacaagtgtggtgctctgttcgcaccccagagtcatcgcatgaggggctgatcacagacccacactctccatctagatttagagtgattggctccctatccaatagtaaggaattcagcgagcactttcgttgcccccctggctcccctatgaatccaccacacaaatgcgaggtgtggtag

SEQ ID NO: 221969 - DNA, 2217 bp, Artificial Sequence
  Description of Artificial Sequence: Synthetic coding sequence
atgcgtggagtgtggcctcccccagtcagcgctcttctgtctgccttgggtatgtccacgtacaaaagagcaacactcgacgaggaggatttagtggatagcctctctgagggagacgcctaccccaacggtctacaagtaaacttccattcccctagatccggacagcgatgctgggcagcaagaactcaagtcgaaaaacggttagttgtcctagtggtgttgctagccgcaggcttagtggcctgtctggccgcactggggattcagtaccaaactcgcagtccaagtgtttgtctgtccgaagcttgcgtgagtgtgacgtcaagcattttatctagtatggatccaacagtagatccatgccacgatttcttttcctatgcttgcggcggatggataaaagcaaacccggtgcccgacgggcacagccggtggggcacattctccaatctctgggagcacaaccaagctattatcaagcacctgcttgaaaactcaaccgcctcagtttccgaggctgagcggaaggcacaagtgtactaccgcgcatgtatgaatgaaaccagaattgaagaattgagggcaaagcctttgatggaattgatcgagcggctgggaggttggaatatcactggaccgtgggccaaagataacttccaggatacgctgcaagtggtgaccgctcactaccgaacgagcccgttttttagtgtctacgtgtctgcagattcaaagaatagcaacagcaacgttatacaggtggaccagtcgggactcggtctgccaagcagagactattacctcaataaaacggagaacgagaaggtgttgaccggctatctgaactatatggtgcagctgggaaaattactgggcggtggcgatgaggaagcaattcgcccacagatgcagcagatcttggactttgaaacagcactcgccaacatcacaattccccaggagaaacgaagggatgaggagctgatttatcataaggtcactgccgcagaattgcaaacacttgctccagccattaactggctgcctttcctgaacactattttctatcccgttgagatcaatgagagcgagccgatcgtggtgtacgacaaggaatacctggagcaaatttccacattgatcaacaccactgaccgatgcctcctgaacaattatatgatttggaatctggtgagaaagacgagcagctttcttgaccagagattccaagatgcagacgagaagtttatggaggtaatgtatggaaccaagaaaacctgtctgccaagatggaagttttgcgtcagtgacactgagaacaacctgggctttgccctcggtccaatgtttgtcaaagctacctttgccgaggactccaagtctattgccaccgagattattctcgaaattaagaaggctttcgaagaaagcctttctacgctgaaatggatggatgaggagacccggaaatccgccaaagagaaggcggatgcaatctacaatatgatcgggtatcccaatttcattatggaccctaaggagttggataaggtattcaatgactataccgccgttccggacctgtattttgagaatgccatgcggttcttcaatttcagttggcgcgtaactgccgatcagctacggaaagctcctaatcgggatcaatggagcatgacccctccaatggtgaatgcatactacagtcccacaaaaaacgagattgtcttcccagcagggattctgcaagctccattttatacgaggagttcgccaaaggcactgaattttggcggaataggggtcgtggtgggacacgagcttacgcacgcctttgacgaccagggcagggaatatgataaagatggaaacttgcgcccatggtggaagaattcctcagttgaggcctttaagcgtcagactgagtgcatggtagaacagtactccaattattcagtcaatggcgagccagtgaacggacgccacacgctgggcgaaaacattgctgacaatggcggtctgaaggccgcatatcgagtctggtgtagcgtccgcacccctgagagtagtcacgaagggctgatcacagaccctcatagtccctcccgatttcgtgttatcggttcactgtcaaattctaaggaattttcagagcactttagatgcccaccaggatcaccaatgaaccccccacacaaatgtgaagtgtggtag

SEQ ID NO: 221970 - DNA, 2328 bp, Artificial Sequence
  Description of Artificial Sequence: Synthetic coding sequence
atggagcccccatattccctgactgcccattatgatgagttccaggaagtgaagtacgtttccagatgtggcgcaggcggtgctagaggtgcctcgctgcctcccggatttcccctcggagcggcacgctccgctaccggtgccagaagtggactccccagatggaacagacgggaggtgtgtttattgtccggactggtgttcgccgcaggtctttgcgcgatactggccgctatgcttgcactgaagtatcttggaccagtggctgccggaggcggtgcgtgtcccgaaggatgcccagagaggaaagccttcgcccgtgccgctaggttcctggctgctaatctcgacgctagcatcgatccatgtcaggacttttacagcttcgcatgcggcggatggctccgccgacacgccatcccagacgacaagttgacatacgggactatcgcagccattggcgagcagaatgaggaacgcctccgcaggcttcttgcgagacccggaggcggaccaggcggagcagcgcagaggaaggtgagggctttctttcgttcatgtctagatatgagggaaattgagcgactgggaccacgacctatgctcgaagtgatcgaagactgtggtggatgggatttagggggtgccgaagagcgacctggcgtggctgccaggtgggacctgaaccggctgctctataaagctcagggtgtgtattccgccgcagcactgttcagcctgacggtgtccttggacgatagaaactcaagccgttacgttattcgtattgatcaagatggcctgactctccccgagcggactctgtacttggcacaagatgaggactctgaaaaaattcttgcggcttatagggtgtttatggagcgagtgttgagccttctgggcgcagacgcagtggagcagaaggcccaagagatactgcaggttgagcaacagcttgctaacatcaccgtgagtgagcatgatgatctgcggcgtgacgtgtccagcatgtataataaggtcaccctgggccagctgcagaagatcacaccccacctccggtggaagtggctcctcgatcagatatttcaggaggacttctccgaggaagaggaggtggtcttgcttgcgacagactatatgcagcaggtgtctcagctgattcgcagtacacctcacagggttttgcacaactatctcgtgtggcgcgtggtggttgtcctgagcgagcacctgtctcctcctttcagggaggcattgcatgagctggcacaggagatggagggctcagataagccccaggagctggcacgggtatgtctgggccaggccaaccgccacttcggtatggccctgggtgcactcttcgtgcacgaacacttttctgctgcttccaaagcgaaagtccagcagctggtggaggatattaaatacatattgggtcagcggctggaggagttagattggatggacgctgaaaccagagcagccgctcgagctaagttgcagtatatgatggtgatggttggatatcccgatttcctgttgaaacccgatgcggtggataaggagtacgaattcgaagttcatgagaaaacatactttaagaatattttaaacagtatccggttttcaatccagctgtctgtgaaaaagattcgccaggaggtggacaagagcacatggctgttacccccacaagcacttaacgcctactatttgccgaacaaaaatcaaatggtgttccctgccggaatcctgcagccaaccttgtatgatcctgacttcccccaaagcctgaattacggcggaatcggcaccattattggccatgaactgacacacggctatgatgattggggagggcaatatgacaggagcggaaatttattacactggtggaccgaagcgagttattcacggttcttgcgcaaggccgagtgcatagttcgactgtatgacaactttacggtgtataatcagagggttaacggcaaacatacactgggggagaatatagctgacatggggggtctgaaattggcctatcacgcctaccagaagtgggttcgtgagcacggaccagaacaccctcttccaagattgaagtacacacacgaccagttgttctttatagcattcgcccagaactggtgcattaagaggcggagccagtcaatctatctgcaggttctaacagataaacacgccccagagcattaccgcgtcctcggctccgtcagccagtttgaagagtttgggcgagcctttcattgtcctaaggatagtcctatgaaccccgctcacaaatgttctgtctggtag

SEQ ID NO: 221971 - DNA, 2322 bp, Artificial Sequence
  Description of Artificial Sequence: Synthetic coding sequence
atggagcctccgtattctcttactgcccactacgatgagttccaggaagtcaaatacgtgagtagatgtggggctggtggagctcgcggagcttctctccccccaggcttccccttaggagcagccaggtctgccacaggcgctaggtctggcttgccacggtggaacaggagggaagtctgtttgcttagcggcctggtcttcgccgctggattgtgtgcaattctggcagctatgctagccttgaaatacttaggccctgtcgccgcagggggaggggcatgccccgaggggtgccccgagcgcaaggcattcgcgcgtgccgcacgttttcttgctgccaatctggacgcctccatagacccgtgtcaggatttttattcttttgcgtgcgggggatggcttagaaggcacgcgattccagacgataagcttacttacggaacaatagccgctatcggtgaacaaaatgaggaaagacttcgcagactgctggccaggcctggtggcggtcccggaggtgccgcacaaagaaaagtaagagccttctttcgcagttgtctcgacatgagggaaattgaacggttgggccctcggcctatgcttgaggtcatcgaggattgcgggggatgggatctgggcggagccgaagagcgccctggcgtggctgctcgttgggacttaaatcgtctgctgtacaaagctcagggggtctacagcgccgcagcacttttcagcctcaccgtttccctggatgaccggaatagttctcggtatgtcatccgcatcgatcaggacggactgactcttcctgaacgcaccttgtaccttgcgcaggatgaggattccgaaaaaatactcgcagcttatagagttttcatggagcgggttctgagcctgctgggcgctgatgcagttgagcagaaagctcaggaaatattacaggtggagcagcagctcgctaatattaccgtgtccgaacatgacgacctccgcagggacgtgagttccatgtataataaggttactctgggccagcttcagaaaattacgccacatctgcgctggaagtggttactggatcagatcttccaggaagacttcagcgaagaagaggaagtggtcctgctcgcgaccgactacatgcagcaggtgagccaactgatcagaagcacccctcacagagtactgcacaactacttggtctggagggtggtcgtcgtgttgtcagaacacctgtctccaccctttagagaggctctccacgaactggcacaggagatggagggatccgacaaaccacaagagctggcacgtgtttgtctcggacaggcaaaccggcactttggaatggcattaggagcactgtttgtccacgagcacttttctgcagcctccaaagccaaagttcaacaactggttgaggatatcaaatacattctggggcaacggctggaagagctcgactggatggacgctgagacacgggctgccgctcgcgctaaactgcagtatatgatggtcatggtgggctatccagatttcttgttaaagcccgatgccgtcgacaaagaatacgagttcgaggtccatgaaaagacctactttaaaaacatcctgaattcaattcgattcagcatccagttaagcgttaagaaaatcaggcaggaggtggacaagtggttattgccaccccaagccctgaacgcctattacctgcccaacaaaaatcagatggtattccccgctggaatcctacaacctaccttatacgatcctgactttccccaaagcctaaactatggaggcattgggactatcatcggccacgaacttacacacggttacgacgattgggggggacagtacgaccggagcgggaatctgttgcattggtggactgaggcttcttatagcaggtttctacgtaaagccgagtgtatcgtaagactctacgataacttcacggtctacaaccaaagggttaatggcaagcacactctcggtgaaaacatcgccgatatgggcggactaaaactggcctaccacgcctatcagaagtgggtgagagagcacggcccagagcatccactccctagactcaagtacacccatgaccagctgttcttcatagcctttgcacagaattggtgcatcaagagaaggtctcaaagcatttacctgcaggtactgactgataagcatgcccctgaacattatcgagtgttagggtccgtatcgcaattcgaggaatttggacgggcttttcactgtccaaaggattcccccatgaatccagcccataaatgctcagtatggtag

SEQ ID NO: 221972 - DNA, 1284 bp, Artificial Sequence
  Description of Artificial Sequence: Synthetic coding sequence
atggagaccctgtgcttgagagcatctttctggctggctcttgtcgggtgtgtcatttcggacaatcccgaacgttattctactaacctgagcaaccacgtcgatgatttcactacattcagaggcaccgagctctctttcctagtgactacacaccagcccacaaatctagtgctgccttctaatggaagcatgcataactattgtcctcaacagacaaagatcacatcagcattcaagtacattaataccgtgataagctgcactatctttattgtgggaatggtgggcaatgctacactgctccgtatcatataccaaaataaatgcatgcggaatgggcctaatgcactgatcgcttctctggctctcggagatctgatttacgtagtgatcgatctgcccattaacgtatttaagctactggccggaaggtggcccttcgaccataatgatttcggcgtgttcctctgcaaattatttccgttcctacagaagtcatctgtgggcatcaccgtcttaaacctatgtgcattatccgtggaccggtatagggctgtggcaagttggtctagggtccaagggatcggcattcccctggtaacagcaatcgagatcgtgtctatttggattttgagctttatccttgccattcccgaagctatcgggttcgtaatggtcccatttgagtatagaggtgaacagcacaaaacatgtatgctgaacgctaccagcaagtttatggaattttaccaagatgtgaaagattggtggctgtttggtttctacttttgtatgcctctcgtgtgcacggcgattttttatacgttaatgacttgcgaaatgctcaaccgaagaaacggttctctccgaatcgccctaagtgagcaccttaaacagcgtagagaggtggctaagactgtattctgcttggtcgtgatattcgccttgtgttggtttccattacacctgtcccggatcctgaaaaaaaccgtttacaacgagatggacaagaaccgttgtgaactgctctcattcctgctgctgatggactatatcggtatcaatttggccaccatgaattcttgcataaacccgattgccctgtattttgtgagcaagaaatttaagaactgctttcagagttgtctttgttgttgctgctaccagtctaagagcctgatgacatccgtgcctatgaatggcaccagcatccagtggaaaaaccacgaccaaaacaaccacaatacggacagatcttctcacaaagacagcatgaactag

SEQ ID NO: 221973 - DNA, 486 bp, Artificial Sequence
  Description of Artificial Sequence: Synthetic coding sequence
atggagactttgtgtttgagagccagtttttggctcgcactcgtcggctgtgtcatctccgacaatccagaacgatattccactaatctgtccaaccacgtcgacgactttacaacctttcgtggcactgaactgtcattccttgtaactacgcatcagccgacaaacttagtgttacccagcaatgggtctatgcacaattattgtccacagcaaacaaaaattacgagcgctttcaagtatatcaataccgtcatcagctgtacaatcttcatcgtcggcatggttgggaatgcgaccctgctgaggatcatctaccagaataagtgtatgcgcaatgggcctaatgccctgattgcatctttggctttaggtgatctcatctatgtagtgattgacctgcctatcaatgtcttcaaagtccagtcaagttgtctgttggaatcatgcagtggcaactgggactccttcggcaactgtcactag

SEQ ID NO: 221974 - DNA, 957 bp, Artificial Sequence
  Description of Artificial Sequence: Synthetic coding sequence
atggagactctatgcctcagagcgagtttttggctcgccctggtgggatgcgtaataagcgacaacccagagcggtactctactaacctttctaatcatgtagacgacttcactacttttcgcggaacagaactctctttcctggtgacgactcatcaacctacgaatcttgtgctgcctagtaatgggagtatgcacaattactgcccgcaacaaaccaagattacttcagcatttaaatacatcaacacggtgatctcatgcaccatcttcatcgtcgggatggtggggaacgccactctccttcgcataatttaccagaacaagtgcatgcggaatgggcctaacgcccttattgccagccttgctcttggagacctcatctacgttgtgatcgatttgcccattaatgtcttcaaattttaccaagacgttaaggactggtggctgttcggcttttacttctgcatgccattagtgtgcactgcaattttttatacactaatgacgtgcgaaatgcttaatcgtcgcaacgggagtctgagaattgccctcagtgagcaccttaaacagaggcgtgaagtggccaaaactgtgttttgcttggtggtgatttttgcactgtgctggttccccctgcatctgtcccgcatcctgaaaaaaaccgtgtataacgagatggataagaatagatgcgaactactgtcattcctgcttctgatggactacattggcatcaatctggccaccatgaactcttgcatcaaccccattgctttatactttgtttccaagaaattcaagaattgcttccagagctgtctctgttgttgctgctaccagagtaaaagcctgatgacatctgtacctatgaatggcacctctatccagtggaaaaaccacgatcagaacaatcataatactgaccgctcttctcacaaggactccatgaactag

SEQ ID NO: 221975 - DNA, 564 bp, Artificial Sequence
  Description of Artificial Sequence: Synthetic coding sequence
atggaaaccctttgcctgcgcgctagcttttggctcgcattggtgggttgtgtcatttctgataatccagaacggtatagcacgaatttgtctaaccacgtggacgattttactacatttaggggaaccgagttgtctttcctcgtcacgacccatcagccaaccaatctcgtgcttcctagcaatggtagcatgcataattattgtccccagcagaccaaaatcacgagtgcttttaagtacattaatacagtaatcagctgcactatcttcatcgtgggtatggttggtaacgcgacactcctgcgaattatttatcaaaacaaatgtatgcgcaatgggccaaatgccctgattgccagccttgcactgggtgacctaatctatgtcgtgatcgacttgcccatcaacgtttttaagctcctggctggacgatggcctttcgaccacaatgactttggagtatttctgtgtaagctgttcccctttctgcagaaatcatccgttggcatcaccgtgcttaacttgtgtgctctctccgtggataggaaaaccgagatgtag

SEQ ID NO: 221976 - DNA, 957 bp, Artificial Sequence
  Description of Artificial Sequence: Synthetic coding sequence
atggagaccctgtgcctgcgggcatctttctggctggccctggtaggctgcgttattagcgataatcctgaacgctatagtactaacctttcaaatcacgtggatgattttaccacctttcgcggaaccgagctcagcttccttgtcactacccaccaacctactaacctagtcttgccgagtaatggctctatgcataattactgcccccagcagacaaaaataaccagtgcttttaaatacatcaacactgtgattagctgtaccatttttatagtgggaatggtgggaaatgctaccctgctgaggataatctatcaaaataagtgcatgcgcaacgggccaaacgcactcatcgcatctctcgccctcggcgacctgatttatgtggtcatcgatctccctattaacgtgttcaagttctatcaggatgtcaaggactggtggctgttcggcttttatttttgcatgcctttggtgtgcactgctattttttacacacttatgacttgcgagatgctgaacagaagaaatggcagccttcggatcgcactctcagagcatttaaagcagcgtcgcgaggtcgcaaaaaccgttttctgtctggtggtcatctttgctctttgctggttccctctgcacctgagccgcatcctgaaaaaaacagtttataacgagatggacaagaatagatgcgagcttctctcgtttctgctcttgatggactacatcggcatcaatctagcgaccatgaacagttgcatcaacccgatagccctgtatttcgtctctaaaaagtttaaaaactgcttccagagctgtctgtgttgttgttgttatcagtctaagagccttatgacgtcagtccccatgaacgggaccagcattcagtggaaaaatcacgatcagaataaccataataccgaccgtagttcacacaaagatagtatgaattag

SEQ ID NO: 221977 - DNA, 1179 bp, Artificial Sequence
  Description of Artificial Sequence: Synthetic coding sequence
atggaggaacagcagcccgaaccgaaaagtcagagagattctgcactgggcgcagccgcagctgcgacaccgggtggtttgtccctgtctctgtcccctggagcctcaggcagttcaggctccgggagcgacggagacagtgtcccagtgtcccctcaaccagctccaccctctccaccagcggctccgtgcctgccgcctttggcccatcacccacatctaccccctcacccacctccacccccaccccagcacctggcggcacctgcacaccagccccagcctgcagcgcagctccaccgcacaactaatttcttcatcgataacatcttgaggcccgattttggctgcaaaaaagaacagccaccgcctcaattgctagtggctgcagccgctcggggaggtgccggaggcggtggcagagtggagcgggacaggggtcagacagcagccggaagagacccagtgcaccccctgggtaccagagcccctggtgccgcttctctcctctgtgcacccgacgctaattgcggacccccagacggaagtcagcccgcagccgctggggcaggtgcgtcaaaggccggtaaccctgccgctgctgcagcggcagccgctgccgctgtcgccgcagctgctgctgcagccgcagcaaaaccgtcagataccggcggtggcggaagcggcggtggagctggcagcccaggggcacaggggacaaagtacccagagcacgggaaccccgctatactgctcatgggctccgcaaacggcggaccagtcgtaaagaccgatagccagcagcccctggtttggcccgcttgggtgtattgcacaaggtattctgatagacccagcagcggacctaggacccggaaactaaagaaaaagaaaaatgaaaaggaggacaaaaggcctcggactgcgtttacagctgaacagcttcagaggttgaaagctgagtttcaggccaaccgatacataacagagcagcgacgacagacgttagcccaggagcttagcctgaatgagtcccagataaaaatttggttccagaacaagcgggcaaagataaaaaaagccacaggtattaaaaatggcttagccctccatctgatggcacagggcctttataatcactcgaccacaaccgtccaggacaaggatgaaagcgagtag

SEQ ID NO: 221978 - DNA, 1002 bp, Artificial Sequence
  Description of Artificial Sequence: Synthetic coding sequence
atggaggagaacgaccctaaaccgggagaggctgctgccgctgtggagggtcagcggcagcctgaaagtagtccgggaggcggaagcgggggtggagggggaagctccccaggtgaagcagatactggccgtcggagagcgctgatgcttcccgcagtactccaggcacctggcaatcatcagcatccccaccgtatcactaatttttttattgataatatcctgaggccagaattcggtcgacgcaaggacgccggtacatgctgtgctggcgctggtggcggacgtggaggtggcgctggcggtgaaggcggtgcttctggcgctgagggtggcggaggggcaggcggatctgagcagctgctcggcagtggaagccgcgagccaagacagaacccaccatgcgctccaggagctgggggaccacttcctgctgctggctcggacagtcccggtgatggtgaaggcggaagcaagacattgtccctccatgggggagcgaagaaaggtggagaccctggagggcctcttgatggcagcctgaaagccaggggccttggcggtggggatctgagcgtgagctccgactctgattcttcccaggcaggcgctaacctgggtgctcagcccatgctgtggcctgcctgggtctactgtacgcgctactctgacaggccaagttccgggcctagatcacggaagccgaagaaaaagaaccctaataaggaggacaagcgacctcgcacagcgttcaccgccgaacagcttcagcggttaaaggcagagttccagaccaatcgctatttgaccgaacagcgcagacagagtctagctcaggaactgtcacttaatgaatctcagattaagatatggttccagaacaagcgggcaaagataaagaaagccactgggaataagaacaccctggccgtgcacctaatggctcaggggctgtacaatcacagcaccaccgcgaaggaaggtaagagtgactcagaatag

SEQ ID NO: 221979 - DNA, 2184 bp, Artificial Sequence
  Description of Artificial Sequence: Synthetic coding sequence
atgccccctcctgccgacattgtgaaggtggcgattgaatggcctggtgcgtacccaaagcttatggaaatcgatcagaagaagccactcagtgcaattataaaggaggtatgtgacggttggagcctggcaaatcacgagtatttcgcactccagcacgccgactcctcaaacttctacattactgagaaaaatcggaacgagatcaagaacggcacaatcctccgccttactacgagccctgctcagaatgcccagcagctgcacgaacgcatccagtcctcaagcatggacgctaaactggaggcgctgaaggatctggcatccctgagcagagatgtgacctttgctcaggagttcataaaccttgatggaattagcttattgacacagatggtggagtccggcacggagagataccagaagctacaaaaaataatgaagccatgttttggcgatatgctttccttcaccctcacagccttcgttgagttaatggatcacggcatagtgagctgggatacattctctgtcgcctttattaaaaaaatcgcttcctttgtgaataaatcagctatagacatttcgattttacagagaagcttggcgatattagagagcatggtgctgaactcccacgatctctaccagaaggtcgcccaggagatcaccattggtcaattgatccctcacctgcagggctccgatcaggagattcagacctatacgatagcggtcattaacgctctttttctgaaagcccctgatgaacgacgccaagaaatggcaaacatccttgcccagaaacaactgcgctccataattcttactcacgtaatccgtgcccagcgagctataaacaacgagatggctcaccaattgtacgtgctccaagtcctgaccttcaaccttctggaagacaggatgatgaccaagatggacccccaagaccaagcgcagcgggatataatcttcgagctcaggcgcatcgccttcgacgcagagtcagaacctaataacagctcagggtccatggaaaagcgtaaaagtatgtatactagagattataagaagctgggtttcatcaatcacgtgaatccagcgatggactttacgcagacccctccaggaatgctggcacttgataacatgctctatttcgctaagcatcaccaggatgcctacatccggatcgttctagagaattcctccagggaggataaacatgagtgtccttttggacgaagctctatcgagctgactaaaatgctctgtgagatcctgaaagtaggcgaactgccttccgaaacctgcaatgactttcatcctatgttcttcacgcacgacaggtctttcgaggagttcttttgtatctgtattcaactgctgaacaagacttggaaggagatgcgtgccacatccgaggattttaacaaagtgatgcaggtggttaaggaacaagtgatgcgcgctttgaccacgaaaccatccagcctggatcagttcaagtccaagctgcagaacctgtcttacaccgaaatcctcaagatcaggcagagcgagagaatgaatcaggaggatttccagagtagacctatattggaactcaaggagaaaatacaacccgagatccttgaactgattaaacagcaacgcctgaaccggttggttgaaggcacctgcttcagaaagctcaatgcgagacgacggcaggacaaattttggtactgcaggctgtccccaaaccacaaagtcctgcattatggggatctggaagagtcccctcagggagaggtaccacatgattccctgcaggataagctcccggtcgcggatatcaaagctgtggtaacaggcaaagattgtccccatatgaaagagaaaggagctctcaagcagaacaaggaggtgctggagctggccttcagcatcttgtatgactccaattgccaactcaacttcatcgccccagacaagcacgagtactgcatttggaccgacggcctgaacgcactcctcgggaaggacatgatgtctgaccttacgaggaatgatttagacaccctgctttccatggaaataaagctgcggctgctggacctcgagaatattcagattccggacgctcctccccctattccaaaagagccgagcaactacgactttgtatatgactgtaactag

SEQ ID NO: 221980 - DNA, 1290 bp, Artificial Sequence
  Description of Artificial Sequence: Synthetic coding sequence
atgtctgagcaccaaaaggagcaaaccttagacaccccctctctgcgaactgtgactctcaccgtgagggtgcacgggtttatactggaagttagcaaaacaaagaacccccctatccctgataccttttggccaccacggtgggaccaccgtccctcgcccggaggagaaacgaacgcatattgccagatgaaccatgtcaatcctgctatggacttcactcaaacgcccccagggatgctggcgctggacaatatgctgtattttgcaaaacaccaccaggatgcgtatattcggatagtgctcgaaaattcttcacgggaagacaagcatgaatgtcccttcgggaggagtagtatcgagctgaccaagatgctgtgcgagatccttaaggtcggcgagctaccatctgagacttgtaacgattttcaccccatgttttttacccatgaccgcagctttgaggaattcttttgtatctgtatccaactgctcaacaaaacttggaaagaaatgcgcgctacttctgaggactttaacaaggtgatgcaggtcgtgaaggagcaagtgatgcgggcacttacaaccaaaccatcgtccctcgaccagtttaagagcaagcttcagaacctgtcctacacagagatcctgaagataaggcagagcgagagaatgaaccaagaggacttccagtctagacctattttggagctgaaggaaaagatacaaccggaaattctggagcttatcaaacagcagaggttgaatagactggtcgaaggcacttgtttcaggaagttaaacgctaggaggcggcaggataaattttggtactgtcgacttagtcccaaccacaaggtgctgcattatggagatctggaggaaagtccacagggtgaagtcccccatgatagcctccaagataagctgcctgtggccgatatcaaggccgtggtaaccggtaaggattgtcctcatatgaaagaaaaaggtgccctgaaacagaacaaagaagtactcgagctggccttttcaatactctacgacagcaactgccaactcaatttcattgctccagacaaacacgaatactgcatttggacagacggcttgaacgccctcctgggaaaagacatgatgagcgacttgacccgcaacgatctagacactctcctgtccatggagataaagctgaggttgcttgatctggagaatatacaaatccctgatgccccacctcctatcccaaaagagccttccaattatgacttcgtctacgactgcaactag

SEQ ID NO: 221981 - DNA, 1896 bp, Artificial Sequence
  Description of Artificial Sequence: Synthetic coding sequence
atggatgctaaactcgaggcgttgaaggatctggcctctctctctagagacgttacatttgcccaggagttcattaatcttgatggaatctctctcctcacacaaatggttgagtccggtacagaacgctaccagaagttgcaaaagatcatgaagccatgcttcggagatatgctctctttcactctgacagcattcgttgagttgatggatcacggaatcgtatcctgggatacattctccgtggcattcatcaaaaagatcgctagctttgtcaataagtctgccatcgatatcagtatactacagagatccctcgcaattctggaatccatggtgctgaattcacatgatttataccaaaaggtagctcaggagatcaccatcggccagctgattcctcacctgcagggaagcgaccaggagatccagacttacaccatagccgtcatcaacgcgctctttctgaaagccccagacgaacgacgccaggagatggccaacatccttgcccaaaagcagcttaggagtataatcctaacccacgtcatcagggcccagagggcaataaacaatgaaatggcgcatcagctttacgtgctgcaggtgttaacgttcaacctcctagaggacagaatgatgacaaaaatggacccacaggatcaggcccagcgagatataatattcgaacttagacggattgctttcgatgcggaatcagaacctaacaacagcagtggaagcatggagaagagaaaaagtatgtacacccgcgactataagaaactggggtttattaatcacgttaaccctgcaatggactttacacaaacaccccctgggatgcttgccctcgacaacatgctatattttgctaaacaccatcaggatgcgtatattcgtattgtcctcgaaaactcatcaagagaggacaagcacgaatgcccttttggcaggtcctccattgaattgaccaagatgctgtgtgaaattctcaaggtgggggagcttcctagtgagacctgcaatgatttccaccccatgttctttacgcacgaccggagtttcgaggagttcttctgtatctgcattcaattgctgaacaaaacatggaaggaaatgcgggctactagtgaggattttaacaaagtgatgcaggtagttaaggaacaggttatgcgggctctcacaaccaaaccctctagtttagaccagttcaaatcaaagttgcagaacctttcctatactgaaatcctgaagattcgacaatctgagcgaatgaatcaggaagactttcagtcccggccaatattggaactgaaggagaaaatacagccagaaattttagagctcatcaaacaacagcgcctcaacaggctggtcgagggaacttgctttcgtaaactcaacgctcgacggcgtcaggacaaattctggtattgtaggctgtctcccaaccataaggtgctgcactatggcgacctggaggagagcccccagggcgaggtcccccacgacagcttgcaggacaagctgccagttgccgatatcaaagctgtggtgaccgggaaagattgccctcacatgaaggaaaagggcgcactgaaacaaaacaaggaggtgctcgaattggcgttcagcattctttatgacagcaattgccagctcaatttcatcgccccagataaacatgaatactgcatttggactgacggactcaacgcactactcggcaaagatatgatgagtgatctgacaaggaacgacctcgacacgcttcttagcatggaaattaaactgcgactgctggatctagagaacatccagatccctgacgctccaccacctatccctaaggagccaagcaactatgatttcgtgtatgactgcaactag

SEQ ID NO: 221982 - DNA, 744 bp, Artificial Sequence
  Description of Artificial Sequence: Synthetic coding sequence
atgcaagtggtgaaagagcaggttatgcgggctctcaccacaaagccctccagcctcgatcagtttaagagcaagcttcagaatttaagctacactgaaattctcaagataaggcaaagcgagcgaatgaaccaagaggacttccagagtaggcccatacttgaacttaaggagaagattcagcctgaaatcctggagcttatcaagcagcagaggttgaatcggttagtggagggcacctgtttcaggaagctcaacgccagacgtcgacaggacaaattctggtattgccggctatcccctaatcataaggtgttacactacggcgacttggaggagagtccacagggcgaggtgccccacgatagcctgcaggacaaactgccggtcgccgatatcaaggctgtggtcacgggaaaagattgtcctcacatgaaggaaaagggcgcactgaagcagaataaagaggttctagaacttgccttttcaatcctgtatgactccaattgccaattgaactttatcgcacctgacaaacacgagtactgcatctggacagatggcctgaatgctctcctgggcaaggacatgatgagcgacttgacacggaatgatctggatactctgctctccatggagatcaaattacgcctcctggaccttgagaatatccagatcccggatgcaccacccccaattcccaaggagccctcaaattatgactttgtatacgactgcaactag

SEQ ID NO: 221983 - DNA, 744 bp, Artificial Sequence
  Description of Artificial Sequence: Synthetic coding sequence
atgcaggttgttaaggagcaagtcatgagagcactgactacaaagccctcgagcctagaccagttcaaatcaaagctccagaatttgtcttataccgagatactaaaaatacggcaatctgaaaggatgaatcaggaggacttccaatcaaggcctatcttggaattgaaagaaaagatccagcctgagatccttgaacttatcaagcagcagcgtctcaatcgccttgtcgaaggcacttgcttccggaagttgaacgcccgtcggcgacaggataaattttggtattgcagactgagccccaaccataaagttcttcactacggagacctggaagagtcacctcagggtgaggtgcctcatgacagcttacaagataagcttcctgttgcggacatcaaggccgttgttacgggaaaggattgtccccatatgaaggagaagggcgcactgaaacagaataaagaagtgttagaactagcattttctattctgtatgacagcaactgtcaactcaactttatcgctcctgataagcacgaatattgtatctggaccgacgggttaaatgcattgctgggtaaggatatgatgagtgatctgacaagaaatgatctggacacactgttgagcatggagattaagcttcggctgctggacctggaaaacatccagatcccagatgccccaccacccattcctaaggaaccctctaactacgatttcgtgtacgactgtaattag

SEQ ID NO: 221984 - DNA, 2184 bp, Artificial Sequence
  Description of Artificial Sequence: Synthetic coding sequence
atgccccctcccgcagatatcgtgaaagtcgctatcgagtggcccggtgcctaccccaagcttatggaaattgaccaaaagaaacccctgtctgcgataatcaaagaagtgtgcgacggctggagcctggcaaaccacgaatacttcgcccttcagcatgcagacagcagtaacttctacatcaccgaaaagaaccggaatgaaattaaaaatgggacaatattaaggcttaccaccagcccggctcagaatgctcaacagctacacgagcgtatccagtcgtcctcaatggacgcaaagttggaggcacttaaggacttagctagccttagtcgcgacgtcacgtttgcgcaagaatttataaacctggatgggatttctttattaacacagatggtggaatctggaaccgagagataccagaagctccagaagatcatgaaaccgtgctttggtgacatgctctcatttacattaaccgcctttgttgagctcatggatcacggcatagtttcttgggatactttttccgtggctttcattaagaagatcgcgtcgtttgttaataagagtgccatcgacatctccatcttgcaaaggagtctggctattctcgagagcatggtgctgaattcacatgacctgtaccagaaggtggcccaggagatcaccatcggccagttgataccccatttacaaggctctgaccaggagatccagacatatacgattgccgtgatcaatgccctctttctgaaggccccagacgaaaggaggcaggagatggctaatatactggcccagaaacagctgagatctattatactgacacacgttattcgggcacagagggccattaataacgagatggctcaccaattgtacgtgctccaagtcctaacctttaatctgctggaggaccgtatgatgacaaagatggatcctcaggatcaagcccagagggacatcatctttgagctcaggaggattgcatttgacgcagagtccgaacctaacaacagctccgggagcatggaaaaacgcaaaagcatgtatacccgcgattacaagaaactcggcttcataaaccatgtgaatcctgcaatggactttacacagacacccccaggcatgcttgccttagataatatgttgtatttcgccaaacaccaccaggacgcatatattcggatcgtcctggaaaacagcagtcgcgaagacaaacatgagtgcccgttcggacggtcctctattgagctcaccaagatgctgtgtgagatactgaaggtcggcgaattgccctctgaaacctgcaacgattttcaccccatgttcttcactcatgatcgttcgtttgaggaattcttctgcatatgcatccagttacttaataaaacgtggaaggagatgagggcgaccagcgaggatttcaacaaagttatgcaggtggtgaaagagcaggtcatgcgggcactcacaacaaaaccatctagtctggaccaattcaaatcaaaattacagaatttgagttacacagaaattttgaagatacgccagtccgagcggatgaaccaagaagacttccagtctcgcccaattctcgagctgaaggagaagatccaaccagagatcctggaattgattaaacagcagagacttaacagacttgtggagggaacttgtttcaggaaacttaacgccaggagacgccaggacaaattttggtactgcaggctgtcacctaaccacaaggtgctgcattacggggatttagaggagtcaccccagggagaggtccctcacgatagtctgcaggataagctgcccgtcgctgatatcaaggcggtcgtgaccggcaaagattgcccacatatgaaagagaagggcgctttgaagcagaataaggaagtgctggagttggcgttctccatactgtatgattccaattgccagctgaattttatcgcccctgacaagcatgaatattgcatttggaccgacgggttgaatgcacttctgggaaaggacatgatgtccgaccttacgcgcaatgacctggacacactgctgtccatggagataaagttacgccttctggacttggagaacattcaaatccccgacgccccaccgcctattccaaaggaacccagcaattatgactttgtgtatgattgcaattag

SEQ ID NO: 221985 - DNA, 180 bp, Artificial Sequence
  Description of Artificial Sequence: Synthetic coding sequence
atgcctccgccagcggacatcgtgaaagtggccatcgaatggcccggagcataccccaagcttatggagattgaccagaaaaagcccctgtcagccataattaaagaagtttgcgatgggtggtccctcgctaaccatgaatattttgcactgcaacacgccgatagctccaacttttag

SEQ ID NO: 221986 - DNA, 2184 bp, Artificial Sequence
  Description of Artificial Sequence: Synthetic coding sequence
atgccacccccagcagatatcgttaaggtcgccatcgagtggcctggcgcttatcccaaacttatggagattgatcaaaaaaaacccctctctgccatcattaaggaagtgtgcgacgggtggagcttagccaaccacgaatactttgctttgcagcacgctgactcctctaatttttacattacagagaagaatcggaatgagattaagaatggcactatcttgcggttaactacgagcccagcccaaaatgcacaacagctgcacgaacgaattcaatcatcctcgatggacgcgaaattagaggctctcaaggacctcgcctctctgtcccgagacgttacatttgcccaggaatttattaatctcgacggtatatcgcttttaactcagatggtggaatccggcactgaaaggtaccaaaaattacagaaaattatgaaaccctgctttggggatatgctatctttcacattgaccgcgtttgtggaattgatggatcacggcatagtctcttgggatactttttcagtggcattcattaagaaaatcgccagcttcgtcaataaaagtgccatcgatatcagcatcctacaacgtagccttgccatcctggaatcaatggtgctgaatagtcatgacctgtaccagaaagtcgcccaagaaattactattggacagctgatcccacatctgcagggaagcgaccaggaaatccagacctacacaattgctgttatcaacgccctctttctgaaagctcctgacgaacgcagacaggagatggctaatatcctcgctcagaaacagctcaggtctatcatactgactcacgtcatcagagctcagcgcgctataaataacgaaatggcccatcagctgtacgttttacaggtcctgacattcaacctcttagaggacagaatgatgaccaaaatggacccacaagaccaggcccagcgggatatcatttttgagctcagacggatcgcctttgacgccgagagtgaacccaataatagttctggatcaatggaaaagcgtaagtccatgtatactagggattacaagaagctgggattcattaatcatgtcaatcctgccatggacttcacgcagactcctccaggaatgctggcccttgataatatgttgtatttcgcaaagcatcatcaggacgcctacataaggatcgtgctggagaactcgtcaagagaggacaagcacgaatgtccttttgggaggtcatctattgagttgaccaagatgctgtgcgagatcctcaaagtcggagagcttccatcagagacatgtaacgactttcaccctatgttcttcactcatgatcggtcatttgaggagtttttctgcatttgtatccagctgctgaataaaacatggaaggagatgcgggctacaagcgaagactttaacaaagtgatgcaggtcgtgaaggagcaggtcatgcgcgctcttacgaccaagcccagttctcttgaccaatttaagtctaagttgcagaacttgtcttacactgagatcctaaagattcggcaaagtgagcgcatgaatcaggaggacttccagagccggccaatcctggagctgaaagagaaaatccaacctgagatacttgagctcatcaagcagcagaggctgaacagactcgtggaaggcacctgctttcggaaactgaacgccagaagaagacaggataaattctggtactgcaggctgagccccaaccacaaagtcctccactatggtgacctggaggaatcccctcagggagaggtgccccacgatagcctgcaagataagctgcctgtggcggatatcaaggcggtcgtgacagggaaagattgtcctcatatgaaggagaaaggtgcactgaagcagaacaaagaagtattggaactcgcgttttctatcctgtacgatagtaattgtcaactcaacttcattgcccctgacaagcatgagtattgtatatggaccgatggcttgaacgccctcctgggcaaggacatgatgagtgaccttacaaggaatgatctggataccctgcttagcatggagattaagctaaggctgctggacctcgagaacattcagatacccgacgcaccccctcccatccccaaagagccaagtaattacgattttgtatatgactgtaattag

SEQ ID NO: 221987 - DNA, 246 bp, Artificial Sequence
  Description of Artificial Sequence: Synthetic coding sequence
atgcccccaccagccgacatagtcaaagtggcgattgaatggccaggtgcctatccaaagcttatggagatcgatcagaagaagcctctgtccgccataataaaggaggtgtgtgatggctggtcgctcgctaaccatgagtacttcgccctgcagcacgccgacagcagcaatttctacatcactgagaagaatagaaacgagattaaaaatggaacaattctccggctgaccacctccccttag

SEQ ID NO: 221988 - DNA, 450 bp, Artificial Sequence
  Description of Artificial Sequence: Synthetic coding sequence
atgccccctcccgcagacatcgtcaaggtggccattgagtggcccggagcatatcccaaactgatggagatcgaccagaagaagccccttagcgctatcattaaggaagtttgtgacggatggagtcttgccaatcacgagtattttgcgctgcagcacgcggacagctccaacttttacatcactgagaagaatagaaacgaaattaagaatggcaccatccttcgattaacgacatctcccgctcagaacgcccagcagctgcacgaacggatacagtcttcgtccatggacgctaagcttgaagcgctgaaagaccttgcatccctgtccagggatgtgacctttgcccaggaatttatcaacctcgacgggatctcccttctaactcagatggtggagtccggaaccgagagataccagaagttacagaagatcatgaaaccatag

SEQ ID NO: 221989 - DNA, 2163 bp, Artificial Sequence
  Description of Artificial Sequence: Synthetic coding sequence
atgccaccacctagcgacattgtcaaagtcgccatagagtggccaggtgctaatgcccagttgctggagattgaccagaagcgaccactggctagcattataaaggaggtgtgtgatgggtggtctctgcccaaccccgagtactacacgctgcgttacgcagacggcccacagttgtacattactgaacaaaccagatccgatataaagaacgggacaatcctgcaactggctatctctccctctagggctgcgaggcagttaatggaacgcactcagtcctctaatatggagactaggctggacgcaatgaaagagctggctaaattgtccgccgacgtcaccttcgccaccgagtttattaatatggatggcatcatcgtgcttacgagattggttgaatctgggacgaagctcttaagtcactactctgaaatgctggcatttacactgaccgctttcctggaattaatggaccatggcattgtgtcttgggatatggtgagtatcacttttattaagcagattgcagggtatgtctcccagcccatggtagacgtgagtatccttcagagaagccttgccatcctggagtcaatggtgttgaatagccagtcgctgtaccagaaaatagctgaggagatcactgttggacaactgattagtcatctccaagtcagtaaccaggagatccaaacctacgcaatcgcacttattaatgctctctttctgaaggctcccgaagataagagacaggatatggctaacgcatttgcccagaagcacctgcggtcaatcattctgaatcacgttataaggggaaatagaccgattaagacagaaatggcccaccagctttacgttctccaggtgctgacatttaatctactggaagagcggatgatgaccaagatggatccaaatgaccaggcccagcgggatattatttttgaactgcggagaatcgcgtttgatgccgagtctgacccttcaaatgcgccaggttccggaacggaaaaacgaaaagcaatgtacacgaaagactataagatgctgggatttacgaatcatatcaaccctgccatggattttacgcagaccccacctgggatgctggccttggataatatgctctacctcgctaaggttcaccaggatacttacattcgcatagtcctggagaatagctccagagaggataaacacgagtgcccatttggcagatccgccattgagctgacaaaaatgctatgtgagatcttacaagtcggcgaactccccaacgaaggcaggaacgactatcaccctatgttcttcacccacgacagggcctttgaggaactgttcgggatctgtattcagctgctgaataaaacctggaaagagatgcgggcaactgccgaggatttcaataaggtgatgcaggttgttcgagaacagattactagggcactccccagcaaacccaattcgttggaccagttcaagagcaagctcagaagtctgtcctacagcgaaattctgaggctacggcagtccgagcggatgtctcaggacgacttccagagccccccaattgtcgagctaagagagaagatccagcctgagatacttgagttgatcaagcaacaaagactgaataggctctgtgaaggctcaagtttccgtaaaatcggaaataggcgtcggcaggaaagattttggtattgtcggcttgctctgaaccacaaggtgcttcattatggagaccttgacgacaatcctcagggagaggtaacctttgaaagccttcaggagaaaattcccgtcgccgacattaaggctatcgtaacaggcaaagactgtcctcacatgaaagaaaagagtgcacttaaacagaataaggaggtactggaactggccttcagcatcctgtacgatcccgatgagacactcaacttcattgccccaaacaagtacgagtactgcatctggattgatggactgtcagccctcctggggaaggatatgagcagtgagcttactaagagcgatctcgatacactgctgagcatggaaatgaaactgcggctgcttgacctggagaatattcaaatcccggaggcccctccaccgattcccaaggagccgtcttcgtatgatttcgtgtaccactatggctag

SEQ ID NO: 221990 - DNA, 2157 bp, Artificial Sequence
  Description of Artificial Sequence: Synthetic coding sequence
atgccgcctcctagtgatatcgtaaaagtagccatcgaatggcctggtgctaacgcccagctgttagagatcgatcaaaagcgacccttggccagtatcatcaaagaagtgtgtgatggttggagcctgcctaaccctgaatactacacactgagatacgccgatggaccgcagctctacatcaccgaacaaactcgatctgatatcaagaacggaacaatcttgcaactcgccatctcgccaagccgagctgcaagacaattgatggaacgaactcaatccagcaacatggagacacgtctggatgcgatgaaggaactggcaaaattatctgcagatgtcacttttgccactgagttcatcaacatggatggaataattgtgctgacccgactcgtagaatctggcaccaagttgttatcgcatgaaatgctcgcctttacactgacggctttcctggagttaatggaccatggtatcgtcagctgggatatggtatcaataacattcataaagcagatcgccggttatgtgtcacaacccatggtcgacgtgtccatcctgcaaaggagcctggccatcctggaatcaatggtcctgaatagccagtctctgtaccagaagatcgcggaggaaatcaccgtgggacagctgatcagccacctgcaggtgtcaaatcaggaaatccaaacatacgctatagccttgataaatgcgctgttcctgaaggctcctgaggacaagcggcaggacatggccaatgcctttgcccagaaacacctcaggagcattatcctaaaccatgttattagaggaaatcgacccattaagacagagatggcccaccagctctatgtcctgcaggtcttgacgttcaaccttctcgaagaacggatgatgacgaagatggatcctaacgaccaggcccagagggacattatcttcgagttgaggcggatcgctttcgatgcggagtcggatccctccaacgcaccaggcagcgggaccgagaagcggaaagccatgtatacaaaagactacaaaatgttagggtttactaatcacatcaatccagccatggatttcacgcaaactccccctggtatgttggcacttgacaatatgttataccttgcaaaggtgcaccaagatacctacattaggattgttctggaaaattcctcccgggaagataagcacgagtgcccatttgggaggtctgccatcgagctgacaaaaatgctttgtgagatcctgcaagtgggtgagctccccaatgaaggtcggaacgactaccatcctatgtttttcacgcacgacagagcgtttgaagaattgtttggcatttgtatccagctgctgaataagacatggaaggagatgagggccaccgctgaggatttcaataaggtaatgcaggtggttagagagcagattacaagggccttacctagtaagcctaattcgctcgatcagtttaagagcaaattgagatcacttagctacagcgaaatcctcagattgcggcaatcagagcgcatgtcgcaggacgatttccagtccccaccaatcgtggagctgcgcgaaaaaatccagccagaaattcttgagctgattaagcagcagcggctgaatcggctatgtgaggggtcttcattcaggaaaattggcaaccggaggcgacaggagcgcttctggtattgcaggttagctctgaatcacaaggtgttgcactacggggatttagacgacaatcctcaaggcgaggtcaccttcgagagtcttcaggaaaagatacctgtcgctgacattaaagccatcgtgacaggtaaagactgcccccatatgaaagaaaagtccgcgctgaagcagaacaaagaagtcctcgagctcgccttctccatactctacgatcctgatgagactcttaacttcatcgcccctaataaatatgagtattgcatctggattgacggcctgagcgctcttctgggaaaagacatgtcttcagaactgacaaaatcagatctcgacactctcctgtcaatggaaatgaagcttcgcctattagatctggaaaatattcaaattcctgaggcacccccacccatccccaaggagccgtcctcctatgactttgtgtaccattacgggtag

SEQ ID NO: 221991 - DNA, 1899 bp, Artificial Sequence
  Description of Artificial Sequence: Synthetic coding sequence
atggaaagaacccaatcatccaacatggaaacacgacttgatgccatgaaagagctggccaaattgagcgccgatgtgaccttcgccactgaattcattaacatggacgggatcatcgttctgacccggctggtagaatccggcaccaagctgttatcacactactctgaaatgttagccttcacattaacagcatttctggagctgatggaccatgggattgtgtcctgggacatggtgagtataaccttcatcaagcagattgccggttacgttagtcagcccatggtggacgtctctatcctgcagcgaagtcttgccattctggagtcaatggtgcttaatagtcagtcactctaccagaaaatcgctgaggaaattaccgtgggccagctgatcagccatctgcaagttagtaaccaggaaatccagacctacgcgattgctcttatcaatgctctctttttgaaagccccagaagacaaacgtcaagacatggcaaacgcttttgcacaaaaacatcttaggagcatcatcctgaaccacgttattagagggaaccgacctatcaagacggaaatggcccatcaactctacgttctgcaggtgctcaccttcaatttgctagaagagcggatgatgacaaagatggatcctaacgatcaggcccagagggacattatatttgagctaaggaggattgccttcgatgccgaatcagaccctagcaatgctccaggttctggaaccgagaagaggaaggcaatgtatacgaaagactataagatgcttggtttcacaaaccacatcaaccccgcaatggattttacccaaacgccacccggaatgctggcactcgataatatgctgtatttagctaaggtccaccaagatacttacattaggattgtgctcgaaaattcatcccgcgaggacaaacacgaatgcccgttcggaagaagcgcaatagaactcaccaaaatgttatgcgaaatactccaggtcggggagctgcctaatgaaggcagaaacgactaccaccccatgttcttcacccacgaccgcgctttcgaagagctgttcggtatttgcatccagctccttaacaaaacctggaaggaaatgcgagcaacagcagaggatttcaacaaggtaatgcaggtggtccgcgaacagatcacaagggccctgcccagtaagcctaacagccttgatcagtttaagtccaaattaaggtctctcagctattcagaaatcttgcgcctgcgacagtccgagaggatgtcccaagatgactttcagtccccgccaatcgtggagttgagagaaaagatccaaccagaaatcttagaacttataaaacagcaaagactgaatcgcctgtgcgagggctcgagtttccgtaagatcgggaatcggcgtcgccaggaaaggttctggtactgtcgcctggcattaaatcataaggtccttcactacggggatctggatgacaacccgcagggcgaggtcacattcgaaagcctgcaggagaagattccggtggcagatatcaaagccattgttacgggaaaggattgtcctcatatgaaggagaagtcagccctgaaacagaacaaggaagtactggagctagcctttagcatcctgtatgatccagacgagacccttaacttcattgcccctaacaagtacgaatactgcatctggattgacgggctctcagccctcttggggaaggacatgagtagtgaactgacgaagtccgacctagacactctgctgtccatggagatgaaattaagattactagacttggaaaacatacagatccccgaggcccctccacccatacccaaagaaccctcctcttacgattttgtctatcactatgggtag

SEQ ID NO: 221992 - DNA, 2163 bp, Artificial Sequence
  Description of Artificial Sequence: Synthetic coding sequence
atgccacccccatcagacatcgtgaaggtcgcgatcgagtggcccggagctaacgctcagttgctagagatcgaccaaaaacgtccactggcatctattatcaaagaggtctgtgatggttggagcctgcccaaccctgaatactataccctccgctatgccgacggaccccagctgtacatcactgaacaaacgagaagcgatattaaaaatgggaccattctgcagttagccatttctccctccagagccgcacgtcagctgatggagagaacgcagagctcaaacatggaaacacgcctggacgccatgaaggagctggcgaaactgagcgccgatgtcacctttgccacggaattcatcaacatggacgggatcatcgtcctgactcggttggtcgaatctggcaccaaactcttgagtcactattcggaaatgctggccttcaccctgactgcatttttagagctgatggatcatggcattgtgtcctgggacatggtgagcattactttcattaaacaaatagctggctatgtatcccagcctatggttgacgttagtatactgcagagatcattggccattctggagagcatggtccttaatagccagtcgctataccagaagatagcagaagagatcacagtggggcagctgatctcgcatctacaagtctccaatcaggagatacagacatacgctattgctctgatcaatgcgcttttccttaaggcaccagaggataaacgtcaggatatggcaaacgcattcgcccagaagcaccttaggtccattatccttaaccatgtcatcaggggaaacaggcctatcaagactgaaatggcgcaccaactgtatgtactccaggttctgacctttaacctcctcgaggagagaatgatgactaaaatggacccaaacgatcaggcacaaagagatattatttttgaactgcgcaggattgcctttgacgccgaatccgatccaagtaacgcccctgggtccgggaccgagaaacggaaagccatgtacacgaaggactacaaaatgctgggcttcacaaaccacatcaaccccgcaatggacttcacgcagaccccacctggaatgctcgcattggacaacatgttataccttgccaaggttcaccaggatacttacattcgaatcgtcctggaaaactcttccagggaggataaacatgagtgcccttttggacgcagtgctatcgaacttaccaagatgctttgtgagattcttcaggtgggggagctgccgaacgaaggcaggaacgactatcacccaatgttttttactcatgatcgggctttcgaggaactgttcggcatctgcattcagctcttgaataaaacctggaaagagatgcgtgcaacagcggaggatttcaacaaagttatgcaggtcgtgagggagcagattacccgtgccctgcccagtaaacccaacagtctggaccaattcaagtcaaagttacggtctctaagctactccgaaattctgcgtctgcgacaaagcgagaggatgagtcaggacgacttccaatcaccacccatagtcgagcttcgggaaaagatccagccggagatccttgaactgattaaacaacagcgcctaaaccgcttgtgcgagggttctagtttccgaaaaatagggaataggaggcgccaggaacggttctggtactgccggctcgccctaaatcataaggtgctacactacggagatttggacgacaacccccagggagaggtgacatttgaatccttgcaggagaagattcctgtagccgatattaaagccattgtgaccgggaaggactgtccccatatgaaggaaaagagtgccctcaaacaaaacaaagaggtgctcgagctcgccttttctatcctgtatgaccctgatgagacattgaactttattgcacctaacaaatatgagtattgcatatggattgacggtctcagcgccttgctcggaaaggatatgagttcagagcttactaagtccgatctcgatactctcctctctatggagatgaaactccgcttgctcgacctagaaaacattcagatccccgaggcccctccaccaattcccaaagagccgagtagctacgattttgtgtaccattatggatag

SEQ ID NO: 221993 - DNA, 804 bp, Artificial Sequence
  Description of Artificial Sequence: Synthetic coding sequence
gaagagataacagtggggcagttaattagccacttacaggtcagcaaccaggagatccagacatatgccatcgcactaatcaacgcactgttcctgaaagcaccagaggacaagaggcaggacatggcaaacgccttcgcccagaagcatttacgaagcattatcttaaatcacgtgatccgcggtaatagacctatcaagacagaaatggcccaccagttgtacgtcctccaggtgctgacatttaatctcttggaggagaggatgatgactaaaatggatcccaacgatcaggcccagagagacataattttcgaactgcggagaattgcattcgatgcagagtcagatcccagcaacgctccaggatcaggaaccgagaaaaggaaggccatgtataccaaggattacaaaatgctagggtttactaatcacatcaacccagccatggatttcacccagactccccctggcatgctcgccctcgataacatgctatatctggcaaaggtccaccaggatacatacattagaatcgtgctggagaatagctctagagaggataagcacgagtgtccattcggcagatctgcgatcgagctgacaaaaatgctttgcgagatcttgcaggtcggggagttaccgaacgagggcaggaacgattaccaccccatgttcttcactcacgacagggcatttgaggaactgttcggtatttgtattcagttactgaacaaaacctggaaggaaatgcgggcaaccgccgaggattttaataaggtatcagtctctggactgctttag

SEQ ID NO: 221994 - DNA, 2199 bp, Artificial Sequence
  Description of Artificial Sequence: Synthetic coding sequence
atgcctcctccttcagacattgtgaaagtcgcaatcgagtggcccggagctaacgcccagcttctcgagatcgaccaaaagagaccattagcgtctataatcaaagaggtgtgcgatggctggagcctgcccaaccctgagtactacactctgcgatacgccgatggccctcagctttacatcacggagcagaccagaagcgacattaagaatggtacaatcctccaactcgcgatttctccctctcgggcagctcgccaactgatggagaggactcaaagctcaaatatggagacacgcctggacgctatgaaagagctcgctaagctgagcgctgacgtgacctttgccaccgagtttataaatatggatgggataatcgtcttgactagactggtggagtcaggcactaaactgctctcacattatagcgaaatgttagcattcacgctgactgctttcctggaattaatggaccacggcatcgtttcctgggacatggtgagcatcacgttcatcaagcaaatagccggatacgtcagccagcccatggtcgatgtctccattctgcagcgctctctagcaatcctcgagtcaatggtcttgaacagccagtccctatatcagaaaatagccgaggagatcacagtgggtcaactgatttctcatctccaggtaagcaaccaggagatccagacctacgccatagctctgatcaacgcactctttctgaaggctcctgaagacaagagacaagacaaacacctcaatccactcgaccttccggtcactgatatggccaatgcatttgcgcaaaaacatttgcggagcatcattctgaatcatgtcattagagggaaccgacctataaagaccgagatggcccaccaactgtatgtgctccaggtactcacctttaacttattagaggagcgtatgatgacgaaaatggatcccaatgatcaggctcagcgggacattattttcgagttgcggagaatcgcgtttgacgctgagtcagacccctctaatgcgcctggatccggaactgaaaagagaaaggcaatgtacactaaagactacaaaatgctggggttcaccaaccacatcaatcccgctatggatttcacccaaacacctcctggaatgcttgccctggacaacatgctctatctggccaaggtccatcaggatacatacatccgaatcgtcctggaaaacagctcacgcgaggacaaacacgaatgtccctttgggaggtccgctatagagctgacaaagatgttatgtgaaattctgcaagtgggagaactacctaacgagggacgcaacgattatcacccaatgttctttacccatgatcgcgcttttgaagaactcttcggcatctgcattcagctgctgaacaagacttggaaggagatgagagcgacagcagaggattttaacaaagtgatgcaggtggttagggaacagattactcgagccctgccctcaaaacctaactccctcgatcagtttaaaagtaaactgaggagcctgtcgtatagcgagattctgaggttgaggcagtctgagaggatgagtcaggatgatttccagtcacctcctatcgtggagctgagggagaaaatccagcctgagatactggaactgataaaacagcagaggttgaatagactatgtgaaggctcaagtttcaggaaaattggtaaccggcgtaggcaggagcgtttttggtactgtcggcttgctctgaatcacaaagttcttcactatggagatcttgatgataatccgcagggggaggtgacgttcgagagtctccaggagaagatccccgtggcagacatcaaagctatcgtgactggcaaggactgtcctcatatgaaggaaaaatccgctctgaagcagaataaggaggttttggagttggcatttagcattctatacgaccccgacgagactctgaacttcatcgcaccaaataagtacgagtactgcatctggatcgatggcctctccgctctgctgggaaaagatatgtcctctgagctgaccaagagcgacctcgatactttgctgagtatggagatgaaacttcgccttctcgatttagagaacattcagattcccgaggctccgcctcctataccaaaagaaccatcttcctacgatttcgtgtatcactatggctag

SEQ ID NO: 221995 - DNA, 1614 bp, Artificial Sequence
  Description of Artificial Sequence: Synthetic coding sequence
atggtagacgtcagcatcctccagagatctctggccattttggaatccatggtactcaacagccaaagcctgtaccaaaagatcgctgaagagatcaccgttgggcagctcataagccacctacaggtgagcaaccaggaaatccaaacctatgccatcgcactcattaacgccctctttcttaaagcccctgaagacaagagacaggacatggctaacgccttcgcccagaagcatctgcggtctattattctgaatcatgtcattagaggaaaccgccctataaagaccgagatggcccatcaactttacgtccttcaggtgctgacgttcaatcttctggaggaaagaatgatgactaaaatggaccctaacgaccaggctcaaagggacataatctttgagctgaggaggatcgcctttgacgccgagtccgatccaagcaacgctcctgggagcggcacggaaaagcggaaagctatgtacaccaaagactacaaaatgttaggcttcaccaatcatataaatccagctatggactttactcagaccccaccaggcatgctcgctctggacaatatgttatacctcgcgaaagttcaccaggacacgtacataagaattgtcttggagaatagctctagggaggacaagcacgaatgcccattcgggagatccgcaattgaactgacgaagatgctttgcgagattctgcaggtaggcgagctgcccaatgaagggagaaacgactaccacccgatgtttttcacacacgacagggccttcgaagagcttttcggaatttgtatacagctgctgaataagacctggaaggagatgcgcgctacagccgaggacttcaacaaggtaatgcaggtcgtgagagagcaaatcacacgggcactgccttctaagcccaattctctagaccagtttaagagcaaactgcgcagtctgagctattcggagatcctgcgactgcgtcagtctgaaaggatgagtcaggacgattttcaatccccccctatcgtcgagctccgagaaaagattcagccagaaattctggagctgattaaacaacagagacttaatcgactgtgtgaaggatcgtcttttcgaaaaatcggaaataggcgacgtcaggaaaggttctggtattgtaggctggccttgaatcacaaggtgctgcactatggggacctcgacgacaacccgcagggagaggtgaccttcgagtcattacaggagaagatcccagtcgctgacatcaaggcaatcgtgacgggcaaggactgtccccatatgaaggaaaagagtgcattaaagcaaaataaagaggtcttggaactggctttttctatactgtatgaccccgacgagacgctaaattttatcgctcccaataagtatgagtattgcatatggatcgatggtctgtccgcgctgttgggcaaggatatgtcaagcgaactcaccaagtccgaccttgacacacttctgagcatggagatgaagctgcgcctcctggatctcgagaacattcaaatccccgaagcccctcctcccattccaaaggaacccagctcctatgacttcgtgtaccactacggctag

SEQ ID NO: 221996 - DNA, 1017 bp, Artificial Sequence
  Description of Artificial Sequence: Synthetic coding sequence
atgcctcctcccagtgacatcgtgaaagttgcaattgagtggccaggtgcaaacgctcagttattagaaatcgaccagaagcgcccacttgcgagcattataaaagaggtctgcgacggttggtcgttgcccaatcccgagtactacacgcttagatacgccgacggtccccaactgtacatcactgaacagactagatccgatattaagaacggtaccatcctgcagttagctatcagtcccagccgtgctgcccgtcagttaatggaacgaacccaatcttccaacatggaaaccaggctcgatgcaatgaaggaactggccaagctgagcgccgatgtcacattcgcgacagagtttattaacatggatggcatcatcgtgcttactcggttggtcgagtctggtacaaaactgttatcacactattctgagatgctggcctttaccctgacagcctttttagagctgatggatcatgggatcgtgagttgggacatggtgtcaatcaccttcattaagcagatagctgggtacgttagtcagcccatggtggatgtgagtattctgcagaggtccctggctattctagagagtatggtgcttaacagccagagcctttatcagaagatcgcggaggagatcacagtcgggcagctcattagtcacctccaagtatcaaatcaggagattcagacgtacgccatcgctctcatcaatgccctgtttcttaaggcccctgaggacaaacgccaggacatggccaacgcgttcgcacaaaaacacctccgctcaataattcttaatcacgtgatccggggaaaccgaccaataaagaccgagatggcacaccaactgtatgtcttacaggtccttacctttaatctattggaggagaggatgatgacgaagatggatccaaacgaccaagcccagcgagacattatctttgagttgagaagaatcgcatttgatgctgagtccgacccaagcaacgcacccggttcaggtacttag

SEQ ID NO: 221997 - DNA, 852 bp, Artificial Sequence
  Description of Artificial Sequence: Synthetic coding sequence
tatcacccgatgtttttcacacacgacagggcatttgaagaactgtttgggatatgtatccagctgctcaataagacctggaaggagatgcgggctaccgccgaggatttcaataaggtaatgcaggtagtgagagagcagatcacaagagccctcccgtccaaacccaatagtctggaccagttcaaaagcaagctgaggtcactgtcctatagtgagattctgcgcctgagacaaagtgagcgcatgtctcaagatgacttccagagcccaccaattgtagagctgagagaaaagattcagccggaaatcttggagttgatcaagcaacaacggctcaatagactgtgcgaaggatcaagttttcgcaagattgggaaccggagaagacaggaaagattctggtactgcagactggccttgaaccataaggtcctccactatggagaccttgacgacaaccctcagggggaagtcactttcgaatctttgcaggagaaaaatataaaagctattgtaaccggaaaggactgcccccacatgaaggagaaaagtgcactcaaacaaaataaagaggtgctcgagttagcgttctcaatcttgtatgatccagacgagaccctgaactttatagcaccaaataaatacgagtactgcatatggattgatggactgtccgccctgttgggaaaggatatgagctccgaactgaccaagtccgatcttgacacacttctatctatggagatgaaactgcgcttactcgacctcgagaatatacagatccctgaggctccgcctccgatccctaaagagccttcttcgtacgactttgtctaccactacggctag

SEQ ID NO: 221998 - DNA, 1359 bp, Artificial Sequence
  Description of Artificial Sequence: Synthetic coding sequence
atgcatgtgatcaggggaaataggccaatcaagacagagatggctcaccagctgtatgtgctacaggtactcacgttcaatctcttggaggaaagaatgatgacgaagatggaccctaatgaccaggcccaaagggacattattttcgaattgcgcagaattgcgtttgacgccgaatcagacccctctaatgcaccgggtagcggcacagagaagaggaaagcgatgtacacgaaggactacaaaatgctgggatttactaaccacattaaccccgctatggatttcacacaaacgcctccagggatgctggctttggacaacatgctctacctggctaaggtgcaccaggacacttacattcgcatcgtcctcgaaaactccagccgcgaggacaagcatgagtgccccttcggaagatccgctatcgaactcacgaagatgctgtgcgagatcctgcaggttggagaattaccgaacgagggaaggaatgactatcatccaatgttttttacgcatgacagagccttcgaggagctcttcggaatttgtatccagctcctaaataaaacatggaaggaaatgcgcgctacagcagaggacttcaataaggtaatgcaggttgttagggaacagatcacccgtgccctgccatctaagccgaactcattggaccagtttaagtccaagctccggagtctgtcttattctgagatcctcaggttacgacaatccgagcgaatgagccaggatgacttccaatccccacctattgtcgagctgcgggaaaagattcagccggaaatcctggagctgattaagcagcagagactgaatcgcctgtgtgaagggtcttcattccggaagattggcaatagaaggagacaggagcggttttggtattgcaggcttgcattgaaccataaggtcctgcactacggcgacctcgacgacaatccccaaggggaggtgacatttgagagcttacaggaaaaaataccagtagcagatattaaagcgatagttaccgggaaggactgcccccacatgaaggagaaatcagctctgaagcagaataaggaagtgctcgaactggcattctccatactgtatgatccggacgaaaccctcaattttatagccccaaacaaatacgagtactgcatctggatcgatggcctctctgctttactgggaaaggatatgagtagtgaactaaccaaatccgacctcgacactctattaagcatggaaatgaaactgagattgctggacctggagaacatccagatccctgaagcaccccctcctatccctaaagagccaagcagttatgatttcgtgtatcattatgggtag

SEQ ID NO: 221999 - DNA, 2322 bp, Artificial Sequence
  Description of Artificial Sequence: Synthetic coding sequence
atggctcggagtagctcgctgggtcgagaatgtggcacccccaggtcaggacttggcaagggcggtccacccagaccccagggcccacaggcacgctgtaccctgggccgtcggtgtaccgttagcggtaagtgccgtcgtccaaggccgtcatggaccatggcaccacctcggaatgtggtcaaaatagcaattaaaatgcgggacgcgattccccagctgattcagttggaccaggccaaacccctggccgcagtgctgaaagaagtatgcgacgcatggtctctaacccacagcgagcgctatgccctgcagtttgcagatggtcaccgcaggtacattactgagaataatagggctgaaataaagaatggttccatactgtgtctttctactgctcccgatcttgaagctgagcaactgctgggaggtctccagtctaatagcccggaaggaaggagggaggcattgcgcagattggtgcccttggcatccgacatgatcttcgcaagagaggttatctctagaaacggtctgcaaatactgggaaccatcatcgaagacggcgatgatctgggcgaagtactggcactgtcccttagagccttctcagagctaatggagcacggcgtggtttcatgggagacactgagtatacccttcgtgaggaaagtggtttgttacgtcaatatgaatcttatggatgcctcagtgcccccactggccctaggtctcttagagagtgtcacactaagctcgcccgctcttggccagctggtgaaaagcgaagtcccacttgatcgcctgctggtgcacttacaggtgatgaaccagcaactccaaaccaaggcaatggctttgctaactgctttacttcagggggcttcccctgtggagaggaaacatatgctggattacctgtggcagcgaaatctcagacaattcatctacaagaatatcatccactcagcggctcctatgggagacgaaatggctcatcatctttatgtgcttcaagccctcatgctcgggctactggagcctcgcatgagaactccgctggacccatatagtcaagaacagcgcgaacagttgcaggtgctccgccaggctgcatttgaagtggagggggaatcgtctggggctggactctctgccgacaggcgtcgcagtctgtgcgcccgagagtttcggaaattgggattcagcaactctaacccagctcaggacctcgaaagggtgcctccaggcctgttagctctggataacatgctgtatttttccaggaatgcaccaagcgcctactctagattcgtattggagaattccagcagggaggacaagcatgagtgcccattcgccaggggaagcatccaactgacggttcttctctgtgagttgctgagggtgggtgagccatgcagcgagaccgcccaggacttttcccccatgttcttcggacaagaccagtcctttcacgagttgttttgtgtcggcattcagctgttaaacaaaacatggaaggagatgcgtgccacccaagaagattttgacaaagtcatgcaggtcgtgcgcgaacagctagccagaaccctggctttaaagccaacgagcctggaactgttcagaaccaaagtcaacgcactgacttacggcgaagtccttcgcctaagacagacagagcggctgcaccaggaaggcacccttgccccacctattctggagctacgtgaaaagctgaaacctgaactgatggggctcatcaggcaacagagactgctgagactctgtgaagggaccctctttaggaagatctcctctcgccgtcggcaagataaactgtggttctgctgtttatcccctaatcacaaattattgcaatacggcgatatggaagagggcgcatccccaccaacgctcgagagccttcctgagcagttgcctgtagcagacatgcgggctctgttgacaggcaaggactgtcctcacgtgagggagaagggaagtggcaaacagaataaggacctctatgaactagcgttttccatctcgtatgatcggggtgaggaagaagcatatttgaacttcatcgcaccctctaaacgggagttctacctgtggaccgacggcctaagcgcattgcttggtagccctatgggttccgagcaaacacgcctggatcttgaacagctgctgaccatggagaccaagctccgccttctcgagctggaaaacgtccccatcccagagaggcccccacctgtcccaccccctcctacaaactttaacttctgttacgattgtagcattgctgagccatag

SEQ ID NO: 222000 - DNA, 2511 bp, Artificial Sequence
  Description of Artificial Sequence: Synthetic coding sequence
atgtccaagctgagctttcgcgcacgcgcactcgacgcatctaaacctctgccagttttcaggtgtgaggacctccccgacttacacgaatatgcaagcattaatcgtgctgtccctcagatgcccacaggtatggaaaaagaagaagagtctgagcatcacctccagcgggcaatttctgcacagcaggtttatggtgaaaaaagggataatatggttattccagtgccagaagcagaaagcaacatagcctattatgaaagcatataccctggcgaatttaagatgcccaagcagttgatacacatccagccatttagcttagatgccgagcagcccgactatgaccttgattcagaagacgaggttttcgtgaataaactaaagaaaaagatggatatctgcccccttcagttcgaggagatgattgatcgacttgagaaagggtccggacagcagcctgtgtcgctgcaggaagccaaattgctcttgaaggaggatgatgagctgatcagagaggtgtacgaatattggatcaaaaaacgcaaaaattgtcgaggcccaagtttaatcccttccgttaagcaggagaaacgggatggcagcagcacaaatgacccctacgtggcctttcgacggaggacagaaaagatgcagacgagaaaaaatcgaaagaacgatgaggcctcatacgaaaagatgcttaaactgcgcagggacctctcacgtgcagttacaatccttgaaatgattaagcggagagagaagagcaaaagagaactcttacaccttaccctggaaattatggaaaaaagatacaacctgggcgattacaatggtgagatcatgtctgaagtaatggcccagagacagcccatgaagcccacgtatgctatccccataatccccatcaccaacagtagccaatttaaacatcaggaggctatggatgtgaaggagtttaaagtcaacaagcaggacaaagcagatctgatcagaccaaagcgcaagtacgaaaaaaagcctaaggtgctcccctcctccgcagctgccacccctcagcaaaccagccctgcagctctcccagtattcaatgccaaggatctgaaccaatacgattttccctcatcagatgaggagcctctgtctcaagtgttaagcggatccagcgaggcagaagaggacaatgatccagacggcccattcgctttcagaaggaaagcaggatgccagtattacgctccacaccttgatcaaacgggaaactggccatggactagccccaaggacggaggactgggagacgtgcggtatagatattgcttgactactcttacggtgccacagcggtgcattggttttgcacggcgaagggttggacggggaggcagagttctgcttgatcgcgctcatagcgactacgacagcgtgtttcatcacctggatctcgagatgctcagcagcccacagcactcccccgttaatcagtttgcgaataccagcgagacaaatacatctgacaaatcatttagtaaggatttatcacagatcctggttaatatcaaaagttgtcggtggcgacatttccgtccacgcaccccatctctgcacgactctgataacgacgaactgtcttgtaggaaattgtaccgttccatcaaccgaacaggcacagctcagcccggaacccagacctgctccacatctacacagagcaaatcctcctctggtagcgcccatttcgccttcacagcagagcagtatcaacagcatcaacagcagttagcactcatgcagaagcagcaactggcccagattcagcagcagcaagcaaattccaactcttccaccaataccagccaaaacctggcttccaaccagcaaaagtctggcttccgcctgaacattcagggactggaacgcactctgcaaggattcgtgtcaaagaccttggactccgccagcgctcagttcgcagcaagtgcactggtgactagtgagcaactgatgggtttcaagatgaaggacgacgtggtattaggcataggcgtcaatggcgtgcttcctgcttccggcgtttacaaaggtttgcacctctcaagtacgacgcctaccgctttagtccacacgagcccatccacggccggtagtgcacttctacagccttcaaatataacacagactagtagcagccactcagcgctgtctcaccaagtgaccgccgctaattcagccaccactcaagtgctgatcggaaacaacattcgactgaccgttcctagctctgtggctacggttaattccatagcgcctattaatgctaggcatatccccaggacgttaagcgcagtgccatcatcagccttaaaattagccgctgctgccaactgccaagtgagcaaagtaccctcctctagcagtgtggattccgtgccaagagagaaccacgagagcgagaagccagccctaaacaatatcgccgacaataccgtagcaatggaagtgacatag

SEQ ID NO: 222001 - DNA, 2442 bp, Artificial Sequence
  Description of Artificial Sequence: Synthetic coding sequence
atgtcaaaactcagttttcgggctcgcgctctcgatgcctctaagccacttcccgtgttccgatgcgaggatctgccagacctccacgaatatgcctcaatcaatcgagccgtaccccaaatgcccactgggatggaaaaggaggaagagtctgagcatcacctgcagagagctatctctgcacagcaagtgtacggagagaaacgcgacaacatggtgattccggtgcctgaggctgagtcaaatatcgcctactatgagagtatatatccaggagagtttaagatgccaaaacagctaatccacattcagcccttctctcttgacgcggagcagccagactatgatctggacagcgaagatgaggtgtttgtgaataagctaaaaaagaagatggacatctgtcccctccagtttgaggagatgatcgatcgcctcgaaaagggcagtgggcaacaaccagtcagtctgcaggaggccaaattgctgttaaaagaggacgacgaactcattcgtgaggtttacgaatactggatcaaaaaacgcaaaaactgccggggtcccagcctaataccttccgtgaagcaagagaagagggacggttcctctaccaatgatccatacgtggccttccgacgacgcaccgagaaaatgcagacaaggaagaatcggaagaacgatgaggcctcttatgaaaaaatgcttaaactgcgtcgcgacctgagcagggcagtgaccattttggagatgattaagaggagggagaagtccaaacgtgaattgttgcacctcaccctggagatcatggaaaaacgatacaatctcggggattacaatggtgaaataatgtcagaggttatggcgcagaggcagcccatgaagccaacatatgcaatccctataatccccatcacaaactccagtcagtttaaacaccaggaagccatggacgtcaaggagtttaaagttaataaacaggacaaagcggatctaataaggcccaaacgcaaatacgagaagaaaccaaaagtgctgccttcgtcggcagccgcaacaccgcagcagacgtcccctgcggcactccctgtgtttaacgctaaagatctgaaccaatatgatttcccctcctctgatgaggagccactgagtcaggttctcagcggtagtagtgaagcggaagaagacaatgatcctgacggcccatttgcctttcggagaaaagccggttgtcaatactacgcccctcatctggaccagacgggtaactggccctggaccagccctaaggatggaggtctgggagacgtgcgatatcgctactgtctgacaaccctcaccgtacctcagcggtgcataggcttcgctcgaagaagggtcggacgcggtggacgcgtgctgttagatcgcgctcacagtgattatgatagcgtgtttcaccatctggacctagagatgttgagcagcccacagcactcccctgtgaaccagttcgcgaacacgtctgagaccaacacctccgacaaatcctttagcaaggacttatcccaaatcttggtgaacataaagagctgccggtggaggcacttccgtccccgaacaccaagtctccacgattccgataatgatgagctatcttgccgcaaactctaccggtcaatcaatagaaccggcaccgctcaaccaggcacccagacctgcagtacatccactcagtctaagagcagttccgggagcgctcatttcgctttcaccgctgagcagtaccagcaacaccagcaacagttggctcttatgcaaaagcagcagttagcacaaatccagcagcagcaggctaactccaatagcagcacaaatacaagccagggcttcgtcagtaaaacgttagactcagcctccgcgcagttcgccgcttccgctcttgtgacatcagagcagctcatgggatttaaaatgaaggacgacgtggtgctgggcataggggtgaatggagtgcttccagcatccggcgtgtataagggtcttcatctgtccagcactacacctacagctttggttcacacgtccccctccacagcgggttcagccttgcttcagcctagcaatatcacgcagacaagctcttctcactctgcgttaagtcaccaggtaactgcagctaactcggctacaacccaggtgctgataggcaacaatatcagactcaccgtgccgagctccgtggcaacagttaatagtatagcaccaatcaacgccaggcacataccacggacactgagcgctgtgcccagctccgccctcaaacttgcagcggcagctaactgtcaggtctccaaggtgccttcttcctcatctgtcgatagcgttcctcgtgaaaatcatgaatcggaaaaaccagcattgaacaatattgccgataacactgtggcaatggaggtgacttag

SEQ ID NO: 222002 - DNA, 2292 bp, Artificial Sequence
  Description of Artificial Sequence: Synthetic coding sequence
atggaacatcacctgcaaagagcgataagcgctcagcaggtttacggcgaaaagagagacaacatggtcatcccagtgccagaggccgaaagcaacatcgcctactatgaaagcatctaccctggagagtttaagatgccaaagcagctgatccatatccagcccttttcacttgacgctgagcagccggactacgacctggattcggaagacgaggtcttcgtcaacaagcttaagaagaagatggatatatgcccactgcaatttgaggagatgattgaccgcctggaaaagggttcaggccagcaacctgtgtcacttcaagaagctaaactcctgttgaaagaggatgacgagctcataagagaggtgtatgagtattggattaagaagagaaagaattgtaggggccctagcctgattccaagcgtaaaacaggagaagagggatggctctagcaccaatgacccatacgtggctttccgcagacggacagaaaagatgcagaccagaaaaaatcgaaagaacgacgaggcttcttacgaaaagatgcttaagctgcggagagatctttctagggcagtgactattctggagatgattaaacgcagggagaaaagcaaaagggagcttctgcacctgacacttgaaatcatggaaaagaggtataaccttggcgactataatggcgagatcatgtccgaggtgatggcccaaagacagcccatgaagccaacatatgctatccccatcattcctatcacaaattctagtcagttcaagcaccaggaagcaatggacgttaaggaatttaaagtgaataaacaggacaaggcggacctgattaggccaaagaggaaatacgagaagaaaccgaaggtgttaccctccagtgcggctgccaccccacagcagacaagccctgccgctctgccagtattcaatgcaaaggatctgaaccagtacgacttccctagttccgacgaagagccactgagtcaggttctcagcgggtcctcagaagcggaggaagacaacgatcctgacggaccttttgctttcaggagaaaggccggatgtcaatattatgccccacacctcgatcagactggtaattggccttggacaagtccaaaggatggaggactaggggatgttcggtatcggtactgtctgaccactctcactgtgccccaacgctgcatcggcttcgctcgcagaagggtgggaagagggggtcgcgtgctcctggaccgcgctcattccgactacgatagtgtatttcatcatctagatctggaaatgctgagttctcctcagcattctcctgtgaaccagttcgcaaatactagtgagaccaacaccagcgacaaatcattctctaaagacctgagtcagattctcgttaatataaagtcctgccgctggaggcacttcagacctcgcacacccagtttgcacgattctgataacgatgaattgtcgtgtcgtaagttgtatagatccataaacagaacggggacagctcagcccggaacacagacctgcagtacgtccacgcagagtaaaagcagttctggcagcgcgcactttgctttcacagcagaacagtaccaacaacatcagcagcagctggcactgatgcaaaagcagcaactggcccagattcagcaacagcaggccaattctaatagtagcactaatacctcgcagggctttgtgagtaagactttagattctgcctctgcgcaatttgctgcttcggctttggtcacatcagaacagcttatgggcttcaagatgaaagatgatgtagttctgggtatcggagttaacggagtgttgccagcctccggagtctacaagggcctgcacctcagttccaccaccccaaccgcccttgtccatacatccccaagtactgccggaagtgccctcctgcagccttccaacatcactcagacttctagctctcattccgctctaagccaccaggtgacggccgcaaattccgccaccacccaggtgctcatcggaaataacatcagactcacagtccctagtagtgtggcgaccgtcaacagcattgccccaatcaatgccagacacatcccacggacgttgagcgccgtcccttcctccgcattaaagctcgcagcagccgcaaattgccaagtctcaaaggtgccctcaagtagctccgtcgatagtgtaccgagagaaaaccacgaatccgaaaaacccgcattgaacaatattgcagacaacactgtagcgatggaggtgacttag

SEQ ID NO: 222003 - DNA, 2424 bp, Artificial Sequence
  Description of Artificial Sequence: Synthetic coding sequence
atgagcaagctgtccttccgagctagggcactagacgccgcaaaaccgctgcccatttatcgcggaaaggatatgcctgacctaaacgattgcgtgtctatcaatagagcagttccacaaatgcctaccgggatggaaaaagaagaagaatcggagcaccacctccagcgggcaatttccgcccagcaagttttccgcgagaagaaggaatcaatggtcattccagtgccagaagctgaatccaacgtcaattattacaacaggctgtacaaaggggagttcaaacaacccaaacaatttatccacatacagcccttcaatttggacaatgagcagcccgattatgacatggacagcgaagatgagactctgttaaatcgtttaaatagaaaaatggaaataaagcctctacagtttgaaatcatgattgacagactggagaaagctagtagcaatcagctggtgaccctgcaggaagcaaaactgctgctcaatgaagacgattatctcattaaagcagtttatgactactgggtgcgcaaacgcaagaattgccgtggcccatcactgatccctcaaatcaagcaagagaaacgtgatgggtccacaaacaatgacccctacgtggcctttcgccgacgaacggaaaagatgcaaacaagaaaaaatagaaagaatgatgaggcttcctacgaaaaaatgttgaagctccggagagagtttagcagagcgataactattttagaaatgatcaaaagaagagaaaagactaaaagagagctgctccacttaacactcgaagtggtggaaaaacgataccacctcggtgattacggcggagagattctgaatgaagtcaagatttctaggagcgaaaaggagctttacgcaacccctgctactttgcacaatggcaatcatcacaaagtacaggagtgcaagaccaaacatccccaccatttaagtctcaaggaggaggctagtgacgtagtgcgacagaagaaaaaatacccaaaaaagcccaaggctgaggctttgattacctcccagcaaccaacaccggaaaccctcccggtcatcaacaaatcagacatcaaacagtacgactttcacagtagcgacgaggatgagtttccacaagtgctcagcccggtctctgaacccgaagaagaaaatgaccccgacggcccatgcgcgttccgtcgacgagcaggctgccagtattacgccccaaggttagaccaggccaaccactcctgtgagaattcagagctcgcagacttggataagctaaggtacagacattgccttaccactttaaccgtcccaagaagatgcattggctttgcaagaagacgtattgggagggggggtagggtgatcatggacaggatcagtacagaacacgaccccgtgttgaaacaaatcgacccagagatgctcaactctttctcctcctccagtcagacaatagacttttcttctaatttctctcggactaacgcaagctctaagcactgtgaaaatagattatctctctccgagattctgtccaatatacgatcttgcagacttcagtgctttcagccaaggttgctaaacctgcaagactccgactcggaagagtgcacatcccgcaagcccggacagaccgtgaacaacaaacgggtgagcgccgcatcagtggccctgctaaacaccagtaaaaacggcatcagtgttacgggcggaattacggaggagcagtttcagacacatcagcagcagctggtccagatgcaacgccaacagttggctcagttgcagcaaaagcagcagtctcaacattccagtcagcaaacgcaccctaaagctcaaggatcatctacttcagactgtatgtcaaagacacttgacagcgcctccgctcatttcgctgcatctgcagtagtttctgccccagtgccctctaggtccgaagtcgccaaggagcagaataccggccacaacaacataaatggcgtggtccagccaagcgggaccagtaagaccctgtactctactaatatggcattatcctcttcacccggtatttccgccgtgcagctggtgagaactgttggacacaccaccacaaatcacttaataccagcactgtgcacctcaagtccacaaacgctccctatgaacaatagttgtcttactaacgcagtgcacctgaataatgtttccgtggtgtcccccgttaatgttcatattaacacccggacttctgccccaagtcctaccgcactgaagttggccactgtggcggctagtatggaccgcgttcctaaagtcaccccttcatctgccatatcctctatcgccagggaaaaccacgagccagagcggttaggtttaaatggtatagctgaaaccacggtggctatggaagtaacctag

SEQ ID NO: 222004 - DNA, 315 bp, Artificial Sequence
  Description of Artificial Sequence: Synthetic coding sequence
atgagccacacaatcttactggtgcagcccactaagcggccagagggcaggacatacgctgactacgaatcagtcaatgagtgcatggaaggtgtgtgcaagatgtacgaagagcacctgaagaggatgaacccaaattccccctcaatcacctacgatatatctcagctgttcgactttattgatgacttagctgatctatcttgtctggtgtatcgtgccgatactcagacttatcaaccatacaataaagattggataaaggagaaaatctatgttttactgcggagacaggcacagcaggccggtaaatag

SEQ ID NO: 222005 - DNA, 2253 bp, Artificial Sequence
  Description of Artificial Sequence: Synthetic coding sequence
tactctaagatggagattcctaatccccctacctcaaagtgcattacatactggaagagaaaggtcaaatcagaatatatgaggctgcgtcaactcaaacgactacaggctaacatgggcgcaaaagcgctgtatgtcgccaacttcgcaaaggtgcaggaaaaaactcaaattcttaacgaggagtggaaaaagctcagggtccagcccgtgcagagcatgaaacctgtctcaggccatccatttttgaaaaaatgtactatcgagtcaatcttccctgggtttgcttcacagcacatgttgatgagaagtctcaatactgttgcgctcgtgcccattatgtattcatggtcacctttgcagcagaattttatggtggaggacgagactgtcctctgcaatataccatatatgggagacgaggtcaaggaggaagatgaaacctttattgaagagctgatcaataattacgatggtaaggtgcatggcgaggaagaaatgatccccggttctgtgttgatttccgacgctgtgtttttagagcttgtggatgctctgaatcagtactcagatgaggaagaagagggccacaacgacacgtccgacgggaagcaggatgattctaaggaagatctgcctgtgacccgcaaaagaaaacgtcatgccatagaggggaataagaagtcatctaagaagcagttcccaaatgacatgatcttctctgccattgccagcatgtttccagaaaacggggtgccagatgatatgaaggaacgctatcgggagctgaccgaaatgtcggacccaaatgctctgcccccacagtgcaccccaaacattgacggtcctaacgcaaagtcggtgcagagagagcaaagtctccattctttccacacactcttttgcagaaggtgttttaagtatgattgcttcttacacccgttccatgccacccccaacgtttacaagcgcaaaaataaagagatcaagatcgagcccgaaccatgtggtactgattgctttctgttgctcgagggtgctaaggagtacgccatgctacataaccccaggtccaaatgctctggccgtcgacggagacgccaccatattgtgtccgcttcatgctccaatgcctccgcctccgcggtggctgagacaaaggaaggagactccgaccgtgataccggtaatgattgggcaagctctagcagtgaagctaacagtcgctgccaaacccccacgaagcagaaggctagcccagcccctcctcagttgtgcgtagttgaggctccttcagagccagtagagtggacaggtgctgaggaatcactatttagggtttttcacggcacatactttaataacttctgctctatcgcgcgtctgctggggactaagacatgtaagcaggtgttccagtttgcagtgaaagagtccttgattctgaagcttcccacagatgagctcatgaatccctcccagaaaaagaagcgaaaacaccgactgtgggctgctcactgtaggaaaatccagcttaaaaaggacaacagtagcacgcaagtctacaactaccagccatgtgaccacccagaccggccttgcgactccacctgtccgtgtattatgactcagaatttttgtgagaaattctgtcagtgcaaccccgactgccaaaaccgtttcccaggctgccggtgcaaaacgcaatgcaatacaaaacagtgtccatgttatctggctgttagggagtgtgatcctgacctgtgcctgacatgtggagcctcagaacactgggactgtaaagtggtgtcctgcaaaaactgctcaatccaaagaggcttgaagaaacatcttcttttggcaccctcagatgtcgcaggatgggggaccttcattaaggaatccgtgcaaaagaacgagtttatctctgaatattgtggcgagctgatctcccaggacgaggcggaccgcaggggcaaggtttacgataagtacatgtctagtttcttgttcaacttaaacaacgactttgtggtggacgccacacgtaaggggaacaaaatccgcttcgccaatcatagtgtcaatcccaattgctacgctaaagtggtgatggtgaatggcgaccatagaattggcatctttgcgaagagggccatccaagcgggagaagagctgttctttgactaccgctatagtcaggccgacgcattgaagtatgtcggaattgaacgggaaactgatgtgctctag

SEQ ID NO: 222006 - DNA, 2124 bp, Artificial Sequence
  Description of Artificial Sequence: Synthetic coding sequence
atggagattcctaaccccccaacttctaagtgcattacctattggaagcgaaaggttaagagtgagtacatgcggttaaggcagctgaaacggctccaggctaatatgggagccaaggcattgtatgttgctaacttcgctaaggtccaagagaagacccagatccttaacgaagaatggaagaagttacgagtgcagcctgtgcagtctatgaagccggtgagtggacacccgttcctcaagaaggtagaagacgaaactgtattgtgtaacataccttatatgggtgacgaagtgaaggaggaagacgagaccttcatcgaagagctgatcaacaattatgacggaaaggtgcatggggaggaagagatgatccctggctcagtgctcatcagcgacgcagtcttccttgagctcgtagatgccctgaatcagtatagtgacgaggaggaagaagggcataatgacactagtgatgggaaacaggacgacagtaaggaagatcttcctgtgacgagaaaaaggaaacggcatgcaatcgaggggaacaagaagagcagcaaaaagcaatttcccaacgacatgatttttagcgctattgcttccatgttccccgaaaacggcgtcccagatgacatgaaggagcggtaccgcgagctgactgagatgtcggatcccaatgcgttacctccacagtgcacccctaatatcgacggtccgaacgcgaagagtgtgcagagagaacagtctctccattccttccacactttgttttgtcggcgttgtttcaaatacgattgctttctgcacccttttcacgctacccccaacgtatacaagcgaaagaacaaagagattaaaatcgagccagaaccctgtggcaccgactgttttctgttgctggaaggagcaaaggagtacgctatgctgcataacccgagatccaagtgctccggcagacggcgacgcagacatcacatcgtgtctgcatcatgctccaatgcttctgcttctgccgtcgcagagaccaaggaaggtgactcagacagagacacgggtaatgactgggccagttcctccagcgaggcgaatagccggtgtcagacaccaaccaagcagaaggctagccctgcccctccacagctgtgcgtggtcgaagccccttccgaacccgtggaatggactggtgccgaggagtccctgtttcgggtgtttcacggcacctatttcaataatttctgttctatagcacgactcctcggcaccaagacctgcaagcaagtttttcagtttgccgttaaagaatccttaatcctcaagctgcctaccgatgagctcatgaacccttcccagaagaaaaaaaggaagcatagactgtgggcagcacactgccggaagattcagcttaagaaggataactcaagcactcaggtgtataattaccagccttgtgatcatccagatcgtccatgcgatagtacttgcccctgtattatgacacagaatttctgcgagaagttctgccagtgtaaccccgattgccagaatagattcccaggctgtcggtgcaagactcagtgtaatacaaagcagtgtccttgctacctcgccgtgagggagtgcgaccctgatctttgcctgacctgcggggcttcggaacactgggattgtaaggtggtcagctgcaagaattgttcgattcagagaggcctgaaaaaacacttgctccttgcaccaagtgatgtggcaggctgggggaccttcataaaagaaagtgtacagaagaatgagtttatttctgagtattgtggagagctcattagtcaagatgaggctgaccggaggggaaaagtttatgataaatacatgtcctcattcctgtttaatctgaacaacgactttgttgtggacgcaactagaaagggaaacaagattcgatttgcaaatcactcggttaatccaaactgctacgccaaagttgtcatggttaatggggatcatcgtatcggcatcttcgcaaagcgggctatccaagcaggagaggaactgttcttcgactaccggtatagtcaagccgatgccctgaaatatgttggtatcgaacgggagaccgatgtgctgtag

SEQ ID NO: 222007 - DNA, 2244 bp, Artificial Sequence
  Description of Artificial Sequence: Synthetic coding sequence
atggaaattcccaaccctcctacttccaagtgtataacatattggaagagaaaagtcaaaagcgagtacatgaggctccgccaattgaaaagattgcaggccaatatgggtgctaaagccctttacgtggcgaacttcgccaaggtgcaagaaaaaactcagatactgaatgaagaatggaaaaaactccgcgtacagcctgtgcagtccatgaaaccagtgtcggggcacccctttctgaagaaatgtactatcgagtcaatcttcccgggatttgcatctcaacatatgctgatgagaagcctcaatacagttgccctggtgcctatcatgtattcttggtcgcctttacagcaaaactttatggtggaagatgagacagttctttgcaacatcccctacatgggcgacgaagtcaaagaagaagatgaaacattcatcgaagagttaatcaataattatgacggtaaggtgcatggtgaggaggagatgatccccggaagcgtcctgattagcgatgccgtctttctcgagctggtggatgccctcaaccagtattcagacgaagaagaggaaggccataatgacacaagtgacggcaaacaggatgacagcaaagaggacttgcccgtcaccagaaagcgcaagcgacatgctatagaggggaacaaaaaaagctcaaaaaaacagttcccgaacgatatgatcttcagcgcaattgctagcatgttccccgaaaacggcgtgccagacgatatgaaagagaggtaccgggaactgacagagatgagcgatccaaacgccctcccacctcaatgcacccccaacatcgacggcccaaatgccaagagtgtgcagcgagagcaatcactccacagtttccacacactcttctgccggaggtgttttaagtacgactgcttcctgcatccctttcatgccacccccaacgtgtacaagcggaaaaacaaggaaatcaagatcgagcctgaaccttgtggaaccgattgtttccttctgctggagggagccaaagaatacgccatgctccacaacccgagatcgaagtgtagcggacggagaaggagacgtcaccacatagtcagtgcttcatgttccaatgcttctgcctcggctgtggcagagaccaaggagggcgacagcgatcgcgataccggcaacgactgggcctcatcctcctccgaggctaactccagatgccaaactcctactaaacagaaggcatctccagctccacctcaactctgcgtggttgaagctccttcagagccggtagagtggaccggcgctgaggaaagtctgtttagggttttccatgggacctatttcaacaatttttgttccatcgccagactgctgggtacaaagacctgcaagcaggtctttcagttcgcagtgaaggagagtctgattttaaagcttcctaccgacgagctgatgaaccctagtcagaagaagaagagaaaacataggctgtgggcggcacactgccgtaaaatccagttgaagaaggataactcctctacgcaagtgtacaactatcagccctgcgaccatccggaccgaccctgcgatagcacctgtccatgtatcatgacgcagaatttttgtgaaaaattctgtcaatgcaatcctgattgtcagaatcggttccctgggtgcagatgtaagactcaatgtaacaccaagcagtgcccatgttatctggctgtacgcgagtgtgatcctgacctctgtctcacttgtggcgctagcgagcattgggactgtaaggtggtgtcttgtaaaaactgcagtattcagcgcggattgaaaaaacatctcctcctggccccttctgatgtggccggttgggggacatttatcaaagagagtgtacaaaaaaacgaattcatctctgagtattgcggcgagctgataagtcaagacgaggctgatcgcaggggaaaagtctatgacaagtatatgagttcctttctgttcaatctcaacaatgacttcgtggtggatgcgactaggaaaggtaacaagattcgttttgctaaccattccgtgaacccaaattgctacgccaaagtggtcatggtgaatggcgaccatagaattggaatctttgcgaagcgggctatccaggctggcgaagaactcttcttcgattataggtacagccaggccgacgcccttaagtacgtcggcattgaaagggagacagatgtcctgtag

SEQ ID NO: 222008 - DNA, 1827 bp, Artificial Sequence
  Description of Artificial Sequence: Synthetic coding sequence
atggaagaggcttcatgcccaacttgctctgttaacgaggcctgcgagtggactccttttagccagaaggaaatgatcccaggcagcgtgctcatcagcgacgcggtatttttggagttggtggacgcacttaatcagtactccgacgaagaagaagagggacataacgacacgagcgatggtaaacaggacgactctaaagaagacttaccagttacccgtaaaaggaagcgccatgccatcgagggcaataaaaaaagttctaagaaacagtttcccaacgacatgatcttttctgctatcgcaagtatgtttccagagaatggcgtgcctgatgatatgaaagagagatatcgcgaattgaccgaaatgagcgatcctaatgctttgcctcctcagtgcacccctaacatcgatgggcctaatgccaaatccgtgcagcgcgaacaatctctgcattcctttcacacgctcttttgccgcaggtgctttaagtacgattgcttcctacacccttttcacgcgacaccgaacgtctacaaaagaaagaataaagagattaagattgaaccagagccctgtggcacagattgctttcttttgctcgagggtgccaaagagtacgcgatgctccacaaccctcgttctaagtgcagcgggcgtaggcgacgcagacatcacatcgtgtccgccagctgtagcaatgcttcagccagtgccgtggctgagactaaagagggagactccgaccgcgacactggaaatgattgggcttcctcttcttcagaagccaacagcaggtgtcagacccctaccaagcagaaggccagcccggcaccaccacaactctgcgttgttgaggctccctcggaaccagtagaatggacaggcgcagaagagtctcttttcagagtgtttcacggcacctatttcaacaacttttgtagtatagcaaggctgttgggaacaaaaacctgcaaacaggtgttccagtttgccgtgaaggaaagcctgatactgaaactgccaacagatgaactgatgaacccttctcaaaaaaaaaaacgcaagcatcgattatgggcagcgcactgtcggaagattcagctcaaaaaggacaactcctcaacacaggtctataattatcagccgtgtgatcaccctgacagaccctgcgactccacctgcccctgtatcatgacccaaaacttttgcgaaaaattttgtcagtgtaacccagactgccagaacaggtttcccggatgtcggtgcaaaacgcagtgcaataccaagcaatgcccctgttacctggccgttcgcgagtgcgatcctgatctttgtcttacatgcggcgcttcagaacattgggattgcaaggtagtttcctgcaagaactgctcgattcagcgcggactcaagaagcacctgctgctggcccctagtgatgtagcaggctggggtacctttattaaagaaagcgtgcaaaagaatgagttcatttccgaatactgtggagagttaatcagccaggatgaggctgataggcggggaaaagtatatgataagtacatgagctcgtttctgtttaacctgaacaacgactttgttgttgacgccacccgtaagggcaataaaatccgctttgccaatcatagcgttaacccaaactgctatgcaaaagtggtgatggtgaacggagatcatcgtatcgggatttttgctaaacgggcaatccaggctggcgaagagctttttttcgattacaggtactcgcaggccgacgccctgaaatacgtgggcatcgagcgcgagactgatgtgctgtag

SEQ ID NO: 222009 - DNA, 2256 bp, Artificial Sequence
  Description of Artificial Sequence: Synthetic coding sequence
atgggccagacaggtaagaagtccgagaaaggacctgtttgttggaggaaacgagtgaaatcggagtacatgcgactgcgacagctgaaacgattccggagggccgatgaggtcaagtctatgttttcctccaacagacaaaaaatactcgaaagaactgagattctcaaccaggagtggaagcagcgtaggatccagccagtacatatcctaacttctgtgtctagcctaaggggcactcgggaatgctccgtcacctcggacctggactttccgacccaagtgataccgctgaaaacactcaacgcagtcgctagtgtgcctattatgtacagctggtcacccttgcagcagaattttatggttgaggatgagaccgtgttacataacattccatacatgggagacgaagttctggatcaggatggtacattcattgaagagctgatcaaaaactatgacgggaaggtccacggagatcgagaatgcggtttcatcaatgatgagatcttcgtagagctcgtgaacgcccttggccaatacaacgacgacgatgatgacgatgacggagatgacccagaagagagagaagaaaaacagaaagatcttgaagaccacagagatgacaaggaaagccggccacccaggaagttcccaagtgataaaatctttgaggccatttcatccatgtttccagataaaggcacagccgaggaactgaaggaaaagtacaaggaactgactgagcagcaactcccaggagcactgccacccgagtgtacccctaacattgatgggccaaatgcaaaatccgtccagcgggagcagagtctccatagcttccacactcttttttgccgcaggtgcttcaagtacgactgtttccttcatcgaaaatgcaactactcttttcatgccactccgaacacttacaaaagaaaaaatactgagaccgcccttgacaacaaaccttgcggcccacagtgctaccagcacctggaaggcgcaaaagagtttgccgcagctttgacagcagaaagaattaaaaccccacccaagcggcctggcggaagacgcagaggccgactgcccaacaactcctcaaggccaagcaccccaacaattaacgtgcttgaatcaaaggacacagattcggacagggaagcaggaaccgaaacaggcggtgaaaataacgataaagaagaggaggagaagaaggatgaaacctccagcagtagtgaagccaatagtcgctgccagacacccataaagatgaagccaaacattgagcctcctgagaatgtcgagtggtctggggcagaggcatctatgttccgcgtgctcataggcacgtattatgataacttttgtgctatcgcgcgactgatcggaacaaagacgtgccgccaggtctatgagtttcgcgtgaaagagagttcaatcatcgcccctgctccagctgaagacgtagatacccctcccaggaagaaaaaaagaaaacatcggctgtgggccgcacattgcagaaaaattcagttaaagaaggacggatcatccaatcacgtttacaactatcagccctgcgaccacccgcgacagccttgtgactctagttgcccctgtgtcatagctcagaatttttgtgaaaaattctgccagtgcagcagcgagtgccagaaccgcttcccgggatgtaggtgcaaggcacaatgcaatacgaaacagtgtccatgctacctggccgtgagagaatgtgatcccgatctttgtctcacctgtggggctgctgaccattgggactccaagaacgtgtcctgcaagaactgctccattcaacggggttccaagaagcacttgctgctagccccaagtgacgtggccggatggggcattttcattaaggaccctgtgcaaaagaatgagtttatctcagaatattgcggcgaaataatctcccaggatgaggctgaccgacgcggaaaagtgtatgacaagtacatgtgctcattcctgtttaaccttaataatgatttcgttgtggacgccactaggaaaggcaacaaaattagattcgccaatcatagcgtgaaccccaattgctacgcaaaagtaatgatggtgaatggggaccatagaatcggaattttcgcaaaaagggccattcagacgggggaggagttgttcttcgattaccggtatagccaagccgacgctctgaagtacgttggaattgagagagaaatggaaattccttag

SEQ ID NO: 222010 - DNA, 2124 bp, Artificial Sequence
  Description of Artificial Sequence: Synthetic coding sequence
atgggccagacaggcaaaaaatccgaaaaggggccagtgtgctggcgtaaaagggtgaaaagtgaatatatgcgcctgagacagctcaaacggtttcgaagggccgacgaggtcaagtctatgttctcatctaatcgtcagaaaatattggaacggaccgaaatcctgaaccaggaatggaagcaacggaggattcagccggtgcacattttgacctcagtttcctctctccgaggaacacgagaagtggaagacgaaacagtcctccacaatattccctacatgggcgatgaggtgttggaccaggacggcacgttcatcgaggaacttatcaagaattacgacggtaaagtacacggagacagggagtgcggcttcattaatgatgaaattttcgtggagctggtgaatgccctgggccagtacaacgatgacgatgatgatgacgatggggatgatccagaggaaagagaagaaaagcagaaggatctggaggaccatcgggacgataaggaatcccgtccccctaggaagtttccctctgataaaatcttcgaggcgatctcaagtatgttccctgataaaggaactgccgaggagctgaaggagaagtacaaggagctgaccgaacagcagttgccaggcgcattgcctcccgaatgcacacctaatattgatggccctaacgccaaatccgtgcaacgcgagcagagcctccacagctttcacacacttttctgtcgacgatgtttcaaatatgactgcttcctgcacccgttccacgccactcccaacacctacaaacggaagaacacggaaactgctctggataacaaaccatgcggccctcagtgttatcagcacttggagggtgcaaaagaattcgccgcagctttaacagcggaacggattaagaccccacctaaaagacctgggggtcggagacggggtagactcccaaataattctagccgaccctccacaccgaccattaacgtgctggagtcgaaagacactgacagtgacagagaggctggaacagagaccggcggagagaacaacgacaaagaggaagaagaaaagaaggatgagacaagtagcagctcagaggctaacagcaggtgtcagacacctataaagatgaagccaaacatcgaacccccagaaaacgttgagtggagcggggcagaagcctccatgtttcgagtattgatcgggacgtactatgataacttctgtgcgattgcgagactgattggaaccaagacctgccggcaagtgtacgagttccgagtgaaagagagcagcattatcgcgccagcacctgctgaggatgtcgacactcctccacggaagaaaaaacggaagcacagattgtgggctgctcactgtcgcaagatacagctcaagaaggacggctcctcgaatcacgtgtataattaccaaccctgtgatcaccctcgacaaccatgcgattcgtcttgtccgtgtgtgatcgcacagaacttttgcgaaaaattctgccagtgttcctccgaatgtcagaaccgtttccctggatgcaggtgtaaagctcagtgcaacaccaaacagtgtccttgttacctcgctgttcgcgagtgtgatcccgatctctgccttacatgcggggctgctgaccactgggatagcaaaaacgtgagctgcaagaattgttcaattcagcggggaagcaaaaaacacctgctcttggccccttcggatgttgccggatggggaatcttcatcaaagacccagtccagaagaacgaattcatttccgagtattgtggagagatcatctctcaagacgaagccgaccggagaggaaaagtgtacgacaaatatatgtgcagcttcctcttcaaccttaataatgattttgtcgttgacgctacccgtaaaggaaacaagatccgttttgctaatcatagtgttaatcctaactgctatgctaaggttatgatggttaacggcgatcaccgcattggtatattcgccaagcgcgcaatccaaacaggagaagaactcttctttgactaccgctatagtcaagcggacgccctgaaatatgtgggaatcgaacgtgaaatggaaattccttag

SEQ ID NO: 222011 - DNA, 2241 bp, Artificial Sequence
  Description of Artificial Sequence: Synthetic coding sequence
atgggccagacaggaaagaagtccgagaaggggccagtgtgttggcgaaagcgcgttaagtctgagtatatgagactcaggcagttgaagcgctttcgccgtgcagacgaagttaagagcatgttttccagcaatcggcagaagatactggagagaactgaaatcttaaatcaggagtggaagcagcgaaggatccagccggtccacattctcacaagcgtgtcaagcctcagagggaccagagaatgctccgtgacctcagacctggactttcctacacaagtcatcccactcaagacactgaacgcggttgccagcgttccgatcatgtacagctggagccccctgcaacagaacttcatggtggaggacgagacagtgctgcataatatcccatatatgggtgatgaggtgctggaccaagatgggactttcattgaggagttaattaaaaattacgatggcaaggtgcacggcgatagagagtgtggattcatcaacgatgaaatcttcgtcgagctggtgaacgcactggggcagtacaatgatgacgacgacgacgacgatggggacgatcctgaagaaagagaggagaaacagaaagatctcgaagaccacagggacgacaaagaaagtaggccccctaggaaatttccatctgacaaaatttttgaagcaatcagcagcatgtttcctgataagggcacagccgaagaactgaaggagaagtataaggagctgaccgagcagcagctgccaggtgccctaccgcctgagtgcacgccaaacatcgacggtccaaacgccaagagcgtgcagagagaacagagtctccattcatttcacacactgttttgtcgccgttgtttcaaatacgattgctttctgcacccattccacgccacccccaatacgtacaagcgaaaaaacaccgagacggcattagacaacaagccctgtggaccccagtgttaccagcatcttgagggtgcaaaggagtttgccgctgccttaactgccgagaggatcaagacgccacccaaacgccctgggggacgacggagagggaggcttccaaacaactccagcagacctagtacacccactattaacgtgctggaaagtaaggataccgatagtgatcgtgaggccggaactgagactggaggagagaacaatgataaggaggaggaggagaagaaggacgaaactagctcaagctcagaagcaaatagccgctgccaaacaccgatcaaaatgaaacctaacatcgagcctccagagaacgttgaatggtccggcgcagaggcttctatgttcagggtgctgattggaacctactacgataacttttgcgccattgccagattaattgggacgaagacgtgcagacaggtgtacgaatttcgtgtcaaggaatcgtctatcatcgcaccagcccctgcagaagatgttgacacacctccaagaaagaaaaagaggaaacatcgtctgtgggctgctcactgtcgaaagatccaactcaagaaagacggaagttccaaccatgtctacaactatcagccatgcgaccatcccaggcagccctgcgactcttcatgtccatgcgtcattgctcagaatttctgcgagaaattctgccagtgttcatctgagtgccagaaccggtttcctgggtgccggtgcaaagcgcagtgcaatacgaagcaatgtccatgttaccttgccgttcgcgaatgcgaccctgacctttgtcttacctgtggagctgccgaccactgggattccaagaatgtgtcctgcaagaattgttcaatccagcgcggatcaaagaagcacctcctacttgccccttccgatgtggcaggctggggaatctttatcaaagaccctgtccagaaaaacgagtttatttctgagtactgcggagagatcattagtcaggacgaggccgataggagggggaaggtgtatgacaagtacatgtgtagcttcttgttcaacctgaacaacgattttgtcgtggacgcaacacgcaagggcaataagattcgctttgcaaaccatagcgttaacccaaactgttacgctaaggtgatgatggtcaacggcgatcatcgcattgggatctttgccaagcgggctatacagacaggcgaggaattattcttcgactaccgctacagccaagcagacgctctgaagtatgtgggcatcgaacgcgagatggagatcccgtag

SEQ ID NO: 222012 - DNA, 678 bp, Artificial Sequence
  Description of Artificial Sequence: Synthetic coding sequence
atgtactcatggtcccctcttcagcaaaatttcatggtcgaggatgagactgttttgcacaatatcccatatatgggcgacgaagttctcgatcaggacggcacttttatcgaggaactgatcaaaaactatgacggcaaagtccacggggaccgggaatgcggtttcatcaacgatgagatcttcgtggagctggttaatgccctagggcaatacaacgatgacgatgatgacgacgatggagatgatccagaggagagagaggaaaaacagaaggatctagaagaccatcgggacgacaaagagtcgaggccccctcgcaagttcccaagtgataagatctttgaagcgatttcaagtatgttcccggacaaggggacggccgaggaattgaaggagaagtacaaggagctgactgagcagcagctgccaggcgctctgccccctgagtgcacacccaacattgacgggccaaacgccaagtcggtgcagcgggaacagtcactacattcatttcacactctgttctgtcgaagatgtttcaaatatgattgtttcctccacccattccacgcaaccccaaacacctataaacgcaagaacactgagacggcgctggacaacaaaccatgtggccctcagtgttaccagcatcttcccctcttgcccagaaattag

SEQ ID NO: 222013 - DNA, 2088 bp, Artificial Sequence
  Description of Artificial Sequence: Synthetic coding sequence
atgggtcagaccggcaagaaatccgagaagggtccagtgtgttggagaaagcgtgtgaaatctgagtacatgcggttgcgccagctgaagaggtttagaagagctgatgaagtaaaatccatgttctcaagtaacagacaaaagattctggagagaacagagatactcaatcaagaatggaaacagcgcaggattcagccggtgcacatcctcacctcttgctccgtgacctctgatctggactttccaacccaggttatccccctcaaaacacttaacgcggttgcctcagtaccaatcatgtattcttggagtccattgcaacagaacttcatggtcgaagatgagactgtactccacaatatcccctatatgggggatgaggttctcgatcaggacgggaccttcatagaggaacttatcaaaaattatgacggcaaggttcatggcgaccgcgagtgcgggttcatcaacgacgaaatctttgttgaactggtcaacgcactgggccagtacaacgatgacgacgatgatgacgatggagatgaccctgaggagcgcgaggaaaagcagaaagatctagaagaccaccgggacgacaaagagtctcgcccaccaaggaagttccctagcgataagatcttcgaagccatttcatctatgttccccgacaaaggcacagctgaggagcttaaggaaaaatacaaggagctgaccgagcaacagctgccgggtgccttacccccagaatgcacacccaacatcgatggcccaaacgccaagagcgtccaaagagagcagagcttgcactctttccacacactattctgtcgtcggtgttttaaatatgattgcttcctccatccgtttcacgcaacacccaatacctacaagagaaagaatactgagactgcgctggacaacaagccttgtggccctcaatgctaccaacatctggagggggctaaggaatttgctgccgcactgacagctgagagaataaaaactcctcctaaaaggccaggagggaggagacggggaaggctgccaaacaattcctctagaccaagcacgccgactataaatgtactggaatcaaaagacactgactcagacagggaagcgggaaccgagactggaggggagaataacgacaaagaagaggaagaaaaaaaggacgagacatccagctcttctgaggccaactcaaggtgtcagacgcctattaaaatgaagcctaatattgaacctcccgagaatgtcgagtggtcaggagccgaagcctccatgttccgagtgctaattgggacatactacgacaacttttgtgccatcgcccgactcatcggcactaagacatgcagacaggtatacgaattccgggtaaaggagtcaagtataatagcacctgctccggctgaagatgtggacacacctcccaggaaaaaaaagaggaagcatcgcctttgggctgctcattgtcgcaagattcagcttaagaaggggcagaatcgcttccctggctgcaggtgcaaagctcagtgcaacacgaagcagtgcccttgctacttggcagttcgtgaatgcgatcccgatctgtgtctgacctgcggagctgccgaccattgggactcgaagaatgtcagttgcaaaaattgctccattcagaggggtagcaaaaagcatttattgctggccccaagcgacgttgccggttggggcatttttatcaaagatcctgtgcagaagaatgagttcatctccgagtactgtggggaaatcatcagtcaggatgaagcagaccgccgtggcaaagtgtatgataagtatatgtgtagcttccttttcaaccttaacaatgactttgtcgtcgatgctacacgcaagggcaacaagattcgttttgcaaatcactccgtaaatcccaactgttatgctaaggtgatgatggtgaacggggaccacagaatcggcatctttgccaagcgtgccatccaaacaggcgaggaacttttcttcgattaccggtattcccaagccgacgcgctgaagtatgttggaatagagcgggaaatggagataccttag

SEQ ID NO: 222014 - DNA, 2088 bp, Artificial Sequence
  Description of Artificial Sequence: Synthetic coding sequence
atggggcaaacgggtaaaaaatccgaaaaaggaccagtgtgctggaggaaacgcgtaaaatcagagtatatgcgtttgcgacagcttaagcgctttcggagggcagatgaggtaaaaagtatgttttcgagtaaccgacagaaaatcctggaaaggactgaaattctaaaccaggaatggaaacagcgtcgcatccagccagtgcacatcctcacctcatgcagcgtgacctctgaccttgattttcccactcaggtcattccactcaaaaccctgaacgctgttgccagcgtgccaataatgtattcttggtctccccttcagcaaaacttcatggtcgaggacgagaccgtacttcacaatataccatacatgggagatgaagtgcttgatcaggacggcaccttcattgaggagttaatcaaaaactatgatgggaaagttcacggagaccgcgaatgtggattcattaatgatgaaattttcgtcgagcttgtgaatgcgctggggcagtacaatgacgacgatgacgatgacgacggtgatgacccagaagagagagaagagaagcaaaaggatctggaagatcaccgcgacgacaaagagtcccgccctccgaggaagttcccctctgataagatttttgaagcaatttcttccatgtttcccgataaaggaaccgcagaggagctgaaggaaaaatacaaagagctaaccgaacagcaactacccggtgccctgcccccagaatgcaccccaaatatcgatggcccaaatgccaaatccgtgcagcgcgagcagtctctgcactctttccacacactcttctgccggaggtgtttcaagtacgattgtttccttcacccttttcacgcgaccccgaacacgtataaacgcaaaaacactgaaacagctctggataataagccttgcggcccacagtgctaccaacaccttgaaggagcaaaagagttcgccgctgcactcactgctgaacggataaagacccctcctaagagaccgggaggcagaaggcgcggaagactgcccaacaatagttctaggcccagcacacctactataaatgtcttggagagcaaggatactgattcggaccgcgaggcaggcacggaaacagggggagaaaataatgataaggaggaagaggaaaagaaggatgagacatcatcgtcatcagaggccaatagccgctgccagaccccaatcaagatgaaacctaacatagagccacccgagaacgtcgagtggtccggagccgaggcatccatgtttagagtattgatcggaacctattacgataacttttgcgccatcgccaggcttatcggtaccaaaacgtgtcggcaagtgtacgagttccgagtgaaggagtctagtatcattgccccagctcccgcagaggacgtggacaccccgcctaggaagaagaaacggaaacacagattatgggccgcacattgccgaaaaatccaattaaaaaagggacagaacagattcccaggctgtcggtgcaaagcacagtgtaacaccaaacaatgcccctgttacctggctgttcgcgaatgtgatcctgatctgtgtctcacctgcggcgctgccgatcattgggattctaagaatgtttcatgtaaaaattgcagtatccagagaggctctaaaaaacatcttctcctggcgccttccgacgttgctggttggggtatctttattaaggatccggtccagaagaacgagtttatcagcgagtactgtggcgagatcatctctcaggacgaggccgacaggcgtggcaaagtttatgataaatacatgtgctcattcctgttcaacctgaataatgactttgtggtagacgccactcgaaaagggaacaagatacgctttgccaaccactctgttaaccctaactgctacgctaaagtgatgatggttaatggggaccatagaattggtatcttcgctaaacgcgctatccagaccggggaggagctcttcttcgactaccggtattcccaggctgatgctctgaagtacgtgggaattgagcgggaaatggagattccgtag

SEQ ID NO: 222015 - DNA, 2214 bp, Artificial Sequence
  Description of Artificial Sequence: Synthetic coding sequence
atgggccagactgggaaaaagtctgagaaaggtcccgtctgttggcgtaaaagggttaagtccgagtacatgaggctcagacagctgaaaaggttccgcagggctgatgaggtgaagagcatgttctcctccaataggcaaaagatcctcgagaggactgaaatcttaaatcaggaatggaaacagcgcagaattcagccagtgcacattctcacctcatgcagcgtgacatccgatcttgatttccccacccaggtcataccccttaaaaccctgaatgcggtcgcatccgtgcctatcatgtatagttggagccccctgcagcagaacttcatggtggaagatgagaccgttctgcacaatatcccctacatgggcgacgaagttctcgatcaagatggcaccttcattgaggagctgatcaaaaactatgacgggaaggtgcacggagatcgtgagtgcggattcatcaatgatgaaattttcgtggagctggtgaatgccctaggtcaatacaatgacgatgatgacgatgatgacggagacgatccagaagagagagaggaaaagcagaaagacttagaagaccacagagatgataaggaatcccgacctccccgtaagttccccagcgacaagatttttgaggctatcagctctatgtttccagacaaaggcacagctgaagaactcaaagaaaagtacaaagagctgacagagcaacaactgccaggcgctctcccacctgaatgtaccccaaatattgatgggccaaatgccaagtccgtgcagcgagagcaaagcctacacagcttccacacacttttctgccgccgttgttttaagtacgattgttttctgcatccctttcatgcgaccccaaatacctacaaaagaaagaatacagaaacagctcttgataacaagccttgcggcccacaatgctatcagcacctggagggcgctaaagagtttgccgcagcactcaccgccgaaaggatcaagaccccccctaaacgcccaggcggacggagacgagggcgactacctaataactccagcagacccagcaccccaacaataaatgtccttgagtctaaggacacggatagcgacagggaggctgggactgaaaccggcggagagaataacgacaaagaagaggaagagaaaaaagacgaaacctctagctcgagtgaagctaattcaagatgtcaaacccccattaagatgaaacccaatattgaacctccagagaatgtggaatggagtggagctgaggcgagcatgttccgtgtgttgatcgggacatactacgataatttctgcgcaatcgctagactgatcggcactaagacctgcaggcaagtgtacgagttcagggttaaggaatccagcatcattgccccagcccctgccgaggacgtcgacactcctcctcgtaagaagaaaaggaaacaccgcctgtgggctgcgcactgtaggaaaattcagctgaagaaggatggatcctctaaccatgtgtataactaccagccatgcgatcacccaaggcagccttgtgattcttcatgtccttgtgtcattgcacagaatttttgtgagaagttttgtcagtgcagctccgagtgccagaatcgttttcccggatgtcgctgtaaagcccagtgcaataccaagcagtgtccctgttatctcgctgtgcgggagtgcgatccagacctctgtctgacctgtggggctgcagatcattgggattcaaaaaatgtgtcttgcaagaattgcagtattcagcggggttcgaagaagcacctcttgcttgctccctctgatgtagccggttggggtatcttcattaaggacccagttcagaaaaacgaattcatttcggaatactgtggggagatcatctcacaggacgaggccgatcgacgtggaaaagtctatgataaatacatgtgctcctttctgttcaacctcaacaatgacttcgtggtagatgcgaccagaaaaggcaataagattaggttcgctaaccactccgttaacccaaactgttatgctaaagtgatgatggtcaacggcgatcatcgaatcggcatttttgctaagcgggcaatccaaaccggcgaagagctgttttttgattacagatattctcaggccgacgccctgaagtacgtcgggatcgagcgagagatggagattccctag

SEQ ID NO: 222016 - DNA, 939 bp, Artificial Sequence
  Description of Artificial Sequence: Synthetic coding sequence
atggccgcactttatgcctgcaccaagtgccaccaaaggtttccattcgaagctctgtctcagggacagcaactctgcaaggagtgtcgtattgcacatcccgtggtgaagtgcacctattgccggaccgaatatcagcaggagagactggaatgcaacgggactatttctgcacactgtaacctgcacctacctggaagctccgacagcccagcaagcagctcccgagtggctgggatcacagggatcaagactaacactatctgtaaaaaatgtgctcagaacgtgcagctctacgggacacctaagccctgccagtactgtaatatcattgcagcttttatcggaaacaagtgccagaggtgcaccaacagcgaaaagaaatatggtccaccttatagctgtgagcagtgcaaacaacaatgcgcctttgaccgtaaagacgaccgtaaaaaggtagatggaaagctcctctgctggctgtgcaccttgagctacaaaagggttctgcagaaaactaaggagcagaggaagcatctgtcaagctcgagtagagctggccatcaagagaaagagcaatactcccggctcagtgggggaggtcattacaactccttcagcccggatttggcactggactcaccgggtacagaccatttcgtgattatcgcccaactcaaagaagaagttgcgacactcaagaaaatgcttcatcaaaaagatcaaatgattcttgagaaggaaaagaaaatcaccgagctcaaggctgactttcaatatcaagagagtcagatgagagccaaaatgaaccagatggagaaaacccataaagaggtgactgaacagcttcaagccaagaatcgggaactactgaagcaggccgcagctttatccaagtcgaagaaaagtgaaaaatccggcgctatcacatcgccatag

SEQ ID NO: 222017 - DNA, 861 bp, Artificial Sequence
  Description of Artificial Sequence: Synthetic coding sequence
atggcggaggatggggaggaagcggagtttcatttcgccgcactctacattagcgggcagtggccgaggcttagggcggacactgatctacaaagactggggtcttccgctatggccccttccaggaaattcttcgtgggtgggaactggaaaatgaatggcaggaagcaaagcctgggcgaactcatcgggactttaaatgctgccaaagtccctgccgatacagaagttgtatgtgctcctcccacagcatacatcgactttgcaaggcaaaaactcgatcctaagattgccgtcgccgcacagaattgctacaaggtcacaaacggggcattcacaggagaaatcagccctggcatgatcaaagattgtggcgctacttgggtcgtgttagggcactctgaacggcgtcatgtgtttggcgaatccgacgaattaattggccagaaggtggctcacgctttggctgagggcctgggggtgatagcctgtattggggaaaaactggacgaaagagaagctgggataactgaaaaagttgtgttcgagcagactaaggtaatcgcagataatgtcaaggactggtccaaggttgtgcttgcctacgaaccggtctgggcaatcgggacaggcaagaccgccaccccacagcaggcacaggaagtgcacgaaaagctgagaggctggctcaagtctaacgtcagcgatgctgtagcgcaatcaacacgcatcatttatggcggaagtgtgacaggagccacttgtaaggaactcgcctcccagcctgatgtcgacggtttcctggtcggtggcgcttccctgaagcccgaatttgtcgatatcattaacgccaagcagtag

SEQ ID NO: 222018 - DNA, 1305 bp, Artificial Sequence
  Description of Artificial Sequence: Synthetic coding sequence
atgtccattgagaagatatgggcaagggagatattggactctagggggaatcctacggtcgaggtcgacctgtacacggctaaagggctgtttcgagccgcagtgccttccggagcatcaacaggcatttacgaggccctggaactccgggacggggacaaacagcgatatctaggcaaaggcgtacttaaggcagttgatcacataaacagtacaattgcccctgctcttatcagcagtggactcagcgtggtggagcaggaaaagctggataacttaatgctcgaactcgacggtactgagaataagagtaagttcggtgctaatgcaatattgggggtttcactcgctgtttgcaaagccggtgcggctgaaagagagctacccctctataggcacattgcccagctcgctgggaactcggatctgatactccccgtgcctgcttttaatgtgatcaacggcggaagccacgccggtaacaagctcgcaatgcaagagtttatgattctcccagtgggagccgaatctttcagggacgctatgcgccttggggctgaggtctaccacaccctgaagggggtgatcaaagataagtacggaaaagacgcgaccaatgtaggagacgaaggaggctttgcccctaatatcctggagaactcggaggcactagagctcgtgaaggaggcaattgataaggccggatatacagagaagatcgtgatcgggatggacgtggcggcatcagagttctacagggatggcaaatatgatctggatttcaaatcccctaccgacccctctcgctacataacaggggaccagctcggagccctctatcaagattttgtacgagactaccctgtggttagtattgaggacccttttgatcaggacgactgggccgcatggtctaagttcacagccaatgttggcatccaaatcgtgggggatgacctgactgttaccaaccctaaacgcatcgagcgcgcagtggaagagaaggcctgcaattgtctgctcctcaaggtgaatcagatcggctctgtaacagaagcaatacaggcatgtaaactggcccaggagaacgggtggggcgtcatggtgagccataggagcggtgagactgaggacacattcatcgccgacctcgttgtaggcctgtgcaccggccaaatcaagaccggcgctccttgtaggtctgaacgacttgcaaaatacaaccagttgatgcgcatagaggaggagctgggcgatgaagcacggttcgctggccacaactttcgcaatcccagcgtcctctag

SEQ ID NO: 222019 - DNA, 1176 bp, Artificial Sequence
  Description of Artificial Sequence: Synthetic coding sequence
atgtcaattgagaagatatgggcccgagagatcctagattctaggggcaatcccacagtggaggttgacctctatactgccaagggactgtttcgagctgccgtgccatccggagcctctaccggcatctatgaagcgttggagctgcgggatggagataagcagaggtacctgggcaaagcaaagtttggcgctaatgccatcctgggcgtgagtttggcagtctgcaaagctggcgcagcagagcgtgagctgcccctttaccgccatatagcccaattggccggaaacagtgatctgatactcccagtcccagcgttcaatgtgatcaatgggggtagccacgcgggaaacaagttggccatgcaggagttcatgattctcccagtgggggctgagagcttcagagatgctatgcgacttggtgcagaagtgtaccacacgttaaagggcgtgattaaagataagtacggcaaggacgcaaccaatgtgggggatgaaggtgggttcgcccctaacattctggagaatagcgaggcgctggagcttgttaaagaggctatcgataaagccggttacaccgagaagatcgtcatcggaatggatgtggccgctagcgaattctatcgggacggcaagtacgatctcgattttaagtccccaacagaccctagtagatacatcactggcgaccagctaggggcactgtaccaggacttcgtgagagattatcctgttgtttcaatagaagacccctttgatcaggacgattgggccgcatggagcaagtttacagctaatgttggcattcagattgtgggtgatgacctgacggtaaccaacccaaaacgcatcgagcgcgctgtggaggagaaagcttgcaattgtcttttgttaaaggttaaccaaattggcagcgttacagaggctattcaggcgtgcaagctcgcccaggagaatgggtggggagtcatggtctctcaccggtccggcgaaacagaggataccttcatagccgatctagtggtaggcctgtgcacaggccagatcaaaaccggagctccctgtcgctctgaacgactggcaaagtataaccagctaatgcggatagaagaggaactgggcgatgaggctaggtttgctgggcacaattttcggaacccctccgtgctctag

SEQ ID NO: 222020 - DNA, 1305 bp, Artificial Sequence
  Description of Artificial Sequence: Synthetic coding sequence
atgtccatagaaaagatctgggctcgcgagattttagattctcggggtaaccctacagtggaagtcgacctttatacagctaaggggctgtttcgggctgcggtgcctagcggcgcaagcactggcatttacgaagctctggagctacgtgatggggataaacagcggtacctaggaaagggggtcctgaaggccgtagatcatattaactcgaccatcgccccagcgttgataagctccgggctgagcgtggtcgagcaagaaaaactagacaatttaatgctagagctcgacggcacagagaacaagagcaagttcggcgcaaacgcaatcttgggagtttctctcgccgtctgtaaggccggtgccgcagagagggaactgccgctgtatcgccatatcgcccaattggcgggtaattcagacctgattctccctgtgcccgctttcaatgttatcaacggcggatcacatgcgggaaacaaattagcaatgcaggaatttatgatccttcccgttggggctgagtctttccgggacgctatgcgtctcggcgcagaagtataccataccctgaagggcgtcatcaaggacaagtacgggaaggacgccaccaatgttggagatgaggggggtttcgctcctaatatcctagagaacagtgaggcgcttgagctggtgaaagaagcaattgacaaagcagggtacactgaaaagatcgtgataggcatggacgtggctgccagcgagttctatagagatggtaagtacgatctggattttaaatcccccaccgacccatcacgatacatcacaggggaccagctgggagccctttatcaggactttgtccgcgactatcccgttgtgtctattgaggaccccttcgatcaggatgattgggcggcttggagcaaattcacagctaatgtgggaatacaaatcgtcggtgacgatttaaccgttactaaccccaagagaatcgagcgagccgtcgaggagaaggcatgtaactgtcttctgctgaaggtgaaccagattggctctgtcactgaggccatccaggcctgcaaactggcccaggaaaatgggtggggggtcatggtgagtcacagatcgggagagactgaagacacgtttattgcagatctggtcgtgggactctgcacaggacagatcaagacaggagccccttgtcgttcagagaggctcgccaaatataaccagctgatgaggatcgaggaagaactcggggacgaggccagatttgcgggacacaacttccgaaatccatcagtgttgtag

SEQ ID NO: 222021 - DNA, 1176 bp, Artificial Sequence
  Description of Artificial Sequence: Synthetic coding sequence
atgagcatcgaaaaaatctgggccagagagattttggactcacgagggaacccgaccgtcgaagtggacttgtatacagctaagggcctgttccgagcggcagtgccctccggcgcatcgaccggaatctatgaagcccttgaactgcgtgacggagacaagcagcggtatctcgggaaggctaagttcggagccaacgccatcttaggtgtgagcctggcagtatgcaaagccggtgctgcagagcgcgagctccctctgtaccggcacatagcacagctagctggtaattccgaccttatactgcccgttccagccttcaacgtgataaatggtgggagccacgcaggtaataagctggccatgcaggaattcatgattctccccgttggtgctgagtctttcagagacgctatgaggttgggtgcagaggtctaccatacactaaagggtgtgattaaagataaatatggcaaagatgcaaccaacgtgggagatgaaggtgggttcgcccctaatattttagaaaactccgaggctcttgagttggttaaggaggcgatagacaaggccggatatacagaaaagatcgtgattggtatggacgtcgctgcctctgaattctatagggacggaaagtatgaccttgacttcaagtctcccaccgacccctcccggtatatcaccggcgatcagctcggcgctctttaccaggatttcgtgcgggactatcctgttgtgagtatcgaggaccccttcgatcaggacgattgggccgcttggagtaaattcactgcgaacgtcggcatacaaatcgtcggggacgatttgacagtgacaaaccccaagcgaatcgagcgtgctgtggaggagaaggcctgtaactgcctgctcctcaaggttaaccagatcggtagcgtgaccgaagctatccaggcttgtaaactcgctcaagaaaatggatggggtgttatggtgtcacaccgatccggcgaaaccgaggatacgttcattgcagatttggtcgtcggcctgtgtacaggccagataaagacaggcgctccctgccgttcagagcggctggccaaatacaatcaactcatgaggattgaagaagagttaggagatgaagcccgttttgcgggtcataacttccgcaacccctctgtcctgtag

SEQ ID NO: 222022 - DNA, 1176 bp, Artificial Sequence
  Description of Artificial Sequence: Synthetic coding sequence
atggccatgcagaagattttcgcaagagagatcctagattccaggggtaaccctacagtggaagtggatcttcataccgctaaaggccgtttcagggcggctgtcccctcaggggcttctacgggcatttatgaagccctggagctcagagacggggataagggaaggtatcttggtaaagcaaagtttggcgctaacgccatactgggtgtgagcttggccgtctgtaaagccggagcggctgagaagggggtccccctctatcggcatatcgccgacctcgccggaaaccccgacctgattttacccgttccagcatttaatgttattaatggagggagtcatgccggtaacaagctagccatgcaggaatttatgattttgcccgtaggggcaagctcatttaaagaagccatgagaatcggggctgaagtgtaccaccacctaaaaggcgtgattaaagccaaatacggaaaagacgcaacaaatgtgggcgatgagggtggatttgcacctaacatcctggaaaacaatgaagcactggaactcctgaagaccgctattcaggcagccggttatcctgataaggtggtgattggaatggacgttgcagcaagcgagttttaccggaatggaaagtacgacttagattttaaatctcccgacgatccagccaggcacatcaccggggagaagttaggtgaactgtataagtcatttattaaaaattacccggtggtgagcattgaggatcccttcgaccaggacgactgggctacgtggaccagcttcctgtcaggcgtaaatattcagatcgtcggagatgacctgacagtgactaatcccaagcgcattgcccaagcggtcgagaagaaagcatgcaattgcttgctacttaaagtcaaccagataggcagcgtgaccgagagcatccaggcatgtaagcttgcccagtcaaacgggtggggtgtgatggtatctcatagaagtggagaaactgaggatacattcattgccgatctcgtcgtgggcctttgtactggacagatcaaaaccggtgctccgtgcaggagcgagcgactcgccaagtacaaccagctgatgaggatagaagaggccctaggcgacaaggccatcttcgcgggacgcaagttccgaaatcctaaagccaagtag

SEQ ID NO: 222023 - DNA, 1305 bp, Artificial Sequence
  Description of Artificial Sequence: Synthetic coding sequence
atggctatgcagaagattttcgccagagagatccttgacagcagagggaatcccaccgtcgaggtcgatcttcacacggctaaggggagattccgggctgccgtgccatctggcgcatctaccgggatctatgaggctctggagttgagggacggggataagggtcgctacctgggaaaaggagtacttaaggccgtcgaaaatatcaacaacaccttggggccagccctgctgcagaaaaaactctccgtggtggatcaggagaaggtggacaaatttatgatcgagctggacggcaccgagaataagtcaaagttcggggctaacgccatcctgggtgtcagcttggcagtgtgtaaggccggtgccgcagagaaaggagtgcccctctaccggcatattgccgacctggcaggtaatccagatctgatccttcccgttccagcatttaacgtgatcaatggcggtagccacgccggaaataagctggcaatgcaggagttcatgatcctgccagtgggcgcatccagttttaaggaggcaatgaggattggcgcagaagtgtaccatcacctaaagggagtgattaaggctaagtatggcaaagatgcaactaacgtgggcgacgaaggtggatttgcacctaatatattggagaacaatgaggccctggagctcctcaaaacggccatacaggccgcaggttatcccgacaaggtggtgattggaatggacgttgccgcatccgaattctatcggaatggtaagtacgatcttgactttaagtcgccggatgaccctgccaggcacataaccggagaaaagttaggcgaactgtacaagtcatttatcaagaattaccctgttgtaagcattgaagatccctttgatcaagacgattgggcgacctggacttcctttctgtccggggtgaatatccaaattgtgggagacgacttgacagtaaccaatcccaaaaggatagcccaggccgtggaaaaaaaagcatgtaactgcctattactgaaggtcaaccagatcggaagcgtgactgagagtattcaagcgtgcaagctggcacaatccaatggatggggtgtgatggtcagccacaggagcggcgagaccgaagatacattcattgcagacctggttgttggcctctgtactggccaaattaagaccggggcaccatgtcggtccgagagactggccaaatataatcagttgatgcgcatcgaggaggcgctcggtgacaaagctatattcgccggaagaaagttccgcaacccaaaggccaaatag

SEQ ID NO: 222024 - DNA, 1305 bp, Artificial Sequence
  Description of Artificial Sequence: Synthetic coding sequence
atggctatgcagaagatcttcgcccgtgagatccttgactcacgaggcaatccaaccgtcgaagtcgacctgcatacagccaaaggacggtttagggctgcggtgccctctggcgctagtactggaatctacgaggcactagagttacgcgatggggataaaggcaggtacttaggcaaaggagttttgaaggccgttgagaacattaacaataccctgggtccagcactgttacagaagaaactgagcgtcgtggatcaggagaaggtggataagtttatgattgaactcgatgggactgagaataaatctaagttcggagctaatgctattcttggtgtgagtctggccgtgtgcaaggcaggagcggcagagaaaggagttcccctatatagacatatcgctgacctagccggaaatccggatctgatcttgcctgtacccgcattcaatgtgattaacggtggtagccatgcaggcaacaaactagccatgcaggagttcatgatcttacccgtcggggctagctcctttaaggaagcgatgagaataggggcagaggtttatcatcatctgaaaggcgtgatcaaggctaaatatgggaaggatgccaccaatgtgggtgatgagggcggatttgcgcctaatatccttgagaataatgaggcccttgaattactgaagactgccatccaggctgccggatatcccgataaagtcgtgatcggtatggatgtcgctgcctcagagttctatagaaatgggaaatacgatttagacttcaaatctcctgatgatccagcccgacacattacaggtgaaaaactgggcgagctttacaaaagctttataaagaattatccagttgtgtcaattgaggatccttttgatcaagatgactgggccacctggacaagctttctgtcaggcgtaaatatccagatagtgggcgatgatctgacggtcactaaccccaagaggattgcgcaagccgtcgagaagaaagcatgtaactgccttctactcaaggtcaaccagattggcagcgtaacagagtccattcaagcttgcaaattggcccagagtaacgggtggggggtgatggtgtctcatagaagcggcgagactgaggacacattcatcgccgatctggtggttggcctgtgcactggccagattaaaacaggggctccttgcaggtctgaaaggcttgccaagtacaatcagctgatgagaattgaggaagccctgggtgacaaagctatcttcgctggtagaaaatttcggaatcccaaggctaagtag

SEQ ID NO: 222025 - DNA, 852 bp, Artificial Sequence
  Description of Artificial Sequence: Synthetic coding sequence
atggccatgcaaaaaatctttgcaagagagatccttgactcacgtggtaaccccacggtcgaagtggacttacacacagctaagggacgcttccgcgctgccgtcccctccggagctagcaccggaatttacgaggctctcgagttgagggacggcgataaaggtagatatctgggcaagggggtgctaaaggctgttgaaaacattaacaacactttgggcccagctttgttacagaagaagctcagcgtggtggaccaggaaaaggttgataaattcatgatagagctggatgggaccgaaaataagtcaaagtttggtgctaatgccatcctgggggtgtcgctggcggtttgtaaagcgggtgccgctgaaaaaggagtgcccctgtatagacacatcgccgaccttgcgggtaacccagacttgatcctccccgttcccgcattcaacgtcataaatgggggatcccacgctggcaacaagctggcaatgcaggagttcatgattctgccagtcggggcatccagctttaaggaggctatgcgtattggagccgaagtttaccaccatttaaagggcgtcattaaagccaaatatgggaaggacgccaccaacgtgggcgatgaaggcggattcgctccgaacatactggagaataatgaggccttggagctattgaaaactgcaatccaggcagccggttatcccgataaagtggtgatcggcatggatgtagcagcctctgaattttatcggaatgggaaatatgatctggattttaaatcacctgacgacccagctcgacacattacaggagaaaagctaggcgaactttacaaatcattctag

SEQ ID NO: 222026 - DNA, 465 bp, Artificial Sequence
  Description of Artificial Sequence: Synthetic coding sequence
atggccatgcagaagatatttgcccgtgagattcttgatagtcgcggaaaccccacagtagaggtcgacctgcacaccgcgaagggtagattcagagccgctgtgccatctggcgcatcaactgggatctacgaagccctagaactaagagacggtgataaggggaggtacctggggaaaggcgtgttgaaggccgttgaaaacatcaataacactctaggacccgctcttctgcagaagaaactgagcgtggtggatcaggagaaggtcgataagttcatgatcgagctcgacggtaccgaaaacaagtccaagtttggtgccaatgcaatcctcggagtgagcctggccgtgtgtaaagcgggagcagccgagaaaggggtgccgctatatcgacacatcgcagacctggctggaaacccagacttgattctcccggtcccagcctttaacgtgatcaattag

SEQ ID NO: 222027 - DNA, 447 bp, Artificial Sequence
  Description of Artificial Sequence: Synthetic coding sequence
atggcaatgcagaagatcttcgcgagggaaattctagatagtagggggaatccgacggtggaggtggatctgcatactgctaaaggtcgctttagagcagcagttccatctggtgcaagcaccggcatctacgaagcactagagctcagggacggagacaaggggaggtacctgggcaaaggtgtgcttaaagctgtggagaatataaacaacacgctgggaccagctcttctccagaaaaaactgtcagtcgtggaccaggagaaggtggataaatttatgatcgagctcgacggaactgagaacaagagcaaatttggtgccaatgcaatcctcggagtgtccttggccgtctgtaaagcaggtgccgctgaaaaaggggtccccctgtaccgacatatcgctgacctggcaggcaacccagacctaattcttcctgtgccttag

SEQ ID NO: 222028 - DNA, 1332 bp, Artificial Sequence
  Description of Artificial Sequence: Synthetic coding sequence
atggttcgcggacggatctcccggctgagcgtgcgggacgtccggttccctacctcgctgggagggcacggtgccgacgcaatgcatactgaccctgactattcagccgcttacgtggtgatcgaaactgacgcagaggatggaataaagggatgcggtattactttcaccctgggtaaggggacagaggtggtagtttgtgccgtaaatgcacttgctcaccacgtgctgaacaaagatctcaaggatatagtgggagactttagaggcttctaccgacagttgacttctgacggccagctccgatggatcggacctgaaaaaggggtggttcacttggcaacagctgcggtgctgaatgcggtctgggatctttgggccaaacaagaggggaaacccgtgtggaaactgctcgtggacatggatccccgtatgctggttagctgtattgactttcgatacatcaccgacgtgctgaccgaagaggatgcattagagatcctgcagaagggacagattggcaaaaaagaaagagaaaagcagatgctcgcccagggataccctgcctatactacttcatgtgcatggttaggctactccgatgatactctgaaacaactctgtgcccaggctctaaaggacggttggacacggtttaaggtgaaggttggtgccgatctgcaggacgacatgcgacggtgccagatcattcgcgatatgatcggccctgaaaagaccctgatgatggatgcaaaccagcgttgggacgttccagaagccgtggaatggatgtcaaagctggccaagttcaagcctttatggatcgaagaaccaaccagcccggacgatatcctggggcatgctaccatctccaaagcacttgtacctctcggaattggaatcgcgaccggcgaacaatgccacaacagggtgatcttcaaacagctgttgcaagccaaggctctgcagttcctccaaattgatagttgtcgcctcgggagcgtgaacgaaaatctttccgtgctcctgatggcaaaaaagtttgagatacccgtgtgccctcatgccggaggagtcggactgtgcgagctcgtgcaacacctgattattttcgactacatctccgtgtccgcttcccttgagaaccgtgtgtgcgagtacgtggatcatcttcacgagcactttaaataccccgttatgatacagagggcttcatacatgccaccgaaggaccccggatattccacagagatgaaagaggagtcagtcaaaaagcaccaatatcccgacggcgaggtgtggaaaaagttactgccagcccaggagaactag

SEQ ID NO: 222029 - DNA, 642 bp, Artificial Sequence
  Description of Artificial Sequence: Synthetic coding sequence
atgaggcgttgtcagatcatacgcgacatgataggcccagagaagactctgatgatggatgccaatcagagatgggacgtgcctgaggcagtggaatggatgtctaaactggctaagtttaagcccctgtggatcgaggaacccacgagccctgacgatatcctcggccatgctactatctctaaagccctcgtacccctcggaatcggtatagccactggcgaacagtgtcacaacagagttattttcaaacagctgctgcaggccaaggccctgcaatttttgcagattgattcttgtagactggggtcagtgaacgagaacctgtctgttctcctgatggcaaaaaaattcgagattccagtatgcccgcatgccggaggtgttgggctttgcgagctggtgcagcaccttattatctttgattacatctccgtgagtgcctcgctggagaaccgggtgtgtgagtacgtggatcacctgcacgagcactttaaatatcctgtgatgatccagagagcatcctatatgccacctaaagaccctgggtacagcaccgagatgaaagaagagtctgtgaaaaaacatcagtaccctgacggagaagtctggaaaaaactactgcccgcacaggagaactag

SEQ ID NO: 222030 - DNA, 1353 bp, Artificial Sequence
  Description of Artificial Sequence: Synthetic coding sequence
atggtcagtgccgacgcaatggtgtctgctgacgccatggtgtccgctgatgccatggtgtccgcagatgccatggtgagtgccgacgcgatggtaagcgccgatgccatggtctctgccgacgccatggtaagcgctgacgctatgcataccgatccagactactccgcggcttacgtggtgattgagaccgacgcagaggacggaataaagggctgtggcatcactttcactttgggcaaaggaactgaggtggtggtgtgcgcggttaacgcactcgctcatcacgttctgaataaagatctcaaagacatcgtgggcgacttcagaggtttttatcgacaactcacgtcagacggccagctcagatggatcggtcctgaaaagggagttgtacatcttgccacagcggcagttctcaacgctgtctgggatttatgggcaaaacaggaaggaaagccagtctggaaactgttggtggacatggacccgagaatgcttgtgtcgtgcatcgatttccggtatattaccgacgtgctgactgaggaggatgcccttgaaatcctgcagaaggggcaaatcggaaagaaagagagagagaagcagatgctggctcaaggctacccagcctacacaacctcttgcgcctggcttgggtattcagatgacaccttaaaacagctttgtgcacaagccttgaaggatggctggacgcggtttaaagttaaagtcggcgcagacctgcaggatgacatgcgaaggtgccagattataagagacatgattgggccagaaaaaactttgatgatggatgctaaccaacgctgggacgtgccagaggcggtagaatggatgtcaaagctcgctaaatttaaaccgctgtggatcgaagaacctacctctcccgatgacatcttgggtcacgctacaatctcaaaatgccacaaccgggtcatcttcaagcagctcctccaggctaaggccctgcagttcctgcagatcgacagctgccggttggggtcagtgaatgagaacttgtccgtactgctcatggcaaagaaattcgagattccggtttgcccacatgctggcggtgtcggtctgtgtgagctggtccagcatcttatcatcttcgactatatttccgtatccgcctctctggaaaatagagtctgtgagtacgttgaccacttgcacgagcactttaagtatcctgtgatgatccagcgggcaagctacatgccccctaaggacccaggatattccaccgagatgaaagaagagtctgtcaagaagcatcagtacccagacggagaggtttggaagaaactacttccagctcaggagaactag

SEQ ID NO: 222031 - DNA, 1086 bp, Artificial Sequence
  Description of Artificial Sequence: Synthetic coding sequence
atgcagaaaatggagagcagaggagttgagcttccttcactgtgggaaaaagcattgaaattgataggacccgagaagggcgtagtgcacctggcaactgccgcagtgctgaatgccgtttgggatttgtgggctaaacaagaaggcaagcccgtgtggaaattgttagtggacatggatcctagaatgctagtgagctgtatcgacttcagatacatcactgatgtgctcactgaggaagacgccctcgaaattcttcagaaaggtcagatcggtaagaaagagagagaaaaacagatgctggcacaaggatatccagcatataccacatcttgcgcctggttagggtactcggatgacaccttgaagcagctgtgcgcccaggctcttaaggacgggtggaccagattcaaggttaaggtgggggcagacctccaggacgacatgcgcaggtgtcagataatcagagatatgattggcccagaaaaaactctgatgatggacgccaaccagcggtgggacgtgccagaggccgtcgaatggatgtccaagctggcgaaattcaagcctttgtggattgaagagcccacaagcccagatgacatcctgggccacgctaccatatcaaaggcactggtacctcttggaatagggatagcaacaggagagcaatgtcataacagagtgattttcaaacagctcctccaggccaaggccttacagtttctgcagattgatagctgcagattaggctcggtcaacgaaaatctatcggtgctgctgatggctaagaagtttgaaattcctgtttgtccacatgcgggaggtgtgggtctatgcgagctggtgcaacatctcattatcttcgactatatttcagtctccgcctcattggagaatagagtctgcgagtatgtagatcaccttcatgaacactttaaataccctgttatgatccagcgcgcaagctatatgcctcctaaggatccgggatactccactgaaatgaaggaggaatctgtgaagaagcaccaatacccagacggtgaggtgtggaaaaaactgctgcccgcacaggaaaattag

SEQ ID NO: 222032 - DNA, 429 bp, Artificial Sequence
  Description of Artificial Sequence: Synthetic coding sequence
atggtcagagggaggatcagtcgcttaagcgttagagatgtgcgctttccgactagtctggggggacacggagccgacgccatgcacacagacccagactacagtgccgcatatgtggtcattgaaactgatgcagaggacggaattaagggatgcgggatcaccttcacgcttggcaagggtactgaagtcgtggtgtgcgccgtcaacgcattggcccaccatgtgctgaacaaggatcttaaggacatagttggggactttcgagggttttacaggcagctcacgtccgatggacagctccgctggataggaccagagaagggtgtcgtccacctggcaacggctgcggtgttgaacgctgtatgggacctctgggccaagcaggaggggaagcctgtttggaagctgttggtggatatgggctag

SEQ ID NO: 222033 - DNA, 1392 bp, Artificial Sequence
  Description of Artificial Sequence: Synthetic coding sequence
atggctaccgtgactgcaaccacaaaggttcccgaaattcgggatgtgaccagaatcgaacgcataggagctcacagtcacattagggggctcggtcttgacgacgctctggagccaaggcaagcttcccagggcatggtcgggcaactggcggcacgtcgcgctgccggagtggtgctggagatgattagagaggggaagatagccggaagggctgttctgattgcaggacagccaggcaccggcaaaactgccattgccatggggatggctcaagctctggggcctgatacgccttttaccgctattgcaggcagtgaaatcttctccctcgaaatgtccaagacggaggcacttacacaggctttcaggcggagtattggcgtgcgcatcaaggaggagaccgagattattgagggtgaggtagttgagatccaaatcgatcgtccagcaacaggaacagggtcaaaggtggggaaacttactctgaaaaccactgaaatggagaccatatacgatttagggactaaaatgattgaaagcctcacaaaggacaaggtgcaggccggagatgtgatcaccatcgacaaagccaccggaaagatctctaaattgggcagaagcttcaccagagcacgcgactatgacgcaatgggttcacaaacaaaattcgtccagtgccctgatggagagttgcaaaagaggaaagaggtagtgcatactgtctctttgcacgagattgatgtcataaatagtagaacacaggggttcctggcgttattctctggagacaccggagaaattaagtccgaggtgcgagaacagatcaacgcaaaagttgcggaatggcgggaagagggtaaggcagaaatcatcccgggagtactatttattgacgaggtgcatatgcttgacattgaatcattttcatttttgaatcgggcattagagagcgatatggcacccgtgctgatcatggccacgaacagaggaattacaagaatcagaggaaccagctaccagtcacctcatggcattcccattgacctgctggaccggctgttaatcgtcagtacaactccatactctgaaaaggatacaaagcagatccttcgcattcgatgcgaagaagaggacgtggaaatgagcgaagatgcctacactgtattgacaagaattggcttagaaactagcttaagatatgcgatacagctcatcactgcagccagcttagtatgtagaaaacgcaaggggacagaagtgcaggtcgatgacattaagcgcgtatattctttgtttttagatgagagccgcagcacccagtacatgaaagagtatcaggacgcgttcctgtttaatgagctgaagggtgaaaccatggatacaagttag

SEQ ID NO: 222034 - DNA, 855 bp, Artificial Sequence
  Description of Artificial Sequence: Synthetic coding sequence
atggccaaaagcctcttaaaaaccgcaagcctgtccggcaggacgaagctgcttcaccagactggcctttctctttattccaccagccacgggttctacgaggaggaagtgaaaaagactctgcagcaattccccggagggtcaatcgatctccagaaagaagacaacgggattggcattctaaccctgaacaatcctagtcgaatgaatgccttttccggcgtgatgatgctgcagctgctcgagaaggttatcgaactcgaaaattggacagagggaaagggattgattgtaagaggcgctaaaaacacgtttagttccggctccgacctgaacgctgtcaagtcccttggtctgcagaggcgactgccacttatttcagtcgcactggtgcagggctgggcattaggcggaggtgcagagttcaccacggcatgtgacttccgcctaatgactccagaatcaaagatccgttttgtgcacaaggagatgggaattattccgtcttgggggggtaccacacgcctggtggaaattataggcagcagacaggcactcaaagtgctgtcgggcgctctgaaactcgacagcaagaacgcccttaacatcgggatggttgaagaggtgctccaatcaagcgacgaaactaagagcctcgaggaagcacaagagtggctgaagcaattcatccagggacccccagaggttataagagcgctgaagaagtccgtatgctcaggaagggagctctatctagaggaagccctgcagaatgagagggacctcctcggcactgtgtggggcggacctgcaaacctggaggccattgcaaaaaaaggaaagtttaataagtag

SEQ ID NO: 222035 - DNA, 438 bp, Artificial Sequence
  Description of Artificial Sequence: Synthetic coding sequence
atggcaaagtctctcctgaagacagcttccctgtccgggcgaactaaactgctccaccaaacaggacttagtctgtactccaccagtcacggcttctacgaagaggaagttaaaaaaaccctacagcagtttccgggaggcagcattgacctacagaaagaggataacgggatcggcattctcaccttaaacaatccctcacgcatgaatgccttctctggcgttatgatgcttcaattacttgaaaaagtgatcgaacttgaaaattggactgagggcaaaggtctgatcgttagaggcgcaaagaatacatttagttccggaagcgacctgaacgctgtcaagtccctcggaactcctgaaaccagcttcaacaaatgctgcgccggaagcagactaggtattggctggcgatcgcgcatatattattccatgtag

SEQ ID NO: 222036 - DNA, 441 bp, Artificial Sequence
  Description of Artificial Sequence: Synthetic coding sequence
atggccaaaagtctgctcaagaccgcatctctgtccggaagaactaagctgctgcatcagaccggactgtcactgtatagtacctcacacggtttttatgaagaggaggtgaaaaaaacgctgcagcagttcccaggcggtagtatcgacttacagaaggaagacaatggcattgggatcctgacgctcaataacccatcgcgaatgaacgcatttagcggcgtcatgatgctacagttgttagaaaaagtgatcgaactcgagaactggactgaggggaaaggcctcatcgtgagaggcgctaaaaataccttcagttccggcagtgatctcaacgctgtgaagtctcttggtacacctgaggagacctcctttaataaatgctgtgctggaagcagactggggattggttggcggtcgaggatctattacagcatgtag

SEQ ID NO: 222037 - DNA, 438 bp, Artificial Sequence
  Description of Artificial Sequence: Synthetic coding sequence
atggctaaatccctcttaaaaaccgcctctctctccggccgaacaaaactgctgcatcagacagggttgagcttgtactcaaccagccacgggttctacgaagaagaggtgaaaaaaactcttcagcagtttcccggaggttcaatagatcttcagaaggaggacaatggaatcgggatattgacgctaaataaccccagtcgcatgaatgcgtttagtggcgtgatgatgttgcaattactggaaaaggttatcgaattagagaattggaccgagggcaagggattgatagtgcgaggagctaaaaacaccttctcatcagggtccgacctcaacgcagtaaagtctctgggtaccccagagacttcctttaacaaatgttgcgcaggcagtagactgggtatcggctggagatcaaggatctattattctatgtag

SEQ ID NO: 222038 - DNA, 642 bp, Artificial Sequence
  Description of Artificial Sequence: Synthetic coding sequence
atgaatgccttttctggggtcatgatgttgcaactgttggagaaagtaattgaattagagaactggaccgagggaaaaggtttgatagtgagaggtgccaagaataccttttcttccggcagcgacctcaatgctgttaaatcacttggtactccagaagagagttgcaggtggaacactgagttcctgtacaccctgcaccccgtttccccttttattaacatcctgtactcttacgggtggaacggaagaatgcacgtgcatgctaagcaccttaataagatttatgaagttaaaaaacaacgcggaaagattctgctgggactttcacgcctcccactgataagtgttgccctcgtccaggggtgggctctagggggaggggcagaatttaccacggcctgtgacttcaggctgatgacgccggagagcaaaatacggttcgtccataaagagatgggaattattccatcatggggcggaacgacgcgattggtcgagatcataggtagccggcaggccctcaaagtcctgtccggggctctcaagctcgatagcaaaaacgctcttaatattggcatggtggaggaagtgctgcaatctagtgacgagacaaaaagcttggaagaagcccaagaatag

SEQ ID NO: 222039 - DNA, 906 bp, Artificial Sequence
  Description of Artificial Sequence: Synthetic coding sequence
atggctaagagtctgttgaaaacagcgtcactgagcgggagaacgaaacttctgcatcagaccggcctatctctgtatagtacctcccacggattttacgaagaggaagtgaagaaaactctgcagcaatttcccggtggatcaattgacctccagaaggaggacaatggtattggtatcctgaccctcaacaatcccagcaggatgaatgcattcagcggagtgatgatgctgcagctcctggaaaaagtcatcgaactggagaactggaccgaaggcaaaggcctgatcgtgagaggtgccaaaaacacattctcttccgggtctgaccttaatgctgtcaaaagtcttggcacacccgaggatgggatggctgtatgtatgttcatgcagaacaccctcactcgatttatgcgcctgccccttatatcagtggcgctggtgcagggttgggctctcggcggtggggctgaatttacaactgcttgcgatttcagattaatgacccccgaaagcaaaatccgttttgtccataaggagatgggaattatcccatcctggggaggcacaactcgcctagtcgagatcatcggatccagacaggccctaaaggtgttaagcggggctctgaagttggattcgaagaacgccctcaatatagggatggttgaggaggtgttgcaaagcagcgatgagaccaaaagtctggaggaggctcaggagtggctcaagcagttcatacagggacctccagaagtgatccgggctctcaaaaaatccgtctgctcaggacgggaactctaccttgaggaagccttgcagaatgagcgagacctgctggggacagtctggggtgggccagccaacttagaggcgatcgctaagaaaggtaaatttaataagtag

SEQ ID NO: 222040 - DNA, 681 bp, Artificial Sequence
  Description of Artificial Sequence: Synthetic coding sequence
atgatgttacagttactggaaaaagtgatcgagttagagaattggaccgaggggaagggactgatcgtgcgcggagcaaagaacaccttcagcagcgggtcagatctgaatgctgtgaaaagtctgggcacccccgaagatggtatggcagtgtgcatgtttatgcagaatactctgacgcggttcatgaggctgcctctgatatcggtagcgttagtgcagggctgggcactgggcggaggcgctgaatttaccaccgcatgcgactttaggttaatgacaccggagtctaaaattcgtttcgtccataaggagatgggtatcattccttcctggggagggactactaggctcgtggagatcattggctctaggcaagccctgaaggtcctcagtggtgctctcaaattggactccaagaacgccctgaatattggaatggtggaagaggtgttgcagagtagcgatgaaacaaaaagtctggaggaggcccaggagtggctgaagcagtttattcagggaccgcctgaggtcatacgggctctcaagaagtcggtctgttccggcagggagttgtacctcgaggaagcacttcaaaatgaacgagatttgctgggcacagtctggggcggtcctgcaaatctggaagcgatcgccaaaaaggggaagttcaacaagtag

SEQ ID NO: 222041 - DNA, 906 bp, Artificial Sequence
  Description of Artificial Sequence: Synthetic coding sequence
atggctaagtcccttctgaagactgcatccctctctggcaggactaaactccttcatcagactgggctgtcgttatattctacttcccatgggttctacgaggaagaagtgaagaagactctccagcaatttccaggcggtagtatcgatctacaaaaggaagacaatggaatcggaatattgactctgaacaacccctccagaatgaatgccttttctggggtaatgatgctgcagctgttagagaaggttattgagctggaaaactggacagagggcaaggggctgatcgttagaggagccaaaaatacctttagtagtggctccgacctgaatgccgtgaagtccctgggaactcccgaagatgggatggctgtctgtatgtttatgcagaacacactgactcgctttatgagactgcccctgatctcagtggcgctggtccaggggtgggcattgggagggggagccgagtttaccacagcatgtgattttcgcctgatgactcctgaatccaagatccggttcgtgcacaaagagatgggaataatccccagctgggggggtactaccagactagtggagatcatcggctcacgtcaggcactgaaggtgctgagcggcgcactaaagctggattctaaaaatgccctgaatattggcatggtcgaggaggtgttgcaatcctcagacgagacgaaaagtctcgaggaggcccaggaatggttgaaacagtttatacagggcccacctgaagtgatacgcgctttaaaaaaaagcgtatgtagcgggagagagctttacctggaggaagctctccagaacgaacgggatctgctcgggactgtttggggcggaccagcaaatctagaggccatcgctaaaaagggaaagttcaataaatag

SEQ ID NO: 222042 - DNA, 906 bp, Artificial Sequence
  Description of Artificial Sequence: Synthetic coding sequence
atggcaaagtcactgttgaagaccgccagcttgagcggtcggactaagctattacaccagacgggcctttccctctattctactagccacggcttttatgaggaggaggttaaaaagacgttgcaacaattcccgggaggcagcatcgatctgcaaaaagaggacaacggcattggcatcctgaccctcaacaatcccagcagaatgaatgccttctcaggagtgatgatgctccagctcctggaaaaggtcatcgagcttgagaactggaccgaaggcaaaggcctgattgtccggggtgctaaaaataccttttcctccgggtccgacctcaacgctgtgaaatctctcggaacacctgaggatggaatggctgtgtgtatgtttatgcagaacacactgacgcgcttcatgaggcttcccctgatctctgtggctctcgttcaggggtgggccctgggtggcggagccgaattcacaacagcttgcgactttcggctgatgacccctgagagtaagatccggttcgtgcataaagaaatgggtattattccctcgtggggagggacaacgcgcctcgtcgagattatcgggagccgccaggcactgaaagtacttagcggagctctgaagctggattccaaaaatgccctaaacatcggtatggtagaggaggttctgcaatctagtgatgagactaaatccctagaagaagctcaggaatggctgaaacagttcatccagggccctcccgaggtcatcagggcattgaagaaatctgtgtgctccggcagagaactttacctggaggaagccctccaaaatgaacgcgacctactgggcacagtctggggcggtcctgccaatcttgaggctattgcgaagaaggggaagttcaacaaatag

SEQ ID NO: 222043 - DNA, 408 bp, Artificial Sequence
  Description of Artificial Sequence: Synthetic coding sequence
atggctaagagtctcttgaaaacggcttccttgtcaggtagaactaagctgctacaccagacagggttatccctgtattccaccagtcatgggttttacgaagaggaggtgaaaaagactctgcagcagtttccaggcggatccatcgatctgcaaaaagaagacaacggaatagggattctgactctgaataacccatcaagaatgaatgcatttagcggtgtaatgatgctccagctgctggagaaggtgatagaactggagaattggaccgaaggcaagggccttattgtgcgcggtgccaagaatacgttttcttcaggcagcgatcttaatgccgtcaagtccttggggacccccgaggatggcatggcagtgtgcatgttcatgcagaacaccctgacgtag

SEQ ID NO: 222044 - DNA, 924 bp, Artificial Sequence
  Description of Artificial Sequence: Synthetic coding sequence
atggcgctgaaacaagaaatggcaaaatctctcctgaaaacagcctccctctcagggcgtactaagctgctgcatcagaccggtctctctctgtactccacctcacatggcttctacgaagaagaggtaaaaaagaccctgcagcagttccccggaggctccatcgacttgcagaaagaagataatggaataggcatcctgaccctgaacaacccttctcggatgaacgctttctcaggcgtgatgatgctgcaattgctagagaaggtgatcgagctggagaactggactgaaggtaaagggctgattgtgaggggagcaaagaacacctttagctctggctccgacctgaacgccgtgaaaagcctgggcactcccgaagacgggatggccgtctgcatgttcatgcagaacaccttgactcgcttcatgcgcctgcctcttatttcagttgctcttgtgcagggctgggcactcggaggaggagctgagttcaccaccgcatgcgacttccggcttatgacccccgagagcaaaatccgctttgtgcataaagagatgggcatcataccaagttggggaggtactacacgtctggttgaaataattgggtcccgccaggcactgaaagtcctcagcggcgctctaaagctggattccaaaaatgccttgaatataggcatggtggaggaggttctgcaatcaagtgatgaaactaaaagccttgaagaagcccaagagtggctaaagcaattcatacaaggaccacccgaggtcattagagctctgaagaaaagtgtttgttcgggtcgggaactttaccttgaagaagctctacagaatgagcgcgacctgttaggcactgtgtggggcggacctgcgaatttggaagccatcgcaaaaaagggcaagtttaataaatag

SEQ ID NO: 222045 - DNA, 456 bp, Artificial Sequence
  Description of Artificial Sequence: Synthetic coding sequence
atggccaagagcctgctcaagaccgcaagcttgagcggtaggacgaagctgctgcaccaaaccgggctgtcactttatagtacatctcacggcttttacgaggaagaggtgaagaagactcttcagcagttccccggaggttcaatcgacctgcaaaaagaggataacgggataggaatcctcactctgaataatccttcccgtatgaacgccttttctggggtgatgatgctccaattactggagaaggttattgaactggaaaattggactgagggcaaaggcctgattgtgagaggagcaaagaacactttctcatccggatccgacctgaacgctgtgaagtctctgggcacacccgaggacgggatggcagtgtgtatgtttatgcaaaataccctcactaggttcatgcgcctgcccctgatctctgtggccttagttcaaggatggtag

SEQ ID NO: 222046 - DNA, 378 bp, Artificial Sequence
  Description of Artificial Sequence: Synthetic coding sequence
atggcaaaatctcttctgaaaaccgcaagtctctccggcaggactaaactccttcatcagacaggtctttcgctgtactcgacctcacacggattttacgaggaggaggtaaagaaaaccctgcagcaattccctggcggttctattgatctgcaaaaagaggacaatgggatcggcatcttgactcttaataacccctcccgcatgaacgccttctctggagtcatgatgctccagctgttggaaaaagtgatcgaactggagaactggacagaaggaaaaggacttattgttagaggcgcaaaaaatacatttagtagtggtagcgacctaaacgcagtgaagagccttggcacccccgaggcgaattttctttag

SEQ ID NO: 222047 - DNA, 213 bp, Artificial Sequence
  Description of Artificial Sequence: Synthetic coding sequence
atgatgctgcagctccttgaaaaggttattgagttggagaattggacggaggggaagggcctgattgtcagaggagctaaaaacactttctcatcgggcagtgacctaaatgctgtgaaatccctaggaacgcctgagacgtcctttaacaaatgttgtgccggatcacgactgggaatcggttggcgtagcagaatttattattccatgtag

SEQ ID NO: 222048 - DNA, 873 bp, Artificial Sequence
  Description of Artificial Sequence: Synthetic coding sequence
atggcggctctgagggtgctcctttcatgtgtgcgtggacccttgcgcccaccggtaaggtgtcccgcatggcgaccgttcgcttcgggagccaatttcgaatacataatagcagaaaaaaggggcaaaaacaacacagtgggcctgatacagctcaatagacccaaggccctgaacgctctctgcgacggactcatcgacgagctaaaccaggccctcaaaacgtttgaggaggatcccgcagtaggagccattgttctgaccggtggagacaaggcctttgcggctggcgcagatattaaagagatgcaaaatctgtcatttcaggattgctattcttcgaaatttcttaagcattgggaccatctgacccaggtaaaaaagcctgtgatcgctgccgttaacggatacgcgttcgggggaggatgcgaacttgctatgatgtgtgacatcatctatgcaggggaaaaagcccagttcgctcagccagaaattctaatcgggaccatacctggagcaggcggtacccaacgcctgacacgagcagtcggcaagtcattggctatggagatggtgctcacgggggatcgaatttcagctcaggacgcaaagcaagctggcctcgtcagtaaaatctgccctgtcgagaccctggtggaggaagctattcaatgtgccgagaaaatagctagcaactctaagattgtggtggccatggctaaggagagtgtgaacgcggcatttgagatgactctcactgaaggctccaagttggaaaagaaattgttttactccacattcgcgaccgatgatcgtaaagagggcatgactgccttcgtggagaaacgaaaggccaactttaaggaccagtag

SEQ ID NO: 222049 - DNA, 2271 bp, Artificial Sequence
  Description of Artificial Sequence: Synthetic coding sequence
atgtcgtttgtggctggggtgatacgcagactagatgagaccgttgtcaacaggattgcggctggggaggtgattcagaggcctgcaaacgcgattaaggagatgatcgagaactgtctggacgccaagagcaccagcatccaggtgattgtgaaagaaggaggcctcaagctcattcagattcaggataacgggaccgggattcgcaaggaggatctggacattgtctgtgagcgattcacaacatctaagctgcagtcattcgaagacctcgcttcaatctctacctacggattcagaggggaggctctggcctccatcagccatgtggcacacgttaccatcaccactaaaacagccgatggcaagtgcgcatatcgggcaagctactctgacgggaagctgaaagccccacccaaaccctgcgccggtaatcagggcactcagataactgtagaggaccttttctataacatcgccacaagacgaaaggctctgaagaacccgagcgaggagtatgggaaaatcctggaagtggtaggtcgctactccgtacacaacgccggtatctcattcagcgtgaaaaaacagggggagaccgttgcagacgtcaggacattgccaaacgccagcaccgtggataacatccggagcatcttcggtaacgcagtgagtcgcgagctcatagaaattggatgtgaggacaagaccctagcattcaagatgaatggctatatctctaatgccaactattccgtcaaaaagtgcatctttctgctctttattaaccacaggctcgtggaaagcacctcgttaagaaaagccattgaaactgtgtatgctgcatacctgcccaaaaatacccatccctttctttatctgtcactggagatttcaccgcaaaatgttgacgtgaatgtgcaccctacaaagcacgaggtgcattttctgcacgaggagtcaatcctggagagggtccagcaacatattgagtcaaaactgttgggttccaacagctcacggatgtatttcacacaaacattacttcccggactggcaggcccttctggcgagatggtgaaatctaccacaagcctgacatcctcttcgaccagtgggtcttccgataaggtctatgcacaccagatggtgcggaccgactctcgagagcaaaaacttgatgcattcctacagccactttcaaaacccttgagcagccagcctcaggcgatcgtgacagaagataaaacggatatctcatccggcagagcaaggcagcaagatgaggagatgctggagctgcccgctcccgctgaagtcgctgcaaagaatcagagtctggagggggacactaccaaaggcacttcagaaatgtccgagaagaggggaccgacttccagcaatccacgcaaacgacatagggaggactctgacgtggagatggtggaggatgatagccggaaagagatgaccgccgcttgcaccccaagacgccgtatcatcaacctcacaagcgtgctgtctctgcaagaagagatcaatgagcagggacacgaggtactccgcgagatgttgcacaatcatagcttcgttggctgtgtgaatccccagtgggccctggcccagcatcagactaaactctatttactgaacacgactaaacttagcgaagagctcttctaccagatccttatttatgacttcgctaattttggagtgctacggctgagtgagcccgctcctttatttgacctcgcgatgctggcactcgattctcctgagtctggctggaccgaagaagacggcccaaaagagggcttggccgagtacatcgtcgagttcctgaagaagaaagctgaaatgctggccgactatttcagtctggagattgatgaagaaggaaatctgatcggattgcctcttctcattgacaactacgtcccaccgctcgaaggactgccaatcttcatcctgaggttggcgacggaagtgaactgggacgaagaaaaggagtgtttcgagtcgctgtccaaagagtgtgccatgttctactcaattcgcaagcagtacatcagcgaagagtcaaccctgtctggacagcagtccgaggtacctggcagtatcccgaactcctggaagtggaccgtggaacacatcgtgtacaaggctcttcgctcccatatactccctcccaagcattttacagaagacgggaatattttgcagcttgcaaatctgccagatctgtataaagtttttgagagatgttag

SEQ ID NO: 222050 - DNA, 1884 bp, Artificial Sequence
  Description of Artificial Sequence: Synthetic coding sequence
atggcgtttggtggcggtctggagctggctcttggatgccactacaggatagctcacgctgaagctcaggtgggattgcctgaagtgacattagggctgcttcccggtgcccgaggtactcagctactgccacgcctcaccggcgtgcctgcggctctggatctcataacatcaggtagacgcatcttggccgacgaggcattaaagctggggatcttggacaaggtagtgaattcggacccagttgaggaggctatccggttcgcccagagggtgagcgatcagcctttggagtcccggagactgtgtaataaaccaatccaatcgctgcctaacatggattccatcttttctgaggctctcttgaaaatgcgtcgtcagcacccgggatgcttggctcaggaggcgtgtgttcgggcagtacaggccgctgtgcagtatccttacgaggtggggattaaaaaagaggaagagctctttctgtacctactgcagagcgggcaggcaagagcactgcagtatgcctttttcgccgagagaaaagctaataaatggtccaccccgtcgggagcctcatggaagacggcctctgcgagaccagtatcctcagtgggtgtggtcgggctgggaacaatgggcaggggtattgtaatttcgttcgctcgggctcgcattcctgtgatcgctgtcgatagcgataaaaatcagctggcgactgcaaataagatgattacaagtgtgcttgaaaaggaagcctcgaagatgcagcagagcggccacccctggtccgggcctaagcctcggttgacatccagtgtcaaagaacttgggggagtagatttggtgatcgaggcagtgttcgaggagatgtcactgaagaaacaggtgttcgcagagctcagtgcagtatgcaaacccgaagcattcttgtgtactaatacaagtgctctcgatgtggacgagatcgccagctctaccgatcgtcctcatcttgtgataggaacacacttcttcagccccgctcatgtcatgaagcttttagaagtcatccccagccaatattccagccccactacaatagccaccgtaatgaacttgtctaaaaaaattaaaaaaattggggtagtcgtgggaaattgctttggttttgtcggaaaccgaatgctcaatccctattacaatcaagcctacttccttctcgaggaaggctcaaaacccgaggaggtagaccaggtgctagaagaatttgggtttaaaatgggcccattccgagtgagcgacctggctggcctggatgtgggatggaaatcgcgtaagggccaaggtctgaccggaccgacactgctgcctgggaccccagctcgcaagcgcggaaatcggaggtattgtcctattcctgacgtgttatgcgagcttggcaggttcggccaaaaaaccgggaagggctggtaccaatacgacaagcccctggggagaattcacaaacccgacccatggctgagcaagttcttgagtcgatatagaaagacccatcacatcgagcccaggaccatcagtcaggacgaaatcctggaacgctgcctttacagcctaatcaatgaggctttcagaatcctgggggaggggattgcggctagtccagagcatatagatgtggtgtacctgcacggctacggttggcctaggcacaaggggggtcctatgttttacgcaagcacggtcggcctccccactgtcttggagaaactacagaagtattaccgccagaacccagatattccgcagctggagccttctgattacctcaagaaacttgccagccagggcaatcctccactgaaagagtggcagtccctagctggcagtccttcctctaaactatag

SEQ ID NO: 222051 - DNA, 1464 bp, Artificial Sequence
  Description of Artificial Sequence: Synthetic coding sequence
atggccgagtatacaaggctgcataacgctttagcccttataaggctacgcaaccccccagttaatgcaatttctacaacacttctgagggacataaaagaaggactacagaaggccgtaatcgaccacacaatcaaggctattgtgatctgtggcgcagaaggcaagttctcagcgggagcagacattaggggattcagcgctccccgtacatttggcctgactcttgggcacgtggtggacgaaatccagcgcaatgagaagcctgtcgttgcggcaatacagggtatggcctttgggggaggtctggaactggccctgggatgccattacagaatcgcacatgcggaggcccaggtgggtctgcccgaagtgaccctcggattactgcccggagcccgaggcacccagcttctgccaaggttgacgggcgtgccagcagctctggatttgattacctctggtcgccgaattctggctgatgaagccctgaaactaggtatactggataaggtggtaaactccgatccggttgaggaggcaatcagatttgctcagcgcgtgtctgatcaaccactggagagtagaagactttgcaataagccgatccagagcctgcccaatatggatagcatcttctccgaggccctcctcaaaatgaggaggcaacatcctggatgtctcgcccaggaggcatgtgtacgtgctgtgcaggctgccgtccagtacccatatgaggtaggaatcaagaaggaagaggagctgtttctctacctactccagtctggccaggctcgcgcactgcaatacgccttcttcgcggagaggaaggccaacaaatggtcgacaccatctggtgcgtcttggaagaccgcctcggccagacccgtgagttccgtgggcgtcgttggacttggcaccatgggaagaggaatcgtgatttcctttgctagggcccgaatcccagttatcgcagtggatagcgataaaaaccagctggccaccgcaaataaaatgattaccagtgttctggagaaagaggcaagtaaaatgcaacaaagcggccatccgtggagcggacccaaacctaggctgacatcctcggtgaaggaactcggcggagtcgacctcgtgatcgaggctgtttttgaggaaatgtctctaaaaaagcaggtttttgctgagctgagcgcagtctgcaagccagaggcctttttgtgcaccaacaccagcgcactggatgtggacgagattgcgagcagcacagacagaccgcacctggttattggcacacacttcttttcgccagcacacgtcatgaaactcctggaagtcatccccagtcaatattcctctcccaccactatcgcaacagtgatgaacctgtctaagaagataaaaaagatcggcgtagttgtgggaaattattcagtctccaagaaaaagaagaagaaaaaaaaatag

SEQ ID NO: 222052 - DNA, 6101 bp, Artificial Sequence
  Description of Artificial Sequence: Synthetic coding sequence
atgttcaagggcctgtccaaaggctctcagggaaaaggatcaccaaagggatcacccgcaaaaggttcaccaaaaggctctccatcccgtcacagccgcgctgcaactcaggagctggccctgctcatttcccgcatgcaggcaaacgccgatcaagttgaaagggacatcctggagactcaaaagcgcctgcagcaggatcggctgaattccgagcagagtcaggctctccagcaccagcaggagacggggcgatccctcaaagaggccgaggtcctcctgaaagatctgttcctcgacgttgacaaagctagacgattgaaacaccctcaggccgaagagattgaaaaagacattaagcagttacacgaacgggtcacccaagagtgcgccgagtatcgtgcactgtacgaaaaaatggtgctgcctcctgacgtgggcccaagagtagactgggcacgagtattggagcagaagcagaaacaagtgtgcgcaggccagtatggcccagggatggccgaacttgagcagcagatcgccgaacataatatacttcagaaggaaatcgatgcgtacggtcagcagttgagatccttagtagggcctgacgccgcaacaatccggtctcaatatagagacttactgaaggccgcttcttggcgcggtcagtccctcggcagcctgtatacacatttgcagggctgtactcgacagctgtctgccttggcggaacagcaaagacggattctgcagcaggattggtccgatttgatggctgaccccgcaggcgtacgaagagagtacgagcacttcaaacagcatgagctgctgtcccaagagcagtcggtcaatcagttagaagatgacggcgaaagaatggtggagcttagacatcccgcagtgggccctatacaggcccaccaggaggccttaaagatggagtggcagaatttccttaatttgtgcatatgtcaagaaactcagcttcaacacgtggaggactacagacggttccaagaggaagctgatagcgtcagccagacgctagcaaaactgaattctaatctggacgccaagtactcaccagcccctggaggtcctcctggggctcccactgaattgctgcagcaactggaggccgaggaaaaacgtttggccgtgacggagcgggctaccggtgacctgcagcggagaagccgggacgtcgccccactgccccagcggcgtaacccccctcagcagcctcttcatgtggacagcatttgtgactgggacagtggagaggtgcaactgctgcagggcgagcgatacaagttagtagacaacactgacccacatgcctgggttgtgcaaggacccggaggagaaactaaaagagcccctgcggcttgcttctgcattccagccccagaccccgacgcagtggcccgagcaagcagactggctagcgagttgcaggctttgaagcagaaacttgccacagtgcagagtcgactgaaagccagtgccgtagagtcattacgcccatctcagcaggctccatccggctccgacctggccaacccacaagcccagaagttgctcactcaaatgactaggctggacggggaccttgggcagattgagaggcaggtcctggcctgggcgcgtgcacccctgtccagacccactccccttgaagacttggaaggcagaattcattcccacgagggcacagcccaaaggctgcaatctctgggcaccgaaaaggagactgctcagaaggaatgcgaagcttttctctcgacccgccctgtgggacccgcagccctgcagttgccagtggctctcaactccgtcaaaaacaaattttcagacgtacaagttctttgcagtctctacggagagaaggccaaagcagccctggaccttgaacgccaaattcaggacgctgaccgggtgattcgcggatttgaagcaacgcttgtgcaagaagccccaatccctgctgagccgggtgcactccaggagcgcgttagtgagcttcagcggcaaagacgggagctgcttgaacaacaaacctgtgtgttgcggctacatagagcgctgaaagcgtcagaacacgcctgtgctgcactccagaataactttcaggagttctgtcaggacctcccaagacagcagcgccaggtacgagcactgacggacaggtaccacgctgttggtgatcagttagatctacgggagaaggtagtccaagacgcagctctgacttatcaacagttcaaaaattgtaaagacaacttgtcaagttggttggagcacctgcccagaagccaggtcaggccgtcagatgggcctagtcaaatagcctataagcttcaggcccagaagagattgactcaggagatccagtcccgggaaagggaccgggctactgcctcacaccttagccaggcccttcaagccgctctgcaggattatgagctgcaggcggatacctatcgctgcagtcttgaacccacactcgccgtgtcggcccctaagcgcccacgcgtggcccctcttcaggagtcaatccaggctcaggagaaaaatctagccaaagcatacactgaggtggcagcggcacaacagcagctactgcagcagctggagtttgcacgaaagatgctggaaaagaaggagctgagcgaggacattcgtagaacccacgacgccaaacagggttctgaatctcccgcacaggcagggagggaaagtgaggccctgaaagctcagcttgaagaagagagaaaacgggtggcgagggtccaacatgaactggaggctcagcggagccagctgctgcagctgcgtacccaacgacccctggagagattagaggaaaaagaagtggtggaattttaccgggatcctcagctcgaagggtcgctgtcaagggtgaaagcacaagtggaggaagaaggaaaaagacgggctggactgcaggctgatctggaagtcgctgcccagaaggtcgtccagctggagtctaagagaaaaactatgcagccgcatctgctcacgaaggaggtcactcaggtggagagagacccaggactcgactcgcaggcagctcaattaaggattcagatccaacagctgagaggagaagacgctgtgataagcgctcggctcgaaggcctgaagaaggagctcctggcgctggagaaacgcgaagtagacgtcaaggaaaaggtggttgtcaaagaggtggtgaaagtcgaaaagaatctcgagatggtcaaagctgcgcaagctctgagactccagatggaagaggatgccgctagacgcaagcaagccgaagaggcagtggctaaattacaggcgagaattgaagacttagaaagagccattagctcggtcgaaccaaaagtcatcgtgaaagaggtaaaaaaggtggagcaggaccccggattactgcaagaatccagtcggttgaggagcctgcttgaagaggaaaggacaaagaatgccactttggcacgcgaactgtctgacctgcattcaaagtactctgtagtggagaagcagaggcctaaagtgcagttacaggagcgggtgcatgagattttccaggtggatcccgaaacggagcaagaaatcacaagactgaaagctaaattgcaggagatggccggaaagcggtccggcgttgagaaagaggtcgagaaactgcttcccgacctcgaggtgctgagggcccaaaagccaactgtggaatacaaagaagttacccaagaagtggttcgacatgagcggtcgccagaagtactcagggagatcgacagactgaaagcccagctcaatgagctggtcaattcacatggtcggtctcaggaacagctcattcgcctccagggggagcgggacgaatggagacgcgagcgagccaaggtagagaccaaaaccgtgagcaaggaagtggtgagacacgagaaggaccccgtgctggagaaggaagctgagcgcctgcggcaggaggttagagaggccgcacagaagaggagggccgcagaagatgcagtgtatgagctccagtcgaaaagactcctgctcgaacgccgaaaacctgaggagaaagtcgtggtccaggaagtagttgtaacccagaaggacccaaagttgcgagaggagcacagccgcctgtccgggtcgctggacgaggaagtgggtcggcgtcgccagttggagctggaggtgcagcagctccgcgctggtgtcgaagagcaagaaggactactgtctttccaggaggaccggtccaaaaaactggcagtcgaacgagaattacggcaattgaccctccgcattcaggaactggagaagaggccacctactgtgcaggaaaaaatcatcatggaggaggtcgtcaagctggaaaaagatccagatttggagaagtctacagaagcgctgcggtgggatttggaccaagaaaagacacaagtcacagagcttaaccgagagtgtaaaaatttgcaggtgcagatagatgtactgcaaaaggccaagtctcaggagaaaaccatatacaaggaggtgatcagggttcagaaggaccgggtcctggaggacgagagagcacgggtatgggagatgttgaatcgagaaagaactgctaggcaggcccgagaagaggaggcacgccgtttgagagagaggattgatcgggctgaaacacttggaaggacgtggtcgcgcgaggagagcgagctgcagagagcccgtgatcaggcagatcaggagtgtggcaggctgcagcaggagctacgtgccctggagagacagaaacagcagcaaactctgcaactgcaagaggagagcaagttgctcagtcagaaaacagaaagcgagagacagaaagcagcccagaggggtcaagagttgtcaaggctagaagcagcgattctgcgagaaaaggaccaaatatatgagaaggaaaggactcttagggatcttcatgctaaagtgtcacgagaggaactgagccaggaaacccagactcgcgagactaacctgagcacaaaaatatcaatactggagcccgaaaccggcaaagacatgtccccctacgaagcttataaacggggaatcattgaccggggtcagtacctgcaattacaggaactggaatgcgattgggaagaggtgaccacatcaggaccatgtggcgaagagtcagttctcttggatcggaagagcggcaagcagtattctatagaggctgccctgcgctgcaggcgaatcagtaaggaggagtaccatttatataaggacggccacttaccaatcagtgagtttgctttgttggtggccggagagacaaaacccagcagctccctctcaatcggaagcatcatctccaaaagtcccctcgccagccccgctcctcaatcaacctctttcttttcaccatcattctctttaggactaggtgacgacagtttccccatcgccggaatctacgacacaaccacagacaataagtgttcaattaagactgccgttgcaaaaaatatgctggaccccataaccggtcagaaattgctggaggctcaggctgccacgggaggcatagttgatttgctatctcgcgagaggtacagcgtccacaaggccatggagaggggtctgattgagaacacttctactcagcgattgctcaatgctcagaaggcattcaccggaatcgaggaccctgttactaagaagagactgtctgtcggcgaggctgtgcagaaggggtggatgcctcgcgaatcagtccttccccatctacaggtgcagcatctcactggagggcttatagatcctaagagaacaggtcgtattcctattcagcaggccctcctcagcggaatgatcagcgaggaactggcgcaattgctgcaggacgagtcctcatatgagaaggatctcaccgaccccatcagcaaggagcggctgtcatacaaagaggctatgggcaggtgtcgcaaagatccattgagtggcctgctcctgttaccagccgcattggaaggctatcgctgttaccggtcagcctcgccaaccgtaccacggtcgctgcggta

SEQ ID NO: 222053 - DNA, 2061 bp, Artificial Sequence
  Description of Artificial Sequence: Synthetic coding sequence
atgcaactgggtgagcagctgctggtcagcagtgtgaacctccccggagcacacttttacccactcgagtcagcaagagggggtagcgggggttctgcaggtcatctgccatccgcggctccgtcacctcaaaaactcgacctcgataaggcctcaaagaagttctccggcagtctgtcttgcgaggcggtcagtggggagcccgcagccgcaagtgccggagcacccgctgctatgttgtccgatactgatgccggagatgctttcgcgagcgcggcagccgtggcgaagccaggaccacctgatggtagaaaggggtcaccttgcggcgaggaggagctacccagcgcagcggctgcagccgcagccgcagccgcagccgctgccgcaacagcgcgttactcgatggacagtttgtccagtgagagatactacctgcaatcacccggaccccaggggtctgagctcgccgcaccatgctcgctctttccgtaccaggcagcggcaggggcaccgcatggcccagtgtacccagccccaaatggcgcacgctacccctatggatctatgcttccgccaggaggctttccagcggctgtgtgtccccctgggagagcccagttcggtcctggggcaggtgccggatcaggtgccggaggatcttcaggcggagggggtgggccaggcacctaccagtacagccagggagctcctctctacggcccttatccaggcgcagccgctgccggatcgtgcgggggactgggcggtctcggcgtgcctggttccggcttcagagcccacgtctatctctgtaacaggcccctttggttaaagttccaccgacaccagactgagatgattatcacaaaacaaggacgtcgcatgttccctttcctgagctttaatattaacggactcaaccccactgcccattacaatgtgtttgtcgaggtggttttggccgaccctaaccactggaggttccaagggggaaaatgggtaacctgtggtaaggcagataacaatatgcaggggaacaaaatgtatgtgcacccggagagtcctaacactggatcccattggatgcggcaagagattagcttcggaaaactgaaactaactaataacaaaggtgccaacaacaacaacacgcagatgattgttcttcaatctctgcataagtaccagcccaggctccacattgtggaagtcactgaggatggagtagaggatctgaacgagcccagtaagacacagactttcactttctctgagactcagttcatagccgtcactgcctaccagaacacagacatcacacagctgaagatcgatcataatccattcgctaaaggcttccgcgataattatgattcctcacaccagatcgtgccagggggacgatacggggtgcaatccttctttcccgaacctttcgtcaataccctgcctcaagccagatactacaatggagagaggactgttccacagacaaacggacttctctcgccacaacagtccgaagaggttgcaaatccaccgcagcgctggctagttactcccgtgcagcaaccaggcacaaacaagttggatataagctcctatgagtcagagtatacgtcaagtaccctcctgccctatggcattaagagcctgcccctgcagacttcacacgccctgggctactatcctgaccctaccttcccggcaatggccggatggggtgggaggggatcataccaacgcaagatggcagcgggactcccttggacttccagaacaagcccgaccgtgttctctgaggaccagttgtctaaggaaaaggttaaggaggaaattgggtccagttggatagagacgccgccaagtatcaaatccttggactccaatgactccggcgtctacacatctgcgtgcaaaaggagacgattaagcccatcaaattcaagcaatgaaaattcccctagtatcaagtgtgaggatatcaatgcagaggaatattcaaaagacaccagcaaggggatgggaggatactatgctttttatactacaccctag

SEQ ID NO: 222054 - DNA, 2118 bp, Artificial Sequence
  Description of Artificial Sequence: Synthetic coding sequence
atgcagctgggagagcagcttctggtgagtagtgtgaacctgccaggggctcacttctatcctctcgagagtgccagaggcggttccggcggttccgctggtcatctgccttccgctgcaccgagcccccagaaattggacctcgataaagcatctaaaaaatttagcggatcgctgagttgcgaggctgtctcgggggaacccgcagccgctagcgccggtgcccctgctgctatgctgtccgatacggatgctggcgatgcctttgccagtgcagctgccgtggctaagccagggccacctgatggcagaaagggtagtccatgcggcgaggaggagttgcctagcgccgctgcggcagccgcagcagcagcggctgctgctgccgctactgctagatactctatggatagcctcagcagtgagcgatattacctccagtcccctggtccccagggttccgagctggcagccccttgttctcttttcccttaccaggccgcagccggagcacctcacggtccagtttaccccgcaccaaatggcgctaggtacccatacggatcaatgttgccccctggcggtttcccagccgctgtttgtcctcccggtcgtgcacaatttggcccaggcgcaggtgctggctccggagctgggggatcctcaggaggaggcggaggcccaggaacgtaccaatattcccagggcgctcccctctacggtccctacccaggcgctgcggcagcaggcagctgcggtggcttgggcggattgggggtgccaggttccgggttcagagctcacgtgtacctgtgtaaccgccctctgtggttgaaattccatcggcaccaaaccgagatgattatcactaaacagggcaggcgcatgttcccttttttgagctttaatattaacgggctgaaccccaccgcacactacaacgtgttcgtggaagtggtactggccgatcccaaccattggcggttccagggaggcaagtgggtgacttgtgggaaagccgacaataacatgcaaggcaataagatgtacgtgcaccccgaatcaccaaatactgggtctcactggatgcgccaagagatttccttcggcaaactgaagttgacaaacaacaagggtgctaacaataacaacacccaaatgatcgttctgcagtccctgcacaaataccagcctcgactgcatattgttgaggtgactgaagatggcgttgaggatttaaacgaaccaagcaagacacagacattcacgttctccgaaacacaattcatagccgtcacagcttatcagaacacagacattacacagcttaaaattgaccataatccctttgccaagggattcagggacaattacgacagtatgtacaccgcctcagagaatgacagactgaccccatcccctacagactcccctcgatcccatcagatagttcccggtggtcgctatggcgtgcagtcgttcttccccgaaccgtttgttaacactcttccacaagccagatactataacggagaacggacggttccacaaaccaacgggctactgtcaccgcaacaaagtgaggaggttgccaacccgcctcagcgatggcttgttacacctgtacagcagccaggcaccaacaaattggacatttcaagctatgaatctgagtatacgagtagtactctgctgccatatgggattaagtcattgcccctgcagacctctcacgccctcggatactatccagatccaactttcccagctatggcgggatggggtggacgcggatcatatcagcggaagatggcagctggattaccatggacatctagaacaagcccaaccgtgttctctgaggaccagttgagtaaggagaaagtaaaggaggagatcggaagtagttggatagaaacccccccatccattaagagtctggacagcaatgatagcggggtctacacatccgcctgtaaacggagaaggttgtcaccatcaaattcatcgaacgagaactcccctagcattaagtgtgaggatataaatgccgaggaatatagcaaagatacatcaaaaggaatggggggatattacgccttctacacaaccccttag

SEQ ID NO: 222055 - DNA, 1713 bp, Artificial Sequence
  Description of Artificial Sequence: Synthetic coding sequence
atggatagcctaagctcagaacgctactacctccagtcccccggaccacagggcagtgagctggcagccccttgttccctgttcccataccaggccgcagcaggggcaccccacggtccagtctatcccgctcccaatggagcaaggtatccatatggcagcatgctgcctccagggggattccccgcagccgtctgtccccctggccgagcccaattcggcccaggcgctggtgcagggtcaggcgctgggggatctagcgggggaggaggagggcctggcacatatcaatatagtcagggcgctcccttatatgggccttatccaggcgctgccgcagctggaagctgcggcggattgggcggattaggggtacctggctccggtttccgggctcacgtgtatctgtgcaatagaccattatggttgaagttccatcgccaccaaactgaaatgatcatcacaaaacagggtaggagaatgttcccctttctgtcttttaatatcaacgggctgaatcctacggctcactataacgtcttcgtagaggtagtgttagctgaccctaatcattggcgcttccagggcggtaaatgggtcacatgcgggaaggctgacaataacatgcaaggtaacaaaatgtacgtgcacccagagtctccaaacaccgggagccactggatgcgtcaggagatctcattcggcaagctcaagttgaccaacaataaaggggctaataacaacaacacacaaatgatcgtgctgcagagcttgcataaataccagccaagactccacatcgtggaggtaaccgaagacggagtggaagacctcaatgagcccagtaagacccagacattcacattctcggagactcagttcattgccgttaccgcgtatcaaaacacagacatcacacagcttaaaatagatcacaaccctttcgcaaagggattccgggacaattatgacagtatgtatacagcatcagaaaacgaccggctaacaccaagtcctacagatagccctcggtcacatcagattgtgccaggcggacgctacggcgtccagagcttcttccccgagccatttgtcaatacacttccacaggctagatactataacggtgaaagaactgttcctcaaaccaacggcttgctttccccgcaacagtccgaagaagtggcaaacccccctcaacggtggctggtgaccccagtgcagcaacctggcaccaataaactggacatctccagctacgagtccgaatatacctcttcaacacttctgccctacggaattaagagcctgcctttgcagacatcgcatgccctgggatactaccccgacccaacctttcccgctatggccggatggggtggacggggttcctatcagcgcaagatggcggctgggctcccttggacctctcggacaagtcccaccgtcttttccgaggaccagctaagcaaggaaaaggtgaaagaggagatcgggagcagctggattgagacacctccgtccattaaatcgttggattccaatgattctggcgtctacacttccgcgtgtaaacgcagacgtctctccccttccaactcttccaacgagaatagcccttcgattaagtgtgaggatattaatgcagaagaatacagcaaagacacttcaaagggcatgggcggttactatgccttttacaccaccccttag

SEQ ID NO: 222056 - DNA, 1233 bp, Artificial Sequence
  Description of Artificial Sequence: Synthetic coding sequence
atgtttccatttctgtcttttaacattaatgggctcaaccccactgcccattacaatgtctttgtcgaagtcgttctggccgaccccaaccactggagatttcaagggggaaagtgggtcacatgtggcaaggcggataacaatatgcagggcaataaaatgtatgtccacccagagagtccgaatacaggatctcattggatgcgacaggagatctctttcggcaaactcaaacttaccaacaataagggcgctaataataataacacgcagatgatcgtactgcagtccctgcataagtatcaacctagactgcatatcgtggaagtgaccgaggatggagtggaggatctgaatgagccatctaagacgcagaccttcacatttagcgaaacccagttcatcgctgtgactgcttatcagaacacagacatcactcagctgaaaattgaccacaatccgttcgccaaggggttccgcgataactacgactcaatgtataccgcctccgagaatgatcgtctcaccccatccccgaccgactcgcctaggtctcaccagattgtaccaggcggtaggtatggtgtccagtcatttttcccagaaccgtttgtgaataccctcccacaggccaggtattacaatggcgaaaggaccgttccccagacaaatgggcttctttctccgcagcagagtgaagaagtcgctaatccccctcagagatggctggtgacccccgttcaacagccgggtaccaataaactggacattagcagctacgagagtgagtacactagcagcaccctactcccttacggaattaaatcattaccacttcagacctcacacgcactagggtattacccagacccgaccttcccagcaatggccggatggggagggagggggagctatcaacgcaaaatggctgcaggcctgccatggacaagtagaacatcacccacagttttttctgaggatcagctcagcaaggagaaagtcaaagaagagatcggctctagctggatcgaaaccccaccatcaatcaaatctttagactccaatgattccggggtatatacctcagcctgtaagagacggaggttgagcccctcaaacagctccaatgagaattctcccagcattaaatgtgaagacatcaacgcagaggagtattcaaaagacaccagcaagggtatgggtggatactacgcattctataccactccctag

SEQ ID NO: 222057 - DNA, 1269 bp, Artificial Sequence
  Description of Artificial Sequence: Synthetic coding sequence
atgggacaagccggatgcaaaggcctatgtctgtccttgttcgactacaaaacagaaaaatacgtgattgccaagaacaaaaaagtgggcctgctgtaccggctcctgcaggcctcaatccttgcgtatctggtcgtctgggtgttcctgatcaaaaagggatatcaggatgtggatacttccctgcagagcgctgtgatcacgaaagtgaaaggcgtggcatttacaaacacttccgacttagggcagaggatttgggacgtggcagactatgtcatccctgcacagggcgaaaacgtatttttcgtcgtaactaatcttatcgtgacacccaatcaacgtcagaatgtttgcgcggaaaatgagggcattcccgatggggcatgctccaaggactctgactgccatgctggcgaagccgttaccgccggtaatggagttaagaccggcaggtgtctgaggagggagaatctggcaagaggtacctgcgagatctttgcctggtgcccgctggagacatcttcccggccagaagaaccattcttgaaggaagccgaggatttcacaatatttatcaagaaccatattcggtttcctaagttcaattttagcaagagcaacgtgatggatgtcaaggacaggagttttttaaagtcctgtcactttgggcctaagaatcattactgcccgatctttcggctcggctctgtgatcaggtgggcgggttccgatttccaggacattgccttggagggaggtgtgattggtatcaatatcgagtggaactgcgatctggacaaggctgcaagcgagtgccacccacactatagtttcagtcggctggataataaattgtcgaagagcgtgtcctctgggtataatttccgcttcgccaggtattacagggatgccgctggcgtggagttcagaacgctcatgaaggcttatggcattcggttcgacgtgatggtcaatgggaagggcgctttcttttgcgacttagtcctgatttacttgataaaaaaacgcgaattttacagagataagaagtacgaggaggtacgcggtctggaggattctagccaggaggctgaggacgaggccagtggtttggggttgagtgagcagttgactagtggcccagggttactcggcatgcctgaacagcaggaacttcaggagcctccagaggccaagcgtggctccagtagccagaagggtaatggatccgtgtgtcctcagctgctagagccacaccgatcaacctag

SEQ ID NO: 222058 - DNA, 564 bp, Artificial Sequence
  Description of Artificial Sequence: Synthetic coding sequence
atgagcgaaatggccgagctgtccgaattatacgaggagtctagcgacctgcaaatggacgtgatgcccggagagggagacttgccacagatggaagtgggctccgggagccgagaattatcactccggccaagcagatccggagcccagcagctggaggaagaagggcctatggaagaagaggaggcgcagccaatggcagccccagaggggaaacggtcgctagctaacggcccaaacgcaggtgaacaaccagggcaggtggcgggagcagactttgaaagtgaagacgaaggagaagagtttgatgactgggaagacgattatgattaccctgaagaagaacagctgtccggggctggttatagagtgtccgcggcactcgaggaggccgacaaaatgttcttgcgtactcgcgaacctgccctcgacggagggtttcagatgcattacgaaaagactccctttgatcagctcgcgttcatcgaggaactgtttagtctgatggttgttaaccgcctgaccgaggagctcggctgtgatgagataattgatcgggagtag

SEQ ID NO: 222059 - DNA, 711 bp, Artificial Sequence
  Description of Artificial Sequence: Synthetic coding sequence
atgtcaaagctacccgctgatagctccgttccccagacgggggcagcgaacggggatcgggacgtcccacaggctgaggtgggcaggggaaggagagagcccgcacctgcccaaccagaagaggcaggagagggcgcaatggccgctgccagaggtggccctgttcctgcggctcgcgaggggagaatggctgcggctagggccgcacccgcagccgcagcccgaggggctcccgtggctgcagcagcactggccagagctgccgctgcgggaagggaaagcccagcagccgctgctgccagggaggccagaatggcagaagttgcgaggctgctaggcgaaccagtggatgaggagggaccagagggaaggcctagatcccgacacggtaatggcggattggccgctctgccatatcttaggctgcggcatccactctccgtcctggggataaattatcagcagttcctcaggcactacttggagaactacccaatagcccctggtcgaattcaggaactggaggaaaggcgtaggaggttcgtcgaggcatgcagagccagagaggccgcattcgacgcggagtatcagcgaaatccgcaccgcgttgacttagacatcctcactttcacaatcgctctcacggcgagtgaggtcataaaccctctcatcgaagagctaggatgcgacaagtttattaaccgcgagtag

SEQ ID NO: 222060 - DNA, 564 bp, Artificial Sequence
  Description of Artificial Sequence: Synthetic coding sequence
atgtccaaactgcctgccgattcctccgtgccccaaaccggcgctgcaaacggggaccgagatgttccacaagcagaggtgggcagaggcagacgagagccagctccagcccagcctgaagaagcaggggagagccccgctgcagctgctgctagggaggcacgaatggcagaggtggctaggctccttggtgagcccgtagacgaggaagggcctgaaggccgacctcggtcccgacatggaaacgggggtctggctgctcttccctacctgaggctgaggcacccactgtcagtgcttggcatcaattatcagcaattccttagacactacctggagaactacccaatcgctcccggaaggattcaagagctggaggaacgacgacggaggttcgtggaggcctgtagagcacgagaagccgctttcgacgcagagtaccagcggaacccacaccgagtagatctggacattctgaccttcacaatagccctcactgctagcgaagtcataaatccgctgatcgaggagttgggctgtgataaattcattaacagggaatag

SEQ ID NO: 222061 - DNA, 1002 bp, Artificial Sequence
  Description of Artificial Sequence: Synthetic coding sequence
atgaaaatggatgtaagcgtcagggctgctggttgtagtgatgacctcagctcaggcgaggctgatgtggacccgaagttgctcgaactaaccgctgatgaagagaaatgcagaagcatcagaagacagtatcgacagctgatgtactgtgtgcgacagaaccgtgaggacatcgtgtcctcggccaacaactctctcacggaggctctcgaagaagccaacgtcctatttgatggggtgtcacgtactagggaggctgccctggatgcaaggttcttggtaatggcaagcgatttgggaaaagagaaggccaaacagctgaactctgacatgaacttcttcaatcagttagccttttgcgacttcttgtttctctttgtgggtttaaattggatggagggagacccggacaaactctcagattgcgacgattctattgccctgtcgttctggaaggccattgagaaagaagctaccagttggatggtgaaggccgagacctttcatttcgtgtttggctccttcaaactcgaaagatcagcaccgaaaccaagactcgagcaccagaaaaaggtgcgaaagatggaggagaatggaaacatgcccaccaaattgcagaagttagatctgtcatcatacccggaggctaccgagaagaatgttgaacgcattctgggcctactgcagacatacttccgcaagtatccggatacgcccgtgtcctattttgagttcgtcattgacccaaactccttttccagaacagtggagaatattttctatgtttcattcattgtccgcgacggattcgcgagaatcaggctggatgaggaccgcctcccaattctcgaaccaatgaacgtgaaccagatgggtgagggcaacgactcctcttgtcacggcagaaagcagggcgtcatttcccttaccctacaagaatggaaaaatatcgtcgctgcatttgagattagcgaagcaatgatcacgtactcgtcttactag

SEQ ID NO: 222062 - DNA, 2931 bp, Artificial Sequence
  Description of Artificial Sequence: Synthetic coding sequence
atggagcgtcgatggcctctagggctcggactggtcttgctcctgtgcgcaccattgccacccggtgcacgagcgaaggaagttaccttgatggacacctctaaggctcaaggtgagttgggctggctcctagatcctccaaaggacggatggtctgagcagcaacaaattctcaacgggactccactatacatgtaccaggattgtccaatgcaaggcaggcgcgacacagatcactggcttcggtctaactggatttaccggggagaagaggcatcccgcgtgcacgtggagcttcagttcacagttagggattgcaagtctttccccggtggggctggcccacttggatgcaaggaaacctttaatcttctgtatatggagagcgatcaagatgtgggcatccaactgcgtcgtccgctgtttcagaaggtcaccaccgtggcggctgaccagtcttttacaatccgagacttagtgagcggctccgtcaagcttaatgtggaaagatgctccctgggtaggctgaccagacggggactttatttagccttccataaccctggcgcttgtgtcgccctcgtatctgtgcgtgtgttttaccagaggtgcccagaaacattgaacggcctggcacaattcccagacactcttcctggaccagcgggtttagtggaagtcgccggtacctgcctgccgcatgcgagggccagcccacgcccttccggcgcaccacggatgcactgtagtcccgacggagagtggctcgtgccagtcgggagatgtcattgcgagcccggatacgaggaaggcggatcaggcgaagcttgtgtcgcctgtcccagcgggtcctacagaatggacatggacaccccacattgcctcacctgtcctcagcaatccacagccgagtcggagggggctacaatctgcacctgcgagagtgggcattacagagcacctggggaaggccctcaggtggcgtgtacaggtccaccaagcgcccctcggaatcttagtttcagtgctagcggtacccagttgtccctgcgctgggaaccccctgctgacaccggcggaaggcaggacgtcagatatagtgtcagatgttctcagtgccaaggaactgctcaggatggcggaccttgccagccctgcggtgtgggggttcacttctcacccggagccagaggcctgacaacacctgctgttcacgtgaacggtcttgaaccctacgcaaattatacctttaatgttgaagcccaaaatggtgtctctggcctgggttcatctggacacgcttctacatctgtctccatctctatgggtcacgccgagagcctgtcgggattgtcactgcggctggtgaagaaagagccgaggcagctggaactgacctgggctggcagccggccaaggtccccaggggcaaaccttacctacgagttgcacgtcttaaaccaagatgaagaacgctaccagatggtactggagcccagggtgctgctgacagaactgcagcccgacactacctacatcgtacgggtacggatgcttactccgttgggtcccggacctttcagccctgatcatgaattccgcacatctccacctgtgtctagagggctcactggcggagaaattgtggcagttatctttggtttgctcctcggtgcagccctactcctaggtatccttgtgttcagatcccgacgggctcagcgccagcggcaacagagacagcgtgacagagcaactgacgtcgaccgagaagacaagttgtggctgaagccttatgtggacttgcaggcttatgaggacccagcacagggtgcactggatttcacccgagagcttgaccctgcttggctgatggtcgatacagtgattggcgagggagagttcggggaagtgtatcgagggaccctcaggctcccttctcaggactgcaaaaccgtggcaatcaagacactcaaagacactagtcccggaggacagtggtggaacttcctgagagaagcaaccataatggggcagttttctcatcctcacattctacatttagagggtgtagtcacgaaacgcaagccaataatgataatcaccgagttcatggaaaacggcgcactggatgcgttcctgagagagagggaagatcagctcgttcccggacagctggtggctatgctgcagggcatcgctagcggtatgaactacttgtctaatcacaattacgtgcacagggacctagccgcacggaatatactcgtaaatcagaacctttgttgcaaagtcagtgatttcggcctgacacgcctgctggatgactttgacgggacttatgagactcagggtggaaagattccaatacgctggacagcccctgaggccatcgcccacagaatctttacaactgcctcagatgtctggagcttcggcatcgtaatgtgggaggtgctctctttcggcgacaaaccttacggagaaatgtccaatcaggaagttatgaagtcaatcgaggatggttatcggttgcccccacccgtcgactgtcctgcccctctgtacgagctgatgaaaaactgttgggcctatgaccgagcacgacgtccccacttccagaaactccaggcccatctcgaacaattgcttgccaatcctcatagcctccgcaccatcgctaattttgacccaaggatgactttaagactcccaagcctgtccggcagcgatggcatcccttacagaaccgtgagcgagtggctcgaatctatccgaatgaagcgctatattctgcacttccacagtgccggtttggatactatggaatgtgtgcttgaactgacagctgaggatctgacacagatgggcatcaccctaccgggacatcaaaagaggatcctctgcagcatccagggattcaaggactag

SEQ ID NO: 222063 - DNA, 888 bp, Artificial Sequence
  Description of Artificial Sequence: Synthetic coding sequence
atggaaacttgtgccggacctcatccactcagattgttcttgtgtagaatgcagctttgtctcgccctattgctaggcccttggcggccaggtaccgccgaagaggtgatcctcctcgacagcaaggcaagccaggctgagctgggctggactgctctgccttccaatgggtgggaggagatctccggcgtagatgagcacgataggcctattcgcacttaccaagtgtgcaacgtgctggagccgaaccaggataactggcttcaaactgggtggatcagtcgcggaagggggcagcgaatcttcgtggaactacaattcaccctcagggattgtagctctatcccaggagctgcaggtacctgtaaggagacctttaacgtatactacctggagaccgaggctgacctggggcgtggacggcctcgtctgggaggatctaggccacgaaaaattgacacgattgctgcggatgagagtttcacacaaggtgatcttggcgaaagaaaaatgaagctcaataccgaggtgcgtgaaataggcccactttctagaagaggctttcatctggccttccaggatgtgggcgcttgcgtggcattggtgtcggtcagggtatattataaacagtgtcgggctactgtgagggggctggccacgttcccagctactgccgcagagagcgcattttctactctggtcgaggtcgctggtacatgcgtcgcccacagcgagggagagccaggctctcccccacgcatgcattgtggggcagacggggaatggctggtgcccgtcggacggtgtagctgcagtgcaggcttccaggagcggggtgatttctgcgaaggcattcaactggccggaggacgtggcgtcggagtgtag

SEQ ID NO: 222064 - DNA, 1632 bp, Artificial Sequence
  Description of Artificial Sequence: Synthetic coding sequence
atggtcaagacaggtgccccaaccgttacagtgacaaatcttaagcccgctactcggtacgtcttccagatccgggcagcctctcctggtcccagttgggaagcccagagtttcaatccatccatcgaggtgcaaactctgggcgaggccgcaagtggctcgcgcgaccagagccctgctattgtggttacagtcgtgaccatttcagccctcctggtcctcggatctgttatgagcgtgctggctatctggcgcaggccatgtagttatggaaagggtggcggagatgcccatgatgaagaagaactgtattttcacttcaaggtgccaaccagacgtacctttttagaccctcagagctgcggagacctgctccaggccgtgcatctgtttgcaaaggagctagatgcaaagtccgtgacattagaacgctccctgggtggcggaaggtttggcgagctttgctgcggatgtctccagcttccaggcaggcaggagcttttggttgccgttcatatgctccgggattcagcctcagatagccagaggttgggtttcctggccgaggcactaaccctgggacaattcgatcattcccatatcgtgaggctggagggcgttgtgactcgcggttcgaccctgatgatcgtaacagagtacatgagtcacggtgcactggatggatttctcagacgtcacgagggtcagttagtggctggtcaactgatgggcctgctcccaggactcgcatctgccatgaagtacttgtccgaaatgggatatgtgcacagaggcctggccgcacgtcacgtgcttgtcagcagcgacctggtgtgcaaaatatcagggtttggtagaggtcctcgggacaggtccgaggccgtttataccaccatgtccgggcgtagccccgcactttgggccgctcctgaaacgctgcagtttggccatttcagctctgcttcggacgtgtggagttttgggataatcatgtgggaggtgatggcctttggggagaggccatattgggatatgtctgggcaggacgttatcaaggccgtggaagatggatttcgcctgcctccacccagaaactgccccaatctgctacataggctcatgttagactgctggcagaaggatccgggagagagacctagattctcccagattcacagtattttgtctaagatggtccaggatccagaacccccaaaatgtgctctgactacttgcccacggcctcccacccccctagcggatcgtgcttttagtacctttccctcctttgggtctgtcggagcttggttagaagcactggatctgtgtcgctataaggacagctttgccgctgcaggctatggctcactggaggcagtcgcagaaatgactgctcaggacttggtatcgttgggtatctctctggccgagcatcgggaggctctcctgagcggcattagcgctctgcaggcccgagtactgcagctccagggacagggagtgcaagataataaaaaccttagcgtgatatggtgcctgtttgagtggcagcttctggatcactgcatagcaggcgttgaaggcttgctgccaccttcatccagaaccggagtgtcccgcatttgcgtgtag

SEQ ID NO: 222065 - DNA, 3027 bp, Artificial Sequence
  Description of Artificial Sequence: Synthetic coding sequence
atggagacatgcgctggccctcacccactgcggctgttcctttgtcggatgcaactgtgtttggcgcttctcctgggcccatggagaccagggacagcagaggaggtgatcctgttagattccaaggcttcacaggccgagttgggttggactgcattgcccagtaatggatgggaagagatttcaggcgtggatgagcatgatcggccaatacggacatatcaggtctgtaacgtcttggagccaaaccaggataactggttgcagacaggatggattagccggggaaggggccagaggattttcgtggaactgcagttcacactcagagattgttcttccatccccggagctgcaggcacgtgcaaggagactttcaatgtgtactaccttgaaacagaagccgacctggggaggggccgacctagactggggggatctagacctcgaaagattgacaccatagccgctgatgagagtttcactcagggggacttaggtgaacgcaaaatgaaactgaatacggaggttagggaaattggtcctctttctcggaggggtttccacctcgcttttcaggacgttggagcgtgtgtggcattagtgagcgtgcgcgtatactataagcagtgccgtgccactgtcaggggactggccactttccccgcaactgctgctgaaagtgccttcagtactctagtggaagtggctgggacatgcgttgcacattctgagggggaacccggatctcctccccgaatgcactgtggcgcagacggcgaatggctagtccctgtgggacgctgctcttgcagcgcaggatttcaggagcgaggcgacttctgcgaagcctgccctcctggtttctacaaggtttctccgagacgcccactctgtagcccttgtcccgagcatagcagggcactcgagaacgctagtaccttctgtgtctgtcaagacagctatgctcggtcgcctacagacccaccttctgcctcctgcactcgacctccatccgccccacgtgatctgcagtactctctcagccgatcccccctggttctgagactgagatggctgccacctgcggacagtgggggtcgcagcgacgtgacttattcgctgctctgtctgcgttgcggcagggagggccctgccggagcttgcgaaccttgcggacctagggtggcctttctgcctcggcaggctgggttacgggagagggctgccaccctgctgcacttgaggccaggtgccaggtatacagtgcgggtggcagccttaaacggcgtgagtggaccagccgctgccgctggcactacttacgcgcaggtcaccgtttccaccgggcctggggcaccgtgggaggaagacgaaatcagaagggatcgcgtggagccacagagcgtatctctgtcatggagggaaccgattcctgcaggagcaccaggggcaaatgacacagagtatgagattaggtactacgaaaaaggccagagcgaacagacatactctatggtcaagacgggcgctcctacagtcacagtgaccaacctgaaacccgctacaagatatgtctttcagattagggcagcaagcccagggccttcatgggaggctcagtctttcaatccatccattgaagtacagacattgggtgaggctgcctctgggtctcgcgatcagagtcccgcaattgtagtgaccgtggtcacgatctctgcactgctcgtgctggggagtgtgatgtcagtgttggcaatttggcggcgaccttgctcttacgggaagggtggtggcgacgctcacgatgaagaggagctgtactttcattttaaggtccctacccgcagaacttttctcgatccacagagctgtggcgatctgctgcaggcagtccatttgtttgctaaagaactggacgcgaaaagcgtcactctggaacgttcattaggtggcggaaggtttggagagctttgttgcggctgcctgcagcttcctggacgccaagaactgctagtggcggtccacatgttacgggacagcgcctcagactctcaacgcctggggtttcttgcagaagctctgaccttagggcagttcgaccacagccacattgtgcggctggagggggtggttactcggggaagcacgctcatgatagtgactgagtatatgagccacggtgcacttgatggcttcttacgacggcatgaggggcagctggtggctggccaacttatgggcctgctgcccggtctggccagcgccatgaagtatttgtctgaaatgggatatgtgcacagaggcctggcagcccgacatgtcttagtcagttctgatttagtgtgcaaaatcagcgggttcgggagaggcccaagggaccgctcagaggctgtttatactaccatgtccggcaggagccctgctttatgggccgctcctgaaacgctgcagtttggccacttttctagcgcctcagacgtgtggagtttcggtattatcatgtgggaagtgatggcatttggagaacgcccttactgggacatgtccggccaggacgtgattaaagccgtcgaggatggttttcgcctcccacctcccaggaattgtcctaatctgctccacagattgatgctggattgctggcagaaagatcccggagaaagacctcgcttcagccagatccatagcatcctgtctaaaatggtgcaggaccctgaacctcctaaatgcgctctgactacatgccccagaccccctacgcccctggccgatcgtgccttttcgaccttccccagtttcggtagtgttggagcatggcttgaagccctcgatttatgtcgttataaggattcttttgcagctgccggatatggctcattggaggccgtggctgagatgacggctcaggatctggtatccctgggcatctccttagcggagcacagagaggccctcttgtccggtatcagcgcattacaggctcgcgtgctgcagcttcaaggccagggcgtacaagtgtag

SEQ ID NO: 222066 - DNA, 3045 bp, Artificial Sequence
  Description of Artificial Sequence: Synthetic coding sequence
atggagacctgcgctggtcctcatccacttcgcctgtttttgtgtaggatgcagctgtgccttgcactactcctgggcccatggagacctgggacagccgaggaggttatcctcctggactccaaggcttctcaggccgaacttggctggaccgctctgccatcaaacggatgggaagaaatatccggcgttgatgaacacgacagaccgattcgcacttaccaagtatgtaatgtgctggaacctaaccaggataactggctgcagaccggttggattagccgcggtcgcggtcagagaatatttgtggagttgcaattcacgctgcgggactgttcatctattcccggagctgccggaacctgtaaagaaaccttcaatgtgtactacctggagactgaagcagatctgggcagaggaagaccacgactggggggaagccgtcccaggaaaattgatactatcgctgccgacgagtcttttactcagggcgatttgggtgaaagaaagatgaaactcaacaccgaggtccgagagattggacctttatctaggaggggtttccacctcgctttccaagacgtgggggcttgcgtcgcgctcgtatctgtgcgcgtgtattataagcaatgcagggctacagtgagaggcctggccacctttccggcaacagctgcagagtctgctttcagcaccctcgtcgaggtggctggcacctgtgtcgctcactcagagggggagcccggaagtcctcccaggatgcattgtggggctgatggggagtggctcgtgccagtgggccgttgtagctgctctgcaggtttccaggagagaggtgatttctgcgaagcatgccccccaggattctataaagtgtctcccaggcgtccactttgcagcccatgtccagagcatagtagggctctcgaaaatgccagcactttttgtgtgtgtcaggattcatatgctcggtctcctactgaccccccaagcgcaagttgcaccagacctccctctgcccctcgcgatctgcaatattccttatcaaggtctccactcgtgctgaggctgagatggctcccacccgcagacagtgggggacgttctgacgtaacttactctctactgtgtctaagatgtggcagagaggggcctgcaggcgcttgcgagccctgtgggcctcgagtagcttttctgcccagacaggcgggtcttcgagagagggccgcaaccctgctgcatcttagacctggcgcacgttatactgttcgcgtcgccgctttaaacggagtctccgggccagccgcagctgccggaaccacctacgcccaggttacggtctccacaggccctggcgctccgtgggaagaagacgagatccgacgtgacagagttgaaccacaatccgtgtcactgagttggagagaacccattcccgctggggctccaggcgctaatgacacagaatacgaaattcgctattatgaaaaaggccagagtgagcagacttattcaatggttaagaccggggctcctactgtcaccgtgacaaatcttaaacccgctacccggtacgtctttcagatccgtgctgcaagccctggcccatcatgggaggcgcagagttttaacccctcaattgaggtacagacgcttggagaggccgcaagtgggtcacgggatcagtcccctgctattgttgtgactgtggtaacaataagcgcgttgttggtactgggctccgtcatgagcgtcttagccatctggagacggccatgcagttacggcaagggtggcggagacgcccacgatgaggaagaactgtactttcattttaaggtcccgacccgccgaactttcttggaccctcagtcatgcggcgacctgctacaagcagttcatctgttcgcaaaggagctagacgccaagagcgttaccctcgagaggtccctcgggggaggcaggttcggggagttgtgctgtggatgcctgcagttgcctggccgacaggagctcctcgtggcagtccatatgctgcgcgactctgcttccgattcccaacgactcggattcctggcagaggctctgacactgggccaatttgaccactcccacatcgttcggctggaaggtgtggtcacaaggggaagcacactcatgatagtgacagaatatatgagtcacggggctctcgatgggttcctgcgcaggcatgaaggtcagcttgtggccggacaactgatggggttattacctggtctcgccagcgctatgaagtatctgtcagagatggggtatgtgcaccgcggactcgctgcccgacatgtccttgtgtcgtctgacctagtctgtaaaatcagcggctttggtcggggacccagggatagaagcgaggcggtgtatactaccatgagcggtaggtctcctgcgctgtgggccgctcccgaaacccttcagttcgggcactttagctccgcttccgatgtgtggagctttggaattattatgtgggaggtgatggcttttggcgagagaccctattgggatatgtcaggtcaggacgtgattaaagcagtcgaagatgggtttcgactgccccctcctcgaaactgcccaaatctcctgcacagactgatgctggattgttggcaaaaagatcctggagaacgcccaaggtttagccaaatacattccattttatccaagatggtccaagatccagaaccccctaagtgtgcactgactacttgtccaaggccgccaacccctttagccgaccgagctttttcaactttccccagctttggaagcgttggggcatggctagaggccctggacttgtgccggtataaggatagttttgcagccgctggctacggttcattggaggctgttgctgaaatgaccgcccaagatctcgtgtccctgggaatcagtttggcagagcacagagaggcattgctaagcggtatcagcgcattgcaggcgagagtgctgcaactgcaaggacagggtgtccaggtcattataaaaacatgcctttag

SEQ ID NO: 222067 - DNA, 468 bp, Artificial Sequence
  Description of Artificial Sequence: Synthetic coding sequence
atggtgaaaacaggggcaccgacggtgactgtgaccaatctgaagcctgccactcggtatgtgtttcagatccgcgctgcctcccccggtccctcatgggaggctcagtcttttaacccgagtatagaggttcagactttaggcgaagcagcatctggcagtcgggaccagtccccggctattgtggtgactgtcgtgacgataagtgcactattagtgcttggatcagtgatgtcggtactggcaatatggcggcgaccgtgttcctacggaaaaggaggtggcgacgcccacgacgaagaggagctgtactttcacttcaaggtcccgacacgccgaacctttttagatccccaatcttgtggcgatcttttacaggctgtgcatctctttgcaaaggaacttgacgccaagtccgtgacattggaacggtctctcggaggcggtcttgaaacatccccccactag

SEQ ID NO: 222068 - DNA, 2931 bp, Artificial Sequence
  Description of Artificial Sequence: Synthetic coding sequence
atggagctacaggccgcacgggcatgtttcgcactattgtggggatgcgccttggccgcagcagctgcagctcagggtaaagaggtcgtgctactggatttcgccgcagccggaggtgaactcggctggctcacacatccatatggcaaaggttgggatttgatgcagaacataatgaacgatatgcctatttatatgtattcagtgtgtaacgtaatgtcaggagaccaggataactggctaagaactaactgggtgtatcggggtgaagccgaaaggatcttcatcgagctgaagtttaccgtgcgtgactgtaatagttttcctggcggtgcaagttcatgtaaagaaaccttcaatctgtattatgcggagtctgacctagactatggtaccaacttccagaagagactgttcaccaaaatagatactatcgcgcctgacgaaatcaccgtatccagcgattttgaggcacggcacgtcaagttaaacgtcgaggaacgttctgtgggaccacttaccaggaagggcttttacttggctttccaggacattggagcttgtgtggcccttctgtctgttcgcgtgtactataagaaatgccccgagttgctccagggcctggcccactttcctgagacaatcgcgggatccgatgctccttccctggcaaccgtcgcagggacgtgtgtggaccacgctgtggtgccgcctggtggagaggaaccaaggatgcactgtgccgtcgatggagagtggctcgtgcctattggccagtgtctgtgtcaagccggttacgaaaaagtcgaggacgcttgccaggcttgttctcctggcttctttaagttcgaagcaagcgagtctccctgcttggagtgccccgagcataccctcccatctcccgagggagcaacatcatgcgagtgcgaggaagggttctttagagcccctcaggaccccgcatccatgccttgtacgcgacctccttctgcccctcactatttgacagcagtgggcatgggtgctaaagtggagctccgatggactccaccccaggacagtggaggcagggaagatattgtctattccgttacctgcgagcagtgctggccagagtcaggggagtgcggtccatgcgaggcctccgttcgctatagcgaaccccctcatggcctgacacgcacttccgttacagtgtcagatctggagcctcatatgaactacacgttcacagtggaggcgagaaatggtgtgagcggactcgtaaccagtcgcagcttccgaactgcctcagtaagcataaatcagaccgaacccccaaaggtgcgcttagaagggcgttcgaccacctcgctctctgtttcatggagtatcccaccgcctcagcaatctcgcgtatggaaatacgaggttacgtacagaaagaagggggattcgaattcctacaacgtgcgacgtactgagggctttagtgtgacactcgatgacctggcccctgataccacatacctcgtacaggtccaggccctgacacaggaaggccagggagcgggttctaaggtccacgaatttcagacactcagccctgagggaagtgggaatcttgcagttatcggcggtgtagctgttggcgtggttctactgctggtcctcgccggagtgggcttttttattcacagacgcagaaagaaccagcgtgcaagacagtcacctgaggacgtatatttctccaagtctgagcagctcaagccactgaagacctacgtagaccctcacacttatgaggacccaaatcaggcggtccttaagtttaccacagagatacacccaagctgcgtgacccggcagaaggtgatcggtgccggagagttcggggaagtgtacaaggggatgctgaagacgtcatcagggaaaaaggaagtccctgtggccatcaagacactgaaagctggatacacagagaaacagcgcgtggactttctaggcgaggcagggattatgggtcagttttcccaccacaacattatccggctcgaaggcgtgattagcaaatataagcccatgatgataatcacagagtacatggaaaacggggctcttgataaatttctgcgggaaaaagacggggaattctccgtcctccagctcgtgggcatgcttcggggtattgccgcagggatgaaatacttagctaatatgaactatgtgcatagagatctcgctgctagaaatatcctggtcaactccaacttggtatgcaaggtcagtgactttgggctgtcgcgcgtgctcgaggatgatcccgaagccacctatacaacctctggagggaaaattcctattcgctggacagcaccagaagctatctcttaccgcaagtttacgtctgcttctgatgtgtggtcttttgggattgtgatgtgggaggtgatgacctacggtgaacgcccttactgggaactcagtaaccatgaggtcatgaaggcaattaacgacgggtttagacttccaacccctatggactgtccctcagctatttatcaactgatgatgcaatgttggcaacaggaacgcgctaggagaccaaagttcgcagacatcgtgtcaatcctagacaagctgatccgcgctcctgatagccttaaaaccctggcggactttgatccaagggtttccatacgccttccctccacttcagggagcgaaggcgtacctttcaggaccgtcagcgaatggctagagtccatcaaaatgcagcagtacaccgaacactttatggcggctggctacactgccatcgaaaaggttgtgcagatgacaaacgatgacatcaagcggattggcgtaaggttgcctggccaccaaaagaggatcgcctactctcttctcggccttaaagaccaggttaatacagtgggaatccccatctag

SEQ ID NO: 222069 - DNA, 2952 bp, Artificial Sequence
  Description of Artificial Sequence: Synthetic coding sequence
atggactgccaactgagtattttgctgctactgtcctgcagtgtgttggatagttttggtgagctgattccgcagcctagtaacgaggtgaatcttctggactccaagacgatccaaggggaactcggctggatcagctatccttcccatgggtgggaggaaatctctggtgttgacgagcactataccccaattcgaacctaccaagtttgtaacgttatggaccactcacagaataactggctgagaactaattgggttccgcgaaattctgctcagaaaatttacgttgagctgaagttcacacttcgggactgtaacagcattccgctggtgttgggcacctgcaaggaaacctttaacctatactatatggagtccgacgacgaccatggagtgaaattccgcgagcaccagttcaccaagatcgacacgatagcagctgacgaatcatttacccaaatggacctgggtgaccgaatactcaagctgaatactgaaatacgagaagtcggcccagtgaataaaaaaggcttctatttggccttccaggatgtaggcgcttgcgtggcactggtatcagtcagggtgtatttcaagaagtgccctttcacagtaaagaatctggctatgttccccgacacagtacctatggatagccagtctctggtagaggtccgagggtcatgtgttaataactcaaaggaagaggaccccccacgcatgtactgctccaccgaaggggagtggttagtgcccatcggaaagtgcagctgcaatgctgggtatgaagagaggggttttatgtgtcaagcttgtcgtcccggtttttacaaagcattagatgggaacatgaagtgtgcaaaatgcccacctcattcctccacacaggaagacggaagcatgaactgtcgttgtgaaaacaattacttccgagcggacaaggaccctccttcaatggcctgtacgagaccaccttcatccccaagaaacgttatttccaatatcaacgaaacctcagtcatcctggattggtcctggccactggacacgggtggacgaaaggacgtaactttcaacatcatttgtaaaaaatgcggttggaatattaagcaatgtgagccttgttctcccaatgtccgattcctgccccgtcagttcggcctgacaaacaccaccgtgacagtgacggacctactcgcgcacaccaactacaccttcgagatcgacgcagtcaatggagtgagtgagctgtcatctccaccgcgacaatttgcagctgtgtccattacgactaaccaggctgccccatcaccggtcttgaccataaaaaaggatagaacttccaggaatagcatttctctatcctggcaagaacctgagcatccaaacggcatcatcttggactatgaggtgaagtattacgagaagcaggaacaagaaacctcctacacgatactgagggccaggggtacaaacgttactatttcctctcttaagcctgacactatctatgtctttcaaattagagccaggacggcagcaggttacgggaccaactctagaaagttcgaattcgagacgtccccagactcgttcagtatctctggcgagtcgtcccaggtggttatgatagcaatttctgcagccgttgccattatcctccttaccgtagtgatctacgtgctcattggccgtttctgtggctacaaatccaaacatggtgccgatgaaaagagactgcacttcggcaatggccacttgaagctgcccggtctgcgaacgtacgtcgaccctcatacgtacgaggaccctacccaagcagtccatgagttcgcaaaagaactcgatgccaccaatattagcatcgataaagtggttggagccggagaattcggagaagtctgctctggaaggctgaaattaccctctaaaaaggagatttccgtagcaattaagaccctcaaggtggggtataccgaaaaacagaggagagactttctgggagaagccagcataatggggcaattcgatcatcccaacattatccgcctggaaggcgtcgtgactaagtcaaaaccggtgatgatcgttacggagtacatggagaacggcagcctagacagcttcctgcggaagcatgacgctcagtttaccgtgatccagttggttgggatgctgcgcggtatagcctccggaatgaagtacctcagcgacatgggttacgtccaccgcgacctggccgctagaaacatattgataaacagcaatctggtctgcaaagtttcggactttgggctttcgcgcgtgttagaggacgaccccgaggctgcctacaccacacgcggaggcaaaatccctattcgatggacatccccggaggctatcgcttacaggaagttcacaagtgcgagtgacgtgtggtcctatggtatcgtcctgtgggaagttatgagttacggagaaagaccatattgggagatgagtaaccaggacgttatcaaagccgtagacgaaggctacaggctgccaccaccaatggattgtcccgctgcgctgtaccagttgatgctagactgctggcagaaggatcgtaacaatcgtcccaagttcgagcaaatcgtgtctattttggacaaacttattagaaatcctggttcgctgaaaatcatcacctcagccgctgcacgtcccagcaacctactgctggatcaatccaatgtggatatcaccaccttccggacgacaggggactggcttaacggcgtctggactgctcactgcaaagaaattttcactggggtcgagtactcaagttgcgataccatcgcaaagatcagtactgatgacatgaagaaggtgggcgtgaccgtggttggacctcagaaaaagatcatcagttccattaaagcactcgagacccaaagcaaaaacggtcccgtgcccgtctag

SEQ ID NO: 222070 - DNA, 1620 bp, Artificial Sequence
  Description of Artificial Sequence: Synthetic coding sequence
atggactgccaactgtccatcctgcttctactgtcatgcagcgtccttgatagctttggggagttgattccacagccctctaacgaagtgaatctgttagacagcaaaacgatccaaggagaattaggctggattagttatccatcccacggctgggaggagatcagcggcgtggatgagcactacacccccatcagaacataccaggtctgtaacgttatggatcattcgcaaaataactggttaaggacaaattgggtgccccgaaatagtgcccagaaaatctatgtagagctgaagtttactcttagggattgcaattcgattcctctggttttgggaacctgcaaagaaacattcaacctgtactatatggaaagtgatgacgaccacggtgtgaaattccgggaacaccagttcaccaaaattgacacaattgcggcagacgagtcatttacccagatggatctcggggatagaattttaaagctgaacaccgagatacgggaagtggggcctgttaataagaaaggattttacctggccttccaggatgtaggcgcttgtgtagcccttgttagcgttcgagtttacttcaagaagtgtcccttcacggtgaaaaatcttgcaatgtttccagacaccgtcccaatggactcacaatctctggtcgaagtgcgcggttcctgcgttaataactctaaggaagaggatcctccgaggatgtattgcagcacggagggagagtggctggtgccgatcgggaagtgcagctgtaacgcagggtacgaggaacgcggattcatgtgccaggcgtgccggcctggattttacaaggccctcgatggtaacatgaaatgtgccaagtgtcccccacattcatccacccaagaagacgggagcatgaattgccggtgtgaaaacaattattttagagcagacaaggaccctccatcaatggcctgtaccaggccaccctccagccctaggaacgtcatatctaacataaatgagaccagcgtgattctcgattggtcgtggccactcgacaccggtgggagaaaagacgttacttttaatatcatctgtaagaaatgtgggtggaatatcaaacagtgcgaaccatgtagcccaaacgtccgttttctgccaagacagttcggcctgacgaacaccacagtgaccgttactgatctcctggcccacacaaactatacatttgagatagatgccgtgaacggcgtgtcagaactgagctcgccccctaggcaattcgcggcagtgtctataaccactaatcaggctgccccaagcccggtgctcaccataaagaaagatagaactagtcgaaactcaatcagcctttcttggcaggagccggagcaccccaacggaattatactggactatgaagtaaagtactacgaaaagcaggagcaggaaacttcttacaccattctccgtgctcggggaaccaatgtgacgatcagctccctaaaacccgacactatctacgttttccaaattcgcgctcgcacggccgcaggttacggaacgaattctcgcaaattcgagttcgaaacttctcccgattgtatgtattactttaacgctgtgtag

SEQ ID NO: 222071 - DNA, 3114 bp, Artificial Sequence
  Description of Artificial Sequence: Synthetic coding sequence
atgcgcggttccggaccaagaggagctggccgacggagacctcccagtggcggtggcgatactccgataacacccgcatccctggcaggatgttactccgcacccaggagagcgcctctctggacgtgtctgttattatgcgcagccctgcgaacactgctcgcatctcctagcaacgaggtgaacctgctggactcccgaactgtgatgggtgatttaggctggatagcatttcctaaaaacggctgggaggaaatcggggaggtggacgagaattatgccccaatccacacctatcaggtttgtaaggtcatggagcagaatcagaacaactggctcctgacttcctggattagtaatgagggggctagcaggatcttcatcgagctgaagttcacattgcgggattgcaatagtttgccgggtggccttggaacctgcaaggagaccttcaacatgtactactttgagtctgacgaccagaatggcaggaacatcaaagaaaatcagtacattaaaatcgataccatagccgctgacgagagctttacagagctggacttgggcgaccgggtcatgaagctcaataccgaagtacgggatgttggaccgttatccaaaaaagggttttacttagcgtttcaggacgttggagcgtgtattgcactggtgtcagttagagtgtactacaagaagtgcccctcggtggtaaggcatctagcagtattccctgataccatcactggagccgactcttctcagctactggaggtgtcaggaagctgtgtgaatcattccgtgaccgacgagccccctaaaatgcactgtagcgcagaaggtgagtggctggtccccattggaaagtgcatgtgtaaggcaggatacgaagagaagaatggaacctgccaggtttgtcgaccaggattcttcaaggctagcccccacatacagtcttgcggaaagtgccccccacactcgtacacccacgaggaagcctcaacaagctgtgtgtgtgagaaggactattttaggagggaaagcgacccgcctaccatggcttgcaccaggccaccttcagccccacgtaacgctatcagtaatgttaatgaaactagcgtatttctcgagtggatacccccagctgatacaggaggaaggaaagacgtgtcttactatatcgcgtgcaaaaagtgcaattcccacgccggagtctgtgaagagtgtgggggacacgtacgttatcttcccaggcaatcagggctgaagaatacaagcgtgatgatggtggacctcctggctcatactaactacacatttgagatcgaggccgtcaacggcgtgagtgacttgtcaccgggagccagacagtatgtgagtgtgaacgtcacaacaaatcaggccgctccatcccctgttactaatgtcaagaaagggaagattgcgaagaatagtatctccctgagctggcaggagccagaccgccctaatgggatcattttggagtatgagattaagtactttgaaaaggatcaggagacctcttacaccataattaagagcaaggagaccaccatcacagcagagggcctgaagcctgccagcgtgtacgtgtttcagataagagcacgtacggccgcaggctacggtgtgttcagtagacgatttgagtttgaaaccactcctgtattcgcagcaagcagcgatcaaagccagatcccagtaatagctgtctcagtcacagttggcgtgatcctactggccgtagtgatcggggtactcctcagtggatcttgttgcgagtgcggctgtggtcgagcatcatctctctgcgcagttgcccatccatcgttaatttggcgttgcggctactcgaaagccaagcaggatcccgaggaagaaaagatgcacttccataatgggcacatcaagctcccaggcgtgcgcacctatattgatccacacacatacgaggatccaaatcaggctgtgcacgagtttgcaaaagaaatcgaggcaagctgcattaccattgagagagtcataggggcaggggaattcggggaagtttgttccggcaggcttaagctgcccggtaagcgagagctgccagtggccatcaagaccctcaaggttggctatactgagaagcagcggagagacttcctgggggaggcatcaataatggggcagttcgatcaccctaatattattcacctggagggggtggtgaccaagagcaagccagtcatgatagtcaccgagtacatggagaacgggtccctggacacattcttgaagaagaacgacggacagtttactgtcatccagttggtgggcatgctgcggggaattagcgccggtatgaagtacttgagcgacatgggctacgtacaccgagacctggccgctcgcaacatccttataaactcaaacctggtctgcaaggtgagtgatttcggtctgagccgcgtactagaggatgaccctgaagccgcatatactacccgaggaggcaagattcccattagatggaccgcacctgaagcgatcgcctttcgcaaatttacttccgcaagcgacgtttggtcttacggcattgtgatgtgggaggtcgtgtcttacggcgaaagaccttactgggagatgactaaccaagacgtcattaaggcagtggaggagggttaccgtttgccttcgcccatggattgccccgctgccttataccaactgatgctggactgttggcaaaaagaaaggaactccaggccaaagtttgacgagatagtgaatatgctcgataaactcataaggaacccctcttcactcaaaacgctggtaaacgcgagctgtcgagtgtcaaacctgctggccgaacacagccctctgggaagcggagcttaccgaagcgtgggagagtggctcgaggctatcaaaatggggcgatatacggagatatttatggagaacggatactcatcgatggacgcagttgcccaagtgaccctcgaggatctgagaaggctgggggtcactcttgtgggccaccagaagaaaatcatgaacagtctccaggagatgaaagtgcagttggtaaacggaatggtgccgctgtag

SEQ ID NO: 222072 - DNA, 3048 bp, Artificial Sequence
  Description of Artificial Sequence: Synthetic coding sequence
atgcgcggaagtgggccacgcggtgctggacgacgcaggcctcctagtggcggtggagacactcccattacccctgcgagtctagcgggttgttactctgcgccaagaagagcaccactgtggacgtgccttctcctgtgtgccgcactcagaactctccttgctagccctagcaatgaggtgaacctgctggacagcagaacagtgatgggtgacctgggctggattgcctttcctaagaatgggtgggaggagattggtgaagtggatgaaaattacgctcctatccacacatatcaggtctgcaaggtgatggagcaaaaccagaacaactggctccttacttcatggatcagcaacgagggtgcgtcacgcattttcattgaattgaaatttactttgagagactgtaatagcctacccggaggtctcggaacctgtaaagaaacttttaacatgtattatttcgagtcagacgaccaaaacgggaggaatattaaggagaatcagtacattaagatcgatacgatagctgcggacgaaagcttcactgagctggacctgggggatcgcgtcatgaagttaaataccgaggtccgggatgttggcccactttctaaaaaggggttttaccttgcctttcaggacgttggggcatgtatagcactggtgtctgtgagagtttactataaaaagtgtcccagcgtggtgaggcatttggccgtgtttcccgacactatcactggcgctgatagttctcagctgttggaagtgagtggtagctgtgtgaatcacagcgtcaccgatgagccgcctaagatgcattgttccgccgagggtgaatggctcgtgcccataggtaagtgtatgtgtaaagccggttacgaggaaaagaatgggacgtgtcaggtgtgtcgcccagggttttttaaggccagcccacacattcaaagttgcggcaaatgtcccccacactcgtacactcacgaagaggcatctacatcctgcgtgtgtgaaaaggattatttcagaagggagagcgatccccctaccatggcttgtactaggcctccctcggctcccagaaacgccatctcgaacgtgaatgagacaagtgtgttcctggagtggattcccccagcagatactggaggccgtaaagatgtcagctactatattgcctgcaaaaagtgtaattctcatgcaggcgtgtgcgaggaatgtggcggacacgttcgatacctcccacgccagtctgggctaaaaaataccagcgtgatgatggtggacctgctggcccacaccaattacacctttgaaattgaagctgtcaacggagtgtccgacttgtctcctggggctcgacagtatgtctcggtcaacgtcacaacaaaccaggccgctccaagcccggttactaatgttaagaaagggaagatcgcaaagaattctatatccctctcatggcaggaacctgatcggcctaacggcataattctcgagtacgagataaagtacttcgagaaagaccaagagacgagttatactataataaagtctaaagaaactaccatcacagcggaaggcctgaagcccgcatctgtgtacgtgttccagattcgagcacgcactgctgccggttacggagtgttttctcgaagattcgagttcgagaccacccccgtcttcgctgcttcttcagaccaatcccagataccagtgatcgcagtttccgtcactgtgggcgtgatcctgctcgctgttgtcattggcgtacttttaagcggacggcgatgtggatattccaaggccaaacaagatcccgaggaagaaaaaatgcattttcacaacggccatatcaagctgcccggtgttcggacttacatcgatcctcacacttacgaggatccaaaccaggccgtccatgaattcgctaaggaaattgaggcctcctgcatcacgatagagcgagtcataggcgcaggggagttcggcgaggtgtgttccggcagattgaaactgccagggaagcgggaattgccagtagctatcaagaccctgaaagtgggatacacagagaagcagcggagggactttctgggagaggcgtctatcatgggacaattcgaccaccctaatatcatccaccttgagggagtcgttaccaaatccaaacctgttatgatagtaaccgagtatatggagaacggaagtttggatacttttctgaagaagaacgatggacagtttaccgtcattcaactcgtcggcatgctccgaggaatctccgctggcatgaaatatctctccgatatgggctatgtccatcgtgatctggcggcaagaaatatcctgatcaatagcaacctggtgtgcaaagtgagtgactttggcctgtctcgggtgctggaggatgacccagaggctgcctacactacaaggggcggtaaaattccaattcggtggacagcgccagaggcgattgcctttcggaagttcacatctgccagcgatgtttggtcgtacggtatcgtcatgtgggaagtggtatcctacggagagcgcccttattgggaaatgacaaaccaggatgtgatcaaggccgtggaggaaggctaccggctcccgagccccatggactgccccgctgcattgtatcagctgatgcttgactgttggcaaaaggaacgcaattcgagacccaaatttgatgagattgtgaacatgttggacaagcttatccggaacccaagttccctcaagactctagtgaacgcaagctgccgcgtgagcaacctgctggccgagcatagcccgctgggctctggtgcctaccgatcagtcggggagtggttggaggcgataaaaatgggcagatacacggagatctttatggagaatggctactcctccatggacgcagtggcacaggtgacgctcgaggacctgcgcaggctgggcgtgactcttgtcggccatcaaaagaaaatcatgaattcacttcaggaaatgaaggtgcagctggttaacgggatggtgcccctatag

SEQ ID NO: 222073 - DNA, 3015 bp, Artificial Sequence
  Description of Artificial Sequence: Synthetic coding sequence
atgagaggcagcggccctaggggagccggacgccgacgaccaccatctggaggaggtgacacgcccatcacgcctgccagccttgcaggctgttacagtgcacccaggcgagcccctttgtggacctgcttattattgtgcgccgcactcagaaccttactcgcctccccatccaacgaagtgaatctgctcgacagtagaaccgtgatgggagacttggggtggatagcgttccctaaaaatggatgggaggagatcggtgaggtggacgaaaattatgcaccaatccacacctaccaggtgtgtaaggtgatggagcagaatcaaaacaattggcttctgacctcatggattagtaatgagggcgctagccggattttcattgaattgaagttcacactgcgggactgcaattccctccccggaggtctgggaacttgcaaggagacgtttaacatgtattattttgagtctgatgaccaaaacggaaggaatattaaggagaaccagtacatcaagatcgacacaatcgctgcagatgagtctttcactgaactggatctgggggatcgggtcatgaagctgaatacggaggtgagggacgtgggtcccctgtccaagaagggattctacctcgctttccaagatgttggcgcatgtattgccctggtctccgtgcgggtctattacaaaaaatgtccaagtgtggtcaggcacctcgcggtgttccccgacaccatcaccggggctgatagctcacagctcctggaagtgtcaggtagttgcgtgaatcatagcgtcacagatgagccacccaagatgcattgttcagcagaaggggagtggctagtgcccataggaaagtgcatgtgtaaagcgggttatgaggagaaaaatggaacatgccaagtgtgtcgaccaggcttcttcaaagcaagcccgcacatacagagttgcggcaagtgtcctccccattcctacacacacgaggaagcgagcacctcatgtgtctgcgaaaaggactacttcagaagagaaagcgatccccctacaatggcttgcacacgtcctccatcagccccacgcaatgccatctccaacgtgaatgagactagcgtcttcttagaatggatcccaccggctgacaccggcggtcgcaaagatgtgtcttactatattgcctgcaagaaatgcaacagccacgcgggagtgtgtgaggagtgcggaggtcacgtccgctatctgccacgccaatcaggcctgaagaataccagcgttatgatggtggatcttttagcccatactaattatactttcgagatagaggcagtcaacggtgtctccgatttgtcacccggtgctcggcagtatgttagcgtgaatgtgacgaccaaccaagctgccccttcccctgttactaacgtgaagaaaggaaagatcgcgaagaattcaatctctttgtcctggcaggagccagatcggccaaatggcatcatcttagaatacgaaattaagtacttcgagaaggaccaggagacctcctacactattattaaaagcaaggaaaccaccattaccgctgagggactgaagcccgcttccgtctacgtattccagatccgtgctcgcactgctgccggatacggcgtgttctccaggcggtttgaattcgaaacaacgcccgtatcggtggctgcaagctcagatcaatctcagattcctgtgatagcagtgagcgtgaccgtaggcgtgattcttttggctgtggtgatcggcgtgcttctgtctggatcctgttgtgagtgcggctgtggcagagccagcagtctctgtgctgtggcacatccatcactaatctggagatgcgggtattccaaagccaagcaagacccggaggaggaaaagatgcatttccacaacgggcatataaaactgccaggggtgcggacgtatatcgatccacacacttacgaggatcccaatcaagccgtgcacgagttcgcaaaggaaatcgaggcaagctgcataactatagaacgggtaatcggcgctggtgaatttggggaagtgtgctcaggcagactcaagctgcccggtaaacgcgaactccccgtagccatcaaaactctgaaggtaggatacacggaaaagcagagacgagatttcctgggggaggctagtattatgggacaatttgatcaccccaatatcattcacctggagggcgttgtgaccaagagcaagcccgtcatgatcgttaccgaatatatggaaaacggcagcctggacacttttctaaagaagaacgacggccagtttactgtgattcagctggtggggatgctaagaggtatcagtgctggaatgaagtatctcagcgacatgggatacgttcatagggacctggccgctagaaacatcttgattaactctaatcttgtttgcaaggtgtctgacttcggattatcacgagtgctcgaggacgatcccgaggccgcatacaccacccggggtggcaaaatcccaatcaggtggacagctcctgaggccatcgccttccgcaaattcaccagcgccagtgacgtgtggtcatacgggatcgtgatgtgggaggttgtgagttacggcgaacggccatactgggaaatgaccaaccaggacgttatcaaggcggtagaggaaggctatcggttgccctccccaatggattgtccagccgcactgtaccaattgatgcttgattgttggcagaaagaaagaaatagccgccctaagtttgacgaaatcgttaacatgctagataaacttatccgaaatccaagttccctgaagaccctggtgaacgcatcctgtcgggtgtctaacttattagccgagcactcacctctggggtccggggcatatcgctcagtgggtgagtggttggaagctatcaagatgggcaggtacactgaaatcttcatggaaaacggatactctagcatggacgccgtagcccaggttacgctggaatag

SEQ ID NO: 222074 - DNA, 3018 bp, Artificial Sequence
  Description of Artificial Sequence: Synthetic coding sequence
atggctccagccagggggcgattgcccccagcgttgtgggtagttactgctgccgcagccgcagccacttgcgtgagcgctgcacggggagaagtgaatctacttgatacaagtacaattcacggagactggggttggttaacctaccccgctcatggatgggactctattaacgaggttgatgagagctttcagcctattcatacgtatcaggtgtgtaacgttatgtccccaaaccaaaataactggctcagaactagttgggttccacgggatggagcacgacgcgtgtatgctgagatcaagttcactcttcgggattgcaacagcatgcctggcgttcttgggacctgcaaagaaacctttaatttgtactatctcgagtcggaccgggaccttggcgcatctacacaggagtcccagtttctgaaaatcgatacgatcgccgcagatgaaagtttcactggcgctgacctgggagtacgcaggctgaaattaaacacagaagtgcgcagtgtcgggccactaagtaaacgcggattctatctagcattccaagatattggggcttgtctggcaatactgagcttgcgcatttattataaaaaatgccctgccatggtgaggaatcttgctgctttcagtgaagccgtgaccggggctgactcctcttctctggtggaggtacgtggacagtgcgtcagacactctgaagaaagggacactcccaagatgtattgtagtgccgagggggaatggctggttccgataggcaaatgtgtgtgctctgcgggatacgaggagcgacgcgatgcatgtgtggcatgcgaactggggttctacaagtccgcgcctggagatcagttgtgcgcgaggtgtccaccacattcgcacagcgcggctccggctgcccaggcttgccactgcgatttgtcgtattatcgcgctgctctagaccccccatccagcgcatgcaccagacccccaagcgccccagtgaacctgatcagcagtgtcaatggaacatcagtgacgctggagtgggcacctccactggatccgggaggtcgctcagacatcacctataacgctgtgtgtaggcggtgcccatgggcactctcacggtgcgaggcctgcggatccggaactcgttttgtgccccagcagacctctctcgtgcaggcttctctgctagtggctaacctgctggcccacatgaactattcattttggattgaggccgttaatggggtgtccgatctttcgcccgagcctcgccgtgccgctgtggtaaatataacgacaaatcaggcagctccatctcaagttgttgttatccgtcaggaaagggccggtcaaactagcgtttcactactatggcaagagcctgagcaacccaatggaattattctcgagtatgaaataaaatactacgaaaaagataaagagatgcagagctatagcactctcaaagccgtcaccacccgagcgacggtttccggcctcaagcccggaacaaggtacgtgttccaggtccgggctcggacttcagctggctgtgggaggtttagccaagctatggaagtggaaacaggaaaacctagaccacgttacgacacacgcacaatcgtgtggatatgtctgactttaatcactggactcgtcgtccttcttctgctgctgatttgtaagaagcgacactgtgggtatagcaaggcattccaggactccgacgaagagaaaatgcattaccaaaatggacaagcaccaccccctgtctttctgcctctgcatcaccctccaggaaagttgccagagcctcagttctacgctgagccacacacatatgaggaacccggtagagccggacgctcttttacaagagagatagaagcctcccgtattcatatcgaaaagatcataggcagtggcgattctggggaagtgtgctacggcaggttaagagtacccggacaacgcgatgttcctgtagccattaaagcattgaaggctggctacacggaacgtcagaggagagattttctgtcagaggcttcgattatgggccaattcgaccatcctaatattatccgcctggaaggggtagtaactcgcggtcgcttagctatgattgtgaccgaatatatggagaatggctcgctcgacacctttcttcgtactcatgatggtcagttcactatcatgcaactcgtggggatgcttagaggcgttggcgctggcatgcggtatttgagtgacctgggctacgtgcaccgagaccttgcggcaaggaatgtcttggtggacagtaacctggtttgcaaagtgtccgacttcggactttctagggtgttggaagatgaccccgatgctgcttacaccactaccgggggtaagatccccatacgatggaccgctccagaagccattgcgttccgtacctttagtagcgcttctgatgtgtggtcattcggcgttgtcatgtgggaggtccttgcatatggtgaacgcccttactggaatatgacaaaccgcgatgtcatttcttcagtggaggagggttaccgacttccagccccaatgggctgtccgcacgcactgcatcaactgatgctcgattgctggcacaaagaccgggctcagaggccacgctttagccaaatagtcagtgtgctggatgcactcatcagaagcccagagtcacttagagccacagctaccgtttcgcgttgcccgcctcccgcattcgtcaggagctgctttgacttacggggtgggagcggcggagggggtggcctcactgttggcgattggcttgacagcatccggatgggaagatacagggaccactttgctgccggtggctactcctcactgggaatggtgctgcgaatgaatgcccaggatgtgagggcgctaggcattaccctgatggggcaccagaagaagatcctcggttctatacaaactatgcgcgctcagctcacctcaacccagggccctaggagacatctatag

SEQ ID NO: 222075 - DNA, 1488 bp, Artificial Sequence
  Description of Artificial Sequence: Synthetic coding sequence
atggctccagcgagggggaggctgcctccagctctgtgggtcgttactgcagccgctgcagccgcaacctgcgttagcgcagcacggggagaagtaaacctgctggatacctccaccattcatggagactggggatggctcacatacccagcccacggttgggacagcatcaacgaggtggatgaatcctttcagcctatacatacataccaagtctgcaatgtcatgagccctaatcagaataactggctcaggacaagttgggtccctcgcgacggcgctcgcagggtctacgccgagatcaaattcacccttcgcgactgcaacagcatgcctggtgtgctcggaacatgcaaagagactttcaacctgtattaccttgagagcgacagggaccttggagctagcacccaggaaagtcagtttctgaaaatcgacaccatcgccgcagacgaaagtttcacaggcgctgatctgggcgtgcggcgattgaagctgaatacagaggttcggagcgtgggtccattgtccaagcggggtttttacctcgctttccaggatatcggcgcttgcctcgccatactgtctctgagaatctactataagaagtgccccgcaatggtacgcaatctcgccgcttttagcgaggccgtgaccggggcagacagtagctctctggtcgaggtacgtgggcagtgtgttcggcatagcgaagaacgcgacacccccaagatgtactgcagtgccgagggggaatggcttgtgccaatcgggaagtgtgtttgttccgccggttacgaggagaggcgagatgcctgtgtggcgtgcgaattgggcttctataaatccgcccctggtgatcagctgtgtgcccgttgccccccacactcacattcagccgctcctgcggcacaggcttgccactgtgatctgtcttactatcgtgcagctctggatccaccctcgagcgcatgtaccagacctccttctgcccctgtaaatctaatctcctccgtgaatggtaccagtgtgacgttggaatgggcgcctcctttggatcctggtggtagaagcgatatcacgtacaatgctgtgtgtcgtcgctgtccgtgggccctgtctcggtgcgaggcttgtggctccggaacgcgtttcgttccgcagcagacaagcttagtgcaggcctcccttctcgtcgccaatcttctcgcccacatgaattatagcttctggatcgaagctgtcaatggtgtgagcgacttgtctccagagccccgtagagccgcagttgtcaatatcacgacaaaccaggcaggaagaagaaggaactccgtcccacagagacctggtccgccagccagccccgctagtgatccctcccgcgatcagtcatccgccggtgacgttctctgggcctttaggcaggtgcctctgtggccatgcgctccgcaccaggatcccgaattagaggcactgcactgcctatag

SEQ ID NO: 222076 - DNA, 1488 bp, Artificial Sequence
  Description of Artificial Sequence: Synthetic coding sequence
atggctcctgctagagggaggttaccaccggctctctgggtggtgacagccgctgcagctgcagcaacctgcgtctctgcagctcgaggggaggtgaacctgctggacactagcacaatccacggagattggggatggcttacttatccagctcacggctgggactctatcaacgaagtggacgagagctttcagccaatccacacctatcaggtttgtaatgtgatgtcccctaaccagaacaactggttgagaaccagctgggtacccagggacggtgccaggagagtgtatgctgagatcaagtttaccctgagagactgtaacagtatgccaggagtattagggacttgcaaagaaacctttaatctctactacttagagagcgatcgggacctaggggcttccacacaggaatcgcagttcctcaagattgacaccatcgctgcggatgaatcattcacaggcgcagacctgggcgtgcggagactgaaactcaacacagaggtccgttcagtcgggcctctcagtaagcgcggattctacctcgcatttcaggatatcggggcatgcctggccattcttagcttgaggatttactacaaaaagtgcccagccatggtgaggaatctggcagcttttagcgaagcagttacaggggctgattctagcagcttggttgaggtgagaggccagtgcgtgcgccactctgaagagcgagatactcccaagatgtattgttcggccgagggggaatggctcgtccccattggaaagtgtgtgtgttctgcagggtacgaagaacgcagagatgcttgcgtggcttgtgagttgggtttctataaaagcgctcccggtgatcaactgtgcgccagatgccccccacacagtcattcggccgcaccagccgctcaggcatgccactgcgacctgtcttattacagggcagccctcgaccctccatcaagcgcatgcaccaggcctcccagcgcccctgttaatctgatttcttcagttaatgggacctccgtaaccctagagtgggcaccccctctcgaccccggaggcagatccgacattacatacaatgctgtctgtcggaggtgtccgtgggctctctcacgatgtgaagcttgcggtagtggcactcgcttcgtgcctcaacagacttccctagtgcaggcttccctgctagtagccaacttacttgcccatatgaattacagtttctggatcgaggcggtcaatggggtgtctgatttgtcacctgaaccaagaagagccgctgtcgtaaacataactaccaaccaggccggacgacgtcgcaactccgtccctcagcggccaggccctcctgcctcaccagcctctgaccccagcagagatcaatccagcgcaggggatgtgctctgggcctttcgccaggtgcctctctggccttgtgcccctcaccaggatccagagctggaagccctccactgtctgtag

SEQ ID NO: 222077 - DNA, 2955 bp, Artificial Sequence
  Description of Artificial Sequence: Synthetic coding sequence
atggccctggactacctcttgttgctgttgttggcgagtgccgtcgccgcaatggaagagacactcatggacaccaggactgcaacggctgagttaggctggacagccaatcctgccagtggctgggaggaggtgtccgggtatgacgagaacctgaacacaatccgcacctatcaagtttgcaatgtgttcgagccgaaccagaacaattggctccttacgacattcatcaacaggcgcggtgcacacagaatttataccgaaatgagattcacagtgagagattgttcttctctgccaaacgtgccaggatcttgcaaggaaacttttaacctatattattacgaaaccgattcagtcatagccactaagaaatccgcgttctggtcggaggcgccttatctgaaagtcgatacaattgccgcagacgaatccttttctcaggtggatttcgggggacgcctgatgaaggtgaacaccgaggttcgttcttttggacctctgacacgtaacggcttctatctcgcctttcaagactacggcgcttgcatgtccctgcttagcgttagggtatttttcaaaaagtgtcctagtatcgtccagaatttcgccgtttttccagaaactatgaccggagcagaaagtacatccctcgtgatcgcgaggggtacttgtatcccaaacgccgaagaggttgatgtccctattaagctctattgtaacggcgacggagaatggatggtccctataggacggtgtacatgcaaacccggatatgagccagagaactctgtagcttgcaaagcttgccctgccggaaccttcaaggcaagtcaagaggcagaagggtgctctcactgcccctcgaactcaagaagccctgctgaggctagcccgatatgcacctgccgaactggctactatcgggctgattttgatccgcctgaggttgcgtgtaccagcgtgccttcaggtcctaggaatgtgatctcaatcgtgaatgagactagtatcatcctagagtggcatcctccccgtgagaccggaggcagggatgacgtaacctacaacatcatctgcaagaaatgtagagcggacagacgctcgtgctcacgatgcgacgataatgtggaattcgtgcctcgccagctcggcctgacagagtgcagagtgtcaataagttcactgtgggcccacaccccctatacttttgatatacaggcaataaacggagtgagcagtaagtctccctttccccctcagcatgtgagcgtcaacataacgacgaatcaggccgcaccttccacagtgccaatcatgcatcaagtaagtgccactatgcggagcattacactgagctggccacagcccgaacaaccaaacggcattattctcgattatgagatcaggtactacgaaaaggagcacaacgaattcaacagctcaatggccagaagccaaacaaacaccgccagaatcgacggactgagacccggtatggtctatgtggtgcaggtgagagctcgcacagtggcaggctacggaaagttttctgggaagatgtgcttccagactcttacagacgacgactacaagagtgagctgcgtgagcagcttcctttgatcgccggtagtgcagccgctggcgtcgtttttgtcgttagtcttgtcgcaatctcaatagtgtgtagtcgcaaacgggcatatagtaaagaggctgtgtacagtgataagttacaacattacagcactggtcgtggctctccaggcatgaagatatacatcgacccattcacctacgaagatcctaatgaggccgttcgagagtttgctaaagaaatcgacgtatcattcgtgaagattgaagaagtgatcggggcaggcgagttcggggaggtgtataagggcaggcttaagctgcctggcaagcgcgaaatctacgtcgccatcaaaactcttaaagccggttatagcgaaaaacagaggcgggatttcctttctgaagcaagcatcatgggccagtttgaccatccaaatatcatcagattggaaggcgtagtgacaaaaagccggcctgtcatgatcattaccgagtttatggagaacggagcactcgattcctttctccgacaaaacgacggtcagttcaccgtcattcaactcgtcggcatgttacggggaattgccgcaggcatgaagtacttggccgagatgaattacgtgcatagagacttggccgctagaaacatactggttaacagtaacttagtttgtaaagtatctgatttcggtctgtctagatatctgcaggacgacacatcggatcctacatatacaagctctctgggcggtaaaattcctgttcgatggacagccccagaggcaatcgcctatcggaaattcacgtctgcttctgacgtctggagctacgggatcgtgatgtgggaggtgatgagtttcggagaacgaccctattgggacatgtctaatcaggatgtgattaatgccattgagcaggactaccgactgccgcctcccatggactgccctgctgcgttgcaccagctgatgcttgattgctggcagaaagacaggaactcacgcccacgattcgccgagatcgtcaatactctggacaagatgataaggaacccagccagcctgaaaacggtcgcgacaatcacagcggtcccctcccagcctctgttagaccgtagcattcccgattttaccgcttttacaacggtggacgactggctcagtgccataaaaatggtgcagtacagggattccttccttacggctggcttcacgagcctccaacttgtgacccagatgacatccgaggaccttttacgaatcggaattaccttggcagggcaccagaaaaagattctgaattctattcactcaatgcgggtgcagatttcacaatcccctacggccatggcctag

SEQ ID NO: 222078 - DNA, 1638 bp, Artificial Sequence
  Description of Artificial Sequence: Synthetic coding sequence
atgcaccaagtgagtgctaccatgcgttccatcacactgagttggccacaaccagaacagccaaatggcattatcctggactacgagatccgctactacgagaaggaacacaacgagtttaatagctccatggcacggtctcaaacaaatacagccaggatcgatggtctgcgcccaggtatggtgtacgtggtgcaggtgagagccagaacagtcgccggttacgggaagttttctggcaagatgtgctttcagacactgaccgatgacgattataagtcagaactgcgcgaacagctgcctctgattgctggcagcgcagcggctggagtcgttttcgtggtctccctggtggctatatccatcgtatgttccaggaagagggcatactctaaggaagccgtttattccgacaaactgcagcactattccacagggcgagggagccccggaatgaaaatttacattgacccgtttacgtacgaggatccaaacgaagctgtccgagaattcgcaaaagagatcgatgtaagctttgtcaaaatcgaagaggtgatcggtgccggtgaattcggtgaggtgtacaaggggaggcttaaactgccaggcaaacgtgagatctacgttgccatcaagaccctcaaagcgggatactctgagaagcagaggagggactttctgagcgaggccagcattatggggcagttcgaccatcccaatattatcagactggaaggcgttgtgaccaagtcacggcctgtgatgatcatcactgagttcatggagaatggggctctggattccttcttgcgccaaaatgacggacagttcaccgtaatccagttggtcggaatgttacggggaattgccgctggaatgaaatacctcgcagagatgaactatgttcatcgggacctggccgctcgcaacatcctagttaattcgaacttggtctgcaaagtctccgattttggcctctcccgctatctccaggacgataccagcgaccctacctacacatcctcgctcggcggtaagatccctgtgcgctggaccgctccagaagccatcgcctacaggaagttcacgtccgccagtgacgtgtggagctatggaatcgtgatgtgggaggtcatgagctttggtgaaagaccatattgggatatgtctaatcaggacgttatcaatgctatcgagcaggactaccgcctgcccccaccaatggactgtcccgctgctctgcatcagctcatgctggactgttggcaaaaggacaggaactcccgccctcggttcgccgagatcgtaaatactcttgataagatgatccggaaccctgccagtctgaaaaccgtagcaaccattaccgccgtaccttcccaacccctactcgatcgatccatccctgactttactgcgttcacaaccgtagacgactggctatctgcaatcaaaatggtccaatatcgagattcttttttgactgcaggattcacatctctgcagctggtcactcaaatgactagcgaggacttactgcgcatcggtattactctcgctggccaccagaagaagatccttaattccattcactccatgagggttcagatctctcagtcacctaccgccatggcgtag

SEQ ID NO: 222079 - DNA, 2997 bp, Artificial Sequence
  Description of Artificial Sequence: Synthetic coding sequence
atggcgcgagcacgacctccaccacctccctctcctcctccagggttactgcccctattgccacccttgctgctgctccctcttttactcctgcctgccggttgtcgagctttggaagaaactctgatggacacaaagtgggttacatcagagcttgcctggacatcacacccagaaagcgggtgggaagaagtgtccggctatgacgaagccatgaaccctatcaggacctaccaggtgtgcaatgtgcgggaatcatctcagaacaactggctcagaacgggttttatctggagacgggacgtccaaagggtctacgtcgagctgaagttcactgtgagggattgcaacagcatacccaacattccaggatcctgtaaggagaccttcaatcttttttattacgaagctgattcagacgttgccagcgcatcctccccattctggatggaaaacccttacgtgaaagtggataccattgctccagatgagagcttctctcgattggatgcagggcgagtgaatacaaaagtgcgtagttttgggccactcagcaaagccggattttacctggctttccaagatcagggggcatgtatgagtctaatcagtgtaagggcattctacaaaaaatgtgctagtaccacagccggttttgccctgttccctgagactctgaccggtgcagagccaacaagcctggtcattgctcctgggacttgcattccaaacgcggttgaggtaagtgtgcctctaaaactgtattgtaacggagatggggagtggatggtccctgtgggcgcatgtacttgtgctacgggacacgagcctgccgctaaagaaagccagtgtagaccctgtccacctggatcctacaaggcaaagcagggggagggcccatgtctcccctgtccaccgaactccagaactacatcccctgctgcatccatctgcacatgtcataacaacttttaccgggcagactctgacagcgcagattcggcctgtacgacggtgccaagccccccacgcggagttatatccaacgtcaatgagactagccttatcctcgagtggagcgagccacgagatctgggaggcagagatgatctcttatacaacgtgatttgtaagaagtgccacggcgctggcggtgctagtgcttgtagcagatgtgacgacaacgtggaattcgtgcctaggcagttaggtctcaccgaaaggcgcgtgcatatctcacatctcctggcacacactaggtatacatttgaggtgcaggcagtcaatggtgtgtccggtaagtcacctctgcctcccaggtatgctgccgtgaacattactacgaaccaggccgctccgtcggaggtccccacccttcggctgcactcttcatccggcagcagcttgaccctcagctgggcccctcccgagcgcccaaatggcgttatcctggactatgagatgaaatacttcgaaaaatcagaagggattgcaagtactgtgacgtctcaaatgaactctgtgcagctcgacgggctccggcctgacgccaggtatgtagtccaggtgcgtgcccgtactgtcgcagggtacggacagtactctagacccgcagagtttgaaacgacctctgaacggggatccggcgcacagcagctgcaagagcagctccctctgatcgtgggttccgccacggcgggactggtatttgtggtggctgttgtggtgattgccattgtatgcctgcggaaacagcggcacggaagcgactcagaatacaccgagaagttgcagcaatacattgcgccagggatgaaggtctacatagatcctttcacttatgaagacccgaacgaagccgtcagggaattcgctaaggagattgatgtgtcctgcgtgaagattgaggaagtgatcggcgctggtgagttcggtgaggtttgcagggggcgtctgaagcagccaggcaggcgcgaagtgtttgttgctatcaaaacattgaaggtcgggtatactgagagacaacggagggactttctctctgaggcctctatcatgggtcagttcgaccaccccaatatcatccggctcgaaggcgtcgttacaaagtctcggccagttatgatcctgacagagttcatggaaaactgcgcactcgattctttcctgcgccttaacgacgggcagtttactgtcattcagctagtggggatgctgaggggcatcgctgccggaatgaaatacctcagcgagatgaattatgttcatcgtgatttggccgctcgcaacatcttggtcaacagtaacctggtttgcaaggtgtcagactttggcctgagtcgcttccttgaggatgacccctctgaccccacttacacttcgtctctggggggaaagattcctattcgttggacagcccctgaagcaattgcctacaggaaattcaccagcgcaagcgatgtatggagctacggcatcgtgatgtgggaggtgatgtcctacggagagaggccctattgggatatgtccaaccaggacgttatcaacgctgtagagcaggattatcgactgccccctcccatggactgcccaaccgccctgcaccaactcatgctggattgttgggtgagggataggaacctccggcctaaattttcacagatcgtcaatacactagacaagcttatccgaaacgccgcttctctcaaagttatcgcctccgcccagtcggggatgtcccagccgcttttagacaggacggtgcccgattacaccacattcacaactgtcggcgattggcttgacgccatcaaaatgggcagatacaaagaaagcttcgtgagcgctgggtttgcaagcttcgatttagtagcccaaatgaccgcagaggatttgctgcggattggggtaaccctcgctggacatcagaaaaagatcctgagctctatccaagacatgagactacagatgaaccagactctgcctgtacaggtgtag

SEQ ID NO: 222080 - DNA, 3066 bp, Artificial Sequence
  Description of Artificial Sequence: Synthetic coding sequence
atggctaccgagggcgctgcacagctggggaatcgcgtggctgggatggtttgtagtctatgggtacttcttctcgtgtcatccgtcctcgccctggaagaggtcctgctcgacacaacgggggagacatccgagataggatggctgacttaccccccaggcggttgggacgaagtaagcgtgttagatgaccagcggagactaacccggactttcgaagcgtgccacgttgctggcgcacccccaggaacaggacaggacaattggctgcagactcacttcgtcgagcgacgcggagcccaacgcgctcacattcgactccatttctccgtaagagcctgtagctctttaggtgtttctggagggacatgtcgagagacttttaccctgtattacaggcaagctgaagagcctgactcgcccgacagcgtgagctcctggcatttaaagcggtggactaaggtggacactatagcagctgacgagtcattcccgtcatcatcttcaagctcatcttcctcttccagcgccgcttgggctgtgggcccacacggagccggtcaacgcgctggtctgcaactgaacgtgaaagagcgcagctttggtccgctcacccaacgaggattttatgtagcattccaggataccggcgcttgtctggccttggtggcggtcaggttgtttagctatacatgtcccgcagtcttgaggtctttcgcttcattccctgaaacccaggctagcggtgctggtggagccagtctcgtggctgccgtgggcacatgtgtcgcacacgctgagcccgaggaagacggggtgggaggacaggcaggcggtagccccccacggctgcactgtaatggggagggcaagtggatggtcgccgtgggtggctgtcgctgccagccaggctaccagccagcacgaggcgacaaggcttgtcaagcatgtccaagagggctctataaaagcagtgccggaaatgccccttgctccccctgccctgcacgaagccatgctccaaatccagccgctccagtctgtccatgtctggaggggttctaccgagccagcagtgacccccctgaagccccttgcaccggacccccttccgcacctcaggaactgtggtttgaagttcagggaagcgccctcatgcttcactggaggcttccgagagaactgggtggacgaggagatcttctgttcaatgtggtctgtaaggagtgcgagggcagacaggaaccggcttcaggagggggaggaacatgccacagatgccgagatgaagtccactttgaccccagacaacgcggactgacagagtctcgggtcttagtgggaggcctgagagcacatgtcccttacatcttggaagtacaagcggtgaacggcgtcagtgaacttagtcccgatccaccccaggccgctgcaatcaatgtgagcacttcccacgaagtgccttctgcggtgccagtggttcatcaagtcagtagagcctctaacagcattaccgtcagttggccacagccagatcagactaacggcaatattctggactaccagcttagatactacgatcaggcagaagacgaatcccattcattcacacttaccagcgagaccaacacagcgacagttacacaactcagcccaggtcatatctacggtttccaggtgcgggctagaacagctgctgggcatggcccatatggcggaaaagtgtattttcagactctgccacagggggagctgagctctcagctgcccgaaagactttctctggtgatcgggtcaattttaggcgctcttgcctttctcctcctagcggctataactgtcctggcagtcgtgttccagcggaaacgtcgagggactggttacaccgaacaactgcagcagtatagctctcctggtctgggcgtgaaatactatattgacccttccacctacgaggacccatgccaggccataagagagctcgcacgggaagtagaccccgcatatatcaagattgaggaggtgatcggtaccggatccttcggtgaggtcagacaggggagactgcagccccgagggcgacgagagcagaccgtagccattcaggccctctgggcaggaggagccgagtccctgcaaatgacatttctgggcagagccgctgtgctgggccagtttcagcatcccaatattttaagactcgaaggggtggtgaccaaaagtagacctctgatggtcctcactgagttcatggagttaggacctctggattcctttcttcgacagcgcgaaggtcagttcagcagcttgcagctggttgccatgcagaggggggtggcagctgccatgcagtacctgagttccttcgctttcgttcaccgaagcttatcagctcactccgtgctggtgaacagccacctggtgtgcaaagtggctcggctggggcatagtccacaagggccatcttgcctgctcagatgggcggcacctgaagtaatcgctcacggaaagcatacaacttcctctgacgtatggtcctttggcatactgatgtgggaggtcatgagttacggagagcgcccttattgggacatgagcgaacaagaagtgctcaacgctattgagcaggaattcagattaccccctcctcccggttgtcccccaggcctacacctgcttatgttggacacctggcagaaggacagagctaggcggcctcatttcgaccaattggtcgctgcattcgacaaaatgatccggaaacccgacacccttcaggccggaggcgatccaggggaacgacccagccaagctttactgacacctgtggccctggacttcccctgcctcgacagcccccaggcctggttatcagctattgggcttgaatgttaccaagacaattttagtaaatttgggctctgcactttcagtgatgtggcccagctaagcctcgaagatctgccagcactgggaattaccctcgccggacatcagaaaaaattattacaccacattcaactgttgcagcagcacctgcgtcagcagggatcagtcgaagtatag

SEQ ID NO: 222081 - DNA, 2235 bp, Artificial Sequence
  Description of Artificial Sequence: Synthetic coding sequence
atggccacagagggggctgcccagctgggaaacagggtggctggcatggtgtccgtcggcggttgtagatgccagccgggataccaacctgccaggggcgacaaagcttgtcaggcatgccccagaggcctttacaagagcagcgcaggtaacgccccatgttctccttgccccgcacgaagccacgctcctaacccagccgcacctgtttgcccgtgtctcgagggattttacagagcaagcagtgatcctcccgaggcaccatgcaccgggcctccatccgctccacaagaattgtggttcgaagtgcaagggtccgccctcatgcttcactggagattgcctagggagctggggggtcgtggcgacctgctgtttaatgttgtatgtaaggaatgtgaagggaggcaggaacccgctagtggcggaggcggtacttgtcaccggtgtagggatgaggtccacttcgatcctaggcagcgcggactgacagaatctagagttctagtagggggtctgagggcccatgtgccatatatccttgaagtgcaagcggtgaatggcgtctccgaattgtcgcctgaccctccgcaggccgctgctattaacgtgtccacaagccatgaagtgcctagcgcagtgcccgttgtccaccaggttagccgtgcttccaactccataaccgtgtcttggccgcaaccagaccagacaaatggtaatattttggactatcagctgagatactatgaccaggccgaggatgaatcccattcattcacccttacttcagaaactaacaccgcgaccgtaacccagttaagtcccggacacatctatggctttcaagtaagagccagaactgctgccggtcatggcccatacgggggtaaggtatacttccagactcttccccagggcgagctgagctcacagctgcctgaacggctgagtctggtgatcggctccatcctgggcgctttagcatttcttctgctggcagccatcacagtattagccgtcgtgtttcagcgtaagagaagaggaacagggtatactgaacagctgcagcaatattctagcccgggtctgggcgtgaaatactatattgatccgtccacatatgaggatccctgtcaggcgatcagagagctggccagagaggtagaccccgcttatatcaagatcgaggaggtcataggtaccggttcttttggagaggtcaggcagggcaggctacagccaaggggaaggcgggaacagaccgtggcgattcaggctctgtgggcgggtggtgctgagtccttgcaaatgacgttcttgggtagggcagccgtgttgggtcagtttcagcatcctaacattctgcgattagagggagtagtgaccaaatcacggccactgatggttctgaccgagttcatggagctgggccctttagattcctttctgcggcagcgggagggtcagttcagctcgctgcagctggtggctatgcagcgaggcgtggccgctgccatgcagtatctgtcttcttttgctttcgtgcataggtccctctctgctcactctgtgctcgtaaactctcatctcgtctgtaaggtcgcccgactcgggcacagcccccaagggccttcctgtctgctacggtgggcggctcctgaggtgatcgcgcatggtaagcacactacctcgtccgacgtatggtcattcggtatactcatgtgggaggtcatgtcttacggcgaaaggccatactgggacatgagcgagcaggaggtgttaaacgccattgagcaggaattcaggcttcctccacctcccggttgccctccagggttgcacctgttgatgctggatacgtggcagaaagacagagcgcgaagaccccactttgaccagctcgttgccgctttcgacaaaatgatccgaaaacctgacactttacaagccggaggtgaccccggagagagaccatcccaagccctcttgacccctgtggccctcgactttccttgtctggactccccccaggcctggctcagcgctattggcttagagtgttaccaagacaatttttcaaagtttggcctctgtacctttagtgatgttgcccaactgtcactggaggatctgcctgccctggggatcacactcgccggacaccagaagaagctccttcatcatattcagttgctgcaacaacacctaagacaacagggaagtgtagaggtgtag

SEQ ID NO: 222082 - DNA, 3066 bp, Artificial Sequence
  Description of Artificial Sequence: Synthetic coding sequence
atggcaaccgaaggggctgcacagctcggcaaccgcgtggcgggtatggtgtgttccctgtgggtgctgttgttggttagcagtgtcctggcgctcgaggaggtgttgcttgataccaccggcgaaacttcagaaattggatggctgacttatcctcccggaggctgggacgaagtaagcgtgcttgacgatcaacgtagattaacccgtactttcgaggcctgccacgtcgccggagccccacctggaactggacaggacaattggctgcaaacccactttgtggagcggagaggagctcagagggcacatataaggctacatttcagtgtcagggcatgttctagcttgggcgtaagtggcggaacctgtcgggagaccttcactttatactacaggcaagctgaggagcctgatagtcccgattctgtgtccagttggcacctgaaaaggtggacaaaggttgacaccatagccgctgatgagtcctttccatctagctcctcaagcagtagctcaagcagctccgcggcttgggcagtggggccacacggcgctggccaacgagcaggcctacaattgaatgttaaagagcgctcctttggtccactgactcagcgcggattctatgtcgcattccaggacactggtgcatgtctggccttggtggctgtcagactgttttcatacacatgcccagctgttctcaggtcctttgcctcttttcctgagacgcaagcctctggtgccggtggggcttccctggtcgcagctgtaggaacttgcgtcgcacacgcggagcccgaggaagatggggttggtgggcaggccggtggcagtcccccacgtctgcactgcaacggcgaagggaagtggatggtggctgtcggcggatgtcgttgccagccagggtaccagccggcacgaggggataaggcttgccaggcctgccctcgcggtctttataaatcatcggcaggaaatgccccttgttctccatgccccgcaaggagtcacgcacctaacccagccgctccggtctgcccttgcctagaaggattctaccgcgcatcttccgaccccccagaggcaccttgcacgggccctccttcagctcctcaggagctatggtttgaagtacagggtagtgcattgatgctgcactggcgactgcctcgcgagctgggtggcaggggggacctgctgttcaacgtcgtgtgcaaagaatgtgaaggtcgccaagagccggctagcggtgggggaggaacatgccacaggtgcagggacgaagtgcactttgaccctagacagagaggactcactgagtcacgggtgctagtggggggacttcgtgcccatgtgccatacatcttagaggtacaggctgtgaacggggtgtcagagttaagccccgatcccccacaggcggctgcaatcaatgtgagtacgtcccatgaggtgccaagcgccgttcctgtggtgcatcaggtgagtcgcgcttctaacagtatcactgtctcatggccccagccagatcagacgaacggaaacattctcgactatcagctacgttactacgatcaggctgaggatgaatctcatagttttacattgaccagcgagaccaacaccgctacagttacccagcttagccctggccacatttatggcttccaggttcgagccagaacagctgctggtcatgggccatacggcggaaaggtctacttccaaaccctcccacagggtgagctgagttctcagctcccagagcggctctcactggtcatcggcagcattctgggggcacttgctttccttctgctcgccgctattactgttctcgccgtggtctttcagcgaaaaaggcggggaaccgggtataccgagcaactgcagcagtactcctcccctggcctgggagtgaagtattacattgaccccagcacgtatgaagatccttgtcaggctatcagggagctggcccgtgaggtggatccagcctacatcaaaatcgaagaagtgatcggcaccggatcattcggcgaggtgcgacagggcagactgcaacccaggggccgacgtgaacaaacagtcgcaatccaggcactttgggcaggcggagccgaaagcctgcagatgacctttctcggtagggctgctgtcctgggccagttccagcatccgaatatcctccgccttgagggtgtggtgacaaaaagtcggcctctgatggtgcttaccgaattcatggagttgggcccactggattctttcctacgccagagggaaggacagttttccagcctccaactggttgcaatgcagcgaggggtggcagcagcgatgcagtatttgagtagttttgcctttgtgcacaggagtctgtcggcacattccgtgctggtgaattcccacctggtctgtaaggtggcacgtctcgggcatagcccccagggcccttcttgcctgttacgatgggctgcgccagaggtaattgcccacggtaagcatacaactagttctgacgtctggagctttggcattctcatgtgggaggtgatgagctatggcgagaggccctattgggatatgtctgagcaggaggttctgaacgccatcgaacaggagtttcgcctgccacccccacctggatgccctcctggactccatctgctgatgctcgacacctggcagaaagaccgcgcacgcaggccacatttcgaccagttggtggccgctttcgacaagatgattcgcaaacccgacacactgcaggccggtggcgacccgggtgaaagacctagccaggccctcttgacccccgttgccctggatttcccctgccttgacagcccccaggcctggctatctgctatcggattggagtgctaccaggacaattttagcaagttcggcctgtgcacattttctgacgtggcccagctgtccttggaggatctgccggctttaggaattaccttggccggtcatcagaagaagttgctgcatcatatccagctgctccagcagcatctccgccagcagggtagcgtggaggtgtag

SEQ ID NO: 222083 - DNA, 654 bp, Artificial Sequence
  Description of Artificial Sequence: Synthetic coding sequence
atggccggacggaccgtgagggcggagacaaggagtcgcgcaaaggatgacattaagaaggtaatggccacaatcgagaaagtaagacggtgggaaaaacggtgggtgacagtgggagacactagtcttcggatctttaagtgggttcctgtagtggatcctcaggaagaagagcggcgaagagcaggaggcggagccgagcggtcacggggtcgtgagagacggggacgaggtgcctctccacgagggggtgggcctttgattttgctggacttgaacgatgagaactccaaccagagcttccatagcgaaggcagtctgcagaagggaactgagccctcccctgggggaaccccacagccaagccggccagtgagccccgcaggaccacctgaaggggtgcccgaggaggctcaacctcctcgactaggccaggaacgggacccaggcggtattactgcaggcagcaccgatgaaccccctatgctcacaaaagaggaacctgtgcctgaactcttagaggcggaggctcctgaggcttaccccgtgtttgagcccgttcctccagtcccagaggccgcacagggggataccgaagatagtgagggtgcacccccactgaaaagaatttgccccaatgctccagatccgtag

SEQ ID NO: 222084 - DNA, 717 bp, Artificial Sequence
  Description of Artificial Sequence: Synthetic coding sequence
atggctgccgcacccttacttctgctgctgctcctcgttccagtgccattactgccccttctcgctcagggccctggaggagcgctgggcaaccgtcacgcagtgtactggaattcaagtaaccagcacctgcggagagaaggctacaccgtgcaagttaatgttaacgactatttagatatctactgtccccactataactcatcgggcgtgggcccaggtgctgggccaggacccggaggtggcgctgagcaatatgttttgtatatggtgagcagaaacgggtacagaacttgcaacgctagtcaaggatttaagaggtgggaatgtaacaggccacatgccccacattctccaattaaatttagcgaaaaatttcagaggtattcagccttctcgctggggtatgagttccatgcgggtcatgaatattattatattagtacaccgacccataatctgcattggaaatgtctccgcatgaaggtgtttgtttgctgcgccagcacatcccatagtggagagaagcccgtcccaaccctaccacagtttacgatgggacccaacgtgaagataaatgtgctggaggacttcgaaggggagaacccacaagtcccaaagctggagaagtcaatctcggggaccagccctaaaagggaacatttacctcttgctgtggggattgcttttttcctgatgacattcctcgctagttag

SEQ ID NO: 222085 - DNA, 639 bp, Artificial Sequence
  Description of Artificial Sequence: Synthetic coding sequence
atggcggcagctcctcttctgctcctcctcttgctcgtccctgtgcctctcctgccactgttggctcaggggccagggggtgctttgggaaaccgccatgcagtttattggaacagtagtaaccagcacctcaggagggagggatatacggtacaagtgaacgtgaatgactacctggatatttactgcccccactacaactccagtggagtcgggccaggggcagggccaggtcccggtggaggcgcagagcaatatgtcctttacatggtgtccaggaacggctaccgcacatgcaatgcgagtcagggatttaaacgctgggagtgcaacagaccacatgcaccccatagccctataaagttctcggaaaagttccaacgctattccgcattctcgctgggttatgagttccatgccggtcatgaatactattacatttctacacctacccacaacctgcactggaagtgcctgcgaatgaaagttttcgtctgttgcgcctccaaagacttcgagggggagaacccacaggtccccaaactagagaaaagcatttcaggaacctcccccaagcgcgaacacctgcccctagccgtggggatagccttcttccttatgaccttcctagcatcctag

SEQ ID NO: 222086 - DNA, 702 bp, Artificial Sequence
  Description of Artificial Sequence: Synthetic coding sequence
atgcggctcttacctttacttcgcaccgtgttgtgggccgcattcctgggctcgcctctgcgcggaggttcgtctctgcgtcatgtggtatactggaattcttccaatcccagcctgaggcgcgaaggctacacggtccaggtgaatgtcaacgactacctggacatttactgtcctcattataatagcagtggtgtgggacccggtgcaggcccagggcctgggggtggagctgagcaatacgtcctgtacatggtgagccgtaacgggtatcgaacctgcaacgctagtcaagggttcaagcggtgggagtgtaacagaccgcacgctccccactctcctattaagttcagcgagaaatttcagcggtactctgccttttctctgggctatgagttccacgcagggcatgagtactattacatttccaccccaacccacaacctccactggaagtgtttgcgaatgaaggtctttgtgtgctgtgccagcacaagtcattctggagaaaaaccggttccgactttacctcaattcactatgggtcctaatgttaagattaatgtactagaggacttcgaaggggaaaatccacaagtgcccaagctggaaaaatcaatctctggaacgagccccaaacgcgaacaccttcccctggctgtcgggatcgcattttttctcatgacatttctggctagttag

SEQ ID NO: 222087 - DNA, 582 bp, Artificial Sequence
  Description of Artificial Sequence: Synthetic coding sequence
atgagactgctgcctctcttgcgcaccgtgctatgggcagctttcctcggtagccccctcaggggcggttctagcctgcgacacgttgtgtactggaattcatctaatcccagactgctacggggtgacgcagtcgtcgagctgggactgaacgattaccttgatattgtgtgtcctcactacgaaggaccgggtccaccggagggtccggaaactttcgctctgtatatggttgactggccgggttacgagtcttgccaggccgaagggcctcgagcatataagagatgggtgtgttcgctaccctttggccacgtgcaattctccgagaagattcagcggttcactcccttctctctggggttcgagtttttgccaggtgagacctattactacatttcagtcccaacccctgaatcttccggccagtgtttgcggttgcaggtctctgtctgttgcaaggaacgtaaccttcctagtcatcctaaggagcccgagtcaagtcaggaccccctcgaagaggaaggctcccttttgccagcgctcggggtcccaattcaaaccgacaagatggaacattag

SEQ ID NO: 222088 - DNA, 606 bp, Artificial Sequence
  Description of Artificial Sequence: Synthetic coding sequence
atgaggttactccctctgttgagaacagttctttgggctgccttcctgggatcccctttgagagggggaagcagcttgcgtcatgtggtgtactggaactccagcaatcccaggctcctgaggggagacgccgtggtggagctgggactgaacgactacctggacatcgtgtgtcctcattacgaaggacctggcccacccgagggacctgaaacattcgctctgtatatggtggactggcccggatacgagtcatgccaagccgaggggccaagggcttataaacggtgggtctgcagccttcccttcggacatgtccagttttcagaaaagatccagcggtttaccccatttagtctgggctttgagtttctgcccggagaaacctactattacatttcagtgcccaccccagaaagcagcggccagtgtctccggttgcaggtgagtgtgtgttgtaaggaaaggaagtcagaaagcgcgcatcccgtaggatccccaggcgagtcgggtacgtcaggctggaggggaggtgatacaccatcacccctctgccttctgctgttgctgctccttttaatactgaggttgctgcgtattctatag

SEQ ID NO: 222089 - DNA, 624 bp, Artificial Sequence
  Description of Artificial Sequence: Synthetic coding sequence
atgaggttgctgccactccttcgcaccgtgctgtgggctgcttttctgggctcccccctcagaggtggcagcagccttcgccacgtcgtctattggaatagcagtaacccaagactgctcaggggagacgcagtggtggaactgggtctgaatgactatttggacatcgtctgtccgcattacgagggcccaggcccacccgagggccctgagacatttgccctttacatggtcgattggccaggatacgagtcctgccaagctgagggacctagagcttacaaaaggtgggtttgcagtttgcctttcggtcacgtacagtttagtgagaaaatacaaagattcacgcctttctctttagggtttgagtttctgcccggagagacctattactatattagcgtgcccaccccggagagttcgggacaatgcctgcgactgcaggtgtccgtgtgttgtaaggagaggagggcacgagtcctaccacgcagtcctggaggaggagggattcctgccgcttgtactggaggcgctaactcagatcggcaggatggggctctgatgggggagatccggggttcggaagtgacactggctggggcttgccctctgattaccggctag

SEQ ID NO: 222090 - DNA, 1083 bp, Artificial Sequence
  Description of Artificial Sequence: Synthetic coding sequence
atgagtgactcaaaagaacctcgcctgcaacagcttggacttctggtgtccaaagtaccatcttcgattagtcaggagcagtcgcgacaagacgccatttatcagaacctgactcagctgaaagcagccgtgggggagttgagcgagaaatccaaactccaggaaatctatcaagaactcacccagctgaaggccgcagtcggagagcttccggagaagtccaagttgcaggagatttatcaggaattgacacgccttaaagccgctgttggggaactgccggagaagtccaaacttcaagagatctatcaggaactaacatggctgaaggctgccgtgggtgaactgcccgaaaaatccaaaatgcaggagatataccaagaactcacaaggcttaaagcggctgtcggcgagcttcctgaaaagtctaagcagcaggagatctaccaagagctcacaaggctcaaggctgccgtcggagaactccctgagaagtccaagcagcaagaaatctaccaagaactgacccgcttgaaagccgcagtgggcgagctccccgagaaatccaaacagcaggagatttaccaggagttgacccagctgaaggccgctgttgagcgcctgtgtcatccctgcccatgggagtggaccttttttcagggcaattgctacttcatgtctaattcacagcgtaattggcatgattcaatcaccgcatgcaaggaggttggcgcacagttagtggtcattaaatccgcagaggagcagaacttccttcaactccagagtagccgttcaaatagatttacctggatgggtctgagcgacctaaatcaggaggggacttggcaatgggtcgatgggagccccctgttgcctagttttaaacaatactggaaccgcggtgagccaaacaacgtaggtgaggaagattgtgccgaattctcggggaatggatggaacgacgacaagtgtaatctggctaagttttggatttgcaaaaaatccgcggcttcttgtagcagagacgaggagcagttcctgtctccagcacccgcaacacccaatcccccaccggcatag

SEQ ID NO: 222091 - DNA, 888 bp, Artificial Sequence
  Description of Artificial Sequence: Synthetic coding sequence
atggagaagatgagtcgaccactacctctgaaccctactttcataccccctccctatggcgttctgagatctctattggaaaatccactgaagctaccacttcaccacgaggatgcgttcagcaaagataaggataaggaaaaaaaactggacgacgagagcaacagtcccacagtcccgcagtccgcattccttggtcccacactgtgggacaaaacattaccttacgacggcgatacatttcagctggagtatatggatctggaagagtttctttccgaaaacggcatccctccctctccctcgcagcacgatcattctccacatccccctgggctccagcccgctagcagcgccgctcctagtgttatggatctctcctcgcgggcttctgcgcctctccaccccggaatcccttccccaaattgtatgcagtctcccatccggcctggccagttactcccggcaaatagaaatacaccttccccaatagaccctgacaccatccaggttccagtaggctacgagcctgacccagccgacctggcgctctcctctatccccggtcaggagatgtttgatcctcgtaaaaggaagttctctgaggaggaactcaagccacaaccaatgatcaagaaagcacgtaaagtgtttatccccgatgacctgaaggatgacaaatattgggcacgcagaagaaagaataatatggccgcaaagcggagtagggatgccagacgtctaaaggagaaccagatagccataagagcatccttcctggaaaaggaaaattccgctcttaggcaggaagtggcagacttaagaaaagagttaggaaaatgcaaaaacatcttagcaaaatacgaggccagacatggacccctttag

SEQ ID NO: 222092 - DNA, 780 bp, Artificial Sequence
  Description of Artificial Sequence: Synthetic coding sequence
atggccgctgctgctcagctctcactgactcagctgagttccgggaatccggtctacgagaagtattaccgccaagtcgacacaggaaacactggcagggtccttgccagcgatgccgctgcatttctcaaaaagtctggcctgcctgacctgatcctcggaaagatttgggatttagccgacacagatggaaaaggaatcctgaataaacaggaattctttgtggctctgaggctggtcgcctgtgcacagaatggtctggaagtgagcctgtcctctctgaaccttgcggtacctccgcctaggtttcatgacacctcttctccccttcttatcagtggcacttctgccgcagagctaccttgggctgttaagcccgaagacaaggcaaagtacgatgctatattcgattcactgtcaccagtgaatggctttctgagcggggacaaagtgaagcccgtactactaaattcaaaactgcccgtagatattttggggagggtgtgggagttgtccgacatcgaccacgatggaatgttggaccgggacgagttcgctgtgaccgaaagccactccgtgacccaggctggagtacaatggagggacctgtcctctctgcagccccgacctccgggtttcaaattattcttccacctttccttactacgatcatgggactaccgtcatgcacctcccccaccagctaatttttatatcttttcccgcgattcggtgtcaccgtgccttcctgactggtccagggccccagataatcgttag

SEQ ID NO: 222093 - DNA, 2289 bp, Artificial Sequence
  Description of Artificial Sequence: Synthetic coding sequence
atggctgcagccgcacagctgtccttgacccagctgagctcaggcaatcctgtatatgagaagtattatcggcaggttgacacaggcaatactggcagagtgcttgcttctgacgccgctgctttcttgaaaaaaagcggcctacccgatctgatcctgggcaagatctgggacctggctgacaccgatggaaagggaatcctgaataaacaagagttctttgttgccctccggcttgtggcatgtgctcagaatgggctcgaggtcagcttgagtagcctgaacctcgccgtgcctccaccacgcttccacgataccagttcaccacttctaatcagcgggacaagtgctgccgagctcccatgggccgtgaaacctgaggataaagctaaatatgatgcgattttcgattctctcagtccagtgaacggcttcctttcaggagataaggtcaagcctgtgttgctcaattctaaactgccagtggacatcctaggacgtgtttgggagctgtccgacatcgatcatgacggtatgttagatcgggacgagttcgctgtggcgatgtttctggtgtactgtgcactggagaaagaaccagtccctatgagcctgcctccagctctggtccccccaagtaagagaaaaacctgggtggtgagccccgcagagaaggcgaagtacgatgagattttccttaaaactgacaaggatatggatggttttgttagcgggctggaggtgagggagatctttcttaagactggcttgccctcaacactgttggcacatatttggagcctgtgtgacaccaaggactgtggcaaactgtctaaggatcagtttgctctagctttccatttgatcagccaaaaattgattaaggggatcgatccaccccacgtgcttacaccagagatgatcccaccctccgatcgtgcatccctgcaaaaaaacataatcggcagcagcccagtggccgacttttctgccattaaggagctggacactttgaacaacgaaattgtagacttgcagcgcgagaaaaacaatgtcgagcaggatttgaaggagaaggaagacaccatcaagcagagaaccagtgaggtccaagacctgcaggacgaagttcagcgggagaacacgaacttacaaaaactgcaggcccagaaacagcaggtgcaggagctgctggacgagctggacgagcaaaaagctcaattggaagaacagctgaaggaggttagaaaaaaatgcgcagaggaggcccaacttgcacggagctcaccggagctcctccctagtggagttacagatgagaatgaggttaccactgccgtcactgagaaggtctgctccgagctagataataatcggcactcgaaagaggaggacccattcaatgtcgattcatcaagtctcacgggaccagtggctgatacaaacctggatttcttccaatctgaccccttcgtggggtctgacccatttaaggacgatccgttcggtaaaattgacccatttggtggtgatcccttcaaaggatctgatcccttcgccagcgactgtttcttccgtcagagcaccgatcctttcgctacctcatcaaccgatccattctcggccgcaaacaattctagcatcacttccgtggaaactctaaagcacaacgacccttttgcccctggtggaacagttgttgccgctagcgacagcgccaccgatccattcgcctccgtctttgggaacgagtctttcggtggtgggttcgccgacttcagcacgttgagcaaggtgaacaatgaggatcctttcagatccgctacatcttcctccgtctcaaacgtggttataaccaagaatgtgttcgaagagactagtgtcaaatccgaggatgagccccctgccttaccccctaagataggcacgcccactcgtccatgcccactccccccaggtaaacgctctatcaacaagctcgattcgcccgacccatttaagctgaatgacccgtttcagccgttccctgggaacgactctccgaaggagaaggatcccgagattttctgtgaccctttcacttcagccactaccactactaacaaggaggccgatcctagcaattttgccaacttcagcgcttaccccagcgaggaggacatgatcgagtgggccaagcgtgagtcagagcgtgaggaggaacaacggctcgccagactcaatcaacaggagcaggaggacctggaactggctattgctctttctaagagtgagatctccgaagcttag

SEQ ID NO: 222094 - DNA, 2691 bp, Artificial Sequence
  Description of Artificial Sequence: Synthetic coding sequence
atggcagctgctgcgcagctgagcctgactcaactcagctccggcaatcctgtctatgagaaatactaccgccaagttgacaccggtaataccggacgggtattggcatcggatgccgctgccttcctgaagaagtcaggtcttcctgatctcatcttggggaagatttgggatctggccgacactgacgggaaaggaatactgaacaaacaggaatttttcgtggcactcaggctggtggcctgcgcccaaaacggcttagaggtgagtctgtcctccctgaatctcgccgtcccgccaccacgctttcatgatacttcttcacctctgctgatctctggcacaagcgccgcagaactgccttgggccgtgaagccggaagacaaagcgaaatatgacgccatatttgacagtcttagtcctgtgaacggcttcctgagcggcgacaaggttaaaccagtgctcctgaactcgaaactccctgttgacatcctggggagagtctgggagctgtcagatatcgaccacgatggaatgctggatcgggacgagttcgcagtggctatgttcctggtgtactgcgctctggaaaaggagcctgtgccgatgagcctccccccagccctggtcccaccctctaagcgaaaaacttgggtcgtctccccagccgaaaaggctaaatatgacgagatttttctgaaaactgacaaagacatggacggcttcgtgagcggattggaagtcagagagattttcctcaagacagggctaccgagcacattgctcgctcacatttggagtctgtgcgacactaaggattgtgggaagctgagtaaggatcaatttgccctggcgttccaccttatatcacagaagcttattaaggggatagatccgcctcatgttctgactcctgagatgatccccccttctgatagagccagtctgcaaaagaatataatcggttcttctcctgtcgccgattttagcgccataaaagaacttgacaccttgaataatgaaatcgttgacctgcagcgggaaaaaaacaatgtggagcaggatctgaaggaaaaggaggataccatcaagcagcgcaccagcgaagttcaggatttacaggacgaagtgcagagagagaacaccaatctgcaaaaactgcaggctcagaaacagcaggtgcaggagctccttgacgaattagacgagcaaaaggcacagttggaggagcagctcaaggaggtacgtaaaaagtgtgccgaagaggcacagttgatatcctccctcaaggccgaactcacaagccaggagtcacagatatccacttacgaggaagaattagccaaggcgcgtgaagagctatccaggttgcagcaggagactgcagagttggaagagtcagtggagtctggcaaggctcagctagagcccttgcagcaacatctgcaggatagccagcaggagattagcagcatgcagatgaagctcatggagatgaaagatttggagaaccataactcccagttaaattggtgcagcagccctcacagtatcttagtcaatggtgccaccgactactgtagtttgagtacaagttctagcgagacagctaacctgaacgagcatgtagaggggcaatcgaacttggaatctgaacccattcatcaggagtcccctgccaggagcagccccgaactacttccgtccggcgtgaccgacgaaaacgaggtaacaacagcagtcaccgagaaagtgtgttctgagcttgataacaacaggcattctaaggaggaagaccctttcaacgtcgactcatctagcctcacaggtccagtcgccgataccaatctcgacttttttcaatccgacccatttgttggctctgatcccttcaaggacgatcctttcggaaagattgacccctttggtggggacccctttaagggatctgacccgtttgcatccgattgcttctttaggcagtctactgatcctttcgcaacatccagtaccgatccattttctgctgcaaataatagctccatcacttccgtggaaacactcaagcacaatgacccattcgcgcctggaggaaccgtggtggcagcatccgactccgccactgatcctttcgcctcggtcttcggtaacgagagcttcggaggcggatttgcggactttagcaccctttcaaaggtgaataacgaagatccttttcgtagcgcaacatctagcagcgtgagcaacgtggttattaccaaaaacgtcttcgaggagacttcggtcaaatccgaggacgagccacctgccctacctccaaaaattggcaccccaaccaggccttgtccgctgccaccaggcaaaaggtctatcaacaaactggattcccctgatccttttaagctgaatgatccctttcagccatttccaggaaatgattcacccaaggaaaaggacccggaaattttctgcgacccgttcacgagcgccaccaccactacaaataaggaagcagacccgagcaacttcgcaaacttttctgcttacccttccgaagaagatatgattgaatgggccaaacgggaatctgagcgcgaagaggagcaacggctagccaggctcaaccagcaagagcaggaagacctcgaactggccattgccctgagtaagtcagaaatcagcgaggcctag

SEQ ID NO: 222095 - DNA, 1722 bp, Artificial Sequence
  Description of Artificial Sequence: Synthetic coding sequence
atgatcttgatggtgcgggactgtctcaagtcccaacaccgtgacccgcactgcgatcccagcgataaacgcgagaaaaacaacgtggaacaggacctgaaggagaaagaggacactattaagcaaagaacttccgaagtgcaagatctccaggatgaggtacagcgagagaatacaaatctgcagaagttgcaggcgcagaagcagcaagtgcaggagctgcttgatgagctggacgagcaaaaagctcaattggaggaacagctgaaagaggtcaggaaaaaatgtgccgaggaggcccagctgattagtagcctgaaggcagagctcacatctcaggagtcacagatcagtacctacgaagaagagctggccaaggcgcgagaggagctgtcaagattgcagcaggaaactgcagagctggaggaaagtgtagaaagtgggaaagcccagctggaaccactgcagcagcaccttcaggactcgcaacaagaaattagctctatgcaaatgaagctgatggaaatgaaggacctcgagaaccacaacagccaactcaattggtgctcctctccgcattcaatactggtgaatggggctactgactactgctctctcagcacatcctccagcgagacagctaacttaaacgaacatgtggaggggcagtccaatctggaaagcgagcccatccaccaagaaagtccggctcgatctagccccgagctcttgcccagtggcgtaaccgacgaaaacgaagtgactaccgccgtgaccgaaaaagtatgctctgagttggataacaacagacattccaaagaggaggacccattcaatgtggacagttcatccctaactggacccgtagcagacactaacttggacttctttcagagcgatccttttgtggggtctgatccatttaaagacgatccatttgggaaaattgaccccttcggcggagacccatttaaaggcagcgaccctttcgcttcagactgtttttttaggcagtcgactgaccctttcgccaccagctcaactgatccattttctgccgctaacaacagcagcatcacttctgtggagaccctcaagcataacgaccccttcgcgccaggaggcaccgtggttgccgcttcggacagcgccaccgatccctttgcctctgtgttcggaaatgagagtttcggaggaggattcgcagatttttctacactctccaaggtaaacaatgaagaccctttccgtagcgcaacttcttcctcagtttccaacgtggtgatcacaaaaaacgtgttcgaggaaacttccgtgaaatctgaagacgaacctccagcgctgccacccaagattgggacacctactcgcccttgccccttaccgcctgggaaacggagtataaacaaacttgatagcccagatcccttcaagctcaatgatcctttccagccattcccgggaaacgacagcccaaaagagaaggatccggagattttttgtgatccttttacatccgctaccaccaccactaacaaggaagcagaccccagtaactttgccaacttttccgcctatcccagcgaagaagacatgatcgaatgggccaagagggagtcagaacgggaagaggaacagcgcctggctcgcctaaaccagcaggaacaagaggatctggaactagcaattgctctgtctaaatcggaaatcagcgaggcttag

SEQ ID NO: 222096 - DNA, 2469 bp, Artificial Sequence
  Description of Artificial Sequence: Synthetic coding sequence
atgaatgggcacattagcaatcacccctcttccttcggaatgtaccctagccagatgaacgggtacggaagcagccctacattttcacagaccgatagggaacacggctctaagacatctgccaaagcactctatgagcagcgcaaaaattatgccagggattcagtttctagcgtatccgacatctctcagtaccgtgtcgaacacttaacaacctttgttctggatcggaaggacgctatgataaccgttgatgatgggatccggaagctcaaacttctggatgcaaagggaaaggtgtggacacaggatatgatcctgcaggttgatgacagggcagtttcgctgatcgacctggagtcaaagaacgagctcgaaaactttcccctgaatactatacagcactgtcaagccgtcatgcattcttgttcttatgattccgtcctcgcgctggtttgtaaggagcccacgcagaataagccagatctgcacctcttccagtgtgacgaggttaaggccaatttgatcagtgaagacatcgagagcgcaatatcggactccaaagggggaaaacaaaaaagacgcccagacgccctgaggatgatttcaaatgcggatccttcaataccacccccaccgagggccccagccccagctccacccggaacagtgacacaggtcgatgtgcgatctcgggtcgccgcttggtccgcctgggcagcagaccaaggcgactttgagaaacccaggcagtaccatgaacaagaggaaactccagagatgatggcagcacgaatcgaccgcgatgtccaaatactcaatcacatcctggatgatatcgagttcttcattactaaactacaaaaggccgctgaagcattcagcgagctgagcaagcggaagaagaataagaaggggaagcggaaagggcctggagaaggcgtcttaacactgcgggctaagccacctcctcccgacgaattcttagattgtttccagaaatttaagcacgggttcaatctcctcgctaagttgaaatcacatatccaaaatccaagtgccgctgaccttgtccatttcctctttacccccctgaatatggtggttcaggccacaggaggcccagaacttgccagcagcgtactatcgcccctgctgaacaaggacacgattgattttctgaattacaccgtaaatggagatgagcgacagctgtggatgtccctggggggtacttggatgaaagctagagcggagtggcctaaggagcaattcatccctccctacgtccctagatttcgcaatggatgggagcctccaatgctgaactttatgggggcaaccatggaacaagacttataccagctggctgagagcgtcgctaatgtcgccgagcaccagaggaagcaggagattaaacgcctgagcactgagcacagcagcgtgagtgagtaccaccctgccgatggatatgctttctcttctaacatttacacacggggtagtcacctcgaccagggcgaggctgcagttgctttcaaacctacctcaaatcgccacatcgaccgcaattacgagccactcaaaactcagcccaaaaagtacgcaaaatctaaatacgacttcgtggctaggaataattctgagctttccgtgctgaaggacgacattctcgaaattttagatgataggaagcagtggtggaaggtgcgtaatgccagcggggattcaggatttgtccccaacaacatcttggatatcgtccggccacccgaatccggtttgggacgggctgatccaccttatactcacactatccagaagcagagaatggaatacgggccacgaccggcagacaccccccctgcaccaagcccaccacctactcccgcacccgtgcccgtgccactgcctcccagcacgccagcaccagtacctgtctccaaagtgcctgcgaatataacacgccaaaactcgagctcttctgatagcggaggaagcattgtgagagattcccagcgtcataaacagttaccagtggatcggcgtaaatcacaaatggaggaggtacaggatgaattaatacataggctgaccataggcaggagcgccgctcagaagaagttccacgtgccaaggcagaacgtccccgttatcaatattacttacgacagcacaccagaggatgtgaagacctggctccaaagtaaaggatttaacccagttactgtgaacagtttaggcgtgctaaacggggctcagttgttttctctgaataaggatgagttgcgaaccgtatgtccagaaggggcaagagtgtacagccaaatcacggttcaaaaagcagcgttggaggactcctccgggtcatcggagttgcaagagatcatgcggaggcgccaggaaaagatatcagcagctgcttccgatagtggagttgaatccttcgacgaaggttcgtctcactag

SEQ ID NO: 222097 - DNA, 366 bp, Artificial Sequence
  Description of Artificial Sequence: Synthetic coding sequence
atgaacgggcacattagtaaccatcctagctcctttggtatgtacccatcccaaatgaatggctatggtagttcacccactttctcccagacagatcgggaacacggtagtaaaacaagcgctaaggcactgtacgagcaacggaagaactacgcaagagacagtgtttcatctgtctcggatatctcacagtacagagtggaacatctgaccactttcgtgttagacaggaaggatgccatgatcacagtcgatgatggcattcgaaagttaaagttactggacgccaagggaaaagtctggactcaggatatgatcctgcaagtggatgaccgcgcagtgtctctcatcgatctggagtcctag

SEQ ID NO: 222098 - DNA, 207 bp, Artificial Sequence
  Description of Artificial Sequence: Synthetic coding sequence
atgaacggccatataagcaatcacccatcttccttcggcatgtatccgagccagatgaacggctatggcagcagtccgacctttagtcagacagaccgagagcatggcagtaaaacatccgctaaggcactctatgagcaaagaaagaattacgcccgagattctgtgtcttctgtctctgacatctctcagtaccgggtggagtag

SEQ ID NO: 222099 - DNA, 1689 bp, Artificial Sequence
  Description of Artificial Sequence: Synthetic coding sequence
atgatggcggctaggatcgaccgggacgtacagatcctcaatcatatattagatgacattgaattttttatcacaaagctgcagaaggccgcagaagccttttcggaactctctaaacgaaagaaaaacaagaagggcaagcggaaaggccctggcgagggcgtgctgaccttgagagcgaagcctcctcctcccgatgaattcctggactgctttcagaagtttaagcatggtttcaatctccttgctaagttgaagagccatattcagaatccatcagccgcagacctcgtgcacttcctgtttaccccacttaatatggtggtccaagcaacagggggacccgagctcgcttcttctgtgctgtcacctcttctcaacaaagataccattgactttctcaactacactgtgaacggtgacgaaagacagctctggatgtctctcggagggacatggatgaaagcaagagccgaatggccaaaggagcagtttatcccaccttacgtgccgaggttcaggaatggctgggaaccccctatgctgaattttatgggtgccacaatggagcaggacctctaccagttagccgaaagcgtcgctaacgtagctgagcatcagagaaagcaagaaatcaaacgactatctactgagcactcctccgtgtctgaataccatcctgctgacgggtacgccttttcaagtaatatatataccaggggttcacacctggaccagggtgaagctgcggtcgcctttaagccgacttctaacagacacatagatcgcaattacgaacctcttaaaactcagcccaagaagtacgctaaatcgaagtacgactttgtggcccgaaacaattctgaactgtccgtactgaaggacgacatactggagattttggacgacaggaaacagtggtggaaggtcaggaacgctagcggggattcaggatttgtgcctaataacattctggatatagtgaggcctcccgagtcaggactcggacgcgcagacccaccttatacccacaccatccagaaacaacgcatggagtatgggccacgccctgctgatacaccaccggcaccttcacctccaccaaccccggctccggtccctgttcccctgcctccgtcaacacctgcccctgtccctgtttcaaaagttcccgctaacataaccaggcagaatagttcctccagcgattcggggggatctattgtgagagacagccagaggcataaacagctgccagtggatcgccgaaagagtcaaatggaagaagtccaagatgaattgatccatcgtctcacaatcgggaggtccgccgcacagaagaagttccatgtgccaagacagaacgtccccgtcatcaacatcacctatgactccacacccgaagatgtgaaaacatggctccagagcaagggcttcaacccggtgacggtgaacagtttaggggtcctcaacggcgcacaacttttctccctgaacaaagacgagcttaggacagtctgtcctgagggtgccagggtctattcacagattacggtgcagaaagctgctctcgaggatagctccggttcttccgaactgcaggagatcatgcgtcggagacaggagaagatcagtgcggctgctagtgactcaggagtggagagcttcgatgaggggagcagccactag

SEQ ID NO: 222100 - DNA, 1689 bp, Artificial Sequence
  Description of Artificial Sequence: Synthetic coding sequence
atgatggccgctagaattgatagagacgtgcagattctcaatcatattttggacgacatcgagttcttcatcactaaactgcagaaggctgccgaggctttcagtgaactctccaagaggaaaaaaaataaaaagggtaagcgtaagggcccaggggaaggagttctcacccttagagccaagccgccacctcccgacgaattcctggactgtttccaaaagtttaagcatggctttaatctgctcgctaagctgaagtcgcacatccagaacccctcagcggcagacctggtccactttctgttcacccccctcaatatggtagtgcaagccacaggaggcccagaacttgcttcttctgtgttgagtccacttctgaataaagacacaatagactttttgaactacacagtcaacggagatgagagacaactgtggatgtctctggggggaacatggatgaaggctcgggctgaatggcccaaagagcagttcattcccccatacgtccccaggtttcggaatgggtgggaaccccctatgctcaacttcatgggtgccacgatggagcaggatctgtatcagctggccgaatctgtggccaatgtggcggaacaccaacggaagcaggagatcaaaaggctgagcacagagcattcttccgtgtctgagtatcacccagccgatggatatgctttctcatctaatatctatacacgtggctcccatttggaccagggagaagccgctgtggcctttaagcccacttccaaccggcatatcgatcgcaattatgaaccactaaaaacacagcctaaaaagtacgccaagtccaagtacgactttgtggcacgcaataacagtgagctaagtgtactcaaagacgatatactagagatacttgacgacagaaagcagtggtggaaggttagaaatgcgagcggagattcaggcttcgtgccgaacaatatactcgacatcgtaagaccccctgagagcggccttggcagggctgatccaccctacacacatactattcagaagcaaagaatggagtatgggccaagacccgctgatacgccccctgctcctagtccacccccaactcctgccccagtaccagtccctttgcccccaagcaccccagctcccgtgccagtgtccaaggtgcctgctaatatcaccaggcaaaatagcagctccagcgactctgggggaagcatagttagggactcccagcgtcataagcagctcccagtggaccggaggaaaagccaaatggaggaagtgcaagacgagttgatacacaggttgactatcgggagatctgccgctcagaaaaagtttcatgtgcctaggcaaaacgtccccgtaatcaatattacttatgattctacacctgaggatgtaaagacatggttacagagtaaaggtttcaaccctgtgaccgtgaacagcctcggcgttttgaacggagcacagttgttcagccttaacaaggacgaactcagaaccgtgtgtccagagggcgctagggtgtatagccaaataacagtccagaaggccgcactcgaagattcgagcgggagcagcgaactacaggagatcatgagacgcagacaggagaagatttctgcagccgctagcgacagcggagtggaaagctttgacgagggctcctcccactag

SEQ ID NO: 222101 - DNA, 2076 bp, Artificial Sequence
  Description of Artificial Sequence: Synthetic coding sequence
atgaacgggcatatctcaaatcaccctagcagcttcggcatgtatccaagtcagatgaatggctatggctcttccccaaccttctctcagactgaccgggagcatggcagcaagacttctgctaaggcactgtacgaacagcgcaagaactacgctagggattctgtcagctctgtcagtgatatctcgcagtaccgcgttgaacatctaaccacgttcgttctggataggaaggacgccatgataaccgtggatgacggcattcggaaactgaagctgctagatgctaagggaaaggtttggacacaagacatgatcctgcaggtggacgatagggcagtgagcctgatcgatctcgaatcaaaaaacgagctggaaaactttccactcaacaccatccaacactgccaagctgtcatgcactcctgctcctatgacagtgtactggctctggtctgcaaggagcccacacagaacaagccagacctccatctgtttcagtgcgatgaagtgaaagccaatctgataagcgaggatattgaatctgccataagcgacagtaaggggggaaaacaaaaacggagacccgacgccttgaggatgatctcaaacgccgaccccagtataccccctccaccacgcgctccagcccctgcgccacccggaaccgtaacgcaggtggacgtgagatcgcgcgtggcagcttggtcagcctgggcagcggatcagggcgacttcgagaaacccaggcaatatcacgaacaggaggaaactcccgagatgatggccgctaggatagatcgagacgtccagatcttgaatcatattctggatgatatcgagtttttcatcacgaagcttcagaaagccgcagaggccttttcggagcttagtaagcgcaaaaaaaacaaaaaaggcaagcggaaggggcctggtgagggagtcctcactctcagggccaagcccccacccccagatgagtttcttgattgctttcaaaagtttaagcacgggttcaacctgcttgcaaaactgaagagtcatattcagaacccctctgccgctgacctcgtgcactttctgtttaccccgctgaacatggttgtccaggctacggggggtcccgaactcgcgagcagtgtcctgtcccccctccttaataaggatacaatcgactttctcaactacacggtgaatggggatgaacgccagctctggatgtcgttaggaggaacttggatgaaagcccgtgccgagtggccaaaggaacagttcatccccccttacgtacccagattccggaatgggtgggaaccaccaatgctcaactttatgggggcaacaatggaacaggatctctaccagcttgccgagagtgtggctaatgtggcagagcaccagaggaagcaagaaatcaagcgactctccaccgaacatagttccgtgtcagagtatcatccagcagatgggtacgctttctcaagtaacatttatacacgcggaagtcacctagatcagggggaagccgctgtcgcctttaaacccacgtctaatcgccatatcgaccgaaattatgagccccttaaaacccagcctaagaagtatgcaaaaagcaaatacgacttcgtcgccaggaacaattccgagctgagtgtactgaaagatgacattctggaaattttggacgatcgcaagcagtggtggaaagtgcgcaatgcttctggcgacagcggattcgtcccaaacaatattttggacattgtgagacctcctgagagtggactaggaagggcagatcctccgtacacacatacaatccaaaaacaaagaatggaatacggtccacgcccagcagataccccccctgcccctagccccccacccaccccagccccagtgcctgtcccactgccaccttcaacaccagctccagtccccgtctcaaaggtgcctgccaacattacccgtcagaattccagctcatccgatagtgggggatcaatcgtgcgcgactcacagaggcataagacatctggcggtcctaaagaaatctcagatgggggaagcgcaaggtag

SEQ ID NO: 222102 - DNA, 207 bp, Artificial Sequence
  Description of Artificial Sequence: Synthetic coding sequence
atgaacgggcacatctctaaccacccatcctccttcgggatgtatccatcacagatgaatggatacgggtccagccccacttttagtcaaactgacagggaacacgggagcaagacatccgctaaggccctgtacgagcagcgaaaaaattacgctcgggactccgtttccagcgttagcgacattagccagtatcgtgtggagtag

SEQ ID NO: 222103 - DNA, 2469 bp, Artificial Sequence
  Description of Artificial Sequence: Synthetic coding sequence
atgaatgggcacatctccaaccacccctcgtctttcggcatgtaccccagccagatgaacggttacggcagctcgcctaccttcagtcagaccgatcgcgaacacgggtccaaaactagtgctaaggccttatatgagcagaggaagaattacgctagggatagtgtttcttccgtgtcagacataagccagtacagggtggaacaccttacaacatttgtcctcgaccgaaaggacgccatgatcaccgtggatgatggaatccgcaagctgaagctcctggacgctaagggcaaggtctggactcaagatatgatattgcaggtagacgacagggccgtatcccttattgacttggagtcaaagaacgaactcgaaaacttccccctcaataccatccagcactgccaagccgtgatgcattcttgctcatacgatagcgtcctcgcgctcgtgtgtaaagaacctacacaaaataagcccgatctgcatctgtttcaatgcgatgaggtaaaggccaacttgatatccgaggacatagagtcagcaatctctgacagcaaaggcggaaagcagaaacgacgtcccgatgctttgcgaatgatttccaacgcggatccgtcaatccccccaccacctcgggcacccgcacccgcacctcccggtaccgtcactcaagtagacgtcagatcacgggtggccgcatggtctgcctgggccgcagatcagggcgacttcgagaaaccccgacagtaccatgagcaggaggaaacaccagagatgatggcagccaggatagacagagacgtgcagatcctgaaccatatcctcgatgatattgagttctttataacaaaattgcagaaggctgctgaagccttctctgaactctcgaagagaaagaagaataagaaaggaaaacggaaaggtcctggggagggagtactcaccctgcgtgcgaagccacccccacctgacgagttcctggattgcttccagaagtttaagcatggctttaatctgttggccaaactaaagagtcatattcagaatcctagcgcagctgacttagtgcacttcctgttcacacccctgaatatggtggttcaggctacagggggtcctgagcttgcctctagcgttctgtcccctctgctcaataaagacacaattgacttcctaaattacactgtgaacggcgacgagagacagctctggatgtcactgggaggcacttggatgaaggccagagcggagtggcctaaagagcagtttatccccccttacgttccccgattcaggaatggctgggagcctccaatgctgaatttcatgggggctacaatggaacaggacttgtaccagctggcggaaagcgttgcaaatgttgccgagcatcagaggaaacaagagataaagagactgtcaaccgaacactctagcgtttctgaatatcacccggcagacggctacgcgtttagctctaatatatacacccgcggttcccacctggatcaaggcgaagcagcagtcgcattcaaacccacaagcaacaggcacatcgaccgcaattacgagccacttaaaacccagccaaagaaatatgcgaagtccaaatatgattttgtggcaaggaacaacagtgaactcagcgtgctcaaagacgacatactggaaattctagatgaccggaaacagtggtggaaagtccgcaatgctagcggcgatagcggctttgtgcctaataacatcctggacatagtgcgtcctcccgaaagcgggctgggaagagccgatccaccttacacccataccatccagaagcaaaggatggaatatggtccccgacccgcagacacacccccagccccatcacccccacctactccagctccggtgcccgttcctttgcctccgagcacgcccgctccagtgcccgtgagcaaggtaccggctaatattacaagacagaactcttctagcagcgattctggcggatctattgtgagggatagtcagaggcataaacagctgcccgttgacagacggaagagccagatggaggaggtgcaggatgaactcatacatcgactcacaattggaagaagcgccgctcagaaaaagttccacgttccacgccagaacgtgcctgtgatcaatatcacttacgactcaacgcccgaggacgtcaagacttggttacagtctaaaggctttaatcccgtgacggtgaatagtctaggcgtgctgaacggcgcacagttattttctctgaataaggatgagctgcgcactgtgtgcccagagggcgcacgagtctatagccagattaccgtgcaaaaggccgcactcgaggacagctccggctccagcgagctccaggagatcatgaggaggcgccaagagaaaatcagcgccgctgcatcagacagcggggtggaatcatttgacgaaggctcttctcattag

SEQ ID NO: 222104 - DNA, 2469 bp, Artificial Sequence
  Description of Artificial Sequence: Synthetic coding sequence
atgaacgggcacataagtaatcatccaagttctttcggcatgtatcctagccagatgaatggttatggtagttcccctactttttctcagacagacagagagcatggaagtaaaacaagcgcgaaagctctgtatgagcagcgaaaaaactatgccagggatagtgtttcctcggtgagtgacatctctcagtacagggtggaacaccttactactttcgtgctggatagaaaagacgccatgataacagtggatgacggaatacgtaagctgaagttgctcgatgcaaaaggcaaggtctggacccaggatatgatccttcaggtggatgacagagcagtgagccttatcgatctggagtccaagaacgagctggagaactttccacttaatacaatacagcactgccaggcagttatgcacagttgcagctatgattccgtactcgcgctagtgtgtaaggaacctacacagaataaacctgacctgcacctcttccagtgtgatgaagttaaagccaacctgataagtgaagacatcgagagcgccatttccgattcaaagggagggaagcagaaaagaagacctgacgccctgcggatgataagcaacgccgatccctctattccgcctcctcccagagcaccagctcctgccccaccaggcaccgttactcaggtcgatgtacggtcgcgggtcgctgcctggagcgcttgggccgctgaccagggggatttcgaaaagcccaggcaatatcacgaacaggaggaaacgcccgagatgatggcagcgaggatagaccgtgacgttcagattctgaaccatatactggacgatatagagttcttcattaccaaactgcagaaggctgccgaggcgttctctgagctaagcaagagaaaaaaaaacaaaaagggcaagagaaagggaccgggagagggggtgctgacactccgtgctaaacctccaccccctgatgagtttctggactgcttccagaagttcaagcacggcttcaatcttctggcgaagttaaaatctcatatccaaaatcccagtgcagcagatctggtccatttcttgttcactcccctgaacatggttgtgcaagccactggaggtccagaactcgcatcgagcgtgttaagccctttgctgaacaaagacacgatcgattttctgaattatactgtaaatggcgacgagcggcaactatggatgtccctggggggaacctggatgaaggctagagctgagtggcctaaagagcagtttattccaccttatgtaccacgctttagaaatgggtgggagccaccaatgctgaacttcatgggagctacaatggagcaggatctttatcagctggcagagagcgtcgccaatgtggcagaacatcagcgcaaacaggagattaaacggctcagtacggagcacagctcagtgtcagagtatcatccagccgatgggtacgccttcagctcaaacatttacacgagaggatctcaccttgatcagggggaggccgcagttgcttttaagccaactagcaacagacatattgatcgtaattacgaacccttaaagactcagccgaagaaatatgccaagtctaaatatgacttcgtggcgagaaacaatagtgaattgtccgttctcaaggatgatatccttgagatactggacgatagaaaacaatggtggaaagtgcggaacgcatcaggggattccggtttcgtgcccaataacatactcgatattgtcagacccccagaaagtggactgggcagagctgacccaccctacacccacactatccaaaagcagcggatggagtatggcccacgaccggctgacactccccctgccccatcaccccctccaacaccagccccagtgccagtcccattacctccctcgacccctgcacccgtgcccgtgagcaaagtgcctgccaacattacgcgacaaaattctagctcctccgactccggtgggagcattgtgcgggacagtcagagacacaagcagctgcccgtggaccgtaggaaatctcagatggaagaagtgcaggatgaacttatacatcggctgacaatcgggcgatctgccgcacaaaagaaattccacgttcctagacaaaatgtccccgtgattaatatcacctacgattcaacgccagaggacgtaaaaacatggttacagtcaaaagggttcaatccagttactgtgaacagcttgggggtcttgaatggggcacagctattttcactcaataaagacgaactgaggactgtatgtcctgagggcgcaagggtctactctcagatcaccgtgcagaaggctgcactggaggattcttccggatcgtccgagctgcaggaaatcatgcgaagaaggcaagaaaagatctcagccgctgcctctgactcaggcgtcgagtccttcgacgagggcagcagccactag

SEQ ID NO: 222105 - DNA, 204 bp, Artificial Sequence
  Description of Artificial Sequence: Synthetic coding sequence
atgaacggccatatttccaaccacccatccagctttggtatgtacccatcccagatgaacggatatggtagctccccgacattctctcaaacagatcgggagcacggaagtaagaccagcgcaaaagctttgtatgagcagcgaaaaaactacgctcgggacagcgtgtctagcgttagcgacattagccagtaccgagtgtag

SEQ ID NO: 222106 - DNA, 387 bp, Artificial Sequence
  Description of Artificial Sequence: Synthetic coding sequence
atgaacggccatattagcaaccatccttctagcttcggaatgtacccatcccaaatgaatggatatggctctagtcctacatttagccaaacggacagggaacacggttccaagacatctgccaaggcactgtatgagcagcgaaaaaattatgcgcgtgacagcgtgtcttccgtgagcgacatttcccaatatcgcgtcgagcacctaactacctttgtccttgatagaaaagatgcaatgataactgtggatgacggcattcggaaactcaagcttttggatgccaagggcaaggtatggactcaggatatgatcctccaggtggatgaccgggctgtgtccctgattgacctggaatctaagaacgagctggaaaatttctag

SEQ ID NO: 222107 - DNA, 996 bp, Artificial Sequence
  Description of Artificial Sequence: Synthetic coding sequence
atgcggttcaggttcggcgtggttgtcccccctgccgtcgccggagcacgtccagagcttctggtggtcggctctcgccctgaactaggccgatgggaaccgaggggggctgtcagattgcgccctgcgggaaccgctgcaggggacggcgcactggccttgcaggagcccggattgtggctcggggaagtggagctcgctgccgaggaggccgctcaggacggggctgagatcggggctacacctaagctgccctccacaatattcccatggttcgtgcttagacaggggctgattctcgggaatggccctcatcacgacagatgttgtacctataatgagaacaacctcgtggatggggtgtactgtctgcccatagggcactggattgaagccactggtcatacgaacgaaatgaagcacactacggacttctattttaacatcgctggccatcaggcaatgcattattcccggatcctgcctaatatttggctcgggtcctgtccaaggcaggtggaacatgtaactattaaactcaagcacgaactgggaatcacagccgtgatgaacttccaaactgaatgggacattgtgcaaaacagctcaggctgcaatcgttaccctgagccaatgacccctgatacaatgatcaaactttacagagaagaaggcctcgcctatatctggatgccaacccctgacatgtcaactgagggtagagtccagatgctgccacaggctgtgtgcttactgcatgctctgcttgagaaggggcacatcgtgtacgtgcattgtaatgccggagtcggcagaagtaccgcagccgtgtgtggatggctgcagtatgtcatgggctggaacttgagaaaggtacagtattttttaatggctaaaaggcccgctgtttacatcgatgaggaggctctggcacgcgctcaggaagacttctttcagaagttcggcaaggttcgctcatccgtttgcagcctgtag

SEQ ID NO: 222108 - DNA, 996 bp, Artificial Sequence
  Description of Artificial Sequence: Synthetic coding sequence
atgcggtttaggtttggggtagtcgtgccgccagccgtagccggtgcacggccagagcttctcgtggtgggctcccgccctgagctaggaaggtgggagcctagaggagccgtgaggctgcgacctgctggcacggccgcaggcgacggtgcgctcgccctgcaggagccagggctctggctgggggaggtagaactggccgcagaggaggcagctcaggatggtgctgaacctggacgagtcgatacattctggtacaaattcctcaaaagggagcccggtggggagctcagttgggaggggaacggaccccaccacgatcgatgttgcacatacaatgaaaacaacctggtggatggagtatactgtctgcccattggccactggatagaggctactgggcataccaatgaaatgaagcacaccacagacttctacttcaacatagctggtcatcaggccatgcattactctcgcatccttcccaatatttggttagggtcatgcccgaggcaggtggagcatgtgactatcaaactcaaacacgaactgggtattactgccgtgatgaattttcagaccgagtgggacatagtacagaattcaagcggctgcaaccgctacccggaacctatgacacctgataccatgatcaaattgtatagagaggaaggtctggcatacatttggatgcccacacccgacatgtctacagaggggcgagtacagatgctgcctcaggctgtgtgtttactccacgctctcctggagaaggggcacattgtatacgttcactgcaatgcgggagtgggccgaagcacagccgcagtttgcggatggctccagtatgtcatggggtggaatctgcgcaaggttcaatattttttgatggcaaagcgtcccgcagtttacattgatgaggaggctctggccagagcccaagaagatttttttcagaaattcgggaaagtcagaagttcggtgtgtagcttgtag

SEQ ID NO: 222109 - DNA, 954 bp, Artificial Sequence
  Description of Artificial Sequence: Synthetic coding sequence
atgagatttcgcttcggagtggtggtgcctcccgcagtcgctggagccagaccagagctcctggtggtgggcagccgcccagagctcggtagatgggagccccgtggggcagtgaggctgagaccggctggcaccgccgctggcgacggcgcattagcactacaggagccaggcctgtggctgggggaagtggaattagccgctgaagaagctgctcaagacggagctgagcctggcagagtagacacattttggtataagtttcttaagcgggagccgggaggcgaattgagctgggaagggaatggtccacatcatgacagatgctgcacctataatgaaaacaatctcgtagacggcgtctattgcctgccaatcgggcactggatagaagccactggacacactaatgaaatgaagcatacaaccgatttttactttaatatcgcaggtcatcaggcaatgcattactccagaattctcccaaacatctggctcggctcttgccccaggcaagttgagcacgtgaccattaaattaaagcatgagcttgggattacggccgtcatgaatttccagaccgagtgggacatcgtgcagaattcctccgggtgcaataggtatcctgagcctatgacacccgacaccatgatcaaactctacagggaagaaggcctcgcttacatttggatgcccactccagatatgagcaccgaaggacgggtgcaaatgttgcctcaggctgtatgtctcctgcatgctctgctggagaagggacatatcgtgtacgtgcactgcaacgccggagtgggcagaagtactgcggcagtgtgcggctggctgcaatatgtgatgggctggaatctccgcaaggtgcagtattttctgatggcaaaacgacctgccgtatatatcgatgaggaagctgctagccaggacacatttccgctgtag

SEQ ID NO: 222110 - DNA, 714 bp, Artificial Sequence
  Description of Artificial Sequence: Synthetic coding sequence
taggacacattctggtataagttcctaaaaagagagcccggaggggagctcagctgggaggggaatgggcctcaccacgatagatgctgtacctacaatgaaaacaatctcgtggacggagtgtattgtctcccaattggacattggattgaggccaccggacacacaaatgagatgaaacatacaacagacttctattttaatatcgctgggcaccaggcgatgcactacagccgcattctgccaaacatttggctgggaagctgtcctcggcaggtggagcatgtgacaatcaagcttaagcacgaattggggataacggcagtcatgaattttcagaccgagtgggatatcgttcaaaatagctccggatgtaataggtatccagagcccatgactcccgataccatgattaaactctacagagaggaggggctagcatatatatggatgcctacccctgatatgtccacagaaggcagggttcagatgctcccacaggcagtgtgtctattgcatgccctacttgagaaaggacatatcgtgtacgtccattgcaatgctggcgtgggacggtcgaccgcagcagtatgcggctggctgcagtacgtcatggggtggaacctacggaaggttcagtacttccttatggcaaagaggcccgctgtttatatcgacgaggaggccgcatcgcaggatacttttcccctttag

SEQ ID NO: 222111 - DNA, 513 bp, Artificial Sequence
  Description of Artificial Sequence: Synthetic coding sequence
tgaaacggaccccaccatgaccgatgctgcacgtataacgagaataacctagtggacggggtctattgcttgcctattggtcattggatcgaggcaaccgggcacaccaacgagatgaaacacacaactgatttttactttaacattgctggccaccaggctatgcactattcccgtattcttcccaacatctggctgggaagctgcccgaggcaagtagagcatgttacaatcaagctcaagcacgaacttggcattaccgctgttatgaattttcagaccgagtgggacattgtacagaactcttcaggatgcaacagataccccgagcccatgacaccagacactatgatcaagttatatcgcgaagaaggtctggcatacatttggatgcctaccccagacatgtctacagaggatgagaaacgcactgctgatatgtgttgctcaggcatgtgggaagaaacagcagatttcggcctgggcattctggattacttgaaacaaaagtag

SEQ ID NO: 222112 - DNA, 813 bp, Artificial Sequence
  Description of Artificial Sequence: Synthetic coding sequence
atgcgatttaggttcggggtggtggtgccgccagccgtggccggtgctcgacccgagctcctggtggtgggtagccgcccagaactagggagatgggaaccccgtggcgcagtccgactgagacccgctggaacggccgctggggatggagcactggctctacaagagcccggtctgtggctgggggaggttgaactggccgctgaggaagccgcacaagacggcgcagagcctgggcgagtagacaccttttggtataaatttttaaaacgggaacctggaggtgagctgtcatgggagggcaatggccctcatcatgatcggtgttgtacatacaacgaaaacaacttagtggatggggtctactgtctcccgattggccattggatagaggcgactggccacactaatgagatgaagcatactaccgacttctattttaacatcgcgggtcatcaggccatgcactatagtaggatcctgcccaatatctggctgggatcctgcccaagacaggttgagcatgttacaatcaaactgaagcatgaacttggcatcaccgccgtgatgaattttcagaccgaatgggatattgtgcaaaactcaagtggctgtaaccgatatccagagcccatgacccctgatactatgataaaattgtaccgagaggaagggctggcctacatatggatgcccactccggatatgtcaacagaggacgagaaacggacagctgacatgtgttgcagtggtatgtgggaggaaacagcggactttggactgggcatcttggattacctgaaacagaagtag

SEQ ID NO: 222113 - DNA, 945 bp, Artificial Sequence
  Description of Artificial Sequence: Synthetic coding sequence
atggcccctccccaggttttggcttttgggctactgttagccgctgccactgccacattcgccgcagcacaggaagagtgcgtttgcgaaaactataaactggccgtcaattgctttgtgaataataatcgccagtgccaatgcaccagtgtgggggctcagaacacagtgatatgcagtaagcttgccgcaaaatgcttggttatgaaggctgagatgaatggctcaaaactgggcaggcgagccaaacctgaaggagcccttcagaataacgatggcctttatgaccccgactgtgacgagtctgggcttttcaaagctaagcaatgcaacggaactagtatgtgttggtgtgtcaatacagccggagtgcgcagaacagataaggatacagagataacttgctcagagcgggtccggacctattggatcattattgagctgaagcacaaggcccgtgaaaagccatatgactctaagtcactgcggacggcactgcagaaggaaatcacgaccaggtaccagctggaccccaaattcatcacctcgatactgtacgagaacaacgtcatcaccattgatcttgtgcagaactcctcccagaaaacacagaatgatgtcgatatcgccgatgtggcgtactattttgagaaagatgtgaagggcgaaagcctgtttcactccaaaaagatggatctcaccgtgaacggggagcagctcgatcttgatccaggacagacccttatttactacgttgacgaaaaggcaccagaattcagtatgcagggactgaaagccggagtgattgccgttatagttgtcgttgtgatcgctgttgtcgcgggaatcgtagtgctcgtgattagtaggaagaagcgcatggccaagtacgagaaagccgaaattaaggagatgggagagatgcaccgggaactgaacgcctag

SEQ ID NO: 222114 - DNA, 474 bp, Artificial Sequence
  Description of Artificial Sequence: Synthetic coding sequence
atgcttgtgctgcttgccggtatctttgtcgttcacatcgccaccgtgattatgttattcgtcagcaccatcgcgaatgtgtggctcgtttcgaacactgtggacgcgtcagtgggactatggaagaactgtacgaatatcagttgttccgattcattgagttacgcaagtgaggacgccctcaaaacagtgcaggccttcatgattttatctattatattttgtgtgatagccttgctggtgttcgtgttccagttgtttactatggagaagggcaataggtttttcctttctggcgctacgaccctggtgtgctggctttgtatccttgtcggagtgagtatttataccagccattatgctaaccgagatggcacacaataccaccacggttacagttacatactggggtggatctgcttttgtttcagtttcatcattggcgtgttgtacctcgtactgaggaagaaatag

SEQ ID NO: 222115 - DNA, 426 bp, Artificial Sequence
  Description of Artificial Sequence: Synthetic coding sequence
atgctcgtcctattagcgggtattttcgtagtccatattgctacagtcattatgctgttcgtgtctacgattgccaatgtctggctcgtatctaataccgtggacgccagcgtgggcctgtggaaaaactgcacaaacataagctgctctgacagcctgagttacgcttccgaggatgcattgaagactgtgcaagcattcatgatcctgtccattatcttttgtgtaattgccttactcgtgtttgtcttccaactctttactatggaaaaggggaaccgcttttttctctcgggggctaccacgctggtgtgctttattatgagaattgtgatggaacggagcatcacgaccgctataccgacctcttgggctggctccgctagcgctagcgccagttctagcgccttctcgatctggagctag

SEQ ID NO: 222116 - DNA, 12 bp, Artificial Sequence
  Description of Artificial Sequence: Synthetic coding sequence
atgctggtgtag

SEQ ID NO: 222117 - DNA, 504 bp, Artificial Sequence
  Description of Artificial Sequence: Synthetic coding sequence
atgctggtcctcctggccttcattatcgcgttccacattactagcgccgctcttctgttcattgcgacagttgacaacgcctggtgggtgggagacgaatttttcgcggacgtctggcggatttgtacaaataatactaactgcacggtgatcaacgactctttccaggaatattctactctgcaagccgtccaggctaccatgattctctctaccatcctatgttgtatagctttcttcatttttgtgctgcagctttttagacttaaacaaggagaaaggttcgttctgacttcgatcattcagctcatgagctgcctgtgtgttatgattgctgctagcatttatactgaccggagggaagacattcatgacaagaatgccaaattctatcccgtgaccagggaggggtcctacggttactcatatattctagcctgggtcgcttttgcgtgtaccttcatcagcggaatgatgtacttgatactaagaaagcggaaatag

SEQ ID NO: 222118 - DNA, 504 bp, Artificial Sequence
  Description of Artificial Sequence: Synthetic coding sequence
atgctcgtgcttttagccttcattatcgcgttccacatcacttctgctgccctgctctttattgccactgttgacaacgcctggtgggtcggcgatgaattttttgccgatgtctggcggatctgcacgaataatacgaattgtacagtgatcaatgattcctttcaggagtactctacactccaagcggttcaggccactatgatcttgagcacaattctctgttgcattgcctttttcattttcgtgctgcagctttttcgactgaaacagggagagcgctttgtgctgacttccattatccagctcatgagctgtctgtgcgttatgatcgccgcttccatatatactgacagacgcgaggacatccatgataaaaatgcaaagttttaccctgtaaccagggagggctcctatggatacagctatattctcgcctgggtcgcttttgcgtgtacctttatttcagggatgatgtacctcattctgaggaaaaggaagtag

SEQ ID NO: 222119 - DNA, 492 bp, Artificial Sequence
  Description of Artificial Sequence: Synthetic coding sequence
atgtcactgctgctgctcgtagtgtccgctctgcatattctgatactgatccttcttttcgttgccacactggataagtcttggtggaccctgccaggaaaagagtccctgaacttgtggtacgactgcacatggaacaacgacactaaaacttgggcctgtagcaacgtgtcagagaacgggtggctgaaagcagttcaggtgctcatggtgctgagcctcatcctctgttgcctatcgtttatcctgttcatgtttcagctgtacacgatgcgccgagggggacttttttatgcaactgggctgtgccagttgtgcacgagcgtagctgtcttcacaggagccttgatctatgcaattcatgccgaggagatcctcgagaaacatcccagaggcggaagtttcggatattgcttcgctcttgcctgggtggcattccctctggctctggtctctggtatcatctacattcatttacgcaagagagagtag

SEQ ID NO: 222120 - DNA, 2034 bp, Artificial Sequence
  Description of Artificial Sequence: Synthetic coding sequence
atgaccgcctcaccggactacttggtcgtgctgttcggtatcacagcaggcgctacaggggcaaagctcggctccgacgaaaaagagctgatattgttattctggaaggtcgtcgatctcgccaacaagaaagttgggcagctgcacgaggtcctcgtcaggccagatcagcttgaactaacggaagattgtaaagaagaaacaaagattgacgtagagtcccttagtagcgctagtcagctggatcaggcactccgtcagttcaaccagagtgtcagcaacgagctgaacattggtgtcgggacctccttttgcctttgcactgatggccagctgcatgtccggcaaatcctgcacccagaggcctcaaagaaaaacgttctgctcccagaatgcttctactctttttttgacctaaggaaggagttcaaaaagtgttgccccggatcccccgatatcgataagctggatgtagccactatgacggaatacctgaattttgagaaatcaagctcagtctcgaggtacggcgcaagccaggtggaggacatggggaatataatcctggcaatgatttctgagccctacaatcataggttctcagaccccgagcgagtgaactacaagtttgaatcagggacctgctcgaagatggagctaatcgacgacaataccgtggtgcgagccagaggactgccctggcagagctcagaccaggacattgccaggttttttaagggactgaatatcgcaaagggcggtgcagctctgtgtctgaacgctcaggggagacgcaatggcgaagcccttgtcaggttcgtgtctgaggagcacagagacttagctctgcaacgccacaagcaccacatgggcactcggtacatagaggtttacaaggccacaggtgaagacttcctgaagatagcaggcggtacttccaacgaagttgcacagtttctctccaaggaaaatcaggtgatcgttaggatgagaggtctgcccttcacggcaacggcggaagaggtcgtggccttcttcgggcagcattgccccatcactgggggaaaggaagggatactcttcgtgacttatcctgatgggagacccaccggggacgcattcgttctgtttgcttgcgaggaatatgcacagaacgcacttagaaagcataaggacttactgggaaaacggtacatagaactgttccgctctacggcggctgaagtgcagcaggtcttaaaccgtttttccagcgctccccttatcccactcccgacaccccctattatcccagtgcttcctcagcagtttgtgccacccacaaacgtaagggactgtattcggctgcgcggtcttccgtacgccgctacaattgaagacatattggacttccttggagaattcgctactgatatccggacacacggtgtgcacatggtgctgaaccatcaaggtagaccaagcggcgacgctttcatccagatgaaatctgcagacagagcctttatggcggcacagaaatgccacaaaaagaacatgaaggaccggtatgttgaagtcttccagtgttctgccgaggagatgaatttcgttttgatggggggaactttaaacagaaacggtttgtccccccctccatgtttatcccccccatcatacacgttccccgctcctgcagctgtaatcccaacagaagctgccatctaccaaccatcagtcatcttgaaccctagagccctgcagccttcgacagcctactatccagctgggacccagcttttcatgaattataccgcctattacccttcacccccaggttctccaaactctttggggtacttcccaaccgcagcgaacttatcaggcgtccctcctcagccaggcactgtagtcaggatgcagggcctagcctataacacaggcgtgaaggagattctgaacttcttccagggctaccagtacgccacggaagatggactgatccacacaaatgaccaggctaggacacttccgaaggagtgggtttgcatctag

SEQ ID NO: 222121 - DNA, 1980 bp, Artificial Sequence
  Description of Artificial Sequence: Synthetic coding sequence
atgactgctagtccagactatcttgtagttctgttcggcattacagcaggcgcaactggcgctaagttggggtcggacgaaaaggaactcatccttttattctggaaggtggtggacctcgccaacaaaaaagttggccagctgcacgaagtcctggtccggccagatcaactggagctgactgaagactgcaaggaagagactaagatcgatgtggaatctctttcctccgctagtcagctggatcaggcccttaggcagttcaaccagtcagtgtccaacgagctgaacatcggggttggtacctccttctgcctatgcactgatggacaactgcatgtgcgtcaaatcctgcatcccgaggcctcaaagaaaaatgtgttgctgcccgaatgtttttattccttctttgacctgcgcaaagaatttaagaaatgctgccccggtagccccgatatcgataagctggatgttgccacaatgactgaatatctgaactttgagaaatcatcttctgtttccagatacggcgctagccaagttgaagatatgggcaatatcatcctggcaatgatttccgagccttataatcatagattctccgatccggaaagagtgaactacaagtttgagagcggtacctgctcaaaaatggagcttattgacgacaacactgtagtgcgagctcgtgggttaccctggcagtcaagcgatcaggatatcgcaagatttttcaagggcctcaatatcgcgaaggggggagccgctctctgtctaaatgcacagggcaggcggaacggcgaggcactagtccgctttgttagtgaggaacatagggacctcgcactgcaacgccacaagcatcacatggggacacgctatatcgaggtctataaggcaaccggggaagactttcttaagatcgcaggaggcacctccaacgaagtagcacagtttcttagcaaagagaaccaggtgattgttcgaatgagaggacttccttttactgccactgcagaagaagtggtcgccttcttcggacagcattgcccaattacggggggaaaagaaggcatcctcttcgttacatatcccgatggcagacccaccggagatgcctttgttctgttcgcctgcgaagagtacgcccagaatgccctgcgcaagcacaaggacctcctcgggaagagatacatcgaactgttccgaagtaccgcagccgaagtgcagcaggtattgaatcgattctctagcgccccacttatccccctgccgactccacccatcatccccgtcctgccccaacagtttgttcccccaacaaacgtccgtgattgcattcgcttacggggtctcccatatgctgccacaatcgaggacatcttagatttcctgggcgagttcgcaaccgacatcagaactcatggtgtgcacatggtgctgaatcatcaagggagacctagtggtgacgcattcatccagatgaaatcagctgaccgagcattcatggcagctcaaaaatgtcataaaaagaacatgaaggaccgttacgtggaggtgtttcagtgttctgctgaggagatgaactttgtgctgatgggtgggactctgaaccgtaatggcttatctcctcctccttgtctctcgcccccttcctacacttttcccgcacctgccgctgtgatccctaccgaagctgccatttaccagccatctgtaattcttaatccccgagctctgcagccgtctaccgcgtattaccccgctggcactcagctatttatgaattacacagcgtactatccatcacctccaggctctcctaatagcctgggctacttccccacggccgcaaacctctcaggcgtgccacctcaaccaggaacagtcgtgcgcatgcaaggtctcgcatataacaccggagtgaaagagatcctgaactttttccagggctaccaatgtctgaaggatgtctggtag

SEQ ID NO: 222122 - DNA, 2046 bp, Artificial Sequence
  Description of Artificial Sequence: Synthetic coding sequence
atgacggcttcccccgactacctcgtcgtactctttggcataactgcaggagctacaggggctaaactggggagcgacgaaaaggaattgattctcctgttttggaaagtggtcgatctggccaacaaaaaagtggggcagcttcacgaagtgctcgtgcgcccagaccagttggagttaactgaagactgcaaagaggagactaagatagatgtggagtccttaagctctgcttcacaattagaccaggctctgcgccagttcaatcagtctgtgagtaacgagctaaatataggcgtcgggacaagtttttgtctgtgtaccgacgggcagctccatgtacgacagatcctgcatccagaggccagcaagaagaatgtgttgctacccgaatgtttttattcttttttcgacttacgcaaggagtttaagaagtgctgccccggatctccagacatcgacaaactggacgtggccactatgactgagtatctcaacttcgaaaaaagctctagcgtgtctcggtacggagcaagccaggtggaagacatgggtaacataatcttggccatgatttccgagccctataaccatcgcttttccgaccccgagcgggttaactacaaatttgagagtgggacctgttccaaaatggagctgatcgacgacaatacggtagtgcgcgcaaggggtttgccctggcagtcaagtgaccaggacatagccagatttttcaagggcttgaacattgccaagggcggagccgctctctgcctgaatgcacaggggagaagaaatggtgaggccctggttcggtttgtgagtgaggagcacagggaccttgcattgcagcggcacaaacaccacatgggaacacgctatatagaggtctacaaagcaaccggagaggatttcctcaagattgcaggaggcacctctaacgaggtagcacagtttctcagtaaagagaatcaggtcattgtccgaatgcgaggcttgcccttcacagccaccgcagaagaagttgtggccttctttgggcagcactgtcccattacaggtggaaaagaaggcatccttttcgtaacatatccagacgggcgacctaccggagatgcatttgtgctgtttgcttgcgaagaatacgcccagaatgcacttagaaagcacaaggacctgttgggcaaacgctacatagaacttttcaggtcaacggctgccgaagtgcagcaggtgttgaacagattctccagcgccccactgatacccctgcctactccaccaattattcccgtgctgcctcagcagttcgtcccaccaaccaacgtgcgcgattgcatccgcctccgcggactcccatacgccgctactatcgaagacatcttagatttcttgggagaatttgctactgatattcgtactcatggcgtccatatggtcctgaatcaccagggtcgcccttcaggagatgctttcatccagatgaaaagcgccgacagggcttttatggcagcacaaaagtgccataagaagaacatgaaagatcgttatgttgaagtctttcaatgctctgccgaagagatgaacttcgtcctcatgggcggtacactgaacaggaatggtctttccccacctccttgcaagctgccctgtttgtccccaccctcctatacattccctgctccggcagcagtgattcctaccgaggccgctatctatcagcctagcgttatcctcaacccacgagccttgcaaccctcgaccgcctactatcctgctggcactcagctgttcatgaactatacagcgtattaccccagccccccagggagcccaaactctctgggctactttcccaccgcggcaaacctttctggcgttcccccacagccaggcaccgttgtcagaatgcagggcctggcatataacactggggtcaaggagatccttaacttttttcaagggtaccagtatgccaccgaagatggattaattcataccaacgaccaggctaggacgctgcccaaagagtgggtctgcatctag

SEQ ID NO: 222123 - DNA, 1827 bp, Artificial Sequence
  Description of Artificial Sequence: Synthetic coding sequence
atgacggcttcacccgattatctggtcgtcctcttcggcataacagccggagcgactggagctaaactgggatcagatgaaaaagaactaatactgttattctggaaggtggtggatctggccaacaagaaggtgggtcagctacacgaggtcctcgtgcggccagaccaactggaactgacggaggactgtaaggaagaaacgaaaattgacgtcgaatcactgagcagcgctagtcagctggaccaggcactcagacagtttaaccagtcggtcagtaatgagttgaatatcggggtgggaacatctttctgcctgtgcaccgacggacagctccatgttaggcagattctgcatcctgaagcatcaaaaaaaaatgtgctgctgcccgagtgcttttattcttttttcgacctgaggaaagagtttaagaagtgctgtcccggtagcccagatatagataagcttgacgttgcaaccatgacagagtacctaaatttcgaaaagtctagtagcgtgtcgcggtacggggcatcccaagtcgaagatatgggtaacattatcctcgctatgatctctgagccatataaccatcggttcagcgaccctgagagggtgaattataagttcgagagcggtacatgctcgaaaatggagctaatcgacgataataccgttgtgcgcgctcggggattaccatggcagtcctccgatcaagacatcgcgcgattttttaaagggctcaacatcgcaaaggggggtgcagccttatgcctcaacgcacagggcagacgtaacggcgaggcactggtgagatttgtttctgaagagcatcgggacttagcgctgcaaagacataagcatcacatgggcaccagatatatagaagtgtacaaagccacaggagaggatttccttaagattgccggtgggactagcaacgaggtggcccagtttttgtccaaagagaaccaagtgatcgttagaatgcggggactgcccttcactgctaccgcggaggaagtcgttgcattcttcggccaacactgccctattacaggcggaaaggagggaatcctttttgtgacataccccgacggacggcctactggcgatgccttcgtgttatttgcctgcgaagagtacgctcaaaatgcgttgcggaaacacaaggacctgcttggaaagcggtatattgaactcttccgtagtaccgccgcagaggttcagcaggtgctaaatcggtttagctcggcgccactgatcccgctccccaccccacccataattccagtgctgccgcagcagtttgtgccccctaccaatgtgagggactgcatccggctccggggactgccttacgccgctaccattgaggatatcctggacttcctcggggagttcgccacggacatcaggacccacggtgtacatatggtgctgaatcaccaggggcgtccgagcggcgacgccttcatccagatgaaaagcgctgaccgggctttcatggccgcacagaagtgtcacaagaagaacatgaaagaccgctatgttgaagtcttccagtgcagtgccgaggagatgaacttcgtgctgatgggcggtaccttaaacagaaatggcctgtctcctcctccatgcaaactcccttgcctgtccccgccatcatatacatttcccgctccggcagcagtgattcccactgaggccgctatctaccagccatccgtgatcttgaaccccagagcactccagccatctaccgcctactaccccgcaggcacgcagctgtttatgaattatacggcttactatccctccgtgtag

SEQ ID NO: 222124 - DNA, 2154 bp, Artificial Sequence
  Description of Artificial Sequence: Synthetic coding sequence
atgacacccccaccgcctcccccaccacctcccggaccggatcccgctgccgacccagcggctgatccctgcccatggcccggatccttggtggttctgttcggcgcaactgcgggtgctctgggcagggacctcggaagcgatgagacagatctgatcctgctggtgtggcaggtggttgagcccaggtcccgccaggttggaacattacataagtcacttgtgagggctgaagccgctgctctgtctacccagtgcagggaagcctcagggctttccgctgattctctagcacgggctgagcccctggataaagttctgcagcaattttctcagttagtaaacggcgatgttgcacttctgggcggtggcccttatatgctttgtaccgatggtcaacaactgctccgacaggttttacatcccgaagcctcccgcaaaaacctcgtgctgcccgacatgttcttctctttctatgatttgagaagagagttccacatgcagcacccatctacatgtccggctcgcgacctaacagtagcaacaatggcccagggcctgggcctggagactgatgcaactgaagatgacttcggtgtttgggaagtcaagaccatggtggcagtgattctgcacctattgaaagaaccttccagtcagctcttcagtaagcccgaagttatcaagcagaaatacgagacaggcccatgcagcaaagcggacgtggtcgattcggagaccgtcgtgcgtgccagaggtttgccctggcagagcagtgaccaggatgtggccaggttttttaaaggcctgaatgtggcgagaggcggagtcgcgctgtgtctaaacgctcagggccgacgaaatggcgaggcactaattcgattcgtcgactcagagcaacgggacttggccttgcagaggcacaagcatcacatgggagtgagatatatagaagtgtataaggccaccggagaagagttcgtgaagatagccggaggaacttcgcttgaagtggctaggtttctttctcgcgaagaccaagtcattttgcgattgcggggtctccccttttcggccggacccacggatgtgctagggttcctgggtccagaatgccctgtcaccgggggaacagagggactcctgttcgtgagacatcctgacggacggccaaccggtgatgctttcgccctgttcgcctgcgaagagctggctcaggccgcactgaggagacacaagggtatgctggggaagagatacattgagcttttcagatcaacggccgcagaggtgcagcaggtgcttaataggtacgcctctgggccacttctgcccaccctgaccgcaccgctactgcctatccccttccccctagccccaggcacaggaagagattgcgtgcggctgcggggactgccttacacggcgaccatcgaggacattctgtctttcctgggagaggctgccgctgatattaggcctcatggtgtgcatatggttttgaaccagcaaggcaggccttccggcgatgctttcatccagatgaccagcgctgagcgcgcactggcggcagctcagaggtgccacaagaaagtgatgaaggaacgatatgtcgaggtggtgccttgttctacagaggaaatgagtcgagtgcttatggggggtaccctgggcagatcagggatgtctccccctccttgcaaattgccttgcctgtctccaccaacctatactacatttcaggccacaccaactcttatcccaacagaaacagctgccctctatccatctagcgctctgctgccagcagcaagggtgccagctgcaccgacgccggtagcgtactatccgggtcctgcaacccagctctatctcaactatactgcctattatccttctcccccagtctcacctaccacagtcgggtatctaaccactcccacagctgcgttggccagtgcccctacctctgtgctgtcacaaagcggagccttggttcgtatgcaaggtgttccttatacggccggaatgaaggaccttctctcagtgttccaagcatatcagctgcccgcagacgactacacctccctcatgccagtcggagatccgccaaggaccgttctgcaggcacccaaagaatgggtatgcctgtag

SEQ ID NO: 222125 - DNA, 924 bp, Artificial Sequence
  Description of Artificial Sequence: Synthetic coding sequence
atgaataccaggaatagggtggtcaatagtgggctaggcgcttcacctgctagcagacccaccagggatcctcaggaccccagcgggaggcagggcgaactctcgccagtcgaggatcaacgggaaggcttagaagccgctccgaagggcccatcaagggaatctgttgttcacgccggacagaggcggacgtctgcctacactcttatagcccctaatatcaaccgtcgtaatgaaatccagcggattgcagagcaagagctggctaatctggagaaatggaaggaacagaaccgagctaagcccgtgcatttagtgcccagacgtttgggtggctcacagtctgagaccgaggtgcgccaaaagcagcagctacagctgatgcagtcaaagtacaagcaaaagcttaagagggaagagtccgtcagaattaaaaaggaggctgaagaggctgagctgcaaaaaatgaaagctattcaacgtgagaaatcgaacaaactggaagagaagaagaggctgcaagaaaatttacgacgcgaagcctttagggagcatcaacagtacaagactgccgagtttctgagcaaactcaacacagagtctcccgacaggtctgcctgccaaagcgcagtctgtggcccacaaagttcaacctgggccagatcatgggcatatcgcgatagcctaaaggccgaggagaatagaaagcttcaaaagatgaaggatgagcagcaccagaaatcagagttgctggagttgaaaagacagcagcaggaacaggaacgcgctaagatccaccagacagagcacagacgagtaaacaatgcttttcttgatcgtttacagggtaagagtcagcccggtggcctggagcagtcaggcggatgttggaatatgaacagcggaaactcctggggtatctag

SEQ ID NO: 222126 - DNA, 1233 bp, Artificial Sequence
  Description of Artificial Sequence: Synthetic coding sequence
atgaatacccgtaaccgagtggtcaacagtggtctgggggcatccccggcatctcgccctacccgcgatccacaggacccctcgggtcgccagggtgagcttagcccagtggaggatcaaagggaagggctcgaagcagcccctaagggcccaagccgagagtccgtcgtgcacgctgggcagcggagaacctctgcttatacccttatcgcacccaacattaacagacgcaatgagatacagagaatcgctgagcaggagctggccaatctagagaagtggaaagaacagaatcgagcaaagccagtgcacctggtgccgagacgcctgggaggcagccagagcgagactgaagttagacagaagcaacagctccagctaatgcagtctaagtacaaacagaagctgaagagggaggagtctgtcagaattaagaaggaagccgaagaggccgagctgcaaaagatgaaggccatccagagagagaaaagtaataagttggaggaaaaaaaacggttgcaggaaaaccttaggcgggaagcctttagagaacaccagcaatataagaccgccgagttcctcagcaaactcaataccgaaagtcccgatagatctgcctgccagagcgccgtgtgcggcccacagtcttctacatggaagcttccaatactgcctcgggatcatagctgggctagatcttgggcctatcgtgactctcttaaagccgaagagaacaggaagctgcagaaaatgaaggacgaacagcaccagaaaagcgaattgctggagctcaagcgccagcagcaggaacaagagcgcgctaagattcaccaaactgagcacagacgcgtgaataatgcatttttagaccgcctgcagggtaagagccagcctgggggtttggaacagtctggagggtgttggaacatgaacagtggcaattcgtggggatcgctcctggtgttctccagacacctgcgggtgtatgagaagatactgacccccatatggcctagctcgaccgacctagaaaaaccacacgagatgctctttctgaatgtcattctgttttctctgactgttttcacgctcatcagcacagcccatactcttgatagagccgttcgctcagactggttgctgttagtgctaatatacgcatgcttagaggagctaattcctgaacttatttttaatctgtactgccaaggtaacgccacgttattcttctag

SEQ ID NO: 222127 - DNA, 1368 bp, Artificial Sequence
  Description of Artificial Sequence: Synthetic coding sequence
atgtggctggagattctcctcacttcagtgctaggtttcgccatctattggtttatctctcgtgataaggaggagacactgcctctagaggacggctggtggggcccaggcacacgctccgctgccagagaagacgattccatccgcccttttaaggtggagacttctgacgaagagattcacgacctccaccaaagaatcgacaaattccgtttcacacctcccctagaggacagctgtttccattatggcttcaactcaaattatctcaagaaagtcattagctactggaggaacgagttcgattggaaaaagcaagttgaaatcctgaatagatatccacactttaagacaaaaatcgaagggctggatatacacttcattcatgtcaaaccaccacagttgccggcaggacatactcccaagcccctactaatggttcatgggtggccagggagtttttatgagttctataagatcatacctctcttaaccgaccctaagaatcacggactgtccgatgagcatgtgttcgaggttatatgcccctccattcccggatacggtttttcagaggcttctagcaagaaaggattcaactccgttgccaccgcaaggattttctacaagctcatgctgaggctaggattccaagagttttacattcagggaggagactgggggtcactgatctgcaccaacatggcccagctggtcccaagccatgtgaaagggctccacttaaacatggccctggtgctgtccaacttcagcaccttaactttgctcttggggcagcggtttgggcgattcctgggcctcaccgagcgagatgtggagctgctgtatcctgtcaaagagaaagttttctacagcctcatgcgcgagtctggctacatgcacatccagtgtaccaagccagatactgtgggatctgctttaaatgactcacccgtgggcctggctgcctatattttggagaaattctccacatggactaatactgagttccgctacttggaggacggaggattggagaggaaatttagcctagatgacctgctgacaaatgtgatgctctactggaccacaggaactatcatctcttcccagaggttttataaagagaacctcggtcagggatggatgacccagaagcacgagagaatgaaagtgtacgtgccaactggcttctccgccttcccctttgagctactgcacaccccagagaagtgggttcgattcaaatatccaaagcttatttcctactcctacatggtaagaggcggacattttgctgcatttgaggagccagagttgcttgcccaggacatccgtaagtttttaagcgttctggaaaggcagtag

SEQ ID NO: 222128 - DNA, 1368 bp, Artificial Sequence
  Description of Artificial Sequence: Synthetic coding sequence
atgtggctcgaaattttacttacctcggtcctgggctttgccatttattggtttatcagtcgtgacaaggaggaaacactgcccttagaggatgggtggtgggggcctggcacacgaagtgctgcccgagaagatgacagcattcgccctttcaaagtcgaaacttccgatgaagagatccatgaccttcatcagcgaattgacaagttccggttcacacctcctctggaggatagctgcttccattacggctttaacagtaattatttgaagaaggttataagctactggcgcaacgaattcgattggaaaaaacaggtcgaaatcctcaacaggtatccccatttcaagaccaaaatagaaggattagatatccactttattcatgtgaagccccctcaactacccgcagggcatacgcctaagccattgctgatggtccacggctggccagggagcttctacgagttctacaaaattataccactgcttacggacccaaaaaatcacggcctttcagacgaacacgtcttcgaagtgatttgcccgtcaatacccggatacggctttagcgaggcctcatccaagaagggctttaacagcgtcgccaccgcaagaattttttataaattaatgctgcgcctggggtttcaggagttttatatccagggcggtgattggggttccctgatctgcaccaacatggcacagctcgtcccctcacacgttaaaggcctgcatctcaacatggcactggtgctctcaaactttagcacactgactctcttgctcggtcagcggtttggacgattcctagggctgactgagagggacgttgagctgttgtatcctgtgaaggagaaggttttctattctctcatgagggaatccgggtatatgcacatccagtgcactaagcccgataccgtggggtctgctctgaatgactccccggtggggctagcagcgtacattctcgaaaaattttctacttggaccaacacagaatttaggtatttggaggacgggggacttgagcggaagttcagcttggacgaccttctaaccaatgtgatgctttactggacaacaggtactatcatatcctctcaacggttctacaaggagaatttaggccaggggtggatgacccagaaacatgagcgcatgaaagtgtacgtgccaacgggtttcagcgcattcccctttgagctgctgcacacccccgagaaatgggtcagatttaagtacccaaagttaatctcatacagttacatggtgagaggtggccactttgcggcatttgaagagcctgagctactcgctcaggacatcaggaagttcttgtccgtactggaacgacagtag

SEQ ID NO: 222129 - DNA, 486 bp, Artificial Sequence
  Description of Artificial Sequence: Synthetic coding sequence
atgtggctggagatcctgttgacctccgtcttaggcttcgctatttattggttcatctcacgggacaaggaagaaacacttcccctggaagatggttggtggggcccagggacccgctctgcagcgcgagaagacgactcaatcagaccttttaaggtggaaacatccgatgaagagatccatgatctgcatcagagaattgacaagttcagatttacacctcctcttgaggactcatgcttccactacggctttaatagtaattatcttaagaaggtgatcagctactggaggaacgaattcgattggaagaagcaggtcgagattctgaaccgttacccacatttcaaaacgaagatcgaggggctggacatacattttatccacgtaaagcctccccagctgcctgctggtcatacccccaaacccttactgatggtgcacggatggccaggaagcttttacgaattctataaaattatctag

SEQ ID NO: 222130 - DNA, 411 bp, Artificial Sequence
  Description of Artificial Sequence: Synthetic coding sequence
atgtggctcgagatcttactgacgagtgtgctcggcttcgctatctattggttcatttcccgggacaaggaggagacgctgccactcgaggatgggtggtggggtccagggaccagatccgcagctagggaggacgacagcattagaccttttaaggtcgagacaagcgacgaggagatccacgacctccatcagcggatagacaaatttagatttactccacccctggaggattcttgcttccattatgggtttaatagcaattatttgaagaaggtgatatcctattggagaaatgaattcgactggaaaaagcaggtcgagatcctcaataggtacccacactttaaaaccaagatagaagggctggacatccacttcattcacgtaaaacctccacagctgccgtag

SEQ ID NO: 222131 - DNA, 1509 bp, Artificial Sequence
  Description of Artificial Sequence: Synthetic coding sequence
atgaagggcgagataacgctgtcccaatggatccctctgatggaagagaattgccggaagtgcagtgagactgccaaagtgtgcctcccgaagaatttctcaatcaaggagatatttgacaaggcaattagcgcgaggaaaatcaaccggccaatgctgcaggctgccctaatgcttcgaaagaagggctttaccacagccattttgaccaacacatggttggatgacagggctgagcgtgacgggttagcccagcttatgtgcgagctcaaaatgcactttgattttctgattgagagctgccaggtgggaatggtgaagcctgagccacaaatctacaaattcctgttggacacccttaaggcttcaccctcagaagttgtttttctcgacgacattggcgctaatctcaaacctgcaagggacctcggaatggtgactattctcgtgcaggacaccgacacagcactcaaggagttggaaaaggtcacaggaatccagctcctgaatactcccgcaccactccccacatcgtgtaacccgtcagacatgtcccatggctacgtcacagttaagccaagagttagattgcacttcgtcgagctgggctctggcccagccgtgtgcttatgtcacggctttccagagtcatggtactcctggcggtatcagattccagccttagctcaagctggttacagagtgctcgctatggatatgaaagggtatggagagtcatcagctccacccgagattgaagagtattgtatggaagtgctatgtaaagagatggtgacattccttgacaagttgggattgtctcaggcagtgttcatcgggcatgattggggaggcatgttggtatggtatatggctcttttttacccagaaagggtgcgtgcagtggcttctttgaatacccctttcatcccagcgaaccccaatatgagtccgctggagtcaattaaggctaaccctgtgttcgattatcagctgtacttccaggaaccaggagtggccgaggccgagctagaacagaatctgtcgcgtacatttaagagcctttttcgggctagcgacgagtccgtactgagtatgcacaaggtgtgtgaggcgggaggtttattcgtcaactcaccggaggaaccgtctctgtcccgcatggtaaccgaggaagagattcaattttatgtccaacagtttaaaaagtcaggcttcagaggaccattgaactggtacagaaacatggagaggaattggaagtgggcctgtaaaagcctagggcgtaaaatcctgataccagctctgatggtcacagccgagaaagactttgtgctggtgcctcagatgagccaacatatggaagactggattccccacctgaagagaggccatatcgaagattgtggccattggacccagatggataaaccgacagaagtgaatcagattctcataaaatggctggacagcgacgccaggaacccccctgtggtgagcaaaatgtag

SEQ ID NO: 222132 - DNA, 1470 bp, Artificial Sequence
  Description of Artificial Sequence: Synthetic coding sequence
atggaagaaaattgccggaaatgcagtgaaaccgccaaggtgtgcctccctaaaaatttctccatcaaagagatctttgataaggcgatttctgcaagaaaaattaaccggcctatgctgcaggcggcactcatgctcaggaagaagggcttcactacggcaattctaacgaacacctggctggacgacagagctgagagggatggtctggcccagttgatgtgtgagctaaagatgcatttcgatttcctaatcgaaagctgccaagtgggcatggtgaaaccagaacctcagatctacaagttcctgctggatacgttaaaagcctcacccagcgaagtggtgttcctagatgacatcggggctaacctgaaaccagcccgagacctgggcatggtcaccatcctggtccaagacaccgataccgcattaaaggagctcgaaaaggtgaccggcatccagctactcaacacccccgctccactgccaacaagctgcaacccaagcgacatgtcccatggctatgtgacggtcaagccgagagttaggctgcacttcgtcgagctaggctccgggccagccgtttgcctgtgccacggatttccggagagctggtattcctggcgttaccagattcctgccctggctcaggctggctatcgcgtgctggcgatggatatgaagggatacggcgaatctagcgcacccccagaaatcgaggaatattgtatggaagtgctctgtaaagagatggtgactttcctcgataagctaggcctctctcaagccgtgtttattggacatgactggggaggaatgttggtgtggtacatggccctgttttatccagaaagggttcgagccgttgcatcattgaatacacccttcatccctgccaacccaaacatgagcccattggagtcaatcaaagccaacccagtgtttgattatcagttgtacttccaagagccaggtgtagcagaggctgagctagaacagaacttgagtagaaccttcaagtctcttttcagagccagcgatgaaagtgttctcagtatgcacaaagtctgcgaagccggtggtcttttcgtcaactcaccggaggagccctcactgtcccggatggtgacagaagaagagattcagttctatgttcaacagttcaaaaaatccggcttccgtggacccctcaattggtaccggaatatggaaagaaactggaagtgggcatgcaagtcattaggacgcaaaatcctcattcccgctctgatggtgacagctgaaaaagacttcgtcctggtgccacagatgtctcagcatatggaggattggatcccacacttgaagcgtggccatatcgaggactgcggacattggacacagatggataaacctactgaagtcaatcagattctgattaagtggctggattcagatgctcgaaatccccctgtggtttcgaagatgtag

SEQ ID NO: 222133 - DNA, 1509 bp, Artificial Sequence
  Description of Artificial Sequence: Synthetic coding sequence
atgacactaagagcagcagtattcgacctggatggagttctcgctttacctgccgtgttcggcgtcctggggcgaacagaagaagccctggccctgccaagaggattgcttaacgacgcctttcagaaaggaggacccgaaggtgctactactcgcctgatgaaaggggaaatcaccctgagccaatggattcctctgatggaagagaactgtaggaagtgctctgaaaccgccaaggtttgcctgccgaagaacttctctattaaggaaatctttgataaggccatatccgcaaggaaaattaataggccgatgctgcaggctgccctgatgctgagaaagaaagcgttttgttccgggttcaccaccgctatactgacgaacacctggcttgacgatagagctgaaagggacggtcttgcccagttaatgtgcgagctgaagatgcacttcgatttcctcatcgagtcctgccaggtgggtatggttaagcctgaacctcagatctataagtttctcctggacaccctaaaggcctcgcccagcgaggtggtgttcttggatgatataggcgcaaatcttaaaccagccagagatctcggaatggtgaccatcttggtgcaagacaccgatacagcattaaaggaacttgagaaggtaaccggcatacagttgctcaatacgcccgcacccctgccaactagctgcaacccctcagatatgtcgcatggctacgtgactgtgaagccccgagtcagactgcactttgtcgagctgggaagcggacccgctgtatgcctgtgccatggatttcccgagtcatggtactcatggcgctatcagattccggcacttgcccaggccggttatagggtactcgccatggacatgaagggctacggtgaaagctcagcccctccagaaattgaagaatattgcatggaggttctctgtaaagagagtataaaggcgaatcctgtgttcgactatcaactgtacttccaggagcccggagtggcggaggccgaactcgaacagaatttgtcacgcacctttaagtccttgttccgggcttcagatgagtcggtgctgtcaatgcataaagtgtgtgaggcgggtggcctcttcgtcaatagcccagaagagccatccctaagtcgaatggtgacagaggaagagatccaattttatgtgcagcagtttaagaagagcgggttccggggtcccctcaattggtatcggaatatggaacggaactggaaatgggcttgcaaaagtctggggcgaaaaattctgattccagcactaatggtaacagccgagaaggactttgtgctggtgcctcaaatgagtcagcatatggaggactggataccacatttaaagagagggcatattgaggattgcggccactggacccaaatggataagccgacagaggtgaaccaaatcctgatcaagtggttggacagtgacgcaagaaaccccccagtggtcagtaaaatgtag

SEQ ID NO: 222134 - DNA, 1668 bp, Artificial Sequence
  Description of Artificial Sequence: Synthetic coding sequence
atgaccctgcgcgcagccgtgttcgatttggacggggtgctggcgctccccgctgtgtttggtgtgttaggtcgcacagaggaagctttagcgctgcctcggggtcttctcaacgatgcctttcagaagggcggtcctgagggtgcaactactaggttaatgaagggggaaattacattaagtcaatggattccactcatggaggaaaattgtcgaaagtgcagtgagaccgctaaggtgtgtcttccaaaaaacttttctatcaaggagatcttcgacaaagccatttcagcacggaaaattaacaggccaatgttgcaggccgctctgatgctgcgaaagaagggatttacgacagctatccttactaacacatggctggacgacagagccgagagggacgggttggcgcaattgatgtgcgaactgaaaatgcactttgactttttgatcgagtcttgccaggtgggaatggtaaagccggaacctcagatatataaatttttactggatactctcaaggccagtcccagcgaggtggtgtttctggatgatatcggcgctaacctgaaacccgctagggacctcgggatggtgacaatactggtgcaggatacggacaccgccctgaaggagctggagaaggtcactggcatacaattattgaacacaccagcccctttaccaacatcctgtaacccttccgatatgtcccacgggtatgtgaccgtcaagccacgagtccgtctgcattttgtggagcttggatctggtcccgcagtgtgcctttgccacggattcccagaaagctggtatagttggaggtatcagattcccgcacttgcacaagctggatatagggtgcttgccatggatatgaaagggtacggggagtcctccgcaccaccggagattgaggaatattgcatggaggtactctgtaaagagatggtgacctttctggataaactcggcctgtcacaagccgtcttcattggccacgactggggtggcatgcttgtttggtatatggccctgttttaccccgaacgcgtgagggcagtggcaagtttgaatacacctttcattccggcaaatcctaacatgagccctctggagtctattaaggccaatcctgtcttcgattaccaactctactttcaggagcccggtgtcgctgaggctgagctggagcagaatttatcaagaaccttcaagtccttattccgggcttccgatgagtcagtgctgtccatgcacaaagtttgtgaagcaggaggactcttcgtcaattcgcctgaggagccgagtcttagccgcatggtgacggaagaagagattcagttctacgtgcaacagttcaagaagagtggctttcgcggtcccttaaattggtaccgcaatatggagcggaattggaagtgggcctgcaagagcctcggcaggaagatcctgatcccagctctgatggtcaccgccgaaaaggacttcgtactggtcccacagatgtcacagcacatggaagattggattcctcacctgaagaggggccacattgaggactgtgggcactggactcagatggacaaaccaacggaggtgaatcagatccttatcaagtggctagatagtgatgctcgcaatcctcccgttgtcagcaagatgtag

SEQ ID NO: 222135 - DNA, 1653 bp, Artificial Sequence
  Description of Artificial Sequence: Synthetic coding sequence
atgtcaaccagcagtttgcgtcgtcagatgaaaaacattgtgcacaactacagcgaggcagagattaaagtgcgggaggctactagcaacgacccctgggggccttctagttcgttgatgagtgagatcgccgacctgacatacaatgtagtggccttttccgagatcatgagtatgatatggaaacgcttaaatgatcatggaaagaactggcgacacgtttataaagccatgactctgatggagtatttgataaagaccgggtccgagcgcgtgtctcagcagtgcaaggaaaatatgtacgcggttcagaccctgaaagacttccagtatgtggaccgtgacgggaaagaccaaggcgtgaacgtgcgagagaaagccaaacagctggtggcactactgagggatgaggaccggctccgcgaggagagagcccacgccctcaaaacaaaagaaaagctggcacagaccgctaccgcttcctcagcagccgtggggagcggccctccccctgaagcagaacaggcttggccacagtcttccggcgaagaggaattacaactgcagttggcacttgccatgtctaaagaggaggccgatcaggaagaacgtatccggaggggtgatgacctcaggcttcagatggctatcgaggaaagcaagcgagagactggcggaaaagaggagagctcgctgatggatctggccgatgtgtttactgctcctgcaccagcgcctacaacagacccatggggcggacccgctcctatggctgctgctgtgcccacagctgctcccacttcggatccctggggagggcctcctgtccccccagcggcagatccctggggcggacctgccccaaccccagccagcggcgatccctggcgccctgcagccccagcaggtccatctgtggatccctgggggggtacacccgctcctgccgctggtgaaggccctactcccgatccatggggctctagtgacgggggtgtgcctgtcagtggacccagtgcgtcagacccctggacccccgcaccagctttctccgacccctggggaggaagccctgcaaagccatccaccaatggaacaaccgcagggggattcgacacggaaccagacgagttctcagacttcgatcgacttcggaccgcccttccgacatctggatcttcagctggggaactggaactgcttgccggagaggtcccggcacgttctccaggggcattcgacatgagtggcgtccgcggatcattggctgaggcagtagggtccccaccccctgcagctacccctaccccaacacccccaaccagaaagacacctgagtcatttctgggcccaaatgccgctcttgtcgatctggatagcctggtcagcagaccaggacctacacccccaggagccaaggcgagtaaccctttcctaccaggtggcggtccagcaaccgggccttcagtcaccaatccttttcagcctgcaccacccgctaccctgacgctgaatcaactccgtctctcccccgtccctccagttcctggcgctcctccaacttacatctcccctctcggcggaggtcccggattgcccccaatgatgccacccggtccacctgcccctaatacaaatcccttcctgctgtag

SEQ ID NO: 222136 - DNA, 1731 bp, Artificial Sequence
  Description of Artificial Sequence: Synthetic coding sequence
atgagcacctctagtcttcggaggcagatgaaaaatatcgtgcacaactacagcgaggctgagatcaaggttagagaagctacctccaacgatccatggggcccttcctcctcgttaatgagcgaaatcgcagatctgacctacaacgtagtcgccttctccgaaatcatgagcatgatctggaaacggctgaacgaccacgggaaaaactggcgacacgtgtacaaggcgatgaccttgatggagtatctgattaaaaccggaagtgagagggtctctcagcagtgcaaggagaacatgtatgcggttcaaacattaaaagactttcagtatgtggaccgggatggaaaggatcagggtgtgaacgtccgggagaaagctaaacagctggtcgccttgttacgtgatgaggacaggcttagagaggaacgcgcacacgctctgaagactaaggaaaagctcgctcagaccgccacagcatcatccgctgccgttgggagcggtccaccacctgaggcagagcaggcctggccacagagctccggtgaagaggagctgcaactgcagctggctctcgccatgtccaaagaggaggccgaccagcctccctcatgcggacctgaggacgacgcgcagctccagctggccttatccctgtcaagagaagagcacgataaggaggagcggatccgccgaggagatgatctgaggctccagatggccatcgaagagagcaagagagaaacaggcggaaaggaggaatccagtctcatggacctggctgacgtgtttaccgcccctgcccctgcgccaaccaccgatccatgggggggacccgcacccatggcagccgcagtacctaccgccgcacccacatccgacccttggggcggacccccagttccacctgctgctgacccatggggaggtcctgccccaacacccgcttcaggagacccatggcgcccagcagcgccagctggcccttctgtcgatccgtggggtggtacaccggctcccgctgccggtgaaggcccaacgccagacccatggggatctagtgacggcggtgtgccagtctctgggccttcggcctctgacccttggactcccgcaccagctttttcagatccgtggggtgggtcgccagctaaacccagcaccaacggaacaaccgccgctggaggattcgacactgagccagatgagttctctgatttcgatagattgcggactgccctgcctacatccggtagcagcgctggagagctcgagctgctggctggcgaggtaccagctaggtcgcccggagcctttgatatgtccggggtgagaggaagtctggccgaagccgtcggcagcccacctcctgccgctacacccaccccaactcctcctacgcggaagacccccgaatccttcctggggccaaatgcggcactggttgaccttgactcccttgtgtcaaggccgggacctacaccgccaggagccaaagccagcaatccgttcttgccaggcggaggccctgccaccggcccaagcgttactaaccctttccaaccagccccacctgctacactgactttgaatcagctgcgtctctctcctgtccctccggtgcccggagcaccacctacgtacatctctccactcgggggtggtcctggacttccccctatgatgcccccagggccacctgctcccaacacaaatccttttctcctttag

SEQ ID NO: 222137 - DNA, 1989 bp, Artificial Sequence
  Description of Artificial Sequence: Synthetic coding sequence
atgggtgatcaaagctggctctggaatcaggccgctcctggtgtgcggagtcctgtgtttgcctgcagcgtagaaaagggcaatgtgcctcttgtgttaagcgagcacctggcccacagtcgagacccaggatccggtgctgtgagattccttatcagcccagaaccttgggctagtgctattctaggtaccagtggactgctagcaagtccagtccttcctgcagctctggatgctgtcacgtgtcagcaccttccccaaccctcgagtggcagcagaccaatatcccctcggattggagcactctgtcctctcctgctgcagccaggcaccatgagcacctccagcctgcggcgacagatgaagaatattgtgcacaattatagtgaggcagaaataaaagtgcgagaagccacgagcaatgacccctggggaccatcctcaagtctgatgtctgagatcgctgacctgacatataacgttgtggcttttagcgagatcatgtctatgatctggaaacgcctgaatgatcatggcaaaaactggcgtcatgtgtacaaagcaatgaccctcatggagtacctgatcaaaacggggagcgagagagtgagtcagcagtgcaaagaaaacatgtatgctgtgcaaacactcaaggactttcaatacgtggatcgcgatggaaaagaccagggagttaacgtcagggagaaagctaaacagcttgtggctcttcttagggacgaagatagactgagggaggaacgggctcacgctctcaaaaccaaggaaaagcttgcccagacagccaccgctagttctgcagccgtgggcagcggtcctcctccagaggctgaacaggcctggccccaatccagtggagaggaagaattgcagctgcagctcgccctcgccatgagtaaggaggaggcggaccaggaggagcgaatccgacggggagatgacctacgactacagatggccatcgaagagtccaaaagggaaactggaggtaaagaagagagttccctcatggacctggccgacgtgttcacagctcccgcacccgctcctaccacagatccatggggcggtcccgctcccatggctgccgcagtgccaaccgcagcccctactagcgacccatggggaggaccccctgtgcctccagctgccgacccttggggcggtcctgccccaacaccggctagcggtgatccttggagacctgcagcccctgcaggcccaagcgtagatccgtggggcggaacgcccgctccggctgctggggaaggtccaactccggacccatgggggtcatctgatggaggggtaccagttagtggtcccagcgcaagtgacccctggactcccgcaccagccttctcagatccctgggggggatccccagccaaaccttcaaccaatggaactactgccgctgggggattcgatacagaacctgacgagttcagcgacttcgacagactgcggacagcccttcccacttcaggaagctccgccggagagctcgaactgctggctggcgaggttcctgccagatctcccggagcattcgacatgtcgggtgtgcgcggttcgctggcagaggcggtcggttccccaccgcctgctgctactccaactccaaccccgcctactagaaagacaccagagtcctttctgggccctaatgcagccctggtggacctggactccctggtgagtcggccaggtccgaccccaccaggtgccaaagctagtaatcctttccttccaggcggtggccctgctacagggcctagtgtgaccaacccattccaacccgcaccccctgccaccctgacactcaaccaactgcgcctttctcctgtacctcccgtgcctggagcaccgccaacttacatcagcccactgggcggaggtcccggactgcctcctatgatgccgcctggacctcccgcacccaataccaacccttttctgctgtag

SEQ ID NO: 222138 - DNA, 1611 bp, Artificial Sequence
  Description of Artificial Sequence: Synthetic coding sequence
atgagcgaaattgccgacctcacgtacaacgtggttgcgttcagcgaaataatgtcgatgatttggaagaggctgaatgatcacggtaagaactggcggcatgtctataaggccatgacacttatggagtacctaattaaaactggttctgaaagagtgtcacaacagtgtaaggaaaatatgtacgctgtccagaccctcaaagatttccaatatgttgatagagatggtaaggatcagggggttaatgtccgtgaaaaagccaaacaactggtagccttgcttagagatgaggacagattacgtgaagaacgagcccatgcgctgaaaactaaagagaaacttgcgcaaaccgccaccgcttccagcgctgctgtgggctctggacctcctcctgaagccgagcaggcatggcctcaaagttctggcgaggaggagctgcaactccaattggctctggcgatgtcaaaagaagaggctgatcaacccccatcgtgcggacctgaagacgacgcgcaattgcagttggctctgtccctctcccgcgaggagcatgataaggaggaacgtatcagacgcggtgatgatctccgccttcagatggctattgaagaaagcaaaagggaaactggtggcaaagaggaaagcagcttgatggatcttgcggacgttttcactgccccagctcccgctcccaccaccgatccttggggaggtcccgcacctatggcagctgccgtgcctactgctgctccaacaagcgatccttgggggggaccccctgtgcccccagcagctgacccctggggcggaccagcacctactcccgcttccggagacccttggcggccagcagctcctgccggaccttctgtggatccctggggcggtactccggctcccgcagcgggagagggtccgaccccggacccatggggctcgagtgatggtggcgtccccgtgtcaggcccatccgccagcgacccttggacccctgcgccagccttttctgacccatggggcggttcgccagcgaagcctagcactaacgggactacagctggcggatttgacaccgagccggacgagttttcggacttcgacagactgaggacggcactgccaacctccggtagttctgccggagagctcgagctcctggctggagaggtccccgcacgtagccctggcgcattcgacatgtcaggagtgcggggaagtctcgccgaggccgttggctcccctcctcccgctgctactccaacacccacccccccaacgcgaaagacacccgagtccttcttgggaccaaacgctgctctagttgaccttgatagcctggtgagccggccaggtccgactccccctggggctaaggcttcgaatccgttcctccccggaggagggcctgctacaggtccttcagtgaccaacccgttccagccagctcccccagctactctgacactaaatcagctgcgcctttccccagtgccacctgtccccggagcccctcctacctatatctctcctctaggaggaggaccaggactgcctcccatgatgccgccagggccaccggcacctaataccaatccctttctactctag

SEQ ID NO: 222139 - DNA, 1926 bp, Artificial Sequence
  Description of Artificial Sequence: Synthetic coding sequence
atgacaaccagttcaattaggaggcagatgaaaaatatcgtgaacaactacagcgaagccgagattaaggtgagagaggctaccagcaatgacccttggggacccagcagctccttgatgacagagatcgccgacctgacctataatgtagtagcattttccgagatcatgtctatggtttggaagcgacttaatgaccacggtaagaactggcgccatgtgtacaaagccctgacactgctcgactatttgatcaagactggctccgaaagggtggcccaacagtgccgggaaaatatctttgccattcaaactttgaaagacttccaatacattgaccgggacggcaaggaccagggaatcaacgtaagggagaagtctaagcaattggttgctttactgaaagacgaggaaagactcaaggccgagcgcgcacaggcattgaagaccaaagaacgaatggcccaagtcgctactgggatggggtctaatcaaatcacctttggcaggggaagtagccaaccgaacctgagcacgagtcactccgaacaggaatatgggaaagctggaggctctcccgcttcgtaccacgggagcccagaagctagcctgtgtccccagcatcgcaccggtgcacctctcggacagtccgaggagttgcagccactgagccagagacatcccttcttaccacatttgggtttggccagtagacctaatggggactggagtcagccatgcctaacttgcgatagggcagcgcgtgccacaagtcccagggtatctagcgaactggagcaggcccgaccccagacgtcaggggaagaagaactccaacttcagctggcccttgctatgtctcgggaagttgcagaacaagaggagcggctcaggcggggagacgaccttcgactccagatggcccttgaggagtctcggcgagacacggtgaaaatcccaaagaaaaaagagcatggatctttgcctcaacagaccactctcctcgacctgatggacgccctcccaagttccgggccagccgctcagaaggctgagccctgggggccttctgcaagcaccaatcaaacaaacccatggggtggccctgctgccccagccagcacttccgacccttggccatcattcgggacgaagccagccgcttccatagacccctggggggttcctactggggcaacagttcaatctgttccgaagaatagtgatccgtgggccgcttcacagcaacctgcttcctcagcgggaaaaagggcatctgacgcctggggcgctgtgtcgacaacgaaaccagtgagtgtcagcggatcctttgagctgttcagtaacctcaacgggacaatcaaggatgatttctccgagttcgataatctgaggacatctaagaaaactgccgagtcagtaacttctttaccgtctcagaataatgggaccacgagtcctgacccgttcgagtcacagcccttaacggtggctagtagtaagccctcctctgctcgaaaaacacccgaaagtttcctcggtcccaacgctgccctggtcaatttggattccttagtgacccggccagcacccccagcacagtcactgaatcctttcctagccccaggagcaccagccactagtgcacctgtcaacccctttcaggtgaaccagccccagcccctcacattgaaccagctaagaggttctcctgttctggggacatccacatcctttggacctggccctggcgtagaaagcatggcggttgccagcatgacaagtgccgcaccgcaaccggctcttggcgctaccggaagctcattgaccccgttgggccctgccatgatgaatatggtagggtccgtaggcattcccccttcagctgcccaggcaaccggaaccaccaaccctttcttactttag

SEQ ID NO: 222140 - DNA, 1755 bp, Artificial Sequence
  Description of Artificial Sequence: Synthetic coding sequence
atgacaacctcttctattcggagacagatgaaaaatatcgtgaacaactacagtgaggccgagatcaaggtgagagaggccacctccaacgatccatgggggccatcctcatctttgatgaccgaaattgccgatcttacatataatgtcgtcgcattttcagagataatgtccatggtgtggaagcggttaaatgatcatggcaagaactggcgccacgtctataaggccctcactctgttggattacttgatcaagacagggagcgaacgagtggcccagcagtgtagggaaaatattttcgccatacagactctgaaggacttccagtacatcgatagggatggcaaagatcaaggaatcaacgtgcgcgaaaagagcaaacagcttgttgctttgttaaaggacgaagagagactgaaggccgagagggcacaggccctgaagaccaaggagaggatggcgcaagtggcaaccggcatgggatcaaaccagattacgtttggacgaggatcaagtcaacctaatttaagcacttcacactccgagcaagaatacgggaaagccggtggcagtccagcatcgtatcacggctccacttcgcctcgggtatcgagcgagctggaacaggcaagacctcaaacaagcggagaggaggaactgcagctccaattggctttggctatgtcacgtgaggtggcagagcaggaggagaggctgagacggggagatgatttgcgccttcaaatggccctagaagagtcaaggagggataccgttaaaatcccaaaaaagaaggagcacggttccctcccccaacaaacaaccctactggacttaatggacgccctgccctccagtgggccagctgcacaaaaggccgaaccctgggggccttccgccagtacaaaccaaactaatccctggggcggaccagccgcacctgcctccacctccgacccctggccctcatttggcactaaaccagcagcatccattgacccctggggggtgcccaccggggctaccgtccaatcagtgcctaagaatagcgatccctgggccgcatcgcagcaaccagccagctcagccggaaaacgcgcaagcgatgcctggggagctgtgtctaccacaaaaccagtgtccgtcagcgggtcatttgagctattcagcaatcttaacggcaccataaaggatgattttagcgagttcgataacctgcgcacaagcaagaagactgctgagtcagttactagtctgccaagtcagaataatgggaccactagtccagatccctttgaaagccagcctctgaccgtggcgtcttctaagccgtcaagcgccagaaaaactcccgaaagtttcctaggcccaaacgccgcactcgtgaacctggacagcttggtgacaaggcctgcacctcccgcacagtcgctaaatccctttttggctcccggagcaccagccacgagtgcgccagtgaatccttttcaggtcaatcagccccagccgttaacccttaatcagctgcgcggaagcccagtcctgggcacttctaccagcttcgggccaggaccaggagtcgaaagcatggctgtcgccagcatgaccagcgctgcaccccagccagctctgggcgctaccggctcctccctgactccactgggacccgcaatgatgaacatggttggatcagtcggtataccgccttcggccgctcaggctactgggactacaaacccattccttttgtag

SEQ ID NO: 222141 - DNA, 1071 bp, Artificial Sequence
  Description of Artificial Sequence: Synthetic coding sequence
atgagccgggaagtcgctgagcaggaagagcgcctcagacgtggcgacgatctgaggttgcaaatggcactggaagaaagcaggcgagacacagtcaaaatccccaaaaagaaggagcatggctcccttccccagcaaaccacactgctcgacctgatggacgctctgcctagctctggaccggcagcacagaaagctgagccatgggggccttctgcttctacgaaccaaacaaatccctgggggggaccagccgctcctgctagcacctcagatccgtggccatcatttggaaccaagccagcagcatccatcgacccatggggtgtgccaaccggtgctactgtgcagtccgtccccaaaaactccgacccgtgggccgcatcacagcagccagcctcgtccgccggtaagagagcgtcggatgcctggggggctgtctcaacgacaaagcccgtgagcgtatcgggaagcttcgagctattttcgaatctgaacggcacaattaaggacgacttttctgaattcgataacctccgtacttcaaagaagacggccgaaagcgtgacctctctgccttcccagaacaacgggacaacaagcccagatcccttcgagtcgcagcctttgacagtggcatcaagtaaaccaagctctgcccgaaagaccccagagagcttcttgggtccaaacgcagctctggtaaatctggattccctggtcacccgtcctgctccacccgctcagtcactgaatccatttcttgcacctggagccccagctacatctgctccggtcaacccttttcaggtcaaccagcctcagcctctgactttaaatcagttacggggatccccagtgctcggcaccagcacctcctttggacccggaccaggagtggagtccatggccgtcgctagcatgacaagtgccgctcctcagcctgccctgggggctacggggtctagcctcacccctttagggcctgcgatgatgaacatggtgggttcagtgggtattccaccttctgctgcccaggccactggcactactaatcctttcttattatag

SEQ ID NO: 222142 - DNA, 1755 bp, Artificial Sequence
  Description of Artificial Sequence: Synthetic coding sequence
atgaccaccagcagtatcagaagacagatgaagaacattgtcaacaattatagcgaagctgaaatcaaagtgagggaagcaacttccaacgatccatggggaccctcttccagcttaatgactgaaatcgctgatctgacatataacgttgtggcctttagcgagatcatgtccatggtctggaagcggttaaacgaccacggcaagaactggagacacgtgtataaggccttgaccctactggactatttgatcaaaacaggatcagagagggttgcgcaacagtgtcgagaaaacatcttcgcgattcagactctgaaggacttccagtatatcgaccgagatggaaaagaccaaggaatcaatgttcgcgaaaagtcaaagcagctcgtcgcactgctgaaagatgaagaaaggttaaaggccgaacgtgcccaggcccttaagaccaaggaacggatggcacaggtggccaccggcatgggaagcaaccagataacattcggcaggggaagtagccagcctaacttgagcactagccatagtgagcaggaatacgggaaggcaggagggtcacctgcctcatatcacggctcaacaagcccgcgagttagcagcgagctggagcaggcccgtcctcagacttcaggggaggaggagcttcagttgcaactggctctggctatgagccgcgaggtggcagagcaggaggagcggctgcgtcgcggagatgatctgcgactgcagatggcactggaagaaagtcgaagagatacagtgaagatacctaagaaaaaggaacacgggtctttacctcaacagactacgctgctggacctaatggatgcattaccaagctcggggcctgcggctcagaaggctgagccttggggaccttccgccagtaccaaccaaacgaacccctggggtggacctgcagcaccagcatccacttccgacccttggccttccttcggtacaaagcccgcagcctccatcgatccatggggagtgccaacgggcgctaccgtgcaaagcgtgccaaagaactctgacccgtgggccgcttcccagcagccagcaagctctgccggaaagagggcctccgatgcttggggcgcagtgtctactactaagccagtgtccgtttccgggagctttgaattgttcagcaacctgaacggaacaatcaaggacgactttagtgaatttgataacttgcgcacttccaaaaaaacagccgaatcagtgaccagcttaccgtctcaaaacaacggcaccacaagccctgatccgttcgaatctcagcccctgacggtggctagcagcaagccatctagcgctcgaaaaacccctgagagcttcctcggcccaaacgctgccctggttaacctagattcactggtgactagacctgcgcctcccgctcagagcctcaatcccttcctcgcccctggcgctcctgcaacctccgccccagttaatcctttccaagtaaatcaaccccaacctctgactctgaaccagcttcgcggttcccccgttctcggaacttctacctctttcggccctggcccaggggtcgagagcatggccgtcgccagcatgacatcggccgcaccgcagccggcactaggcgcaactggcagttcccttacaccattaggccctgccatgatgaacatggtcggcagcgtggggattcctcctagcgcagcccaagccacaggtacgacgaatcctttcctcctatag

SEQ ID NO: 222143 - DNA, 1455 bp, Artificial Sequence
  Description of Artificial Sequence: Synthetic coding sequence
atgaccactagcagtatacgccgacagatgaaaaatattgtgaataactattcagaggcggagattaaggtgcgggaggcaaccagcaacgatccctgggggccttcgtcctctctcatgaccgaaattgcagaccttacgtataacgtggtggcattctccgagattatgagtatggtctggaagcggctgaatgatcacgggaaaaattggaggcacgtctacaaggctttgacgctactggattatctgattaaaacaggaagcgaacgagttgcgcaacagtgccgggaaaatatttttgccatacagacactcaaggattttcagtatatcgatagggatggaaaggatcaagggattaacgtcagagagaagagcaaacaattggttgcattactcaaggatgaggagaggttgaaggcagaacgggcacaggcactcaagactaaggaaagaatggcccaggtggcgacagggatgggctctaatcaaatcaccttcggaaggggtagtagccaacccaatctttccactagtcactctgaacaggagtacggaaaagccggaggcagccccgcttcctatcatgggagcccagaggccagcctctgtccgcagcaccgcacaggggcaccactgggacaaagcgaggaacttcagccgctgagtcagcggcaccctttccttcctcatttgggattggcgtctcgcccaaatggagattggtcccaaccctgcttgacttgcgatagagctgcgagggcgacctccccacgtgtttctagcgagcttgagcaggctcgtccgcagacgagcggggaagaggaattacagcttcaactggcactagccatgagtcgtgaagtcgctgaacaggaagagagacttcgccgtggagatgatctgcgcctgcagatggccctggaagagtccaggcgtgacactgtaaaaatccctaagaaaaaggagcatggatctctgccacagcagaccaccctgctcgacctcatggatgcattgccgtcttccggacccgcagctcagaaggcagagccatggggcccatcagccagcactaatcagacaaacccatgggggggtcccgctgcgccagccagcacatccgacccttggcctagctttggaaccaaacccgcagcctcaatcgacccatggggcgtccccaccggtgcaaccgtccagtctgtgccaaaaaactcagatccttgggcggcaagccaacagcctgctagctccgcaggcaagcgggcaagcgatgcctggggcgctgtctctacaacaaaacctgtttctgtcagcggcagctttgaactgttcagtaacctgaacggtacgattaaggatgacttcagcgaatttgacaacctgcgtacttctaaaaagacaggaatgcagggactgacgggactcctgttcaccatggaaatttag

SEQ ID NO: 222144 - DNA, 1500 bp, Artificial Sequence
  Description of Artificial Sequence: Synthetic coding sequence
atgacgactagcagcataaggaggcagatgaagaatatcgtgaacaactactccgaggctgaaattaaagtcagggaggccacatcgaatgatccctgggggcctagttcttctcttatgactgaaatagctgatctgacatacaacgtagtggctttctctgagattatgtccatggtgtggaagcgcctgaatgaccacggaaaaaactggaggcatgtctacaaagcactgactctgctggattatctgatcaaaacaggttctgaacgcgttgcccaacagtgcagagagaacatctttgcaatccagacactgaaagattttcagtacatagacagggatggtaaggaccaggggatcaatgtgcgggagaaatccaagcagctcgtggccttgctcaaggacgaggagcggctcaaggctgaaagagcacaggccctgaaaaccaaagaacgcatggcccaagtggctacgggcatgggaagtaatcaaattacttttggaaggggctcttctcaacctaacctctctacatctcactctgaacaggagtatggaaaagctgggggatcaccggcaagttaccatggatccaccagccctcgggtttcctcagagttagagcaagcgaggcctcaaacgtctggagaagaagagctgcagttgcagctcgctctcgccatgtcacgcgaggtagcggagcaggaagagcgactgcggaggggggacgatctgcgcttgcagatggccctggaggagtctaggcgagataccgtgaagattcccaagaagaaagagcacggcagcctgcctcaacagactacactgctcgacctgatggacgccctgccgtccagtggaccagcagcacaaaaggctgagccatggggcccaagtgcttctaccaatcagacaaacccttggggtggtcccgcagcccctgcatcaactagtgatccatggccttccttcggcaccaagcctgccgctagcatcgatccatggggtgttcctaccggcgctacagtgcagtctgtccctaagaatagtgacccctgggctgctagtcaacaacctgcatcaagtgccggtaagcgcgctagtgacgcctggggcgcagtaagcactaccaagcccgtgagtgtatcaggttcctttgagttgtttagcaacttaaacggaactattaaggatgattttagcgagtttgataatctgaggacctccaaaaagactgccgaatcggtgacttccctgcccagtcagaataatggcaccaccagtcctgacccgttcgaatcccagccgctgacggtggccagcagtaaaccatcgagcgcaaggaagactcccgagtccttcctgggtccgaacgccgctctggtcaatctggatagtctggttacacgcccagcgccacccgctcaaagtctcaatccgtttctcgccccaggaatgcagggcttgactgggctgctgtttactatggaaatatag

SEQ ID NO: 222145 - DNA, 1899 bp, Artificial Sequence
  Description of Artificial Sequence: Synthetic coding sequence
atgacaacatcagctctccgaagacaagtgaagaacatcgtccacaactattctgaggccgaaatcaaggtaagagaagctaccagcaatgacccttgggggccaccgagcagtttgatgtcagaaatcgccgatctgaccttcaatactgtggcctttacggaagtcatgggcatgctgtggcgccgactcaatgatagcggcaagaattggcgccatgtctacaaggctttaactctccttgattacctccttaagacggggtcagagcgggtggcccaccagtgccgggaaaacttgtacaccatccagactttgaaagattttcagtacatcgacagagacgggaaagatcagggcgttaacgtgcgggagaaagttaagcaggtaatggcattactcaaggatgaagagcgattaaggcaggagcgcactcacgctctgaaaaccaaggagcgaatggccttggaaggtattggaatcggctcgggtcaactcggcttttcacgccgttacggggaggattattcgcgaagtcgaggcagtcccagctcttacaacagcagttcctccagtcctcggtatacctcagatctcgagcaggccaggccccagacgagcggtgaggaggaattgcagctccagttggcgctggcgatgtccagagaggaagcagagaagccagtgccaccagctagtcacagagacgaggaccttcagcttcaattggcgttgaggctaagcaggcaagaacacgaaaaggaggtgcgttcttggcaaggagatggctctcctatggctaatggtgcaggagcggtggtgcaccaccaacgtgatcgagagcctgagcgcgaagaacggaaagaggaggaaaagttgaaaacttcccagtctagtattctggatctggctgacattttcgtgcccgctctggccccaccttcaacacattgtagcgccgacccgtgggatattcctggctttaggccgaacactgaagccagcgggtccagctggggaccttctgccgacccctggtcccccatcccttcagggacagttcttagtcgcagtcagccgtgggacctgaccccaatgctgtcaagctccgaaccctggggcagaacgcccgttttgccagccggaccccctacaacagacccctgggcccttaattccccccatcataaactgccctctaccggtgccgacccatggggtgcttcgctcgagacgagcgacacccctggaggagctagcacatttgatcccttcgctaaaccaccggagtccaccgaaactaaggaggggttggaacaggctttgccatccggcaaaccatcgtctccagtcgaattagacctgtttggcgacccatctccatcttctaaacaaaatggcacaaaagagccggatgcattagacttggggattctgggcgaggcactaacccaaccctccaaagaggccagggcctgtagaactccagagagctttttaggacctagcgcctcctcactggtgaacctcgatagcctagtgaaggcccctcaggtggccaaaactaggaaccctttcctgactgggttgagcgcgccatctcccaccaatccatttggcgcaggcgagccaggaaggccaaccttgaaccagatgcgcaccggatctcccgctctgggcctggccggtggccctgtcggagcacccctggggagtatgacatattcggcctccttaccactcccactcagctcggttcccgcagggctaaccctccctgcttctgttagcgtgtttcctcaggcaggtgcgtttgccccacaacctctgcttcccacaccatcatcagccggaccacggcctcctcctcctcaaaccggaaccaaccctttcttgtag

SEQ ID NO: 222146 - DNA, 957 bp, Artificial Sequence
  Description of Artificial Sequence: Synthetic coding sequence
atgacaacatccgccctgaggagacaggtgaagaacatcgtacataactactcagaggccgaaatcaaggtcagagaggctacctctaatgatccatggggaccccctagctcgctaatgagtgagatagctgatcttacattcaacaccgtggcctttaccgaggttatgggcatgctgtggaggagactaaacgacagcggcaagaactggcgccatgtatataaggcactgacattgctggactatctactgaaaaccggctctgagagggtggcccaccagtgtcgggagaacttgtatacgatccagacattaaaggatttccagtacattgatcgcgacggaaaggatcaaggtgtgaacgtccgcgagaaagtgaaacaggtcatggccttgctcaaagacgaggaaaggcttcggcaggagcgcacccatgcccttaagacaaaggaacgaatggccctggaaggcatcggtatcggctcgggccagctgggattttcgagaagatatggagaggactacagccggtctcgcggatccccttcatcttacaattcaagcagctccagtcctcggtatacgagcgatcttgagcaagcacggcctcagacatctggagaagaagagctgcagctgcagttggccttagccatgagcagagaggaggcagagaagcccgtaccccctgcatcacaccgtgatgaggacctccagctgcagttagccttacgccttagcaggcaggagcacgagaaggaagtacgaagctggcagggcgacggctctccaatggctaacggagcaggggcagtggtacaccaccagagagaccgcgaacctgaacgcgaagagcggaaggaagaggaaaagctaaagacttcccaggcaccccctacctcagaacctagactgcccctgccatctaccgtgctgcacccaggtctgggctag

SEQ ID NO: 222147 - DNA, 1725 bp, Artificial Sequence
  Description of Artificial Sequence: Synthetic coding sequence
atggcattagaaacactcccaagactgtgtcggccagctgccgctcaggtggggggtagtcctcagagactgttaggcctcggcctggggccaagagagcccgctctcgaacctcacgtcgaacctaaggatgccgcagcacttctgacaaggcagcctatcttacaggattgtgacctggccaccgttgccctgtccccccctccgcctgccggtgccagggcgacacatctgcaagtgtctagtcatgacgacctgcggacacccgctcccggtgaggaacaccgggctcaactactgcggggacgaaaccaagtagccttcaccgaagtaatgggcatgttgtggaggagactgaacgactcgggcaagaattggagacacgtgtataaagccttgaccctgttggactacctgctcaagaccggctccgagagggtggcccaccagtgtagggagaacctctacactattcaaaccctcaaggactttcagtacatcgatagagatggtaaggaccaaggggtgaatgtaagagagaaagtgaaacaggtcatggcattactcaaggacgaagaaaggttgcggcaggaacgcacacacgccctcaaaactaaggaaagaatggccctggaggggatcggtataggcagcgggcagttgggtttcagccggagatatggagaggattacagccgctctcggggtagcccctcttcttataattctagtagcagctctccgaggtatacaagcgatctggaacaagcccgtccgcagacttcgggcgaagaggagcttcagttgcagttggcactggcaatgtctcgcgaagaagcggaaaaggaggtgcgtagttggcagggggatggatcaccgatggccaatggagctggagctgttgtgcaccatcagcgcgatcgggagcctgaacgtgaggagagaaaggaagaggagaagctgaaaacgtctcagagtagcatcctcgacctggctgacatttttgttccggctctagcccctcccagcactcattgttctgccgacccttgggatatccctggttttcgtccgaatacagaggcctctggcagctcttgggggccatctgcagatccgtggagtcctatcccctcagggacggtgctgagccgctctcaaccatgggatttaacccccatgctgtcttcctccgaaccatggggccgaacccctgtcctccctgccggaccaccaacgactgacccatgggccctcaatagcccacatcacaagctgccctccactggagctgacccgtggggggcaagtctcgaaactagtgacactccaggcggagccagtacattcgatccattcgctaagccaccggaatccacggagacgaaagagggacttgaacaggccctgccctcgggcaagccttcttccccagtggaactcgacttattcggggacccatcgcccagttctaaacaaaatgggacaaaagaacctgacgcactggatctcgggatcctgggcgaggccctgacacagccctccaaggaagccagggcctgtcgcacaccagaatccttccttggtccctctgcctcttcattagttaatcttgatagcctcgtgaaagccccacaagtcgccaagaccaggaacccttttctgacaggcctgtccgctccgcctagactgcggacacgcggttgggccggacgcaggtgctag

SEQ ID NO: 222148 - DNA, 507 bp, Artificial Sequence
  Description of Artificial Sequence: Synthetic coding sequence
atgaccacaagtgcactgaggaggcaggtcaaaaacatcgttcataactatagcgaagctgaaatcaaggtgcgcgaggcgacctctaatgatccctgggggcctccaagcagcttgatgagtgaaattgcagacctgactttcaataccgtcgcctttaccgaggtaatgggcatgctgtggcggagattaaacgattcaggaaaaaactggaggcacgtgtataaagctctcactttactggattatttacttaagactggcagcgagcgggtcgcccaccagtgcagagaaaacctgtataccattcagactctgaaggacttccagtatattgacagagatggtaaagatcagggagtcaacgtgcgggagaaggtcaagcaggttatggctttattgaaagacgaggagcgccttaggcaagagcgcactcacgccctgaaaaccaaggagagaatggccctagagggcatcggcattggctctggccagctcggcttttag

SEQ ID NO: 222149 - DNA, 36 bp, Artificial Sequence
  Description of Artificial Sequence: Synthetic coding sequence
atgactacgagcgcattgagacggcaggttaagtag

SEQ ID NO: 222150 - DNA, 411 bp, Artificial Sequence
  Description of Artificial Sequence: Synthetic coding sequence
atgacgacttcagcactgagacgccaggttaagaatatagtccacaactattctgaagccgaaatcaaagtacgggaagcaacctctaacgacccttggggaccaccatctagcttgatgtctgagattgcagacctgacctttaatacagtcgcttttaccgaggtcatgggcatgctgtggcggaggcttaacgattctgggaagaactggagacacgtttacaaagcccttaccctactagactaccttctcaagactggttcggagcgagtcgcccatcagtgtcgggaaaacttgtacaccatccagacacttaaggacttccagtacattgacagggatggcaaagaccagggcgtcaacgtgcgagaaaaagtgaagcaggtcatggcgctattgaaggactag

SEQ ID NO: 222151 - DNA, 156 bp, Artificial Sequence
  Description of Artificial Sequence: Synthetic coding sequence
atgactacatcggccttgcgcaggcaggtcaaaaacattgtccacaactacagtgaggctgagatcaaggtcagggaagctacaagcaacgatccttggggcccaccttcctcattaatgagtgaaattgctgacttgacctttaatacagtctag

SEQ ID NO: 222152 - DNA, 327 bp, Artificial Sequence
  Description of Artificial Sequence: Synthetic coding sequence
atgacaacttctgcccttcgccgacaggtcaagaacattgtgcacaattactctgaagccgaaattaaggtgcgcgaagccacttccaatgacccctggggccctccttctagccttatgtctgagattgctgacctaactttcaacacagtggctttcaccgaagttatgggtatgctctggcggaggctgaatgactctggcaagaattggcgtcatgtctataaggcccttacactgcttgactacctcttgaagaccggaagtgaacgtgttgcacatcagtgccgggaaaacctctatacaatacagaccttgaaagattag

SEQ ID NO: 222153 - DNA, 1983 bp, Artificial Sequence
  Description of Artificial Sequence: Synthetic coding sequence
atggctctggaaaccctgcctcggctgtgcagaccagctgcggcacaagtcggcggaagtccacaacgactgctcggtcttgggctggggcctcgtgagcctgcccttgagcctcatgtcgagccaaaggacgctgccgctttgttaacacgccagcccatactgcaggactgcgaccttgcgactgtggccttatctcctccaccccctgccggagctagagctactcatctgcaggtgagttctcacgacgaccttaggactcctgctcctggagaagagcacagggcacaattattaaggggacggaatcaggtcgccttcacagaggtcatgggaatgttgtggcgtcggttgaacgactcaggcaagaattggcggcacgtatataaggcattgacactcctggactatctcctcaaaacaggcagcgagcgcgtggcgcaccaatgtagagagaatctctataccattcagacgctcaaagactttcagtacatcgatagggatggaaaagaccagggagtgaatgtgagagagaaggtgaagcaggtgatggctctcctgaaggatgaggaacgcctcaggcaggagagaactcacgctctgaaaactaaagaaagaatggccctcgaaggcatagggatcggtagtggccaattagggttctcacggagatatggcgaggattactcccgttcccgcggatccccctctagctataattcaagctcttcatccccccgatataccagcgacctggagcaagccagaccacagacatccggtgaggaagagctccagctgcagctggccctcgcgatgagtcgggaagaggcagagaaggaggtgcgcagctggcaaggagacgggtccccaatggccaatggcgctggtgccgtcgtacatcatcagagagatcgggagcctgaacgcgaggagcggaaagaagaggagaagctgaagacatcccagtcaagcatcctggatctcgctgatatttttgttccagccttagcccctccttccacacactgcagtgcagacccctgggatatccccggatttaggccaaataccgaggctagcgggtcaagttggggcccttcagcagacccatggagcccaatacctagtgggactgtgctgtcccgcagccagccttgggacctcacgccaatgctctccagtagtgagccatggggaagaacccctgtgttgcctgccggacctcctactacggatccatgggccttgaactcgccgcaccacaagttgccatctactggagctgatccttggggcgctagcttagaaacaagtgatacacccggaggcgctagcaccttcgacccttttgcgaagcctcccgagtctacggagaccaaagaagggctagagcaggccctgcccagtgggaagccctcatcacctgtggagctggacctctttggtgacccaagcccttccagcaaacagaacggcaccaaagaaccagatgcactcgatctgggcatcttaggggaggcgttaacacaaccttctaaggaggccagagcgtgccgcacccccgaaagtttcttaggcccatccgctagctcccttgttaacctggattccttagtaaaggcgccacaggtggccaaaacccgcaatcctttcctcaccggactgtcagctccttcccccaccaaccccttcggagccggagaaccgggacggcctaccctcaaccagatgcggaccggctcccccgcacttggcctcgccggaggccctgtgggcgcacctctgggctccatgacctactcagcgagtcttcctctcccgctgagttctgtgcccgcaggacttacgctcccagcaagtgtgtcggtgtttccacaggccggagctttcgcccctcagccactactgcctacaccctcaagcgcaggtccccgacccccaccgccacagacgggaacgaacccattcctgtag

SEQ ID NO: 222154 - DNA, 753 bp, Artificial Sequence
  Description of Artificial Sequence: Synthetic coding sequence
atgggaatgctgtggagacggttgaatgactccggcaagaattggagacacgtatataaagctctgaccctgctggactatctgctgaagacaggctccgaaagagttgctcaccagtgtcgggaaaacctttatactatacaaaccctgaaagacttccaatatatcgatagggacggaaaggaccagggagtgaatgttagagagaaggtaaaacaggtgatggccctgctgaaggatgaggagaggttgaggcaagagagaacacatgcacttaaaaccaaggaaagaatggccctggaggggatcggcatcggcagcgggcagctgggattcagccgcagatacggagaagattattctcgcagccgaggctctccctccagctataattcatcgtctagctccccgagatacacaagcgatctggagcaggctaggcctcaaactagcggagaggaggagctccaactacagttagcccttgctatgtcgcgcgaagaagccgagaaagaagtgcggtcttggcagggagacggttccccgatggcaaatggggctggcgcagttgtccatcaccaacgtgaccgggaacctgagcgagaggaacgcaaagaggaagagaagcttaagacctctcaggtcctgggacgaacccagcggcctgtggacccccctggcggacttctacagaccccaggcctgcgcagcccacaagagccaagctgcccagaagcctctcccggaatctag

SEQ ID NO: 222155 - DNA, 429 bp, Artificial Sequence
  Description of Artificial Sequence: Synthetic coding sequence
atgagcctgttgccggtcccatataccgaagccgcttccctgtccaccggatctacggtcacaataaagggcagacccctagcatgttttctgaacgagccatacctacaggtggatttccacacagagatgaaggaggaatcagatattgtgttccacttccaggtttgttttggcaggagagtggtgatgaactcaagggagtatggcgcttggaagcagcaggtagagagcaagaacatgcctttccaagatggccaagagttcgagctatccattagtgttctgccagacaaatatcaggtcatggtaaacggccagagtagctacacatttgaccataggatcaagcctgaggcagtaaaaatggtccaagtgtggcgcgatatctcactgaccaagttcaatgtgtcctatctcaagcggtag

SEQ ID NO: 222156 - DNA, 828 bp, Artificial Sequence
  Description of Artificial Sequence: Synthetic coding sequence
atgaatatgactcaggctagagtgctggtcgccgcagtggttggcctcgttgcagttctactatacgcctcgatccataaaatcgaggaggggcatctggccgtttattatcggggaggagcactgcttacgagcccctcaggccctgggtaccatatcatgttgccctttatcacgaccttcaggtctgtccaaacaaccctccagacggacgaggttaaaaacgttccatgcggtacttcggggggtgtcatgatctatatcgacaggatcgaggtggtgaacatgttagctccatacgctgtgttcgacatcgtccgaaattatacagctgactatgataagactttgatctttaacaagattcatcacgaactgaaccagttctgttcagcacacactctgcaggaagtctatatagagctgtttgatcagatcgacgagaatctgaaacaggcactgcagaaggacctgaatttaatggcgccagggctgacaattcaggcagtgagggttacaaagcctaaaatacctgaggccatccggagaaatttcgaattgatggaggccgagaagactaagctcctcattgctgctcaaaagcagaaggttgtggagaaggaagcagaaactgaacgcaagaaggccgttatcgaggcggaaaaaatcgcccaggtggcaaaaattaggtttcagcagaaagtgatggagaaggagaccgagaagaggatttcggaaattgaggacgcggcttttttagctcgtgaaaaagcaaaagccgatgcagaatactacgctgctcataagtacgccacctccaataagtag

SEQ ID NO: 222157 - DNA, 699 bp, Artificial Sequence
  Description of Artificial Sequence: Synthetic coding sequence
atgatctatatcgatcgcatcgaggtggtgaacatgcttgcaccgtacgcagtcttcgacatcgttagaaactacaccgccgattacgacaagacgctgatttttaataagattcaccatgaacttaaccagttctgcagcgctcatacgctgcaagaggtctacatcgagttgtttgaccagatcgacgagaacctcaaacaggcactgcagaaagacctgaacctaatggcaccagggctgacgatacaggccgtgagggttactaagcccaaaatccccgaggctatccgacggaacttcgagctgatggaggccgagaagaccaagctacttatcgctgctcagaaacagaaagtggtggagaaggaagcggagacagagagaaaaaaggctgtcattgaagcggagaagattgctcaagtggcgaaaattaggtttcagcagaaggtgatggaaaaggagaccgagaaaagaatcagcgagattgaggatgccgcttttctggcaagagaaaaagccaaagctgacgcagagtactacgccgctcacaaatacgccacttctaacaagcacaaattgacgccagagtatttggaactgaaaaagtaccaggctatcgcttcaaactctaaaatctacttcggctcaaatatccccaatatgttctctatttccagatgcggacccagaggatag

SEQ ID NO: 222158 - DNA, 1047 bp, Artificial Sequence
  Description of Artificial Sequence: Synthetic coding sequence
atgaacatgacccaggccagggtgctcgttgccgcagtggtcggtctcgtggccgtactgctgtacgcctccatccataagatagaggaaggtcatctagcagtatactaccggggaggagccctgctaacctctccctcagggccaggctatcatattatgctcccatttataacaactttcagatcagtccagactacactgcagacagatgaggtcaaaaatgtaccttgtggcacttccggcggtgttatgatttacattgaccggatcgaagttgtgaatatgttagctccttacgcagtgttcgacatcgtgagaaattacaccgcagattacgataagaccctgattttcaacaagatacatcacgagctgaatcaattctgttcagcgcacacactccaggaggtgtacatcgagctctttgatcagatcgacgaaaatcttaagcaggcattacaaaaggacctgaatctgatggctcctgggctcaccattcaggctgtgcgggttacaaaaccaaagatccctgaggctatcaggcgtaatttcgagctgatggaagcggagaagacgaaattgctgattgcagcgcagaagcagaaagtggtcgaaaaagaggcagagaccgaacgcaagaaggctgtgattgaagctgagaaaatcgctcaggtggccaagatccgtttccagcagaaggttatggagaaagagacagaaaagagaatttctgaaattgaagatgctgccttcttagcccgagagaaggctaaggcggatgcagagtattacgcagcccacaagtacgccacgtccaacaaacataaactgactccagagtatcttgagctaaaaaaataccaggccatcgctagtaactccaaaatttatttcgggagcaatatccccaacatgttcgtggactcttcttgcgcactgaaatattccgatatcagaacaggccgagagagcagtctgccatcaaaggaggccttggaaccaagtggcgagaatgtcattcagaataaagaatcaaccggatag

SEQ ID NO: 222159 - DNA, 1047 bp, Artificial Sequence
  Description of Artificial Sequence: Synthetic coding sequence
atgaacatgacccaggcaagggtactggtggcggcagtcgtgggcctggttgctgtgctgctctatgcaagtattcacaagatagaagaaggacatctggcagtttactatcgcggaggcgcacttctcacaagtccctccggacctgggtaccacatcatgctacccttcatcactacttttcgcagcgttcagacaacacttcagacagatgaagtgaaaaatgttccctgtggtacctccggaggggtgatgatctatattgatagaatcgaagtcgtcaatatgctggctccatacgcagtattcgatatagtgagaaactacaccgcggattacgataaaactctcattttcaataagatccatcatgagcttaatcaattttgcagcgcccataccttacaagaggtatacatcgagttgttcgatcaaatagacgagaacttgaaacaagccctgcagaaagaccttaacttgatggcgccaggtctgacaattcaggccgtacgagtcactaagccaaagatccccgaagcaattaggcgaaactttgagctgatggaggccgagaaaacgaaactgttaattgcggcacaaaagcagaaagtcgtcgagaaggaagcagagacggagcgaaagaaagccgtaatagaggccgaaaagatcgcgcaggtggcgaagattagattccagcagaaggttatggagaaggaaacagagaagagaatctccgagattgaagacgccgcatttcttgccagggaaaaagctaaggcggatgctgagtactacgccgcacacaagtacgctacgtctaataaacacaaactgactcctgagtacctggagctgaagaaataccaggccattgcttcaaactctaagatctacttcggctctaacattccaaatatgttcgtggactcttcctgcgccctaaagtactcagacatacgaaccggtcgcgaaagtagtcttcctagcaaagaggccttggaaccgagcggcgagaatgtgatccaaaataaggaaagtaccgggtag

SEQ ID NO: 222160 - DNA, 1020 bp, Artificial Sequence
  Description of Artificial Sequence: Synthetic coding sequence
atggctcaactgggtgctgtagtcgctgttgccagctcgtttttttgcgcctccctctttagtgcagtgcacaaaatcgaagaaggacatattggtgtttactatagggggggagcactgctgacatcgaccagcggcccaggctttcaccttatgttgccgtttatcacgagttacaaatctgtgcaaacaaccctccagaccgacgaggtgaaaaatgtgccttgtggcacatccggcggagtaatgatctattttgataggatcgaagtcgtcaattttctcgtgccaaatgccgtgtacgatatagttaagaactataccgcagactatgataaagctttgatcttcaacaagatacaccacgaacttaatcagttctgttccgttcacaccctccaagaagtctatatcgagctcttcgaccagatagatgaaaatctcaaactggcgttacagcaggacctgaccagcatggccccaggactggtgatacaggcagtgcgagtgacaaaacctaacatccctgaggccatccgccgaaactacgagctcatggaatctgaaaagactaaattactcatcgcagctcagaaacagaaggtggtggagaaagaagctgaaacagagagaaagaaagcacttattgaggcggagaaggtggcacaagtggccgaaataacatatggacaaaaagtgatggagaaggagaccgaaaaaaaaatcagtgaaatcgaggacgctgcatttctggctagagagaaggcaaaagccgatgctgaatgttataccgctatgaagatcgcagaggctaataaactgaaactgactcccgagtaccttcagttgatgaaatacaaggctatcgcctcgaatagtaagatctacttcggaaaggatatccctaacatgttcatggatagcgctggttcagtttctaaacagtttgagggcctggcagataagctctctttcgggcttgaagatgaacccctggagaccgctaccaaggagaattag

SEQ ID NO: 222161 - DNA, 459 bp, Artificial Sequence
  Description of Artificial Sequence: Synthetic coding sequence
atggcccagctcggagctgtggtggccgtcgctagttctttcttctgcgcgtcactgtttagcgcagtgcacaagattgaagagggccacattggcgtctattacagaggaggcgcactgctcacctcaactagtggtcctggcttccacctgatgcttccatttattacatcttacaagtctgtccagactacgctacagacagacgaagtcaagaacgtcccctgcgggaccagtgggggtgtcatgatctacttcgaccgcatagaagtggtgaattttctggtgccaaacgccgtttacgatatcgtcaagaattacacagcagattacgataaagccctgatttttaacaagattcatcatgagctgaatcagttctgctccgtgcacaccttacaggaagtttacattgaactgtttggcctggagaacgacttttctcaagagagctcttag

SEQ ID NO: 222162 - DNA, 1020 bp, Artificial Sequence
  Description of Artificial Sequence: Synthetic coding sequence
atggcccagctgggcgctgtcgtcgcggtcgctagctctttcttctgtgcctccctattctctgccgttcataaaatcgaagaagggcacattggagtatattaccgcggtggggctctcctgaccagcacgagtggccctggtttccatcttatgttgcctttcatcacaagctacaaaagcgtacagacaaccctccagacagacgaagtgaaaaatgttccatgtggaacgagtggtggtgtgatgatctactttgacagaatagaagttgtcaattttctcgttccgaacgctgtgtacgatattgttaagaattatactgccgattacgataaggctcttattttcaacaaaattcaccacgaactgaatcagttttgctcagtccatacgctccaagaggtctacatagagctgtttgatcagattgatgaaaatttgaaacttgccctccagcaagacctcacaagcatggctccaggtctggtgatccaggccgtccgcgttaccaaacctaacatccccgaggcaatcaggcggaactacgaacttatggaaagtgagaagaccaaactccttattgcggcacagaagcaaaaggtggtggagaaagaagctgagacggagcgcaaaaaggctcttattgaggcagagaaggtcgcccaggtggcagagatcacttacggtcagaaagttatggagaaggagactgagaagaagatctcagagattgaggacgccgctttcttggccagggagaaggctaaggcagacgctgagtgttatacagcaatgaagatagcagaagccaacaagcttaagcttacgccagagtacctgcagctgatgaaatataaggccatcgccagtaattcaaaaatctatttcggaaaagacataccaaacatgtttatggattccgctgggtccgtctctaagcagttcgaggggttggcagacaagctgagttttggcttggaggacgagccgctcgagacggcaaccaaggaaaactag

SEQ ID NO: 222163 - DNA, 621 bp, Artificial Sequence
  Description of Artificial Sequence: Synthetic coding sequence
atggcccagttgggcgcagtggttgccgtggcaagctccttcttttgcgcctctctgttttcagccgtgcacaaaatcgaggagggccacattggggtttactatcgcggaggggcactcctcacctctacaagcggccctgggtttcacttgatgctgccctttatcacaagttataagagtgttcagacaaccctgcaaacggacgaggtgaaaaacgtgccctgtggaactagcggcggtgttatgatctatttcgatagaattgaagttgtgaactttctagttcccaatgcagtgtatgatattgtgaagaactacacagctgattatgataaagccctgatctttaataagattcaccatgaactgaatcagttttgctccgttcacactttgcaggaggtctacattgagcttttcggcaagaaagtctcacccgaacatgccgtgcttaaacagggtagctggaaccccgcaagtctgcactgcttgaagcctggctgtctgcagggcgtcatggtgacttatgggcaggaaatgctgaagaatcttgtgctgaggtcctggagccagcggtctagctggcggatgcttattgcgatgcagcaggatccatag

SEQ ID NO: 222164 - DNA, 459 bp, Artificial Sequence
  Description of Artificial Sequence: Synthetic coding sequence
atggcccagctgggcgctgtggtcgctgtcgcctcgtcctttttctgtgctagtctgttttccgccgtccacaaaatcgaggaggggcacatcggggtgtactaccggggaggcgcattgttaacaagcacttctgggccagggttccacctgatgcttcctttcatcactagctataagtccgtgcagacaaccctgcaaaccgatgaagtgaaaaacgtaccttgcggtacttctgggggagtcatgatctattttgacaggatagaagtcgtcaacttcctagtgccgaacgcagtttatgacatagttaagaactatacagcggattacgataaggcccttattttcaataaaattcaccacgaattgaaccagttctgctctgtccacacacttcaggaagtctacatcgaactgtttggccttgagaatgacttttcacaggagtcttcatag

SEQ ID NO: 222165 - DNA, 4239 bp, Artificial Sequence
  Description of Artificial Sequence: Synthetic coding sequence
atgacgaccaagcgctctctgtttgttcgcttggtgccatgcagatgcctgcggggtgaggaggagactgtgacaacccttgattactcacactgctcattagaacaggtccccaaggagatttttacatttgaaaaaactctggaggagctgtacctggacgcaaatcagattgaggaattgcctaaacagttgtttaattgtcagtctctccacaagctgtcactacccgacaatgacctcaccacactccctgcttctatcgccaatttaatcaatcttagagagttggacgtgagtaaaaacggaattcaggaatttccagagaacattaagaactgcaaagttctgaccatcgtagaggcatctgtgaaccccattagtaaactaccagatggtttcagccagttgctgaacttgactcagctctatctgaacgacgcattcctggaattcctgccggctaacttcggacgtctgaccaagttgcaaattctcgagctcagggaaaaccaactcaagatgctgcccaaaaccatgaacagattgacccaactggagcgtctggatcttggctcgaatgaattcaccgaggtgccagaggtccttgagcaattatcggggttgaaggagttctggatggatgccaaccgtctgacctttatcccaggatttatcggctcccttaagcaattgacatacctggatgttagcaagaacaacatagagatggtggaggaagggatttcaacctgcgagaacctacaggatctgctgctgagctctaactcattacagcagttgcccgaaacaataggttctctcaagaatattacaacgctgaagattgacgaaaaccagctgatgtatctgcctgatagcatcgggggactcatttcggtagaagagttggattgctcattcaatgaagttgaagcgcttccatcctctattggccagttgaccaacctacgaacgttcgccgcagaccataactacttgcagcaactacccccagagattggatcctggaaaaatataacagtccttttcctgcacagcaataaactagaaacacttccagaagagatgggcgatatgcagaagctgaaggtaatcaatctctccgacaatcgactgaagaatcttccgttcagttttaccaaactacagcagctgaccgctatgtggttgagtgacaaccagagcaaaccattaatcccactgcagaaggaaacagatagcgaaactcagaagatggtcttgaccaattacatgtttcctcagcagccccgaacagaggacgtgatgtttataagcgacaacgaaagttttaatccgtccctgtgggaggaacaacgtaagcaacgcgcacaggtcgcttttgagtgcgacgaggacaaagacgaacgtgaggcgccacctagggaagggaacctgaaaaggtacccaaccccctacccagatgagctcaagaatatggttaagacggtccagacgattgtgcaccggctgaaggacgaagagactaatgaagactctggccgagacctcaagccgcacgaggatcagcaggatatcaacaaggacgttggtgtaaagacttccgaaagcaccacaaccgtcaagagcaaagtcgacgagagggagaaatatatgatcggaaactcagtgcaaaagatctctgaacccgaagcggagattagccctggatcactccccgtgaccgccaatatgaaagcctctgagaacctgaaacacatcgtgaatcacgacgacgtctttgaagagtcagaggagttgagctctgatgaagagatgaaaatggccgaaatgagacccccattgatcgaaacttccatcaaccagccaaaggtggtggccctgtcgaataacaagaaagacgatactaaggagacggacagcctgtccgacgaggtcacccataacagcaatcaaaacaattcaaattgtagctcgcccagccgaatgtcagattccgtttcactgaatacggattccagccaggataccagcctgtgtagcccggttaaacagactcacatcgatatcaatagcaaaatccggcaggaggacgagaactttaattccctgctgcaaaacggagacattctgaattcatccacagaagagaaatttaaagcccatgacaagaaggactttaatctcccagagtatgacctcaacgttgaagaacggctggtgttaattgagaagtcagtggacagtaccgctactgccgatgatacccacaagcttgaccacatcaacatgaaccttaacaagctcatcacaaacgacacgttccaaccagagatcatggagcgatcaaaaacccaggatattgtgctgggaacaagctttctctccatcaactctaaagaggaaactgaacacctagagaatggaaacaaataccccaatctggagagcgtgaacaaggtgaatgggcattccgaagagaccagccagagtccaaataggaccgaaccccacgacagtgattgctctgttgatttggggatttcgaagagcacagaagacctgtcgccccagaagtcagggccagtaggttccgttgtcaaatctcactccataacaaatatggagatcggaggtctcaaaatatatgacatcctctccgacaacggccctcagcaaccatcaaccacagtgaaaattacttctgctgtcgacgggaaaaacatcgtgagaagcaaaagtgctacccttctttatgaccagcccctgcaggtgttcaccgggtcctcctcaagctctgacctaatatcaggaactaaagcaatcttcaaatttgacagcaaccacaaccccgaagaaccaaatattattcggggacctacgagtgggccacaaagcgccccacagatatatggaccaccgcaatataacatacagtatagctcaagcgctgcagttaaggatactctgtggcactcgaaacaaaacccccagattgatcacgccagttttcctccccagctgttgcccaggagcgaatccactgagaatcagtcttacgccaagcactctgcgaatatgaacttttctaaccacaacaatgtgcgggctaatacagcgtaccaccttcaccagagactgggccctgcacgccacggagaaatgtgggcgatctcgcccaatgatcggttaatcccagccgtaacgcggtccacaattcaacgccagagctccgtgagctccactgccagcgtgaatctgggagatccgggttctactcggagggcgcagattccggagggggactacctttcctatcgggagttccattcagcagggcgaacgccgcctatgatgcccggttcacagagacctctgagcgcgaggacgtattccattgacggcccaaatgcttcacgcccacagtccgcaagaccttccatcaatgagattcctgaacggactatgagcgtgtccgactttaactattcccgtacgtcgccttctaagcgcccaaatgctagggttggcagtgaacattctcttttggatccacctggcaagagcaaagtccccagggattggagagagcaagtgttacgtcacatcgaagctaagaagctcgagaagaaacacccacagacgtcgtctagcggcgatccctgccaggacggtatttttatctccggccaacagaactattcttctgcaaccctgagccacaaagatgtgcctcccgactcactcatgaaaatgcctcttagcaacggacagatgggccagccattgaggccccaggctaactacagtcaaattcatcatcctcctcaagcttcagtggccaggcatcccagccgggagcagttgatcgactacttaatgttgaaggtggcacatcaacctccgtatacacagccccattgttctccacgtcagggccatgagctggcaaagcaggagattcgcgtgcgggttgagaaagatcccgaattaggcttttccattagtgggggagttggcggtcggggaaacccgttccgcccagacgacgatggcatctttgtgacaagagtacagccagagggaccagccagcaagcttttgcagcctggtgacaagattatccaggcgaatgggtactccttcatcaacattgaacacggccaggccgtgtcgctgctcaagactttccagaacaccgtggagctgattattgtgcgggaggtgagctcctag

SEQ ID NO: 222166 - DNA, 3909 bp, Artificial Sequence
  Description of Artificial Sequence: Synthetic coding sequence
atgacaacaaaaagatccctctttgtccgacttgtaccctgcagatgcctgaggggggaggaagaaacagtgacaactctcgattactctcactgcagtctggaacaagtgccaaaggaaatcttcaccttcgagaaaacacttgaggaactatacctggacgctaatcagattgaggaactgccaaaacagctgtttaactgtcagagcctccataagctgagcctgccggacaatgaccttacaacgctcccagccagcattgccaacctgatcaacttgagagaactcgacgtgagcaagaatggaatccaagagttcccagagaatattaagaactgcaaggtgcttactattgtggaggcctcggtaaacccaatcagtaaactgcccgacggattcagccagttactgaacctaacccagctttatctgaacgatgcttttcttgagttcttgcctgccaacttcggacgcctgacgaagttacaaatcttggagctgagggaaaaccagttaaagatgctcccgaaaaccatgaataggctgacccaactggagcgcctggacctgggctcaaacgaatttacagaagtgcccgaagtcctcgagcaattgtccgggctgaaagaattctggatggacgcaaatcggcttacattcatccccggttttattggctctcttaaacagctgacttacttagacgtgtccaagaacaatattgagatggtggaggagggaatcagcacgtgcgagaacctgcaggatttgctgctttctagcaacagtcttcaacagcttccagagaccataggttccttaaagaatatcacaacgcttaaaatcgatgaaaaccagctgatgtacctacccgactctatcgggggactcataagcgtggaggagctggactgttcctttaacgaggttgaggcgctgccaagcagcattgggcagctcacaaatctgagaacattcgctgctgatcacaactaccttcagcagctccccccagaaattggatcatggaagaacattactgttctgtttctccatagtaataagcttgaaaccttacccgaggagatgggggacatgcagaagctgaaggtgattaatctgagtgacaataggctgaagaacctgcctttcagtttcaccaagctgcagcagttaacagctatgtggttgtccgataatcagtctaaaccactgattccattacagaaggaaaccgatagtgagacccagaaaatggtattgaccaattatatgttcccgcagcagccaaggaccgaggatgtcatgtttatttcagataatgagtcattcaatcccagcctgtgggaagaacagcgcaagcagagagctcaggtagcgtttgagtgcgacgaggataaagatgagagggaagcaccccctagggaaggcaacctcaaacgatatcctactccctacccagatgagctcaagaacatggtgaaaacggtgcaaaccatcgtgcatcggctaaaagacgaagaaacaaacgaagacagtgggcgtgatctgaaacctcacgaggaccaacaggatatcaacaaggacgtgggcgttaagactagcgaatctaccactacagtgaaaagcaaagttgacgagcgtgaaaaatatatgattgggaacagcgtacagaaaatctcagaaccagaggcagagatatcacctggcagcctacccgtgaccgcgaatatgaaagcgagcgaaaatctgaagcacattgtcaaccacgacgatgtgttcgaagaaagtgaggagctgtcctcagatgaggagatgaagatggccgaaatgcggccaccccttatcgagacaagcatcaatcagccaaaagtcgtggcgctcagcaataataagaaagatgacacaaaggaaactgatagcttatctgacgaggtcactcacaattctaaccaaaacaattccaattgctcttcaccgagcaggatgtctgatagcgtatcacttaatacagactcgtcacaagatacttccctgtgtagccctgttaaacaaacccacattgacattaacagcaagatcagacaggaggacgaaaacttcaatagcctcctccaaaacggagacatactcaattcatccacagaagagaagttcaaggcgcacgataagaaagacttcaacttgccagagtatgatcttaacgtggaggagagacttgttctgattgagaagagcgtggacagcacggccaccgcggacgatacacataagttggaccacatcaatatgaatctcaacaagctcattacgaatgacactttccagcccgaaatcatggagaggagtaagacccaggatattgttctgggcaccagtttcctcagcatcaattcaaaagaggagaccgaacatttagagaacggcaataaataccccaatcttgaaagcgtgaacaaagtgaacggccacagtgaagagacttcccagtcacctaataggaccgaaccccatgatagcgattgctctgtagacctgggcattagcaagagtactgaagacttatccccccaaaagtctggacccgtgggttccgtcgtcaagtctcactccatcactaacatggaaattggaggattgaagatctacgacatcttgtctgacaacggaccacagcagccttccaccacagtcaagatcacatccgcagtggatggtaagaacattgtgcgatcaaagtctgctaccctcctctacgatcagcctttgcaggtctttacagggtcttcttcctcctctgatttgatctctggtactaaagcgatttttaagttcgacagcaaccacaaccctgaagaaccaaatatcattagaggtcccacaagtggaccacagagcgccccacagatctatggaccccctcagtataatattcagtattcatccagcgcagccgtaaaagatacattgtggcactctaaacagaatccgcagattgatcacgcctcgttccctccgcagttgctgccacggtcagaatcgacagagaatcagagctatgccaaacacagcgcaaacatgaacttttccaatcataacaacgttcgcgctaacacggcatatcacttgcaccagaggctcgggccagcacgccatggtgagatgtgggccattagtcccaacgaccggctgatcccagcagttacacggagcaccattcagaggcaatcctctgtatcatctactgccagtgtgaatctcggggatccaggcagcacgaggcgcgctcagattcccgagggcgattacttatcttatagggagtttcattctgctggtcggactccccctatgatgcctggctcccagagaccacttagtgccaggacctacagtatagacggacctaacgcaagcagaccacagtctgctcgcccaagcattaacgagatccccgaacgcacaatgtctgtgagcgactttaattactctcgtacaagtccttccaaacgacctaacgcacgggtgggctccgaacacagtctcttggaccctccgggtaagtcaaaggtacctagggactggagggagcaggtgctgaggcacattgaagccaagaaactcgagaagatcagggttagagtcgaaaaggatcctgaattaggctttagtattagcggaggggtcggtggccgtggaaatccgttcaggcccgacgacgacggaattttcgtgacgagggtgcagccagaagggccagctagcaagctgctacagcccggtgacaaaataatccaagctaacggttattctttcatcaacattgagcacggacaggcggttagcctgctcaagacctttcagaacactgttgagttaatcatcgtccgcgaggtgagcagctag

SEQ ID NO: 222167 - DNA, 4023 bp, Artificial Sequence
  Description of Artificial Sequence: Synthetic coding sequence
atgaccactaaacggtcacttttcgtgaggctggtcccctgtcggtgtttacggggagaggaggagacagtcaccactctagactattcacattgctctctggaacaggtacccaaggagatttttacctttgagaaaaccctggaggaactctatctagacgctaaccaaatagaggaactcccaaagcagctcttcaattgccaaagcttgcataaactgagtctcccagacaacgacttgacaactctgcctgcatccatcgccaacctcattaatcttagagagcttgacgttagcaagaatgggatccaggaattccctgagaatattaagaattgcaaagtactcaccatcgtcgaggcctctgtcaatccgatctcaaagcttcccgacggctttagccaactgttaaatctgactcagctatatctaaacgatgcattcctcgaattcttgcctgcgaatttcggtcgcctgactaagttgcagattctggagctaagggaaaaccagttgaagatgctccccaaaacaatgaaccggctaacacagttagagaggttggacttagggtccaacgagtttaccgaggtcccggaagtgttggaacaactatccggactaaaggagttttggatggatgctaacaggctaacttttatccccggatttatcggttcgcttaaacaactgacttacctggacgtgtccaaaaataacattgaaatggtcgaagaaggaatctccacttgcgaaaatctgcaggatttactactgtcatccaatagcctccagcagcttcctgagacaattggctccctgaaaaacattaccaccctgaaaattgacgagaatcaattaatgtacctgcccgattcaatagggggactaatctctgttgaagaactggattgctcctttaatgaggtagaggccctaccctcatctatcggtcagcttaccaatcttcgtacatttgctgcggaccacaactacctgcagcagctacctcccgaaataggcagctggaagaacatcaccgtgctgtttcttcactcgaataaactcgaaactctacccgaggagatgggagacatgcagaagctgaaggtaataaacttgtctgataataggcttaaaaacctgcccttttccttcacaaaattacagcagctgaccgccatgtggctctctgacaaccagagcaagcccctcatcccgttacagaaggaaacagactccgaaactcaaaagatggtattaaccaattacatgtttccccaacagccgaggacggaagacgttatgtttatctccgataatgagtcctttaacccatctctctgggaggaacagaggaaacaacgcgctcaggtggcatttgagtgcgacgaggacaaagacgagcgcgaggcccctccacgagaggggaacttgaagcgttaccccaccccttatccagacgagctgaagaacatggtcaagacggtccagactatcgtccacaggcttaaggatgaagagacgaatgaggactcgggcagagacttgaagccccacgaagatcaacaggacattaacaaggatgtgggagtcaagacctccgagtccacaaccaccgtcaagtcaaaggtagatgaacgagaaaagtacatgatcggaaactcagtgcagaagattagcgaaccagaagctgagatttcacccggtagcctgcctgtaacggctaatatgaaggcttcagagaacctgaagcacatcgtcaatcatgatgatgtgttcgaggagtcggaagagttatcctctgatgaagagatgaagatggcggagatgaggccacctctcattgagacctcgattaaccagccgaaagtggtcgccctgtcaaataacaaaaaagatgataccaaggaaaccgattcactgagcgacgaggtgactcataattccaatcagaataattcaaactgctctagccccagccgcatgagcgactcagtgtcactcaacactgattcctcacaggatacttctttgtgcagcccagtgaaacagacacacattgacattaactccaaaatcaggcaggaagatgagaactttaatagcctgctccagaatggcgacatcctgaactcttccacagaagagaagtttaaagcccatgacaagaaggacttcaaccttcctgaatacgacctcaatgttgaagagcggctggtgctgatcgaaaaatctgtggattccaccgccaccgccgacgacacccacaagctggaccacataaatatgaatctaaataagcttatcacgaatgatacatttcagccagagattatggagaggagcaagacgcaggatatagtgcttgggacctcatttctgagtataaatagcaaagaagagaccgaacacctggagaatggaaacaagtacccgaacttggagagcgtaaataaggtcaatggccattctgaggaaactagccagagtcccaataggaccgagcctcacgattcggattgctcagtggatttaggcattagcaagtctacggaagatttatccccccagaagtccggccctgtaggctcggtggtaaagtcgcacagcatcacgaacatggagatagggggattgaaaatctatgacattctgagtgataatgggccacagcaaccatcgactactgtgaagattaccagcgccgtcgatggcaaaaatatcgtgaggtcgaagagtgcgacactgttatatgaccagcctctgcaggtttttacagggagtagttcctctagcgacttaatttccgggacgaaggcaatctttaagtttgattccaaccataaccccgaggagcccaacataatcaggggcccaacaagtggaccacagtccgctccgcagatatacggaccccctcagtacaacattcagtactctagctcagccgctgttaaagacacactgtggcattccaagcagaatcctcagatcgatcacgcctcattccctcctcaactgctgcccaggagcgaatctactgagaaccagagctatgcaaaacacagtgcaaacatgaatttctcgaatcacaacaacgtgcgggctaacaccgcttaccacctgcaccagcgcttaggaccggctagacatggagaaatgtgggccatctcccccaacgaccgcctaattccagccgtaacccgcagtaccattcaacggcaaagctcagttagcagtactgccagtgttaacctgggagatcctgggtcgacccgtcgtgctcaaatccctgagggcgactatctgtcttatagagagttccactccgcagggaggaccccacctatgatgcccggatcgcagcgaccgctcagcgccaggacttactccattgacggccctaacgcctccaggccccaaagtgccagaccatcaatcaacgaaatacctgagcgtaccatgagtgtctccgatttcaactattctagaacctctccttcaaagagacccaacgccagagtgggatccgagcatagtttgctcgaccctccaggtaagtccaaagttccgagggattggagggaacaagtcctgagacacatcgaagccaagaagcttgaaaagatgccactgagcaatggccaaatgggtcagcccctccggcctcaggcgaattacagccaaatccaccatccaccacaggcgtcagtcgctcgccatcctagtcgcgagcagttgatcgactacttgatgttaaaagttgcacatcagcccccttatacccaaccacactgttcccctagacaaggacatgagctggccaaacaagaaggcatctttgtgactcgcgtgcagcccgagggcccagcatctaagctactccagcctggggataagattatccaggccaacggatacagttttatcaatatagagcatggccaagccgtaagcctgctgaagaccttccaaaatacagtcgaactcatcatcgtaagagaagtcagttcgtag

SEQ ID NO: 222168 - DNA, 4041 bp, Artificial Sequence
  Description of Artificial Sequence: Synthetic coding sequence
atgacgacaaaacggagcctgttcgtcagactggtcccctgtcgctgcttacggggagaagaagaaaccgtcaccaccctcgactatagccactgctcactggagcaagtgccgaaggagatattcacttttgagaagactttggaagagctttacctcgacgcaaaccagatcgaggaactacctaaacagctgtttaattgtcaaagtctgcataagctgtccctgcctgacaatgatctaaccactctacccgcaagcatcgccaacttgatcaacttgcgagagctcgacgttagcaagaacggtattcaggagtttcctgagaatattaagaattgtaaagtccttacaatagtcgaggcatctgttaaccccatatctaagctacccgacggctttagccaactgctgaacctgacccagttataccttaacgacgcattcttggagttcctccccgctaactttggccgtctgaccaaacttcaaattctcgagttgagggaaaatcaattaaagatgctccccaagacaatgaacagactcacccagttggagagactcgacctaggttccaacgaattcacagaggtgccagaagtcctcgagcaactttcagggctcaaagaattttggatggacgccaatagattgacttttataccaggcttcataggcagtcttaagcagctgacctacttggacgtgtccaaaaacaatatcgaaatggtggaggagggcatttcgacctgtgagaacctgcaggaccttctgctgtcttcaaattcactgcagcagcttcccgagactatcggctccttgaaaaacatcactacattgaaaattgatgaaaatcagctcatgtatctgcccgacagcattggtgggctgatttccgtggaggagctagattgttcatttaacgaggtagaggcattgccatcgtccatagggcagctgactaatctccgaacattcgccgcagatcacaattacctccagcagctgcctcccgaaatcggcagctggaagaacattaccgtgctctttttgcacagcaacaagctggagacgttgccggaggagatgggagatatgcaaaagttgaaggtgatcaacctgtcagacaatcgccttaagaacctgcccttttcattcacgaagttacagcagctcacggccatgtggttgtccgataaccagagcaaacccttgatccccctgcagaaagaaacggactccgaaacccagaagatggttctaacaaattacatgttcccacaacagccacggacagaagacgtgatgttcatcagtgataatgagtccttcaacccatctctgtgggaggaacagagaaaacaacgggcacaggtggcctttgagtgtgacgaggataaagatgagcgggaggcaccaccacgagaggggaaccttaagcggtaccccaccccttacccagatgagctcaaaaatatggtaaagaccgtccaaacgatcgtccacaggctaaaggacgaggagacgaatgaagactctggtagggacctgaaaccccatgaggatcaacaggacatcaataaagacgtgggtgtaaagaccagtgaatccactacgacagtgaagtccaaggtcgatgagcgagagaagtatatgatcggcaattctgtccagaaaatcagcgagcccgaagctgaaatttcacccggatcattgccagttactgccaacatgaaagcatcagagaacctcaaacacattgtgaatcatgacgacgtgttcgaagaaagcgaagagctctcctcagatgaagagatgaagatggcggagatgcgcccacccttaatagagacatcgatcaaccagccgaaggtggtggccctgagcaacaataaaaaggacgacacaaaagagaccgattcactaagcgacgaggttacacataattctaaccagaacaactccaattgttcttccccctcacgaatgagtgatagtgtcagtttgaacactgacagctctcaggatactagcctctgctcacccgtaaagcagactcatatagacatcaactcaaagatccgacaggaagacgaaaatttcaacagcctgttacagaatggcgatattctgaacagtagcactgaggagaagttcaaggcacatgacaagaaagactttaacctccccgagtacgacctgaatgttgaggagcggctggttctgatagaaaaaagcgtggattccactgctacagccgatgatacccacaaactggatcatattaatatgaacctgaataagctcatcaccaatgacacattccagcccgaaataatggagaggtcaaaaacacaggatatagttttggggacgagttttctcagcatcaactcaaaggaggagaccgagcacctggaaaatggtaacaagtatcccaatttagagagcgtcaacaaagtgaacgggcactctgaagagacctcccagagtcctaatcggactgagcctcatgactctgactgttcagtggacctgggcattagtaaatccacagaagacctgagtcctcagaagtcaggaccagtgggtagcgtcgttaaatcccatagcattaccaatatggagatagggggactcaaaatttacgacatacttagcgataacgggcctcagcagccgagtaccacagtgaaaataacaagcgccgtggatggtaagaacattgtcagaagcaagtcggcaaccctcttatatgatcagcctctgcaggtcttcacagggagcagttcttctagtgacctgatcagcggaaccaaggccatcttcaagtttgactccaaccacaatccagaggaacccaacatcatacgcggacccacttcaggaccacaaagcgccccacagatttacgggccaccccagtacaacatacagtactcatcatcagcagctgtaaaagacactctgtggcactccaagcagaatcctcagatcgaccacgcgtctttccctccgcagctgctgccgagaagcgagtccactgagaatcaatcttacgctaagcactcggctaacatgaacttctcaaatcataataatgtgcgagctaatacagcataccatctgcatcagaggctgggtcctgcacggcatggcgagatgtgggctatcagccccaatgacagactgattcctgcagtgactcggagcaccattcaaaggcagtcatccgtatcatcaacagcatccgttaatctgggagacccgggttcaaccaggcgggctcagatccctgaaggtgactatctctcatacagagagttccactcggccggacggactccaccaatgatgcctggctcccaacgtcccctatctgctaggacctactccatcgacggtcctaacgctagccgaccacagtccgcccgaccaagcatcaatgaaatcccggagaggacaatgagcgtttctgatttcaactactccaggacctcaccctctaagcgcccaaacgcaagggtcggcagcgagcactccctgctggacccgcctgggaagagtaaagtcccacgggattggcgcgaacaagtgttacggcatattgaagctaagaaactggagaagatgcctctgtctaatggccagatgggacaacccctgcgccctcaggctaattacagtcagattcatcaccctcctcaggcctctgtcgcccgtcacccaagcagggagcagcttatcgactacctcatgcttaaggtggctcaccaaccaccttatacccaaccacactgtagtccgcgacagggacacgaactggcaaagcaagagattagagtgcgagtggaaaaggaccctgagctcgggttctcgatctccggaggcgttggtggcaggggcaacccatttcggcctgacgatgacgctaatggatactcctttatcaatattgagcacgggcaagccgtctctcttttgaagaccttccaaaacacagtggagttgatcatcgtcagggaggtctcctcatag

SEQ ID NO: 222169 - DNA, 4083 bp, Artificial Sequence
  Description of Artificial Sequence: Synthetic coding sequence
atgacgactaagcggtcactttttgttaggctggtgccttgccgctgtctaaggggggaagaggaaaccgtgacaactttagactattctcattgctctctggaacaagtgccaaaggaaatcttcacgtttgagaaaacccttgaggagttatacctcgatgctaatcagatcgaggaattgcccaagcagctgtttaactgccagtctctccacaaattaagcctccccgataatgaccttacaaccctaccagcttccatcgcgaacctgattaacttaagggaactggacgtgtccaaaaatggcattcaggagtttccagagaatatcaagaactgcaaagtcctgaccatcgtggaggcctctgttaacccaatcagcaaactgcctgacgggtttagccaattactgaatctaacgcagctatacctaaacgacgccttcctggaattcctgccagcaaactttggcaggcttacaaagctgcaaattttggagctgagagagaaccaactgaagatgctgcccaaaacgatgaaccgtctgacacagttagagaggctggacttagggagcaatgagtttactgaggtgccagaggtgcttgaacaattgtccgggctcaaagagttctggatggatgctaataggttgacctttatcccgggattcattggtagcttgaaacagctcacttacttagatgtgtcgaaaaataacatcgagatggtggaggagggcatcagcacctgcgagaatcttcaggacctgctgttgagcagtaattctcttcagcagttgcctgagactattggctcactcaagaatatcacaaccctgaagatcgatgagaaccagctgatgtatctgcctgactccattggaggcctgatctccgttgaggaactcgactgcagtttcaacgaggtggaggcattgccatcttcaatcggccagctgactaatctcaggaccttcgcagcagaccataactacctgcagcaactgccccctgagattggcagctggaaaaatatcactgtgctgtttcttcactctaacaaactggaaaccttacctgaggaaatgggggacatgcagaagctcaaggtgatcaatctctctgataatcgcctaaagaatctgccattttctttcactaagttgcagcagttaactgccatgtggctcagtgacaaccagagtaagccgttgatccctctgcagaaagaaacagactcggagacccagaaaatggtgctgacaaactacatgtttccacaacagccccgtacagaggatgttatgtttatttctgataatgaatccttcaaccccagcctctgggaggagcagcggaagcagagggcccaggttgcctttgaatgcgatgaggacaaggatgagcgtgaggcaccacctagggagggcaatctcaagcgataccctacaccgtatcccgacgaactgaaaaacatggtaaagactgttcagaccattgtgcaccgactgaaggacgaggaaactaacgaggattccggtcgagacctcaagcctcacgaggaccagcaggacatcaacaaagacgtcggtgttaagaccagtgagtctacaacaacagtcaagtcaaaggtggatgagagggaaaagtacatgattggcaactccgtgcagaaaatctccgagcccgaagccgagatctccccaggatctctgccagtgaccgcgaacatgaaagcctcggagaacctgaagcacattgtgaaccacgacgatgtgttcgaagagtcggaggagttgtcttctgacgaggaaatgaaaatggctgagatgcgtccccctttaattgaaacctccataaatcaaccgaaagtcgtggcactaagcaacaataagaaggatgacacaaaggagacagactctctgtcagatgaagtcacccataattctaatcagaataattcaaattgtagctcccccagccgaatgtctgactctgtgtctctcaacactgattcgtctcaggatacttcgttatgctcacctgtcaagcagacacatatcgacatcaattcaaagattcgccaggaggatgagaactttaattccctgctccaaaacggcgatatcctcaatagcagcacggaagaaaaatttaaggcccatgacaagaaggacttcaatcttccggaatatgacctgaatgttgaggaaagactagtgctgatcgagaaatccgtggacagtactgcaaccgcggatgacactcacaagctggatcacataaacatgaacctcaacaagctcattacgaacgatacttttcaacccgagatcatggagcgaagtaagactcaagacatagtacttggcactagtttcctaagcataaattcaaaggaggaaactgaacatctcgagaatggcaacaaataccccaacttagagtccgtgaataaggttaatggacactcagaagagactagccagtcaccaaaccgaaccgagccacacgatagcgattgcagcgtggacctcggaatctccaagagtacggaagacctgagtccccagaagtctggacctgtcggctccgtggtgaaatcccacagcataactaatatggagatagggggactgaagatttatgatattttgagcgacaatggcccacagcaaccctcgactacagtgaagatcacatccgcagttgacggtaagaacattgtgcgtagcaagtcagccacactgctttacgaccagccattgcaggtgttcactggctcctcaagctcttccgacctcatatccgggacaaaggcaatcttcaagtttgactccaaccacaatccagaggagcctaatataatacgcggaccaacttcaggtccccagtctgcccctcagatttatggccctccacaatacaacattcagtatagtagctccgccgcagtcaaggataccctttggcattccaaacagaaccctcagatcgaccatgcctccttccccccacagctgctgccccgaagtgaatccacggaaaatcagagctatgcgaagcacagtgctaatatgaactttagtaaccataacaacgtacgcgctaacacagcttaccatctgcatcaacggctgggtccagctcgccacggcgaaatgtgggcgatttcccccaacgataggctgattccggcagttacaaggtccaccatacaaagacaatcctccgttagctctaccgctagcgtgaacttaggcgaccctgggagtacacggcgtgcacaaattcctgaaggcgactatctctcatatcgtgagttccactccgctggcagaactccacccatgatgccaggttcccagcggccactaagtgcccgaacatacagcatcgatgggcctaatgcttctaggcctcagagcgccagaccctctatcaacgagataccagaacggactatgtctgttagtgatttcaactactctcggacctcaccttcaaagcgacctaacgctagagtgggctctgagcattccctgctcgatccgccagggaaaagtaaagtccctcgggactggcgagaacaggtgttgcgacatatagaggcgaagaagctggagaaaatgccgctctcaaacggccagatggggcagcctctgagaccacaggcaagcgtcgctcgacacccttcccgggagcagttgatcgattatttgatgcttaaggtggcgcaccagccaccatacactcagccccactgcagcccccgtcagggccacgaactagccaaacaggagatcagggtgagagttgagaaagatccggagctgggcttcagcatcagtggcggagtgggcggtagagggaatcctttccgtccggatgatgacggcatattcgtcaccagagtgcagcccgagggaccggctagcaaattactccaacctggtgataaaataattcaggccaacgggtatagttttatcaacatcgagcacggccaggcagtcagccttctcaagaccttccagaatactgtggaacttatcattgtccgagaggtgagcagctag

SEQ ID NO: 222170 - DNA, 4116 bp, Artificial Sequence
  Description of Artificial Sequence: Synthetic coding sequence
atgactaccaaacgctcactgtttgtccgtctagtcccttgtagatgtctgcggggagaggaggagaccgtgacgacacttgattacagtcattgcagcctggaacaggtcccaaaggaaatcttcactttcgagaaaactttggaagagctctatttggatgcaaaccagattgaagaattaccaaagcaactttttaactgtcaatcgttgcataagttaagcttgccggacaatgatctgactacgctgcctgcttctatagctaatctgattaacttgagagaactagacgttagcaaaaacggcatccaggaattccctgaaaatatcaagaattgtaaagtgttaaccattgtggaggccagtgtgaacccaatcagtaagctgcccgatggtttttcgcagttgttaaacctgactcagctgtatctgaacgacgccttcctggagtttctgccagccaacttcggcaggttaaccaaactccaaattttagaactacgggaaaaccagttaaaaatgctgcccaaaacaatgaaccggttgacccaactggagagactggacctgggcagcaatgagttcactgaggtgcctgaggttttggagcagctttctggattgaaagagttttggatggacgccaaccgtctgacattcatccccggattcatcggctctctgaaacagcttacatatcttgatgtgtcaaaaaacaacatagagatggttgaagaggggataagtacctgcgaaaatcttcaggacttgttgcttagctctaacagcctgcagcagcttcctgagactattggatcactgaaaaatattactaccctaaagattgacgaaaaccaactcatgtatttgccagattccattggagggttgatatccgtggaagagctggactgctcctttaacgaggtggaagccctcccctccagcattggtcagcttaccaatcttaggacatttgccgctgatcacaattacctccagcagcttcccccagagatcgggtcttggaaaaacatcactgtgctgttcctccactcgaacaaattggagaccctgcccgaagagatgggggatatgcaaaagctgaaagtgatcaacttgtccgacaataggctgaagaacctgccattcagcttcaccaagcttcagcagctcacagctatgtggctaagcgataaccagagcaagcccctcattccactccagaaggaaactgacagtgagacgcagaaaatggtattgactaattacatgttcccacagcagccacggaccgaggatgtcatgttcatttccgacaatgaatctttcaatcctagtctatgggaggaacagaggaaacagagggcacaagtggcatttgagtgcgatgaagataaagatgagcgtgaagcaccacctagagaagggaacttgaagcggtaccccacgccgtatccggatgagttgaaaaacatggttaagactgtgcagaccatcgttcaccgcctcaaggatgaagagacgaacgaggactctgggagagatctcaaaccccatgaagaccagcaggacataaataaggacgtcggggtgaaaacctccgaatccaccacgacggtgaaaagtaaagtggatgagagggagaagtacatgatcggaaacagcgtccagaaaatttccgaaccggaggcagagatatctcccggatcccttccagtgacagccaatatgaaagcctccgagaatctgaaacatattgtcaaccacgacgacgtcttcgaagagtcagaggagctgagctcggatgaggagatgaagatggccgagatgaggccccctttaatcgagacctctatcaaccagccaaaggtggtcgctctgtcaaataacaagaaggacgacaccaaggaaacagacagcctctccgatgaggttacgcataatagcaatcagaacaattccaactgttccagccctagccggatgagtgactctgtgtcgctgaatactgacagctcacaggatacttccttgtgttcaccggttaaacagacgcacatcgatataaattctaagattagacaggaggatgaaaactttaatagtctgctgcagaatggggatatcttaaacagcagcaccgaagagaagtttaaagcacacgataagaaggacttcaacctcccggagtacgacctgaatgtggaggaacgtttggtattaatagagaaaagtgtcgactccactgcaacggcggacgacactcataaactggaccacataaatatgaatctcaacaaactcataaccaatgatactttccaacccgagattatggaacggtccaaaactcaagacatcgtgctggggacatcttttttaagcataaattctaaagaggaaaccgagcatctggagaacgggaacaaataccctaacttggaatccgtgaataaggtaaacggacacagtgaggaaaccagccaatcgcccaataggaccgagcctcatgattcagactgcagtgttgaccttgggatctctaagagtaccgaggatctaagtccacagaagtcaggccctgttggaagtgttgtgaaatcccactccataactaatatggaaatcggaggccttaaaatttatgacatcctgagcgacaatggaccccagcagccatccacaacagtcaaaattacgagcgcagtggacggcaaaaatattgttcgcagtaagagcgctactctcttgtatgaccaacctcttcaggtcttcacgggaagctcctccagtagcgacctgattagtggcacaaaagcgatttttaagtttgattcaaatcacaatcccgaggaacctaatatcattcgcggtcctaccagcggtcctcagtcggctccacaaatctacgggccacctcaatacaatatccagtactcttcttccgccgcagtcaaggatactctttggcacagtaagcagaatcctcaaatcgatcacgcaagctttcccccacagctactcccccgttccgagagcacagaaaatcagtcctacgccaagcatagtgctaacatgaatttttccaaccataataacgtcagagccaacacagcgtaccacttacatcaacgccttggccctgcccgacacggcgagatgtgggctatcagtccaaatgatcggttgattccggcagtgacacgctcaaccattcagcgccagagtagcgtgagttccaccgcatccgtgaatctaggggatccagggtcgacgcgcagagcccagatccccgagggagattacttgtcataccgggaattccacagcgctggaaggacaccaccaatgatgcctggatcccagcggcctctctcagctcgcacctatagtattgatgggccaaacgctagtaggccacagtccgctcgtccatctattaacgaaattcccgagcgcaccatgtctgtgagtgactttaactattctagaacatctcccagcaaacgtcccaacgctagggttggatcagaacacagcttgctcgaccccccaggcaaatctaaagtccccagggattggagagagcaggtcctgagacacattgaagctaaaaagttggagaaaatgcccttatcgaatgggcagatgggtcagcccttacgtccacaagccaattattcacaaattcatcatcctccacaggcaagtgtcgcaagacaccctagcagggaacagttgattgattatctgatgctgaaggtcgcccatcagcccccatatacccagccgcactgctcgcccagacagggacatgaacttgcaaagcaggaaattcgagtgcgggtcgaaaaggacccagaactgggcttctcaatctcaggcggagtgggcggtcggggaaatccgtttagacccgatgatgatggcatcttcgttaccagggtccagcctgagggcccagcatccaaactgctgcagccaggcgacaaaatcatccaggccaatggttactcttttattaatatcgagcatggtcaggctgtgagtctgctgaagacgtttcagaacacagttgagctgatcatcgtgcgagaggtatcaagttag

SEQ ID NO: 222171 - DNA, 3909 bp, Artificial Sequence
  Description of Artificial Sequence: Synthetic coding sequence
atgacaactaaacgatcactttttgttagactggtcccctgccgctgtcttcgaggcgaggaagaaaccgtgacaactttggactactctcactgttccttagaacaagtgcccaaagagatcttcaccttcgagaagacccttgaggaactgtatctggatgcaaaccaaatcgaagaacttcctaagcaactctttaactgtcagtctcttcataagttgtcgctgcccgacaacgaccttacaaccctaccagcttctatagccaacctgatcaacttgagagaactggacgtgagcaagaacgggatccaagagttccccgaaaacatcaaaaactgtaaggtgctcacgatcgttgaagcctctgtcaacccaatttctaagttgccggatgggttcagtcagctgcttaatctcactcagctatacttgaatgacgcatttcttgagttccttcccgcaaatttcggcaggttgacaaaacttcagattttggagcttcgcgaaaaccagttgaaaatgctcccgaaaacaatgaacaggttgactcagctcgaacgcttggaccttgggtccaatgaattcacggaagtacccgaggtcctagaacaattgagcgggctgaaagagttctggatggacgccaaccgtttgactttcatccctggcttcatcgggtcccttaagcaactcacgtacctggatgtctctaagaataacatcgagatggtggaagaaggtatctccacctgtgagaacctgcaggatctgttactctcctccaattctcttcagcagctgcccgagaccattggctcactgaaaaacattaccacactgaaaatcgacgaaaaccaactgatgtatttacccgacagcatcggcggactcatttcggttgaggagttggattgctcgtttaacgaggttgaggcactgccatctagcattggccagctcacaaatctcaggactttcgccgctgatcacaactatttgcagcaattgccaccagagataggctcatggaagaacatcaccgtccttttcttacactccaacaaattggagaccctgccagaagaaatgggtgacatgcagaagctgaaagtcatcaatctgagtgataaccggctgaaaaaccttccattctctttcacaaagctgcagcaactcacagctatgtggctctccgacaatcaatccaagcctctgatcccacttcagaaagaaaccgactctgagacccagaagatggttttgactaactatatgttccctcagcagcccagaacagaggatgtaatgtttattagtgataatgaaagcttcaacccctccctttgggaggagcaacgcaagcaaagagctcaagtggcctttgaatgtgacgaggacaaagacgagcgggaggcaccgccacgggagggcaatttaaagcggtaccctacaccataccctgacgagcttaaaaacatggtcaagacggtgcagacaattgtgcaccgattgaaggacgaagaaactaacgaagattcagggagagacctgaagcctcatgaggatcaacaagacattaacaaagatgtaggcgtgaaaacatctgaatcaaccaccacagtgaaatcaaaagtagacgagcgcgagaagtacatgatcggtaatagcgtgcagaagatctccgagcccgaagccgagatcagccccggatccttgcctgtgaccgctaacatgaaggccagcgagaacctgaagcatatcgttaatcatgacgatgtcttcgaggagtccgaagagcttagttccgacgaggaaatgaagatggcagaaatgcgcccacctctgatcgagacaagcattaaccaacctaaagtcgtagcacttagcaacaataaaaaggatgacaccaaggagaccgattccctgtcagacgaggttacccacaacagcaatcagaataactctaactgctcatctccaagtcgaatgtccgacagtgtgtccctgaataccgattccagccaggatacctcactctgctctcccgtcaagcagactcacatagatatcaattccaaaattcgccaggaggatgagaattttaatagcctgttgcagaatggggacatccttaactcctccacagaggagaaattcaaagcccatgataagaaggatttcaatcttccagaatatgatcttaacgtggaagagcggcttgtgctgattgaaaagtcagtggatagtactgcgaccgcggatgatactcacaagctggatcacatcaatatgaatctgaacaaattgatcaccaacgacacattccagcctgagattatggagcgcagcaagacccaggacattgttctcgggaccagcttcctgtccataaattcaaaggaagaaaccgaacatcttgagaacggaaacaaatatccgaacctggagtccgtgaacaaggtgaatgggcatagtgaggagacaagccaatctcccaacagaacagagcctcatgactcggactgtagcgtcgatttaggtatttcaaaatccacggaagacctcagcccgcagaagagcgggcctgtggggagtgtagtgaaaagtcacagtatcacaaatatggaaatcggcggattgaagatctacgatattcttagcgacaacggtccacaacagccatctaccaccgtgaagattacatccgccgtggatggcaagaacattgtgcgtagtaaaagtgccaccctactgtacgaccagcccctacaggtttttactggttctagctcctcgagtgacctgatttctggaaccaaagccatattcaagttcgatagcaatcacaacccagaagaacctaacatcatcagaggcccaaccagtggccctcagtccgccccacaaatatatggtcctccccagtacaatattcaatactcttcttccgctgctgtgaaagataccctttggcactctaaacaaaatcctcagatcgatcacgcgtccttccctcctcaactgctcccacgctctgagtccactgagaaccaatcttacgccaagcattccgccaacatgaatttcagtaatcataataatgtccgggctaacacagcttatcacctgcaccagcgcctcggtccggctaggcatggggaaatgtgggcgatatcacccaatgataggcttatcccggcagttacaagatccacgatacagcgccagagctctgtctcgagcaccgcttcggtaaatcttggcgaccctgggtccacccgcagagcgcagataccagagggggactacctgtcttaccgggagttccattccgcgggaagaacacctcccatgatgcctggcagccaacgacctttgagcgcgcgtacctacagcatcgacggacctaatgccagccggcctcaaagtgctagaccttcaattaacgagattcctgaaagaacaatgtcagttagtgactttaattatagtaggaccagccccagcaagagacccaacgcaagggtcggtagcgagcattcactgctagacccccctggcaaaagcaaggtacctcgggattggcgggaacaggtccttaggcacatcgaagctaagaagctggaaaagattagagttagagtcgaaaaagacccggaacttggtttttccatctcaggcggtgttggtggccgtgggaatccctttcgcccagatgatgacgggatcttcgttacccgtgttcagcccgagggacctgcaagtaaactgctgcagcctggggacaaaataatccaggcaaacgggtactcgttcatcaatattgagcacggacaagcggtgtccctgctcaagactttccagaacacagtggagctcatcatcgtgagagaagtttccagctag

SEQ ID NO: 222172 - DNA, 4260 bp, Artificial Sequence
  Description of Artificial Sequence: Synthetic coding sequence
atgacaacaaagcgatcgttgttcgtgaggcttgttccatgtcggtgtctgcgaggagaagaagaaaccgtcacaactctcgactacagccactgttccctggagcaggtgcccaaggaaatctttacattcgagaagaccctggaggagctatatttggatgccaaccagatcgaagaacttccaaaacagctgtttaattgtcagagcctgcacaaattatcacttccggacaacgatttgactacattgccggcaagcatcgccaatctgattaacctgagagagctggacgtttccaagaatgggatccaggaatttccagagaatataaagaactgtaaggttctgactatagtcgaggcttctgttaatcccatctcaaaactcccagacgggttcagccagctgcttaatctgacgcagctgtatctgaatgatgcatttctcgaatttctgcctgccaatttcggtagactgactaagcttcagattctggagctcagggaaaaccagctgaagatgctgccaaaaactatgaacaggcttacccagttggagaggctagatctgggaagtaatgagtttacagaagttcctgaggtcttggagcagcttagtggcttgaaagagttctggatggatgcaaatcgccttacatttataccaggttttatcggctcactgaaacaactgacttatttagacgtcagcaagaataatatcgagatggtcgaggagggaatttctacatgcgagaacctccaagacctgcttttatcttccaactcccttcagcagctcccggaaaccatcgggtccctgaagaacattacgacactgaaaattgacgagaatcagcttatgtatctcccggacagtatcgggggactgatttctgtcgaagagctggattgcagcttcaacgaagttgaagccctcccttctagtattggacaactcacaaatctcagaaccttcgctgctgaccataactatctgcagcagttgccgccagagatcggtagctggaagaatatcacagtcctgtttctccactctaacaagctcgaaacattacccgaagaaatgggagacatgcagaaactaaaagttatcaacctgtcagacaaccgcctgaaaaacctgccctttagcttcaccaaactccagcaactgaccgcaatgtggctaagtgacaaccaaagcaaacctcttatccccctgcagaaggaaaccgactccgaaacacagaaaatggtgttaacaaattacatgtttccccagcagcctcgaaccgaagacgttatgttcatatcagataatgagagctttaacccttctttgtgggaagaacagcggaagcagcgagcacaggtggcattcgagtgtgacgaagacaaggacgagcgcgaagccccaccgagggaaggaaacctaaaacgatacccaactccttaccccgatgagctaaaaaatatggtgaagacagtgcaaaccatcgttcacaggcttaaggatgaggaaactaatgaagactccggaagagacctgaaaccccatgaggaccagcaggacatcaacaaggatgtcggcgttaagacttcagagagcaccaccactgtaaagtcaaaagttgatgaacgcgagaaatatatgattggcaattccgtccagaaaatcagtgagcctgaagcggaaatctcccctggcagtctcccagtcactgctaatatgaaggcttccgaaaatctaaagcatattgtaaaccatgacgatgtgtttgaggagtctgaggaactaagcagcgatgaggaaatgaagatggcggaaatgcgcccacctctgatcgagacttcaattaatcagcctaaggtcgtagccttatccaacaataagaaagatgacacaaaggagacagactctctgtccgatgaggtgacccacaacagtaaccaaaataactcgaactgctcatcacccagccggatgagcgatagcgtctccttgaatacagattcaagtcaggatactagcctttgtagccctgttaagcaaacccatatcgacattaacagcaaaatcaggcaggaagacgagaattttaactctttactccaaaatggtgacatattaaatagcagtactgaagagaagtttaaggcccatgacaaaaaagacttcaaccttccagaatacgatctcaatgtcgaagagcgcctggtccttatcgagaaatccgttgatagcacagctaccgccgacgacacgcacaagttggaccacattaatatgaacctcaataaacttataacgaacgatactttccaacccgaaatcatggaaaggagcaaaacacaggacatagtgctgggcacttctttcctgagcattaacagtaaagaggagaccgagcacctagagaatggcaataaataccccaaccttgagtcagtcaataaggtgaacggacattctgaagaaacatctcaaagcccaaataggacagaaccgcacgatagcgactgtagtgtggatttgggcatcagtaaatcaaccgaggatttgtcaccccagaaaagcggccctgtgggcagcgttgttaagtcccattccatcacaaacatggagatcggaggcttaaagatctatgacatcctgtctgataacgggcctcaacaaccatccacgactgtgaagatcacctctgccgtggacgggaagaacattgtgaggagcaaatcggcaaccctgttgtacgatcagccactgcaagtattcactggatcctcttcttcgagtgatctaatttccgggaccaaagccattttcaagtttgacagtaatcacaatcccgaagaacccaacatcataagagggcctaccagcggaccccagtccgctccccaaatctacggaccccctcagtacaatattcagtactcttcttcagctgccgtgaaagacacattgtggcatagtaaacagaatccccagattgaccacgcatcgtttccaccacagcttctcccacggtctgagtccacagaaaatcaatcttacgcaaagcacagcgctaatatgaatttcagcaaccacaacaacgtgcgggcaaatactgcttatcaccttcatcagcggttgggccctgcccgacacggtgagatgtgggcgatatcccctaacgataggctgattcctgccgtcactagatcaacgattcagcggcagtctagtgtttcatctactgcctctgtgaatttaggtgacccagggagcacacgcagggcccagattcctgagggagattatctgtcctacagagagttccatagtgccggtagaacaccccctatgatgcctggatcacagcgcccactgtcggcaaggacctattcaatcgacgggcctaatgcttcccgtccccagtccgctcggccatcaataaatgagatcccggagcgcaccatgagcgtgtctgattttaactactctcgcacaagcccttccaagcgacccaacgctcgggtgggttcagagcatagtctcctagacccgccaggcaagagtaaggtgcctagggactggcgcgagcaagtgcttcgccacattgaggctaaaaagcttgagaagtcaatgctgagtagatcgttcaacagtaattttaccacagtgtcgagcttccactgcggctcaagccgagatctgcatggcagtcaagggtcactggctctgtcagtggccgacaggcggggatccggcggacatatatttaggatgccactgtcaaatggacaaatgggacaaccactgcgccctcaggcgaactattcacagatccaccatccgccacaggccagcgtagcaaggcatccaagcagggagcagctgattgattatctgatgctgaaggttgcccaccagccgccatacacccagccacattgcagtcctaggcaaggtcacgagctggccaaacaagagatccgggtcagggttgagaaggaccctgaactggggttctctattagcgggggagtgggcggtagaggaaacccttttcgtcctgacgatgatggcatcttcgtgaccagagtacagccagaaggtcccgctagtaagctgcttcagccgggagataaaattattcaggcgaacggctacagctttatcaatatcgaacatgggcaagcagtgtccctgcttaagacattccagaacaccgtggagctgataatagtccgagaggtcagtagttag

SEQ ID NO: 222173 - DNA, 1158 bp, Artificial Sequence
  Description of Artificial Sequence: Synthetic coding sequence
atgaaggaggaagagggattcccggaggatgaggccacggaatcggaaaccctatcccttgtgaaggagctagacgccttccctaaggttcctgaatcctatgtcgaaacttctgcatcagggggtaccgtgtccctgatagcatttaccaccatggcattgcttacaattatggaattctcagtgtatcaagacacctggatgaaatacgaatatgaggtcgacaaggactttagtagcaagctgcgaataaacatagacatcacagtggcgatgaaatgccagtacgtgggcgcagacgtgttggatctcgctgagaccatggtggcctctgccgatgggctcgtgtatgagccaacagtgttcgatttgagtccacagcaaaaagagtggcagagaatgctgcagctgatccagtctcgcttgcaggaagaacacagcctgcaggatgtgatcttcaaaagtgcgttcaagtcaacctctacagcactgcctcccagagaggacgactctagccagtcccctaacgcttgccggattcatgggcatctatatgtcaacaaggttgccggaaacttccacataaccgtgggcaaggcaatacctcacccccgaggacatgcacatttagccgctctagtgaaccacgagtcatacaacttcagtcacagaattgaccacctgtcctttggcgaacttgtgcctgcgataattaaccccctggatggaaccgaaaagattgctatcgaccataaccagatgttccagtactttattactgtcgttcccaccaaactgcacacctataagatctcagccgacacccatcaattttctgtcactgaacgagagcgcattatcaatcatgcggcagggagtcacggggtaagcggcattttcatgaagtacgacttgtcatccctgatggtcacggtcaccgaggaacacatgcctttttggcagttcttcgtgcgactgtgcggaatcgtgggtggcattttcagcactaccgggatgctgcacggcatcggaaaattcatcgtagagatcatctgctgtcggttccgactgggaagttacaaaccagttaatagcgtgccctttgaggacggtcatacagacaaccatctgcccttacttgaaaacaatacccactag

SEQ ID NO: 222174 - DNA, 1134 bp, Artificial Sequence
  Description of Artificial Sequence: Synthetic coding sequence
atgaggagactgaaccggaaaaagactctcagcctcgtgaaggaacttgatgctttccctaaggtgccggagagctatgtcgaaacgagtgcgtccggcggaacagtgtcccttatcgcgttcactacaatggcactcttaaccatcatggaattctcagtgtaccaggacacctggatgaaatacgaatatgaggtggacaaggacttctctagcaaactgaggattaacatcgatatcacagtcgcaatgaaatgccaatatgtgggcgctgatgtgctggacctcgccgagacaatggtagcaagcgccgatgggttggtctatgaaccaacggtgtttgatctttccccccagcagaaagagtggcagcggatgctgcaattgattcagagtcgactgcaggaagagcattctcttcaggacgtgatcttcaagtccgcttttaagagcacttccactgccctgccccctagagaggacgacagcagtcagagccctaatgcgtgcaggatacacggccatctatatgtcaacaaggtggctgggaactttcacatcaccgtgggtaaagcaatcccccaccctcgcggacacgctcatcttgcagcactggtcaatcatgagtcatataacttttctcacagaatcgatcacctgagtttcggagagctcgttcccgcaatcataaatccacttgatgggacggagaaaatagccattgaccataatcagatgttccagtacttcattaccgtggtgcctacaaagctgcatacctacaagatctctgcggatactcatcagttcagtgtgactgagcgcgagcgaatcatcaatcacgctgccggtagtcatggagtatcaggtatcttcatgaagtatgatctttcctccctgatggtgacagtcactgaggagcacatgcctttctggcaatttttcgtcaggctttgtgggatagttgggggaatctttagcaccactggaatgctccatggtattggcaagttcatcgtcgagataatttgttgcagattccgactgggtagttacaaaccagtgaatagtgtcccctttgaggacggacataccgacaatcaccttcccttacttgaaaacaatacacactag

SEQ ID NO: 222175 - DNA, 663 bp, Artificial Sequence
  Description of Artificial Sequence: Synthetic coding sequence
atgcggcgactgaatcggaagaagacactgtccctggtgaaagagctggatgctttcccaaaggtacctgagtcttatgttgagacctcagccagcggaggcaccgtaagccttatagccttcaccaccatggccctgctgacaatcatggagttctccgtgtaccaggatacatggatgaaatatgagtatgaggttgataaagactttagtagcaagctgcgtatcaatattgacattacagtcgccatgaagtgtcagtacgtcggcgctgacgttttagacttagccgaaacgatggtagccagtgccgacggactggtatatgaacctactgttttcgatctatctccacagcagaaagaatggcagcggatgctgcaactaatacaatctaggctgcaggaggaacactcgctgcaggacgtgatctttaagagtgcattcaagtcaacttcgactgccctgcccccacgtgaagacgactctagccagagtccaaacgcgtgcagaatccacggccacttatatgtgaacaaagtcgccggaaacttccatattacagtgggaaaggccattccacaccctcggggacatgcccatctggccgctttagtaaatcatgagtcttacaatttctcccatcgtatagaccacctgtag

SEQ ID NO: 222176 - DNA, 216 bp, Artificial Sequence
  Description of Artificial Sequence: Synthetic coding sequence
atgcgccgactgaataggaagaagacactgagcttggtgaaggaactcgatgccttccccaaggtgcctgagtcttacgtcgagaccagcgctagcgggggaactgtgtctctgatagcttttaccaccatggcactgctgacaatcatggaattctcagtgtatcaggacacttggatgaaatacgaatatgaggtggataaggatttcagctag

SEQ ID NO: 222177 - DNA, 528 bp, Artificial Sequence
  Description of Artificial Sequence: Synthetic coding sequence
atgagaaggctcaatcggaagaaaactctcagtctggttaaggaactggatgcatttcccaaggttcctgagagctatgtcgagacatccgcttccggcggaactgtgagccttatcgccttcactaccatggctcttctgaccattatggaattttccgtgtaccaggatacctggatgaagtacgagtacgaggtagataaggatttctcctctaagctacgcattaatatcgacatcacagtggccatgaagtgccaatatgtcggggctgatgtgctagacctagccgagaccatggtggctagcgccgatggtttggtgtacgagcccacagtgttcgatctgtcaccccagcagaaagagtggcaaaggatgttgcagctgatccaaagccgcctccaagaagaacactctctgcaagatgtcatcttcaaatccgcttttaaatccacctcgactgccttaccaccgagggaagatgactcatctcagtcccccaacgcctgccgcatacacggccattag

SEQ ID NO: 222178 - DNA, 1158 bp, Artificial Sequence
  Description of Artificial Sequence: Synthetic coding sequence
atgccagagtacaagggcaggactgttcttgtgagggacgcacaggaaggttcggtgacgttacagatcctcgatgtgagactcgaggaccaggggtcctatcgctgtctgatccaggtgggcaatctgagtaaagaggacacagtgatcctgcaggtggcagcaccttctgtggggagtttgagcccctctgcagttgcgcttgctgtgattctgccggttttagtgctgctcataatggtctgcctgtgcctcatttggaaacaacgtcgggctaaggagaagctgctatacgaacacgtaacagaggtggataacctgcttagcgaccatgctaaagaaaagggcaagctacacaaagctgtcaaaaagttgcgcagcgagttgaagttgaaacgggctgctgcgaacagtggttggagacgggctcggttgcacttcgtcgcagtgacacttgaccccgacaccgcccaccctaaactcatcctgagcgaggaccagcgttgtgttcgactgggggacaggagacagcctgtgcccgataatccccagcgttttgattttgttgtttctatcctgggcagtgagtactttacgacaggttgccactattgggaggtgtatgtgggcgacaaaacaaagtggattctaggggtttgctccgaaagtgtgtcccgtaaaggcaaagtgacagctagcccggctaacggacactggctcttacggcagagccgcggaaatgaatatgaagcgctgacatcaccacagacttcttttagactcaaagaaccacctaggtgcgtgggcattttccttgattatgaggccggagtgatatctttttacaatgtgaccaacaagagtcacatctttacctttacacataatttttctggaccgctgcgccctttcttcgagccctgtttgcatgacggtgggaaaaacaccgctcctttggtaatctgtagcgagttgcacaagagcgaggagtccatcgtcccaaggcccgagggcaaggggcatgccaacggggatgtttccttgaaagtgaactctagcttactgccaccgaaggcccctgaactgaaggatattatccttagcctcccaccggacttggggccagccctgcaggaacttaaggcaccatctttctag

SEQ ID NO: 222179 - DNA, 1428 bp, Artificial Sequence
  Description of Artificial Sequence: Synthetic coding sequence
atggagatggccagcagtgccggaagctggctgtcaggttgtctgattcctctagtgtttttgcgtctgagtgtgcacgtatcagggcacgctggggatgccggtaagtttcacgttgcactgcttggaggtaccgctgagcttctgtgccccctgtctctatggccaggtaccgtccccaaggaggtgagatggctacgctctcccttcccccagcgatctcaagccgtgcacatcttccgagacggcaaggaccaagacgaagacttgatgcctgaatacaaaggcaggaccgtactcgtgcgcgacgcacaggagggttctgtgactctgcagattctggatgtcaggttggaggatcagggatcatacagatgcctcatccaggttgggaacctgtcaaaagaagacactgttatcctgcaggtggctgccccttcggtaggctctctgtctccttccgccgtggcactggccgtgatcctccccgttcttgtgctgctcattatggtctgtctctgtttgatctggaagcagcgtagagctaaggaaaagctgctatacgagcatgtgaccgaggtcgataaccttctctccgaccacgcaaaggagaagggcaaactgcacaaggcagtcaagaagctgagatcggaactcaaattgaaacgagctgctgctaattcgggctggcgaagagcaaggctgcatttcgtggctgtgacactggaccccgataccgctcatccgaagctcatactcagtgaagaccaaagatgcgtcaggctgggagaccggaggcagcccgtacccgacaatccacagcgcttcgactttgttgtctctatactgggctctgagtacttcaccactggctgccattactgggaggtttatgtaggtgacaaaacaaaatggatcctgggagtgtgctctgagtccgtgtcacgcaaggggaaggtgaccgccagtcccgctaacggccactggcttctccgtcagagtcgaggaaatgagtatgaagccctcacatcaccccaaaccagctttcgactgaaggaaccaccacggtgtgtgggcattttccttgattatgaggcaggcgttatttccttttacaacgtaactaacaagtcccatatattcacatttacacacaatttttcaggccctcttaggccatttttcgagccatgtcttcacgatgggggtaagaacaccgctcccctggtgatctgcagcgaactacacaagtctgaggagagcatagttcccaggcctgagggaaagggacacgcaaacggagacgtttcgctcaaggtcaactcatcccttttacctcccaaagcacccgaactgaaagacatcatccttagtctgcctcccgatctgggcccagcattacaggagctcaaagcaccctccttttag

SEQ ID NO: 222180 - DNA, 1428 bp, Artificial Sequence
  Description of Artificial Sequence: Synthetic coding sequence
atggaaatggcatcctcggcgggttcatggctgtccgggtgcctgatccctctggtatttctgcggctgtctgtgcatgtgtccggccacgcgggagatgcgggaaagttccatgtagcgctgcttgggggtaccgctgaactgctctgcccactgtcactgtggccagggacggtgcccaaggaggtgagatggttgcgaagtcccttcccacaacgcagtcaggcagttcatatctttagagacgggaaggatcaggatgaggacctcatgcccgaatataagggccgaactgtcctggtacgggacgcccaggagggctcggtgacactgcagatcctggatgtgagactggaagaccagggctcttacaggtgtcttatccaagtagggaacctcagtaaagaggacactgttatactgcaggtggcagcgcctagtgtcggatcacttagccctagcgctgtcgccttggccgtgatcctgccagtgctggtgctgctgattatggtctgcctgtgcctgatctggaaacagcgtagggccaaggaaaaattactgtatgagcacgtgactgaggtggataacctcctcagcgaccatgctaaggagaagggtaagctgcataaagccgtaaaaaaactcaggtctgagctaaaactaaaaagagctgcagccaattcgggctggcgccgtgcacgtctgcacttcgtggcagtgaccctggacccggataccgcacaccctaaactcattttatcagaagatcaaagatgtgtgcgcctgggagaccgtcgccaaccagttcctgacaatcctcaacgctttgacttcgttgtttccatcctcggcagcgagtattttacaacaggatgccattattgggaagtatacgtgggcgacaagaccaagtggatcttgggtgtctgcagcgagtcagtgtctcggaagggaaaagttaccgctagtcctgccaatggacactggctactgcgccagtcccgcggtaatgaatacgaagcccttaccagtccacagacaagtttccgccttaaagagccccctcgatgcgttggaatcttcctcgattacgaggccggagtgattagcttctataacgttaccaataagagtcacatcttcaccttcactcacaacttttccgggccactgcggcctttttttgagccctgcctgcacgacgggggaaaaaacacggcaccgttagtcatctgttctgagctgcataaaagtgaggagtcaatcgtgcctagaccagagggcaagggccatgccaacggggatgtctctcttaaggtgaatagcagtctgctaccgcctaaagcccctgaactgaaagatattattctatcgctgccaccagatctggggccagctctccaagagctcaaggcccctagcttctag

SEQ ID NO: 222181 - DNA, 2595 bp, Artificial Sequence
  Description of Artificial Sequence: Synthetic coding sequence
atgacaaccgaaaagtctctggttactgaggccgaaaatagccagcatcagcagaaagaagagggcgaggaggctatcaatagcggccagcaagagccgcagcaggaagagtcttgtcagaccgcagccgaaggcgacaactggtgcgagcagaagctgaaagcaagcaacggggacacgcctactcatgaagacttaactaagaacaaggagcggacctcggagtcccggggtttgtccaggttattctctagtttcctcaagaggcccaaatcccaggtgagcgaggaggagggaaaagaggtggaatccgataaggagaagggtgaaggcggacagaaggagattgaattcggtaccagtctggatgaggaaattatcctgaaagccccaattgccgctcctgaaccagaactgaaaactgacccaagtttggatctgcacagtctgagcagcgctgaaactcagcccgctcaggaagagttacgggaagacccagatttcgagattaaggagggagaggggctcgaggaatgcagcaaaatcgaggtgaaggaagaaagcccacagagcaaggcagagactgaactcaaggcatcacagaagcccattagaaagcaccgtaacatgcactgtaaggtcagcctccttgacgatacagtatacgagtgtgtggtagagaagcacgccaaaggccaggacctgcttaagcgagtctgcgagcacctgaacctgctagaagaggactacttcgggctggccatctgggacaatgcgacatcaaagacgtggctggacagcgccaaagagatcaagaaacaggtaagaggagtgccatggaatttcactttcaatgtcaaattttacccaccagacccggcacagctgacggaggatattactagatattatctgtgcctgcagctccggcaggacattgtcgcgggacggctgccctgttcatttgccactctcgcattgctggggagttatacgatccagtctgagctgggtgattatgacccagaactccatggggtcgattatgtttccgactttaaactggcgccaaatcagacaaaagaactcgaagagaaggtgatggaactgcataagtcgtacagatcgatgacacccgcacaggcagatctggaattcctcgagaatgctaagaagctttctatgtacggagtggatctgcacaaagcaaaagacctcgaaggagtggacattatcctcggtgtgtgtagttctggcttacttgtgtataaagacaagctccggatcaatcgcttcccatggcccaaagtactcaagatttcgtacaagcgttctagcttttttatcaagatcaggcctggtgaacaggagcagtacgagtcaactattggattcaagctaccgtcataccgcgcagcaaaaaagctatggaaggtttgtgtggagcatcatactttctttaggctgacttctactgatacaatccctaaatcaaaatttctggcattggggtccaagtttcgatacagcgggcgtacccaggcccagacacggcaggcttctgccctcattgatcgccctgctccccatttcgaacgaactgcgagtaagcgtgcttcccgaagcttagatggcgctgctgctgtcgattctgccgatcggagtccccgtcccacctccgctcccgcaatcacacagggccaagtggctgaagggggagttctcgatgcctccgccaaaaagacagtcgtgccaaaggcacagaaagagaccgtcaaggcagaggtaaaaaaggaggacgagcctcctgagcaggcagagcccgagcctactgaggcatggaaggtggagaagacacacattgaggtcactgtcccaacaagtaacggcgaccagactcagaaacttgcagaaaagacagaggacttgatccggatgcgaaaaaagaaacgagagcgcctcgatggggagaatatctatatccggcacagcaacctaatgttagaggacctcgacaaatcacaggaagagatcaaaaagcaccatgctagtatcagtgagctaaagaaaaactttatggagtcagtccccgagccgagaccttcagaatgggacaaacgactctctactcactcccccttccgtacgctcaacataaacggccagatcccgaccggggaagggccaccactcgtgaagactcaaactgtgacaataagcgacaacgccaatgcagtcaagtcggagattccgaccaaagacgtgccaatcgtgcacacagagactaaaacaatcacctacgaagcggctcagaccgatgataacagcggcgacctagatcccggagtgttgctgacagcgcagacaattacatccgagactccgagttccacgaccacaacccagatcaccaagaccgtcaaggggggtattagcgagacacggattgagaagcgcattgtcattaccggcgacgccgacattgatcacgatcaggttctggttcaggccatcaaggaggccaaggaacaacatcccgatatgtccgtcaccaaagtcgtggtccaccaggaaaccgagatcgccgatgagtag

SEQ ID NO: 222182 - DNA, 2328 bp, Artificial Sequence
  Description of Artificial Sequence: Synthetic coding sequence
atgaccaccgaaaagtcacttgtgactgaggcagagaactcccagcaccagcagaaggaagagggtgaggaggcaattaatagtggacagcaggagcctcaacaggaagaaagctgtcagactgcagccgagggtgacaactggtgcgagcagaagctcaaagcttccaatggggatacacccactcatgaggatctgacaaagaataaggagagaacaagtgagtcccgaggactttcccgtcttttcagttctttcctcaaaagaccaaagtcgcaggtttctgaggaggaggggaaggaggttgaaagcgataaggaaaaaggggagggcggacaaaaagagattgaattcggaacctctttggacgaggaaatcattctgaaagcaccaattgccgcaccggaacccgaactgaagaccgatccctccctggaccttcacagtcttagcagtgcagagacacagccagctcaagaagagctgcgagaagatccagattttgagataaaagagggcgaaggtctcgaggaatgctccaagatagaggtgaaagaagaaagtccccagagcaaggccgagaccgaactgaaagcttcacagaagcctattagaaaacataggaatatgcactgcaaggtctcattgctggacgacaccgtgtatgagtgcgtggtggaaacctggctggacagcgcgaaggagatcaaaaagcaagtacgcggagtgccctggaactttacattcaatgtgaagttttaccccccagaccctgcccagctgacggaggacataaccaggtattatctttgcctgcagttaagacaggacatcgtggccggacgcttgccgtgtagtttcgctacactggccctgctaggctcctataccatccaaagcgaactaggcgattacgaccctgaactccatggagtggactacgtcagcgattttaagctcgctccgaatcagaccaaggaattagaggaaaaagttatggagcttcataagtcttatcgctccatgactcctgctcaggccgatttagagtttcttgagaatgcaaaaaagctgagcatgtatggggtcgatcttcataaggccaaggatctggaaggcgttgacatcatactaggggtctgtagctccggcctgcttgtgtacaaagacaagctgagaattaatagattcccatggcccaaagttttaaaaatctcttataaacgctcctcttttttcattaaaattcggccaggcgagcaggagcagtacgagtcgactataggcttcaaactgcctagctatagggcggcaaagaagctgtggaaggtctgcgtggaacaccacaccttcttccggctcacatccacagacaccatcccaaagtcgaagttcctggctctaggcagtaagttcagatatagcggtaggactcaggctcaaactagacaagcaagtgcactcatagatcgcccagccccacatttcgagagaacagcttcaaagcgcgcaagccgatctctggatggtgcagccgctgttgatagcgctgaccggtccccgagaccaacaagcgcaccagcaatcacccagggccaggtggccgaagggggagtactggatgcttcggcaaagaagacagtggtccccaaggcccagaaagagaccgtcaaagccgaggtcaagaaggaagatgagccaccggaacaagcggaaccggaacctacagaggcctggaaggatctcgataagtcccaggaagagatcaagaaacaccacgccagcataagtgagcttaagaagaatttcatggagagcgtccctgagcctagaccgtcagaatgggacaaaagactgagtactcactcacccttccgaacgctcaatatcaacgggcagattccaaccggggagggcccacccttagttaagacacagaccgtgaccattagcgataatgccaacgctgtcaagtccgagattcctaccaaagatgttccaatcgtccataccgagaccaagacgattacctacgaggccgcacagaccgacgacaattcgggcgatcttgatccaggggtgttgttgacagctcagactataacctccgagactccatccagtactacgactacacagatcacgaagacagtgaaaggcggtatcagtgaaaccagaattgagaaaaggatagtgattacgggagatgccgatatcgaccatgaccaggtcctggtgcaggccatcaaggaagcgaaagagcagcaccctgacatgtctgtaactaaggttgtagtgcatcaagagaccgagatcgctgacgaatag

SEQ ID NO: 222183 - DNA, 1926 bp, Artificial Sequence
  Description of Artificial Sequence: Synthetic coding sequence
atgcactgcaaggtcagcctcttagacgatacagtctacgagtgcgtcgtagaaaaacatgccaaaggtcaggatctgctcaaacgggtgtgcgaacaccttaacttgctcgaagaagactattttggactggcaatatgggacaatgctacatccaagacatggctggacagcgccaaggaaatcaagaagcaggtacggggtgttccttggaacttcacctttaacgtgaaattctatccgcctgatcctgcccagttgactgaagacatcactcgctactacctctgcctgcagttgcgtcaggatatcgtggccggtaggcttccctgttcctttgccaccctcgcgctcctgggctcttataccatccagagcgagcttggggactacgatccagagctccatggggtcgattacgtgagcgacttcaagctggcccctaaccagaccaaggagctggaggagaaggtgatggaacttcacaaatcctacaggtctatgaccccagcccaggcagatttagaattcctggagaatgcgaagaaattgtctatgtacggggtggatttacataaagcaaaagatctggaaggtgtggatattatcctcggtgtctgcagctctggactgctggtctacaaggacaaactccgtatcaaccgttttccatggccaaaagtgctcaagatctcctataagcgcagctccttttttattaaaattcgtccaggagagcaggaacagtacgagagtaccatcggctttaaactgccctcttaccgagctgcgaagaaactgtggaaagtctgcgtcgagcaccatacctttttccggctcacaagcaccgacactatccccaagtccaagttcctagccctgggatcaaaatttcgctacagcggtcggacacaggctcagacgcgccaggcgtcggccctgattgatcgcccagccccacattttgaaagaacagcgagcaagcgggcttctcgcagcttggatggggctgccgctgtagactccgccgacaggagccctaggcctacttctgcacccgcaattacccagggccaggtcgctgagggcggagtgctcgacgcctcagcaaagaagaccgttgtcccaaaagcacaaaaagagacggttaaggccgaagtcaagaaggaagacgagccgcctgagcaggcggagccagagcctactgaggcgtggaaagtggagaaaacccatatcgaggtgacggtcccgacctccaatggcgaccaaacccagaagaagagagagcgcttagacggggagaacatctatatcagacactctaatcttatgctcgaagatcttgacaaatctcaggaggaaattaaaaagcaccatgcctctatatccgaactcaaaaagaattttatggaatctgtccctgaacccagaccgtccgagtgggacaagaggttgtctacacattccccatttcgcaccctgaatatcaatggccagatccccactggcgagggacctccgctagtgaaaacccagactgttacaatttccgataatgcaaatgccgtaaaaagcgagatcccgactaaggatgtccctatcgtacatacagaaaccaagaccatcacgtacgaagccgcacagacagacgataattccggggatttggatccaggagtgctgctgaccgcccagaccatcacgtctgagacgccttcttccaccacaactacccagatcactaagactgtgaaaggcggaatctccgagacaagaatcgagaaacgcatcgtcatcactggtgatgccgatatcgatcacgaccaggttctggtgcaggctatcaaggaggcaaaggagcagcatcctgatatgagcgtcaccaaagttgtcgtccaccaagaaactgagattgctgacgagtag

SEQ ID NO: 222184 - DNA, 2496 bp, Artificial Sequence
  Description of Artificial Sequence: Synthetic coding sequence
atgacaacagagaaatctctagtcactgaagccgaaaacagtcagcatcagcagaaagaggaaggcgaagaagccattaacagcggtcagcaagaacctcagcaggaagagagctgccagacagctgccgaaggtgataactggtgtgagcagaagctgaaagcttcaaacggtgatacgcccacacatgaagatctaaccaaaaacaaggagagaacaagcgagagccgcggactctctcgcctcttcagttcttttctgaagaggcccaaatcccaggtttctgaagaggaggggaaagaagttgaaagcgacaaggagaaaggggaagggggtcagaaagagatcgaatttggcacaagtctcgacgaagaaatcattttgaaggctccaatcgctgccccagagccggagctaaagactgaccctagcttagacctccactcgctttcctccgccgagacccagccggcacaagaagaactacgcgaagaccccgatttcgaaattaaagagggtgagggactcgaagagtgcagcaagattgaagtaaaggaggaatccccccaaagcaaagcagagactgaacttaaggcatctcagaagcccatccgcaaacatcgcaacatgcattgtaaggtttccctgctggacgataccgtgtacgaatgtgtggtggaaaagcatgcgaagggacaggatcttctgaaacgggtgtgtgaacacttaaacctgctggaggaagattatttcggcctggccatttgggacaacgccaccagcaaaacgtggctcgattctgccaaagagattaaaaagcaggtacgcggagtgccttggaacttcacctttaatgtgaagttttacccgcctgaccctgcccagctgaccgaggatataacccgttattatctttgtttgcagctgaggcaggatattgtggccggaaggcttccctgcagtttcgccacgttagcacttctcggatcttacactatccagtctgaattgggagattacgacccagagcttcacggagtcgactacgtgtcagattttaaacttgccccaaaccagacgaaggaactggaagaaaaggtgatggagttgcacaagtcctatcgcagcatgacacccgctcaagcagatctggaatttctcgagaatgctaaaaagttatctatgtacggtgtcgatctgcacaaagccaaggatctggaaggagtggacattatcttgggcgtgtgtagcagtggtctgctcgtctataaagataaactgcgcattaatcggttcccttggcccaaggtcctaaaaatcagttacaaacgcagttcattctttatcaaaatacggccaggcgagcaagagcagtatgagagcaccatagggtttaaactgccctcctatagagctgccaaaaaactgtggaaggtctgcgtagagcaccacacgttcttccgactgacctccaccgacaccatcccgaaatccaagtttctggcgctcgggagcaagttccgatattccggacggacacaggctcagactaggcaggcttcggccttgatcgataggccagctcctcacttcgagaggaccgcaagtaaaagagctagtcgctcacttgatggggctgcggctgttgactcagcagatcgctctccgagaccaacaagtgcacccgcaatcactcagggtcaggtggccgaaggaggcgtcctggacgcatcagcaaaaaaaaccgttgtgcctaaggctcagaaagaaaccgtcaaagcagaagtcaaaaaggaggatgagcctcccgagcaagctgagcccgagccgacggaagcctggaagaagaagcgcgaaaggctagatggcgagaacatctatatccgccatagcaacctgatgctcgaagacctcgataaatcacaggaggaaattaagaagcaccatgcttcaatttcagagctgaagaaaaacttcatggaaagtgttccggagccccgaccatctgagtgggacaaacgcctatctactcattcgcctttccgcactctcaacatcaacggccagatccctactggcgagggtcctcctttggtaaaaactcagaccgttacaatctctgacaatgccaacgctgtgaagagcgaaattcccacaaaggatgtgccaatcgtgcacaccgaaacaaagacgatcacatatgaagccgcacagaccgacgacaactcaggggaccttgaccctggcgtgctgctcacggctcagaccataacatccgagaccccctccagtaccacaaccacacagattacaaagactgttaaaggcggtataagtgagactagaattgagaaacgcatcgtgattactggcgatgccgatatagatcacgaccaggtgcttgtccaagcgatcaaggaggcaaaagaacagcatcctgacatgagcgtgactaaggtagtggtgcaccaggaaaccgaaatcgctgatgagtag

SEQ ID NO: 222185 - DNA, 2484 bp, Artificial Sequence
  Description of Artificial Sequence: Synthetic coding sequence
agggccagagcggctcggtctcaaaatgccgtgggaccggtgcccgcagctccttcacctgagaaaagcctggtaactgaagctgaaaactcccagcaccagcagaaagaggagggggaggaggccatcaactcggggcagcaggaaccgcagcaggaagagagttgtcagacggccgctgaaggtgacaattggtgcgagcagaagctgaaggcatctaatggggatacacccacccatgaggatctcaccaaaaacaaggagagaacctctgagagtcggggattgagtcggctgttttcatcctttttgaagcggccaaagtcacaggtgagcgaggaggaaggcaaagaagtagagagcgacaaagagaagggagaagggggtcagaaggaaatagaattcggcacctctctggacgaggaaattatcttgaaagctccaatagctgcaccagaacccgaactgaagaccgaccccagcctcgacttgcactcattgtcaagcgctgagactcagcccgctcaggaagaattgcgggaggacccagacttcgagatcaaggaaggcgagggcctagaggaatgtagcaagatagaagtgaaagaggagtcgcctcagagcaaggctgagaccgaattgaaagctagccagaaaccgattaggaaacacagaaacatgcattgtaaggtgagcctgctagatgataccgtgtacgaatgcgtcgtggaaaaacatgccaaggggcaggatctgctgaagagagtctgcgagcatctcaacctactggaggaggactacttcgggcttgcaatctgggataacgcaacatccaagacctggctggactccgctaaggaaatcaagaaacaggtccgcggtgtgccttggaacttcacattcaacgtaaagttctatcccccagaccccgctcagttgaccgaagacatcacacgatactatctctgtttgcagctgagacaggacattgtcgcgggtcgccttccatgcagcttcgctacactggcactcctgggctcctacacaattcagagcgaactgggcgactacgaccctgaactgcacggtgtagactacgttagcgacttcaaacttgcccctaaccaaacgaaggagcttgaagagaaggtgatggaacttcataagagctatcgatccatgactcctgcgcaagctgatctcgagttcctagagaacgccaagaagctgtctatgtatggcgtcgacctgcacaaagctaaagacttagaaggcgttgacattattctgggagtttgttcatcaggcctcttggtctacaaagataaactaagaattaaccggttcccttggccgaaagtcctcaagatctcttataaaagaagcagttttttcattaagatcaggcccggtgagcaggagcagtatgagtcaactattgggttcaaactgccttcatatcgtgcagccaaaaaactgtggaaagtctgcgtcgaacatcatacattttttcggttgactagcactgacaccatcccaaagtccaaattcctagctttaggctcaaaatttcggtactctgggcgaacccaagcccagacacggcaggcctctgccctgatcgaccgccctgctcctcactttgaaaggacagcaagtaagcgagcttccagatcactggatggcgctgctgcagtggattctgccgacaggtcccctcgccctacatccgctcccgcaattacccaaggacaggtggctgagggtggggtgctggatgcgagcgccaagaaaaccgtggttcccaaggcacagaaggagacggtcaaagctgaagtgaagaaagaggacgagccccctgaacaagcagaaccagaaccaaccgaagcgtggaaggatttggacaagagtcaggaagaaattaaaaagcaccatgcttcaatctccgaactgaaaaaaaacttcatggaatcagtgccagaaccccgtcccagcgagtgggacaaacggctttccactcacagtcctttcaggaccctgaacataaacggacagattccaacgggagaagggccacctctggtgaagactcagactgtaaccatttcagataacgcaaatgccgtcaaaagtgagatcccaacaaaagacgttccgatcgtgcacacagaaactaagaccattacttacgaggcagcacagaccgatgacaactcaggggacttggatcctggggtgctgctgacagcccagacaatcacttcggagaccccctcttccaccactaccactcagattacaaagacagtcaagggcggaatttctgagacaagaatcgaaaagcgcatagtgatcactggtgacgcagatatcgatcatgaccaggttctagtgcaggccatcaaggaggccaaggaacagcatcccgatatgagcgttaccaaggttgtagtacaccaggaaaccgagatagccgacgaatag

SEQ ID NO: 222186 - DNA, 2163 bp, Artificial Sequence
  Description of Artificial Sequence: Synthetic coding sequence
atgacgacagaaaagtccctggtgaccgaggccgagaatagccagcatcagcaaaaagaggaaggcgaagaggcaataaatagcggacagcaggagcctcaacaagaggagtcatgccaaactgccgctgagggggataactggtgtgaacaaaagctaaaggctagtaatggagatacccctacacacgaggacctgaccaaaaacaaagagaggaccagtgaatccagggggctctccaggctcttttccagtttcctgaaaaggccaaagagccaagtttcagaggaagagggtaaagaggtagaaagcgataaggagaagggagaaggagggcagaaagagattgaattcggcactagcctggatgaggagattatcttgaaagcacccatcgccgctcccgaaccagaattaaagactgaccccagtttggatcttcactcactgagctcagccgaaacccagcctgcacaggaagagttgcgagaagaccccgacttcgagataaaggaaggggaggggcttgaagaatgttctaaaatcgaggtgaaagaggagtcgcctcagtctaaagctgaaaccgagctaaaagcaagccagaagcctatacggaaacatcggaacatgcattgtaaagtgtccttacttgacgatacagtttacgagtgtgtggtggagaaacatgccaaaggccaggacctgctcaaaagggtctgcgagcacctcaaccttcttgaggaggactactttgggctcgcaatatgggacaacgccacaagcaagacttggttggattcagcaaaagagataaagaagcaagtaagaggagtcccttggaattttacttttaatgtgaagttttaccctcccgaccccgctcagttgacggaggacataacgcgctattatctgtgtttgcagctgcgtcaggatattgttgcaggtcgattaccatgcagcttcgccacgctggccctcctgggctcctataccatccagtccgagctcggagactacgaccctgagctacatggagtggattacgtgagtgactttaagctggcccctaatcagacaaaggaactcgaggaaaaggtcatggaattacacaaatcttaccgttccatgacacccgcacaggcagaccttgagtttttggagaacgccaagaaactatccatgtacggcgtggatctccataaggctaaagatctggaaggtgtggacattatcttgggggtgtgctcaagcggacttctggtgtacaaggataagctgcgcattaatcggttcccatggcccaaggtgctgaaaatatcttacaagaggtcaagtttttttatcaaaataagaccaggcgagcaggaacagtatgagtcaacaatcgggtttaagttgccgtcctaccgggctgccaagaaactctggaaggtttgtgtagagcatcacaccttcttccgtctcacatctacggacaccatacccaagtcaaagttcctggcactagggtctaagtttcgctattccggacggacccaagctcagacgcgtcaggccagcgccttgattgatagacctgctcctcacttcgaaaggactgcaagcaagcgtgcatctaggtctctagacggagccgctgcggtcgactcggccgaccggtcaccccgtcccacctccgctcctgccatcactcaaggacaagtcgctgagggcggagtgttggatgcctcagcaaagaagactgtggtgcctaaagcccagaaggagactgtgaaggccgaagtgaaaaaagaggacgaaccccctgagcaggcagagcccgaacccacagaggcctggaaggtcgagaaaacccacatcgaggtgacagtgcctactagtaatggagatcagactcagaaaaagagggagcggttggacggtgaaaatatttacatacgtcattctaacctgatgctggaagatctggacaaatcccaagaagaaatcaagaaacatcacgcctcgatcagcgaactgaagaaaaatttcatggaatctgtgcctgaaccaagacccagtgagtgggataaacgtctaagcacacactcccccttcaggacgttaaatattaacggccagatacccacaggggagggggtctccaccctctctacctag

SEQ ID NO: 222187 - DNA, 2595 bp, Artificial Sequence
  Description of Artificial Sequence: Synthetic coding sequence
atgaccaccgagaaaagtttggtgacagaagcggagaactcccagcatcagcagaaagaagaaggcgaggaggctattaactcagggcagcaggaaccacagcaggaagagtcctgtcagactgctgcagaaggagacaattggtgtgagcagaagcttaaagcctcaaatggtgatactcccacacatgaggacctcactaagaacaaagaacgaacatctgaatcacgtgggctctcccgtcttttttcatcttttttgaaacgaccaaaatcccaagtcagcgaagaggagggaaaagaggtagagtcggacaaggaaaaaggcgaaggaggccagaaggaaatcgaattcggcacctcccttgacgaggagataatcctgaaggcccctatagccgctcccgagccagaattgaaaaccgatccaagcctagaccttcactcgctgagttctgcggagactcagcctgctcaggaagaattgcgcgaggacccagattttgagatcaaggaaggtgagggactggaagagtgttctaagattgaggtgaaagaggagagcccacagagcaaggccgagacagagcttaaagccagtcagaaaccaatcaggaagcatagaaatatgcattgcaaggtatctctgttagacgacacggtgtatgaatgtgtggtggagaagcatgctaagggacaagacctgcttaaacgagtgtgcgagcatcttaatctgctcgaggaggattatttcgggctggccatctgggacaacgccacaagcaaaacatggctggactccgctaaagaaatcaagaagcaggtgcgaggcgtcccttggaatttcacttttaacgtcaaattttaccccccagaccccgcacagctgacagaagatatcaccaggtactacctgtgtctccaactccggcaggacattgttgccggacgtctgccttgcagcttcgctactcttgctctactcggaagctatacaattcagtcagagctcggcgactacgatcccgagctgcacggcgttgattatgtatctgactttaaactggcacctaaccagactaaagaacttgaggagaaagtcatggagcttcataagagctatcgcagcatgacacctgctcaggctgacctggagttcctcgaaaatgccaagaaacttagcatgtatggtgtcgatcttcataaagctaaagatctggagggcgtggacatcatactgggtgtgtgtagcagtggcctgctcgtttacaaagataaactgaggattaaccggttcccctggccaaaggtgctgaaaatttcttataagcgcagctcctttttcataaaaatccgtccaggggaacaagaacagtatgagagcactattgggtttaagctgcccagctatcgcgctgcaaagaagctgtggaaagtgtgcgtggagcaccatacatttttccgcctcacgtccactgacaccatcccaaagagtaagtttctcgcacttggatccaagtttagatactccggtcgcacccaggcccagacccgacaagcaagcgcactaatcgaccgccctgcaccccacttcgagagaaccgcatcaaagcgggcttcccgctcactcgatggggcagccgcagtcgactccgccgatagaagcccaagacccacctccgccccagctatcacacaagggcaagtggcagagggcggtgtactcgacgcctccgcaaaaaagacggtagtgcccaaagcacaaaaagagactgtcaaagctgaggtaaagaaggaggacgaacccccagagcaggcggagcccgaacctaccgaggcatggaaggtcgagaagacccatattgaagtgacagttccaacctcaaacggggaccaaacacagaagctagccgagaagactgaggatctgattagaatgcggaaaaaaaaacgcgaacgcctagatggtgagaatatctacatccgtcatagtaatttgatgttagaggatctggacaagtcccaggaagaaatcaaaaaacaccatgcatccatctcagagctcaagaaaaacttcatggaatccgtgcccgaacccagacctagcgagtgggacaaacgcttgtccacacactccccgtttcgcacactcaatattaatggccagatcccaacgggggaaggcccacccctcgtgaaaactcagacagtgacaatctcagataacgccaatgccgtcaagtccgaaattcctacgaaggacgtacccatagtacacacagagacaaaaaccatcacatacgaggccgctcagacagacgacaacagtggtgacttagacccgggagtactcctgacagctcagactataaccagtgaaaccccgagcagcacaacgaccacccagatcaccaagaccgtgaagggtggcattagtgaaactagaatagagaagaggatcgtcattacaggtgacgctgacatcgatcatgaccaggtattggtgcaggctataaaagaggcaaaggaacaacaccccgatatgtccgtgacgaaggtggtggtgcaccaggaaacagagattgctgatgagtag

SEQ ID NO: 222188 - DNA, 1767 bp, Artificial Sequence
  Description of Artificial Sequence: Synthetic coding sequence
atgcattgtaaggtttctctgctcgacgacaccgtatatgagtgtgtggtggaaaagcatgccaaaggtcaagacctgctgaaacgtgtttgcgagcacctgaatctgttagaggaggactactttggattggcaatttgggacaacgcaactagcaagacctggctggatagcgctaaggagatcaaaaagcaggtccgcggtgtgccttggaatttcaccttcaacgtgaagttttacccccctgatcctgcccagctgacagaagatatcacccgctactacctgtgcctgcagcttcgccaggacatcgtggctgggaggttgccatgttcttttgccacattggccctgcttggcagctatacaattcagtcagaactcggagactatgaccctgagttacatggggtagattacgtgtctgatttcaagcttgccccaaaccaaaccaaagagctggaagaaaaagtcatggagctgcacaagtcctacagaagcatgaccccagcccaagccgatttagaatttctggaaaatgccaagaaactgagcatgtacggggtcgacttgcacaaagcaaaagacctggagggcgttgacattattctcggcgtctgtagctccggcctcctggtgtataaggataagcttcggattaaccggttcccttggcccaaggtgctcaaaatttcttacaaaagaagcagttttttcataaagatacgcccaggtgaacaagagcagtacgagtctacaatcgggttcaagttacctagctatcgcgctgctaaaaaactgtggaaggtctgtgtagagcatcacacgttctttagactcacctcaactgacaccattccgaagagtaaatttcttgctcttggctctaagtttcgctactccggccgaacccaggcccaaacacggcaggccagcgcgttaattgatcggccagcgccacatttcgagaggactgcctccaaacgagcttcccgctccctggacggtgctgccgcagtagatagcgcggaccgatcccccaggccaacttccgctcccgcaatcacccaggggcaagtcgccgaggggggagtgctggacgccagcgcaaaaaagaccgtggtccctaaagcccaaaaagagaccgttaaggccgaggtaaagaaggaggacgagccaccagaacaagcagagcccgagcctacagaagcatggaaaaagaaacgggagcgcctggacggcgaaaatatttatatcaggcattccaacttgatgctggaggacctcgataagtcccaggaagaaattaaaaagcatcacgctagtatcagcgaactgaaaaagaacttcatggagagtgtcccggaaccacggccttccgagtgggacaagagattgtctacacactcaccgttcagaacactcaacatcaatggacagatccccacaggggagggaccgcctcttgtaaaaacgcaaacagtcactataagtgacaacgctaatgcggttaaatcagagattccaaccaaggacgtgcccattgtccacactgagaccaagactataacctacgaagccgctcagactgtgaaaggcggtattagtgaaactagaatcgagaagagaatagtaatcaccggagacgccgacatcgatcacgatcaagttttggtccaggccatcaaggaagccaaggagcagcatccagacatgtctgtgactaaagtggtcgtccatcaggaaacggagatagccgatgaatag

SEQ ID NO: 222189 - DNA, 2115 bp, Artificial Sequence
  Description of Artificial Sequence: Synthetic coding sequence
atgaccaccgagaaatcgcttgtgacagaggctgagaattcccagcaccagcagaaagaggaaggagaagaggcgatcaactccggccagcaggaaccacaacaggaggagtcttgtcaaacagccgcagaaggtgacaattggtgtgagcagaaactgaaggcgagcaatggggacaccccaacacacgaagatctcacaaagaacaaagagagaacctccgagtcacggggattgtcccgactgttcagcagttttctgaagaggcccaaatcacaggtaagcgaagaggaaggcaaggaggtggagtccgataaagagaaaggcgaagggggacagaaagaaatagagtttggtaccagtcttgatgaggagattattctgaaggctcctattgccgctccggaacctgagctgaaaacagaccctagcctcgatctgcatagtctttccagtgccgagacccagacttggctggatagcgccaaagagattaaaaaacaggtgcgcggagtcccttggaacttcacatttaacgtgaagttttatcctcctgatcctgcacagctcacggaagacataactaggtattatctgtgtctgcagctgcgccaagacatagtagccggtcgccttccctgtagcttcgcaacactggccctcctgggatcctatactattcagagtgagttaggtgattacgaccctgagctgcatggggtcgactacgtgagcgactttaagttagcacccaaccagacaaaagagctggaagaaaaggtgatggaactccataagagttatcgttcaatgacccctgcccaggccgacctggaattcctggagaacgcaaaaaagttgagtatgtacggcgtggacctccacaaagcaaaggacttagagggagttgacattattctgggggtctgttcttctgggctgctggtgtataaagacaagttgagaattaacaggtttccatggcctaaggtcctgaaaatttcttataagcgcagttccttcttcattaagatccgccctggtgaacaggagcagtacgagtctaccattgggttcaaactccctagttatagggcagcaaagaaattgtggaaagtttgcgtggaacatcatacattttttagactgacttccaccgatacaatacctaagtcaaagttcctagctcttggatccaagtttcgttacagtggcagaactcaagctcagacgaggcaagcctcagccctcattgataggcccgctcctcacttcgagaggactgcctcgaagagggcaagcaggtctctggacggcgctgccgcagttgattccgccgaccgctcccccaggccgacgagcgcaccggctatcactcagggacaggtcgcagaaggtggcgtactcgatgcctcggcaaaaaagactgtcgtccccaaagcccagaaggaaaccgtcaaagctgaggtaaaaaaagaggatgagcctcctgagcaggccgaacccgaaccaactgaagcctggaaggacctcgataaaagccaggaagagattaagaagcaccacgcaagcattagcgaactgaagaagaatttcatggagtctgttccagagcccaggccctctgagtgggataaaagactttccacccattcaccgtttagaacacttaacattaatggacaaattccaacaggtgagggaccacctttggttaagacccaaacagtaacaatcagcgacaacgccaatgctgtgaagagcgagattcctactaaggatgtcccaatcgttcatacagaaacaaagactattacctatgaggccgcacaaacagacgacaattcgggagacttggacccgggagtgttgttgacagcccaaacgatcactagcgagactccttcatcaacaaccacgacccagatcacgaagactgtgaaagggggtatttccgagactcgtatcgagaaacgtattgtcattacaggagacgcagacattgaccacgatcaggtgctggttcaagccataaaggaggcaaaggagcagcatcctgatatgagtgtgacaaaagtggtggtccaccaggagaccgagatcgccgacgagtag

SEQ ID NO: 222190 - DNA, 2304 bp, Artificial Sequence
  Description of Artificial Sequence: Synthetic coding sequence
atgaccaccgagaaatcactagtgaccgaagccgagaactctcaacaccagcaaaaggaagagggggaagaagcaatcaatagcggccaacaagaacctcagcaggaggagagctgtcagaccgctgccgagggagacaattggtgcgaacagaaattgaaggcaagtaacggggatacacccacccatgaggacctcacaaaaaacaaagagaggacaagtgagtcaagaggactgtcccgcctgtttagctccttcctgaaaaggcctaagtcccaggtgagcgaggaagagggcaaagaagtagaatcggacaaggagaaaggcgaagggggtcaaaaagagatcgaatttgggacaagtttggatgaagaaatcatcctgaaggccccaatagcagcacccgaacctgagctaaaaactgacccaagcctggacctccactctctcagcagcgcggaaacccagccagcccaggaggaactgcgggaggatcctgatttcgagatcaaggaaggtgagggcctggaagaatgtagcaagattgaagtgaaggaagaatcaccacagagcaaagccgagactgaactgaaagcatctcagaaacccatcagaaaacatcgcaatatgcactgcaaggtctcacttctcgacgacaccgtatatgaatgtgtagtggaaaaacatgctaagggacaagacctactcaaaagagtgtgcgaacatctaaatctcttggaagaggactacttcggcctggctatctgggacaacgcaacaagtaagacctggctggatagcgccaaagaaataaagaagcaggtgcgcggtgttccttggaattttacttttaacgtcaagttctacccaccagaccccgctcagctaaccgaggacataacgagatactacctgtgcctgcagctgcgccaagatattgtggcaggaaggttgccatgcagttttgccaccctcgctctcttgggcagctacaccatacaatctgaacttggtgactatgatccagaactgcatggagtggactatgtcagtgatttcaagctggcccctaaccagacgaaggaactagaagagaaagttatggagttgcacaagagctacagaagcatgacccccgcacaggcagatctggagttcttagagaatgccaaaaagctgtctatgtatggcgtcgatctgcacaaagccaaggatctcgaaggcgttgatattattttgggtgtgtgcagctccggtctgttggtgtataaggataaactccgcatcaatagatttccatggccgaaggtattgaagatcagctataaacggagttctttttttattaagatccggcctggcgagcaagagcaatacgaatcaaccatcggcttcaagctcccttcctaccgagctgctaaaaagctgtggaaggtgtgtgtcgaacaccacactttctttagacttacttcgactgatacgattcccaagtctaaatttctggctctcggatccaagttccgctactcaggcagaacgcaggcccagaccaggcaggccagtgctcttattgatcgtccagcaccacactttgagaggaccgccagcaagagggcttccaggagcctagatggagccgctgctgtagattccgcagatcggtctcccagacctacttcggctcccgcaattacccagggacaagtggccgaaggaggcgtcttggatgcatctgcgaagaagaccgtcgtgcctaaagctcagaaggagacggtcaaagcggaagtgaaaaaagaggatgaaccgcctgagcaggccgagcctgagcctaccgaggcgtggaaggacctggacaaatcccaggaggaaattaagaagcaccacgcctctatatcggagcttaagaagaactttatggagagcgttccagaaccgagaccatccgaatgggacaaacgcttgagcactcacagtccctttaggaccctgaatataaatgggcagattccaaccggggaaggcacggatgacaattcaggggatctggatcctggggtcttgctcaccgcccagacaataaccagcgagaccccttcttccacaacaacaactcagattactaaaacagtcaaaggcggaatttctgaaacccgcatcgaaaagcgcattgtgatcaccggcgatgccgacatcgaccatgaccaggtgttggtgcaggccataaaggaagccaaagagcagcaccccgatatgagcgtaacaaaggtcgttgtgcaccaggagactgagatcgccgatgagtag

SEQ ID NO: 222191 - DNA, 2145 bp, Artificial Sequence
  Description of Artificial Sequence: Synthetic coding sequence
atgactactgagaaatccctcgtgacggaagcagagaacagccagcaccagcagaaagaggagggggaagaagcaattaattccggacagcaggaacctcagcaggaagagagttgccagactgccgctgaaggggacaactggtgtgagcagaagctgaaggcctccaatggagacacccctactcatgaggatctgacaaagaataaagaaaggacctctgagtcaagggggttgagtaggcttttctcctcatttttaaagaggccaaaatctcaggtatcggaagaagaggggaaggaagtggagagcgacaaggagaagggcgaaggcggtcagaaggagattgagtttgggacaagcctggacgaggagattattttgaaggctccgatcgccgctccagaaccggaactgaagactgatccaagtctcgatctacactctttgtccagtgctgaaacccaaccggctcaggaggaactgagggaagaccccgattttgagatcaaggagggggaaggactagaagagtgtagtaagatagaagtgaaggaggaaagccctcagtccaaagccgaaactgagctgaaagccagccagaagcccattcgaaagcacaggaacatgcactgtaaggtgtcactgctggacgacactgtgtatgagtgcgtggttgaaaagcacgccaaaggccaagacctcttaaaacgagtttgtgagcacctgaacttattggaagaggattacttcgggctggccatttgggacaatgcaacatcaaagacctggctcgatagtgccaaagagattaagaagcaggtcagaggcgtcccatggaatttcactttcaacgtcaagttttacccgccagaccccgcacagttgaccgaggacattactaggtattacctctgtctacaactgcgacaggacatagttgccggacgtctcccttgctcatttgcaactctggcgctactaggcagctacacaatccagtccgagcttggggattatgaccccgagctgcacggagtggattatgtgtcagatttcaaactcgccccaaatcaaactaaggagcttgaagagaaagtgatggagttgcacaagagttataggtctatgacacctgctcaggcagacttggaatttctggagaatgcgaagaaactctcaatgtatggcgtggatttacacaaagctaaggacttggagggagtggatataatcctgggagtctgttcaagtgggctcctggtgtataaggataaattgcgtattaaccgattcccatggcctaaggtacttaagatttcttataaacgcagttcatttttcattaagatacggccaggcgagcaagagcagtatgagtctacaatcggtttcaaactgccaagctatagggctgccaagaagctgtggaaggtgtgtgtcgagcatcacaccttcttccgcctcacttctacagacacaattccaaaatccaagtttctggctttggggtccaaatttaggtacagcggacggacccaggctcagacgcggcaggctagcgcacttattgaccgcccagccccacacttcgagaggacagcgtcgaagagagcctctaggtcattagacggcgcagctgcagtcgacagcgccgatcgatcacctaggccaactagtgctccagctatcacacaggggcaggtggcagagggtggcgttctggatgcctccgcgaagaagaccgtggttcccaaggcacagaaggagacggtgaaagcggaagtcaaaaaagaggatgaaccgcctgagcaagcagaacccgaaccaaccgaagcatggaaggtggaaaagacacacatagaggtgaccgtccctacctccaatggcgaccagacgcagaagaagagagagagactggacggtgagaatatctacataagacattccaatctcatgctcgaagatttggacaaatcccaggaagagatcaagaagcaccatgcctctatctcagaacttaagaagaacttcatggaatcagttccagaacctcgccctagcgagtgggacaaacggctgtcaacccacagtccattccggacactaaatattaacgggcagattccaaccggtgaaggatag

SEQ ID NO: 222192 - DNA, 2061 bp, Artificial Sequence
  Description of Artificial Sequence: Synthetic coding sequence
atgggctgcttttgcgccgttcccgaggagttttattgcgaagtactgcttctcgacgagagtaagttaacacttaccactcagcagcagggaatcaagaagtcaacaaagggttccgtggtgctggatcacgtcttccatcacgttaacctggtagagatcgactacttcgggttgagatactgcgatcggtcacaccagacctactggctagatcctgcgaaaacgttagcggagcacaaagagttgattaacactggcccaccctacactctctacttcggcattaaattctacgcagaagacccttgcaaactcaaggaagaaatcaccaggtatcaattttttcttcaggtgaagcaggatgtgctacaaggtcgcttaccgtgccctgttaatacggctgcgcagctaggcgcttacgccattcagagcgagctgggcgattacgacccttataaacacacagcgggttatgtaagtgaatatagatttgttccagatcagaaagaggagctggaggaagccatcgagcgcattcacaagactctgatgggacaaatcccatcagaggcggaactgaactacttacgaaccgctaagagcctcgaaatgtatggcgtagacctacaccctgtgtatggagaaaataagtcagagtatttcctcggactgaccccagtcggggtggtcgtttacaaaaataaaaagcaggtgggcaagtacttctggccaagaatcacaaaagtgcactttaaagagacccagtttgagctgagagtgttaggcaaggactgcaatgagactagcttcttttttgaggctaggtccaagactgcttgcaagcacttgtggaagtgctcagtcgagcaccatactttttttcggatgcccgaaaacgagagcaattccctcagccggaagctttcgaaatttggctccattcgctataaacaccgctacagtggtcggacagctctacaaatgagtcgggatctctcaattcaattgccaaggcctgaccagaacgtgacacggagccggagcaaaacctaccccaaacgaattgctcaaacccagcccgcagagtcaaactccatctcacgcattacagctaacatggaaaacggcgaaaacgaaggtaccattaagattatcgcgccttccccagtgaaatcatttaagaaggcgaaaaacgagaactctccggacacacagcgtagtaaatctcacgctccttgggaggaaaacgggccacaatctggcctgtacaactcacctagtgataggaccaagagtccgaagttcccgtacacccgcaggaggaatccctcctgcggcagcgacaacgatagtgttcagccggtgcggcgtaggaaagcccacaattccggggaagattccgaccttaagcagaggcggcgatctcgctccagatgcaacacatccagcgggagcgagagcgagaactcaaacagagagtatcggaaaaaacggaaccgcattcgtcaggaaaacgacatggtggactcagcccctcagtgggaagccgtgctgagaagacaaaaggaaaaaaaccaagctgacccaaataatagacgctcccgccatcgctcacgcagccggtctcctgatattcaggcaaaggaggaactctggaaacatattcagaaggagctcgtcgatccctctggtttgtcggaggagcaactgaaggagataccctatactaagatcgagactcagggcgatcctattaggattcgacatagccacagccccaggtcttaccgccaatataggcggtcacagtgttctgatggtgaacgtagtgtgctctcagaggttaactcaaagactgacctcgtaccccctcttcctgttaccaggtcgtctgacgcgcaggggtccggagacgcaaccgttcaccagcgcaggaatgggagcaaagattccctaatggaagaaaaacctcagacttctactaataatctggccggtaaacatacggccaaaactattaaaaccattcaggcgtcaagactgaaaactgaaacatag

SEQ ID NO: 222193 - DNA, 1836 bp, Artificial Sequence
  Description of Artificial Sequence: Synthetic coding sequence
atggatttcaagaaatcaaagctgacattggtggtggtcgaggatgacgaccaggggcgagagcaggaacatacttttgtgtttagactggacagcgcgcgtacctgcaagcatctctggaagtgcgcagtggaacaccacgccttttttcgcctgcgaaccccgggaaatagcaagtcaaacaggagtgatttcattcgcctaggctctaggttcaggttctctggacggactgaataccaggcgacacatgggtcccgcctcaggaggacttccaccttcgagcgcaagccctccaaaaggtatccctcgaggagacactccacttttaaagctagcaaccccgtcatcgccgctcaactgtgttccaaaacgaatcccgaggttcataactatcagccccagtatcatccgaacattcatccgagccagccaaggtggcacccccactcgccgaatgtgtcctatccgttgcccagccctgtccttagttctagtgatcgcctccctttcggaatagaggagaatggcggtaccccttttctaaccgccgcaagtggaagacaccatcaccagcaccagcaccaacaccagcaccaacaccacagcaactactcactgagcctgactctggagaataaggaagggccacttcggagcccgaacagctcctctaagtccctcactaagctgtcccccggaacccctgccctgttcagcgaggctgcagctcacttgaaaaagctggaattggaaactgtaaaagcagctggtccatggcctcccctgcacattaatattaataaggctgaagaaaagaaggtgtccgaaaagacacttcaaacacctttgctgccctcaccagtagcagatcacgtgaagtgtaatatattgaaagcacagctcgagaatgcgtcaagagtaaatatccaagggggaaaggaggagagcccttttgtcaacatcaacaagaagagcagcttacaagacgcgagcgttagatcacctattcccatacgtgtggaaacagctcagcctgcggtcgaaaaacctgaaatcaaacccccacgggtgcgtaagttgaccagacaatactccttcgatgaagatgacctgccacccgatcttgcggaagctgtgggtgtgactacttcaacaacaaccaacaccacgacagcggctactcaggtcagcgtgccactcccaagtcctaaagtccaaaacgtatcaagtcctcataagtccgaggggaaggggcttctgtccccgggagcaaagtcgccctccgatagaggcggagcgtttacattagaacccggagacctgcttatggatttcacagaggccactccactggctgaacccgctagtaatccgcactgcgcacactccagatgcagccctcccttgtcacttcccatgaaagaagagacaaccggagtttgcatgtatcccccaataaaaacaagacttatcaaaacattcccagtcgacacaatgaatccctttcccgacactttcacaacagggcctcaatttaccgccgacttcagagatagtaaactccagtgttgccctggcccaacaagtccactgatccctgccgcaacactgcgaccgctgaccgagactgtgcacagtgccgaccaccttcatcacccggagacatgctttagcggaagccagtgtcgcgatacccctgctggcaccggtgagcgcgaggatgatgaaaagacggtagatgacaggaccgtcaagtttagcccctgtcacctggaggacggaatggtaccgtccgtgcggctgctgtcctctggattcgtctgttccctgtag

SEQ ID NO: 222194 - DNA, 1323 bp, Artificial Sequence
  Description of Artificial Sequence: Synthetic coding sequence
atgaaattcttgcttatcaaggatgccccagggaaaaagaaacggaagaacctgatgctgagtttcaaaagaaagcatgcgaaggggcaggaccttttcgaccagattgtgtaccatctggatctcgtggagaccgattactttggcttgcaattcctagactctgcccaggttgcgcactggctcgaccacgcaaagccgattaagaagcagatgaagatcgggcctgcctacgccttgcatttcagagtcaagtactattcgagcgagccaaacaatttacgcgaggaattcacccggtatctgtttgttcttcagttaaggcatgatattctgtctggtaagctgaagtgtccttatgagactgcagtggagctggcggcactgtgtctccaggcagaactgggcgaatgcgagctacccgagcatactccagaattggtgtccgaatttaggttcatcccgaaccagacagaggccatggaattcgacattttccagcggtggaaggagtgtagagggaagagcccagcccaggccgagttgtcttacctgaataaggccaaatggctggaaatgtatggcgtcgatatgcacgtcgtccgaggtagagatggatgtgaatattccctgggcctgacccctaccggcatccttatctttgagggcgctaataaaatcggccttttcttctggccaaaaattactaaaatggactttaagaagtccaagctgaccttggtggtcgtagaggatgacgaccagggcagagaacaagaacatacgttcgtgttccgcctagattctgcacggacatgcaagcacttatggaagtgtgccgtggaacatcacgcgttttttcgactacgcacacccggaaactcaaagagtaacagaagcgatttcatccgcttaggaagccgctttcggttcagcggtcgaactgaatatcaggccacacacggcagccggttgcgacggacctcaaccttcgagcggaagccctctaagcgataccctagtagaaggcactcaaccttcaaggctagcaatccagttatcgcagcgcagctgtgcagcaaaacaaacccggaagtgcacaattaccagccccagtaccaccctaacatccatcctagtcagccacgttggcacccccacagcccaaacgtcaggccctcttttcaggatgatagaagccactggaaagcaagcgccagtggagatgacagccatttcgattatgttcacgatcagaatcagaaaaatcttgggggtatgcagtcaatgatgtatagagacaagctcatgaccgctctgtag

SEQ ID NO: 222195 - DNA, 1557 bp, Artificial Sequence
  Description of Artificial Sequence: Synthetic coding sequence
atgctgcgtttcctgaggcgcaccttcgggaggcggtctatgcaacggtacgctagaggcgctgcaggtagaggagctgctggcttaggtgacgaaagggatggcggtccacgcggtggtccagctgcagccgcaagttctagcgccctgcccgcagcaccaggcggaagcgtgttccccgcaggcggtgggccactccttaccgggggtgccgctgttcacatttcagcagccggagcggcaaaagctacattatactgtcgggtttttttgctcgatggcaccgaagtctctgtggacctcccaaagcatgctaaaggacaggacttgttcgatcagatcgtctaccatttggaccttgtggaaacggactactttggactccagttcctggactctgcacaagtagcccattggctggatcatgccaaaccaattaagaagcagatgaaaatcgggcctgcatacgctctccacttcagggtcaaatattattcaagcgagcccaataacctgcgggaggaattcactcggtacctgttcgtgctccaattgaggcatgacatcctttcaggtaagctcaaatgcccctatgaaactgcggtagaattagccgcactgtgcctgcaggcagagttaggcgagtgtgaactgcctgaacacacccctgaacttgtttccgaattccgtttcataccgaatcagacggaagctatggaatttgatatcttccagcgctggaaagaatgcagagggaaatctcctgcgcaggctgagctcagttatctcaacaaggccaagtggctggagatgtatggggtggacatgcatgtagtgagagggagagatggatgcgagtacagcttggggctcacccctaccggtatcctaatatttgagggggctaacaaaattggactgtttttttggccaaagataactaaaatggatttcaagaagtccaagctcactctggtggtggtggaagatgacgaccagggaagagaacaggaacacaccttcgtgtttagactggattctgctagaacgtgtaaacatttatggaagtgcgccgtggaacatcacgcttttttcagactcagaacccctggaaactcaaaaagcaatagatcggactttatacgccttgggtctcgatttaggttttccggccgtacagaataccaggccacccacggttcccggttgagacgaaccagtactttcgaaaggaaaccatctaagcggtatccctcacgcagacactccacttttaaagcgagtaacccagtcatcgccgctcaattgtgttcaaaaaccaatcccgaagtgcacaattatcagccccagtatcatcccaacatacaccccagccagcccagatggcaccctcattctccgaatgtgcgccctagtttccaggatgacaggtctcattggaaagcatcagcctccggcgacgactcgcatttcgactacgtacacgatcagaatcagaagaaccttgggggaatgcagtcaatgatgtacagagataaactcatgactgccttgtag

SEQ ID NO: 222196 - DNA, 2703 bp, Artificial Sequence
  Description of Artificial Sequence: Synthetic coding sequence
atgttgaggttcctccgcaggaccttcggtaggcgctcaatgcagaggtatgcaagaggtgctgcgggacgcggtgctgccggtctgggcgacgagcgggacggaggccctcggggaggacccgctgcggcagcatcctccagtgccttaccagcggcacccggaggatcagtgttccccgctggaggtggaccactcctgacaggtggcgctgcagtccacattagcgcagctggggctgcgaaggcaaccctctattgtcgcgtttttctgctcgatgggacagaggtctctgttgacctgcccaaacacgccaaaggccaggatttgtttgatcagatcgtctaccacttagatctggtggagaccgactattttggcttgcagttcctggatagtgcccaggtggctcactggctggatcacgctaaacctattaagaagcagatgaagatcggacctgcctatgcactgcatttcagagttaaatattactctagcgagcccaacaatctgcgagaggagttcacacgttaccttttcgtgctgcagctaagacacgacatcctctcagggaagctcaaatgtccctatgaaactgcggttgagttggccgcactgtgtctacaggctgagctcggcgaatgtgaactccccgaacatactccagaactggtatctgaatttcgatttatcccaaatcagaccgaagccatggagtttgatatattccaacggtggaaagagtgtcgcggaaagagccccgctcaggcggagctctcctatttgaacaaggctaagtggcttgagatgtatggcgttgacatgcacgtcgtgcggggtagggatggttgtgagtactccttggggctcacaccaacaggaattctgatttttgagggggcaaataagatagggctgtttttctggcccaaaatcacaaagatggacttcaaaaagagtaaactgactctagtcgtggtggaagacgacgaccagggaagagaacaagagcacaccttcgtctttcgcttagactctgcccgaacgtgcaagcacctctggaaatgtgctgttgaacatcatgccttcttccgtctgagaactccaggtaactccaaatcaaatagatccgatttcatcaggttgggttctagatttaggttctccggtcgcaccgagtaccaagctacacacggctctagactccggagaacaagcacattcgagagaaagccgtccaaaagatacccaagcagacgccacagcactttcaaggcctccaacccggtgatcgctgcccagctgtgtagcaagacaaatccagaagttcacaactatcaacctcaataccacccaaacatccaccccagccagcctcggtggcatccccactcgcctaacgtgagttatccccttccttctcccgttttgtcgagctctgacaggctgccatttggcatagaagagaacggagggactccgtttctgacggctgcgtctgggagacaccaccatcagcatcagcaccagcatcagcatcaacatcactctaattacagcttaagtctaaccttggagaacaaggagggacctttgagaagcccgaatagtagctctaaatccctcaccaagctgagtccgggtactcccgcactcttctcagaagccgcagcccacctgaaaaaacttgaattggaaaccgtcaaggctgctgggccatggccccctctgcacataaatattaacaaggccgaggagaagaaggtttcagagaaaacactgcagacacccctgttgcctagcccggtcgctgatcacgtaaaatgcaacatactgaaggcacagctcgagaatgcttctcgggtcaatatccaaggcggaaaggaagagagcccttttgtgaatatcaacaagaagtcctccctgcaggacgcatccgtccgatcccctatacccatacgcgtggaaacggcacagcctgcagtggaaaaaccagagatcaaacccccacgagtaaggaagctgaccaggcagtattcattcgatgaggacgacttaccgccagaccttgctgaagcagttggggttacaacatcaacaactacaaacaccacaaccgcagccacacaggtgagcgtccctctcccatctcccaaggttcagaatgtgtcctccccacataagtctgaggggaagggccttctgagccccggagctaagtctcccagcgatcgaggcggagcatttaccctagagccgggtgacctcctcatggatttcaccgaagccacccctcttgcagagcccgcatccaatccccattgcgcacattctcgatgctcaccaccgctgagcctcccaatgaaggaggagacgaccggagtgtgtatgtatccccctatcaaaaccaggctgatcaagacgtttcccgtggatacaatgaatccgttccccgatacgttcaccacaggaccccagtttacggcggacttcagagattccaaattgcagtgctgccccggtcctacgtcccctttaatacctgccgcaacactgagacccctcacagagacagtgagtaccgtccagaccatctacaccactaggaaacctgtaagcttggccgcaagtgccgagacactcaggcaggaactcgagagagagaagatgatgaaaaggctccttatgaccgaattgtag

SEQ ID NO: 222197 - DNA, 2202 bp, Artificial Sequence
  Description of Artificial Sequence: Synthetic coding sequence
atgttgtccttcttccggcgtacactcggacggcgatccatgaggaaacacgcagaaaaggagcgcctcagagaagcccagagggccgctacccatatcccagccgcaggggactcaaaaagtattattacctgccgcgtgagcttgctcgatggtacagatgtttctgttgatttgcctaaaaaggctaaagggcaggaattattcgatcagattatgtaccatttggatctaatcgaatcagactattttgggctgaggtttatggactccgcccaggtggcacactggctggacgggaccaagtccatcaaaaagcaggtgaaaataggcagtccctattgccttcacctccgggtgaagttctacagcagcgagccaaacaacctgagagaggagctgacccgttacctatttgtgctccagctgaaacaggacatccttagcgggaaattggactgccctttcgataccgccgtgcagttagccgcatacaacttacaggccgagcttggagactacgatctcgcggaacattccccagagctggtctcggaattccgctttgtgcctattcagaccgaagaaatggaactcgctatctttgagaaatggaaagaataccggggtcagaccccagcccaggcagaaaccaactatctaaacaaggctaagtggctagagatgtacggagtagatatgcatgttgtaaaggcgcgtgatggcaatgactactccctaggtctaaccccgactggggtgcttgtcttcgagggcgatactaaaattggcctgtttttttggccaaagatcactcgattagacttcaaaaagaacaagttgacactggtggtcgtagaggacgacgatcagggaaaggaacaagaacataccttcgtgtttagacttgaccatcctaaggcctgtaagcacctgtggaaatgtgccgtggagcatcatgcgttcttccggctcagggggccagtacagaagtcaagccatagaagcggatttatcagactcggatcgcggttccgatatagcggaaagacagaataccagacgacaaagacaaataaggctcggagatccaccagctttgagaggaggccaagtaagaggtacagcagacgtacgcttcagatgaaggcgtgcgccaccaagcctgaggagctttctgtgcacaataacgtctccacccagtcaaatgggagccaacaggcatggggaatgcggtctgctcttcccgtatcccctagcatttcatccgccccagtgcccgtggagatcgagaacctgccccaaagccctggtaccgatcagcacgacagaaagtgtattccactgaatatcgacctgctgaactcacccgacctgctcgaagctaccatcggcgacgtgatcggggcatctgacaccatggagacatctcaggcccttaacgacgtcaatgtggcgactaggctgcctggcctaggtgaacctgaggtcgagtatgagacactaaaagatacctccgagaaattgaaacagctggaaatggaaaacagcccactgctcagtcccagatctaatattgacgtcaatatcaactctcaagaggaggtcgtcaaacttacagaaaaatgtctcaataatgtgatcgaatctccgggattgaatgttatgagggtcccacccgactttaaaagcaacattttgaaggcccaggtagaagccgtccataaggtgaccaaggaggattcactactcagccacaagaacgcaaacgttcaagacgccgctaccaattccgcagttctcaatgaaaataatgttcctctgcccaaggaatcactggagacactcatgcttatcaccccagctgactctggaagtgttctcaaggaggccaccgatgagctggatgcccttctggcatcccttactgagaatctgatcgaccatactgtagctccccaggtaagctctacttcgatgattactcctcgatggatcgtgccgcagtccggtgccatgtctaatgggttggctgggtgtgaaatgttattaaccggcaaggagggccatgggaataaggacggcatttccttgatcagccctccggcacctttcctcgtggacgctgtgaccagtagcggccctattctggccgaagaggccgttctaaagcagaaatgcctcctgactaccgaactctag

SEQ ID NO: 222198 - DNA, 1518 bp, Artificial Sequence
  Description of Artificial Sequence: Synthetic coding sequence
atgctttccttctttagaagaactctaggtcgcagaagtatgcgcaagcatgctgagaaggagcggctgcgcgaagcccagagggccgctacgcacattccggcagcaggcgactccaagtcgatcataacgtgtcgcgtctcccttctggacggaactgacgtaagcgtcgacctacctaaaaaggctaagggtcaagagctgtttgatcagataatgtaccatcttgacctgatcgaatccgattacttcggcctcagattcatggattccgctcaggttgctcactggctcgatgggacaaaatcaatcaaaaagcaggtaaaaatcggaagtccatactgcctacatttaagagtcaaattctactcgagcgaaccgaacaacctacgtgaagagctaaccagatatctatttgttctgcaactcaagcaagacatcttaagcgggaagctagattgtcctttcgatacggctgtccagctcgccgcttataacctccaggctgagctgggcgattatgatttagcagagcacagccccgagctggtgtctgagttcaggtttgtccctattcagaccgaagaaatggagctggcaatctttgagaaatggaaagaataccgcggtcagacccccgcacaggctgaaaccaattacttgaataaggcgaaatggctggagatgtatggggtcgacatgcacgttgtaaaagcgagggacggcaacgattattcactggggcttacccctaccggtgtgctggtgttcgagggtgatactaagatcggcctgtttttctggccaaagatcacaaggctggatttcaagaagaataagttgacactcgttgtcgttgaggatgacgaccagggaaaggagcaggagcacaccttcgtgtttcggctagatcaccccaaagcatgtaagcatctgtggaagtgcgctgtggagcaccacgcgttttttcgcctgcggggacccgtgcagaaatcaagccaccgctcaggattcattagattgggatcccgctttaggtacagcggtaagactgagtaccagactaccaaaacaaataaggcaagaagatctacaagttttgagcgtcgaccatctaagcgatactcccgaagaacgctgcagatgaaggcttgtgctacgaagccagaggagctgtctgtgcacaataacgtttccacacagtcaaatggttcccagcaggcctggggcatgagatccgccttgccagtctccccatcgatctcaagcgcccctgtccccgttgaaatcgagaacctaccccagtccccaggaacggatcagcacgacaggaaatggctgtccgctgcttctgattgctgtcagcgtgggggaaaccagtggaatacacgggcactgcctcccccacagacagcgcaccgcaattacaccgactttgtgcatgaacataatgtgaaaaacgccggaatccgacatgatgtgcatttcccaggtcatacagccatgacagaaatctag

SEQ ID NO: 222199 - DNA, 1518 bp, Artificial Sequence
  Description of Artificial Sequence: Synthetic coding sequence
atgctctcctttttccgtcgcacactcgggcgacggtcaatgagaaagcacgcagaaaaggagagactgagagaggcccaacgcgcagcaacacacataccagccgcaggcgactcaaagtcaattattacatgccgcgtgtccctcttagatgggacagatgtgagcgtggacctgccaaagaaggccaagggccaggagcttttcgaccagatcatgtaccacctcgatctgatagagtctgattactttggcctacgctttatggactctgctcaagtggcgcactggcttgacggtacaaaatccattaaaaagcaggttaaaatcgggtccccctattgccttcacctgagagttaagttttatagtagtgaaccgaataacttgcgtgaggagttaacgagatacctgttcgtgcttcagctcaagcaggatattttgagtgggaaactagattgtccatttgacaccgccgtgcaactcgccgcatataatttgcaggctgagctgggagactatgaccttgcagagcattcgccggaactggtgagcgagttcaggttcgttcccatccagactgaggaaatggagctggcaatatttgagaagtggaaagagtaccggggtcagacccccgctcaggccgagaccaactatctgaacaaggccaagtggctggagatgtatggcgtcgacatgcacgttgttaaagctcgtgacgggaatgattattctctggggctcacacctaccggtgtgttggtatttgaaggagatacaaagattgggttattcttctggccaaaaatcactcgtttggacttcaaaaagaacaaactcactttggtggtggtggaggatgacgaccaggggaaggagcaggagcacacctttgtgttccgcctcgaccaccctaaggcctgcaaacacctttggaagtgtgccgttgagcaccatgctttttttcgcctgcggggtccagttcaaaaatcatcccacagatccggctttattcgactcggctctcggttccggtactccggcaaaacggagtatcagaccaccaaaaccaacaaggcccgtcgctctaccagtttcgaaagacgcccttctaaacgttacagccggagaaccctgcagatgaaggcttgcgctaccaagccggaagaactgagcgtacacaataatgtgagcacccaatctaatggtagccagcaagcgtggggcatgcgctcggctttgccagtcagcccttctataagctccgcaccagtccctgttgaaattgaaaacctccctcagtcgcccggaaccgaccagcacgaccgcaaatggctgtctgcagcaagcgattgctgtcaaaggggcggtaatcagtggaacacacgcgcactgcctccaccccaaacggcccacaggaactacacagattttgtccacgaacataacgtaaagaacgctggcatcaggcacgacgtgcattttcccggtcacaccgccatgaccgaaatttag

SEQ ID NO: 222200 - DNA, 2064 bp, Artificial Sequence
  Description of Artificial Sequence: Synthetic coding sequence
atgctgagtttcttcagacggactctgggcaggcgaagcatgagaaagcacgctgaaaaggaaagactgcgggaagcacaaagggctgcgactcacatcccagccgcaggcgactctaagtctatcatcacctgtagagtttctttgctcgacggcacagacgtaagtgtggacctgcccaagaaggcaaaggggcaggagctgttcgaccagataatgtaccatttagacttgatcgagagtgattatttcggactgcgctttatggatagtgcccaggtcgcccactggctcgacgggacgaagagtattaagaagcaggtcaaaatcggttcaccgtactgtctgcatctgcgcgtgaagttctatagtagtgagcctaacaatctccgagaagagctaacaagatacctatttgtgctccagctgaagcaggatatattgtctgggaagctggattgtccatttgacaccgccgtccagctcgctgcgtacaatctgcaggccgaactgggggattacgatctggcagaacacagtcctgagctcgtgtcagaatttaggttcgtgcctatccaaacggaagagatggagctcgctatatttgaaaaatggaaggagtatcgtggacagacccctgcacaggccgagactaattatctgaacaaagctaagtggctagagatgtacggagtggatatgcacgtggtgaaggcccgtgacggcaatgactatagtctcggattaacaccgactggagtactggtattcgaaggcgataccaagatcgggcttttcttctggccaaagataacaagactagactttaagaagaacaagttaaccttggttgtcgtcgaagatgatgaccaggggaaagaacaggagcacacgtttgtgtttagacttgaccacccaaaagcttgcaaacatctgtggaagtgtgccgtcgaacaccacgcttttttcagacttcgagggccagtgcaaaagagttcacacaggtcaggatttatccgtctgggctcccggttcaggtactctggaaagacagagtaccaaactactaagacaaacaaagccagaaggagtactagctttgaacggaggccaagcaagcggtactccaggcggacgcttcagatgaaggcctgcgcaacaaagccagaggagttgtccgtgcacaataatgtctcaacccagagcaatgggagccagcaggcgtggggcatgaggtctgctctccccgtatccccctcaatctcaagtgcaccagtgcccgtcgaaatagagaacctgccacagagtccagggacagatcagcacgatagaaagtgtattcccctgaacattgatctgctgaactctcccgacctgctggaggcaacaattggcgatgtcatcggcgcttctgacaccatggagacaagccaggctttgaatgacgtaaacgtagcaactcgcctgcctggtcttggtgaacctgaagtggagtatgagacgctgaaggacacaagcgaaaaactgaagcagttggagatggagaactcaccattgctgagtccgaggtcaaacatcgatgtcaacataaacagtcaggaggaggtggtaaagcttactgaaaaatgtttaaataacgtcattgagtcccccggacttaatgtgatgagagttccacctgattttaagtccaatatactaaaagcgcaggtagaggccgtgcataaagttaccaaggaggacagtctgctatcacataaaaatgcaaatgtccaggacgccgctaccaattcggccgtgttgaacgaaaataatgtccccctgcctaaggagtcactggaaaccctgatgctgatcaccccagcagattctggttctgtgctcaaagaggcgaccgatgagctcgacgctctccttgccagtctgactgagaatttgattgaccacaccgtggctcctcaagtgagcagtacctctatgattaccccgagatggattgttcctctctggagccatttcggaaggcgttcctgccccgaggctgaggtttttacagatcactag

SEQ ID NO: 222201 - DNA, 2199 bp, Artificial Sequence
  Description of Artificial Sequence: Synthetic coding sequence
atgctgtcattctttcggagaaccttgggcaggcgcagtatgcgcaagcatgccgagaaggaaagactccgagaggcccagagggcagccacgcatatccctgccgcaggggattctaaatccatcattacttgccgtgtgagcttgctcgacggcactgacgtgtcggtggatcttcccaaaaaagccaagggacaggagttattcgatcaaataatgtatcacctggacctgattgagagcgactattttgggctgagattcatggacagcgcacaagttgcacattggctggatggtaccaaaagcattaagaaacaggtgaaaattggttccccttactgcctgcaccttagagtgaagttttactcttccgagccaaacaacctgcgtgaagaattgacccggtaccttttcgttctgcagcttaaacaagatatcctctcggggaaattagactgcccctttgatacagcggtgcagctggctgcgtacaatttacaggccgaacttggagactacgacctggctgaacatagtccggagttggtgtctgaattccgttttgtgcccattcagaccgaagagatggagctggccattttcgagaagtggaaagagtaccggggtcagactcccgcacaagccgagactaactatttgaacaaggccaagtggcttgaaatgtatggcgtggatatgcacgtcgtaaaggccagagatggaaatgactactccctggggctgacgccaaccggggttttggtgttcgagggggacactaagataggactattcttttggcccaagatcacgcggctagacttcaagaagaacaagctgacgttggtggtagtcgaagatgatgatcaagggaaagagcaggaacacacctttgttttcagactggatcaccccaaggcttgtaaacatttgtggaagtgcgccgtggagcaccatgccttcttccggcttcgcggtcccgttcagaagtcttctcatcgcagcggttttatcaggctggggtctaggttccgctactcagggaagactgaataccagacaaccaagaccaacaaagccaggcggagtacaagcttcgagaggcgcccatcaaaacgatactcgcggagaaccctacagatgaaagcctgcgccaccaagccagaggagctttcagtgcataacaacgtgagtacgcagagcaacggatcccagcaagcttggggaatgagatcagcgctgccagtctctcccagtatctcaagcgctcctgtacctgtggagattgaaaatttgccgcagtctcccggaaccgaccaacacgatcggaaatgtatacctctaaatattgatttgcttaactctccagacctgctcgaagccacaatcggagacgtgataggagcatcggataccatggaaactagtcaggcccttaacgatgtcaatgtcgcgacgcgcctgcctggcctcggggagccagaagttgagtacgaaaccctgaaagatacgagcgagaaacttaaacagctcgaaatggagaactcaccacttctgagtccacgatccaacatcgacgtgaatattaatagccaagaggaggtcgtgaaattgacagagaagtgcctgaacaatgtgatagagtcccccggacttaacgtgatgagagttccacctgactttaagtcaaacattctgaaagctcaggtggaggctgtgcacaaggtgacgaaggaggattctctgttatcgcacaagaacgctaacgtgcaggatgcagcgaccaacagtgcggtacttaatgaaaacaacgtgcctctacccaaagaatccctagagacactcatgctgatcacacccgctgacagcggcagcgtgctcaaagaagccaccgatgaactggatgctctgctggctagcttgacagagaacctgatcgaccacactgtcgcgcctcaggtctcttctacaagtatgattacgcctcgctggatcgttccttcaggcgctatgagtaacggtttagcagggtgcgagatgctgcttacaggaaaggagggtcacgggaataaggatggcatctctctgatcagtcccccagcgccattcctcgtggacgccgtgacgtccagcggcccaatcttggctgaggaggcagtactgaagcaaaagtgtctgctgactaccgagctttag

SEQ ID NO: 222202 - DNA, 2340 bp, Artificial Sequence
  Description of Artificial Sequence: Synthetic coding sequence
atggaggagaaagactactcagaggcagacggactttcagagaggactacgccaagcaaggcacagaagtctccccagaaaatagccaagaaatacaaatcagctatctgtagggtgaccctgctggacgcctcagaatacgagtgcgaagtggaaaagcacggccgaggacaggtcttgtttgatctagtgtgtgaacatctaaacttattagaaaaggattacttcggtctgacattttgcgatgctgacagtcagaaaaattggcttgatcctagcaaagaaatcaagaaacagattaggagtagtccttggaacttcgcctttactgtcaaattctacccgccagacccagcccagctcacagaggatataactcgctattacttatgtctgcagcttcgcgcagatattattacagggcgattaccatgttccttcgttacccatgccctgttaggcagctacgccgtacaagccgagctcggcgactatgacgctgaggaacacgtggggaattatgtgtctgagctgcgcttcgcgcctaatcagacacgagaactcgaagagcgcattatggagctgcacaagacttacagaggtatgacacctggcgaggctgaaatccattttcttgaaaacgcaaaaaaattgtccatgtacggcgttgatctgcaccacgccaaggatagcgagggaatcgatattatgctgggcgtctgtgctaacggactgttgatctaccgggacagattgcgcatcaatagatttgcctggcccaaaatccttaaaatctcttacaaacggagtaatttctatatcaagattcgacctggtgagtatgaacagttcgagagcaccataggcttcaaactaccaaaccaccggtctgccaaaagactgtggaaagtttgcattgagcaccatacttttttccgtctcgtaagtccagagcccccacctaagggtttcctggtgatggggtcaaagtttcgttactctggtaggacccaagcacagacccgccaggcctctgccttaatcgaccgaccagcaccattttttgaacggtcaagttccaagcgatacaccatgtctcgatctctggacggtgccgaatttagccggcctgcatccgtttcagagaaccatgatgctggccctgacggtgacaagcgggacgaagacggagagagtggcggacagcgctccgaggccgaggaaggagaggtgcggactccgaccaagatcaaggaactgaaattccttgacaagccagaggacgtgctactgaaacaccaggcatctatcaacgagctgaagagaaccctaaaggagcccaatagtaaactcatccaccgcgatagagactgggaacgcgagagaaggctcccttcctcaccggcaagcccatcacccaaaggaactcccgaaaaagccaacgagagagctgggctgcgagaaggctccgaggagaaagtgaaaccacctagaccgagagcgccagagtccgatactggcgacgaagaccaggaccaagagcgtgacacagtgttcctgaaggacaaccacctggccattgagaggaagtgctcctcgattacggttagcagcacaagtagcttggaagccgaagtcgactttacagtgatcggagattaccacggctccgcgtttgaggatttcagccgaagtctccccgaactggacagggataagtcagacagcgacacggaaggacttttgtttagccgagacttgaacaaaggggctccctctcaggacgatgagtccggaggaatcgaggactcccccgacagaggggcatgctctacccccgatatgccccagttcgaaccagtcaaaacggaaactatgactgtttcctccctggctatccgcaaaaagatcgaacccgaggccgtcttacagacacgcgtgtccgccatggacaatacgcaagagaatagcctcaagtcagggaaaggcgctgctgcaatgattcctggacctcagaccgtggccacagagatacggtccctgtccccaatcatcggaaaggacgtcctgacatctacctacggcgcaacagccgaaaccctgtcgacgtcaacaacgactcacgttacaaagacggtgaaaggagggttctcagaaacccggatcgagaaaagaattataatcaccggagacgaggacgttgatcaggatcaggcgctggcacttgccatcaaggaagccaaactgcagcacccggacatgctcgtcactaaagcggtggtttaccgggaaactgatccctccccagaagaacgggacaaaaaaccacaggagtcctag

SEQ ID NO: 222203 - DNA, 2646 bp, Artificial Sequence
  Description of Artificial Sequence: Synthetic coding sequence
atgacgaccgagacaggtcctgactcggaggtgaaaaaggcacaggaggaagcccctcagcagcccgaggccgcagccgcagtgactactcccgtaactcctgccggacacggacaccccgaagctaactcaaacgaaaaacatccgtcccagcaagacacccggccagccgagcagtctctggacatggaagagaaggactacagcgaggccgacggcttgagcgagaggacaaccccaagtaaagcccagaaatccccacagaagattgccaaaaagtataaaagtgccatctgtagggtgactttgctggacgcgagcgaatacgagtgtgaggtagagaaacacggtagaggtcaggttctctttgacttggtctgcgaacacctgaatttactagaaaaggattatttcggtctgaccttctgtgacgcggacagccagaaaaattggctggacccatctaaggaaatcaaaaagcaaattagatcgtctccctggaatttcgcttttactgtgaaattctacccaccagatcccgcacagctgacagaagacattactcggtactacctgtgcctgcagctcagggccgacatcatcaccgggagactgccctgttcttttgtgacccacgccttattaggctcatatgccgtgcaggctgagctgggggattatgacgcggaggagcatgtaggaaactacgtttccgagctcagatttgctccaaaccagacacgggagctggaggaaaggataatggagttacacaaaacctatcgtggcatgactcccggtgaggccgagatacacttcctggagaatgcaaagaagctcagtatgtacggcgttgacctgcaccacgccaaggatagcgaaggaattgatatcatgctgggagtctgtgcaaatgggttattaatatacagagatagactcaggatcaaccggttcgcgtggccgaaaatattaaaaataagttataaacgttctaacttctatatcaaaatccgtcctggcgagtatgaacagttcgagagtactatcgggtttaagcttcccaatcatcggtccgccaagagattgtggaaggtatgtatcgagcatcacaccttcttccggttagtttcccccgaaccccctcctaagggttttctggtcatgggctccaagttccggtactccggccgtacccaggctcagactcgacaagcctccgccctcatcgatcggccagcccctttcttcgagcgttctagttccaagagatacacaatgagcaggagcctggatggggctgagttctcacgtccagcatctgtctctgaaaatcacgatgccggtcccgacggcgacaagcgcgacgaggacggagaatcgggcggacagagatcagaggccgaagaaggagaggtacgtacacccactaagatcaaagaacttaagccggagcaagagactacacctagacataaacaagaattcctcgataaacccgaggatgttctcctcaagcaccaggctagcataaacgaacttaagaggacactcaaagaacctaactctaagctcatccatagggaccgcgactgggagagggaacggaggctgccctcctctccggctagtccctccccaaagggcacaccagagaaggcgaacgaacgcgctgggctgcgggaaggctcagaagagaaggttaagccgccaagaccgagagcccctgagtccgacactggtgacgaggaccaggaccaagagcgcgacacagtattcctcaaagacaaccacctcgccattgaacggaaatgtagctcaattactgtctcgtcaacgtcttccttggaagcagaagtggattttacagtgataggcgactaccacgggtctgcattcgaggactttagtaggagtctgccagaactggatagagataagagcgatagtgacactgaggggctgttattttcacgcgatctaaacaagggcgcaccttcacaggacgatgaatctggaggcatcgaagactcacctgatagaggcgcttgcagtactcccgacatgccacaattcgaaccggtgaagactgagacgatgaccgtttcttccttagccatacgcaaaaagattgaaccagaggcagtgctgcagacccgggtgtctgccatggataatacacaacaggtggatggatccgcgtccgttggtcgtgaatttattgcaacaaccccaagcataactaccgaaaccatctcaaccaccatggagaacagtttgaagtctggtaaaggcgcagcagctatgatccccggacctcaaacggtggctacagagatccgcagcctgtccccaatcatcgggaaggacgtgctaacctcaacctacggcgctaccgctgaaactctgagcacgtccaccacgacccacgtgacgaaaaccgtcaagggagggttctcggagacgcggatcgaaaaacggataattatcaccggtgacgaggacgtggaccaagaccaagctctcgcgctcgccatcaaagaagcaaagcttcagcacccagatatgctggttaccaaggccgtggtatatagagagactgaccccagtcctgaggagagagacaaaaagccgcaggaatcgtag

SEQ ID NO: 222204 - DNA, 2877 bp, Artificial Sequence
  Description of Artificial Sequence: Synthetic coding sequence
atgagtcgctccctcgatggcgctgaattcagccgcccagccagcgtgagcgaaaaccatgacgccggtcctgacggggataagcgggatgaggacggggagagcggcggacagagaagtgaggccgaagagggtgaggtccgcaccccgacaaagataaaagagctgaagcccgaacaggaaactactcctagacataagcaggaatttctggacaagcccgaggacgtgcttctgaagcatcaggcatcaatcaacgaactcaagcggacactgaaggaaccaaacagcaaactgattcatcgggaccgagattgggagagggaaagacgtttgccaagtagccctgcctcaccaagccccaaggggacacctgaaaaggccaacgagtcccaaaggacacaggacattagccagcgagacctcgttcccgaacctggcgcagcagcaggactagaggtgtttacacaaaagtcactggccgcaagccccgagggcagtgaacactgggtcttcattgagagggagtacaccaggcctgaggagctcggcctcttgaaagtgactacaatgcagcaggaggagagacaggctggattagctggaattctcgccaatgggaggctaagcaaagtggatgtgctagtagacaaatttaaggtggaggttgccaccgaagaaatggtcggaaaccgaagagcaaatactcaacaacagggaaaaatgatcgcaagccccgaagatttcgaatccgtgggagaggagggaccctggatcagagaatcccccggaggcgcagcgcttgccagcggtagaactttggcagagaaattgctggagggctccgagctaagagccgatacccgggaggccaccattagaaacaggtgcatgagcgatggtcagccagagggtcaaacggagttacggaagggactggaggagccacatacctgcgggaggccaaccgcgcctgggacacgcccagcagaggtagatgttttgtctcccgcttctgacaagggagggctgcagagctttctccttgacccggctcacgccgaggctcgtgctgagttaagcaacgagactgatacctcattcgctgaaaggagtttctatctgaattatgaggagaaagattcagaagaccaggtcctgcctcctccgttggaggagcgcaagggcaggctggatgcacccccaggcggagagcctcggcctactctcaactctcttgacctccgggtgtcagctgcagccagcagccggtccaaagatgaggctcacatgacctcccctaaggaaggagccggaactcccaaaaaccacggaggtcccggagacctaaaaggttctccggcaggccagacatttgctgagggctgggaggatgcgcaatggggggttgaaggcgagttcccgcatttgactgcatctgcggcaagggaggaggggacccccgtgagcggtgatttactaggcaaggcggaggagtctcccaccgaagagctgaagaagcacccgcctcatcgtggccagggagtacatcctgacccacaggcatgcgctcttcctagagcgatacctcttaatgtccggaaaccagtgaagcccgaccgcggaaatttccctcccaaagagcgaggcgtggtccccactcagaaaggtggtgccgaactcaaggacagggaagccagtgcctttctgcacatggaagtgatcattccacttccagcatcccctgggcatagtgaggatctggctgcgcttgaggaggcctccccaagccccacatcacacgggtctggcgagccaagtgagctccgcgaaccgttcttgcgtcatgttcacttatctaaggcttccccggagcccaaggaccaggtcggcttcgtcgtgagcccagcaaccggtggggaacggcgacctccaccaatcacatccaggaagccccgagttgtccctgaagaggccgaaggtcgtatcccccttggctttggcttcccatctggaaagcgtcgcgagatgacaagcttccaagccggagatcaagagggatctctggaagatatttcaaaaacatctgtcgcaaacaagattaggattttcgaaactcacggcgcagaaaccagacgtatgagcgagggtgaggctcgctctctacccaacgacgtgagcagcgaggcacctgttggtcaggccgaacagcagcgcagcacactgtccgacctgggctttgcacagctgcagccccctggcgatttcgcctctcctaaggccacgcacagcacagtcatcccactggcgacccgccatttcagggaggacacttccgcatcgtaccaggaagcccacacagaattagagcctgtgagtcccaacagcggatgcgaaacaaccctggcagaggcaaccggaaccggcaataagtctggcgatgcagttcgggaagaaaagagaagcactaatctggctgccaatacacctgggaaaggtggtaggctgcggttcgcaagcccttctggccctcagagggctggactccgagaagggtctgaggaaaaggttaaaccccctcggcctcgagcccctgagtccgataccggtgacgaagatcaagatcaggaaagagatactgtgttcttgaaagacaaccacctcgctatcgagagaaagtgttcctccataacagtgtcttctacatccagccttgaggccgaggtggatttcacagtgatcggcgactaccacggatctgccttcgaggacttctcgcggtcactgcctgaactggacagagacaagtctgactccgacactgagggcctgcttttttcacgggatctgaacaagggcgctccttcacaggattag

SEQ ID NO: 222205 - DNA, 2643 bp, Artificial Sequence
  Description of Artificial Sequence: Synthetic coding sequence
atgaccacagagacaggccctgactccgaggtcaagaaagcccaagaggaagccccacagcaaccagaagcagccgctgccgtgacgacaccagtgacgcccgctggccacgggcacccggaggcaaatagcaacgagaagcacccatctcagcaagatacacgacctgccgagcagtccctggacatggaggaaaaagattattccgaagccgatggactgagtgaaagaacaaccccaagcaaggcccagaagagcccacagaagattgccaaaaaatacaagtcagcaatctgccgcgttactctactcgatgcatcggagtacgagtgcgaggtggaaaaacacggacggggtcaggtgttgttcgacttggtgtgcgaacatctgaacctgttggagaaggactatttcggcctgacattttgtgacgcagattcccaaaagaattggttggatcccagcaaagagatcaaaaagcagatcagatcaagtccctggaatttcgcattcactgttaagttttacccaccagacccagcccagctgaccgaagacatcacacgctactacttgtgtctgcagctgagggcagacatcatcaccggacgcctaccttgcagctttgtgacccatgctttgctcggctcctatgccgtccaggctgaacttggcgattatgatgcagaagagcacgttggcaattacgtttctgaactccggttcgctcctaatcagacacgggaactggaagagcgcattatggaacttcataagacctaccggggaatgacacctggcgaggccgagattcattttctggaaaacgcaaaaaaacttagcatgtatggtgtggacctgcaccacgcaaaagacagcgaaggcatagatattatgctgggagtgtgcgccaatgggctgttaatttaccgagatagacttaggatcaacaggtttgcatggcccaaaatcctgaagatctcttataagaggagcaacttctatatcaaaataaggccgggagagtatgaacagtttgagtccactatagggttcaaactccctaatcaccggagtgctaagcggctgtggaaagtatgcatcgaacaccacaccttttttcggttagtatctccagagccccctccgaagggattcttggtgatgggatccaaatttagatattccgggcgtacacaagcacagacccggcaggcgtccgctctcattgaccgaccagctccgttctttgaaaggtccagctctaagaggtataccatgtcccgttccctagacggagccgaattttccagacccgcaagtgtctctgagaaccacgatgccggacctgacggagacaagagggacgaagacggtgaaagcggaggccaaaggtcggaggccgaggaaggggaggtgaggaccccaacaaaaattaaggagctgaagcctgagcaggaaactacaccgcgtcataagcaggagttcctcgataagcctgaggatgtcctgctcaaacaccaggcctctataaatgaattgaagaggaccctgaaggagcccaacagtaagctgatacatcgggaccgcgactgggagagggaacggcgactgccctccagtcccgcatccccctcccccaaaggcacccctgagaaggccaatgagagagccggacttcgcgagggcagtgaggaaaaggtgaaacccccacgtccaagagctcccgaaagcgacaccggcgacgaggatcaggatcaggagcgtgacactgtgttcctcaaagacaaccacctggccatcgaacgaaagtgttccagcatcactgtctcgagcacctcatcacttgaagcagaagtggattttaccgtgattggcgactatcacggctctgctttcgaggactttagcagatccctgcctgaattggatcgcgataaatcggactcggacacagaaggtctcctgttcagtcgcgacctcaacaaaggggcaccgagtcaggacgacgaaagtggaggcatcgaggattctccggataggggggcatgttctacacctgacatgccacaattcgaaccggtaaagactgaaacgatgaccgtctcgtctctcgccatccggaagaagatagagcctgaggccgtgctgcagactcgggttagcgcaatggacaatactcaggtggacggcagtgcctccgtgggacgggagttcatcgccaccaccccgtccatcaccaccgagactatttcaacaacgatggagaacagccttaagtccggcaaaggggctgccgcaatgattccgggtccacaaacggtggccaccgagattaggagtctttctcccatcatcggaaaagacgttctgaccagcacttacggcgcaaccgccgagacgctgagcacaagcaccacgactcacgtaaccaagactgttaagggcggattcagcgagacacgcatcgagaagcgaatcatcatcacaggcgacgaagatgttgatcaggaccaggccctggctcttgctattaaggaggctaaacttcaacatccagacatgttggtcaccaaagcagtagtctatcgcgagaccgacccaagcccggaggagcgggataaaaaaccccaggagagctag

SEQ ID NO: 222206 - DNA, 600 bp, Artificial Sequence
  Description of Artificial Sequence: Synthetic coding sequence
atggaggagaaggactactccgaagccgatgggctgagcgagaggaccacgccaagcaaggcccaaaagagccctcaaaaaattgcgaaaaagtacaagtcggcaatctgccgagtgacgctactggatgcatctgagtacgaatgtgaagtagagaaacatggacgtggacaggtcctatttgacctagtctgtgaacatttgaacctgctcgaaaaggactattttggtctcactttttgcgacgccgactcccagaaaaactggctggatccttctaaggaaattaagaagcagattcggtcttctccatggaatttcgcattcacagtaaagttttacccccctgatccagctcagttgaccgaggatattacccgttactacctgtgccttcaattgcgagccgatataatcacaggcagactgccctgtagtttcgtcacccatgccctgttgggctcctatgccgtgcaggcagagctgggggactacgatgccgaggagcacgtggggaactacgtcagcgaattaaggtttgcacccaatcagacacgggagcttgaggagcgaataatggagctccataagacatattag

SEQ ID NO: 222207 - DNA, 2106 bp, Artificial Sequence
  Description of Artificial Sequence: Synthetic coding sequence
atggtttttttaggaagaattaacgaggtggagcctgccaagggactcgcggaatccctggcaccaactgagaggtccgttaagtcgctcgacatggaggaaaaggattactccgaggccgacggactttccgaacggacaactcctagcaaagcccaaaaatctcctcaaaagattgccaagaaatacaaatcagctatctgtagagtaactctcctggatgcaagtgagtatgaatgtgaagtggagaagcacggtcggggacaggtgctgtttgatctggtttgcgaacacttaaacctgttagaaaaggactacttcggattaacattctgtgatgcggactcccagaagaattggctggatccctccaaagaaattaaaaagcagatccgctctagtccatggaacttcgctttcacagtaaagttttaccctccagatccagcccagttgactgaggatatcacacgctactacttgtgcctgcagctgcgcgctgacattattaccggcagactcccttgtagcttcgtgacccacgccctgctcggcagctatgccgtccaagcagaactaggcgactatgatgcggaggagcacgtgggaaattatgtgtctgaactcagattcgcccctaaccagacccgcgagctggaagaacgcattatggagctgcataaaacctaccggggtatgacccctggagaagcagagattcatttccttgagaatgctaagaagctgtccatgtatggtgtcgacctccaccacgccaaagatagtgagggaatcgacatcatgttgggggtgtgcgctaacgggctcctcatttatcgggaccgactgcggataaatcgattcgcttggcctaaaatcttgaaaatctcctataagcggagtaacttctacatcaagattaggccgggtgagtatgagcagttcgagtctactatcggcttcaagctgcccaaccacagatccgcgaagaggttatggaaagtgtgcatcgaacatcacacgttttttaggctggtatcccccgaacccccaccaaagggttttcttgtgatgggcagcaagtttaggtatagcggtcgaacccaagcccagacgcgccaggcctccgctctgattgaccgacccgcaccttttttcgaacgctcctcctcaaagaggtatacaatgagccgtagcctagacggggctgaattttcacgccctgccagtgtgagtgagaaccacgacgcaggccctgatggggacaagcgggacgaggacggcgaatccggcggacagcgttccgaggctgaggagggcgaggtccggaccccaaccaagatcaaggaactgaaatttttggacaagccggaggacgtgctgcttaaacaccaagctagtattaatgaactcaagcgcaccctgaaggagcccaacagtaaacttattcatcgggaccgtgactgggaacgtgagaggcggctaccatccagcccagcctccccatctccaaaaggcacccccgaaaaggctaacgagcctgtcaaaactgaaactatgaccgtatcctctctggcaattcggaagaaaatagaaccagaggcggtactacagactagggttagcgcaatggacaacactcaacaggtggacggcagcgcaagcgttgggcgagaatttatcgcaactaccccgagtatcacgacagagaccatctctactaccatggaaaattcactgaaatccgggaagggagccgctgcaatgatccccggaccacagaccgtcgctactgaaatacgctcgctgtcccctatcatcggtaaagacgtgttgacaagcacttatggtgccacggctgaaacattgtctaccagcaccaccacccacgtaaccaagacagttaaggggggattcagcgaaacccgtattgaaaagaggatcatcatcacaggggacgaggatgtagaccaggaccaggctctggctctggctatcaaagaagccaagctgcagcatccggatatgctcgttaccaaggctgtggtctaccgggagaccgacccatctcctgaagagcgggataaaaaacctcaggagtcgtag

SEQ ID NO: 222208 - DNA, 2319 bp, Artificial Sequence
  Description of Artificial Sequence: Synthetic coding sequence
atggaggagaaggactattctgaggctgatggtttatccgaaagaactaccccctccaaagcacagaaatcaccgcaaaagatcgccaagaagtataagtcagccatatgtcgcgtgacgctgcttgatgctagtgagtatgaatgtgaagtggagaattggttggacccgtctaaggagatcaaaaaacagatccggtcgtcaccgtggaacttcgccttcacagtgaagttctacccaccagacccagcacagctcaccgaggatatcacacggtactatctgtgtttgcagttacgggctgacatcattacggggaggctgccttgttcctttgtaacacatgccctgctaggcagctacgctgtccaagcggaactgggagactatgatgccgaggaacatgtggggaactatgtgagcgaactgcggttcgctcccaaccagaccagagaactggaagagcgcattatggagttacacaagacgtaccgcggaatgacccccggagaggctgagattcatttcctagaaaatgcaaaaaaactgtccatgtatggggttgatttacatcacgctaaggattcggagggaattgatatcatgctgggagtttgtgccaacggcttgctaatttatcgggatagactgaggatcaaccgattcgcttggcccaagattctcaaaatctcttacaagagatcgaacttttacatcaaaataagaccaggcgaatatgagcaattcgaatccactatcgggttcaagttacctaaccacaggagcgctaaacgcctttggaaggtgtgtatcgagcatcatactttttttagacttgtcagcccggaacctcccccaaaaggctttctcgtgatggggagcaagtttcgctactctggcagaactcaggcacaaacgagacaggcatctgccctaatcgaccggccagccccattctttgagagaagctctagcaagagatatacaatgtcccggtccttggacggggcagaattttcccgacccgcttccgtgtcagagaaccacgacgctgggcctgacggtgacaagcgagatgaggacggcgaaagtggtgggcagagatcggaggccgaagagggcgaggtgcgaactcccacaaagataaaagagttgaagttcctggacaagcccgaggacgtgctgctgaagcaccaggccagcatcaatgagttgaaacggactctgaaagagccaaattccaagctaatccaccgtgatagagactgggaacgcgaacgcagactgccgagcagtcccgcttcacccagccccaagggcacgccagagaaggccaacgagagggccggtttgagggagggctcagaggagaaagtcaaacctcccagacccagggcaccagagtccgacaccggtgacgaggaccaggatcaagagcgcgacacagtgttcttaaaggataaccacttggctatcgagaggaaatgtagcagcattactgtcagttccacatcatccctcgaggctgaagtggacttcaccgttattggagactaccacgggtcggcatttgaggacttttccaggtctctcccggagctggaccgggacaaaagcgatagtgacacggaggggctgctatttagccgggatctcaacaagggcgctcccagccaagacgacgaatctggtgggatagaggacagcccagatcgcggtgcgtgttccacccctgatatgccacagttcgaacccgtgaaaacagaaacaatgactgtttctagtcttgcaatccggaagaagatcgaacccgaggccgtgctgcaaacaagagtgtccgctatggataatacacagcaggtagatggaagtgcatcagtgggacgagaattcatagcgactacgccttcaatcacaaccgagacaataagcaccactatggagaatagcctcaagagcggaaagggcgctgccgcaatgataccaggtccacagaccgttgcgaccgagatccggtcgttgagccctatcattggaaaggacgtactgacctccacgtacggtgctactgccgagacgctgagtactagtactaccacacatgttactaaaaccgtaaagggaggtttctcagagacaagaatagaaaagaggattattatcaccggagatgaggatgtcgaccaggatcaagctctcgccttggctattaaagaggcaaagctgcaacatcccgacatgctggtcacaaaggccgtcgtctatcgcgagacagacccgtctcccgaggaacgagacaagaaaccgcaggagagttag

SEQ ID NO: 222209 - DNA, 2319 bp, Artificial Sequence
  Description of Artificial Sequence: Synthetic coding sequence
atggaagagaaggattatagcgaagctgacggcctgagtgagcggaccacccccagcaaggcccaaaaaagcccacaaaaaattgctaagaagtacaaaagcgccatttgtcgcgtgaccctccttgacgctagcgaatacgaatgcgaggtcgagaattggcttgacccctctaaggagattaaaaagcagatacgcagctctccttggaactttgccttcaccgttaaattctacccacccgatccagcccagctaacagaggacatcactcgatattatttgtgccttcagttgagagcagatattattactggcaggttgccttgtagttttgtcacccacgccttgctcggcagttatgccgtgcaggcggagctcggcgactatgacgccgaggagcatgtcggtaattacgtttccgagttgcggttcgcgccaaatcagacgagggagttggaagaacgcatcatggagctacataaaacataccgcggaatgacaccgggtgaggccgagattcattttctggaaaatgccaaaaaactgagtatgtacggcgtggatctccatcatgcaaaagactccgaaggcatcgatattatgctaggcgtctgcgccaacggtcttctcatttaccgcgacagactacgcattaatagattcgcttggcccaagatcttaaagatctcctacaagcggagtaacttctacattaagattaggcccggagaatacgaacagtttgagagtacaatcggatttaaactcccaaatcatagatccgccaaaaggctctggaaagtgtgcatcgaacatcatacctttttcaggctcgtaagccccgagccaccccctaaagggttcctcgtgatgggcagcaagttccggtacagtggtagaacacaggcccagactcgccaggcttcggcactcattgataggccagcaccctttttcgagaggagcagctctaaaagatataccatgtcacgatccctggacggcgcagagttttcccgcccagcctccgtatctgaaaaccacgatgccggacccgatggggataagcgcgacgaagatggagagagcggcggacaaagatcagaagctgaggaaggtgaagtgagaactcccactaagatcaaggaactcaaattcctggataagccggaggatgttcttttaaaacatcaggcctccatcaacgaacttaagaggactctaaaggaaccaaactctaaactgatccatcgggatcgcgattgggaacgcgaaagaaggctccctagctcacccgcatctccttcgcctaaaggtactcccgagaaagcaaacgaacgggcaggacttcgagaaggcagcgaggagaaggtgaaacctccccgaccacgcgctccagaatccgatacgggtgacgaagatcaggaccaggaacgagacactgtgtttttaaaggataatcacttggcaatcgagcgaaagtgttctagtattactgtcagctcaacatcaagtcttgaggcggaggtcgactttacagtcataggcgactaccacgggtctgctttcgaggacttctccagatccttgcccgagctagatcgtgacaaaagcgactcggataccgaaggcctcttattctcaagggaccttaacaaaggggctccttctcaggatgatgagtccgggggtattgaagactctcctgaccgcggagcatgttctacaccagatatgccacaattcgagcccgtgaagaccgagacgatgacagtcagctctcttgccattaggaaaaagatcgagccggaagccgtgctccagacaagggtctctgctatggataacacacaacaggtggacggttccgctagcgtcgggcgagaatttatagctacgactccctctataacaaccgagactatctccaccaccatggaaaattccctcaaaagcggcaagggcgctgccgctatgatcccaggtccccagacggtggccactgaaattaggagcctctccccgattatcggaaaggatgtgctgacttctacttatggcgctacagccgaaactctgtctaccagcacaacaacacacgtgactaaaacagtgaagggagggttcagcgagacaagaatagaaaaaagaatcatcatcacaggggatgaagatgtcgatcaggatcaggccctagctttggcaataaaggaggctaagctgcagcacccggatatgctcgtgactaaagcagtggtgtacagagagactgacccatccccggaggagcgtgataaaaaaccccaggagagctag

SEQ ID NO: 222210 - DNA, 600 bp, Artificial Sequence
  Description of Artificial Sequence: Synthetic coding sequence
atggaggagaaggactacagtgaggccgatggactctccgagcggaccacaccctccaaagcccagaaatctccccagaagatagctaagaaatataaatctgcaatttgtcgcgtcactctgctcgatgcatctgaatacgaatgtgaagtcgagaagcatggacgcggacaggttctgtttgaccttgtttgtgagcacctgaacctgctggagaaagactatttcggactgaccttttgcgacgcagatagccagaaaaactggttagatccgtccaaagagattaagaaacagataagatcctctccatggaatttcgcatttaccgtcaagttctacccccctgatcccgctcagctgacagaggacatcactcggtattacctttgtcttcaattgcgggctgatatcatcacggggcgactgccttgttcgttcgttactcacgcactgctgggcagttacgccgtgcaggccgagttgggcgactacgacgccgaagaacacgtcggaaattacgtgtccgagttgagattcgctccgaatcagaccagggagctagaggagcgcatcatggagttgcataagacatactag

SEQ ID NO: 222211 - DNA, 2385 bp, Artificial Sequence
  Description of Artificial Sequence: Synthetic coding sequence
atgactaccgaaaccggccctgacagtgaagtgaaaaaggcgcaggaggaagccccacaacagcctgaggcggctgctgccgtgaccaccccagttacaccagccggtcacggacatcctgaggcaaattccaacgagaaacatccctctcagcaggacacccgccctgcagaacagagcttggacatggaggagaaagattacagtgaggcagacggcttgtcagagaggaccacgccctctaaagctcaaaagagccctcagaagatcgccaagaaatataagtcagccatctgcagggtgacgctccttgacgcaagcgaatacgagtgcgaggtcgaaaagcacggcaggggtcaagtgctgttcgatctggtttgcgaacatctgaaccttctcgagaaagactattttggtctgaccttttgtgacgccgattcacagaagaattggctggatccaagtaaagaaatcaagaagcagatacggagctctccatggaacttcgccttcactgtcaaattctacccacctgatccagctcaactaaccgaagacatcaccagatattatctatgcctacagctgcgggctgatatcataacgggccgtcttccttgtagcttcgtgacgcacgcacttctcggttcctacgcagtccaggccgagttgggtgactatgacgccgaggaacacgtggggaactacgtgagcgagttgcgtttcgcacctaatcagaccagggagctggaggagagaattatggagctgcacaaaacctaccggggaatgacaccaggcgaggcagagattcacttccttgaaaatgccaagaaactgagcatgtacggggttgaccttcaccacgccaaggactctgagggcatcgacattatgcttggagtttgcgccaacggactactcatttatcgtgatcgcctgaggatcaaccgatttgcttggccaaaaatcctaaagatatcctacaaacgatcaaatttctatattaagattcggccaggcgaatacgagcagttcgagtccacaatcggatttaaattgccaaatcatcggtctgctaaaagattgtggaaagtgtgcatcgagcaccacacttttttcagacttgtcagcccggagccacctcccaaggggtttttggtgatgggcagcaaatttcgatattcagggcgtacccaggcccagacgcgacaggcttcggctctaatcgatcgcccagctccatttttcgagagatcttcctccaaacgctacaccatgagccggtcccttgatggcgctgaattctctcgcccagccagcgtcagtgagaaccacgacgctgggcctgatggcgacaaacgtgacgaagatggggaaagcggagggcagcgaagtgaggcggaagaaggcgaggttagaacccccaccaagattaaggagctcaagccagaacaagaaacaactccacgtcacaaacaggagttcctggataagcctgaggacgtgctgcttaagcaccaggcttccattaacgagctgaaacggacattaaaggagccaaacagtaagttgatccaccgtgaccgcgattgggaaagggagagaaggctgccatctagtcccgcttcgcccagtcctaaaggtacacccgagaaggctaatgagcgggcaggactccgcgaaggcagtgaagaaaaagttaagcccccaaggccgcgagccccagaatcggacacaggcgatgaggaccaagatcaggagcgcgatactgtatttttgaaggataaccacctggcaattgagcgcaagtgctccagcatcacagtatcaagtacatccagcctggaggccgaggtagactttaccgtcatcggagattaccatggatctgcattcgaggatttttcccgctcactcccagagctggatcgcgacaagtctgatagtgacactgagggtctgctgttttcacgcgaccttaataaaggtgccccttcccaggacgacgagtctgggggaatagaagacagcccggacaggggcgcttgttcaacccccgatatgcctcagttcgagcccgtcaagacggagacaatgacggtttcatccttggcgattagaaagaagatcgagccggaggctgtgttgcagacacgcgtaagcgctatggacaacacccaggagaactcactcaagagcgggaagggtgctgcggcaatgattcccggtccccagaccgttgccacagagatcaggagtctcagccccagtgccgaccatcgcgagcgctgtccccatcaacatctccggaggcactgtgggaacccactcaacttacaccaccatccctgtcaccaaaactgtgagagaagggtgttttag

SEQ ID NO: 222212 - DNA, 507 bp, Artificial Sequence
  Description of Artificial Sequence: Synthetic coding sequence
atgaccacggagactgggcctgactctgaggtcaaaaaagctcaggaagaggctccacaacagcccgaggctgccgcagcagttacgacgcccgtgacaccagcagggcatggccatcctgaagccaactccaacgaaaagcacccaagtcaacaggacaccaggccagcagaacagagcctcgacatggaagaaaaggattactcagaagcggacggactctccgaacgcaccaccccttccaaggctcaaaagtctccccagaaaatcgcaaaaaaatacaagagcgcaatttgtagagtcactcttcttgatgcctccgaatacgagtgcgaagtcgagaagcacggcaggggccaagtgctatttgatttggtgtgtgaacaccttaaccttttagagaaagattactttggacttactttctgcgacgccgactcccagaagaactggctggatccaagcaaagaaatcaaaaagcaaatccgctctagcccgtggaactag

SEQ ID NO: 222213 - DNA, 180 bp, Artificial Sequence
  Description of Artificial Sequence: Synthetic coding sequence
atgaccactgagacgggccctgactcagaagttaagaaagcgcaagaggaagccccacagcaaccggaggctgcagctgctgtcaccacgcccgtgactcctgctggccatggacaccccgaagccaactctaacgaaaaacatcccagccagcaggatacaaggccagccgaacagtag

SEQ ID NO: 222214 - DNA, 774 bp, Artificial Sequence
  Description of Artificial Sequence: Synthetic coding sequence
atggaagagaaagattatagcgaagccgatgggctatccgagaggacaacgccgtcaaaagcccaaaaatctcctcaaaagattgctaagaaatacaagtccgcaatctgccgggttacgctcctcgatgcgtccgaatatgaatgcgaagttgaaaagcatgggaggggtcaagtgctcttcgatcttgtgtgcgagcatcttaacctgctcgagaaagactacttcggccttacattctgcgatgccgattcccagaagaattggttggacccgtccaaggagataaaaaaacagatccgcagcagcccttggaactttgctttcacggtgaaattttacccccctgatccagcccagctcactgaggatattaccagatactacctgtgtctccagctcagggctgatatcattacgggacgcctgccctgttcatttgtgactcacgccctgcttggctcctatgctgtgcaagctgagttgggcgattacgacgcagaggagcatgtaggcaactacgtgagtgagctccggtttgcccctaaccagacaagagagctagaggagaggatcatggaattacacaagacatatcggggaatgactcctggagaggccgagattcattttctggaaaacgctaaaaagctgagtatgtatggtgtggacctgcaccacgccaaagacagcgagggaatagacattatgcttggtgtgtgcgccaatggcttactgatctatcgcgaccgactgcgaatcaatcggttttag

SEQ ID NO: 222215 - DNA, 114 bp, Artificial Sequence
  Description of Artificial Sequence: Synthetic coding sequence
atggaagaaaaagactattccgaagctgacggtctctcagaacgcacaacaccctcaaaggctcagaaaagtcctcaaaaaatagcaaagaaatataaaagcgcgatctgctag

SEQ ID NO: 222216 - DNA, 360 bp, Artificial Sequence
  Description of Artificial Sequence: Synthetic coding sequence
taatcggtgggacgcgaattcatcgccactaccccttctattactacagaaactattagcaccaccatgatcataggaaaggatgtgcttactagtacttacggggctactgcagagaccctatctacatctaccacaacccacgtcacgaagacagttaagggcggattttcagagactcgaatcgaaaagcgcatcatcatcactggagacgaggacgtcgatcaggatcaagccctcgcattggccatcaaagaagcaaaactgcagcacccagacatgctggtgacaaaagccgtggtttacagagaaaccgatcctagccctgaggagagagacaagaaacctcaagaatcctag

SEQ ID NO: 222217 - DNA, 2340 bp, Artificial Sequence
  Description of Artificial Sequence: Synthetic coding sequence
atggaggagaaagactattctgaagcagacgggcttagcgagagaacgactccgtcaaaggctcagaaatccccgcagaaaattgccaagaagtataagtcagccatttgcagagtgaccctgctggacgcttcagaatacgaatgtgaggtcgagaagcacggcagagggcaggtgctcttcgacctggtttgtgagcacttaaatctcctcgaaaaggactactttgggctgacattctgcgacgccgactcgcagaaaaactggttggatcctagcaaggagatcaagaagcagattcggtcaagtccctggaactttgcttttaccgttaagttttaccctcctgatccagctcagctgacagaagatatcacacgatactatctgtgcctgcagcttcgggctgatattattacaggcaggctcccttgttcgtttgtcacacacgcactactcgggtcctatgctgtgcaagccgaattaggtgattatgatgcagaggagcatgtaggtaactacgtatcagaactgaggtttgcccctaaccagacccgggaactagaggaaagaatcatggagctgcacaagacctaccgtggaatgactccaggtgaggccgagatccatttcctggaaaatgctaagaagctcagtatgtacggggtcgacctccatcacgccaaggattccgagggcattgatatcatgctaggcgtgtgtgccaatggactgctgatttatagggacagactacgtatcaaccgcttcgcctggccaaagattcttaaaatttcttacaagaggagcaatttttatatcaaaatcagacctggggaatatgagcagttcgagtctactatagggttcaaactccccaaccacagaagcgccaagagattgtggaaggtgtgcatcgaacatcatacattctttcggctggtgagccccgaacctcctccaaaaggctttcttgttatgggatcaaaattccgatattccggaagaacacaagcgcagactaggcaggcatccgccctgatagatagacctgcccctttttttgagaggtcctcttccaagcgctatactatgtcccggtccctggatggagcagagttctcacgtccagccagcgtgagcgagaatcatgatgctggccctgacggcgacaaaagagatgaggatggggaatcaggagggcagaggtcggaagcggaggagggagaggtgcgtacccccacgaagatcaaggaacttaaatttctggataagcctgaggacgtcctgctaaaacaccaggcaagcatcaacgagctgaaaagaactctcaaagaacccaactccaaactcatacatagagaccgggattgggaacgagagagaaggctcccatcctcaccagcatctccatcgccgaaaggaacacctgaaaaagcaaacgaaagggccggtctgcgggagggaagtgaagagaaagttaagccgccaaggcccagggcacctgagagcgacacgggggacgaggatcaggatcaggaacgcgatacagtctttctgaaggataatcacttagcaattgagaggaaatgtagttcgatcacggtctcatcaacatcttctctggaggctgaggtagatttcaccgtgattggagattatcatggatctgctttcgaggatttctcacgctcactgcctgaattggaccgcgataaaagtgacagtgatacggaagggctgctgttcagtcgcgatctgaacaagggggctccatctcaagacgatgaaagcgggggtattgaagattcacccgatagaggggcatgcagcactcctgacatgcctcagttcgagccagttaagaccgagaccatgaccgtgtctagtcttgcaatccgcaagaagattgaacctgaggctgttctgcagacgagggtgtctgctatggataacacccaggagaattctctcaaaagtggaaagggggctgctgccatgatcccgggtccccagacagtggcgacggaaattaggtcgttatcaccaatcatcggaaaagacgtgctgacttccacctacggtgctacagccgagaccctctcgaccagtaccacaactcacgttacgaaaactgtgaagggaggtttttccgagacacggattgaaaagcgcattattattaccggggatgaggatgttgaccaggaccaagcactcgctctcgctattaaggaggccaagctccaacacccagacatgttggtcacaaaggctgttgtatatagagagacggatccatctcctgaagagcgggacaaaaagcctcaggagagttag

SEQ ID NO: 222218 - DNA, 345 bp, Artificial Sequence
  Description of Artificial Sequence: Synthetic coding sequence
atgacaacagagacagggccagactcagaggtcaagaaagctcaagaggaggctccgcagcagcctgaagccgctgctgccgttactactcccgtgacacccgcaggacacgggcaccccgaggctaacagcaatgaaaaacatccttcccaacaggatacccggcctgccgaacagtctcttgacatggaggagaaggattactcagaagccgacggcctaagcgagcggacaaccccaagtaaggcacagaagtcccctcagaagatcgcgaaaaaatataagtctgcgatctgtagagttacgctcttagatgcatccgaatatgagtgtgaagttgagtag

SEQ ID NO: 222219 - DNA, 567 bp, Artificial Sequence
  Description of Artificial Sequence: Synthetic coding sequence
atgaccacagagaccggaccagactcggaagtaaaaaaagcacaggaggaggcacctcagcagcccgaggcagcagctgcagtcacaacaccagtgacgccagcgggtcacggccatcccgaggcgaactcaaacgagaaacatccaagtcagcaagacactagacccgctgagcaatctctggatatggaggaaaaagattatagcgaggctgatggcctctccgagcggactactcccagcaaagcgcagaagagtccccagaagatagctaagaagtacaagtcggccatctgcagagtgacattgcttgacgcaagcgagtatgaatgcgaggtggaaaaacatggaaggggccaggtgctgttcgacctcgtgtgtgagcacctgaatcttctggaaaaggactatttcggccttacattttgcgatgccgactcacagaagaattggctggacccttcaaaagagattaagaagcagataagatctagcccatggaatttcgcgttcaccgtgaagttttacccgccagaccctgctcaactcaccgaagacatcacatag

SEQ ID NO: 222220 - DNA, 705 bp, Artificial Sequence
  Description of Artificial Sequence: Synthetic coding sequence
atggagtccacacctgaaccgaggcccaatgagtgggagaaacggcgaattacacccttgagtctccagactcagggtcgtaaaggcgaccatctgttcaaggacattctgtctgttaaggagaagtatctgatgcctactatctggaccgtcgaagaaaaggctcaagagactgacaagacgagagcacctgaatctgaaggcccatgcaccggtgcgcgagatgctgtgaaaagttctcacgagactttgaacattgtggaggaaaagaaaagggccgaagtaggaaaggacgaacgcgtcatcacagaggagatgaacggaaaggagatctctccaggtagtggccctggtgagatccgcaaggtcgagcccgtcactcaaaaggacagcacgagtctgtcatcggagtcgtctagtagtagttccgagtctgaggaggaagacgtcggagaatacagaccccaccatcgcgtgacggagggcaccattcgagaggaacaggaatacgaagaggaggttgaagaggaacctcgacctgcagcgaaagttgttgagagagaagaggcagtgccagaagcctcaccagtgacccaggcgggtgcttctgtcattactgtcgaaactgtgatccaggagaacgtcggcgcacaaaagatccccggagagaagtccgtccacgagggggcactgaagcaggattag

SEQ ID NO: 222221 - DNA, 3018 bp, Artificial Sequence
  Description of Artificial Sequence: Synthetic coding sequence
atgactactgaggtcggaagcgtgtctgaagtgaagaaggacagctcacagttgggcacagacgccactaaagaaaagcctaaggaagtggcagaaaaccaacagaatcagtcctctgatcccgaagaggagaaagggagccaaccaccccctgccgctgagtctcagagcagcctgcggagacagaaaagggaaaaggaaaccagcgaaagcagaggcatctcgagatttatacccccatggctcaagaaacaaaaatcatataccctggttgtggctaaggacggtggcgataagaaggagcctactcaggccgtggtggaggagcaagtgctggacaaggaagaacccctccccgaagagcagcgtcaggcgaagggcgacgctgaagagatggcccagaaaaagcaggagattaaggtggaggtgaaggaagagaagccaagcgtgtcaaaggaggagaaaccctccgtttcaaaggtggagatgcagccaaccgagctagttagtaaagaacgggaggagaaggtgaaggaaacgcaggaagataagctggaaggcggagctgcgaaacgagagaccaaagaagtgcagaccaacgaattaaaagccgagaaggcatctcagaaggttacgaagaagaccaaaaccgttcaatgcaaggtgactctgctggatggcacagaatattcttgtgatctggaaaaacacgccaaagggcaggtcctcttcgacaaagtctgcgagcacttaaacttgttggagaaagattatttcggcctattgttccaggagtcccctgaacagaaaaactggctcgaccccgcaaaggagataaaaaggcagctgcgaaatttgccatggctcttcacattcaacgtgaagttctatcctcctgatccttctcagttgactgaggacattacacgctactttctctgcctgcagctccgacaggatattgccagtggtcgcctgccatgctcattcgtgacacatgcccttctcggttcctacactctgcaggctgagctgggcgactatgatcccgaggagcatggtagcattgatttatctgaattccagtttgctccaacccagaccaaggaactggaagagaaagtggccgagctccataaaacacaccggggactgtcaccagcccaggccgactcgcagttcctcgagaacgccaaacggttgagcatgtacggagtagatctgcaccatgctaaggacagcgaaggagtggacattaaactgggtgtgtgtgcgaatgggctcctcatctataaggatcgcttgaggatcaatcgcttcgcctggcccaagatactcaagatctcctacaagaggagcaacttttacattaaagtacgccctgctgagctggagcaattcgaaagcacaatcggatttaaattacctaaccatagagccgctaaaagactgtggaaggtttgcgtagagcaccatacattctatcgattggtaagtccagagcagccaccaaaggctaagtttttgactttgggctccaaattccgctactctgggcgtacccaggctcagacccgacaggcgagcacgctgattgataggcccgcaccacattttgaacgcaccagcagtaaacgtgtctccagatcgctcgacggggctccaataggagttatggatcaatcattgatgaaggattttcccggtgctgccggagaaatctcagcctatggaccaggattagtctccattgctgttgtgcaggacggcgacggaaggcgggaggtcaggagtcccaccaaggcccctcacctccagctcattgaaggaaaaaaaaatagcctcagagtcgagggcgataacatctatgtgcgccatagcaacctcatgctggaagagctggataaagctcaggaggacatcctcaagcaccaggcctctataagtgaactgaagcggaattttatggagagcacgcccgagccgagaccgaacgagtgggaaaaaaggcgaattacacccctctccttgcagacacagggcagctcgcatgagaccctgaacatagtagaagagaaaaagagggcagaagtgggcaaggacgaaagggtcatcacagaggaaatgaacggaaaggaaatttcacctggcagcggcccaggtgagatccgcaaagttgagcctgtcacacaaaaggactctacatcactgtcttctgagagttcctcatcttcttctgagtcagaggaggaggatgtgggagagtacaggccacaccaccgcgtgaccgaagggaccatccgagaggagcaggaatatgaggaagaagtggaagaagagccccgtcccgcagctaaagttgtagagagggaagaggccgtcccagaggcttcaccagtgacccaagccggagcctccgtcattacagtggagaccgtgatccaggaaaacgtgggcgctcaaaaaattccaggcgagaagtccgttcacgagggagctctgaagcaggacatgggcgaggaggcagaggaggagcctcagaaggttaatggcgaagtgagtcacgtggacattgatgtccttccacagattatctgctgctcggagccacccgtcgtaaaaactgaaatggtcaccataagtgacgcctcacagcgtactgagattagtacgaaggaggtccccatcgtacagacagagaccaagacaattacctatgagtcacctcagattgacgggggagcaggcggtgattctggcacactcttaaccgctcaaacaattactagtgaatccgtgagcactacaacaaccacacacatcacaaagactgttaaaggaggaatatcagaaacgcgcattgagaaaagaatcgtgattactggggacggagacatcgatcatgatcaggcccttgcccaggccatccgggaggccagagagcagcatcccgatatgtcagttacaagagttgtcgtacacaaggaaactgaactggcagaggagggcgaggattag

SEQ ID NO: 222222 - DNA, 3018 bp, Artificial Sequence
  Description of Artificial Sequence: Synthetic coding sequence
atgaccaccgaagttggaagcgtgagtgaagtcaagaaggatagttcacagctcggcactgatgctaccaaggaaaaaccaaaagaagtggccgagaatcagcagaaccagtcgagcgatcccgaggaagagaagggaagtcagccacctccggctgctgagtcgcagagctcgctgcggaggcaaaaaagggagaaggagacctccgagtctcgtggaatctcccggtttatcccgccatggctgaagaagcaaaagtcatacacactggtggtagcaaaggatggtggcgacaagaaagagcccactcaagcagtagtcgaggagcaggtcctggataaggaggaacccctgcctgaagagcagaggcaggccaaaggagatgccgaggaaatggcacaaaaaaagcaggagattaaggtggaagttaaggaagagaaaccgagcgtgtccaaggaggagaagcctagcgtatcgaaagtggagatgcaaccgacggagcttgtgtctaaggagagggaagaaaaggtcaaagagacacaggaagacaagctggagggcggagccgctaagcgtgagaccaaggaagtgcagactaatgaactgaaagccgagaaggcgtcacaaaaggtgactaaaaagaccaagactgtccagtgcaaagtcacgttactggacggtactgagtattcttgcgacctcgagaaacacgcaaaaggacaggtgctattcgacaaagtgtgtgaacaccttaacctgcttgaaaaggactattttgggcttctgttccaagagtcacctgaacagaagaactggcttgatccagccaaagaaatcaagcggcagctccgtaatctaccatggttgttcacctttaacgtaaagttctatccccctgacccaagccaactcaccgaggatatcacacgctactttctgtgtttgcaactccgacaggatatcgcctctggccgtctcccttgcagtttcgttacacacgctctcctcggctcctacacccttcaggccgagttgggtgattatgatccagaggagcatgggtcaattgacctgtccgagttccagtttgccccaactcagaccaaggaactcgaagagaaggtggctgagttgcataaaactcaccgcggactgtcccccgctcaggccgacagccaattcctggaaaacgcaaaacggctaagcatgtatggggttgacctccaccacgccaaagactcagagggcgtggacatcaaactaggggtatgcgctaacgggctgctgatatataaggacaggttgcgtattaaccgctttgcttggccaaagatcctgaagatcagttataagcgatccaacttctacattaaggttcgtccagctgaactcgaacaattcgaaagcacgatcggatttaagctcccaaaccatagggctgccaagaggctatggaaggtgtgcgttgagcatcataccttttaccgcctagtgtctccggaacaaccccctaaggccaaattcctgacattgggctctaaattcaggtactccggtagaactcaggctcagactaggcaagccagtaccttaatagacagacccgcaccacattttgagagaaccagctcaaaaagggtttccaggagcttagatggcgctcccatcggcgtgatggatcagagtctaatgaaagactttccaggggcagccggagagatctctgcttatggacccggactggtcagtatagccgtcgtccaggacggggacgggcgtagagaggtaagatctcctactaaggccccacacctccagctgatcgaaggtaaaaagaatagtctccgtgtagaaggtgacaatatctacgtcagacattccaaccttatgcttgaggagctggataaggcccaagaggatatcctcaaacaccaggcaagcatttcagaactgaagcgaaacttcatggaaagcactccagaacccagaccaaatgagtgggagaagcgtcgtatcacccccctgtccctgcagacccaggggagcagtcatgagacactcaatatagtcgaagagaagaagcgggctgaggtggggaaggatgaacgggtgatcaccgaggagatgaatggcaaagagatcagccctggctctggtcccggagaaatccggaaagtagaacctgtgacgcagaaggattctacctccctcagttcagagtcttcttcttcgtcaagtgagtcagaggaggaagacgtgggagagtatcgccctcaccacagggttacagagggcactattagggaggagcaggaatatgaagaggaagtcgaggaagagcccagacctgctgccaaggtggtggagcgcgaagaggccgttcccgaggctagcccagtcacacaggccggagctagtgtgattacagtggagacggtaatccaggagaacgtaggggctcaaaaaataccgggagagaagtctgtacacgaaggggctctaaaacaggacatgggcgaggaagccgaggaggagccacagaaggtcaatggagaagtgtctcacgtggacatcgatgtgctcccacagataatctgttgcagtgagccgcctgttgtgaaaacagaaatggtaaccatctccgatgcatctcagcggactgagatcagtacaaaagaagtaccaatcgtgcaaactgaaactaaaacaattacgtatgaatccccacagattgatgggggagccggtggtgactctggcaccctgctgaccgcacagaccattacatctgaatcagtgtccaccaccaccaccactcacattacaaagactgtaaagggcggaatcagtgagacccgcattgagaagcgaatcgtgattaccggtgacggcgacatcgatcatgaccaggctctggctcaagcaattcgtgaggcacgagaacagcatccagacatgtccgtgacacgggtggtggtgcataaagaaacagagttggccgaggaaggagaggattag

SEQ ID NO: 222223 - DNA, 2022 bp, Artificial Sequence
  Description of Artificial Sequence: Synthetic coding sequence
atgactaccgaagtgggtagcgtctcagaagtgaagaaagactcctcccaactggggacggatgccaccaaggagaagcccaaagaggtggcggagaatcagcaaaatcagagttcggacccagaagaggagaaaggctcccagcccccacccgcagctgagagccagagttctcttcgcaggcaaaaaagagaaaaggaaactagtgagagtagaggaattagtagatttattccgccttggctgaaaaaacaaaaatcctatactctggtggtagccaaagacggtggagacaaaaaagagcccacccaggccgtcgtcgaagaacaagtccttgataaggaggagccccttcctgaggagcagcgtcaagcaaagggagacgccgaggaaatggcacagaaaaagcaagagattaaggttgaagtgaaggaggaaaagccctctgtgagcaaagaggagaaaccaagtgtgagcaaggtggagatgcagccaacagaattggtctccaaggagagggaggagaaggtgaaggaaacacaggaagataagctcgaaggcggagctgcaaaaagggagactaaagaggttcaaaccaacgaactcaaagccgagaaagcgagccagaaagtaacgaaaaagacaaagaccgtgcaatgtaaggtcacccttcttgatgggactgagtattcttgtgatctggagaagcacgctaagggccaggtcttgttcgataaagtttgtgaacacctgaatctcctggagaaggactactttggactcttgttccaagaatctcccgagcagaaaaactggctggaccctgcaaaagagatcaaacgacagctccgaaacctgccctggctgtttactttcaacgtgaagttttaccctccagatcctagccagctcacagaagatatcactcggtacttcctgtgcctgcaacttaggcaggatattgccagtggccgacttccatgttccttcgtgacacatgctctcctcggcagctacacactccaggcggaacttggggactacgatccagaggaacacggatccattgatctctcagagttccaatttgcacccacacagacgaaagaacttgaggagaaagtggctgaactccacaaaacacatcgcggactgagccccgcacaggccgactcccagttccttgagaacgctaaacgtctcagtatgtatggagtcgatttacaccacgcgaaggactcagaaggggtggacataaaacttggcgtgtgcgcaaatggcctgttaatctacaaagacaggctgcgcattaaccgatttgcatggccaaagatcctaaagatctcctacaaacgatctaatttttatatcaaagttcggcctgccgaacttgaacagtttgagagcacaattggttttaagttacccaaccaccgagctgctaaaagactgtggaaagtgtgcgtcgagcatcacaccttttacagactggtgagtcccgaacagcccccaaaggcgaaatttttgacactggggagcaaattccggtacagtggacgcactcaggcacagacaaggcaagcgagcactcttatcgatcgtcccgcacctcacttcgaacggacatcttccaagagagtgtctagaagcttggacggagcaccaataggggtgatggatcaatctcttatgaaagactttcccggagcagctggggagatcagtgcctatggacccggtttagtcagcatcgctgtagtgcaggacggggacggcaggcgggaagtgagaagccccactaaggccccacaccttcagctaatcgaaggaaaaactgtcaagggtggcataagtgaaaccaggattgagaagaggattgttatcaccggcgacggtgacattgatcatgatcaggccctggcacaggctataagggaagcccgagaacagcaccctgacatgtcagtgactcgagtagtggtgcacaaagagacagagctggcagaggaaggggaggattag

SEQ ID NO: 222224 - DNA, 1902 bp, Artificial Sequence
  Description of Artificial Sequence: Synthetic coding sequence
atgaccacagaagttggcagtgtatccgaggtgaaaaaagacagcagtcagctaggtaccgacgcaaccaaggaaaaaccaaaggaggtggccgagaaccagcagaaccagagtagtgacccagaggaagaaaagggtagccaacctccgccagccgctgagagtcaatcttccctacgtagacagaagcgagaaaaggaaacatccgaatctcgaggcattagccgatttatacctccctggctcaagaagcagaaatcatataccctggtagtcgcaaaggatggcggtgataaaaaagaacctacacaggctgtggtggaggagcaagtgctggataaagaggaaccactcccagaggaacagcgccaagccaagggcgatgcagaagaaatggctcagaagaagcaggagataaaggtggaggttaaggaggagaagcctagcgtttccaaagaagagaagccctccgtgtccaaggtggagatgcagcctacagagcttgtctccaaagagagggaagagaaagttaaggaaacccaggaagacaaactggaaggcggagcagcgaagcgagaaacaaaggaagtacagactaacgagttgaaagcggaaaaagccagccagaaagtaaccaaaaaaaccaaaaccgtccagtgtaaagtaacgttacttgacggtaccgaatatagctgtgacctcgaaaaacatgctaaaggacaggtgctattcgataaagtttgtgagcacctgaatctcttagaaaaagattatttcggcctgctgtttcaagaaagcccggaacagaaaaactggctggatccagccaaggaaatcaaacgccaacttagaaatctgccgtggttattcacctttaacgtcaagttttacccgccagacccatcgcagctcacagaagacataacgaggtattttctctgcttgcagttgcggcaagacattgcatctgggcgtctgccatgtagctttgtgactcacgccctcttgggaagttacactcttcaggctgagctgggggactacgacccggaagagcacggctccatagatctgagcgagtttcagttcgctccgacacagactaaggagttggaggagaaggtcgccgagctccataagacccatagaggtctctcccctgcccaggccgacagtcaattcctagagaatgcaaaacgcctgtctatgtatggtgtcgatttacaccacgctaaagactccgagggggtcgacattaagttgggcgtctgcgctaacggtctgctgatctacaaggaccggcttaggattaacagatttgcttggcctaagatcctgaaaatatcttacaagaggagcaatttttacataaaggtgaggccagcagaactggagcaattcgagagcactattgggttcaaactgccaaatcatcgcgctgccaaacgcttatggaaagtgtgcgttgagcaccatacattctatcgactggtttcaccagaacagccccctaaggctaaatttttgaccctcggctccaagttccgctacagtggtcggacacaagcacagacaagacaggcatccacccttattgaccgcccagcccctcacttcgaacgcacctcctcaaaaagggtgtcccggtctctggatggggcacccattggcgttatggaccagagcctcatgaaggacttccctggcgctgccggtgagatttccgcatacggccctgggctggtttccattgccgtcgtgcaggatggcgacggcaggagggaggtgagatcccccaccaaggcccctcatctgcaacttatcgaaggaaagtcgtcccatgagacactgaacattgttgaagagaagagcggacagagactgggcaagacgaaagaatag

SEQ ID NO: 222225 - DNA, 2244 bp, Artificial Sequence
  Description of Artificial Sequence: Synthetic coding sequence
atgactactgaggtgggctccgtgtccgaggtgaaaaaggattccagccagctgggtaccgatgccaccaaggagaagcccaaagaagtggctgaaaatcagcagaaccagtcctccgatcctgaggaggaaaaaggaagtcagccgcctccagctgccgagtctcaatccagccttcgaagacagaagcgggagaaggaaacttcagagtccagaggaattagcaggtttatccccccatggttgaagaagcagaaatcctatacgctggtcgtggccaaagacggcggtgacaaaaaagaaccaacccaggcagtggtggaggagcaggtcctggataaggaggaaccgctccccgaagaacagagacaggccaaaggtgacgccgaggagatggcacagaagaagcaggaaatcaaagtggaagttaaagaggagaaacccagcgtctctaaggaggagaaaccatccgtgtctaaagtggaaatgcaacccacagaactcgtgagtaaggaacgggaggagaaggtcaaagagacacaggaagataagctggagggcggtgccgctaaaagagagaccaaggaggtgcaaactaatgagttaaaggccgagaaggctagccagaaagtgacaaaaaagactaagactgttcagtgcaaagtaacgttgctcgacggcacagagtattcctgtgacctagagaagcatgccaaggggcaagtgttatttgacaaggtatgcgagcatctcaacttacttgaaaaggattactttggcctcctttttcaagagagcccagagcagaagaactggctcgatccagccaaggagatcaagagacagctcagaaatctgccgtggctgttcaccttcaacgtgaaattttacccccctgacccctctcagctcaccgaagacattacacgatacttcctgtgtctccaactgcgccaagacatcgcttcaggccgtctcccctgttcctttgtcacccatgcattgcttggctcgtacaccctccaggccgagcttggcgactacgaccccgaagagcacggatcaattgacctgtcagagttccaattcgcaccaacccaaaccaaggagctggaagagaaagtcgcggagcttcacaagacccaccgcggactgagccccgctcaggccgattcacagttcctcgaaaatgctaagcgcctctcgatgtacggtgtcgacctgcatcacgcgaaggatagcgagggtgtagacattaagttgggtgtctgcgctaatggcttgctgatctacaaagaccgcctgcgcattaaccggtttgcctggccgaaaattctgaaaatctcttataagcgcagcaacttctacatcaaagtcaggccagcggagctggagcaattcgagagtacgataggtttcaaactcccaaaccaccgagccgcaaagcgtctgtggaaggtctgtgtagagcaccacaccttctatcgcttagtctctcctgaacagcctcccaaagcgaagtttctcacgctcggcagtaaatttcgatattctggcaggacccaggcccagaccaggcaagcctcgaccctcattgataggccagcaccacacttcgaaagaacttcttctaagagggtcagcaggtcattggacggcgctcctattggagtgatggatcagtctcttatgaaagattttccgggagccgcaggcgaaattagcgcttatggccctggtcttgtaagtatagcagttgtgcaggatggggacggaagaagggaggtcaggagcccaaccaaagcgccacatctgcagctgattgagggtaagccacccgtcgtaaaaactgaaatggtgacaatttcggatgccagccaacgcaccgaaatatctactaaagaggtcccgatagtgcagacagagaccaagaccatcacatatgagtcaccgcaaatagacggcggagctggtggtgacagtggaactctgctcaccgcacagactataaccagcgagtcggtctccacaacgacaacgacccatatcacaaaaaccgtgaaagggggtataagtgaaacccggattgaaaaacgaatcgtgattaccggggacggagacatcgaccatgaccaagctctggctcaggccattcgagaggcccgagaacagcacccagacatgtcagtgacccgggtggtggtccacaaggagactgaactggcagaagaaggggaggattag

SEQ ID NO: 222226 - DNA, 1143 bp, Artificial Sequence
  Description of Artificial Sequence: Synthetic coding sequence
taactggggagtaaatttaggtatagcggcaggactcaggctcagactcgccaggccagtaccctgatcgatagaccggctccccacttcgaaagaacaagttctaaacgcgtatctaggagtctcgatggagcacccatcggtgtgatggatcagtctttaatgaaagattttccgggagctgcaggagaaatctcagcctatggcccaggcttggtaagcatcgccgttgttcaggacggggacgggaggcgtgaggtccggtcacccactaaagctcctcacctgcagttaattgagggaaaaaagaattcccttagagttgagggagataatatatacgtgcgacacagcaacttgatgctcgaagagctggacaaggctcaagaggatatcctcaaacaccaggcatccatatcggagctcaaaaggaacttcatggagtctacccccgagcccagacccaacgagtgggagaaacggaggatcacaccattatccttacagactcagggtagaaagggcgaccacctgtttaaggatatcctctcggtaaaagaaaaatacctgatgcccaccatttggaccgtagaagaaaaggcccaggagacagacaagacccgagcccctgagagtgagggaccatgtaccggtgcacgggacgcggtaaagagcagccatgagaccttgaacattgtggaggagaagaagcgcgctgaggtgggcaaggatgaacgggtaattacagaagaaatgaacggcaaggagatttcaccaggatcggggccaggggaaatcaggaaagtggagcccgtgacacagaaagactctacttctctgtcaagtgagagttctagcagtagcagtgaatcagaggaagaagatgtaggggagtatcgtccccaccacagagtgacagagggcaccatcagagaggaacaagaatacgaagaagaagttgaagaggagcctagacctgccgcaaaggtggtcgagagagaagaagctgtgccggaggcgagcccagttacacaggcgggtgccagcgtgatcaccgtggagaccgtaatccaggagaacgtgggggctcaaaaaatcccaggagagaaatcggtgcacgaaggggctctgaagcaggactag

SEQ ID NO: 222227 - DNA, 1152 bp, Artificial Sequence
  Description of Artificial Sequence: Synthetic coding sequence
atggaagaggaagaaactcagcttgaagaggaattggacaaagctcaggaggacatcctgaaacaccaggcctctatctctgagctgaaaaggaatttcatggaatcgacgccggaaccaaggccaaacgagtgggaaaaaagaaggatcactccactttccctccagacccagggatcaagccacgagacactgaacatcgtggaagaaaaaaaaagagctgaggtcgggaaggacgaacgggttattactgaggagatgaatgggaaagagatttccccaggcagcgggccaggagaaatacgtaaggtcgaaccagtgacccaaaaagactccaccagtttgagcagcgaaagcagtagctcttcttctgagagtgaagaagaggatgtgggtgaatatagaccccaccacagggtcacagagggaaccatccgagaggagcaggagtatgaagaggaagttgaggaagaaccaaggcctgctgctaaagtggtggaacgcgaggaagcggtccccgaagcctcaccagttacccaggcaggggcttccgttatcaccgtcgaaacagtcatccaggaaaacgttggggcacagaagatccccggagagaagagcgtgcatgaaggtgctttaaaacaagatatgggtgaggaggcagaagaagaaccacagaaggtgaacggagaagtgtctcatgtggacatcgacgttctgccacagatcatctgctgctccgaacccccagtggtgaagacagagatggttactatctcggacgcctctcagcggaccgagatctctaccaaagaggtcccaattgtccaaacagaaacaaagacaatcacatatgaaagtccgcagatcgacggcggagcaggaggggatagcgggacgctgctcacagcccagacaatcacctctgagtccgtgtccacaaccacaactacccacattacaaaaacagtaaagggtggaatctccgagacgaggatcgaaaagaggatagttattactggcgatggggacattgatcacgaccaggctcttgcacaggcaattcgcgaggccagagagcagcacccggatatgtccgtgaccagagtggtagtgcacaaggagacagagttggccgaggaaggcgaggattag

SEQ ID NO: 222228 - DNA, 2022 bp, Artificial Sequence
  Description of Artificial Sequence: Synthetic coding sequence
atgaccacggaagtcggctccgtctcggaggtcaagaaagacagctcacaactcggcaccgatgcaaccaaggagaagccaaaagaagttgccgagaaccagcagaaccagtcttcagaccctgaagaagagaagggttcacagcccccacctgccgcagagagccagtcttctcttaggaggcagaagcgtgagaaagaaacatcagagagccgcggaatctcaagatttatcccaccttggctaaagaaacagaaatcctacaccttggtggtagctaaggacggtggtgacaagaaggagcctacccaggctgtcgtagaggaacaggtcctggacaaagaggaaccattgcccgaagaacagaggcaggctaagggagatgcagaagaaatggctcagaaaaaacaggagatcaaagttgaggttaaggaggaaaaacctagcgtaagtaaggaagaaaagccctccgtcagcaaggtggagatgcagcctacagaacttgttagcaaagagcgggaggaaaaagtaaaggaaacccaagaggataaacttgaagggggagcggcaaaacgcgagactaaagaagtacagactaatgagctgaaagcagagaaagcctcacagaaggtgacgaagaagaccaagaccgtccaatgtaaggtgacgctgctcgatgggaccgagtactcctgcgacttggaaaagcacgccaaagggcaggttctgttcgataaggtgtgcgagcatctgaatctcctggagaaagactatttcggcttactttttcaggagtctcctgagcagaaaaactggctcgatcccgcaaaagagattaaacgccaactgcgtaatctgccctggctgttcacattcaatgtgaagttctatcctcccgatccaagccaactgacagaagatattactcggtactttctctgcctccagctcagacaagatattgccagcggacggctgccatgttctttcgtcacccacgctctcctcggctcttatacacttcaggctgagctaggtgactacgatccagaggagcacggctccatcgatctgtccgaattccagtttgccccaacccagacaaaggaactggaagagaaagtggctgagctgcataagacccacagaggcttaagccccgcacaggccgatagccaattcctagaaaatgcaaagcggctctcaatgtacggtgttgatctacaccatgccaaggatagtgagggggtcgatataaaattgggggtgtgtgcaaacggcctgctgatctataaggaccgcctgagaatcaatcgcttcgcgtggccaaaaatccttaaaattagttacaaacggtcgaacttctatatcaaagttcgcccagcggagttggagcaatttgagtccacaatcggatttaaattgcccaatcatagggctgcgaagcgcctttggaaggtctgcgtggaacaccataccttttaccggcttgtgagcccggagcaacctcccaaagctaaattcttgacactggggtccaagttccgctatagtggcaggacacaggcgcagaccaggcaggccagcaccttgattgatcggcctgctccacactttgaaaggacttctagcaaacgggtgtcaagaagccttgacggggcacccattggcgttatggatcaaagtctgatgaaagactttcctggggctgccggagagatcagcgcctacggtcccggactcgttagcatagcagtggttcaggacggggacgggcgacgtgaagtcagatccccaactaaagcccctcacctgcaactgattgaaggcaagaccgttaaagggggaatatcagaaactaggatagagaaacgcatcgtgatcactggagatggggatattgatcacgaccaggctctggcacaagcaatcagagaagccagggagcagcaccccgatatgtccgttactcgggtagtggtccataaagagacagagttagcggaggaaggcgaggattag

SEQ ID NO: 222229 - DNA, 462 bp, Artificial Sequence
  Description of Artificial Sequence: Synthetic coding sequence
atgactacagaggtcggaagtgtgtccgaagtcaaaaaggatagctcccagctcggaacagacgcaaccaaggagaaacctaaggaggtcgcggagaaccaacagaaccagtcctccgatcccgaagaggagaagggcagtcaaccccctccggcagctgagtctcagtcttctttaaggagacagaagcgagaaaaagagacgtctgagagccgtgggatctcgcgatttatcccaccctggcttaaaaaacagaaatcttatacacttgtggtcgccaaagacggcggagacaagaaggaacccacccaggcagtggttgaggagcaggtattggacaaggaagagcccctgcccgaggagcagaggcaagccaagggagacgcggaagagatggctcaaaaaaagcaggaaattaaagtcgaggtcaaagaggagaagccctccgttagcaaagagtag

SEQ ID NO: 222230 - DNA, 2244 bp, Artificial Sequence
  Description of Artificial Sequence: Synthetic coding sequence
atgaccactgaggttggtagtgtttcagaggtgaaaaaagattccagccagctgggaacagacgccacaaaagaaaagcctaaagaggttgcagaaaaccaacagaaccagagcagtgacccagaagaggaaaaaggaagccagccgccacccgctgccgagagccagtcttccctacgacggcagaagagggagaaagaaacctccgaatctagagggattagcagatttatccctccctggctcaagaagcagaaaagttacacactcgtcgtcgcaaaagatggtggcgataaaaaggaacccactcaggctgtagtggaagagcaggttctggataaggaggagcccctgcccgaagaacagagacaagctaaaggtgatgccgaagagatggcccagaagaagcaggagatcaaggtagaggtgaaggaggagaagcccagcgtaagcaaggaggaaaagccatctgtttcaaaggttgaaatgcagccaaccgagttggtgagcaaagaaagagaggaaaaggtgaaagagacccaagaagacaaactcgagggaggtgctgccaagagggagaccaaggaagttcagaccaatgagctcaaggcagaaaaagcctcgcaaaaggtgacaaagaagacaaagaccgtgcagtgtaaagtgaccctcttagatggtaccgagtattcctgcgatttagagaagcacgccaaaggccaagtactgttcgacaaagtttgcgaacatctgaacctgttagaaaaagactattttggcctgctgttccaagaaagccccgaacagaaaaactggttagaccccgctaaggaaatcaaacgacagctgaggaatttgccttggctcttcacgttcaacgttaagttctatcctcctgatccaagccagcttacggaagatatcactcggtactttttgtgtctgcagctccgccaggatatcgcgtccggaagactgccatgcagttttgtgacccacgctctgttaggaagctacacgctgcaggccgagctgggggattatgaccccgaggaacacgggtctatcgatctatccgaatttcaatttgcccctacacaaaccaaagagctcgaggagaaagtggcggaacttcacaaaacccacagaggtttaagtcccgcacaggccgactcacagtttcttgaaaacgcaaagcggctctccatgtacggtgttgatctgcaccatgctaaggacagtgagggggtcgacatcaaactgggagtgtgtgccaatggcctgttaatatataaggaccgcctcagaattaaccggttcgcttggccgaagatcctgaaaatatcttacaaaagaagcaacttttacattaaggttcgccctgccgagctcgagcagttcgaatctaccatcgggtttaaactccccaatcacagagctgccaagaggctgtggaaagtgtgtgtggagcaccataccttctatcgcctcgtgagtcctgagcagccaccaaaggctaaattcttgacattagggtctaaatttcgatattctggccgaacccaggcgcaaacgagacaggcctctacactaatcgaccgcccagcgcctcatttcgagcgtacctcatcaaagagagtgtcacggagccttgacggagcccctattggagttatggatcagtccctgatgaaagatttcccaggtgcagcaggcgagatttctgcatacggtcccggtttagtcagtattgctgtggtccaggatggggacggtaggcgtgaggtccgcagtcctacaaaggctcctcacctccaattgatagaggggaaaccgcctgtggtgaaaacggagatggttacgatcagcgacgcctcgcagaggaccgagatctccaccaaggaggtccctattgtgcagactgaaaccaaaaccattacgtatgagtccccacagatcgacggcggagctggaggagatagtgggactttgcttactgcgcaaaccataacctccgaatccgtctctacgacaaccactacccacattacaaaaacggtgaaaggtggcatctctgaaacgagaattgaaaagaggattgtcataaccggcgatggtgacatcgatcatgatcaggctcttgcacaggccatcagggaagcacgggagcagcaccccgatatgtcagtgacgagggttgtggtccataaagagaccgaattggctgaggaaggcgaggactag

SEQ ID NO: 222231 - DNA, 540 bp, Artificial Sequence
  Description of Artificial Sequence: Synthetic coding sequence
atgacaaccgaggtaggcagcgttagcgaagtcaaaaaagacagtagtcagctgggaactgacgccaccaaggaaaagccaaaagaggtggccgaaaaccaacagaaccagtccagcgacccagaggaggaaaagggctcacaacctccacctgcggctgagtcacagtcaagtctgcggagacagaagcgggagaaagaaacgtccgaatccaggggcatctcacgcttcatcccgccttggctgaaaaagcaaaagtcctatacccttgtcgtcgctaaggacggcggagacaagaaagaaccaacacaagccgtagtggaggaacaagtgcttgacaaggaggaaccgctacccgaggagcagcgacaagctaagggggatgctgaagaaatggcccagaagaagcaggagattaaagtggaagttaaagaggagaagccctccgtatccaaagaagaaaaaccgtctgtcagcaaggtggaaatgcagcctactgaactcgtctcaaaagaacgggaagagaaggttaaagagtag

SEQ ID NO: 222232 - DNA, 2559 bp, Artificial Sequence
  Description of Artificial Sequence: Synthetic coding sequence
atgacaactgaagtagggagcgtatcagaggtaaagaaggactcatcccagctcggaaccgatgcgacaaaagaaaagcccaaggaggttgccgagaaccaacaaaatcaatcatctgaccccgaggaggagaaaggcagtcagcccccacctgcagcagagagccagtcctctctgagacgccagaagcgtgagaaagagacatccgagagtcgcggtatctccaggtttatacctccttggttgaaaaaacagaaatcatacacgctggtcgtggcaaaggacggcggagataagaaagagcctactcaggcggtggttgaggagcaggtgctggacaaagaagagccattacctgaagaacaacgccaagcgaaaggtgacgctgaggaaatggcacaaaaaaagcaggagattaaggtcgaagtgaaggaggagaagcctagcgtgagcaaggaagaaaaacccagcgttagcaaagtggagatgcagccaaccgaactggtaagtaaggagcgcgaagagaaggtgaaggaaactcaggaagacaagttggagggtggagccgctaagcgcgagacaaaggaagttcagaccaacgaactcaaagctgagaaggcttctcagaaagtgactaaaaagacaaaaaccgtccagtgcaaagtgacactcttagacggcacagaatatagctgtgacctcgagaaacacgcaaaagggcaggttctcttcgataaggtgtgcgaacacttgaacctgctggagaaggactacttcggactcctctttcaggaatctcccgagcagaaaaactggcttgacccagccaaggagattaagagacaactgcggaatctcccctggctctttacatttaacgtgaagttctacccgccagatccaagtcagctcacggaggacatcacgagatacttcctgtgcttgcagctccggcaggacatcgcatccggaaggcttccctgtagcttcgttacccacgctctcctggggtcatacacattgcaagctgaactgggagattatgacccggaggagcatggaagtatcgacctgtcagagttccagttcgctcctacgcagaccaaggagctggaggagaaagtggcagagttgcacaaaacacaccgaggtctgagtcctgcccaggccgactctcagttcttggagaacgccaaacgcctgtctatgtacggtgttgatctacatcacgccaaggatagtgagggcgtagacatcaaactgggagtgtgcgccaacggtcttttgatttataaggaccgcctgagaattaatcgctttgcctggccaaaaatcctcaaaataagctataaaaggtcaaatttctacatcaaggtccgtccagcagaactagaacagtttgagtcaaccattggatttaaactgcctaaccatagagctgctaaaagactctggaaggtgtgtgtggagcaccacacattctaccgcctcgtctcacccgagcagcctccaaaagctaaattcctcactcttgggtcgaagttccggtactcaggcaggactcaagcccagacacggcaagcttccacactcatcgataggcctgcaccccactttgagcggacatcaagcaagcgagtatcacggagtttggacggggcacccatcggtgtgatggaccagagcttaatgaaagatttccccggagccgctggcgaaatctctgcgtatgggccaggcttggtgtccatcgccgtcgtgcaggatggcgatggaagacgggaagttaggtcaccgactaaggctccccatcttcagctgatagagggaaaaagttctcatgaaacactgaatattgtggaggaaaagaagcgggctgaggtgggtaaggatgagcgggtcattaccgaagagatgaatggaaaagagataagccctggctccgggcctggagaaataaggaaagtcgaacctgtcactcagaaagattcaacttctctcagctctgagtccagcagctccagctcagaatcagaggaagaagacgtgggggaataccggcctcatcacagggtcacagaggggacaatccgcgaggaacaagagtatgaggaggaggtcgaagaggagccccgaccggcagccaaaccccctgtggtcaaaaccgagatggtaactatttccgatgcttcccaacggaccgagatcagtactaaggaggtccccatcgtacagaccgagacgaaaacaatcacctacgaatctccccagattgatggaggcgctggaggggactcaggaaccctgctgactgctcagactatcacaagcgagagcgtgtcaaccaccacaaccacacatataactaaaaccgtgaagggcggaattagcgaaactagaatcgagaagaggatcgtgataactggggacggcgacatcgaccatgatcaggcactggcccaagccatcagagaagcccgagaacaacatcccgacatgagcgtgacacgagtggtcgtccataaagagactgaactggccgaagagggcgaggattag

SEQ ID NO: 222233 - DNA, 357 bp, Artificial Sequence
  Description of Artificial Sequence: Synthetic coding sequence
atgaccactgaagtgggaagcgtatctgaagttaaaaaggattcctcacagctgggcacggacgccaccaaggaaaaacccaaggaggttgcagaaaatcagcaaaatcagagctctgatccagaagaggagaagggaagtcaacctcctcctgccgctgagagccagtcatccctgaggagacagaaaagggaaaaggagacctctgagtctcggggtatttcaagatttatacccccttggctaaagaagcaaaagtcatacacactcgtggtcgcaaaagacggcggtgacaaaaaagagccgacgcaggcagtagtggaggagcaagtgttggataaagaagaacccctttag

SEQ ID NO: 222234 - DNA, 606 bp, Artificial Sequence
  Description of Artificial Sequence: Synthetic coding sequence
atggaagaggaggagacccaactggaagaaaaaaactcattaagagtcgagggcgataacatatacgtgcggcacagcaatctcatgctcgaggaactggacaaagcccaggaggacatcttgaaacatcaggcatccatttccgagcttaagaggaattttatggagagtacgcccgaaccacggcctaatgaatgggaaaagagaaggattacacctctgagccttcagacccagggcacccgcgctcccgaaagcgaagggccatgcaccggagctcgagacgcagttaaaccaccggtggtcaagactgaaatggtgacaattagtgacgcctcccagcgtaccgagatttctactaaggaagtgccaattgtccagaccgagacaaaaacgatcacatacgagagtccccagacagtgaagggtggcatttcagagacaagaatagaaaaacggatcgtcattaccggtgatggtgacatagaccatgaccaggccctagcacaggccattagagaggcaagagagcagcaccctgacatgtccgtaaccagggtagtggtgcataaggagacagagctcgccgaagagggtgaggattag

SEQ ID NO: 222235 - DNA, 384 bp, Artificial Sequence
  Description of Artificial Sequence: Synthetic coding sequence
atgacgacggaggtcgggtctgtgtctgaggtaaaaaaggattcatcgcaactcggaactgacgctacaaaggagaaacctaaagaggttgccgaaaaccaacagaatcaaagctctgatccagaggaggagaaaggatcgcagcccccacccgcagcggaatcccagtcttctctccgtaggcagaagagagaaaaggagacatctgagtccagggggatctccagatttattcctccgtggctaaagaaacaaaaaagttacaccctagtagtggcgaaggatggcggagataagaaggaaccgacgcaggcggttgtcgaggagcaggtgctagataaagaggaaccattgcccgaagagcagaggcaggccaaaggatag

SEQ ID NO: 222236 - DNA, 489 bp, Artificial Sequence
  Description of Artificial Sequence: Synthetic coding sequence
atgactacggaagtgggcagcgtttccgaagttaagaaggactccagccagctcggcacggacgcaacaaaggaaaagccgaaggaggtggccgagaatcagcagaaccaaagcagtgaccccgaggaagagaaggggagccagccccctccggcagctgagtctcaaagcagtctgcggcgacagaaaagagaaaaagagacaagtgaaagccgcggaatcagccgatttatccctccgtggctgaaaaaacagaagtcctacacattggtggtcgccaaggacggtggagacaaaaaggaaccaacacaggcagtcgtggaggaacaggtgctggataaggaagaacccttgccagaggaacagcgccaggcgaagggcgatgccgaagagatggctcagaagaagcaggagatcaaggtggaggtgaaggaagagaagccctccgtgtcaaaagaggaaaagccgagcgtcagcaaggtagaatag

SEQ ID NO: 222237 - DNA, 3264 bp, Artificial Sequence
  Description of Artificial Sequence: Synthetic coding sequence
atgaccacagaatctggatccgactccgaatccaagccagaccaggaggccgaacctcaggaggctgccggagcacaggggagggctggagcacccgtgccagagccgccaaaggaagagcagcaacaggctcttgagcagttcgcagcagctgcggcacatagcacgcccgtacgccgagaggtgactgataaggagcaggagtttgcagctcgggctgccaagcaactagagtatcaacagttggaggatgataagctatcccaaaaatcatcttccagcaaactgagcagatcacctctcaagattgtgaaaaagcctaagagcatgcagtgtaaggtgattctcttggacggttcagaatatacatgtgatgtggagaagcgatctcgtggacaggtgctgtttgacaaggtgtgcgaacacctgaacttgcttgaaaaggactatttcggactgacttaccgagacgctgagaaccagaagaattggctagatcctgccaaagaaattaagaagcaggtccgcagcggtgcttggcattttagcttcaatgtgaagttctaccccccagatccagcccagctgtctgaagatattacaagatattacctttgtctgcagctgcgagacgatattgtatctgggagactgccatgctctttcgttacccttgcgctgctcggtagctacactgtacagagcgaactaggagactacgaccccgacgaatgtggcagtgactatatttccgaatttcgcttcgccccaaatcatactaaggagcttgaggacaaagtaatagaactccacaagagtcacagaggcatgacaccagctgaagcagaaatgcatttcctggagaatgccaagaaattatctatgtacggagtggatctgcatcatgcgaaggattcagaaggggttgagattatgctgggcgtgtgcgcctcaggtctgctgatctacagggacagactgagaatcaaccgcttcgcctggcccaaggttctgaagataagctacaagcggaataacttctacattaaaatccgccctggggagttcgagcagttcgagtccacaatcggcttcaagctccctaatcaccgggcagccaaaagactgtggaaggtgtgtgtcgagcaccatacattcttcagactgcttctgccggaggctcccccaaagaagtttctgaccttaggctcgaagtttcggtatagcgggagaacacaggctcagaccaggcgcgcttcagctctgatcgaccgacccgctccctattttgagagatcgagcagcaagcgctacactatgtcccgcagtctggatggggaggtcgggactgggcagtatgcgactaccaaaggtatttcccaaacaaatttaattacaaccgtcacgcctgagaaaaaggcggaggaggagcgagacgaggaagaagacaaaagacgcaagggggaagaggtgacacccattagtgctatccggcacgaaggtaaatctcctggcttaggcactgattcatgtcctctgtcaccaccgtccacgcactgcgctccgacgagcccgacagagctccgacgaagatgtaaagagaatgactgcaagttacccggatacgagccatcccgggcagaacacctccctggcgaacctgcgctggactctgatggcccaggccgtccttacctgggcgaccaggatgtggccttctcatacaggcagcagactgggaaaggtacaacacttttctcattcagcctgcagctacccgagtcatttccttcgctgctagacgacgacggttaccttagttttcccaatctgtcagaaacaaatttgcttccccaatctctgcagcactacctcccaatccggtccccctctctcgtcccatgttttctgtttatattcttttttctcctcagtgcctcgttcagcgttccctatgccctgacactctctttccccctggccctttgtttgtgctacctcgaacctaaagcagcttcactctcagccagcctagataacgatccaagcgattcgtcagaggaagaaaccgacagcgagcgcaccgataccgccgcagacggcgaaactactgcgacggagtctgaccaggaggaagacgcagaactgaaagcgcaggaattagagaaaacacaggacgacctcatgaaacatcaaactaacattagcgagttgaagcggaccttcctcgagacaagcacagacaccgcggtgaccaacgagtgggagaaacggttgtctacatcacctgtgcgcctggctgccaggcaggaagacgcaccgatgatcgagcccttggtgcccgaagagacgaagcagtccagtggggagaagttgatggacgggtctgagatcttttctttactggaatcagccaggaaacccacagaattcatcggcggagtgactagcacatctcaatcatgggtgcagaagatggaaacaaagaccgaatctagcggtatcgagaccgaacccaccgtgcatcatctcccactgtcaactgagaaagtggtgcaagagaccgtcctggtagaggagcggagagtcgttcacgccagcggtgacgccagctactcagctggagattcaggtgacgccgcagcccagccagcattcactggtattaaaggaaaagaaggatccgcgctaacagaaggagctaaagaggagggtggcgaggaggttgcaaaagccgtgctggagcaggaggagaccgcagcggcatcaagggaacgccaagaggagcaaagcgccgctatccatatatccgagaccctagagcagaaaccgcattttgagtcatctacagtaaagacggaaacaattagctttgggagtgtcagccctggcggtgtcaagctggagatcagcaccaaagaggtgccagtcgttcatactgaaaccaagaccattacctacgagtcttctcaggtagaccctgggacagacctggaaccaggcgtccttatgtccgcacagactatcacgagcgaaacaacaagtaccacaacaacaactcatatcactaagactgttaagggtgggatctctgagacccgaatagagaagcgcatcgtgataacgggagacgccgacatcgaccacgaccaggctctggcccaagccattaaagaggcaaaggaacagcaccccgatatgtctgtcaccaaggttgtggtgcacaaggagactgaaatcacacctgaagacggcgaggactag

SEQ ID NO: 222238 - DNA, 3264 bp, Artificial Sequence
  Description of Artificial Sequence: Synthetic coding sequence
atgacaaccgaatccggaagcgactccgaatccaagccagatcaagaagctgagccccaggaggccgcaggtgcacagggtcgagccggtgcaccagtgcccgagcctcccaaggaagagcagcagcaggcgctggagcagttcgccgcagcggctgcccacagcacccccgtcaggcgcgaggtgacggacaaagaacaagagtttgccgcaagggccgcaaagcagctcgagtatcagcagttggaggatgacaagctgagtcagaagagctcatccagtaaactatcccgtagccccctgaagatcgtgaagaagcccaaatccatgcagtgcaaggtgattttgctagatggaagtgaatatacctgtgatgttgagaaaagaagccggggtcaggtcttatttgataaggtttgtgagcatttgaacctattagagaaagactacttcgggctgacctacagggacgcagagaaccaaaagaattggctggatcccgctaaagagattaaaaaacaggtgcgctcaggagcttggcacttctctttcaatgtgaagttttacccaccagaccccgctcagttaagcgaggacatcacacgatattatctatgcctgcagctaagggacgacatcgtgtcgggacgactaccctgctcattcgtgacactggctctgctaggctcatacaccgtgcagtccgagttgggtgactatgatcctgacgagtgcggctcagattatatcagcgagtttaggtttgcccctaatcacacaaaagaattggaggacaaggtgatagaacttcataagtcacacagaggaatgaccccagccgaggccgaaatgcacttcctcgagaatgccaagaaactgagcatgtatggggtcgatctccaccacgcaaaagacagcgagggcgtggagataatgttaggggtctgtgccagcggtctcttgatctatagagaccgattgagaatcaatcggtttgcctggcctaaggtcctcaagatcagctataagcggaacaacttctacatcaaaattcgccctggggagtttgaacaatttgaatccacaatcggcttcaagctgccaaatcacagagctgccaaacgactatggaaggtgtgcgtggagcaccatacgttctttaggttactcctgcctgaagccccacccaaaaagtttctgactctaggatctaagtttcgttactcgggtagaacacaagctcagaccaggcgcgcatctgctctgatagaccgaccagccccttactttgaaaggtccagctccaaacgatataccatgtccaggtcgttggatggtgaggttgggaccgggcagtatgcgaccactaagggaatatctcaaacaaatctgattaccactgtcactcctgaaaagaaggcagaagaagaacgtgatgaagaggaggacaaacggcgaaaaggcgaagaggtcacccctatctccgcaattaggcatgaaggcaagtcccctggtcttggcacagacagttgcccattatctccccctagcacacactgcgcccctacgtctccaaccgagcttcgccgtcgatgcaaagagaacgactgtaagctcccgggttacgaaccatctagggctgaacacctgcccggtgaacctgcactcgattcggatggcccagggcgaccctacctcggcgatcaggacgtagccttttcttatcgccagcagactggaaaaggcacaaccctgttctccttttcactccagctgcctgagtctttccctagcctcctcgatgacgacggctatctatccttcccgaacctgtccgaaactaacctgctgcctcagtctttgcagcattacttgcctattcgtagccccagtctcgtcccttgctttctttttatctttttcttcctactctctgcctccttctcagtcccttacgccttgactttatctttccccttagccctgtgcctgtgctatttggaacccaaggctgccagtctgagcgccagcttggacaacgacccttctgactcttctgaggaggagactgacagtgagaggacagatacagcggcagacggcgagactacagccaccgaatcagatcaggaggaagacgccgagcttaaggctcaggagcttgagaaaacccaggatgacttaatgaaacatcagactaatatttccgagcttaaacggacctttttggaaacatctacggacaccgctgttaccaacgaatgggagaagaggttgtcaaccagcccagtccgccttgcagctcggcaggaggacgccccaatgatcgagccactggtacctgaggagactaagcagagttctggagagaagctcatggatggctccgaaatcttttctttgctggagtctgcacgtaagccgactgaatttatcgggggagtcacctcgacaagtcagagttgggtccagaagatggaaacaaaaactgaatcatctggcatagagacagagcccacagtgcaccatctcccactctccaccgagaaagttgttcaggagaccgtgctcgtggaggagcgcagggtagtgcatgccagtggggatgcttcatacagcgcaggagacagcggtgacgctgccgcacaacccgctttcacaggaatcaaaggcaaggaagggagcgcactgacggagggtgccaaggaggaaggaggcgaagaggtggcaaaggctgtcttggaacaggaagagaccgcagcagctagtcgggaaaggcaggaggagcagagcgctgcgattcatatcagcgagactctcgaacagaagcctcattttgagagctccacagtgaagaccgagacaataagctttggctccgtgtcccctggcggagtgaagctggaaattagtactaaggaagtgccagttgtgcacactgaaaccaaaaccatcacgtatgagagtagccaggtcgatccgggtactgatttggaaccgggtgtgctgatgtcagcacagaccataacatccgaaacaaccagcacaaccactactacccacataacaaagaccgtgaagggcggaatttcggaaactcggatcgaaaagcgaattgtcatcactggagatgccgatatcgatcatgaccaagccttggcccaggctataaaggaggccaaagaacagcaccccgatatgagcgtgaccaaggttgtagtgcacaaggaaacagagataacccctgaggacggagaagactag

SEQ ID NO: 222239 - DNA, 2598 bp, Artificial Sequence
  Description of Artificial Sequence: Synthetic coding sequence
atgactacagagagcggctccgatagcgagtctaaacccgaccaggaagctgagccccaggaggccgctggcgctcaggggcgagcaggcgctcctgtgccagaaccgccaaaagaggagcagcagcaagctctggagcaatttgcagccgcagctgcacactcaacacccgtgcggagggaggtcaccgataaggagcaggagttcgctgctagagccgcaaagcagctcgagtaccaacagctcgaggatgataagttaagccagaagagctccagcagcaagctctccaggtcacccttaaagattgtaaagaagccgaagtctatgcagtgcaaggtgattctactcgacggcagtgaatacacttgtgatgtggaaaagaggtctcgcggacaagttctatttgacaaagtatgtgagcatctgaatctgcttgaaaaggattacttcggtcttacatatagagacgccgagaatcagaaaaactggttagatcccgctaaagagattaagaagcaggtgcgctcaggagcctggcattttagctttaatgtcaagttttacccaccagatccggcacagttatcggaggacatcacaaggtattatctgtgcctgcagctgagggacgacatagtttccggacgcctgccatgctcattcgtgacgcttgcacttttggggtcctacacagtacagtcggaactgggggattatgatcctgatgagtgtggttcggactacatctcagaattcaggttcgctccaaaccatactaaagagttagaagataaggtgatcgagttgcacaagtcacaccgcggaatgactcctgctgaggctgagatgcacttcctggagaacgcaaaaaagctctccatgtatggagtagatcttcatcatgccaaggatagcgagggggtcgaaataatgcttggagtgtgtgcctcaggtttactcatttatagagatcgtctgaggatcaatcgattcgcatggcctaaggtgctgaaaatttcatataagcgcaacaatttctacattaaaattaggccgggagagttcgagcaatttgagtccactatcgggtttaaactgcctaatcatagggctgctaagagactgtggaaagtttgcgtcgagcaccacactttcttcaggctgcttctgccagaggccccaccaaagaaatttttgacgctcggaagcaaattccgctatagcggcagaacacaggcccagacccggcgagcatcggctcttatcgataggcccgctccgtattttgagcggagttcatctaaacgatatacaatgtcacgaagccttgatggggctagcgtaaatgaaaaccacgaaatatatatgaaggattccatgtcggccgctgaggtgggtaccggacagtatgcaaccaccaaaggcatctcccagacaaacctcatcacaaccgttaccccagaaaagaaggctgaggaagaaagagacgaagaagaggacaaacgtcggaaaggtgaagaagtaactcctatcagcgctattcgccacgagggcaaaacagacagcgaaaggacggacacggctgcagatggtgagaccacagcgaccgaggagctggagaaaactcaggacgatttgatgaagcatcagaccaacatctccgaactgaagaggaccttcctggagacctcgaccgacacagctgtgacgaacgaatgggagaaaagactctctaccagtcctgtacgtctcgcggcacggcaagaggatgctcctatgatcgagccactcgtgcccgaagagaaaatggaaaccaagacagagagctctgggattgagacggaacccaccgtccaccatctgccgctcagtaccgaaaaggttgtacaagaaacagtgctggtcgaagagcggagagtggtacatgcaagcggcgatgcttcttactctgctggagactctggtgacgctgccgcacaacccgcatttacaggaataaagggcaaagaaggcagcgccctgactgagggggctaaagaggaagggggagaagaagtggcgaaagccgtcctcgagcaggaagaaacagctgctgcctctagggagcgccaagaagaacagagtgcagccatccacatttctgagaccctggagcaaaaaccccacttcgagtcctcgactgtcaaaactgaaactatcagctttggttctgtttcacctggcggagtcaagcttgagatctcaaccaaggaggtgcccgtcgtgcacacagagacaaagacaattacctacgagagctctcaggtggacccaggcactgacctggagccaggtgttctaatgtccgcacagactattacaagcgagaccacgagcaccaccactaccacccacatcaccaagaccgtaaaaggcggaatcagcgagactcgaatcgagaagcgtatcgttatcaccggtgatgcagacattgatcacgaccaggcgctggctcaagcgattaaagaagccaaggaacagcaccccgatatgtctgtgactaaggtcgtggtgcacaaggagacagagattaccccggaggatggtgaggactag

SEQ ID NO: 222240 - DNA, 1155 bp, Artificial Sequence
  Description of Artificial Sequence: Synthetic coding sequence
atgaagcatcagacaaatatttctgaactgaaacgaacattcttggaaacctcaaccgacacagcggttaccaatgagtgggagaagcgcctgagtaccagtccggttcggctggccgcaagacaggaagatgcgccaatgatcgaaccactggtgccagaagagaccaaggaggaaacagaaatcagcgagaaagtgatcttccttcaacagggatctgccccttttctagaaagtcagactaagcaatccagcggagagaagttgatggatgggagtgaaatctttagcctcctcgagtccgcgcgaaaaccaactgagttcatcggcggtgtaacaagtaccagccaaagttgggtgcagaagatggaaaccaagacagagtcaagtggtattgagacagagccaacagttcaccatctccctctgtcaacagaaaaagtggtgcaagaaaccgttctggtcgaggaacggagagttgtccacgcttccggtgacgcaagctattccgctggtgacagtggagatgctgctgctcagcctgctttcacaggtatcaaggggaaagaagggtcagccctgacggaaggagccaaggaggagggaggagaggaggtggctaaggccgttttggagcaagaagaaacagccgctgcctcaagagagcgccaggaggaacaatccgccgcaatccacattagtgaaacccttgaacagaaaccacacttcgagagttctacagtcaagacggaaaccatcagcttcggttctgtctcgccgggaggagtgaaactggagatttcaaccaaggaagtccctgtggtacacaccgaaacgaagaccataacatacgagagctctcaagttgacccgggaaccgacctggaaccaggcgttctgatgtccgcccagactatcaccagtgaaaccacatcaaccaccaccaccactcatatcaccaagaccgtaaaggggggtatcagcgagacacgtatcgaaaagcgcatcgtgatcactggggatgcagacattgatcatgatcaggccctcgctcaggctataaaagaagccaaggagcagcatcctgatatgagcgtcacgaaagttgtggttcataaggagactgagataacccctgaggacggcgaggactag

SEQ ID NO: 222241 - DNA, 2271 bp, Artificial Sequence
  Description of Artificial Sequence: Synthetic coding sequence
atgcaatgcaaggtgatcctgttggatggatctgagtacacttgcgatgtggagaagagatcacgcggacaggtgctattcgataaagtgtgcgagcacctgaacttactggagaaagattatttcggtcttacatatcgcgacgctgagaaccagaaaaactggctcgatcctgcaaaggagataaaaaaacaggtgaggtcgggcgcatggcatttcagctttaatgtgaaattctacccgccagatcccgcacagctgagcgaggacatcacccgctactatctatgcttacagctgcgtgacgatattgtttctggccgactcccttgctccttcgtgacactcgccttattaggcagttatactgtgcagagtgaactgggggactacgatccggacgagtgtggcagcgattacatcagcgagtttaggttcgcccctaatcatactaaagagcttgaagacaaggtgatcgagctacacaaatcccatcggggtatgactccagccgaagctgaaatgcatttcttggagaatgccaagaaactttccatgtatggggtggacctgcaccatgccaaagattcggagggcgtggagatcatgctgggggtgtgtgccagcgggctgctgatctatcgcgacagactaaggatcaaccgatttgcatggcctaaggtccttaagatctcctacaagcggaacaacttctacattaaaatcagaccaggagaattcgaacagtttgagtccacgattggttttaaacttcccaatcaccgggcagcaaagcgcctgtggaaggtctgcgtggagcatcataccttttttcgcctgcttctgccggaggctcctcctaaaaagttcctgacactaggatccaagttccgctactcaggcaggactcaggctcagacacgccgtgcgagcgcactgatagataggcccgctccctacttcgagcggtcctcttccaagaggtacaccatgtctagaagtttggacggcgcttcggtcaacgaaaaccacgagatttatatgaaggactcaatgtcagccgcagaggtcgggaccgggcagtacgccactacaaagggtatcagtcagacaaacctcataaccacagtgactcctgagaaaaaagccgaagaagaacgcgacgaagaggaggacaagagaaggaagggtgaggaagtgactccaatttctgcaatcaggcatgagggtaagaccgattcagagagaacagataccgccgctgacggcgagacaaccgccacagaagagttggagaaaactcaggacgacctcatgaaacatcaaaccaatattagcgagctcaagcgaacatttttggaaacctctacagataccgcagttaccaacgaatgggaaaagcggctgtcaacatccccggtccgtctggctgccaggcaggaggatgcacccatgatagaaccgctggtgcccgaggagaaaatggaaaccaaaactgagtccagcggcatcgaaacagagccaacagtgcatcatctcccattatcaacagaaaaagtagtgcaagaaacagtgctggttgaagagagaagggtcgttcacgcctctggcgacgccagctattcagccggagattccggcgatgccgctgcccagcccgcattcactggcatcaaagggaaggagggcagtgcccttaccgagggcgcaaaggaagagggcggagaggaggttgcgaaggccgtgctcgagcaagaggagactgcagctgcctcccgcgaacggcaggaggaacagtccgcggcaatccacatttccgagactctggaacagaagccacacttcgaatccagcaccgtgaagaccgagacaataagcttcgggtcagtgtcccctggcggagttaagctggagatatctactaaagaagtccccgtcgttcacacagagaccaagactattacctatgagtcaagtcaggtggaccccggaactgatttggagccgggtgtgctcatgagcgcccagacaatcacatctgaaacaacatcgacaaccaccaccactcacattacaaaaactgtcaagggtggaatctctgaaacacgcattgagaaaaggatcgtaatcacgggcgacgccgacattgatcacgatcaggccctggctcaggcgattaaggaggccaaggagcaacatcctgatatgagtgtcacaaaagtcgtggtccataaagaaaccgagatcactccggaggacggtgaggactag

SEQ ID NO: 222242 - DNA, 1179 bp, Artificial Sequence
  Description of Artificial Sequence: Synthetic coding sequence
atgaaacatcagaccaatatctcagagttgaagcgcacatttctggaaacttccaccgacaccgctgtcaccaacgaatgggaaaaacgcctctctacctctcctgtccgcttagctgccagacaggaagatgccccaatgatcgagccattggttcctgaggaaccctctgtgatcaaaaagatgcaggagggagattccgcagacagcgtcgtgacctcgagacagatcatattccagaagacagttccttccacactcgaaactaagcagtcctccggtgagaaactcatggatgggagtgagatcttttctcttttggagagcgctaggaaaccaactgaatttatagggggagtcacatcaaccagccagtcttgggtgcagaagatggagaccaagacagaatcatctggaatagaaacagagccaaccgtgcatcacctgcccctctccactgagaaagtcgtgcaggaaactgtgctggtggaagagaggcgtgtggtgcatgcttcaggggatgccagttattctgcaggggatagtggcgacgcggcagcccagcccgcatttactggcattaaagggaaagaaggaagtgcccttacggaaggcgctaaggaggagggcggagaggaagtcgcaaaggctgtcctggagcaagaagagactgccgcagcaagtcgggaaagacaggaggagcagtccgctgcaatacatatttctgaaactctggagcagaaaccccattttgaaagttctacagtgaagactgagacaattagttttggctctgtgagtcctggcggtgtgaagctggaaatctctactaaggaggtcccggtggtgcataccgagactaaaacgattacgtatgagtcgagtcaggtggatccaggaaccgaccttgaacccggtgtgcttatgagtgctcagacgatcacgtccgaaaccaccagcaccaccacgaccacacacatcaccaagaccgtcaagggtggaatctccgaaactcggattgagaaacgaattgtgattaccggggatgccgatattgatcacgaccaggccctggctcaggctataaaagaagccaaggagcagcaccctgatatgtctgtgaccaaagtggtggtgcataaggaaactgagattacacccgaagatggcgaagactag

SEQ ID NO: 222243 - DNA, 936 bp, Artificial Sequence
  Description of Artificial Sequence: Synthetic coding sequence
cggtggcagcttggtggggctgctacggctgcagcaggcggagctcgcgtctggcgtcccttgcccgctagcaggagctccttcccacctccctctcctcgcctggatcctggagagttcgagggaaagtctccatgtggtggaacatgcgagcagccctatttgagtttacctttaaggtactttttttcacccagaaaagttgtgccggctggttgcgagcaggcgccaggaggcgctcctaaggaggggtttggggatagcgacagcgagtctaagccagaccaggaagcagagcctcaagaggccgctggggctcagggacgagccggtgcacctgtgccagaacctccaaaggaagagcagcaacaggctcttgagcagttcgcggcagccgcagcccattccacacccgtgcgtcgagaggtcaccgacaaagagcaggaattcgcggctcgcgctgccaagcaactggaataccagcaactcgaggatgataaactaagtcaaaagagttcctctagcaaactgtcccggtccccactgaagatcgttaagaagccaaaatccatgcagtgcaaggtaatcctactggatggctccgagtacacttgcgacgttgagaagaggtctcgcggtcaggtgctgttcgataaggtatgcgagcaccttaacctgctggagaaagattacttcggattgacatatcgggatgccgaaaaccagaaaaactggctcgacccggctaaggagatcaagaaacaagtgagaagtggagcgtggcattttagctttaacgtaaaattttatccacccgaccctgcacagttgagcgaggacatcacacggtactatctgtgtctccagctcagagatgacatcgttagtgggaggcttccatgcagcttcgtcacgctggcactgctaggcagttag

SEQ ID NO: 222244 - DNA, 2652 bp, Artificial Sequence
  Description of Artificial Sequence: Synthetic coding sequence
atgacgaccgagtccggttctgattctgagtcaaagcctgatcaggaggccgagccccaagaagctgcaggggctcaaggcagagctggagccccagttcctgagccaccaaaggaagagcaacagcaggcactggagcaattcgccgcagcggcagcccactccactccggtacggagggaggtcaccgacaaagagcaagagtttgcggctagagctgcaaaacagctagagtaccagcagctggaagacgataaactgagccagaaaagttcatcctcaaagctgagtaggtctcctctgaaaatcgtgaaaaagcctaagtccatgcagtgtaaagtgatccttctcgacggaagcgagtatacttgtgacgttgagaagagaagcagggggcaggttctgttcgataaggtgtgcgagcatttgaacctgctggaaaaggattacttcggtttgacttaccgcgacgctgaaaatcagaagaattggcttgatcctgctaaggagataaagaaacaggtgcggtcaggcgcttggcacttttccttcaatgttaagttctacccgcctgatccggcacaactctctgaggacataacaagatattacctctgcctgcagctgcgcgacgacatcgtctccggacgattgccttgcagttttgtaacgctcgcgcttctcggaagttacaccgtacaaagcgaattgggggactacgatcctgatgagtgtggctccgattatatctcagaatttcgctttgctccaaaccacacaaaggagttagaagataaggtgatcgaacttcacaaatcccatagggggatgactccagccgaggccgagatgcacttcctggagaacgccaagaagctgagcatgtatggggtagacctgcaccacgccaaagattctgagggcgtggagatcatgcttggagtatgcgcaagtggcttgctgatatacagagaccgattgcggattaatagatttgcgtggcccaaggtgttaaagatttcatataagcgcaataacttctatattaagatcagacctggagagtttgaacaattcgaaagcactattgggttcaaacttcctaaccatagagccgcaaaacgcctctggaaggtatgcgtcgaacaccacacctttttccggttactgctgccagaggcgccaccaaagaaattcctaactctggggagcaagttccgctacagtgggaggactcaggctcaaactcgtcgagcatcggccctgatcgaccgtcccgcaccatacttcgagaggtcgtcctccaaaagatataccatgtcccggtctctggacggtgcctcggtcaacgagaatcacgaaatatatatgaaagattcaatgtccgctgctgaagttgggaccggccagtatgcaaccactaagggtatatctcagaccaacttgattacaacagtcacacccgaaaaaaaagctgaagaggagagagacgaggaagaagataagcggcgaaaaggagaagaggttaccccaatcagtgctatccggcacgagggcaagaccgatagcgaacggactgacaccgctgcagatggcgagacaaccgcaacagagtccgatcaagaggaggacgctgaactaaaggcccaggagctggaaaaaacgcaggatgatcttatgaagcaccagacaaacatctctgagttgaaacgcactttcctcgagacatccaccgataccgccgtaactaacgagtgggagaagcggctgtcaacgtctcctgttagacttgctgccaggcaagaggatgcccctatgatagagcctctcgtacctgaggaaacaaagcagtcttctggcgaaaaactgatggatggctctgagattttttccctacttgagtccgcacgcaagcccactgaatttataggtggagtgacctctacctcccagtcgtgggtgcagaaaatggaaacaaaaacagaatctagcggaattgaaactgagcccaccgtgcaccatctgccgttgtctaccgaaaaggttgtgcaggagacagtgttggtcgaagagagaagggtggtgcacgcgagcggcgacgcttcctattccgcgggtgactctggtgatgcagccgcacagcctgctttcactggcataaagggtaaagaggggagcgcactgacagagggtgccaaagaggaaggaggagaagaggtggccaaggcggtcttagagcaagaggagaccgcagcagcttcaagagagaggcaggaagaacagagtgctgccattcacatctcagagacccttgaacagaaaccacactttgaaagtagtaccgtcaagacagagaccataagcttcggaagtgtttctcctggaggcgtaaaacttgagatcagtaccaaagaagtgccagttgtccacaccgagacgaagaccataacttatgagagtagccaggtagaccctgggaccgatctggaaccaggagttctcatgagtgcccagacaataacctccgagaccacttccaccaccaccacgacccatattactaaaactgtcaaaggtgggatttcagaaacgcggatcgagaaacggatcgtaattactggcgacgcagacatcgaccacgatcaggaatag

SEQ ID NO: 222245 - DNA, 2271 bp, Artificial Sequence
  Description of Artificial Sequence: Synthetic coding sequence
atgcaatgcaaagtgatattgttggatggctctgagtatacctgtgacgtcgagaagcgcagccgtgggcaggttctctttgataaagtgtgtgaacaccttaaccttttggagaaggattattttggtctgacgtacagagatgccgagaaccagaagaactggctggacccagcaaaagagatcaaaaaacaagtgcgtagcggagcctggcacttcagctttaatgtcaaattctatcctcccgatcctgcacagctctccgaagatatcacccggtactatctgtgcttacagctgcgggatgatatcgtttctggtcggctgccctgctccttcgtcacactggctttgttaggctcctatacagtgcaatcagaactgggggactacgatcccgatgagtgtgggtccgactacatttcagagtttcgcttcgctccgaatcacactaaggagctggaggacaaggtgattgagcttcataaaagccacaggggaatgacacccgctgaggccgagatgcatttcctcgaaaatgcaaagaaactttccatgtacggggttgacctgcaccatgccaaggattcggaaggggtagagattatgctgggagtgtgtgcctccggcctgctcatttacagagatcgtttgcgaattaatcgctttgcttggccaaaggtgcttaaaatttcttacaagagaaataacttctacatcaagataagacctggggaattcgagcagtttgaatccacaatcggctttaagctgcccaaccacagagctgccaagaggctttggaaagtgtgcgtggagcaccacacgtttttccgtctcctcctccctgaggcacccccaaaaaagttccttaccctgggttccaagtttcgctatagtggaagaacacaggctcagacccgacgggctagcgccttgattgatcgccctgctccttactttgaaagaagctcttcaaagcgttatacaatgtccagatctctggatggcgcttctgttaacgagaaccatgaaatatacatgaaagactctatgtccgcagctgaggtgggcacagggcagtacgccacaacaaagggaatttcgcaaactaatctcatcaccacagtgacccccgagaaaaaagcagaagaagagcgggacgaggaggaagacaagcggagaaaaggggaagaggttacacccatcagtgctatccgccatgaggggaaaaccgactcagaacgcactgacacggcagccgacggagagacaaccgcaaccgaagaactggaaaaaacacaagatgacctgatgaagcatcagacaaacatttctgagttgaaacggacatttctagagacttcgacggacacagctgttacgaacgagtgggagaagagactgtctacgtcccctgtgaggttagctgccaggcaggaagatgctcccatgatagagcccctggtccccgaagaaaagatggagaccaaaaccgagtcatccggtattgaaactgaaccgacagtccatcacctgccccttagtacagagaaggtggtgcaggagacagtgctcgtagaggagcgtcgggtggtccacgccagtggagatgccagctattctgctggagactctggggatgcagctgcccagccagcctttacgggaataaaaggcaaggaagggtctgcactgactgaaggagctaaggaggagggtggcgaggaggtggcgaaggctgtgctggagcaagaagagaccgccgctgcttctcgcgagaggcaggaggaacaatccgccgcaattcacatctccgagactctggagcagaagccgcattttgagtcctcaactgtaaagacagaaactattagcttcggatctgttagtcctgggggagtgaagctggaaatttctaccaaggaggtacccgtcgttcatactgaaactaaaaccattacatatgagagcagccaggtggacccgggaacggatctcgagcctggagtcttgatgtcagcccagacaattaccagcgagaccacttctaccaccaccacaactcacatcacgaagaccgtgaaagggggaattagcgaaactcgcatagagaaaaggattgtaattacgggggacgcggatatcgaccatgatcaggcccttgcccaggcaattaaggaggcgaaagagcagcatcctgacatgagcgttacaaaggtcgtcgtgcacaaagaaaccgagatcacccccgaggacggggaggactag

SEQ ID NO: 222246 - DNA, 2166 bp, Artificial Sequence
  Description of Artificial Sequence: Synthetic coding sequence
atgggtcagggcgaaccttcccagcgaagcactggtttagccggactttacgcagctcctgcagcctcacccgtttttatcaaaggctctggcatggatgcgctcggaataaaatcttgcgatttccaagccgctcggaataatgaggagcatcacaccaaggctctctcctcacggcgtctctttgtcaggcggggtcagccctttacaatcattctctactttcgggcacctgttcgcgcatttcttcccgctctaaaaaaggtggcactaacagcacagaccggcgaacagcccagcaagattaaccgtacccaagctacattccctatatcctcactgggggaccgaaaatggtggtcagcggttgtcgaagagcgggacgcacagtcctggacaatatcagtcactacacccgctgatgccgtaattggccactacagcctcctgcttcaagtttccgggagaaagcagctcctattaggccaattcaccctgctgttcaacccttggaatagggaggacgccgtgttccttaagaatgaggcgcagcgtatggaatacctgttgaaccagaacggactaatctatttgggaactgccgactgtattcaagctgaatcttgggatttcggtcagtttgagggtgacgtaattgacctttcactccggctgctgagcaaggacaagcaggtggaaaaatggagtcaacccgtacatgtggctagggttctgggtgccttgctgcactttttgaaggagcagcgagttctgcccaccccccagactcaggccacccaggagggagccctgctgaataaaagacgaggcagcgtaccaattctgcgacagtggctgactggccgaggcagacccgtgtacgacggacaggcttgggtgctggcagccgtcgcttgcacagtattgcggtgtctggggataccggcacgggttgtcaccactttcgcttccgcacagggtaccggcggacggctgctcatcgatgagtactataacgaggaaggactgcagaacggtgagggacagaggggcaggatttggattttccaaacctcaaccgagtgctggatgacacggccagcactgccgcaagggtatgatggctggcaaattctgcatccatccgctcccaatggcggtggcgtgctgggcagctgcgatctggtaccagtgagagccgtgaaggaggggacgctgggcttaacacccgcagtatcagatctgttcgcagcaatcaatgctagctgcgtggtctggaaatgctgcgaagatggcacactggagctcactgattccaacacgaaatatgtcggaaataacatttcaacaaaaggagtaggaagcgaccggtgtgaagacattacccagaactacaaatatcctgagggatcgctgcaggaaaaagaggtactggaacgggtggagaaagagaaaatggagagagaaaaggacaacggaattcggcctcccagtttagagaccgcttctccactctacctactgctgaaggcccctagttcactcccattaagaggagatgctcagatctccgtgaccttggtgaaccacagcgaacaggaaaaggccgtgcagctggctatcggcgtccaagccgtccactataatggcgttctcgctgcaaaactgtggcgtaaaaaactgcacttgacactctctgcaaatctcgagaagatcatcaccatcgggctgttcttcagtaacttcgagcgcaatccaccagaaaacacttttctacgcctcacagccatggctactcactctgagagcaacctcagctgtttcgcccaagaggatatcgcgatatgccggcctcacctggcgataaagatgccagaaaaggccgaacaatatcaaccattgactgcctctgtgagcctgcaaaatagcctggacgcacctatggaggattgtgtgatcagcatcctgggccgaggtttgattcacagggagcgcagttatagatttcggtccgtctggccggagaatacaatgtgtgctaagtttcagtttacccctactcacgtggggctgcagcgcttgacagttgaggttgattgcaacatgtttcagaacctgaccaattacaaaagcgttacagtcgtggccccagagctttcagcttag

SEQ ID NO: 222247 - DNA, 1860 bp, Artificial Sequence
  Description of Artificial Sequence: Synthetic coding sequence
atgggtcaggctttaggcataaagtcttgcgattttcaagctgctagaaacaatgaggagcaccacacaaaagcactgtccagccgacgccttttcgtccggcgtggccagccctttaccattatactctacttccgggcaccggtgagggcgtttcttcctgccctgaaaaaggtggcacttaccgcacaaacaggagagcaaccgtccaaaatcaatcgaacacaagcaacatttcctataagcagtcttggcgaccgtaagtggtggtccgccgtggtggaagagcgagacgcccaatcatggacaatttctgtgacaactcctgctgacgccgtgattggacactattcactcctgctgcaggtgtccggcagaaaacaactgctgctgggtcagtttacactgctgttcaacccatggaaccgggaggatgccgtgtttctgaaaaacgaagcccaacggatggagtacctgctgaaccagaatggtctgatttacttgggcactgctgactgcatccaggcggagtcctgggactttggccagttcgaaggtgacgtaattgacttgtccctgaggctcctgagtaaggataaacaggtggagaaatggtcccagccagtgcatgtggctagagttcttggggctctgcttcacttcctgaaggaacagcgcgttcttcctacgccacagactcaggcgacccaagaaggagcactcctaaacaagcgacggggtagcgtgcccattctgagacagtggcttaccgggagaggaaggcctgtttacgacggacaggcttgggtccttgcagctgtagcctgcacagtcctgaggtgtcttggaatcccagcaagggttgtaacaacattcgccagcgctcagggaactggcggacggctgttaatcgatgagtactataatgaagagggcctgcagaatggggagggtcaacggggaaggatttggaagtgttgcgaggacggaacgctcgaactgactgactccaacactaagtatgttggtaacaacatctctaccaagggcgtcggttcagatcgctgcgaggatatcactcagaattataagtaccctgaaggctcactgcaagaaaaggaagtcttggagagggtcgagaaggagaagatggaaagagaaaaggacaacgggattcgtcctcccagcctggagactgcctccccattgtatctcctgctgaaagccccttctagtctgccattaagaggcgatgcacaaatttccgtgaccttagtgaaccactctgaacaagagaaggccgtccagcttgctatcggtgtgcaagcagtacactacaacggcgtcttggccgctaagttgtggagaaagaagttgcatttaacactgagcgccaatctcgaaaagatcattactattgggctgttctttagcaattttgagcgaaacccccctgagaatactttcctgcgcctcacagccatggcaactcactcggagagtaatctgtcctgctttgctcaggaggacatagccatctgtcgaccccatctggctatcaagatgcctgaaaaagccgagcagtatcagcctcttaccgcctctgtcagtttgcagaacagtctggatgcccctatggaggattgcgtaatctccatcctagggcgaggtctgatccaccgtgagcgttcatacaggttccggagcgtgtggccagaaaacaccatgtgcgcaaaattccagtttacaccaacccacgttggtctgcaaagactgaccgtggaggtggattgtaacatgttccagaacttgacgaattacaagagcgtaactgttgtggcccctgagcttagtgcctag

SEQ ID NO: 222248 - DNA, 2076 bp, Artificial Sequence
  Description of Artificial Sequence: Synthetic coding sequence
atgggacaggccctaggtatcaagagctgcgactttcaggctgccaggaacaatgaggagcaccacacaaaggccttgagctctcgaaggctctttgtgaggcggggtcagcctttcaccatcattctatatttccgagcacctgttcgcgcttttctccctgcgcttaagaaggtggccctcactgctcagaccggcgagcaaccttcaaagataaatcggacccaggccacttttcctatatcctccctgggcgatcgaaaatggtggagcgccgttgtcgaggaacgtgatgcccaatcctggaccatctcagtaaccaccccagccgatgcggtcatcgggcactattcactgcttttacaagtgtccggacgcaagcagctgctcctcgggcaatttaccttactgttcaacccttggaatagagaggacgccgtgttcctaaaaaacgaggcccagagaatggaatatcttcttaatcagaacggccttatctacctcggcaccgcagactgcatccaggctgaatcttgggacttcggtcagttcgaaggggatgtgatagacctgagtttaaggctcctgtctaaggataagcaggtggaaaaatggtctcagccggtccacgtagctcgggtcctgggggctcttctgcactttctcaaggagcagcgtgtcctgcccacccctcaaacacaggccacacaggaaggggcacttctgaacaaacggagaggatctgtgcccatcctgaggcaatggctgacaggtcgcggaagacctgtctacgatggccaggcctgggtgctagctgccgtcgcctgtacagtcctgaggtgtcttggaattcccgctagggtcgtgaccacctttgcaagcgctcagggcaccggtggaagactactgatcgacgagtattacaatgaggagggtttgcagaacggagagggccagcgtgggcgaatctggatatttcagactagtacggagtgctggatgaccagacccgctcttccccaaggttacgacgggtggcagattctgcacccaagtgcacctaatggtggcggagttctcggatcctgcgacctagtcccagttagagcagtaaaagaggggaccctgggactgacccccgcagtatctgacctgttcgcggctattaatgcgagctgtgttgtctggaagtgctgcgaggacggcaccctcgagctgactgactccaataccaaatatgtaggcaacaatatcagcacaaaaggcgtcgggtcggatcgctgcgaggacattacacaaaactacaaataccccgagggtagcctgcaggaaaaggaagtcctggagcgagttgagaaggaaaaaatggaacgtgaaaaggacaatggaattcgcccaccaagcttggagacagcgagtcctctgtacttgctgctgaaggctccttcgagcctgcctttacgaggggatgcgcagataagtgttacccttgttaaccactcagagcaggaaaaggccgtccagctggctataggagtgcaggctgtccactacaacggtgtgctggcagctaagttgtggaggaaaaaacttcaccttacgctgtccgctaatttggaaaaaattatcacaatcggcctctttttctcgaactttgaaagaaaccctccagaaaacacattcctaaggctgacagctatggcaactcacagcgaaagcaacctaagctgttttgcacaggaggatattgcgatatgtaggccgcacttggcgattaaaatgcctgaaaaggcagaacagtatcaacccctcacagcctccgtatctttgcagaatagcctggacgcaccaatggaggactgcgtcatcagtatcctgggcaggggactgattcatagggaacggagctaccgattccggagcgtatggcccgagaatactatgtgtgccaagttccaatttacccctacacacgttggactacagcgtctcaccgtggaggtggactgtaatatgttccaaaatttgactaactacaaaagtgtcacggtcgttgctccagaactcagcgcctag

SEQ ID NO: 222249 - DNA, 1842 bp, Artificial Sequence
  Description of Artificial Sequence: Synthetic coding sequence
atgggtcaagcgctggggatcaagtcatgtgatttccaggcggctagaaacaatgaggagcaccacacgaaagccctgtcgtctcgtaggctctttgtccggaggggccagcccttcacgattatcctgtattttcgggcacccgtgcgcgcatttctccctgctctcaaaaaggttgccctcactgctcagaccgaagatgctgtgttcctgaagaatgaggctcagaggatggagtatctcctgaatcaaaacggcttaatctatcttggcactgctgattgtatacaggctgagtcttgggatttcggtcagttcgaaggagatgtgatcgacctgtctctgagattattatccaaggataaacaagtggaaaaatggtctcaacctgtccacgtggcgcgtgtactgggagcccttctgcatttcttaaaggagcagagggtactgccaaccccccagacccaggccacacaggaaggcgcactgctgaataagcgccgaggctcagtgcccattttgcgtcagtggctcacaggacggggtagacctgtctatgacggacaggcttgggttttagccgctgttgcctgcactgtgctgcgctgcctggggatacccgcacgggtcgttaccactttcgcttcagcccagggcacaggagggcgtctgctgatagatgagtattacaatgaggaaggcttgcagaacggggagggtcagcgcggaagaatctggatttttcaaactagcaccgaatgttggatgaccagacctgcactgccacaaggttatgatggctggcaaatcttacatcccagcgctcccaacggaggcggagtccttggatcttgtgatttggtccctgtgagagcggttaaggaaggaacgttgggtctgacgccagcagtttccgacttattcgcagctattaacgcctcctgcgtggtgtggaaatgttgcgaggacggcactttggaactgaccgattcaaatacgaaatacgtgggaaataatatcagcacgaaaggtgttggatccgacagatgcgaggatatcacccagaattataagtaccctgagggatccctccaggagaaggaggtccttgaaagagtggagaaggagaagatggagagggagaaagataacgggattcgtcctccatcactggagaccgctagtcctctgtatctgttactgaaggccccatcatctctgcccctgcggggtgacgcccagatatcagtgaccctcgtcaaccattctgagcaggagaaagccgtccagctggctataggtgttcaggctgttcactacaacggagtcttagcagcaaagctgtggaggaagaagcttcatctgacccttagtgctaacctggagaaaatcattacaatcgggttgtttttctctaactttgagagaaacccacccgagaatactttcttgaggctgaccgccatggcgactcacagtgagagcaacctgtcatgttttgctcaggaggacatagccatttgtcggcctcacctagcaattaagatgcctgagaaagcggagcagtatcagcccctcaccgcatcagtctctctgcagaatagcctggacgctcctatggaggactgcgtcattagtatcttggggagaggcttaatccatagggagagatcttataggtttcgctccgtttggccggagaacactatgtgcgccaaatttcaattcactcctacgcatgttggcctgcaaaggctcaccgtcgaggtggattgtaatatgtttcaaaacctgaccaattataaatccgtaaccgtggtcgcccctgaactgagtgcctag

SEQ ID NO: 222250 - DNA, 1218 bp, Artificial Sequence
  Description of Artificial Sequence: Synthetic coding sequence
atggaaagactacagaaacaacccctgacatccccgggatccgtctctccatcgcgtgacagttcagtgccagggagtccctcaagcattgtggcaaagatggacaatcaggtcctggggtacaaagatttggccgctattcctaaggacaaagcaattctagacattgaaagacctgacctgatgatatatgagccacattttacttacagccttctggagcacgtcgaactgccacggagtagggaacgctcgctaagtcccaagagcacgagtcctcctccatcaccggaagtttgggccgacagccggagcccagggattattagtcaggcctccgccccaaggaccaccggtacacccagaactagcctacctcactttcaccacccagaaaccagccgccctgatagcaatatctataagaagccgccaatatataagcagcgcgaatccgtggggggttccccccaaacgaagcacctgattgaggacttgattattgagagctctaaatttcccgctgcacagccgcctgaccccaatcagccagccaagatagagaccgactattggccatgtcctccctccttggctgtggtggagactgaatggagaaagcggaaggcctcgagacggggtgccgaagaggaggaagaagaggaggatgacgactccggggaagaaatgaaagcactgcgtgaaaggcagcgggaagagttgagcaaggtgacttcaaaccttggaaagatgatcctcaaggaggaaatggaaaaaagcctgccaatccgcaggaagacccggtctttgcctgataggacacccttccacacctctctgcaccaaggaacgtcaaaatcatctagcctgccagcttacggaaggaccactctgtcaagacttcagtctacggaattttcaccgagcggatccgaaacagggtcacccggactgcaaaatggtgaagggcagagagggaggatggaccggggaaatagtctcccatgcgtcttggagcaaaagatttatccatacgaaatgctagtggtaacaaacaaaggcaggacaaagctgcctcctggcgtggacagaatgagactggagagacacttgagcgccgaggatttctcgcgggtgtttgccatgagccccgaggagtttggtaagctcgcactatggaagaggaatgaactcaaaaaaaaggcctctctcttttag

SEQ ID NO: 222251 - DNA, 1218 bp, Artificial Sequence
  Description of Artificial Sequence: Synthetic coding sequence
atggagcggctgcagaagcaacccctgacctcaccaggatcggtgagtccttctcgagattctagcgtacccggatccccttcaagcatcgtagccaaaatggataatcaggtgctggggtacaaggacctggctgccataccaaaggataaagctattctcgatattgagaggcccgatctgatgatttatgaacctcactttacctactcactattggagcatgttgagctgcccaggtcacgggagcgatccctgtctccaaaatcaacatctccccctcccagccccgaagtgtgggctgacagtcgcagccccggtattataagtcaggccagcgcccctcgtactactggaacaccaaggacttctctgccccacttccatcaccccgagacatcccggcctgactctaatatatataaaaaaccgcctatctacaaacagagggagagtgtcggaggttccccccaaaccaagcatctgatcgaagatctcattattgaatcttcaaagttccccgctgcacagcctcccgatccgaatcagcccgctaaaattgagacagactattggccctgtccgccttcgctggcagtggtggaaaccgagtggagaaagcgaaaagcttctaggcgaggggctgaggaggaagaggaagaagaggacgacgattctggggaagagatgaaggctttacgggagaggcaacgcgaggaactaagcaaagtgacctctaacctgggcaagatgatcctgaaggaagagatggaaaagtccttgcccattagacgaaaaacccggagccttccagataggaccccgttccacaccagcctgcaccaggggacatccaaatcgtcctctctccctgcttacggcagaactactctatctcgcctacagtccacggagttctcccccagtggatccgagacaggctcgcctggtctgcagaatggtgagggacagcgcggacgcatggataggggaaattctttgccttgtgtgttggagcaaaagatttacccgtatgagatgctggtagttaccaacaagggcaggaccaaactgccgcctggtgtagataggatgcgcctggaaaggcacctgtctgccgaggacttttccagggtgtttgccatgagtccagaggaatttggtaagttagccttgtggaagagaaacgaactgaaaaagaaagcatctctattttag

SEQ ID NO: 222252 - DNA, 1626 bp, Artificial Sequence
  Description of Artificial Sequence: Synthetic coding sequence
atgatctacgagccacattttacctactccttgcttgagcacgtggagctgcccagatctcgcgagaggtcactgtcgcccaagagtacatcacctccaccaagtcccgaggtgtgggccgatagtcggagcccgggtataatcagtcaggcgtccgcacccaggactaccggaacgcccagaacttctctgccccactttcaccatcccgaaaccagcagaccagacagcaacatttacaaaaagcccccaatttacaaacagcgggaatcggtaggaggaagcccccagacaaaacacttgattgaggatttaattattgagagcagcaaatttcccgcagcccagccccctgatcccaaccagccagccaaaatcgagaccgattactggccttgccctccctctctcgccgttgtagaaaccgagtggcgcaagagaaaggctagccgcagaggcgcagaagaggaggaagaggaggaagacgatgattccggcgaagaaatgaaggcattaagagagcgacaacgggaagaactgtcaaaggtcacctccaacttggggaagatgatactaaaagaagagatggagaagagcctcccaataagacgcaagacgaggtctctaccagataggacacctttccacacgagtctacatcagggaactagcaagtcttctagtctgcccgcatacggtcgcactaccctgtccagactccaaagcacagagttttcaccgtccgggtccgaaactggatcccctggtcttcagaatggtgagggccagcgagggaggatggatcgcggaaatagcctgccctgcgtgctggagcagaagatctacccctacgaaatgctcgtagtcaccaacaaaggccgaaccaaactgccccctggggtggatcggatgcgtcttgagcggcacctctcagctgaggacttcagtcgggtatttgccatgagtcctgaagaattcggaaaactcgccctgtggaaacgtaatgagctgaaaaagaaagctagcctgtttggtgccttagtggtgcggcctgtgggatgtttggaacagctggaaggtcggtgccggggaggaaaacgaccaggaaggaagtcaagtcgcttgctttgccgacctcccagccctccaatcttaaccccagactcattccccgctctgcagcctcctgcacctctgaccctggtggggacaggacccagtagcgcaagcggtcgggaggtgactccccctctgcagttggcgcttacgtctgcccgtaaaccaagagccagcaaaccttttgcacctgcattgcggctgcctcagaagcctggactgcgcgtggagatgccaccaacgcacgacccagggcctcctcctgccagcaggccccgaaatggcaatagctctaccaaacctgggaccggtcagaagctgggtcttcccccacctctggacggtgtcaagagacccggactcgcacactttggtgtgtcttggctgcccgcactcacttacacccatgctccccctcatacactttgtagcctaaagaatgtaatatactggggcccaccttcgtgcttcccacacctaccactaccttacctcacacctcctgcttag

SEQ ID NO: 222253 - DNA, 1152 bp, Artificial Sequence
  Description of Artificial Sequence: Synthetic coding sequence
atggagcgactacagaaacaaccattaacctcgcccggttctgtgagtccttctcgggactcgtccgttcctggttctccaagctcgatcgtcgcgaaaatggacaaccaggtactcggttataaggatttggccgctatcccaaaggacaaagccatcttggacatcgaacgcccagaccttatgatttatgaaccccatttcacatactccctactggagcacgtcgaacttccgcgtagccgtgagcggagtctttccccaaaatccacctctccgccacccagtcctgaggtatgggccgactcccggtcaccaggaatcatttcgcaggcctccgcccctcggactaccggcactccaaggacatccctcccacacttccaccaccccgagacatctcggcctgattccaacatatacaagaaacctcccatctacaagcagcgagaaagcgtcggaggttcaccacaaacaaagcacctgattgaggatctcattattgagtcttccaaatttcctgcagcccagcccccagacccaaaccagcccgctaagatagagacagactactggccatgtccccctagcttggccgttgtagaaactgagtggaggaaacgcaaagccagcagaaggggcgctgaagaagaagaggaggaggaagacgacgactctggagaggaaatgaaggctctgcgcgaaagacagcgggaagaactttccaaagtcacttccaacctaggcaaaatgatcctaaaggaggaaatggagaaatccctgccaatccggcgtaaaaccagatccctgccagatagaacaccgtttcacacctccctgcaccaggggacttccaaatcttcttccctccctgcctacggtaggacaacactgtcaaggctacaaagtaccgagttctccccaagtggaagcgagacgggttcccctggtctgcagatttacccttatgagatgctggttgtgacgaacaaggggagaaccaagcttcccccaggcgtggaccgtatgagattggagaggcacctgagcgccgaggacttttcccgagtatttgcaatgtccccagaggagtttggaaagctcgctctgtggaaacgtaacgagctcaagaaaaaagcatcccttttttag

SEQ ID NO: 222254 - DNA, 1152 bp, Artificial Sequence
  Description of Artificial Sequence: Synthetic coding sequence
atggagcgtctgcaaaagcagcctcttacgtccccagggtcagtgtcgccatctcgcgactcaagcgtgcccggttctcctagctcgatcgtggcaaagatggataaccaagtcctcggatacaaggaccttgcagcaatacccaaggacaaagcgatactggacatagagcggcctgacctgatgatttacgagccccactttacttatagcctcttagaacacgtagagttgcccagatcccgggagagatctctgtccccaaaatctacctctccaccaccttccccagaagtgtgggccgactctcgaagccccggtattatctctcaagcttccgctccccgtactacagggacgcctaggaccagtctcccccattttcatcaccctgaaacttcaagaccagattccaacatttacaagaaaccaccaatttataaacagagggaatccgttggcggttccccccagactaaacatttaatcgaggaccttattatcgaaagttcgaagtttcccgctgcacagcctccagaccctaaccagccagccaaaatcgaaactgactactggccctgccctccgagtttggcagtggtcgagactgaatggaggaaaagaaaggctagcaggaggggcgctgaggaggaggaagaggaagaagatgatgactctggagaagagatgaaagccctgagagaacgccaacgagaggagttgtctaaggttaccagtaatttgggcaaaatgatacttaaggaagagatggaaaagagccttccgatccggagaaaaactcgtagcctgccagaccgcacccctttccacacatcactccatcaaggcaccagcaaatcttcatcactacctgcctacggacggactaccctgagccgtctgcaaagtacggaatttagtcctagcggtagtgagacaggatccccaggcttacagatttatccctacgagatgctagtggttacaaataaaggtcgaactaaactgcctccaggggttgatcgaatgcggctggaacggcaccttagtgccgaagactttagcagggtcttcgcgatgtcgccagaggaattcggaaaactagccttatggaagcggaacgagctgaagaaaaaagcgtcactgttctag

SEQ ID NO: 222255 - DNA, 1218 bp, Artificial Sequence
  Description of Artificial Sequence: Synthetic coding sequence
atggagcgcttgcagaagcaaccactgacctccccaggatcagttagccccagtcgggacagcagtgtcccaggaagccccagctccatcgtggccaaaatggataaccaggtactgggttacaaagatctcgctgcgattcctaaggataaggcaatcctggatattgaacgccctgacctgatgatttacgagcctcatttcacttactctctgcttgagcacgtggaactgcccagaagtagagagcgttcactgtccccaaaatccacctctccacccccatccccagaggtgtgggccgactcccgcagtcctggaatcattagtcaagcaagcgcgcctagaaccaccggaacacctcggacatccctgccccacttccaccaccccgaaacctctcgcccagactcgaacatatacaaaaagcctcccatctacaaacagagggagtcagtgggtggcagccctcagacgaagcatctgatcgaggaccttatcatcgaatctagcaaattccccgcagcccagcctcctgatccaaatcagccagctaaaattgaaacagactattggccatgtcccccaagtttagccgtggttgagaccgaatggagaaagaggaaagcctctcgtcgcggagctgaggaggaagaagaggaggaggacgacgatagtggcgaggaaatgaaggccttgcgtgaacgtcaaagggaagagctctcaaaggtcacgtccaacctcggcaagatgattctgaaggaggaaatggagaagtcactgccgattcgccgtaagacccgcagtctgcccgacagaaccccctttcatacttcactgcatcaggggacttcgaagtcatcctcactgccggcttatggaagaacaaccctgagcaggctgcagtcaacagagttcagtcccagcgggtccgaaacaggatcacctgggctgcaaaatggcgagggtcagcgaggtagaatggaccgcggtaactccctcccctgcgttcttgagcaaaagatctatccgtacgagatgttggtggtgacaaataaggggagaaccaaactgccaccaggagtggacaggatgagacttgagcgccacctgagcgccgaagattttagcagagtcttcgccatgagcccggaggagtttggtaagctggctttgtggaagcggaacgaactcaagaaaaaagcgagccttttctag

SEQ ID NO: 222256 - DNA, 1077 bp, Artificial Sequence
  Description of Artificial Sequence: Synthetic coding sequence
atggaacgcttgcagaaggccaaaatggacaaccaggtgctcggttacaaggacctggctgccatcccaaaggataaggccattctcgacatcgaacgcccagacctcatgatctatgaaccccacttcacttattcactcctcgaacacgtggaattaccgcgaagccgcgagagatctttgtccccaaagagtaccagccctcctcccagtcccgaagtttgggcagattctcgctctcctggcatcatctcacaggcctcagcccctcggacaaccggcacaccacgtacaagtctgccccattttcaccaccctgagacctctagaccggatagtaacatctacaagaaaccaccaatttacaagcaacgtgagagcgtgggcggatcaccgcagacgaagcatctaatcgaagacctgattattgagtcctctaagtttccagctgctcagccacccgatccgaatcagcctgccaagatcgagacagattattggccctgtccaccatcgctggcagtggtggagacggagtggcgtaaaagaaaggcatctagacgtggcgctgaagaggaagaggaggaagaggacgatgattctggggaggagatgaaggccttaagagaaaggcagcgagaagagttatctaaggtgaccagtaatctgggcaaaatgatcctcaaagaggagatggagaaaagccttcctattcgtagaaagacacgatccctgcctgatcgaactccctttcacacctcccttcatcaagggacatccaaatccagctcattacctgcttatggcaggacgacattaagcaggcttcagtcaaccgaattcagcccaagcggttctgagacaggcagccctggacttcagatttacccgtacgaaatgctcgtcgtgacgaataaagggagaaccaagctccctcccggtgtggaccgcatgaggcttgagcgacacctgagtgcggaagactttagtagggtgttcgcaatgagccccgaggagtttggcaagctggcactgtggaagagaaacgagctcaagaagaaagcttctcttttttag

SEQ ID NO: 222257 - DNA, 1152 bp, Artificial Sequence
  Description of Artificial Sequence: Synthetic coding sequence
atggaaagacttcagaaacagccgctcaccagcccaggcagcgtgtccccctcaagggacagctctgtgcctggaagcccttcaagcattgtggcgaaaatggacaaccaggttctgggctataaggacttagccgctattcccaaggataaagctattctggatatcgaacgtcctgatctgatgatttacgaacctcacttcacctacagcctactggaacacgtggaactgccccgaagcagggaaagatcattatctcccaagagcacctccccacctcctagtcccgaggtgtgggcagattctagaagtccaggcattatcagccaggcatctgctccacgcacaactggcacccccaggacctccctgccgcacttccatcaccccgaaacttcccgtcctgatagcaacatttacaaaaaacctccgatctataagcagagggagagcgtaggaggcagtccccagactaaacaccttatagaagacctaatcattgagagctctaaattccccgcagcccagcccccagatcccaaccagcctgcaaaaattgagacggactactggccttgccctccctccttggctgtggttgagactgaatggcgcaagaggaaagcttcccgcaggggcgcagaagaggaagaagaagaggaagatgatgatagcggcgaggagatgaaggcgctccgcgagcggcagagagaggagttgtccaaagtgacctctaatttaggaaaaatgatacttaaggaagagatggagaaaagcctgcccattcggcgaaaaactcgtagcctgcccgaccgaacaccgttccacaccagcctgcatcagggtacatctaagtcctcaagcctgcccgcttatggaagaactacactgagtaggctgcagagtacagagttctcccctagtggtagtgaaacaggctccccgggtctccagatctacccttatgagatgctggtggtgaccaataaggggaggaccaaactcccgccaggggtggatagaatgaggctggaacggcatctgtcagctgaggacttttcacgggttttcgccatgtctccagaagagttcggcaagcttgccctatggaagcgtaacgagctcaaaaagaaagcttctttattttag

SEQ ID NO: 222258 - DNA, 1218 bp, Artificial Sequence
  Description of Artificial Sequence: Synthetic coding sequence
atggaacgcttacagaaacagcccttgacttcgccagggtccgtcagcccttctcgtgacagtagcgtccccggatctccaagttccatcgttgcaaaaatggataaccaggtccttggatataaagatctagctgccataccaaaagacaaggcaatcttggacatcgagcggcctgacctgatgatttacgagcctcactttacctactctttgctggaacacgtcgaactgcccaggagccgagagcgttcactgagtccgaagtctaccagcccccctcccagtccagaggtgtgggccgactcccgaagccctggcataatttctcaagcgtcagcccctcgtaccaccggtaccccaaggacatcactgccgcatttccatcaccccgagacttctcgccctgactccaacatctataaaaagcctccaatttataagcagagagagagcgtaggtggcagcccccagacgaagcatctgatcgaggatctgataatcgagtcttcaaagttccccgcagctcaaccacccgatcccaatcagccagcgaaaattgagactgactactggccctgtccaccctccctcgctgtcgttgaaacagaatggcgcaagagaaaggctagccgccgaggagctgaggaagaagaggaggaggaagacgacgatagcggcgaagaaatgaaggcacttagagagcgccagcgagaggagttgagcaaggttacaagcaacctgggaaaaatgatcctgaaggaagaaatggagaagtccctgcccatccggaggaagacacgaagtctgcccgaccgcactcctttccacacctctcttcaccaggggacatctaaatcatcctcactgcccgcttacggtcgtaccacactttctcggctgcagtctactgaattctcaccatcagggtcggagactgggagccctggcctacagaatggggagggtcaacgtgggaggatggaccgaggcaatagcctaccttgtgtgcttgagcaaaagatctacccatatgaaatgctggttgtcacaaataagggcagaacgaagttgcctcctggggtcgacagaatgcggttggagcgccacctcagcgccgaggacttcagtcgcgtgtttgccatgagcccagaagagtttggaaagcttgccctttggaaaagaaacgaactcaagaagaaagcctccctcttctag

SEQ ID NO: 222259 - DNA, 1098 bp, Artificial Sequence
  Description of Artificial Sequence: Synthetic coding sequence
atggaacgactgcagaaagccaaaatggataatcaggtcctaggctacaaggacctggctgccataccaaaagataaagccatattagacattgagcgacccgatctgatgatttacgagcctcactttacctatagccttctggaacatgtcgagttgcctcgctcccgagaggtgtgggctgattcacgaagtcccggaatcattagccaggcctccgcccctcggaccaccgggactccacgcactagcctcccgcactttcaccaccccgaaacctcacgccctgacagcaatatctataagaaacccccaatttataaacaacgcgaatctgtgggagggtcgccacagacaaaacatctcatcgaggacttgatcatcgagtcttccaaattcccagctgcgcagccaccagaccccaaccagcctgccaagattgagaccgattactggccctgcccaccatctctggctgtcgtggagacagaatggcggaagagaaaagccagccggaggggggcagaggaagaggaagaggaggaggatgatgattcaggagaggagatgaaagccctgcgagagcgtcagagagaagaactctcgaaagtaaccagtaacctaggcaagatgatcctgaaagaggagatggagaagtcccttcctatacgacggaaaactcgctcgctgcctgacagaacacccttccatacctccctgcaccagggaacaagtaaatcatcctcgctgcccgcatacggacgtactacgttaagccggctccagtcaacagaattctccccaagcggatccgagaccggcagtcccggactgcaaaacggcgaaggacaaagaggaaggatggaccgaggaaactccttaccctgcgtgctggagcagaagatttatccttacgagatgctggttgttacaaacaagggccgtacaaagctgccaccaggtgtcgacagaatgcgtcttgaaaggcacttgtctgcagaggacttctcccgggtgttcgccatgagtcccgaagagttcggtaagctcgcgttgtggaaaaggaacgagttaaagaaaaaagcctctcttttttag

SEQ ID NO: 222260 - DNA, 570 bp, Artificial Sequence
  Description of Artificial Sequence: Synthetic coding sequence
atggatgctgtcgatgccaccatggagaaactccgtgcccaatgcctcagccggggtgcctcaggtattcagggccttgccagattctttcgccagctagatcgggacggctcccgctctcttgacgccgatgaattccgccagggactggcaaaactcggtctggtgctagatcaggctgaggcagagggcgtttgtagaaagtgggaccgaaatggatctggtacgctagacttggaggaattcctacgcgctcttcgccctcccatgtctcaggctagagaggctgttatcgcagctgccttcgccaagctagatcggtctggagatggggtcgtgacggtcgacgacctgagaggcgtatactcgggtagagctcaccctaaggtccggtctggcgaatggacggaggacgaggtgcttcggcgttttctggataattttgatagttctgagaaggacggccaggtgaccctggccgaattccaggactattacagcggggtgtctgcctccatgaacaccgacgaggagttcgtggccatgatgaccagcgcctggcaactctag

SEQ ID NO: 222261 - DNA, 2565 bp, Artificial Sequence
  Description of Artificial Sequence: Synthetic coding sequence
atggcccttgagcaggcattacaggctgccaggcaaggcgagttagatgtcctcaggagcctccacgcagctgggctgcttggacctagtctgagagaccctctggatgccctccctgtccaccacgcagccagggctggaaaactccactgtctcaggttcctcgtggaggaggccgctctgcccgcagccgctagggcccgaaatggcgctacgccagcccatgacgcttccgctaccggtcaccttgcctgcctgcagtggctgttgagccaggggggttgtcgtgtgcaggataaagacaacagcggagcaaccgttcttcatctagccgcacgatttggccaccccgaagtcgtgaattggcttttgcaccatggcggaggggacccaacagccgcaacagatatgggggctctgcctattcactatgccgcagccaagggggactttccaagcctgcgactgctggtggagcactatccagagggtgtgaacgctcagaccaaaaatggcgcaacaccactctacctcgcctgtcaggagggtcacttggaggtgacgcagtatcttgtgcaagagtgtggagctgatccccatgcacgagctcacgatgggatgacgcccctacatgctgcagctcagatggggcactcaccagtcatagtttggctcgtttcatgtactgatgtcagcttgtccgaacaggacaaggacggcgcaaccgcaatgcacttcgcggcaagcagggggcataccaaagtactcagttggcttctcctgcatggaggagaaataagcgccgatctgtggggtggaacacctctgcatgacgccgctgagaatggtgaactcgaatgctgccagatcttggtggtgaacggggcagagctcgacgtgagggaccgggatggatacacggcagctgatcttagcgactttaatggacactcacattgtacaagataccttcgtacagtggagaatctgtccgtcgagcatcgtgtcctcagccgcgacccatctgctgaacttgaggccaaacaacccgacagcggtatgtccagccctaataccactgttagcgtgcaacccctgaattttgacctgagctctcccacgagtactctcagtaattatgattcctgtagttctagccactccagcattaaggggcagcaccctccatgtggactcagctccgcgagagcagcggacattcaaagttatatggacatgctgaaccccgagctggggttgccacgtggaaccataggcaagccgactcctccacctcctccaccttcctttccccctcctcctcctcccccaggcacgcagttaccccctccccctcctggataccctgccccaaagcctccggtgggcccacaggctgcagacatttacatgcagactaagaataagctgaggcacgtcgagacagaggcactgaaaaaggaactgtcttcttgcgatggtcatgacgggctgcggaggcaggattcctcacggaaacctcgggctttctctaagcaacccagtactggcgactactaccgtcagctgggtagatgtcccggagagaccctggctgcaagaccagggatggcacacagcgaggaagtgcgcgctcgtcagccggcacgagctggctgtcccaggcttggccctgcagctcgtgggtccttagagggcccatccgctccgcctcaggcagcgctgctacccggaaaccacgtgcccaatgggtgtgctgcggatcccaaggctagtcgcgaactccctccaccaccccctccacccccacctccactaccggaggccgcaagttcccccccacctgctcctcccctgccactggaaagcgcaggccctggatgcgggcagaggagaagctcttcaagcactggctccactaagtcctttaacatgatgtcccctaccggggataattcagagcttctcgctgagataaaagcgggaaaaagcttgaaacccacacctcagtcaaaaggattaaccacagtgttttcaggcatcggacagccggcatttcaacccgactcccccttgcccagtgtgtctccagcactgagccccgtgcgtagtccaacgccgccagccgcaggtttccaaccactcctgaatggcagcctggtgccagtgccacctactacccccgctccaggtgtgcagctcgacgtggaggcgcttattccaacccacgatgagcaaggccgaccaattccggagtggaaacggcaggtcatggtacgcaagatgcaactcaagatgcaggaggaagaggaacagcgacgtaaggaggaagaagaagaagcgcgtcttgcctctatgccggcatggcgcagggacctactcagaaaaaagttggaggaggaacgtgaacagaagaggaaggaggaggaacgccagaaacaagaggaactgcgacgtgagaaggaacagtccgagaagctccgaaccctgggctacgacgaatccaagctggccccatggcagagacaagttattcttaaaaagggcgatatcgcaaaatactag

SEQ ID NO: 222262 - DNA, 867 bp, Artificial Sequence
  Description of Artificial Sequence: Synthetic coding sequence
atggctcactcagaagaagcggctctgcttcctggcaaccacgtgccgaatggctgtgccgctgacccaaaggcctcacgagaactcccaccccctcccccaccccctccacccccactgcctgaggccgcatcatcgccacctcctgcaccacccctgccactagagtccgccggtcccggatgcggtcagcggagatccagctccagtacgggtagcaccaagtcgttcaacatgatgtctcccaccggcgataactccgagttgctcgccgagataaaagctgggaagtccctcaaacccaccccccagtctaagggtctgaccactgttttctccggaattggacagccagctttccagcccgattcccctcttccctccgtttctccagctctgagcccagtgagatcacccactccccctgctgctggattccagcctctacttaacgggtctctggtgccggttccaccaacaactcctgcacctggggtacagctggatgttgaagccctgattcccactcatgatgagcagggacgtcctattccagaatggaaaaggcaggtcatggtccggaagatgcaattaaagatgcaggaggaggaagaacagaggagaaaggaggaagaggaggaggcgcgacttgcctctatgcccgcttggcgacgcgaccttttgaggaaaaagttagaggaggaacgtgaacagaagcggaaagaggaggagagacaaaaacaggaggagctccgcagagagaaagagcagtctgagaaactgcgaacactgggctatgatgaaagcaaactggcgccatggcagagacaggtgattttaaagaagggggacatcgccaagtactag

SEQ ID NO: 222263 - DNA, 645 bp, Artificial Sequence
  Description of Artificial Sequence: Synthetic coding sequence
gatggcatgactccactccacgcagctgctcagatgggccactctccagtaatcgtgtggcttgataaggacggggctactgcgatgcacttcgcagcttctagaggccacactaaggtgcttagctggcttctgctgcacggtggagagatatctgcagatctttggggtggcactcccttacacgatgctgctgagaacggcgaattggaatgctgccagatactggtcgttaatggcgctgagttggacgttcgagaccgggacggatatacagccgcagatcttagcgatttcaacgggcactcacattgcacaaggtacttgagaaccgtggaaaacctttcagttgaacacagagtcctctcccgggatcctagcgctgagctggaggctaagcagcctgattccggcatgagcagcccaaacaccactgtgtccgtgcaaccactcaacttcgacctctccagccctacaagcacgctttcgaattatgacagctgctcatcatctcactcgtccattaaggggcagcatccaccatgcgggctaagcagcgcccgagctgcagatatccaatcctacatggatatgttgaacccggagctgggactgccacgcggaacaattgggaagcccacatag

SEQ ID NO: 222264 - DNA, 567 bp, Artificial Sequence
  Description of Artificial Sequence: Synthetic coding sequence
tgagagattaaggccggtaagtccctgaagccaacccctcagagtaaaggtctgactaccgtttttagtgggatcggccagcctgcttttcaacccgattcccccttgccatctgtgtcccctgccctgtccccagtgaggagcccaacaccgccagctgctgggttccagccgctcttgaatggtagtctagttcctgtgccaccgaccacacccgctcctggggtgcaactggatgtcgaggccttgattcccacacatgacgagcaggggagaccaataccagagtggaagcgccaagtcatggtccgaaagatgcaactcaaaatgcaagaggaggaggagcagaggcgcaaagaagaagaagaggaggcgaggttggcaagcatgcctgcctggaggcgcgacctcttgcgtaagaagttagaagaggaacgcgagcagaagcgaaaggaggaagagcgtcaaaagcaagaagaactaagacgggaaaaagaacagagcgaaaagctgcgtactctgggctacgatgaatctaaactggcaccgtggcaacgccagatctag

SEQ ID NO: 222265 - DNA, 1335 bp, Artificial Sequence
  Description of Artificial Sequence: Synthetic coding sequence
atggcccgagttggacccggaagggctggtgtttcctgccagggacggggtcgcggacgtggcggttcaggccagcggaggcccccaacgtgggaaatttccgactccgatgccgaagattctgccggaagcgaggctgctgccagggccagagatccggctggagagaggcgcgctgctgcagaagctcttagacttctgagacccgagcaagtcctgaaacgattggccgtttgcgtggacaccgccatcttggaggatgccggtgcagacgtcctcatggaggcattagaagccctggggtgcgaatgccgaatcgagccgcaaagaccagccagatctctacgctggactcgcgcaagccccgacccttgtcctcgatcgctcccacctgaggtctgggcagctggggaacaggagttgctgcttctgttagagccagaagaattcctgcagggggtggcaacattgacccagatctctggccctacccactgggttccttggatctctccagagacaaccgccagaccacatctggccgtcataggcctggatgcttatttgtggtatcgatccctttcttgcccccaacaggggtggctggggagaggcttccggggaggtggcctgtggcagaggccttcctcagggagagccggacccatggggagcggcgaggagtggagccctcttctccggagtcgtcaacacgttagccgaggcacgcagcaacccgaaagccctaaagttgcaggggcagaggtagccgttagctggccagaggttgaagaggttcgggcttgtctttcttgggccctggtgcttctgcaattgtgggctaacctggacgtacttctcgtcgcctcctggcaggaactctctcgacatgtttgcgctgtgaccaaagctctagcccagtacccccttaagtgtgttatgcccaggcttaaaggagggcgtattacttccagacagtacagggagtcccaggccttctctttttgtactgcagggcgatgggccgcaggcgagccagtagcaagagatggagcgggactgcaggcagcctggcgtcgccagatcagacagttttccagagtaagcccagctgttgctgacgccgtcgttaccgccttcccctcaccaagactgcttcagcaggccttggaggcctgttcaaccgagcgggagaggatgggcctcctcgccgatttgcccgtgcccccatccgagggcggtcggccaaggcgcgtcggaccagacttaagcaggcgtatttgcctttttttgaccacggctaatcccgatttgctcctggatctagggtcatag

SEQ ID NO: 222266 - DNA, 1161 bp, Artificial Sequence
  Description of Artificial Sequence: Synthetic coding sequence
atggcacgggtcggacctgggagggccggagtgagctgccagggacggggtagagggaggggcggttctggccagcggaggccgcctacctgggagatctcagatagtgatgccgaggattcagctggatccgaggccgctgcccgagcccgagacccggcaggcgagcggagagccgctgccgaggcactgagactgcttaggccggaacaggtcctgaaacggcttgccgtgtgcgtggacactgcgatccttgaagatgcaggtgcagatgtgctgatggaggcccttgaagcattgggctgtgagtgccggatcgagccccagagaccagcgagaagcctacggtggacccgagcttcacccgacccttgtccaaggagccttccacctgaggtgtgggccgctggggagcaggagctcctgctccttcttgaacctgaagagttcctgcagggcgtggcaacactcactcagatctccggacctacacactgggtgccctggatttccccggaaacaacagctcgccctcatctggctgtgattggccttgatgcttatctgtggtccaggcaacacgtaagccgtggaacacagcagccggaaagcccaaaggtcgccggagcagaggtggcagtaagttggcctgaggtggaggaggtacgggcatgcctttcttgggcgctggttttgctccagctctgggcaaaccttgatgtgctgttagtggcctcttggcaagaactgtcgaggcatgtgtgtgcagtgacaaaagccttggcacaatacccactgaagtgtgttatgcctaggctgaagggcggacgcattacgtcacgccagtatagagagagccaggccttcagcttctgcaccgctgggaggtgggcagcgggtgagcctgtggcgcgagatggtgcaggcttgcaggcagcctggagaagacagatccggcaattcagcagggtttcccccgctgttgcagacgcagtggttacagccttccccagtccgagactactccagcaggccttagaggcatgctcgactgagcgcgaacggatgggactgctagccgttgggccagatctgtctcgccgtatttgcttgtttcttaccacagccaaccccgacctgctcctcgacctaggatcctag

SEQ ID NO: 222267 - DNA, 2523 bp, Artificial Sequence
  Description of Artificial Sequence: Synthetic coding sequence
atgatgtcaatccaggagaagagtaaagagaatagctcaaaagtgacaaagaaaagtgatgataaaaactcggagaccgaaattcaggacagccaaaagaacctagccaagaaatccggacctaaggagacaattaagtctcaagctaagtcctcaagtgagagcaagattaatcaaccggagcttgaaacacggatgagtaccaggtcgtcaaaagcggcatctaacgacaaggcgacgaaaagcatcaacaaaaacacagtgacggtgagaggctactcacaagagtctaccaagaagaagctttcacagaaaaagttagttcatgagaaccctaaggccaatgaacagctgaacagaaggtcccaacgcttacaacagctgactgaagtgagccgcagatccctgcgctccagggagatccagggccaggtgcaggctgtgaagcagagtctccctcctacaaaaaaggagcaatgctccagcacgcaaagcaagagtaacaagacaagtcaaaaacatgttaaacgcaaggtcctggaagtgaagtcagactctaaggaggacgaaaacttagtgatcaacgaggtcattaatagccccaaaggcaagaaaagaaaggtggaacatcaaactgcatgcgcttgttcctcccagtgtacccaggggagcgagaagtgccctcagaagactactcgacgggatgaaacgaagccggttcccgttacaagcgaggttaagagaagtaagatggctacaagcgtagtcccgaagaagaacgagatgaagaaatccgtgcatacccaggttaataccaataccactcttcctaagagccctcagccaagtgttcctgagcagtctgataacgagctcgagcaggcgggaaaatccaagcgaggaagtattctacagctgtgtgaggaaatcgccggagaaatagaaagtgacaatgtggaggtcaaaaaggagtcaagccagatggaatcggttaaggaggagaagcctacagagatcaaacttgaagagaccagcgttgaacggcagatcctgcaccagaaggagacaaaccaggatgtccaatgtaaccgattcttcccaagccggaagacaaagccagtgaagtgcatattaaacgggatcaattcaagcgctaagaagaactccaactggaccaaaatcaagctaagtaaattcaattcagttcagcacaacaagcttgacagccaggtgagccctaagctgggcctgcttagaacgtccttctcaccacccgctctggagatgcatcaccctgtcacacagtccactttcctgggtacgaaactgcacgatcgcaatatcacgtgtcaacaggagaaaatgaaagagatcaattcagaggaggtgaagattaacgatatcactgtggagataaacaagacaaccgaaagagcgcctgaaaattgccacctggccaatgagatcaaaccgtctgatcccccactggacaaccagatgaagcacagttttgattctgcatctaacaaaaacttctctcagtgtctggagtccaaactggagaactcacccgtggaaaacgtcacagctgccagtaccctgttgtcccaggcaaaaattgacactggggaaaataaatttccaggctccgcccctcagcaacattctatcctgtctaatcagacatccaaatcttcggataaccgtgagacaccacggaaccactccctcccgaagtgcaattcccacttggaaataactatccccaaagacctaaagcttaaggaggctgagaaaacagacgagaagcagctgatcattgatgcaggtcagaaacgatttggtgccgtgagctgcaatgtctgcgggatgctgtacaccgcatcgaaccccgaggacgaaactcagcatctattgtttcacaatcaattcattagcgcggtcaaatatgtggggtggaaaaaagagcggatactcgctgaataccctgatggtcgaatcatcatggtactgcccgaggatccaaagtacgctttgaagaaggtcgacgagatacgagagatggtcgataacgacctgggcttccagcaggcccctctcatgtgttactctcgaaccaagaccctcctgtttatttccaatgataagaaggtggtgggatgcctgattgccgaacacattcagtggggatatcgcgtcatcgaggagaaactcccggttattcggtccgaagaggaaaaagtacggttcgagaggcaaaaagcgtggtgctgctcgaccttgccagagccagcaatatgcggaatatcaagaatctgggtgtttagtatgatgcgacggaaaaaaatcgccagcagaatgatcgagtgcttgcgctcaaatttcatctacggcagctatctttctaaagaagaaattgctttttccgatcccacccctgatggaaaactgtttgctacccagtactgtggcactggacagtttcttgtttataattttatcaatggccagaatagcacctag

SEQ ID NO: 222268 - DNA, 2106 bp, Artificial Sequence
  Description of Artificial Sequence: Synthetic coding sequence
atgatgtccatccaggaaaaaagcaaggagaactcgagcaaggtgacaaaaaagtctgacgacaagaacagcgagaccgaaatccaggacagccaaaagaatcttgcaaaaaaatctggtccaaaagagaccatcaagagccaagccaagtccagttcggaaagcaaaatcaaccagcccgagctggaaactcggatgagcacacggtcatctaaggctgcatccaacgacaaggcaaccaaatcaatcaataaaaataccgttacagtgagaggctactcgcaggaaagcaccaagaaaaaactttcacagaaaaagctggtgcacgaaaaccccaaagcaaatgagcagctgaacaggaggagccagcgtctccagcagctgactgaggtgtcacggagaagcttgcgaagtagggaaattcagggccaggtccaggccgtgaaacagagcctgcctcccactaaaaaggaacaatgtagctctacacaatcaaagagcaacaagacatcccaaaagcacgttaaacggaaagtgctggaggttaaatccgactctaaagaggatgaaaatctggttataaacgaagttattaatagccctaaaggaaagaagcggaaggtagagcatcagaccgcttgcgcttgtagcagccagtgtacccagggcagcgaaaaatgtccccagaaaacaacccggagagatgagacaaagccggtccccgtgacatctgaggtgaaaagaagtaagatggccacctccgtagttccaaaaaagaacgagatgaagaaaagcgtgcatacccaggtgaacacaaatacaacattacccaagtctcctcagccctcagtgcctgagcagtccgacaacgagctcgagcaagctgggaagagcaagcgcggttctatcctccagttatgcgaggagatcgccggagaaatcgagagcgacaatgtggaagtgaagaaggagtccagccagatggagtcagtgaaggaggaaaaacctacagagataaaattggaggagacttccgtggaacgtcagattcttcatcaaaaagaaaccaatcaggatgttcaatgtaatcggttcttcccgtctagaaaaaccaagcccgtcaagtgtatcctcaacggtattaacagctctgccaaaaaaaacagcaactggacaaagatcaaactctcaaaattcaacagtgttcagcataacaaacttgactcacaggtaagcccaaagctgggcttgctgaggaccagcttttctccgccagccttagagatgcaccacccggttacccagtctacctttctgggaactaagcttcatgatcgcaatattacctgtcagcaagaaaagatgaaagagatcaactccgaagaggtcaagatcaatgacatcacggtggagatcaataagaccactgagcgagcccctgaaaattgccatttagctaatgagattaagccgtcagatccgcctctggataaccaaatgaaacactcgttcgatagcgcgagcaacaagaactttagccaatgtcttgaaagcaagctggagaattcccctgtggaaaatgttacagccgcaagcacgctcctgagccaagccaaaatcgacaccggagagaataagtttcctggttcagccccacaacagcactctatcctgtctaaccagacctctaagtccagcgataatcgcgaaacacctcggaatcacagcctccccaagtgcaactcacacctggaaatcactattcccaaagaccttaagcttaaagaggctgaaaagacagacgaaaagcaactgatcatcgatgccggacagaaaagatttggtgccgtgtcatgtaatgtctgtggcatgttgtacacagcctctaatccagaggatgagacccaacacctattatttcacaaccagttcatatctgcggtaaagtatgtagtgctcctgatcaaccatcacgaatgtggcagcgaggaagaattcataactagcctgttcctcagtatgttcaattttcgctacactcaaagaagcttctcctttcctatccggttcctagaaggactagaagagcgcaagaactccggttag

SEQ ID NO: 222269 - DNA, 1806 bp, Artificial Sequence
  Description of Artificial Sequence: Synthetic coding sequence
atggctgctctgactcccaggaagcgcaagcaagactccttgaaatgtgattcgctgcttcatttcacggaaaacctcttcccaagccccaataaaaaacactgcttttaccagaattccgataaaaacgaggaaaatttacactgctcccaacaggagcattttgtgttatcagccctcaaaactacagagatcaacagactgccttcagcaaatcagggctcaccattcaagtcggctctgtctacagtgtccttttataaccagaataaatggtacctaaatcctctcgagaggaagttgataaaagaatcccgaagtacttgtctgaagacgaacgatgaggataagagtttcccaatagtcactgagaagatgcagggtaaacccgtgtgtagcaagaagaataacaagaagccccagaagagcttaactgcgaagtaccagccaaaataccggcatattaagcctgtgtcacggaattcacgcaactctaaacaaaaccgcgtgatctataagcccattgtcgagaaggaaaataactgccatagcgccgagaataacagtaatgcccctcgcgtgctctcacagaagattaagccccaggtgacattacagggaggcgctgctttttttgtgaggaagaagagtagccttaggaaatcctccttggagaacgaaccaagtcttggacgtacacagaaatcaaagagcgaagtaatagaagacagcgatgtggaaacagtcagtgaaaagaagacctttgccactaggcaggttcctaaatgccttgtgctggaagagaaattaaagattggcctcctgtcggcctcatctaagaataaggagaagctgattaaggatagctccgacgacagagtgtcttccaaggagcacaaggtggacaaaaacgaagcttttagtagcgaagactctcttggtgaaaataaaactatcagtcccaagtcaaccgtttatcccattttctcagcaagtagtgtgaatagcaagaggtcactcggagaggagcagttctctgtgggctcggtgaactttatgaaacaaacaaatatacagaaaaacaccaatacacgcgatactagcaaaaagacaaaggaccaactcatcatcgacgctggccagaaacattttggggcaaccgtgtgtaagagctgcggaatgatttatacggcaagtaacccagaagatgaaatgcaacacgttcagcatcatcataggtttcttgaaggaattaagtatgtcggttggaagaaggagcgagtggtggcagagttttgggatggaaagatcgtattagtgctcccccatgatccgtcctttgctatcaagaaagtggaagatgtgcaagagcttgtagacaatgagctcgggttccagcaggtagtccctaagtgtccaaataagataaagacgtttttgttcattagtgatgaaaagcgggtcgttggctgtctgatcgcagaaccaattaaacaagcctttagagtcctctctgaaccgattggtccggagagtccatcttcaacagagtgtccacgtgcttggcagtgttctgacgtacccgagcctgcagtatgcggcatctccagaatctgggtcttccggctgaagcgcagaaagagaattgcacgcagactggtagatactctgaggaattgttttatgtttggctgctttctgtcgactgacgagatagcgttctcagacccaacacctgacggtaaattgttcgcaaccaaatactgcaatactccaaatttcctggtttacaactttaacagctag

SEQ ID NO: 222270 - DNA, 720 bp, Artificial Sequence
  Description of Artificial Sequence: Synthetic coding sequence
atgaagcagacaaacatccagaaaaacacaaatactcgggatacatcaaaaaagaccaaagaccagttaatcatcgatgctggccagaagcatttcggagccaccgtgtgtaaatcgtgcgggatgatctatactgcctccaatccagaggacgagatgcagcacgttcaacatcatcacagattcctggagggaatcaagtatgttggttggaagaaagaacgcgtggttgccgagttttgggacggcaagatagtgcttgtattgccccatgacccaagcttcgctatcaagaaagtcgaagacgttcaagaactggtcgacaatgagttaggatttcagcaggtcgttcctaaatgtccaaataaaataaagaccttcctctttataagtgatgagaaacgggtcgtgggttgtctcatcgctgagccaataaaacaggcattccgtgtgcttagcgagcccatcggccctgagtcaccaagcagcaccgagtgtccacgggcatggcaatgttcggatgtcccagagcccgcagtgtgtggaatatctaggatctgggttttccgactcaaacgccgtaaacgcattgcaaggcggctggtggacacattgcggaactgcttcatgtttggatgcttcctcagtaccgatgagatagcatttagtgatcccactccagatgattgtcgtagactgaaccggtaccaggaaacttag

SEQ ID NO: 222271 - DNA, 849 bp, Artificial Sequence
  Description of Artificial Sequence: Synthetic coding sequence
atggccctcaaacagatttctagcaacaaatgtttcggcggattgcaaaaggttttcgaacacgactctgttgaactcaactgcaagatgaagttcgctgtttacctcccaccaaaggctgagacaggtaagtgccctgcgctgtactggttaagcggactgacatgcaccgagcagaattttattagtaagtccggctatcatcagtcagcgtccgaacatggtctggtcgtgattgccccagacaccagccctagaggctgcaatattaagggagaggatgaatcatgggacttcggaaccggagcaggcttctatgtggacgccacagaagacccctggaagactaattatcgcatgtactcttacgtgactgaggaactgcctcagctgatcaacgctaactttccagttgatcctcagcgcatgtccatatttggacacagcatgggcggtcacggagccctgatctgcgctcttaagaacccaggaaagtacaagtctgtctccgcttttgccccaatctgtaacccggtcctttgcccttggggaaaaaaagccttttctggctatcttgggacagatcagagtaaatggaaggcctacgatgccacacatttggtcaaatcttaccctgggtctcaattggacatccttattgatcaagggaaggatgaccagttcttgctcgatggccagctgctgcccgataattttattgctgcctgtaccgagaaaaagattccagtcgtgtttcggctccaagagggctacgaccattcatattatttcatcgccacgtttatcaccgaccatatcagacaccatgccaaatacctcaacgcgtag

SEQ ID NO: 222272 - DNA, 642 bp, Artificial Sequence
  Description of Artificial Sequence: Synthetic coding sequence
atggccatcacccagttccgcctgttcaaattctgtacctgcctggcaactgtcttctccttcttaaagaggctcatctgccgttctggtcgcggtaggaagctaagcggggaccaaattactctgccaaccactgtcgactactccagcgtgcctaaacagactgatgtcgaggaatggacttcttgggatgaggacgccccaacatctgtcaaaatcgaaggagggaacggaaacgttgcgacacagcagaatagtctcgagcagctggaacctgattactttaaagacatgacaccaacaatcagaaagacgcagaaaattgttatcaagaagagggaacccttgaatttcggaattccggatggatctactggatttagcagtagactggcagcgacacaggacctccctttcatccatcagtcttccgagttaggcgacctcgacacctggcaagagaacacgaacgcttgggaggaagaagaggatgcagcctggcaggctgaagaggtgctccgccaacagaagctggctgatcgagagaaaagagcagctgagcagcagagaaagaagatggagaaagaggcgcagaggctgatgaagaaggagcagaataagattggtgttaagctcagttag

SEQ ID NO: 222273 - DNA, 642 bp, Artificial Sequence
  Description of Artificial Sequence: Synthetic coding sequence
atggctatcacccagttccggctgtttaagttttgtacttgcctggctactgtgttttccttcctgaagcgccttatttgtaggagcgggcgtgggcgtaagctgagcggagatcagattacccttcctaccaccgtggactattcctccgtcccgaagcagacggatgtggaggagtggaccagttgggacgaagatgcacccacctctgtcaaaatcgaaggtggcaatgggaacgtggcaacccaacagaatagcctcgagcagctcgaaccggactattttaaggatatgactccgactattcggaagacccagaaaatcgtcataaagaaacgtgaaccattgaattttggaatcccagacggcagcacaggttttagctctaggctggcagctacacaagatctccctttcatccaccagtcatccgagctcggtgacctggatacttggcaagaaaacactaacgcctgggaagaggaggaggacgccgcttggcaggcggaggaggtacttcgacagcaaaagctggccgacagagaaaagcgggctgccgaacagcagagaaagaaaatggagaaggaagcccagagactcatgaagaaggaacagaataagatcggagtcaagctcagctag

SEQ ID NO: 222274 - DNA, 594 bp, Artificial Sequence
  Description of Artificial Sequence: Synthetic coding sequence
atggcaattacgcagtttcgacttttcaaattctgcacatgtttggccaccgtcttcagctttttgaagcgcctcatatgcaggagcgggcgagggcgaaaactgagcggggatcaaatcactctgcccacaactgtggattattcaagcgtgcccaaacagaccgatgttgaggaatggaccagttgggacgaggacgctcctacatcagtgaagatcgaagggggaaatgggaatgtggcgacccagcagaactctttagaacagctggagcccgattattttaaggatatgacaccaactatccgcaaaacccaaaagatcgtgatcaaaaagcgcgaaccgctaaacttcggtatccccgacggctccacagggtttagtagcaggctcgccgcaacacaggatttacccttcatccaccaaagcagtgaattaggagacttggatacgtggcaggagaacacaaatgcctgggaagaggaggaagacgccgcatggcaggctgaggaggtgctcagacagcagaagctggccgacagggaaaagagggccgcagagcagcagaggaagaaaatggaaaaggaggcatag

SEQ ID NO: 222275 - DNA, 777 bp, Artificial Sequence
  Description of Artificial Sequence: Synthetic coding sequence
atggccatcactcagttcagattgttcaaattctgcacctgtctcgcaaccgtatttagtttccttaaacggttgatctgtcgctccggcagaggccgtaaattgtctggagatcagatcacactcccgactacagtcgattacagtagcgtgcccaagcagactgatgtggaggaatggacctcatgggacgaggatgctcccacgtcggtgaagatagaagggggtaacggaaacgtcgctacacaacaaaactcactggaacagctagaacccgattatttcaaggatatgaccccaactattcgcaagactcaaaagatcgtgatcaagaaaagagaacccctaaacttcggaattcccgacggatcgactggctttagttccagactggctgccacacaagatctaccgtttattcaccagagctcggaactaggagacctcgatacatggcaggaaaatacaaatgcttgggaggaggaagaagacgccgcttggcaggctgaagaggttttacgtagtagaaccaacgtgtgcctgctgtgttccctgctgtttcaccatcctacccccacgtccacgccctatatcaaccagtcggtcaagatcgagcgggtgtcacttggccagtggtcgtatggtaagagtaaggaacaacagaagttggcagaccgtgagaaacgggcagccgagcagcagcggaaaaagatggaaaaggaagcccaaaggctgatgaaaaaggagcagaacaaaataggagtaaaactctcgtag

SEQ ID NO: 222276 - DNA, 237 bp, Artificial Sequence
  Description of Artificial Sequence: Synthetic coding sequence
atggcaattacacagttccgtctgtttaagttctgcacctgcctggcgaccgtctttagctttttaaagcggctgatctgtcgcagcggacggggaagaaagctgagcggcgaccagattactctacccaccaccgtggattactcatccgtgcctaaacagaccgatgttgaagaatggacttcctgggacgaggacgctcctacttcggttaaaattgaaggcggaaacggctag

SEQ ID NO: 222277 - DNA, 1272 bp, Artificial Sequence
  Description of Artificial Sequence: Synthetic coding sequence
atgagcagccaggttgtcggcatcgaacctctgtacatcaaggcggagccggcttccccggacagcccgaaaggcagcagcgagaccgaaaccgagccccctgtggcactggcgcctggtccagcacctactcgctgtctccctggccacaaggaggaggaagatggcgagggggctggcccaggcgaacagggcggaggaaagctcgtgctctctagcctccccaagcggctttgccttgtgtgcggtgatgtagcaagcggctaccattatggagtagcctcttgtgaggcctgcaaagccttctttaagcgcaccatccaggggtctatagaatatagctgtccggcttctaatgagtgcgagattacaaagcggagaaggaaggcttgtcaggcatgtcgatttacaaagtgcctcagagtgggcatgctgaaggagggggtgagactggacagggtccggggaggcagacagaaatataagcgcaggccagaggtggaccccttaccctttccagggccattcccggctggccctcttgccgtggctggcggacccaggaaaacagctgctccagttaacgccctggttagtcaccttcttgtggtagagcccgaaaagctgtacgccatgcccgacccagccggacccgacgggcacctgcccgctgtggccaccctgtgtgacttatttgaccgtgagatagttgtaacaatttcctgggccaagtccattccagggttttcttcgctgtctctgtctgaccagatgtccgtactgcagtctgtctggatggaagtgctagtgttgggtgtggcacagcggtccctaccgttgcaggacgagcttgcattcgccgaagacctcgttctcgatgaagagggcgctcgagccgctgggctgggtgaactcggcgctgccctgctgcagttggtgaggaggctgcaagccctgagactggaaagggaagaatatgtactcctgaaagctctggcactggcaaactccgactccgtgcacatcgaagatgctgaagctgtggaacaactcagggaggcattgcacgaagctctattagagtacgaagccggaagggcgggtccgggtgggggtgctgaacgacgaagggccggaagactgctattaactcttccattgctgagacagacagcgggaaaagtcctggcccacttctatggcgttaagctggaaggaaaagtgccaatgcacaagctttttcttgagatgctggaggccatgatggactag

SEQ ID NO: 222278 - DNA, 1272 bp, Artificial Sequence
  Description of Artificial Sequence: Synthetic coding sequence
atgtcctcccaagtggtgggcattgaacctctctacattaaagccgaacctgcatctcctgacagtccgaaaggctcgtcagagactgagacagaaccacctgtcgcactcgcaccaggacccgctcccacaaggtgcctacccggtcataaagaggaagaggatggcgaaggtgccggtcctggggagcagggcggaggcaagctcgtgctgtcctctctccctaagagactgtgtttggtctgcggggatgtggcgagcgggtatcattatggggtggcctcttgtgaagcatgcaaagctttctttaagaggacaatccaggggtccatcgaatacagttgccctgctagcaatgaatgcgaaatcacgaagcggagaaggaaagcctgtcaagcctgtcgtttcacgaaatgcctccgagtgggcatgctgaaggagggcgtcaggcttgacagggtgcggggaggcaggcagaagtataagcgtaggcctgaggtcgaccctcttcctttccctggacctttcccagcgggaccactcgctgtcgctggtgggccacggaaaactgctgctcccgtaaatgcactggtctcccatctccttgtggtggagcccgagaagctttatgccatgccagatccggctgggccagacggccacttgcctgccgttgccaccttatgtgatctattcgatcgcgaaatcgtggttacaatctcctgggctaagtcgatccccggattctcgtctttgtccctgagcgaccagatgtccgtattacagagcgtgtggatggaagtgttggttcttggggtggctcagcgatccctccccctgcaggacgaactggcattcgcagaggacctggttctcgacgaagaaggcgctagagccgcagggttgggagagctgggagctgcactcctgcaactcgtcagaaggctgcaagctttgcgattggaacgcgaggaatatgtgctccttaaagcactggccctggcgaactcagactccgtgcatatcgaagatgccgaggcggtggaacagctgcgtgaggcccttcacgaagccctcctcgaatatgaagcaggaagagctggacccggaggcggtgcagaaagaagacgggctgggcgtctgcttctcacacttcctctgctacggcagaccgcgggtaaggtactggcacacttctacggagttaagctcgaggggaaggttcctatgcataagctcttcctcgagatgctcgaggcaatgatggactag

SEQ ID NO: 222279 - DNA, 1269 bp, Artificial Sequence
  Description of Artificial Sequence: Synthetic coding sequence
atgagttcccaagttgtgggaattgaacccctatacattaaggctgaaccggcaagccctgactcgccaaagggatcctccgagacggagacagagccaccagtagccctcgcccctggcccagcgccaactcggtgtcttccagggcacaaagaagaggaggatggggaaggcgctggacccggtgaacagggaggaggaaagctcgttttgtcatccctaccaaaacgactgtgcttggtgtgcggagacgtcgcctcaggctatcattatggtgttgcaagttgtgaggcctgcaaagctttcttcaagagaacgatccagggctcaattgagtattcatgcccagcttcgaacgaatgtgagataactaagcgtcgcaggaaggcatgtcaggcctgtcgatttactaagtgtctgcgagtaggtatgctcaaagagggcgtgagactcgaccgcgtaaggggtggcagacagaaatataaaagacgacccgaagtggatccactcccgttcccgggacccttcccggctggcccattagccgtagcgggaggccctagaaaaactgctcccgtcaatgccctagtctcacatttgcttgtggtcgaaccagagaagctgtacgctatgccagatcccgctggaccggacgggcacctccctgctgttgccaccctttgcgatctgtttgacagagagattgttgtcacgattagttgggctaaaagcatccctgggttttcctctctctctctgtctgatcagatgagcgtgcttcagtcagtgtggatggaggtactggtgctcggtgttgcgcagcggagtctaccactccaagatgagctggccttcgccgaggatcttgtgctagacgaggagggagcccgagctgccggtttgggcgagctgggtgccgctctgctccagctcgttcggagactccaggccctccgtttggagagagaagaatatgtgctcttgaaggcgctagccttggctaactccgatagcgtccacattgaggatgccgaagccgtggagcagctgagggaggccctccacgaagccctcctcgaatatgaggctggcagagcaggtcctggtggcggagctgaacgcaggagagctggcaggctgctcttgactctgcctttgcttcgtcagaccgcaggtaaggtattagctcacttttacggagtgaagcttgaaggtaaggtccctatgcacaagttgtttctggaaatgctggaggcaatgatggactag

SEQ ID NO: 222280 - DNA, 330 bp, Artificial Sequence
  Description of Artificial Sequence: Synthetic coding sequence
atgtcctcccaggtcgtaggcatcgagccactgtatattaaggctgagcctgcgagtccagactcgcccaagggtagttcggagactgaaaccgaaccacctgttgccctggccccaggacccgcaccaacccggtgtctccctggacacaaagaggaggaggatggtgaaggcgcaggtcctggggagcaggggggaggcaaattagtgttgagctctcttcccaagagactctgtctcgtgtgcggggatgttgcatctggttaccactatggagtggcgagctgcgaggcatgtaaggccttttttaaaagaactatccagggatag

SEQ ID NO: 222281 - DNA, 1503 bp, Artificial Sequence
  Description of Artificial Sequence: Synthetic coding sequence
atgtctagtgatgatcgtcacttaggtagttcttgtggcagcttcatcaaaacagaaccatcttcacccagctccgggattgacgccctgtcacaccactcaccctccggctcctccgatgccagcggcggtttcgggctggccctgggtacccacgccaacgggctcgattctccaccaatgtttgcaggggctgggctcggtgggactccttgccgtaaatcatacgaagactgcgcaagcggaatcatggaggactccgcaataaaatgcgagtacatgctgaatgccattcccaaacggctctgtctggtctgcggggacatagcctctggctatcactatggtgtagcctcgtgcgaggcttgtaaggccttctttaagcgaacgatccagggaaacatcgagtatagctgtccagcaaccaacgagtgcgaaatcactaagcgccgacgcaagtcgtgtcaggcatgccgattcatgaagtgtctgaaggtgggtatgctgaaggaaggcgtgcggcttgaccgtgtccgaggcggacgccagaagtataaaagaagattagattccgaatcctcaccatacctgagtcttcagatcagcccccctgccaagaagcctttaaccaagattgtgtcctatctgctggtcgctgagcccgataagctgtacgccatgccgccacccggaatgcccgagggggatatcaaggcattaacgacactctgcgacctcgccgatcgtgagttggtggtgattatcggttgggctaagcacatccccggtttcagttccctgtccttgggcgatcaaatgtcactacttcaatctgcctggatggagatccttatccttggcattgtctatcggagtctgccctatgacgataaactggtttatgctgaagactatataatggatgaagagcactcacgacttgccggtctccttgagctctaccgggctatacttcagctggtacgtcggtataagaagctcaaggtagaaaaagaggagtttgtaaccctgaaggccctggctctagcgaattctgattctatgtatattgaagatctggaggcggtccagaaattgcaagatctgcttcacgaagccctgcaggattatgagttatcccagcgtcatgaggagccttggagaacaggcaaacttctgcttacattgcctctgctgaggcagactgcagccaaagcagtgcagcacttctatagcgtcaagctgcaagggaaggttccaatgcataaactgtttctcgagatgctagaggccaaagcgtgggcccgagcggatagcctccaagagtggcggcctttggagcaggtccccagcccacttcaccgagccaccaaacggcagcatgtgcactttctaacccctctgcctccacccccttccgtggcctgggtgggcacagcccaagcgggttaccacttggaggtgttcctgccacagcgcgcaggttggccaagggcggcatag

SEQ ID NO: 222282 - DNA, 1527 bp, Artificial Sequence
  Description of Artificial Sequence: Synthetic coding sequence
atgagcagtgacgaccgccatctgggttccagctgtggaagtttcattaaaacagagccctctagcccctcctccggcattgatgctctgagtcaccatagtccatctggcagctcagatgcctccgggggtttcgggctggctctgggcacacatgcaaacggcctagatagcccaccaatgttcgcgggtgccggactcggcggaacaccttgccggaagtcatacgaggattgcgcctctggcattatggaggattccgcaattaaatgtgagtacatgctgaacgctatcccaaaacggctctgccttgtgtgtggcgacattgcatcaggataccactacggggttgcttcctgtgaggcttgcaaagctttcttcaagcggaccattcaggggaacattgagtattcgtgtcctgctaccaacgaatgcgagattactaaaaggagaagaaaaagctgccaggcctgcagattcatgaagtgcctgaaggttggaatgctcaaagagggagtgcgattagatagagtgcgcggagggagacagaaatacaaaaggcggctggattcagaatcttcaccttacttatccctgcaaatctccccccctgcaaagaaaccacttaccaagatcgttagctacctattagtcgctgagcctgacaaactttacgcgatgcctccaccaggtatgcccgaaggagacatcaaggctcttacaacactgtgtgacctcgccgaccgggaattggttgtgatcataggttgggcgaaacacatacccggattttcatctctgagcctgggagatcagatgtcactgctgcagagcgcttggatggagatcctcattctcggcatcgtgtatcgttctctcccttatgatgacaagctggtgtacgccgaagactacattatggatgaagaacattctcgcctcgccggtcttctggagttgtaccgcgctatactccaactggtcagacggtataagaaactgaaagtagaaaaggaagaatttgtcaccttaaaggccctggcccttgccaattccgactcaatgtatatcgaggaccttgaggctgtccagaagctgcaggaccttctgcacgaggcattgcaggactatgaactttcccagagacacgaagaaccgtggagaaccgggaaactacttctaacactgccactgcttagacagacggccgctaaggccgttcagcatttctattccgttaagcttcaaggcaaggtgcctatgcacaaactcttcctggagatgttggaggctaaagtgggtcaagagcagttacgaggtagtccgaaagatgagaggatgagtagtcatgatggaaagtgtccatttcagtcagctgctttcaccagccgcgaccaatcgaacagtcccggtatccccaaccctcggccatcatctcccaccccactgaacgagcgcggtagacagatctcaccaagcaccaggacccctgggggtcagggtaagcacctctggctcaccatgtag

SEQ ID NO: 222283 - DNA, 1503 bp, Artificial Sequence
  Description of Artificial Sequence: Synthetic coding sequence
atgtcatcagatgacagacacctcggatcctcttgcgggagcttcatcaaaaccgagccatcttcccccagcagtggaatagatgcactgagccaccactctccttccggaagttctgatgccagtggcggattcgggttggctctggggacccacgcaaacggcctcgatagccccccaatgtttgccggagctgggctaggagggacgccttgccgcaagtcgtacgaggattgtgcctctggaattatggaggacagcgctataaagtgcgagtatatgttaaatgctattcctaagcgactgtgccttgtgtgtggagatatcgccagcggctaccattatggcgtggcctcatgtgaagcctgcaaagcctttttcaaacgcacgatacagggaaacatcgagtacagctgtccggcaacaaacgagtgtgaaattaccaagaggcggaggaagtcctgccaagcctgccggttcatgaaatgtctcaaagtgggcatgctcaaagagggcgttagattggatcgagtcagaggcggacgacaaaagtacaagaggaggctagatagtgagtcgagcccctacctgtcactgcagatctcacctcctgcgaagaagccccttaccaaaatcgtctcttacttattggtcgcagaaccagataagttatatgctatgccccctcccggtatgcctgaaggagatatcaaagccctgacaactttgtgcgatctggctgatagggagctcgtagtaattataggttgggctaaacatattcctggcttcagttccttgtcactaggtgaccagatgtctttgctccagtcagcctggatggaaattcttatactgggcattgtctataggtcactgccgtacgacgacaagctagtttacgccgaggactacattatggacgaggagcacagccgcctggcgggtcttctggagctctaccgagccattctgcaactcgtcaggcgatacaaaaaacttaaggtcgaaaaagaagagttcgtcaccctaaaagctctggccctagcaaacagtgatagtatgtacatagaggacctcgaggccgtccagaagctgcaggacttactgcacgaggctctgcaggattatgaattgtcccaaagacacgaggaaccgtggcggacaggcaaactactgctgactttgcccctcctgaggcaaaccgccgctaaagcagtgcagcatttttacagtgtcaagctgcagggtaaagtacctatgcacaaacttttcctggagatgctagaggcaaaagcttgggccagggctgacagcttgcaggaatggaggccccttgaacaggtgccctccccgctgcatagagctaccaagaggcagcacgtgcatttcttaactcccctccctcctcctccatccgtcgcttgggttggtactgcacaagccggttatcatttagaggtctttttgccacagcgcgctggatggcccagagccgcttag

SEQ ID NO: 222284 - DNA, 1527 bp, Artificial Sequence
  Description of Artificial Sequence: Synthetic coding sequence
atgtctagcgacgatcgccatctcgggtcttcttgtgggtctttcatcaagaccgagcctagtagtccctcttctgggattgatgctctttcacaccactcccccagcggcagctcagacgctagcggtggattcggactggctcttgggacccacgccaacggtttagattctccgcctatgttcgccggagcaggattgggaggcaccccctgccgtaaatcctacgaggattgcgcctcaggcatcatggaagatagcgctatcaaatgcgagtacatgctcaacgctatccccaaaaggctgtgtttggtgtgcggcgatatcgcctcagggtatcattacggcgttgcatcatgcgaagcctgtaaagctttctttaagagaaccatccagggtaacatcgagtattcctgcccagcaaccaatgagtgcgagataaccaaacggagacggaagtcttgccaggcctgtcgcttcatgaagtgcctgaaagtaggcatgttgaaggagggagtgaggttggatagagtcagaggaggacgccagaagtacaagagacggctggactcagaaagctcaccatatttaagcttgcagatcagcccccctgcaaagaaacctcttaccaagatcgtgagttatctgcttgttgctgagcccgataaactgtatgctatgcccccacccggaatgcctgaaggggatatcaaagccctgacaaccctgtgtgatctggccgacagagagctcgtagtcattattggctgggcgaaacacattcctgggttctcatccttgtcactgggggaccagatgtccctgcttcagtccgcttggatggagatattaatacttggcatcgtgtacagaagcttgccatacgatgacaagctggtatatgccgaagattatattatggatgaagaacactctaggctcgccggactccttgagctatatagggcaatattgcagctggttcgacgttacaagaagctcaaggtggaaaaagaggaatttgtcactcttaaggctctggcactggcgaactccgatagtatgtacatcgaggaccttgaagccgtacaaaaactgcaggatctcctgcatgaagccctgcaggattacgagttgagccagcgccatgaagaaccttggcgtaccggcaagctcctgctgacgctgccattgcttcggcagactgctgctaaagccgtgcaacatttttactcagtgaagttgcaggggaaggtccccatgcacaaactctttctcgagatgctggaggctaaggtgggccaggagcagttgcggggatccccaaaggatgaacgaatgtctagccacgacgggaaatgtccatttcaatctgccgcttttacctctagggatcagtccaattcccctggaatcccgaatccgagacctagctctcccacccctttaaacgaaagaggcaggcaaatcagcccctccacaagaactcctggaggacaggggaaacacctgtggttgacaatgtag

SEQ ID NO: 222285 - DNA, 1527 bp, Artificial Sequence
  Description of Artificial Sequence: Synthetic coding sequence
atgctgctcaacaggatgtcgtcagacgaccgccatctcgggtcaagttgtggaagcttcatcaaaactgaaccctcctcaccttcgagcggcattgacgcattatcccaccactccccgagtgggtcctccgacgcctcaggcggttttgggctggcactgggaacccatgctaatggattagacagtccacccatgttcgcgggagccggactgggaggaacaccctgtcgcaagagctacgaagactgtgcctctgggatcatggaagatagcgcgataaaatgcgagtatatgctcaatgccattcccaagcgcctctgccttgtctgcggggacatcgcctctgggtatcactatggagtggctagttgtgaggcctgtaaagctttcttcaaacggacgattcagggaaacatcgaatattcctgtcctgccacaaacgaatgtgagatcaccaaacgcaggcgaaaatcctgccaagcgtgcaggttcatgaagtgcttgaaagttggcatgctcaaggaaggagtccgactcgacagagtgcgtggaggaaggcagaaatataagcgacgtcttgatagcgagtccagtccttacctatccctccaaataagccctccagctaaaaagccactgaccaagatcgtgtcctatctgctggtggcagaaccagacaagttgtatgcaatgccacctcctgggatgccagaaggggatattaaggcgctgaccacactgtgcgacttggcagatcgggagttggtcgtcataatcggatgggccaaacatattccaggcttctcttccctgagtctcggggatcaaatgagcctgcttcagtcagcatggatggagatcttgatccttggcatagtgtaccggtccctgccatacgatgacaagctggtctacgccgaagattacattatggatgaggagcattcgcgtctcgcaggactgctcgaactctaccgggctattctgcagctggtccgcagatataaaaagctgaaggtggagaaagaggagttcgtgacgctgaaagccctggccctggccaattcagattcgatgtatatagaggacttggaagctgtacagaaacttcaggatttactgcacgaggctctacaggactatgaactgtctcagcggcacgaggaaccttggcgaactgggaagttgctgctcaccttgcctctgctccggcagacagcagcaaaagcagtccagcacttttacagtgtcaaattacagggaaaggtgcccatgcataagctttttctggaaatgctggaagctaaggtcggccaggaacagctgagaggctctcctaaggatgaaagaatgtcaagccacgacggcaaatgtccttttcagagcgctgccttcacttccagggaccagtccaatagcccaggcattcctaaccctagacccagttcacccactcctcttaacgagaggggtcgccagataagtcctagtactaggactccgggaggccagggcaaacactag

SEQ ID NO: 222286 - DNA, 1302 bp, Artificial Sequence
  Description of Artificial Sequence: Synthetic coding sequence
atgtcatccgacgatcgacatctggggtcctcttgtgggtcatttatcaaaactgaacccagctcaccaagtagcggaattgatgctctttcacaccactcacctagtgggtctagtgatgcctccggaggctttggcctggcgttgggcactcacgccaacggtctggatagcccgccaatgttcgccggtgccggtctgggaggcacgccatgcaggaaatcctacgaggactgcgctagcggtataatggaagattcagctatcaaatgtgagtatatgctcaacgccatccctaagcgcctgtgcctggtctgcggggacatcgccagcggataccactacggggtggcttcatgtgaggcatgcaaggcgttcttcaaaaggacaatccagggaaacattgagtatagctgccctgccacaaacgagtgtgagatcactaagaggcgtcgaaaaagctgtcaggcctgcaggttcatgaagtgtctcaaggttggtatgctgaaagagggagtgagactggacagagtgaggggagggaggcaaaaatacaagaggcgtctggacagcgaatcgagcccctacctgtctctacaaatcagtccccctgccaaaaagccactgaccaagatagtgtcatatctgctcgtagccgagccagacaagctgtacgcaatgccacccccaggcatgcctgaaggtgatatcaaagcactcaccacgttatgcgatctggcagacagggagctggtggtgatcatcggttgggccaaacatatacccggattttcatccctcagtctgggcgatcagatgtctctactgcagtccgcctggatggagatcctgattttaggaatagtgtacagatctttgccctacgatgataagctggtctacgccgaggactacataatggacgaagagcattctagattggccggtctcctggaactttacagagctatactccaacttgtccggcgatacaaaaagctcaaggtggaaaaggaggaatttgtgaccttgaaggccctagcattggctaattcggactcaatgtacattgaggatcttgaagccgtacaaaagctccaggacctcctgcatgaagctttgcaggactatgaactttcacaaagacatgaggaaccctggagaaccggaaagctgctgctcacactgcccctcttgcgccagactgccgctaaggccgtgcagcacttctatagtgtgaaacttcagggtaaggtcccgatgcacaagttatttctggaaatgctagaggccaaggtgtag

SEQ ID NO: 222287 - DNA, 1311 bp, Artificial Sequence
  Description of Artificial Sequence: Synthetic coding sequence
atgtctaacaaagacagacatatcgactcctcttgcagtagcttcataaagaccgaaccttcctccccggcttccctgaccgacagcgtgaaccaccattcccccggagggagttccgatgcttctggatcctattcatccaccatgaatggccatcagaatggcctcgactctcctcccttgtatcccagcgcaccaatcctgggagggtcaggcccagtgagaaagctgtatgacgattgctcttccaccattgtggaggaccctcaaacaaagtgcgagtacatgctcaactcaatgcctaagcggctctgtctggtttgcggagacatagcatctggataccattatggagtcgcgtcctgcgaggcttgtaaggccttcttcaaaaggacaatccagggtaacattgagtacagttgcccagccaccaacgagtgtgagattaccaagcgtcggagaaagtcgtgccaagcttgcaggttcatgaaatgcttgaaagtaggcatgcttaaagaaggcgtgagattagatagagtgcgcggtggaagacagaaatacaaaagacggattgatgcggaaaactccccgtacttgaatcctcagctggtccagcccgctaagaagccctataataagatcgtatcacacctcctggttgctgaacctgaaaaaatctatgccatgccagatcctactgtcccagatagtgatataaaggcacttacgaccctgtgcgacttggccgaccgggaactagtggtgattatcggatgggccaaacacatccctgggttttctacactctcactggctgaccagatgagtctactgcagtctgcttggatggaaatcttgatcctaggcgtagtgtatcggagcctatcctttgaggacgaactggtttatgctgacgactacataatggacgaagaccagtccaaattagccggactcctggatcttaacaacgctatactccagttggtcaaaaagtacaaatcaatgaagttagagaaggaggagtttgtaaccctgaaagctatcgcacttgcaaatagtgactccatgcatatagaggacgtcgaggccgtccagaagctgcaggacgtgcttcacgaggctctgcaggactacgaagccggtcagcacatggaagatccaagaagggctggcaagatgctcatgaccttaccactgctgcgccagacgagcacgaaagcggttcaacacttctacaatattaagttagaaggaaaggtaccaatgcataaattatttttggaaatgcttgaggcgaaggtttgctag

SEQ ID NO: 222288 - DNA, 1308 bp, Artificial Sequence
  Description of Artificial Sequence: Synthetic coding sequence
atgtcaaataaagatagacatattgacagctcgtgcagttcgtttattaagactgaaccttccagccctgcttccctcaccgactctgttaaccatcacagccccggaggcagctccgacgccagcggcagctactcgtcaacgatgaacggtcaccaaaatggactcgattccccacccctgtatccgagcgcacctatcctggggggatcaggccctgtccggaaactgtacgacgattgcagcagcaccattgtcgaagatccacagacaaagtgcgaatatatgctcaactcaatgcccaagagactgtgtttggtttgtggggatattgccagcgggtatcattacggagtggctagttgtgaagcttgcaaagcctttttcaaacgcacaattcaggggaatatagaatactcatgtccagccactaacgagtgtgagattactaaacggagaagaaaatcttgccaagcctgcaggtttatgaaatgccttaaggtcgggatgctcaaggaaggcgtcaggctcgatagggtcaggggaggacgccagaaatataagcggaggattgatgcggagaatagtccataccttaacccacagctcgtgcagcctgcgaagaagccctataacaagattgtgtcccacctgcttgtggcagaacccgaaaagatctacgcaatgccagatcctaccgtgcccgacagcgacattaaggccctgaccactttatgtgacctcgccgaccgagaactggtcgttattatcggatgggcaaaacatattcctggcttttccacattatcgctggctgaccagatgtcactgctccagtctgcctggatggaaattcttattctcggcgtggtgtatcgcagtctcagttttgaggatgagctggtttacgctgatgactatattatggacgaggaccaatcaaagcttgcagggctactggacctcaacaatgctattctccagctcgtcaagaagtataagtccatgaaactagagaaggaggaatttgttaccctcaaggctatagccctggctaattccgactcaatgcacatcgaagatgtagaggccgttcaaaagctgcaggacgtcctgcacgaagcccttcaagattatgaggctggacagcacatggaagatccgcgtagggcaggaaagatgctgatgaccctgccattgttgcgacagacctcaaccaaagccgtgcagcacttttataatattaaattggaggggaaggtgcctatgcataaactctttctggaaatgctcgaagcaaaggtgtag

SEQ ID NO: 222289 - DNA, 1308 bp, Artificial Sequence
  Description of Artificial Sequence: Synthetic coding sequence
atgtcaaataaagataggcacatcgactcaagctgtagctcctttattaaaacggagccatctagccccgcaagcctcacagatagcgtaaaccaccactccccaggcggatcctctgacgccagcggaagctattcctctaccatgaacggtcaccagaatggattagatagcccccctttgtacccatcggcacctatattagggggatctgggccagtccgcaagttatacgacgactgctcatccacaattgtcgaagacccgcagaccaaatgtgagtatatgctgaacagcatgccaaagaggttatgtttagtgtgtggagacatagctagcggataccactacggcgttgcttcctgtgaagcatgtaaggcgttctttaagcgaacaatccaggggaatatcgagtatagttgccccgctactaatgaatgcgagataactaaacgaaggcgcaaatcttgccaggcctgtaggttcatgaagtgcctgaaggtgggcatgctgaaggagggagttcgcctggacagagtgaggggcggtagacagaagtataagcggcgaatagatgcagaaaactccccatacttaaatcctcagctcgtgcagccggctaagaaaccttacaataaaatcgtaagtcacctcctggtggcagaaccggagaagatctatgcgatgcccgaccctactgtgcctgattccgatattaaggcacttactaccctctgcgacctagccgacagagagctggtggtcattatcgggtgggccaagcacatcccgggtttctctaccttatcactggctgaccagatgtccctgctgcagtccgcatggatggagattctgatattaggcgttgtctacagatcactaagcttcgaagacgagcttgtatacgccgatgattatatcatggatgaagatcagtctaaactcgctgggctactagacctgaataacgctattcttcagctggttaaaaagtacaagagcatgaagctcgaaaaagaggagttcgtaaccctcaaggctatcgcccttgccaattccgactcaatgcacattgaggacgtggaggcggtgcagaaactgcaggacgttctacatgaagctctgcaagattacgaagcaggccagcatatggaggacccccgacgggcaggaaaaatgctgatgactctcccactcctgagacagacatccacaaaagcagtccagcacttctacaacatcaagctggagggcaaagttcctatgcataaactttttttggagatgctcgaggccaaggtgtag

SEQ ID NO: 222290 - DNA, 1308 bp, Artificial Sequence
  Description of Artificial Sequence: Synthetic coding sequence
atgtccaacaaagataggcatattgactctagttgctcctcattcatcaaaaccgaaccctcttcccccgctagtttgaccgatagcgttaaccaccacagtcccggaggcagttccgacgcctccggctcatactctagtaccatgaatggacatcagaacggactggactctccccctctgtatccatctgctcctattcttggcggaagcggccctgtgagaaaactttacgatgactgctctagcaccatcgtcgaggaccctcagaccaagtgcgagtacatgttaaattcaatgcctaaaaggctgtgcttggtgtgtggcgatatcgcgagcggataccactatggagtggcgtcgtgcgaggcctgtaaagccttcttcaagagaacaatccagggcaatatcgaatacagctgccccgctaccaacgagtgtgaaattactaagagacggaggaagagctgccaggcttgtagattcatgaagtgtctgaaagtcgggatgctcaaagagggggtgcgcctcgacagggttagaggcggaaggcagaaatataaacgacgaatcgatgccgagaactcaccctacctcaatccacagctggtacaaccggcaaagaaaccttacaacaaaattgtgtcccacttgctggtagccgaacctgaaaagatttacgccatgcccgaccccactgtcccggactcggatattaaggccctcaccacactgtgcgatctcgccgatagggaactcgtggttatcattggatgggccaaacatattcctggattcagtacattgtccctcgcagaccagatgtccctactccagagcgcatggatggagatcctgattcttggcgtcgtatatagatctttatcttttgaagacgaactggtctatgcggatgattacatcatggatgaggatcaatctaaactggccggacttctggacctgaataatgctattctgcaactggttaaaaaatacaaatccatgaagctggaaaaggaggaatttgtcacattgaaggctatagcactggccaatagcgatagtatgcacattgaagatgtggaagccgttcaaaaacttcaggacgttctccacgaggcccttcaggactacgaagccggtcagcatatggaagatcctaggcgagcgggaaagatgctgatgaccctacccctcctgcgccaaactagtaccaaagcggtgcagcacttttacaacatcaaacttgagggcaaagtacccatgcacaaacttttcctcgaaatgctggaagccaaggtgtag

SEQ ID NO: 222291 - DNA, 1308 bp, Artificial Sequence
  Description of Artificial Sequence: Synthetic coding sequence
atgtctaacaaagataggcatattgactcaagctgcagtagcttcatcaagaccgaaccgagctcccctgccagtcttaccgacagcgtaaatcaccactctcccggagggagttcggacgcttctgggtcttattcaagcaccatgaacggccaccagaatggattagactcacctcctctgtatcctagcgcacccatactgggcggtagcgggccagtccgcaaattatatgatgattgctcttctactattgtggaggacccccagaccaagtgcgagtatatgcttaacagcatgcccaagcggttatgcttggtatgtggagatattgcaagcggataccactacggggtggcctcctgtgaggcttgtaaggcattcttcaagaggacaatccagggcaacatcgagtattcatgccctgcaaccaacgagtgtgagatcacaaagaggcgaaggaaaagctgccaagcgtgcaggtttatgaagtgtctgaaagtgggaatgctcaaggaaggggtgcggctagacagagtacggggtgggcgacagaagtataagaggcgcatagacgccgagaattccccgtatctgaatccacagcttgtccagcccgctaaaaaaccatataataagatcgtatcacaccttttagtggcagagcccgagaaaatatatgccatgccagatcccacagtccctgactcagacatcaaagcgttgacgacactgtgcgatctcgccgaccgcgagttggtagtgatcattggctgggccaaacatatccctgggttttctacacttagtctcgcagatcagatgagcctgcttcaaagcgcttggatggagattttgatcctgggtgtggtataccgcagcctgtcttttgaagatgaactcgtgtacgctgacgattatatcatggatgaggaccaaagtaaactggcaggcctgttggacctgaacaacgctattctgcagctggtgaaaaagtataaatccatgaaactcgagaaggaagagtttgtgacactgaaggccatcgccctcgctaacagcgattccatgcatattgaggatgtggaggctgttcagaaacttcaggacgtgctgcacgaggcacttcaggactacgaagccggacagcacatggaggacccacgtcgcgctggcaagatgctgatgaccctacccctgctcaggcagactagcacgaaggctgtccagcatttctataacatcaagttggaaggaaaggtgcctatgcacaaattgttcctggagatgctagaggctaaggtgtag

SEQ ID NO: 222292 - DNA, 1308 bp, Artificial Sequence
  Description of Artificial Sequence: Synthetic coding sequence
atgagcaataaggatcggcacattgatagctcatgcagtagctttatcaagactgagccaagcagtcctgcaagcctgactgactctgtcaaccatcactctcccggaggctcctctgacgcttctggaagttattcctctacgatgaacggccaccagaatggccttgactcccctccgctttacccgagtgctccaatcctgggcggaagcggacccgtacgaaaactctatgacgattgttcctccaccattgtggaagacccacaaacgaagtgcgaatatatgttgaacagcatgcccaaacggctgtgtctagtctgcggcgacatcgcttctgggtatcattatggcgttgccagctgcgaggcctgtaaagcattcttcaagcggaccatccaaggcaacattgagtatagctgccctgcaacaaatgagtgtgagatcaccaagagacgcagaaagagctgccaggcttgtcggtttatgaagtgcttaaaggtaggcatgctgaaggaaggtgttcgccttgaccgcgtgcgcggaggtagacagaaatataagcgtcgcatcgacgctgaaaactccccatatctgaatccccaactagttcagcccgctaagaaaccttacaataaaattgtcagccaccttctggtggctgagcctgagaagatttatgctatgccagaccctaccgtgccagattctgacataaaggccctgaccaccctctgtgacctggccgaccgtgaattagttgtaatcattgggtgggctaagcatatccctggtttctctacactgtcactcgcagatcagatgagcctgctgcagagtgcgtggatggaaatcctgatcttgggggtcgtttacaggtccctgagtttcgaagacgagctagtgtacgccgatgattatatcatggacgaagatcaatctaagttagccggtctcctggacttgaataacgccatactccagctggttaagaaatacaagagcatgaagcttgaaaaagaggagtttgtgaccctgaaagccatcgccttagccaatagtgattcaatgcacattgaggatgtcgaggccgtgcagaaactgcaagatgtgctgcacgaagccctccaggactatgaggcaggccagcacatggaagatcccagacgggctggcaaaatgcttatgacactgccactgctgcggcagacctctacaaaagccgttcagcacttctataacatcaagctcgaaggaaaagttccaatgcataagttgtttttagagatgttggaggccaaagtgtag

SEQ ID NO: 222293 - DNA, 1308 bp, Artificial Sequence
  Description of Artificial Sequence: Synthetic coding sequence
atgtctaacaaagaccgacatattgactcctcctgttctagtttcatcaagactgagcctagcagtcccgctagcctgactgactctgtcaaccaccactctccgggaggatcatccgacgcttccggttcatactcctctaccatgaacggccatcagaacggcctggattcgcctcctctctatccaagtgcacccattcttgggggttcaggtcctgtgcggaaactttacgatgattgtagctctaccatcgtggaggacccccaaacaaagtgtgaatacatgctgaattctatgcccaagagactctgcctagtttgtggcgatattgcctctggctatcattatggggtggccagctgtgaggcctgtaaagccttctttaagcgcactattcaggggaatattgaatattcatgtcccgctaccaatgagtgtgaaatcacgaaacgcagaagaaagtcatgccaggcttgtagattcatgaagtgccttaaagtcggcatgctgaaggaaggggtacgactcgacagagtgcgcggaggccgacagaaatacaagcggcgtatcgacgccgaaaattcgccatatctgaacccccaacttgtgcagccagcaaagaagccttacaacaaaatcgtctcccatctgctggtcgccgaaccagagaaaatttatgcaatgccagaccctacagtacccgatagcgacatcaaggctctaacaacgctttgcgatttagcagatcgcgagctcgttgtcatcattggctgggccaagcacatccctgggttttctacattaagcctggcagatcaaatgtcccttctgcagtctgcttggatggaaatcctgatacttggggtggtgtatagaagcctcagcttcgaagacgagttagtctatgccgacgattatatcatggatgaagatcagtctaagcttgctgggttgctagacctcaacaacgcaatccttcagctggtcaagaaatacaagtctatgaagcttgaaaaggaggagtttgttaccttaaaggccatcgccctcgcgaactctgacagcatgcacattgaagatgtcgaagccgttcaaaagctgcaagacgtactacacgaagcgctacaagattatgaagccggacaacacatggaagacccaagacgagccggtaagatgctgatgacactgcctctgctccgacagacttcgacaaaggcagtgcagcacttctacaacatcaaactggaaggcaaagtccccatgcataagttatttctggagatgctggaggctaaggtatag

SEQ ID NO: 222294 - DNA, 1329 bp, Artificial Sequence
  Description of Artificial Sequence: Synthetic coding sequence
atgagcaacaaggataggcatatagattcctcgtgctcctccttcattaagactgagcctagctcccctgcctcccttacagactctgttaaccatcactcaccagggggttccagcgatgcctcaggctcttactctagcacaatgaacgggcaccagaatgggttggactcgccacctctgtaccctagcgctccgatccttggaggttctggccctgtgcgaaagctgtatgatgattgtagcagcaccatcgtggaggatccacagacaaagtgcgagtatatgctcaattctatgccaaagagactatgtctcgtctgtggcgatattgcctccgggtatcactacggtgtggcgtcctgcgaggcctgcaaagcttttttcaagcggaccatccagggcaatatagaatatagctgccctgctacaaacgaatgtgaaatcaccaaaagacggaggaagtcttgtcaggcatgtaggttcatgaaatgtctgaaggtgggcatgctgaaagagggcgtgcggctggatagagtgcggggtggaaggcaaaagtataaaaggcgcatcgacgccgaaaacagcccctacctgaaccctcaactggtgcagcccgctaagaaacccctcctgtggagcgaccctgccgacaacaaaattgtgtcgcatttactcgtggctgagcccgagaagatctacgcaatgcccgaccctacagtgcctgattcagacattaaagctctgactactctgtgcgatctggccgaccgggaactagttgtgataattggctgggcaaagcacattccgggattcagtaccttaagcctggccgatcagatgtcactgctgcaatctgcttggatggagatcttgatcctgggcgtcgtgtatcggtctttaagctttgaggacgaactggtatatgctgatgactacattatggatgaagatcaatcaaaactagccggattacttgatcttaataacgcaatcctgcagcttgttaagaagtacaagtccatgaagttggagaaagaagagttcgtaacactcaaggccatcgctctggcaaactcggactccatgcacattgaggatgtggaggccgtgcagaagttgcaagacgtactgcacgaggcattgcaggactacgaggctgggcagcacatggaggacccgagacgtgcagggaagatgctgatgacgctgccattattgcgtcagaccagcaccaaggcggtacagcatttttataatattaaattggagggcaaggtaccgatgcataagctctttctcgagatgctggaggcaaaggtgtag

SEQ ID NO: 222295 - DNA, 1377 bp, Artificial Sequence
  Description of Artificial Sequence: Synthetic coding sequence
atggacagtgtcgaactctgtctccccgaaagcttttccctgcactatgaggaggagctcctgtgcaggatgtccaataaggacagacatattgactcctcctgttccagctttataaagaccgagccctcctcccccgcttctcttacagatagtgtcaatcaccacagccctggcggaagttccgacgccagcggctcctattcgtcaactatgaatggacaccagaatggcttggactctcctcccctataccctagcgcgccaattctgggcggatctggcccagtgcgcaaactttatgatgactgttcatccactatcgtcgaagacccacagacaaagtgtgaatacatgctcaactctatgccaaagagactgtgcctggtgtgtggagacattgcgtctggatatcattacggggttgcttcttgtgaagcttgcaaggcctttttcaaacgcacaatacagggcaacattgagtattcttgtcctgccactaacgaatgcgaaataactaaacgccgaagaaagtcatgccaagcttgtaggttcatgaaatgtctcaaggttggtatgctgaaagaaggcgtgagactggaccgggtgagaggcggacgtcagaagtacaaaagacgtatcgacgctgaaaacagcccctatctgaacccacagttagtgcagccagccaaaaagccatacaacaaaatcgtttcgcacctactggttgccgagcccgagaaaatttacgctatgccagatcccaccgtgcccgactcagacatcaaagcactgaccacactatgtgacttagccgacagagagttagttgttataatcggctgggccaagcacattcccggatttagcaccctgagcctcgcagatcagatgtccctgcttcaatcagcctggatggaaattttgatcctgggcgtggtctaccggtcccttagcttcgaagacgagttagtctatgcagatgactatattatggatgaggatcagtcaaagctggcaggcttacttgatttgaacaatgccatcctccagttggtgaagaaatataaatctatgaagctggaaaaggaggagtttgtaacgttaaaggccattgctcttgccaatagcgactcaatgcatatcgaagacgtggaggctgtgcagaagctgcaggacgtattgcacgaggcactccaggattatgaagcgggacagcatatggaagaccccaggcgggcagggaagatgctcatgacattaccgctattgaggcaaaccagcactaaagctgtccagcatttctataacatcaagttggaaggtaaggtgccaatgcacaagctgtttcttgaaatgctggaggccaaagtgtag

SEQ ID NO: 222296 - DNA, 171 bp, Artificial Sequence
  Description of Artificial Sequence: Synthetic coding sequence
atgtctaacaaggacagacacatcgatagcagctgctcctccttcataaaaacagagcctagctctcccgcatccttaactgatagtgtcaaccatcattcacctgggggaagcagcgatgcgtctggttcctactcctctacgatgaatggccaccagaacggcctctag

SEQ ID NO: 222297 - DNA, 279 bp, Artificial Sequence
  Description of Artificial Sequence: Synthetic coding sequence
atgagcaataaggatagacacatcgatagtagctgttcaagctttattaagaccgaaccatccagcccggcatctctgacagactcggtcaaccaccactccccgggaggaagcagtgatgcctcagggtcctattcaagcaccatgaacggacatcagaacggccttgactcacccccactatacccctctgctcccattttggggggttccgggccagtgaggaagttatatgatgattgtagttccacaatcgttgaggacccacaaacgaagtag

SEQ ID NO: 222298 - DNA, 1065 bp, Artificial Sequence
  Description of Artificial Sequence: Synthetic coding sequence
atgtccaacaaagatcgacatatcgactcgtcctgctcaagctttattaagacagaacctagctcccctgcttccctcacagactctgttaatcaccatagcccaggcggatcctcagatgcgtctggaagctactcctccactatgaacggacatcagaacggactcgacagtcctccactgtaccccagcgcaccaatcctgggcggttctgggcctgtgcggaagctgtacgacgattgttcgagtactatcgttgaggacccacaaactaaatgcgaatacatgcttaattccatgcccaaacgtctgtgtctggtgtgcggcgacatcgcctctgggtaccattatggcgtcgccagctgtgaagcgtgtaaggcttttttcaagcgtaccatccagggaaatatcgagtattcctgtcctgccaccaacgagtgcgagattactaagcgcagacgcaaatcgtgtcaggcatgccggtttatgaagtgcctgaaggttggaatgctcaaagaaggtgtccgtttagacagggtccgaggaggtaggcagaaatataagcgacggatcgacgccgagaacagcccgtacctgaacccgcagctggttcagccagccaaaaaaccctacaacaaaatcgtctcccatttacttgtcgctgagccagagaagatttatgcaatgcctgacccaacggtgcccgattcagacatcaaggccctgaccacgctctgcgacttggccgacagggaactggtggtgatcatcggctgggcaaagcacataccgggattctctacccttagtctggcagaccaaatgagcctactgcagagtgcctggatggagatcctgattttgggtgtggtctaccgatccctcagttttgaggacgagcttgtatatgctgatgattacattatggatgaagatcaatcgaagttagccggacttctggacctaaacaatgccatccttcagctcgtaaaaaaatacaagagcatgaagttggagaaagaggaatttgtcacactgaaggccatagccttggccaattcgtag

SEQ ID NO: 222299 - DNA, 153 bp, Artificial Sequence
  Description of Artificial Sequence: Synthetic coding sequence
atgtccaataaggatagacacattgactcatcatgctcaagcttcatcaagaccgagccttctagccccgcttccttaacagacagtgtgaatcatcactcccctggaggctctagtgatgccagtgggtcttacagcagtacaatgaattag

SEQ ID NO: 222300 - DNA, 1308 bp, Artificial Sequence
  Description of Artificial Sequence: Synthetic coding sequence
atgtcaaataaggataggcacatagacagcagttgctcctcgttcataaaaactgaaccatcaagtcccgcaagcttaaccgacagcgttaaccatcattcccctgggggatccagcgacgccagcggatcttattccagcacaatgaatgggcatcagaacggactggactcccctcccctgtacccttctgccccaatcctcggcggtagcggcccagtgcgcaaattatacgacgattgcagttctacgattgttgaggatccacaaactaagtgtgaatatatgctcaattcgatgcctaagcggttgtgccttgtgtgcggcgacatagcctccgggtatcactacggcgtcgcttcttgtgaggcctgtaaagcattttttaagaggacgatccagggcaacatcgagtactcgtgtccagccactaacgagtgcgagataactaaacggaggcgcaaatcgtgccaggcctgcagatttatgaaatgtttgaaggtggggatgctgaaggagggggtgcgcctggaccgggttcggggaggaaggcagaagtataagcgtagaattgatgcagagaattcaccttatctgaacccccaacttgtacaaccagcaaaaaagccatataataagatcgtcagtcacttactagtggcagaacccgagaagatctatgctatgccagacccgactgttccagactcggacattaaggccttaaccacactttgtgacctcgcggaccgagaacttgtcgtgataatcgggtgggccaaacacatacctggattctctaccttgtctttagccgatcagatgtcactccttcagtcagcctggatggagattcttattctaggggtggtttacagatcacttagtttcgaagatgaattagtgtacgcagatgactatatcatggacgaagaccagtctaagctggcgggactgctcgatcttaacaacgcaattctgcagttagttaaaaaatacaaaagcatgaaactagaaaaggaagaatttgtcactctaaaagccatagcgctggcgaacagtgattctatgcacatagaagacgtggaggccgtccaaaaactccaggatgttttgcatgaggcccttcaggattatgaggccggacaacatatggaagatcccaggcgcgcaggcaaaatgctgatgacactccccttgctgagacagacttcaacaaaggccgtccagcacttttataatatcaagttggaaggaaaagtacctatgcacaagcttttcctggaaatgcttgaagcaaaagtctag

SEQ ID NO: 222301 - DNA, 1308 bp, Artificial Sequence
  Description of Artificial Sequence: Synthetic coding sequence
atgagcaataaggatagacacatcgactcttcttgtagctcttttatcaaaacagaaccctcatctccagccagcctgaccgattctgtcaatcaccatagccccggaggaagctctgacgcatctggctcttattcaagcaccatgaacggacatcagaatggactagattccccacctctgtatcctagcgcacctatcttgggaggctccgggccagtgcgcaaactctatgatgattgttcttctacaattgtcgaagaccctcagactaaatgcgagtacatgctcaattctatgcctaagagactgtgtttggtatgtggggatatagcatcaggctaccactacggtgttgcctcttgcgaggcgtgcaaagcctttttcaaacggacgatccaggggaatatcgagtattcctgcccagctaccaatgaatgtgaaattactaaaagacgtagaaaaagctgtcaggcatgccggttcatgaaatgtctgaaagtcggcatgttaaaagaaggggtgagactcgacagggtccgtgggggacggcagaaatataagcggagaattgatgccgagaatagcccgtacctgaatcctcagttggtccagcctgcaaagaagccttataataagatcgttagtcatctgctggtggccgaacccgagaaaatctacgccatgcccgaccccacagtgcccgattccgacatcaaagctctgaccaccctctgtgatttggccgatcgagagctcgtggttataattggttgggccaagcacattcccggtttctcgacactgtcccttgccgatcaaatgagtctgctccaaagcgcctggatggagattctaatcctgggagtggtctaccgatcgctgagtttcgaagacgaactcgtgtatgccgacgattacatcatggacgaagaccagagcaagcttgccggtctcctcgatttaaacaatgccatcctgcaactcgttaagaaatacaagtcaatgaaactggagaaggaggagttcgtgaccctgaaggcgatagctctggcgaactccgacagcatgcacattgaagacgttgaggccgtgcaaaagctccaggacgtgttgcacgaggccctgcaggactacgaggctggtcagcatatggaggatccccgacgagctggaaaaatgttgatgaccctccccctcctcaggcagacctctaccaaagccgtgcaacacttctacaacataaagttggaaggaaaggtcccaatgcacaagctgtttctggaaatgctcgaagccaaggtctag

SEQ ID NO: 222302 - DNA, 1308 bp, Artificial Sequence
  Description of Artificial Sequence: Synthetic coding sequence
atgtccaacaaggataggcatatagatagctcatgtagctcctttataaaaacagagcccagttcaccagcttctctgaccgattccgtgaaccaccacagccccggaggatctagcgatgctagcgggtcctactcatccactatgaacggccatcagaacggcctggattccccgccactgtatccttccgctccaatactaggcggaagcggaccagttaggaagctgtatgacgactgttcatctaccatcgtcgaggaccctcaaacgaaatgcgagtatatgctaaacagtatgccgaaacgactctgtctggtctgtggcgatatcgcaagcggataccactacggggttgcctcctgtgaggcctgcaaggcttttttcaagagaaccatacagggaaatatagaatattcttgccccgcaaccaatgagtgtgagattacaaagcgccgaaggaaaagttgtcaggcttgcagatttatgaaatgtctgaaagtgggtatgctcaaggagggggttaggctagacagagtcagaggtggaagacagaagtataagcgccgaatagatgcggagaactctccgtacctcaatccccagttggtgcagccagcgaaaaagccgtacaataagattgtaagtcacctgttagtcgccgagcccgaaaagatctacgccatgcccgatcccactgtcccagattcagatattaaggctttgacaactctgtgcgatctagccgatcgggaactcgtggtcattattgggtgggccaagcatatacccggattttcaactctctcgcttgcagatcagatgagtctcctgcagtcggcttggatggaaatcttgattttgggcgtggtgtatagatctctttctttcgaagacgaactcgtatatgcagacgactacatcatggacgaagatcagtcaaaactggctggccttttggacctgaacaatgctatactgcagctggttaaaaaatataaatccatgaagctggaaaaagaggagtttgtaactcttaaggccattgcgctcgccaacagtgacagcatgcacatcgaggacgtggaggcggtgcagaaacttcaggatgtactccatgaagccctgcaggattacgaggcgggtcaacacatggaggatccacgcagagcaggcaagatgttaatgacgctgcctctcctcaggcagacatccaccaaagcagtgcaacacttctacaatataaagctcgaagggaaagtacccatgcataagctgtttttagaaatgttggaggcgaaggtctag

SEQ ID NO: 222303 - DNA, 1413 bp, Artificial Sequence
  Description of Artificial Sequence: Synthetic coding sequence
atgtggcgcgagtgcgattgggggcttggcgcagtgaaatccgatctcgcttgcgtcccatccgctaaaaggttgctgtgtcggatgtccaacaaagaccggcacatcgattcttcatgttccagctttattaagacagagccaagcagtccagcttccctgacagacagtgtgaatcatcatagccccggaggctcctctgacgcctcggggagctatagttcaactatgaatggacaccagaacggactcgatagcccacccttatacccatccgctcctattctgggaggcagcggacctgtgcggaagttgtacgatgattgcagttcgacgatcgtggaggatccacagactaagtgcgagtatatgctcaattctatgcccaagaggctgtgtcttgtttgtggtgatatcgcctcgggctatcactatggggtggctagctgtgaggcctgcaaggccttcttcaagagaaccatccaaggtaacatcgaatatagctgtcctgccaccaacgagtgtgagatcacgaagagaagaaggaaatcatgtcaagcatgccggttcatgaaatgtctgaaggtgggaatgctaaaggagggcgtgaggctggaccgggtgcgtggcggtagacagaaatataaaagacggatcgatgctgagaatagtccttacctcaacccccaacttgttcagcccgctaagaagccgctgctttggtcagatcctgccgacaataagattgtttcccatttactagtggctgaacctgagaaaatttacgccatgccagacccaacggttcccgactcagacatcaaggcactgactaccctgtgcgatttagctgaccgagaactggttgtgataatcggctgggccaagcacattcctggcttctctactctctcgctagcagatcagatgtccttacttcaatcagcctggatggaaatcctaattctgggggttgtgtataggtctctctccttcgaggacgagctcgtttacgccgacgattacattatggacgaggatcagagcaaacttgccggacttcttgatctgaacaacgccattctgcagctggttaaaaaatacaagtccatgaagctcgaaaaagaggaattcgtaaccctgaaggccattgcattggctaactcggactccatgcatatcgaggacgtggaggcggtgcaaaagttgcaggacgtcctccacgaggctttgcaggattacgaagcagggcagcacatggaggatccgagacgggcaggaaagatgctcatgacactccccctgttaaggcagacatcaacgaaggccgtccagcacttctataacattaaactggaggggaaggtgcccatgcacaagttgttcttggaaatgctggaggcgaaggtgtag

SEQ ID NO: 222304 - DNA, 1359 bp, Artificial Sequence
  Description of Artificial Sequence: Synthetic coding sequence
atgttatgcggtcgtccgcgttcatcctccgataaccggaattttctgcgcgagagggccggactgtccagtgctgccgtgcagactcggatcggtaactccgcggctagtcgcagaagtccggcagcaagaccgccagttcctgcacctcctgccctgcccaggggtcgcccaggaaccgagggatccaccagtctatctgcaccggcagtacttgtagtagcggtggcagttgtggtggttgttgtctctgcagtggcgtgggccatggctaattatattcatgtgccacctggcagtcctgaagtgcctaagctgaatgtgaccgtgcaggatcaggaagaacatcgatgtcgggagggcgcactctcactcctgcagcatctccggcctcactgggaccctcaggaggtgaccctgcagctattcaccgacgggatcacaaataagctgatcggatgctatgttggaaacacaatggaggatgtggtcctagtccggatatatggaaataagactgagttgctggtggaccgtgatgaggaggtgaagagcttcagagtcctccaggcgcatggctgtgcccctcaactctattgtacattcaataacggcctttgctatgagttcatccagggcgaagctctggatccaaaacacgtgtgcaacccggctatttttaggctgatcgcaaggcaactagctaagattcacgctatccacgcacacaacgggtggattcctaagagcaatctctggctcaaaatggggaaatacttttccctgatacccaccggctttgccgacgaagacataaacaagaggttcctgagcgacatcccatcatcacaaattttgcaggaggaaatgacttggatgaaagaaatattaagtaatttagggagcccggtcgtgttgtgccacaatgacttgctctgcaaaaacattatttataatgagaaacagggggatgtgcagtttatagactatgagtactcgggatacaactatctggcgtatgatatcggcaaccactttaacgagtttgcgggtgttagcgacgtcgactacagcctgtatccggacagagagttgcaatcccaatggctgagagcttatcttgaagcatataaagaatttaaggggttcggcaccgaggtgacggagaaagaggtggagatcctgtttatccaggttaatcagttcgccctggcttctcatttcttttggggcttatgggccctgatccaggccaagtacagtactatagagtttgattttctaggatatgcgattgttcgattcaatcagtacttcaagatgaaacctgaggtgaccgccttgaaggtcccagaatag

SEQ ID NO: 222305 - DNA, 777 bp, Artificial Sequence
  Description of Artificial Sequence: Synthetic coding sequence
atgctctgtgggaggcctaggagttcgtccgacaacagaaattttctgagagagagggctggcctgagctctgccgctgttcagactcgaatcggaaacagcgccgcaagcaggaggtcacctgcagccagaccaccagtccctgccccacccgctctccctagaggacgacctggaactgaaggatcaacttctctgagcgctccagcagtgctggtggtcgctgtcgccgtggtagtagttgtggtcagcgctgtagcatgggcaatggctaactatattcacgtaccacctggatctccagaagtgccaaagctcaatgtgaccgtacaagaccaagaggagcaccggtgcagggaaggcgctcttagcctcctccaacacctgaggccccattgggacccacaggaggtcacactccagctgttcactgatggaattacaaataaactcatcggctgttacgtcgggaacaccatggaggacgtggtcctcgtgcgcatctacggaaataagactgagctgttggttgacagggatgaggaggtcaagagcttcagggtgctacaggcgcacggctgtgctcctcagctttactgcacttttaacaacggcctatgctacgaatttatacagggagaagccctggaccccaaacacgtatgcaacccagccatcttcagtttgtcttcactcactctgtgcaaaggaaagactacaaggtgttttggtctgacaggctgtagaggatctcggttacttctgtcctttttttag

SEQ ID NO: 222306 - DNA, 1305 bp, Artificial Sequence
  Description of Artificial Sequence: Synthetic coding sequence
atgctctgcggcagacccaggtcatctagcgataatagaaatttcctccgtgagcgtgctggcttgtcttccgccgcagtgcagactcgtattggaaattctgcagcatcccgcagatccccggcagctcgcccacctgtgccggctccccctgccctaccaagaggacgtcctggcaccgagggcagcacatcactgtcagccccagccgtattggttgtggcagtcgcggtcgtggttgtggtggtgtcagcagttgcatgggctatggcaaactatattcacgtgccccctggctcacccgaggtgccaaaactgaatgtgaccgtgcaggaccaagaggaacatcgatgccgtgaaggagctttgtctttgctgcaacatctcagacctcactgggaccctcaggaagtgacactgcagctgttcacagatggtatcactaataagctcatcggctgctacgtgggcaatactatggaggatgtggtgctagtccgaatttacggaaataagactgagctgctggtggatagagatgaagaagtaaagtcgtttagggtgctccaggcccatggctgcgcccctcagctctattgtaccttcaacaacggcctctgctatgaatttatacagggggaggcccttgaccccaagcatgtatgcaatcccgctatattcagactaatagcaagacagcttgcaaagatccatgccatccatgcccacaatggttggatcccaaaatcaaatctatggttaaagatgggcaagtacttctccctgatccctacaggtttcgcggatgaggatataaataagcggtttctctccgatatcccaagttcacaaatcctgcaggaggagatgacatggatgaaggagattctcagcaacttaggctccccagttgtgctgtgtcataacgatttgctctgcaagaatattatctataacgagaaacagggtgacgtccagtttattgattatgagtacagcgggtacaactatctcgcttatgacataggtaatcactttaatgaatttgcgggagtctccgatgtggactacagtctgtaccccgacagggagctccagagccagtggctgagggcctatctggaggcatataaagagttcaagggtttcggaacggaggtaacagaaaaggaggtagagattctttttattcaggtgaatcagttcgctctgggtgaaaatctgaactttatcatcgggaacaagtattgtcagctattctccctaaaatggctgctgatatccttcggcgattgcggcctgtag

SEQ ID NO: 222307 - DNA, 627 bp, Artificial Sequence
  Description of Artificial Sequence: Synthetic coding sequence
atggcgaaaatccatactatccacgccaatgggtcactcccaaagcccatcctgtggcataagatgcacaactattttacgctggtaaaaaatgaaatcaacccctctttaagtgccgacgttccaaaggttgaagtgctggagcgtgagctcgcatggcttaaggagcatttgtctcaactcgagtcccccgttgtcttctgccacaacgatctcctatgtaaaaacattatttatgactccattaaaggccacgtccgcttcatagactacgagtacgctggatacaactaccaggcttttgatatcggtaaccattttaatgagtttgcaggcgtcaacgaagtggactattgcctctatcccgctagggagacacagctgcagtggttacactattacctccaagctcagaagggcatggcagtgacaccgagggaggtgcagcggttgtatgtgcaggttaataagttcgctttggcctcccacttcttctgggcactatgggcattgattcaaaatcaatactccaccattgacttcgattttttgcgctacgccgtgattcgcttcaaccaatatttcaaggtgaaacctcaagccagcgctcttgaaatgcccaagtag

SEQ ID NO: 222308 - DNA, 954 bp, Artificial Sequence
  Description of Artificial Sequence: Synthetic coding sequence
atggaggagaaagccgcagcttctgccagctgtagggaaccccctggtcccccacgggctgccgcagtggcctatttcgggatctcagtcgatcccgacgatatcttacctggtgccctgcgactgattcaagaactgcggccacattggaagcctgagcaagtccgcactaagcgctttacggatggtattacaaacaagttagtcgcctgttacgttgaagaggacatgcaagactgcgtgctggtgagagtgtacggagagaggactgagttgctggtagacagagaaaacgaggtacggaattttcaactactccgagcccatagctgcgcacccaaactctactgcacctttcaaaacggcctctgttacgaatacatgcaaggcgtagctctcgaacctgagcatataagagaaccacggcttttctcgctgtccgccgacgtgccaaaggtggaagtactggaacgcgagctggcttggttgaaggagcacctgtcccaactcgagtcaccggtggtgttctgtcacaatgaccttttatgtaagaacatcatctatgacagtattaaaggacatgtgcgttttattgactacgagtatgctggttacaattatcaggcatttgacataggaaatcactttaacgaatttgccggtgtgaacgaggtggattattgcttatatccagccagagagacacagttgcagtggctgcactactacctacaggcccagaaaggcatggcggtgaccccacgcgaggtccaaagactctacgtccaggttaacaaatttgccctggcatcccattttttttgggctctttgggcacttattcagaatcagtattccactatcgattttgactttctccgatacgctgtcatcaggttcaatcagtacttcaaagtcaagccccaggcaagtgccctggaaatgcctaaatag

SEQ ID NO: 222309 - DNA, 1185 bp, Artificial Sequence
  Description of Artificial Sequence: Synthetic coding sequence
atggctgtgcccccatcggctccacagcctcgtgcatcttttcatctgcgcagacatacgccatgcccccagtgctcctggggtatggaagagaaggccgctgcaagcgcaagttgtcgggaaccccctggccctcccagggccgctgccgtcgcttacttcggtatctctgtcgatcctgacgacatactaccgggtgccctgcggctgattcaggagttgaggccccattggaaaccagagcaggtcagaacaaagcgatttacagatggcattaccaataaacttgttgcctgctatgtggaagaggacatgcaggactgtgtgttagtccgggtatacggagagagaacggagcttcttgtggaccgtgagaacgaggtccggaattttcagctgctgcgtgcacatagctgcgcacccaagctgtattgcaccttccagaacggattgtgttacgaatacatgcagggtgtggctttggagccagagcacatcagagagcctagattgtttcggttaattgcacttgagatggccaagatccataccatccatgcgaatggctcccttcctaagccaattctgtggcacaaaatgcataactatttcaccctcgtgaaaaacgagatcaatccttccctgtccgctgatgtccctaaagtggaggttttagagagagaactcgcttggctgaaagagcacctctcacagctggaatcacccgttgtgttctgccataacgacctgctgtgtaaaaacattatatacgactcaattaaaggccacgttcgcttcattgattatgaatacgccggatacaattaccaggccttcgacattggcaaccacttcaacgagtttgctggcgtcaatgaggtcgactattgcctctatcctgccagggagactcagctgcagtggttgcattactatctgcaggcccaaaaggggatggctgtgactccaagggaggtccaacggctgtacgtccaagtgaataaatttgccctaggccctagctgtgtcagttcaaccatgacagcttctcttcagtgctgtcgggtggggaacaggcacggcgagatcgcccgactaactctctctggactgtttcccggagtttcattgctgctggggagcttgggacctcatcctgaaccagtcctgcatcacaggctttag

SEQ ID NO: 222310 - DNA, 1161 bp, Artificial Sequence
  Description of Artificial Sequence: Synthetic coding sequence
atggccgttcccccttctgccccacagccacgtgccagcttccacctgcgacggcacactccctgtccacaatgctcctggggaatggaggagaaggccgctgcttctgctagctgccgggaacctcctggcccaccacgcgcagctgccgtcgcttactttggcatttcagtggatcctgacgacatacttccaggcgctctccgcttgattcaggagctgagacctcactggaagcccgagcaggtcaggacgaagcgcttcactgacggaataaccaacaagcttgttgcctgctatgttgaggaggacatgcaagattgtgtcttggtgcgtgtgtacggagagcggaccgagcttctggtcgatcgggagaacgaggttaggaacttccaattactcagagcacacagctgtgcccctaaactttactgcaccttccaaaacggtctctgttatgaatacatgcagggcgtagccttagagccagagcacatcagagagcccaggcttttccgccttatcgccttggagatggcaaagattcacacaatacacgcaaatggaagtctgcccaaaccaattctgtggcacaagatgcacaattactttactctcgtcaagaatgagattaatccatcactgagtgctgatgtgccaaaggttgaggtcctcgaaagagagctcgcctggctgaaagaacatctcagccagcttgagagcccagtagtgttttgtcacaatgatttactgtgtaagaacattatatacgacagcattaagggtcacgtccggtttatcgattatgagtacgcaggttacaattaccaggctttcgatatcggaaaccacttcaacgagtttgcaggggttaatgaggtcgattactgtctttatcccgctagggagactcaactgcagtggctgcactattacttgcaggcgcaaaaaggcatggcagtgaccccacgggaagtccagcgtctttacgtgcaagttaacaagttcgctctggcctctcactttttctgggcactgtgggctctgatacaaaaccagtatagtaccatagatttcgactttctgcgctacgccgtgatacgatttaaccagtatttcaaggtgaagccccaagctagcgctctcgagatgccgaagtag

SEQ ID NO: 222311 - DNA, 759 bp, Artificial Sequence
  Description of Artificial Sequence: Synthetic coding sequence
cggagactgggcggagggaccgctgagggtaaaaccggtagggggctcggtggaccgagctgggacacaggacccagagcaatgggaagtctgtctcgacccagtttcagtgatcggctcatcgccctggagatggctaaaatccacaccatccatgccaatggctccctgcccaagcctattctgtggcacaagatgcataactacttcaccctcgtcaaaaatgagatcaaccccagcttgagtgccgatgtgcctaaagtcgaggtgctggaaagagagctcgcttggctcaaagaacatctttcccagctggaatcaccggtagtattttgtcacaacgatctgctgtgcaagaacataatctatgactccatcaaaggacatgtaaggtttatcgattacgagtatgccggttataactaccaggcgttcgacatcggtaaccacttcaacgagtttgcgggagtaaacgaggtggactactgtctgtaccccgcacgggagacacaactgcagtggttgcattactatttgcaggcccagaaaggcatggctgttacgccacgagaagtgcagcgcttgtacgtccaagtgaacaagtttgctctggcatcacatttcttttgggctctgtgggctctgattcagaaccagtatagcacaatcgatttcgatttcttaagatatgctgtgattcggtttaaccagtactttaaggtgaagcctcaagccagtgccttggagatgccgaagtag

SEQ ID NO: 222312 - DNA, 765 bp, Artificial Sequence
  Description of Artificial Sequence: Synthetic coding sequence
atggctgaagccgtgctaagggtcgcccgacgacagttaagccagagagggggatctggcgctcctattctactccggcagatgttcgagcctgtaagctgcacctttacctacttattgggagacagagagtctagagaggcagttctgattgacccggttctcgagacagcccctcgagacgcccagctgattaaggaattgggcctgcggttgctttatgctgttaacacacattgtcacgccgaccacattaccgggtccggattgttgagaagtctcctccccggttgccagtcagtcatctcccgactttccggagctcaagctgaccttcatatagaggacggtgactctatacggtttggacggtttgcactcgagacaagggcttccccgggtcatacgccaggctgtgtgacattcgtcctcaatgaccattcgatggcatttaccggcgacgctctcctgatcagaggttgcgggcgtactgattttcagcaggggtgcgccaagacgctttaccattctgtgcacgagaaaatcttcactctgcccggagactgcctgatctatcctgcccacgattaccatgggttcactgtcagtactgtagaagaagagcgaactctaaatccgagactgacactctcctgtgaggagtttgttaagatcatggggaaccttaatctgccgaagccacagcagatagacttcgcagtaccagccaacatgcgatgtggtgtgcagacgcccacagcatag

SEQ ID NO: 222313 - DNA, 1020 bp, Artificial Sequence
  Description of Artificial Sequence: Synthetic coding sequence
atggccgacagtgtgaaaaccttcctgcaggatttagccagaggcatcaaagacagtatatggggtatctgcacaatttcaaaactggatgcgcgaatccagcaaaagcgggaagaacagagacggaggcgcgcttctagcgtgctggctcagaggagagcccagagcattgaacggaagcaggagagtgagccacgaatcgtctcacgcatcttccaatgctgcgcttggaatgggggagtgttctggtttagtcttctcctgttctatcgcgtcttcatccccgtactgcaaagtgttacagctcgcatcattggagacccctccctgcatggggatgtatggtcttggttagagttcttcctcactagcatattctcagctttgtgggtgctgcccctgttcgtgctctcaaaagttgtgaatgcaatctggttccaggatatcgcagacctggcctttgaggtgtctgggcgaaagccccatcccttcccctctgtgagtaaaatcatagccgacatgctttttaacctgctgttgcaagccctcttcttaatccaagggatgtttgtgagtctgttccctattcacctagtcggtcagcttgtctcgctactgcacatgtcactactgtactcattgtattgctttgagtatcggtggtttaataaaggcatcgaaatgcaccagcgcctctcaaacatcgagaggaattggccgtattactttggctttgggctacctctcgcattcttgacagccatgcagagcagctacatcatatccggttgtctgttttcaattctgttccctttgttcatcatctccgctaatgaagctaagcccggaaaggcttacctatttcagctgcggcttttcagcctagtcgtctttctgtctaataggctgtttcataaaaccgtgtatcttcagtcagcgttatcatcttctacctccgccgaaaaattcccatcaccacacccaagtccagctaaattgaaagccaccgcaggccattag

SEQ ID NO: 222314 - DNA, 786 bp, Artificial Sequence
  Description of Artificial Sequence: Synthetic coding sequence
atggcagatagtgtaaagaccttcctccaggacctggccagggggataaaggactccatatggggcatctgcaccatctcaaagctcgacgccaggatccagcagaaacgtgaggaacaacgtagaagaagagcttcaagtgtgctggcgcagcgccgagcgcagtcgatcgagaggaagcaagaaagcgagcccaggatcgtgtccaggatttttcagtgctgtgcctggaacgggggtgtcttttggtttagcttactcttattttacagggtatttatccccgttttgcagagcgtcaccgcacggatcataggggacccaagtttgcacggagatgtttggagttggctcgagtttttcctcaccagtatcttcagcgcactgtgggtgctgcctctcttcgttttgagtaaggtggtcaatgctatctggtttcaagacattgcagacctcgccttcgaggtgagcggtcgcaagccacacccattcccaagcgtctcaaagatcattgcagacatgttgtttaatttgttactgcaagcactatttctaattcaaggcatgttcgtttccctattcccaattcacctggttggtcagctggtgtccttactccatatgtcgctgctctacagcttatattgttttgagtatagatggtttaacaaggttgccgcattctctttgtcttcattcctgtattcgcttagtgccccaatgaagcagagacccgcaaagcatatcagcagcagctgtgcttcgagcccctggtggagttcctag

SEQ ID NO: 222315 - DNA, 903 bp, Artificial Sequence
  Description of Artificial Sequence: Synthetic coding sequence
atgattcttgaaggtgggggtgtcatgaatttaaaccccggaaataacttgctccaccagcccccagcctggactgattcctacagcacttgcaacgtttcaagcggttttttcggcggtcagtggcacgagatccatccacagtattggaccaagtatcaggtgtgggagtggctgcagcacctgctggacactaaccagctcgatgctaactgcatcccttttcaagagtttgatattaatggggaacatctgtgctctatgtcactgcaggaattcacaagagccgcagggactgccggtcaactgctgtacagcaatctgcaacatctgaagtggaacggacagtgtagtagtgacctctttcagagcacacacaatgtaattgttaagacggagcagacagagccgtcaataatgaacacatggaaagacgagaactatctttacgacactaactatggctctactgtagacctgcttgactctaagacattctgccgcgctcagattagcatgaccactacatcacacctccctgtggctgagtcgcctgacatgaagaaggagcaggaccctccagccaagtgtcacaccaagaagcacaatcctagaggcactcatttatgggagttcatccgcgacatcctcttaaaccccgacaagaatccaggcctgatcaaatgggaggaccggagcgaaggagtgttccgatttctgaaatctgaagcggttgctcagctttgggggaagaagaagaataactcctccatgacctacgagaaactctcccgggctatgcgctactattataagagggaaatattagagcgggttgacggacggaggctggtatataagttcggtaaaaacgcacgcggttggcgggaaaacgagaattag

SEQ ID NO: 222316 - DNA, 903 bp, Artificial Sequence
  Description of Artificial Sequence: Synthetic coding sequence
atgatactggaaggcggtggggtcatgaacctgaaccccggaaataacctgctgcatcagcctccagcttggacagatagttattcgacatgcaacgtgtctagtgggttttttggcggtcagtggcacgaaattcatccccaatattggaccaaataccaggtgtgggaatggctacagcatctgctggataccaaccaactggatgccaactgcatcccctttcaagaattcgacattaacggagagcacctgtgcagtatgtccctccaggagtttactagggccgcagggacagctggccagctgctctacagtaaccttcagcacctgaaatggaatggacagtgctccagcgacttattccagtccacccacaatgtgatcgtgaaaaccgaacagactgaacctagtattatgaacacctggaaggacgagaattacctttacgataccaactacggctcgacggtcgatctactggatagcaaaacattctgtcgggctcagatatctatgaccactactagccacttgccagtcgctgaaagccccgacatgaagaaggagcaagatcccccagctaagtgccacaccaaaaaacacaatccacgaggtacacacctgtgggagttcattcgggacatactgctaaacccggacaagaacccgggactgatcaagtgggaagataggagtgagggggttttcaggttcttgaagtctgaggcggttgcccagctgtgggggaagaagaaaaataactcctccatgacatacgagaagctatccagagccatgagatattactataaaagggaaattttagaacgtgtcgacggtcgtagactagtctacaaatttggaaagaacgccaggggttggagggagaatgaaaattag

SEQ ID NO: 222317 - DNA, 969 bp, Artificial Sequence
  Description of Artificial Sequence: Synthetic coding sequence
atgggtctgcccgagaggaggggcctggtgctgctcctgtctttggccgagatacttttcaaaattatgatactcgaaggaggtggcgtcatgaatctgaaccctgggaataaccttctgcaccagcccccagcctggactgattcctatagcacgtgcaatgtgtcatccggattctttggcggacagtggcatgagatccatccacagtattggaccaagtaccaggtgtgggaatggctccagcatctcctggacaccaaccagctcgacgccaattgcatcccattccaagaattcgatataaacggagagcacctttgcagtatgtcactgcaggaatttactcgcgctgctggaactgccggacagcttttgtattccaatttgcagcatctgaagtggaacggacaatgtagtagtgatctgtttcagtccacacataatgtaattgtgaagacagaacagacggaaccatcgatcatgaatacttggaaagacgaaaactatttatacgacaccaactacggaagtacggtggatctgcttgactctaagaccttttgccgagctcagatctcaatgactactacatctcaccttcccgtggcggaatccccagacatgaaaaaggaacaggacccacctgccaaatgccatactaaaaaacacaacccgcgagggacccacctgtgggagtttatacgagacattttgctaaacccagataagaatcctggactgatcaagtgggaagatcgatcagaaggtgtgtttcgatttcttaagtcagaagccgtcgcccagctgtggggtaagaaaaagaacaactctagcatgacatatgaaaagctctcacgagccatgcggtattattataaacgggagatccttgaaagagtggatggacggagactggtgtataagtttgggaagaacgccagaggctggcgggagaatgagaactag

SEQ ID NO: 222318 - DNA, 903 bp, Artificial Sequence
  Description of Artificial Sequence: Synthetic coding sequence
atgatcctcgaaggtggcggagttatgaacctcaacccaggtaacaaccttcttcatcagccccctgcttggactgatagttactcaacatgcaacgttagtagcgggttttttggcggacagtggcatgagattcatccacagtattggaccaaataccaggtttgggagtggctccagcacctactggacaccaatcagctggatgcaaattgcattccatttcaggagtttgacattaacggggaacatctctgcagcatgtccctgcaagaattcacccgcgctgcgggaacggcaggccagctcttgtactcgaacttgcaacacctgaaatggaacggccagtgttcctctgatctattccagagcactcacaacgttattgtcaagacagaacagactgaaccttctatcatgaatacttggaaggatgagaattacttgtatgatacgaactacggaagtacagtggacctgttggattcaaaaactttctgtagagctcagatcagcatgactactacatcccatttgcccgttgcggagtcccctgacatgaagaaggaacaggacccgccagcaaaatgccacacaaagaaacacaaccctaggggaacgcatctgtgggagtttataagagacatcctgctgaatcctgacaagaatccaggtttaattaagtgggaggatcgatccgagggggtgttccggtttctgaaatctgaggcagtggctcagttatggggaaagaagaaaaataacagctctatgacttacgaaaaacttagtcgggcaatgcgctattactataagagggaaattctggagcgcgtggatggaaggcgactggtctacaagtttggcaagaacgcacgtggctggcgcgagaatgaaaactag

SEQ ID NO: 222319 - DNA, 834 bp, Artificial Sequence
  Description of Artificial Sequence: Synthetic coding sequence
atgattctcgaaggaggcggagttatgaatctgaatcctggaaataatcttctgcaccagccacctgcctggacggactcttactcaacctgtaacgtgtcctcaggtttctttggagggcagtggcatgagattcacccacagtactggactaaatatcaagtgtgggagtggcttcaacacttgctcgacactaaccagctcgacgccaactgcatccctttccaggagtttgacattaacggcgaacacctgtgttctatgtcattgcaggagttcactagagccgcaggaacagctggacagctgctttattccaatttacagcacttgaagtggaacgggcagtgttcgagtgacttgttccagtccacacataacgtgattgtgaagaccgaacagactgaaccatccatcatgaacacctggaaggacgagaactacctttatgacacaaattacgggtctactgtggccgaaagcccggacatgaagaaggagcaggacccgcctgccaaatgtcacactaaaaaacacaacccacgcggtacccacctgtgggagttcatccgggatattctgctcaacccagataagaatcctggactcataaagtgggaagaccgatccgagggggtgtttcgcttcctcaagagcgaagcagtggctcagttgtgggggaagaagaaaaataactcgagtatgacatatgaaaagctgagccgggctatgaggtattactataagagggagattttggagcgtgtcgacggccgacggttagtgtataaattcggtaagaatgctaggggctggagggagaatgaaaactag

SEQ ID NO: 222320 - DNA, 555 bp, Artificial Sequence
  Description of Artificial Sequence: Synthetic coding sequence
atggacctctggaactgggatgaggcatcgccccaggaggtgccaccaggcaacaagcttgctggacttgaaggagctaaacttggcttttgttttccagacctggccctgcagggcgacactccaactgccaccgcagagacctgttggaaggggacttcctccagcctcgccagttttcctcaacttgattggggtagcgccctgttgcacccagaggttccgtggggtgcagaacctgattctcaagctctcccttggagcggcgactggaccgatatggcgtgtactgcgtgggatagttggagtggggcaagtcaaaccctggggcctgccccacttgggccaggtccgattccggcagccggtagcgaaggagcggcaggtcagaactgcagccctcccgcacccggtctgtaccacctgctggaacccggagcagcatgcggctggcatcatttattcgaagccgtgcctgaacttagtagtcatcgactgctgaggactgagccagccgttggcccttgtcagtttggcagtatgccgcaaaattag

SEQ ID NO: 222321 - DNA, 468 bp, Artificial Sequence
  Description of Artificial Sequence: Synthetic coding sequence
atggacttatggaactgggacgaagcatccccgcaggaggttcctccgggaaataaattagcaggactcgaaggtgccaagctgggtttttgtttccccgacctcgcattgcagggagacaccccaacagcaaccgctgaaacctgttggaaaggccctatccagttgtggcagttcctgctggaactgctgcatgacggcgcacggtctagttgcattcgctggacaggtaactctcgggaatttcagctgtgcgaccctaaggaggtggccagactctggggggagcggaagcgcaagcctgggatgaattatgagaagcttagcagaggtttgagatattactaccggagggacattgtccgtaagagcggcggtagaaaatatacatacagatttggcggtcgagtcccaagtttagcttacccagactgcgcagggggaggtcggggagcagaaactcagtag

SEQ ID NO: 222322 - DNA, 1029 bp, Artificial Sequence
  Description of Artificial Sequence: Synthetic coding sequence
atggatctttggaactgggatgaagcaagcccccaagaggttccacctggcaataagctggccggactggagggggctaaactgggcttctgctttcccgacttagccctgcagggcgatacccctacagctacagcggagacctgctggaaaggcaccagcagctcactggccagctttccacagcttgactggggatcggctctccttcaccctgaggtcccatggggggcagaaccggactctcaggccctgccatggtccggggattggaccgatatggcttgcaccgcctgggactcatggtctggtgcctcacagactctaggtcctgcccctcttgggccagggccaattcccgctgccggtagcgagggagccgctgggcaaaattgcgtgcctgttgctggagaagctactagttggtctagggcccaagccgctggcagtaatacctcctgggattgtagcgtgggaccagatggtgatacatattggggaagcggactgggaggtgagccccgtacagactgcactatctcgtggggtggcccagccggacccgactgcaccacttcttggaatcccggtctacatgcaggcggaactacatccctcaagagataccagtcatcagcgttgactgtgtgcagtgagccatcgccacaatctgatcgggcttcattggcccgatgccctaaaacaaatcatcgaggccctatccagttatggcagtttttactcgaattactgcacgatggggcaagaagttcttgcatccgctggacggggaattccagggagttccagctgtgcgaccctaaggaagtggccaggttatggggcgaaaggaagcgtaaacccggaatgaactatgaaaagttatctcggggtttgaggtattactaccgacgcgatatagtgcggaaatcaggcggtcgaaagtacacatatcgatttggcggtcgggtgccatctctcgcttatccggattgtgcaggaggaggtcgcggagcagaaacccagtag

SEQ ID NO: 222323 - DNA, 1029 bp, Artificial Sequence
  Description of Artificial Sequence: Synthetic coding sequence
atggacctctggaactgggatgaagctagtcctcaggaggtgccgcctggcaataagcttgcaggccttgagggcgctaagctggggttctgtttcccagatctggccctgcagggcgacacccccaccgccaccgccgaaacttgctggaagggcacctcaagctctttggcttccttcccacagttggattggggatctgccttgctacacccggaagtgccctggggagcggagccagattctcaggctttaccatggagcggcgattggacagacatggcatgcacggcctgggactcctggtcaggtgctagccagaccctggggccagctcctctcggacccggacctatcccggctgctggctctgaaggcgctgccggtcaaaattgtgttccagtggctggggaggccacatcttggtcaagggcacaagccgcaggttctaacacctcttgggactgttccgtcggaccagacggcgatacttattggggctctggactggggggagagcctcgtacggattgtacgatctcctggggcggaccagcgggtcctgactgcacgacttcctggaatccagggctgcacgctggcggaaccacctccttgaaaaggtaccaaagtagcgctttaaccgtgtgtagcgaacccagtccacagtcagatcgggcatcccttgccagatgccccaaaaccaatcacaggggcccaatacagctctggcaattcctgctcgagttactacacgatggcgctagaagcagttgtattcgctggacaggtaatagccgtgagttccagctgtgtgatccaaaagaggtcgccagactgtggggtgagagaaagagaaaacctggtatgaactatgagaagctgtctcgaggactgcggtattattacaggagggacattgtgcgcaagagcggaggaagaaagtatacatacaggttcggcggaagagtgccatccctcgcttatcctgattgcgccggaggcggacggggtgctgaaacacagtag

SEQ ID NO: 222324 - DNA, 432 bp, Artificial Sequence
  Description of Artificial Sequence: Synthetic coding sequence
atgaaagcaggttgctctattgtggagaagcccgaggggggaggtgggtaccagttccctgattgggcatataagaccgaatcgagtcccggtagcaggcagattcaattatggcattttatcctggagcttctacagaaagaggagtttaggcatgttatcgcctggcagcagggggaatatggcgagttcgtgatcaaggacccagatgaggtcgcaaggctgtgggggcgacggaagtgcaagcctcagatgaactacgacaagttaagcagagccttaaggtactattataataagcgtatcctccacaagactaagggtaaacgtttcacctataagtttaactttaataagctggtgatgccgaactatccctttataaatatccgcagtagtggcaaaatccagaccctgctagtcggaaactag

SEQ ID NO: 222325 - DNA, 1539 bp, Artificial Sequence
  Description of Artificial Sequence: Synthetic coding sequence
atgaaagcgggatgctccatcgtggagaagcccgagggcggaggcggataccaatttccggactgggcttacaaaacggaaagctcacccggtagtcggcagatccaactgtggcacttcatccttgagctcctgcaaaaggaggaatttagacacgtcatagcttggcagcagggggaatatggcgaattcgtcatcaaggatccagatgaggtcgcgagactatggggtcgaaggaagtgtaaaccccagatgaactatgacaaattaagccgagccctgcggtattattataacaaacgcatcttacacaaaaccaaaggcaaaaggttcacatataaatttaactttaacaagctcgttatgcccaactatccctttatcaatatccggtcctcaggggtcgtaccccagtcagcccctcctgtgccaacagcttcttccaggttccacttcccccctttggacacacactctcccacaaatgatgtccagcccggtagatttagcgcttcatcgctcacggcctctggtcaggagtcctctaatggaacagaccgcaaaactgagctctctgaattggaggacgggtcggccgctgattggaggaggggagttgaccccgtttcctcacgcaacgcaattggcggtggtggcatcggacaccagaagcggaagcctgacatcatgctgccgttattcgcacggccaggcatgtaccccgacccccattctccattcgccgtctctccaatacctggtcgcggtggcgtcttgaacgtgccaatttctccagcactgagcctgactccgactattttctcatattctccatcgccgggactgtctcccttcacttcatcatcttgcttcagcttcaatcctgaggagatgaagcactacttgcattctcaggcatgttctgtctttaactaccaccttagcccaaggacattccccaggtatccgggtttaatggtgcctcctctgcagtgtcaaatgcatccagaagagagcacgcagttctccataaagttgcagccccctccagttgggcgaaagaatagagagcgagtggagtcttccgaggagtccgcaccggtgaccaccccgaccatggcatctatccctccaaggataaaggtggagccagcctcggagaaggatccagagtctctgagacagagcgcgagggagaaagaggaacacacacaagaggagggaactgtgccatcccgtaccatcgaggaagaaaaggggactattttcgcaagacctgctgctccgcctatttggccgagcgtgccaatctcaactccatccggtgaacccttggaagtgactgaggactcagaggaccgtcctggaaaggaaccatccgcccctgagaaaaaggaggatgccttgatgccacctaagctgcgcttgaagcgaagatggaacgatgaccctgaggccagagagctgagcaagtcaggaaagtttctttggaacgggagcggccctcaaggactagccaccgccgctgccgacgcgtag

SEQ ID NO: 222326 - DNA, 1533 bp, Artificial Sequence
  Description of Artificial Sequence: Synthetic coding sequence
atggatggattttacgaccaacaggtgccattcatggtcccaggaaaaagtcgctcagaagagtgcagagggcgtcctgtgatcgacaggaagcgtaagttcctcgacacagacctggctcacgacagtgaggagctctttcaggacctgagccagctgcaggaggcctggcttgcagaagcccaggtccccgacgatgagcaattcgttccggattttcagagtgacaacttagtgctccatgccccaccccctacaaagatcaaacgcgaacttcatagcccctcctccgagctgagtagctgctcccatgagcaggctctgggagccaattacggagaaaagtgcctctataactactgcgcttacgaccgtaagcccccatcaggatttaagcccctcacacccccaactacgcccttgtctccaacacatcagaacccattatttcctccgccacaagccacacttccaacctccggccacgcacccgctgctggccctgtgcaaggcgtcggaccagcccctgctcctcattcgttaccagagccgggtcctcagcaacagacgttcgccgtccctagaccaccacaccagccattgcagatgccgaaaatgatgcctgaaaaccagtatccttccgagcaacgcttccagaggcagcttagtgaaccatgccatccattcccaccgcagccgggtgttccaggtgataacaggccctcctaccatcgccaaatgtcagaacctatcgtgccagccgcaccacctccgcctcagggatttaagcaggaataccatgatcctttgtacgaacatggcgtgcccggaatgccagggcctcccgctcatggtttccagagccctatgggaattaagcaagaacctagagattactgcgtggactcagaagtgccaaactgtcagtcatcctacatgagggggggttacttttcgtccagccacgagggctttagttacgagaaggatccccgtctctacttcgatgatacgtgcgtcgttcctgaacgactggagggaaaagtgaagcaggaaccaactatgtatcgcgaaggtccaccctaccagcgcagggggtcccttcagctgtggcagttcttagtgactctgttggatgaccccgctaatgcgcattttatcgcctggactggacgtggtatggagtttaagttgatcgagccagaggaggtagccagacggtgggggatccagaaaaatagacccgctatgaattacgataagctgagtcgcagtctccggtactattatgaaaagggtatcatgcagaaggttgcaggggaaaggtacgtttacaaattcgtgtgcgaccccgatgcgctctttagcatggccttccccgacaaccagaggcccttcctgaaagctgaatctgaatgccacctgtcagaagaggatacgctgccccttacacattttgaggattcccccgcttacctgctcgatatggatcgctgctcctccctcccttatgccgaagggttcgcttactag

SEQ ID NO: 222327 - DNA, 399 bp, Artificial Sequence
  Description of Artificial Sequence: Synthetic coding sequence
atggacgggttctatgaccaacaggtgccatttatggtacctggcaagagccggagcgaagagtgtcgcggtaggcccgtgatcgataggaagcggaaatttctagacaccgacttagctcatgattctgaagaattgttccaggatctgtcacaattacaagaagcctggctcgcggaagcccaggtgccagatgatgaacagttcgtccccgatttccagtctgacaacctggtattacatgctccacccccaacaaaaatcaagcgcgagttgcacagtccatccagcgagctgtcctcttgctcacacgagcaggccttgggcgctaactacggcgaaaagtgcctgtacaactattgtgcctatgatcgcaagccaccaagtgggtttaagtag

SEQ ID NO: 222328 - DNA, 423 bp, Artificial Sequence
  Description of Artificial Sequence: Synthetic coding sequence
atggacggattttatgatcaacaggtgcctttcatggtacccggaaaatcacggtccgaagaatgcagagggagaccagtaatcgatcgtaaacgcaaatttttagacacggacctggcccacgactcggaagaactgttccaggaccttagtcagttgcaggaagcatggctggccgaagctcaggtgccagatgacgagcaatttgtccccgattttcaaagcgataatctggtgctccatgcccctccacccacaaagataaagagggaactgcacagtcccagcagtgaactgtcctcatgtagccacgagcaggctctaggcgctaattatggggagaagtgtctgtataactactgcgcctacgatcgcaagccccctagcggctttaaacctcttaccccacccactactccctag

SEQ ID NO: 222329 - DNA, 1533 bp, Artificial Sequence
  Description of Artificial Sequence: Synthetic coding sequence
atggatggattctacgaccagcaggttccatttatggttcccggaaaatcaagatccgaggagtgccgagggagacctgttatcgatagaaagagaaagttcctagacacagatctagcgcacgattccgaagagctttttcaggatctaagtcaactgcaagaggcctggcttgccgaagctcaggtgcccgacgacgaacaatttgtacctgactttcaatctgataaccttgtgcttcacgcccctccacctactaaaatcaaacgcgaactgcacagcccgagctcagagctcagttcctgtagccacgagcaggctctgggcgctaattacggagaaaagtgtctgtacaactattgtgcttatgaccgcaagcccccttcagggtttaagccgctcacccctccaacgactcctctctctcctacccatcagaaccccctgtttccacccccacaagctacccttccaacatccggacatgccccagccgcagggcctgtccagggggttggaccagcgccagcccctcactctcttcctgagcccggaccacagcagcagaccttcgcggtgccgcgacccccacatcagccacttcaaatgccaaagatgatgcctgagaatcagtatccatcggagcagagattccagagacagctcagcgaaccgtgccacccattccccccacagccaggggtccccggtgacaaccgtccatcatatcacaggcagatgagtgaacctatcgtgcctgcagctccgccacctcctcagggtttcaagcaagaatatcacgacccgctgtacgagcacggcgtcccgggaatgccaggcccacccgcacacgggttccaatcgcctatgggcattaagcaggagcctcgtgactattgtgtggattccgaggtaccgaactgtcagtcatcatatatgcggggaggctattttagttccagccacgagggtttctcgtatgaaaaagatcctcgtctctatttcgatgacacatgtgtggtgccagagcgactggaaggtaaggtgaagcaagaacctacaatgtaccgcgaaggacccccataccagcgtaggggcagtctccagctgtggcagttcctcgtcactcttctggacgacccggctaacgcacacttcattgcttggacgggccgaggtatggaattcaagctcattgaacctgaagaggttgcaaggaggtgggggatccagaaaaatcgcccagcaatgaattacgataagttaagcaggagcctgagatattattatgaaaagggtattatgcagaaggtagcaggggagcgatacgtgtataaatttgtttgcgaccctgacgcactgttctctatggcttttccggacaaccagcgccctttcctgaaagccgaatcagagtgccacctcagcgaagaggacactctgcctctcacacatttcgaagattccccagcctaccttcttgatatggaccggtgctccagcttgccttacgcagaaggattcgcctactag

SEQ ID NO: 222330 - DNA, 453 bp, Artificial Sequence
  Description of Artificial Sequence: Synthetic coding sequence
atggacggcttctacgatcagcaggtcccttttatggtgcctggtaagagtcgttcagaagagtgccgcggaaggcccgtgattgacaggaaacggaagttcttggacacagatcttgcccacgacagcgaggaattgtttcaggacctctcccagctccaggaagcctggctcgctgaagcccaggttcccgacgatgaacagttcgtcccagattttcaatcagataatctggtgcttcacgctcctccgcctaccaagattaaaagagaattacactcaccttccagcgaacttagctcctgttcacatgagcaggccctcggcgcaaactacggagaaaagtgtctctataactattgtgcctatgataggaaaccgcctagcgggttcaagcctctaacccctcctacaacccccctttcacccacccaccagaacccattgttttag

SEQ ID NO: 222331 - DNA, 1659 bp, Artificial Sequence
  Description of Artificial Sequence: Synthetic coding sequence
atgtcggagaggcggtgccctccagagcaccgggagggagttaatgataccggcggaagtctttttccccaaaaattgctaaacgcagaaactagtcagtccggcattagagacgccgaatctacaatggacggcttctatgatcagcaggtacctttcatggtccctgggaagtccaggagtgaggagtgtaggggcaggccagtaattgatcgaaagcgcaagttcctggatacagaccttgcccatgatagcgaagagctttttcaggatctgtcccaactgcaggaggcctggttagctgaagctcaagtgcccgatgacgaacagttcgtgcctgatttccagagtgataatttagttctgcacgcaccgcctccgactaagattaaacgcgagctgcattcccctagttctgaactctcgtcatgttctcatgaacaggcactaggggcaaactacggcgaaaagtgcttatacaactactgcgcctatgatcgtaaaccaccatccggcttcaaacctctgacccctccaaccactcctctgtctcctacacaccagaatcctctgttccccccaccccaagctaccctgcctacttccggccatgctcctgccgctgggcctgtgcagggggtgggcccagcacctgcacctcattcccttccagagccaggccctcagcagcagacattcgccgtgcctcgcccaccgcaccagcccctacaaatgcccaagatgatgcctgaaaatcagtacccgtctgagcagagattccaacggcaactctctgagccatgtcacccattcccacctcagcctggcgtgcctggtgataatcgtccctcttaccacaggcagatgtctgaacctattgtccctgcagccccacctccccctcaggggttcaaacaagagtaccatgacccattgtacgaacacggcgtccctggaatgcccggtcccccagctcacgggttccagagccctatgggaatcaaacaagaacctagagactattgcgtggacagcgaggtccccaactgtcagagctcttacatgaggggcggatacttttcctcctcacacgaaggcttttcctacgagaaggacccacggctttatttcgacgacacatgcgtggtcccagagagacttgaagggaaggtcaagcaggaaccaactatgtacagagagggaccaccataccaacgtcgagggtccttgcaactgtggcaatttttagtcacacttctggacgacccggcaaacgctcatttcatcgcctggacagggagggggatggagtttaaactcatcgagcctgaggaagtggccagaaggtggggtatccagaagaaccggcctgcaatgaactatgacaagctgtctcggtccctcaggtactactatgagaaaggcataatgcagaaagttgcaggtgaacgatacgtttacaaattcgtatgtgaccctgacgccctcttttctatggctttcccggataaccagagaccgtttctaaaagctgagtccgagtgtcatttgtccgaggaggataccctgcccctaacccactttgaagacagcccggcttacctgcttgacatggacagatgctcctccctaccgtacgctgagggtttcgcctactag

SEQ ID NO: 222332 - DNA, 1359 bp, Artificial Sequence
  Description of Artificial Sequence: Synthetic coding sequence
atgtccgaaacccccgctcaatgtagcatcaagcaggaacgaatctcctatacccctcctgagtctcccgtgccctcgtacgcatcatccacaccactacacgtgcccgtgccacgagctctgcggatggaggaagacagtataaggctgccagctcatctgagactgcaacccatctattggagccgggatgacgtagcacagtggctaaagtgggccgagaacgagttctctttacggcctattgactccaacacattcgagatgaacggcaaagcactgttattgctcaccaaagaggatttcagatatcggagtccccactccggtgacgtgctctatgaacttttgcagcacattctgaagcaacggaagcctaggattctgtttagcccatttttccaccctgggaactcgatccacactcagccggaggtgattcttcaccagaaccatgaggaggacaattgcgtccagcgaacacctcgcccatctgtcgacaacgtccatcacaaccccccaacaatcgaattgctgcatcgtagtaggtctcccataacgacaaaccaccggccatcccccgacccggagcagcgcccactgagatcccctctggacaatatgatacgacgtctgtcacctgccgaacgagcacaaggaccgaggccccaccaggagaataaccaccaggaatcgtatcccttatccgtgagccccatggagaataatcactgtcctgcaagctccgaatctcaccccaaaccttcttctccccgtcaggagtctacgagagtgattcagctgatgccgagccccatcatgcacccactcattctgaaccctcgccatagtgttgacttcaagcagagccggctgtcggaggatggcctccatagggaaggtaagcctatcaacttgtctcatcgcgaggatctcgcttatatgaaccatatcatggtaagtgtgtctccgcctgaggagcacgctatgcccatcggcaggatcgcagactgccgactgctgtgggactatgtgtatcaactcctgtccgattcccggtatgaaaacttcatccggtgggaggataaggagtccaaaatctttcgcattgtggaccctaacggtctggccagactgtggggcaatcacaagaatagaaccaatatgacctacgagaagatgagccgggcattacgtcactactacaagctaaacattatcaggaaagaacctggccagcggttattgttccggtttatgaagacgccagacgaaatcatgagcggtcggaccgacaggctggagcaccttgagtctcaagagctcgacgagcagatttatcaggaagatgaatgctag

SEQ ID NO: 222333 - DNA, 954 bp, Artificial Sequence
  Description of Artificial Sequence: Synthetic coding sequence
atgcaggagggggaacttgccatttcccccatttcacccgttgccgcaatgccgcctctaggaacacacgttcaggcccgatgcgaagcacagattaatctgcttggagaggggggtatttgtaagctgccagggcgactgaggattcagcctgccctctggtccagagaggatgtcctgcactggctgcgctgggccgagcaagagtactcactgccatgtactgccgaacatgggtttgaaatgaatggacgggcactttgtatcctcacaaaagatgattttcgtcatcgtgctccatcctccggagacgtcctgtacgaactgctgcagtacatcaaaactcagagaagagccctggtgtgcgggcctttttttggtgggatctttagacttaagaccccgacacaacactctcccgtgcctccagaggaagtgacgggcccaagccaaatggatacaagacggggacacctgctgcagcccccagatcccggactgacctccaattttggacacctcgacgatccaggccttgcccgttggacccccggtaaagaagagtccctgaacctgtgtcactgcgcagagcttggctgtcgcacacagggagtttgctctttccctgcgatgccacaagcacccatcgacggccgtatcgctgactgtaggttgttgtgggattacgtatatcagctactgctcgacaccaggtacgagccatatattaaatgggaagataaagatgccaaaatttttagggtggtcgatccgaacggactcgcaaggttgtgggggaaccataagaatcgggtgaatatgacctatgagaaaatgtcccgcgctctgcggcattattataagttgaatatcattaaaaaggagcccggacaaaagctgctgttccgaaatggtcttcagctaatttttattttcatttggagctttcaatag

SEQ ID NO: 222334 - DNA, 1026 bp, Artificial Sequence
  Description of Artificial Sequence: Synthetic coding sequence
atgcaggaaggagagctagccatttcccccatttcccccgtggcagctatgccccctctgggaacccacgttcaggcgcgatgtgaagcgcagattaatctactgggcgaagggggtatctgcaagctccccggtaggctgaggatacaaccagcactgtggtccagggaggatgttctgcattggctccggtgggcagagcaagaatactccctgccctgcactgctgaacatggattcgagatgaacggcagggcgctgtgcatattgactaaggacgattttagacacagagccccttcctccggggatgtcctctacgagcttcttcaatatataaagacacaaagacgtgcgctggtgtgtggcccattttttgggggaatcttccggttaaagaccccgacccagcactccccggtgcccccagaggaagtcaccggcccaagccagatggatacaagacgcggacacctgctgcagccccctgacccaggtctgacgtcaaacttcggacaccttgacgaccccggtctggcccgatggactccaggtaaggaggagtcacttaatctgtgccattgcgcagaactgggttgcagaacacagggagtctgttctttccctgctatgccacaggctcccatagatggccgaatagctgattgccgattactgtgggactacgtgtaccaactattacttgacacaaggtatgagccttacattaagtgggaagataaggatgcaaaaatctttcgcgtcgtcgatccaaacggactcgcacgactttggggtaaccataaaaacagggtgaacatgacatatgagaaaatgtcgagggcactgagacactactacaaactgaacataatcaagaaagagcctgggcagaagctccttttccggttcctaaagaccccaggcaagatggtacaggataagcattcccatctcgagccacttgaaagtcaggagcaggatcggattgaatttaaggacaagcgtcctgagatttctccctag

SEQ ID NO: 222335 - DNA, 795 bp, Artificial Sequence
  Description of Artificial Sequence: Synthetic coding sequence
atgcaggaaggggagttggccatatctcctatttcaccagtcgcagcaatgccgcctctgggaacacacgtacaggctcgctgtgaagcccagatcaatttgctcggtgagggcggaatttgcaaactgccgggtcgcctcaggatccagccagccctgtggagccgcgaggatgttctgcactggctgcggtgggcggaacaggaatattcattgccctgtactgccgagcatggattcgagatgaacgggagagctttgtgcatcctgactaaagacgacttcaggcaccgggctcctagctccggcgacgttctgtacgaacttcttcaatatatcaagacacaaaggagagccctcgtctgtggcccatttttcggtggtatttttaggctgaaaacccctacacagcattcccctgtacccccagaggattgtaggctgttatgggactacgtctatcaactgcttttggataccagatacgagccctacatcaagtgggaagacaaggatgccaaaatttttagagtcgttgacccaaacggcttggcacgtctgtggggcaaccacaaaaatcgagtgaatatgacatacgagaagatgtccagagcacttcgccactattataagttgaatataatcaaaaaggagcctggacagaaactgcttttccgctttttgaagacacctggaaaaatggtccaggataagcattcccatctagagcccttggagagccaggagcaggaccgtatcgagttcaaggataaacgtccagagatctccccatag

SEQ ID NO: 222336 - DNA, 861 bp, Artificial Sequence
  Description of Artificial Sequence: Synthetic coding sequence
atgcaggaaggcgaactcgctatttcccccatttcacccgtagctgcgatgccacccctgggcacgcacgttcaggcacgctgcgaggcgcagatcaatttattaggggagggaggaatttgcaagcttccaggaaggctgagggatgtcctctatgaactcctgcagtatattaagacacagagacgggcactcgtgtgtggcccattctttgggggtatctttcggcttaagacaccgacccagcatagcccagtgccccctgaggaagtgaccggtccaagccagatggatactcgccgagggcatctcctgcagccaccggacccgggattgacatcaaacttcggccacctcgacgatcccggactcgccagatggacccccggaaaggaagaaagtttgaacctgtgtcattgtgccgaacttgggtgtcgaacccagggagtttgctctttccctgctatgcctcaggccccaatagacggacgcattgctgactgccgtctcttatgggattacgtgtaccagcttctccttgacacacgctatgaaccatacataaaatgggaagacaaggacgccaagattttcagagtggtggacccaaacggcctggcgcgactctggggcaaccacaaaaatagggtgaatatgacttatgaaaaaatgagtcgagccttgcgccactactataagcttaatataatcaaaaaagaacccggacagaaattgctgtttcgtttcttaaagactcccggtaagatggttcaggataaacactctcacctcgaacctcttgagtctcaggaacaggatcgtatcgagttcaaagataagagacctgagataagcccatag

SEQ ID NO: 222337 - DNA, 573 bp, Artificial Sequence
  Description of Artificial Sequence: Synthetic coding sequence
atggacacccgtagggggcatttgttgcagccaccagacccgggactgacttcaaatttcggccatctggacgaccccggactcgctagatggacaccaggcaaagaggaatcattaaatctttgtcattgtgctgagctgggctgcagaacccagggggtatgcagctttcctgctatgccccaagcccctatcgatggcaggattgctgattgtcgactcctgtgggactatgtgtaccagctcctactggacacaaggtacgagccatacatcaaatgggaggacaaagacgcaaagatctttagagtcgtcgatcctaatggacttgctcgcctgtggggtaatcacaaaaatagagttaacatgacgtacgaaaagatgtcacgcgcattgaggcattattataagctgaacataatcaaaaaggaacctggtcagaagttgctgttccgctttttaaagacaccagggaagatggtccaggacaagcacagccatctcgaaccactagagtctcaggaacaggatcgcattgagttcaaggacaagaggcctgaaatctccccatag

SEQ ID NO: 222338 - DNA, 1242 bp, Artificial Sequence
  Description of Artificial Sequence: Synthetic coding sequence
atggccagctgtgcagaaccatccgaaccgtctgctccccttccggcaggcgtacccccactcgaggatttcgaggtcttggacggcgtggaagacgcggagggagaggaggaagaagaggaggaggaggaggaagaagatgatctcagcgagctaccaccgttagaggacatgggacagcctcctgcagaagaggcggagcagcccggagctctcgcgcgtgagttcttagcggctatggaaccagaacccgcacctgcccctgcaccagaggagtggctcgacatcttaggaaatggcctgctgcgcaagaagactcttgtccccggtcccccaggatctagccgcccagtcaaaggacaggtcgtgactgtccatctgcaaaccagcctggagaacggcacccgtgtacaagaagagcctgagctggtgtttacactgggtgactgtgacgtgatacaggcactcgacttaagcgtgcccctgatggacgtaggggagactgcaatggtgaccgcggacagcaagtattgttatggtccacaaggttcacgctcgccatacattcctccccacgcagcactctgcctggaggtgactctgaaaacggcagtcgacggacctgacctcgagatgctgactgggcaagagagagttgctcttgccaatcggaagagggaatgcggcaatgcccactatcaaagggcagacttcgtcctcgccgcaaactcgtacgatctggcgatcaaagccatcacaagttctgccaaagttgatatgaccttcgaagaagaagctcaattgctccagcttaaggtgaaatgtctgaacaatttagcagcttcacagctcaaactagaccactatagggccgctctacgatcttgtagcctggttctggaacaccagcctgacaatatcaaggccctgtttcgaaaagggaaggtcctggctcagcagggtgagtacagcgaagctatccctatcttgcgggctgccttaaagctggagcctagcaacaagacaattcatgcggagctgagtaagctcgtaaagaagcatgccgcacagcgcagtaccgaaactgcactgtatcggaagatgctgggaaatcccagtcgactccctgctaagtgtccaggcaagggcgcatggagtatcccttggaagtggttgtttggggcaaccgcagtggctttgggcggagtggccctctccgtggtcatagctgcaaggaactag

SEQ ID NO: 222339 - DNA, 1422 bp, Artificial Sequence
  Description of Artificial Sequence: Synthetic coding sequence
atgaattatgataagctcagtagggccctcaggtattattataacaagaggatacttcacaagactaagggcaagcgattcacctataagtttaatttcaacaagctcgttctggtgaactacccatttattgatgtgggacttgccggtggcgcagtcccccagtccgccccacctgtgcctagcggaggatcacactttcgattcccccctagtaccccctccgaggttttatcccctacagaggatcccagaagccccccagcatgctccagctccagttcttctctcttctcagctgtcgtcgcaaggagactcggcagaggaagcgtgtctgactgttccgatggcacaagcgaactcgaggaacctttgggagaagatcccagggctaggcctccaggcccacccgatctcggggcattccgcggacctccgcttgctcggctcccccacgatccaggcgtgtttagagtgtacccaagaccacggggaggtcctgaaccactctcaccctttccagtctcccctcttgccggacccggaagtttacttccacctcagctgtcacctgccctgccaatgactccaactcacctagcatatactccaagccccaccctgtcacccatgtatccatccggcggaggcggaccttctggaagcggaggtggaagtcacttctccttttctcccgaggatatgaagagatacctacaggcgcacactcagtccgtatacaattaccatctttctccaagagccttcttgcactaccccggattggttgtaccccagccccagcgtccagataaatgccctttaccgcctatggcacccgagacacctcctgtcccctcctcagccagcagctcctccagcagttcctcttccccattcaagttcaagctccagccccctccactaggcaggaggcagagggccgcaggcgaaaaagctgtcgccggagccgacaagtcaggcggatcggcagggggactggctgagggtgcgggagctctggccccacctccgccacctcctcagatcaaggtggaacctatttctgaaggtgaatcagaagaggtggaggtgacggatatcagtgacgaggatgaagaagatggagaagtgtttaagactcccagggcacctcctgctcctccaaagccagagcccggtgaagccccaggcgcttcccagtgtatgcccctcaagctcaggttcaagcggcgatggagcgaggactgtcgtctggagggcggtggtgggccagccggaggctttgaagatgaaggcgaggacaagaaagtccgcggtgaaggcccaggcgaggctggcggacccttgacacctcgtcgggtatcttcagacctccaacatgcaactgcccagctgtccctcgaacatcgggactcgtag

SEQ ID NO: 222340 - DNA, 2478 bp, Artificial Sequence
  Description of Artificial Sequence: Synthetic coding sequence
atggccgcagatgaaggatcagcagagaagcaggctggcgaggctcacatggccgctgatggggagactaacggcagctgcgagaatagcgatgcatcaagccatgcaaatgccgctaagcacactcaggacagcgccagggttaatccccaggacggaactaacactctcacgcggattgctgagaacggcgtctctgaacgagactctgaggctgcaaaacagaaccatgtgaccgctgatgatttcgtccaaacatctgtgataggcagtaatggctacatactcaacaaacctgccctgcaagcgcagccgctccgcacaacctctaccctggcaagcagcctgcctggccacgcagccaagactctgccaggtggtgctggcaagggcaggacgccatctgctttcccacagacaccagcggctcccccagctaccttaggagaggggtcagccgatacagaagataggaagcttcccgcaccaggcgcagatgtaaaggtccaccgggcacgcaagaccatgccaaagtcagtggttgggctgcacgcagctagcaaagatccacgagaggtccgggaggccagggaccacaaggagcccaaagaggaaatcaacaagaatattagtgacttcggccgacaacaattgctgcccccatttccgtctttacaccagtccctgcctcagaatcagtgttacatggcgacaaccaaatctcagactgcctgccttcctttcgtactggctgcagctgtatctcggaagaaaaagcggaggatgggaacatactctctagtgcccaaaaaaaagacaaaagtcctgaagcagcgtacggtgattgaaatgttcaagtccattacccattccaccgttggttcaaaaggtgaaaaagacttgggtgcaagtagtctacatgtgaacggcgaatctctcgaaatggattcggacgaagacgactctgaagaactcgaggaggacgatggccacggagctgagcaggctgccgcattcccaacagaggatagcaggacatcgaaggagtcaatgtccgaggccgacagagctcagaagatggatggggaatccgaagaagagcaggagagcgtggacactggagaggaggaggaggggggtgatgagagtgacctgtcgagtgagagcagcatcaagaaaaaatttttgaagcgaaagggaaaaaccgattctccctggattaagcctgccaggaagaggcggcgacgaagccgcaagaaaccttcaggcgctctgggctccgaatcgtacaagtcctcagcagggtccgcggagcagactgctccaggcgattcgacaggctatatggaggtgagcctggattcattggacctgcgggttaagggtatcctgtcctcccaggctgaggggttagctaacggaccagacgtattggagacggatggactgcaggaagtgcctctatgctcctgtagaatggaaaccccaaagtctcgcgaaattactacgttggcgaataatcagtgcatggccaccgagtcggttgatcacgagctgggcaggtgcactaattccgtcgttaaatacgagttgatgagaccctcaaataaagcaccccttctcgtgctgtgcgaagaccaccggggtcgaatggtgaaacaccaatgttgtccaggctgtgggtacttctgtaccgctggcaacttcatggaatgtcaaccggaatcgtcaatttctcatagattccacaaggattgcgcaagccgtgtgaacaatgcctcgtactgtccgcactgcggggaagagtcatcaaaggcgaaagaggtaactatcgctaaggctgataccactagcaccgtaacccccgtccccggtcaagagaagggttctgctctggaaggtagggccgacacaactaccggcagcgctgctgggccaccattaagtgaagatgataagcttcagggagctgcttctcacgtaccagagggctttgatccgactggccctgcaggactggggagacctacaccaggactctctcagggaccgggtaaggagacccttgaaagcgccctgatcgccctggactctgagaaacctaaaaaactgcgcttccaccctaagcagctgtatttctctgcaagacaaggcgaactacaaaaagtgctgctcatgcttgtggacggcatcgatccaaatttcaagatggagcaccagaacaaaaggagtccactccatgccgcagccgaggcaggccacgtggatatctgccatatgttggtccaggccggagcaaacattgacacctgctcggaggaccagcgcacacctttgatggaagcagccgaaaataatcatctcgaggcagtgaaatatttaattaaagccggagctttggtcgatccgaaaattcagaaaacaagtaaggtctatactgaatctcaggagacacagagaagccagacaattctttag

SEQ ID NO: 222341 - DNA, 3462 bp, Artificial Sequence
  Description of Artificial Sequence: Synthetic coding sequence
atggctgctgacgaggggagcgcagaaaagcaggcaggcgaagcgcatatggcagcagatggcgagacaaatggcagttgcgaaaactccgatgcctcatcccacgccaacgcggcaaaacacacacaagacagcgctcgcgtgaatcctcaggacggaactaacaccctaacaagaatcgcagaaaacggcgttagtgagagagactctgaggcagcaaaacagaatcacgttaccgcggacgacttcgtgcagacttcggtgataggatccaacgggtacatcctgaacaaacccgctctgcaggctcaacccctgagaaccactagcaccctcgcgtcaagtttacccggacacgccgcaaaaactcttcccggtggtgccggaaagggccgtactccctccgcattcccgcagacccctgccgctccccctgccactctgggcgaaggatctgccgacacagaggatcggaagctgcctgcccctggcgcagatgtgaaggttcatcgagccagaaaaaccatgcctaaatccgtcgtggggctacacgctgcgagcaaggatcctcgagaagtgcgagaggccagagatcacaaggaacctaaggaagagatcaacaagaacatttcagattttggaaggcaacagctgctcccaccatttccatctctccatcagtcactgccccaaaaccagtgctatatggcaactacaaaatcccaaacggcatgcctcccatttgtattagcggctgctgtgagccgcaaaaagaaacggaggatgggcacctattccttggtccctaaaaaaaaaacaaaggtcctgaagcaaaggactgtgatcgagatgttcaaatcgatcacgcacagtaccgtaggctccaaaggcgagaaggacctaggggcatcctctttacatgtcaatggggagagcttggaaatggattctgacgaagacgatagcgaggagctcgaggaagacgatggccacggggctgaacaggcagcggcattccctaccgaagattctcggactagtaaagaaagtatgtccgaggccgatcgagcccagaagatggacggagaaagtgaggaggaacaagaatcggtcgatacgggcgaggaagaggaagggggtgatgagtcagacttgagctcggagtcatcaataaagaagaaatttctcaagcgcaaggggaagaccgactccccctggatcaagcccgctcggaaacggcgaaggaggtccagaaaaaaaccgagtggtgcgttgggaagtgagagttataagagcagcgctggctctgcggagcagacagcccctggggattctacggggtacatggaggttagtcttgacagcttggacctgagggtgaagggcattctctctagtcaagcagagggccttgcgaacggcccagacgttctggaaaccgacggtctccaggaggtgcctctctgtagttgtaggatggagactcccaagtctcgagagattaccacactggctaacaaccagtgtatggccacagaaagcgtagatcacgagctggggagatgcaccaatagcgttgttaaatacgagctgatgcgaccatccaacaaggcacctctgctcgtcttgtgtgaggatcaccgcggtagaatggtgaagcatcagtgctgtcctggctgcgggtacttctgcactgcaggaaactttatggaatgtcagccagaatcatccatcagtcaccgttttcacaaggactgcgcctcccgtgtcaataacgcttcatactgcccacactgtggcgaggagagttcgaaagcaaaagaagttacgatcgccaaggcagatactacctccacagtgactcccgtccccggtcaggaaaaaggtagcgctctggaaggccgtgccgatactaccactggctctgcagcaggcccaccactctctgaggatgataaattacagggggctgctagccatgtcccagagggatttgaccctactggccctgcgggactcggccgaccgaccccagggctgagccagggcccaggaaaggaaacgctcgagtccgctctaatcgctttggattccgagaagcctaagaaacttcgttttcaccctaaacagctgtatttcagtgctaggcaaggcgagctacaaaaagtgcttctgatgctggttgatggcatcgaccctaacttcaagatggagcatcaaaacaagaggtctccattgcacgccgctgccgaagctgggcatgtcgacatttgtcacatgctcgtacaggccggagccaacatcgatacctgttcagaggatcaacgtaccccacttatggaggccgctgaaaacaatcacttggaggccgttaagtatctgatcaaggctggcgctctggtggatcctaaggatgccgaaggctccacatgtctacatctggcagccaagaagggccactacgaagtagtacagtatctgcttagtaacgggcagatggatgtgaattgccaagatgatggcggatggactccgatgatctgggccacggagtacaagcacgtcgaccttgtgaagctcttactgtctaaaggttctgacatcaacattagagataatgaggagaatatatgcctgcactgggcagccttttcgggatgtgtcgacattgcagagatcctgctagccgcaaagtgcgatcttcacgccgtgaatatccatggagattcacccctacacatagccgcacgggagaatagatatgactgcgtggtgctcttcttatcgagggacagtgatgttacactgaaaaacaaggagggggagactcctctgcagtgtgcctcccttaactcccaggtgtggtccgccttgcagatgagcaaagcgcttcaggattcagctccagaccggccttcaccagtggagcgtattgtcagtcgcgacattgctcggggatacgaaaggattcccatcccatgtgtgaatgccgtggacagcgaaccttgtccatcaaactataagtacgtctcccaaaattgcgttacctcccccatgaatattgatcggaacattactcatcttcaatactgcgtctgcattgacgactgcagtagcagcaattgcatgtgtggacagctttcgatgcgctgttggtatgacaaggatggcaggctgttgccagaatttaatatggctgagcccccactcatctttgagtgcaatcacgcatgcagttgctggaggaactgtaggaatcgtgtggtgcagaatggcctgcgcgctagactgcagctgtatcgaacccgtgacatgggatggggtgttagatctctacaagatatccccccaggcacatttgtctgtgagtacgtgggcgaactaatttcagattctgaggcggacgtccgcgaggaggatagttacctttttgatctggacaataaagtgatttccgcttag

SEQ ID NO: 222342 - DNA, 3897 bp, Artificial Sequence
  Description of Artificial Sequence: Synthetic coding sequence
atggccgctgcggatgccgaggccgtacccgcaaggggcgagcctcaacaagattgctgtgtgaaaacagaactcctgggtgaagagaccccaatggccgctgatgagggatctgccgaaaagcaggccggagaggctcatatggctgcagatggcgagaccaatggcagttgtgagaatagtgatgcctcttcacacgccaatgcagctaagcatacccaggacagcgcaagggtaaatccccaggacgggaccaacacacttactcgtattgcagagaacggggtgtctgaacgggactccgaagccgctaaacaaaaccacgtaacggccgacgactttgttcaaacgtccgtgataggtagcaatgggtacatcttgaataaaccggcactccaggcccaaccccttcggactacgtctacattggcgagtagcttacccggtcacgccgcaaaaacgcttcccggtggcgcaggaaaaggtagaactccctctgccttcccacagacacccgctgccccaccagccactctgggcgagggttccgcagatacagaagaccgcaaactgccagctcccggtgctgatgtcaaagtgcacagggctcgcaagactatgccgaagagtgttgtgggcttgcatgctgcttctaaagacccacgcgaggtcagagaggctcgtgatcataaagaaccgaaggaggaaatcaataagaacatttcggacttcggcagacagcagttgttacccccttttccctcattgcaccaatcactgccacagaatcaatgctatatggccaccactaagtcccagaccgcttgcctgccatttgttctggctgccgctgtttcacggaaaaaaaagagaaggatgggcacttattctttagttccaaagaagaaaaccaaggtcctgaaacaacgaactgtgatcgagatgtttaagtctataacgcacagcactgtggggtcaaaaggagaaaaagatctcggagccagctcactgcacgtcaacggagaaagccttgagatggatagtgatgaggacgactccgaagaattagaagaggacgatggacatggggctgaacaagccgctgcatttcccacggaagactcccggacctctaaagaatctatgtcggaggcagatagggctcagaagatggatggagaaagcgaggaggagcaggaatcagttgacactggagaagaggaggaagggggagacgaaagcgacctgagctcggaaagttccatcaaaaagaaatttctgaaacgcaaggggaaaactgactctccttggatcaagccagcccgaaagagacgtcgccgatcgcggaagaagccctccggcgctttgggctcggaaagctacaaatcctccgcaggatctgctgaacagacagctccaggagactctacagggtatatggaggtcagtctagacagcctagacttaagagtgaaaggcatcctcagctcccaagctgaaggcctggctaacggtcccgatgtcttggagacagatggactacaggaggtgccgctctgcagctgccggatggagacaccaaagagtagggagatcacaactctggcaaataaccaatgtatggcgaccgagagtgttgatcatgaactgggacgctgcacaaatagtgtggtcaagtatgaactgatgcggccttctaataaagccccactgctggttctgtgcgaagaccacagaggaaggatggtgaagcatcagtgctgccctggatgcggttatttttgcactgctgggaactttatggagtgccaacctgaatcttccatatctcatcgtttccacaaagattgtgcctcccgagtcaataatgcctcctactgcccacattgcggagaggagagctctaaagcaaaggaggtgacaattgccaaggccgatacaacctccaccgtgacccctgtgcctggccaggaaaagggttcagcacttgagggtcgggctgacaccacaaccgggtccgccgcagggccaccactttccgaggatgacaaactccagggtgccgctagccacgtgcctgaaggcttcgaccccacaggcccagccggtttggggcgaccaacgccaggtctgagccaagggcctggaaaagagactctagaaagcgcgctcattgcattggacagcgaaaaaccaaaaaagctgcgatttcatccgaagcagttgtacttcagtgcccgtcaaggagagctacagaaggtgctcctgatgctggtggacggaattgaccccaatttcaaaatggagcatcagaataagcgttcgccactccacgcagccgcagaagccggacacgtcgatatttgtcatatgttagtgcaggctggcgctaacatcgatacgtgctctgaagatcagagaacacccttgatggaggcggctgaaaacaatcacctggaggccgtaaaatacttaataaaggccggagccctggtcgatccaaaggatgccgagggatccacatgcctccacctggccgcaaagaagggacactatgaagtggtccaatacctcctgagcaacggccagatggatgtaaattgtcaagatgacggaggttggacgcctatgatctgggctaccgagtataagcacgtcgatcttgtgaagctattacttagcaaggggagcgacatcaatatcagggacaacgaagagaacatttgtcttcactgggcagcattctccgggtgtgtggacatcgccgagatcctcctcgccgcaaaatgcgatttgcacgcagtgaacatccatggcgactcccccctgcatattgctgcccgtgagaatagatatgactgcgtggttttgttcctgtcgcgcgattccgacgtgacgctcaaaaacaaggagggggagactcctctccaatgtgcatccctcaatagtcaggtgtggagcgctctgcagatgagtaaagcactgcaagactctgcacccgaccggccatctcctgtggagcgcattgtctctagggatattgcccgaggatatgagagaatccccattccgtgcgtgaacgccgtggatagcgaaccatgtccttctaactacaaatacgtatcacagaattgcgtcacctctcccatgaacattgacagaaatatcacacatttgcagtactgtgtatgcatcgatgattgctcatcctctaactgtatgtgcggtcagctgtccatgcgatgctggtatgacaaagatggcagattattaccagagttcaatatggccgagccacctcttatattcgagtgcaaccatgcgtgtagctgttggcgaaattgtcggaaccgtgtggtccaaaacggcttgagagctagacttcagctttataggacacgtgacatgggctggggggttaggtccctccaagacatccctcccggaaccttcgtttgtgaatacgttggagagttaatcagtgattctgaggcggatgtgagagaggaggacagctacctgtttgatttggacaacaaggatggggaagtttactgtatcgatgcaagattttacggcaatgtgagccgcttcataaatcaccattgcgaaccaaaccttgtgccagtaagagtctttatggcccatcaggatctgcgattcccaagaatcgctttcttctccacacgtctcattgaggctggggagcagctcggcttcgactacggtgaaagattttgggacatcaaaggcaagcttttcagttgccgatgtggcagccctaagtgtaggcattctagcgccgctctagctcaacgccaggcttctgcagcacaggaagctcaggaagacggattaccagatacgtcaagcgcggcagctgcagatccactgtag

SEQ ID NO: 222343 - DNA, 2427 bp, Artificial Sequence
  Description of Artificial Sequence: Synthetic coding sequence
atggccgcagccgatgccgaggctgtgcctgctagaggtgaaccacaacaggattgttgcgtcaaaacggagcttctcggggaagagactccaatggcggcagatgagggttcagccgaaaaacaagcgggagaggcacacatggcagcagatggcgaaaccaacggatcctgtgaaaattcagacgcatcatcccacgccaacgctgccaagcatactcaggattctgccagggttaaccctcaggacggtacaaacactctcacacgcattgctgagaacggggttagcgaacgtgattctgaggccgcaaaacaaaatcatgttacggctgatgactttgttcagacttccgtgataggaagtaacgggtacattttgaataagccagcactccaggcccagccactcagaacaactagtaccctggcatcctcactgcccggacatgcagccaagaccctgcctggaggggctgggaaagggagaaccccatctgctttcccccagacgcctgccgcaccacccgcaactctgggcgagggctcagccgatacagaggacaggaagttgccagctccaggagcggacgttaaggtccaccgtgccaggaagactatgcccaagagtgtggttggcctccatgccgcaagcaaggatccacgggaagttcgtgaggccagagaccataaggagcccaaggaggagataaataaaaacatctccgactttggacgacaacagctgttgcccccatttccatctcttcaccagtcactgccgcagaaccagtgttatatggccaccaccaagagccagactgcctgtctgccctttgtgctcgccgcagctgtgtctcgtaaaaaaaaacgccgtatgggaacatacagcctcgtccctaaaaagaaaactaaagtcctcaagcagaggactgttatagaaatgttcaagagcattacacattcaactgttggctccaagggtgaaaaagacctcggggcatccagcctccacgtgaacggcgagtcacttgagatggacagcgacgaagacgatagcgaggagctggaagaggacgacgggcacggtgcagagcaggcagcggctttccctaccgaggactcgcgtactagtaaagagtctatgtctgaagccgatcgcgcacaaaaaatggacggagagagcgaggaagagcaggagagcgttgataccggcgaggaagaggagggaggagatgaatcagacttgagctcagaatcttccattaaaaaaaagttcttaaaacgaaaaggcaagacggacagtccttggattaaacccgctaggaagcgccgacgccgttcgcgcaagaagccttcaggcgctctgggatccgagtcctacaagagttcagccggaagcgccgagcagacagcacctggagacagtacaggctatatggaagtgtcccttgacagcctagaccttcgggtgaagggaattctgagcagtcaagccgaagggttagctaacggcccagatgtgctggaaaccgacggccttcaggaagttcccctctgttcttgccgcatggaaacccccaaaagtagggaaatcacaaccttggccaacaaccagtgcatggcgacagaatccgtcgaccacgaacttggcagatgtacgaatagcgtggtgaaatacgagctgatgcgtccctccaataaggctccattgcttgtactgtgcgaggatcatcgcggtcggatggtgaagcatcagtgttgtccaggttgcggttatttctgcaccgcaggcaattttatggagtgtcagcccgaatcaagtatatcacaccgattccataaagattgcgcttcacgcgtgaataatgccagctactgccctcattgcggggaggaaagtagcaaagccaaggaggtgactattgccaaggccgacactacatccacagtaacccctgtccctggtcaggagaaaggttctgctctggagggacgtgccgatacaacaaccggctccgcggcaggcccaccactgtccgaggatgataagctccagggagctgcctcccacgttcccgaaggtttcgatccaactggaccagccggtctgggcagaccaacccctggattgtcccagggcccagggaaggaaaccctggaaagtgcgctaatcgcccttgacagcgagaagcctaagaaattgaggttccatccaaagcagctgtacttctctgctcgccaaggcgagctccagaaagtcctccttatgctggtggacgggattgatcctaatttcaaaatggagcaccaaaataaacggtctccactccacgcggctgctgaggccggtcacgttgatatttgtcatatgttggtgcagttctgccgcttaggaagccccaggtcaagggggtgcttgtggtag

SEQ ID NO: 222344 - DNA, 3702 bp, Artificial Sequence
  Description of Artificial Sequence: Synthetic coding sequence
atgcggggtctgcccagaggacgaggtctgatgagagctcggggtcggggaagagcagccccacctggctcacgcggaagaggccgaggaggtccgcaccgcggtcggggaagacccaggtccctattatccctaccacgggctcaggcctcctggactcctcaactctctaccggactgacttccccacctgtcccttgtctaccatcccagggcgaggcccctgccgagatgggggcactgctactcgaaaaggagactcggggagccacagagcgggtgcatggatctctcggggacacacctcgcagtgaggaaacgttacctaaagctacacccgactccttggaacctgccggtccgagctccccagcctcagtcactgtgacagtgggagacgagggtgcagacacaccggtgggagcaactcccctgataggcgatgaaagcgagaacttagagggagatggggacctccgtgggggaaggatcttactgggccacgccacaaaaagcttcccttctagcccatcaaaggggggttcatgcccctctcgagccaagatgagtatgacgggggctgggaaatctccaccaagcgttcagagcctcgctatgcggttgctgagtatgcccggtgcacagggtgcagctgcagcagggtccgagcctcccccagcaacaactagtcccgagggacagcccaaagtgcaccgagctagaaagaccatgagtaaacctggcaacgggcagcctcccgtgcctgagaagaggccaccagaaatacaacacttccgaatgtctgacgacgtgcacagcctggggaaggtcacgtcagatctggccaagagacgcaaattaaatagcggaggtggcctgagtgaagagctgggatcagcgcgacggtctggagaggtgacattaaccaagggtgatcccggaagcttggaggagtgggagactgtagtgggagacgatttctccctgtactacgatagctactctgtcgatgaaagggtagactccgatagcaagtccgaggttgaggccctcaccgaacaattgagcgaagaggaggaggaagaggaagaggaagaggaagaggaagaggaggaagaggaggaagaggaggaggaggaggacgaggaaagcggcaatcagagtgataggtcaggcagttccgggcgtcgcaaagctaagaagaagtggcggaaagattccccatgggtgaagcctagccgaaagagaaggaagagagagcctcccagagcaaaggaacccaggggcgtgagcaacgatacgtccagtctcgagacagaacggggtttcgaagagttgccactgtgcagttgtaggatggaagcacccaagattgatcgaatcagcgaacgggcaggacacaagtgcatggctacagaatccgtagacggggagctgtcggggtgtaatgccgctattctgaaacgggagacaatgcggcctagttctagagtcgcactgatggtcctgtgcgagacacaccgagcgaggatggtgaaacatcactgttgcccaggctgtggttacttttgcacagccggtaccttcctggagtgtcatcccgacttcagagtcgcccatagatttcacaaggcgtgtgtcagccagttaaacggaatggtgttttgcccccactgtggagaagacgcctctgaggcccaagaggtgactattcctcgcggagatggagtgaccccaccagctggcacagcagcccctgcaccacctcccctatcccaagatgtacccggtagggccgacacatcccagccctccgctaggatgcgtgggcatggagagccaaggagacctccatgcgatccccttgccgacactatcgatagctcaggccctagtctcacactccctaacggcggatgtcttagcgccgtgggacttcccttgggacctgggagggaggccctcgagaaagccctcgtcattcaagagagcgaacggaggaaaaagcttcggtttcaccccaggcagctgtatctgtccgtgaaacaaggtgagttgcagaaagtgattctcatgctgctagataatcttgatcctaattttcagtccgatcagcaatccaagcgcacgccactgcatgccgcagcccagaaaggatcagtggaaatatgtcatgttctgctgcaagctggagccaatattaacgccgttgataagcagcaacgtacgcctctgatggaggctgttgtcaacaatcatttggaggttgcccgttacatggtgcagcgaggagggtgtgtttatagcaaggaggaagatggaagcacgtgcctacaccacgctgcgaagatcggtaacctggaaatggttagcctgctcctcagtactggacaggttgacgtgaacgcacaagatagtgggggatggactccaatcatctgggctgctgaacacaaacacattgaggtgatcaggatgctactcacgagaggggctgatgtgaccttaactgacaatgaagaaaacatctgcctgcattgggcttctttcacagggtccgccgctatcgccgaggtgctcctgaatgctagatgtgatctccatgcagtgaactatcacggcgatacccctctgcatatagccgctagggaaagttatcatgattgcgtgttgttgtttcttagtaggggggctaacccagagctcaggaataaggagggcgataccgcttgggatttaaccccggaacgaagtgatgtctggttcgccttacaactgaatcgcaagctccgtctcggagtaggaaatcgcgcaatccggaccgaaaagatcatctgccgggatgttgctcgcggatatgaaaacgtgcctattccatgcgtgaacggcgtcgacggagagccctgtcctgaggattacaagtatattagtgaaaactgcgaaactagcactatgaacattgataggaacattacacacctccagcactgcacctgtgtggacgattgcagctcaagtaactgtctctgcgggcagctgtctatccgatgttggtacgacaaggacggacggctgctgcaggagttcaacaagattgagcctccattgatcttcgaatgcaaccaggcatgttcatgttggcggaattgtaagaaccgagtggttcagagcggcataaaagtgcgcctacagctgtataggactgccaaaatgggttggggcgtgcgggctttacagaccatcccacagggaactttcatctgtgaatatgtgggggaattaattagtgatgccgaagctgatgtacgcgaggacgattcgtatttattcgacctagataacaaagatggggaggtgtactgcatcgacgctcgttattatgggaatataagcagatttattaatcacctgtgcgatccaaacatcattcccgttagggtgtttatgcttcaccaggacttaagatttccccgtatcgccttcttttctagtcgagacataaggacaggcgaagagttgggtttcgactacggggatcgattttgggatatcaaaagtaaatactttacatgtcagtgtggttccgagaaatgtaagcattccgctgaagccatcgccctggagcagagcagacttgccagactcgacccacatccagagctactcccggaattgggttccctgccacccgtaaacacttag

SEQ ID NO: 222345 - DNA, 3531 bp, Artificial Sequence
  Description of Artificial Sequence: Synthetic coding sequence
atggccgcagccgctggcgcagcagcagccgcagccgcagagggcgaagctccagctgagatgggtgctcttctgcttgagaaagagacacgcggagctacagaacgcgttcacggttcgcttggagatactcccagatccgaggagaccctaccaaaggctacacccgacagcctggaacccgcaggacctagtagccctgccagcgtgactgtgacagtgggcgacgagggcgcagacactccagtgggcgctacccctctcatcggtgatgagagtgagaacttagagggtgacggcgacctgcggggaggccgtatcctgttaggccacgccaccaaaagttttccctcttcacctagtaaaggagggtcatgtcccagccgggctaaaatgagcatgaccggagccggaaaaagcccgccttcagtgcaatctttggcgatgcggctcctgagtatgcctggcgctcagggagccgctgctgcaggaagcgagccccctccagcgacgacttcaccagagggccagcccaaagtgcaccgcgctcggaagaccatgtcaaagcctgggaacggacagccaccggttcccgaaaaaaggcctcctgaaattcaacactttaggatgtcggacgatgtgcatagcctgggaaaagtgacctcagatctggctaagcgcagaaagctgaatagtgggggaggcttgtcagaggagctgggcagtgcgagaagatcaggcgaagtgactttgaccaaaggagacccaggttctcttgaggagtgggaaactgtagtgggcgacgactttagcctgtactacgactcctatagcgttgatgaaagagtcgattctgatagcaagtccgaagtagaggctctaaccgaacagctgagcgaggaggaggaagaagaggaggaagaagaagaggaagaagaagaggaagaggaggaagaagaagaggaagaagacgaggagtccggcaaccagtcagatcggtccggatccagcggtcgcaggaaggctaaaaagaaatggagaaaggattcaccctgggtgaagccctcgcgcaagaggcgaaagagggaacctccccgagccaaggagcctcgcggtgtttccaacgacacaagttcactcgaaacggagcgaggtttcgaagaactccccctgtgttcttgccgaatggaggctccgaagatcgaccggatttcagagagggctgggcacaaatgcatggccaccgagtccgttgatggcgagttgtctgggtgcaatgcagccatcctgaaacgcgagaccatgcgacccagctctcgggtggccctaatggtgttatgcgagacgcacagagcacgtatggttaagcatcattgctgtcctggctgcgggtacttttgcaccgccggaaccttcctcgaatgccacccagatttccgtgtcgctcacaggtttcataaggcctgcgtaagccagctgaacggcatggtgttctgcccccactgtggcgaagatgcaagcgaggctcaggaagtgaccatcccgcgaggtgacggggttacccctcctgccggtaccgctgccccagcccctccccctctgtctcaagatgtgcctggcagggccgatacctcacaaccttcagctagaatgcgcggacatggtgagcccagaagacctccctgtgatcccttggcggacacaatcgactcttccggaccctcacttactctgcctaacggaggctgcctgtctgccgtcggcttgccacttggcccagggagagaagccctggagaaggcgctcgtgatccaggaatctgagcgcagaaaaaagctgcgcttccatcccagacagctatacttgtcagtgaaacagggcgagcttcaaaaagtgatactaatgctgctggataacctcgatccaaactttcagtccgatcagcaatctaaaagaacccctctgcacgcagctgcccagaaagggtccgttgagatatgccatgtcctactgcaggcaggagcaaacatcaatgctgtggataaacagcagcggaccccactgatggaagctgtggtgaacaatcaccttgaagtagcgagatatatggtccaaaggggtgggtgcgtgtattctaaagaagaagacggctcaacgtgcttacatcatgccgctaaaattggaaacctggaaatggtgtccctcttgctttctacaggacaggtggatgtgaacgctcaggattccggcggatggactcctatcatatgggcggctgaacataaacacatcgaggttattaggatgctgctgacccggggagctgacgtaactttgactgataatgaggagaatatctgtctgcactgggcttctttcaccggaagcgccgctatcgcagaggtgttactcaatgcacggtgtgatcttcatgccgtgaattaccacggagatacgccactccacatcgcagctcgggaatcctatcatgactgcgtgctcttgtttctctcacgaggggctaatcctgagttaaggaataaagaaggcgacaccgcttgggacctgacccctgaaaggtctgatgtttggtttgccctccagttgaacagaaagctgcgtctgggggtggggaacagggccatccgcactgagaaaattatttgtcgcgacgttgctcgtggatatgagaacgttccaatcccatgtgtcaacggcgtggacggagagccgtgcccagaagattataaatatataagtgaaaactgcgaaacttctactatgaacatcgacaggaacataacccatctgcagcattgcacatgcgttgatgactgttcgtccagtaattgtctttgtggacagcttagcatcaggtgttggtacgacaaggacggtaggttgctacaagaatttaacaagatagagccgcctctcatttttgaatgtaatcaggcttgctcctgttggcggaactgcaagaatcgggtggtccagagcgggatcaaggttcgtctgcagctctatcggaccgctaaaatggggtggggcgtacgtgccctgcagacaatcccacagggcacctttatatgtgagtacgtcggcgagctaattagtgacgccgaggcagatgtccgggaagatgattcataccttttcgacctcgacaataaggacggcgaagtctactgcatcgatgctaggtactacggaaacattagcagattcattaaccacctttgtgatccaaacatcatccctgtgagggtctttatgttacaccaagatctccggtttcctcgcattgcctttttttcttccagagacatccgaactggggaagaactcggttttgactatggcgaccgcttttgggatattaaatcaaaatatttcacctgccagtgtggcagcgagaagtgtaagcacagtgcagaagccattgccctggagcaatctcgcctggctaggttggaccctcacccagaactcctgcccgagctgggatctctcccccctgtgaacacctag

SEQ ID NO: 222346 - DNA, 3633 bp, Artificial Sequence
  Description of Artificial Sequence: Synthetic coding sequence
atggccgcagccgctggagccgcagcagctgccgctgcagagggcgaggcccctgcagaaatgggagcactcctgttagaaaaggaaacccgcggagccaccgagagggtgcatgggagcttgggggatactcccagatccgaagagactctgcccaaggctaccccggactctttggaaccagcaggccctagcagccctgcttcagtgacagttactgtgggagacgaaggagcggatacgccagtaggcgcaaccccacttattggtgacgagtcagagaatcttgagggggacggcgatctcaggggcggtaggatcctcctgggtcacgcaacaaagtcttttccatcttctcccagcaaaggcggatcttgtccctcccgggctaagatgagcatgacaggagcaggtaagagcccacctagtgttcagtctctcgccatgaggctgctgtccatgccaggggctcagggagctgccgctgccggaagtgagccacctccggcaacaacgagccctgagggacagccaaaggtgcaccgcgcaagaaaaacaatgtctaagcctggaaacggtcagccccctgtaccagagaaaaggccaccggagatccagcactttcggatgtctgacgatgtacactccctggggaaagtgacttcagatctggcaaagcggcgaaaactcaactccggcggtgggctttccgaagaactcggaagcgccagaaggagcggcgaagtgactctcactaaaggcgaccctggctctcttgaggagtgggaaacagtggtaggggacgatttctccctgtactacgactcttactccgttgacgagcgagtggacagcgacagcaaatctgaagtggaggccctaaccgagcaactgtcggaggaggaagaggaggaagaagaagaggaggaagaagaagaggaagaggaggaggaggaggaagaagaagaggacgaggagtcaggaaaccagtccgacaggagcggaagctccggacgccgtaaggctaagaaaaagtggagaaaagatagcccctgggtcaagccttctcggaaacgcagaaaaagagaaccacccagagcaaaggaaccacgcggtgtcaatggtgtggggtcctcaggaccctctgagtatatggaggttcctctgggatcactggaactcccttctgagggaaccttatctccgaaccacgcgggagtgagcaacgacacgagcagtctggagaccgagagaggcttcgaggagcttcccttatgctcctgtaggatggaggccccaaagatcgatagaatctcagaaagagcagggcataaatgcatggccaccgaaagcgtggatggggagctctctggatgtaatgccgcaattttgaaaagggagaccatgaggccttcgagcagggtcgccctcatggtgctgtgcgaaacccatagggccaggatggtgaaacatcactgttgtccaggatgcggatacttctgcaccgccggaacatttctggagtgtcaccctgactttcgggttgcacaccggttccacaaggcgtgcgtctctcagctgaatggcatggtgttctgcccacattgtggagaggacgcctccgaagcccaggaagtgacaattcctcgcggtgacggggttacacccccagctgggaccgccgctccagcccctcccccactatcccaggacgtacccggtcgggcagacaccagccagccgtcagctcgcatgagaggacacggcgagccacgccgtccaccctgcgatccccttgccgacacgattgacagtagcgggccttccctgaccctccccaacggcggttgtttgagcgccgtgggacttcctcttggacctgggcgtgaggcactcgagaaggctttggtgatccaggaaagcgaacgtcggaagaagcttcgctttcaccccagacagctgtatctctccgttaagcagggcgagctccaaaaagtgatcctgatgcttcttgataatctcgatcctaacttccagagtgaccagcaatctaagaggacacccttacatgcagctgcccagaaaggcagcgtcgagatctgccacgttctactgcaggccggtgcgaacattaacgcagttgacaaacaacagcgtacccccctcatggaagctgtagtgaacaaccacctggaggtcgcacggtacatggtacagcggggtgggtgtgtatactccaaagaagaggatggatcaacgtgcctgcaccatgccgctaagattggtaacctggagatggtgtctctgctgctctccacgggccaggtggatgtgaacgcccaggatagcggcggttggactcccatcatatgggccgcagaacataagcatattgaagtgatcaggatgctcctcacccgcggtgctgacgttacacttactgacaacgaggaaaatatctgccttcattgggcgtcttttaccgggagcgctgcgattgcggaggtgctcttgaatgctaggtgtgacctccatgctgttaactaccatggcgatacacctctgcacatagccgcaagggaatcctaccacgattgtgttcttctgttcctgagcaggggggctaatcccgaactgcggaataaagagggggacactgcctgggatctgacccccgaacgaagcgacgtgtggttcgcactgcagctcaacagaaaactcaggcttggcgtgggcaacagagctatccgtactgagaaaatcatttgccgggacgtggcacgcggttacgagaacgtccccatcccgtgcgtcaacggtgtggacggagagccctgcccggaagactacaagtacatttccgaaaattgcgagaccagtacaatgaacatcgatcgaaacattacacacctgcagcactgtacatgtgtcgacgattgctcaagcagcaactgtctgtgcggccagctctctatcaggtgttggtacgacaaagatggtaggttgctgcaggaattcaataaaatcgaaccccctctgatctttgaatgcaatcaggcctgcagttgttggcggaactgcaaaaacagagtggtgcaatcaggaattaaggttaggctacagctctatcggaccgcaaaaatgggctggggcgtccgagccctgcaaaccatcccacagggaacttttatctgtgagtacgtgggcgaactgatctctgacgcagaagcagacgtccgcgaagatgacagctacctgtttgatctggataacaaggatggcgaagtgtattgcatcgatgccaggtattacggtaacattagtcggttcatcaaccatctgtgtgatccgaatattatcccagttcgagtcttcatgctgcaccaggatctacgcttccctcggatagcttttttctcctctcgcgacatcagaaccggagaggaacttggctttgactacggggatagattttgggatattaaatctaagtatttcacatgtcaatgtgggagcgagaagtgtaagcattctgctgaggcaatcgccctggagcaaagtcgactggctagattagatccccatcccgaactcctgcccgagctgggatccttacctcccgtaaatacgtag

SEQ ID NO: 222347 - DNA, 3531 bp, Artificial Sequence
  Description of Artificial Sequence: Synthetic coding sequence
atggcggctgccgcaggcgctgccgcagctgccgctgctgagggagaagcgcctgcggagatgggcgctctgctgctggagaaggagactcgcggagccacggagcgtgtacacggaagccttggggataccccacgcagcgaagaaactctgcccaaggcaacccccgacagtttggaacctgcaggaccttcttctccagctagcgtgactgttaccgtgggggacgagggagccgatacccccgtgggagctacacctctgatcggcgacgagagcgaaaatctggagggagacggcgatctgcggggaggccgaatattactcggccacgcgactaaaagtttcccctcaagtccgtccaaaggtgggagttgtccaagtcgcgctaagatgtctatgaccggggctggcaaatcacctccgtctgtccagtccctggcaatgcgcctgctgtcaatgcctggtgcccagggcgcagctgccgctgggtctgagcctcctccggcaactacaagcccagaggggcagccaaaggttcaccgcgcacgtaagacaatgagcaagcccggtaacggccagccaccggtccccgagaagcgacccccagaaatccagcactttcgcatgtccgacgacgttcacagcctcggaaaggtgacatccgacctggccaagcggcgtaaacttaactccggaggcggactaagcgaggagctggggagcgccagaagaagcggggaggttactctgactaagggagatccaggctcattggaagagtgggaaaccgtggtgggcgacgatttttcgctgtactacgattcctattctgttgatgagcgggttgattcagatagtaagtccgaagtagaggcactcacagaacagctctctgaggaggaggaggaggaggaagaggaggaagaggaggaagaagaggaagaagaagaggaggaagaggaagaagatgaggaatcggggaaccagtcagatcggtctggttctagcggccgtcggaaagccaagaagaagtggcgcaaagacagcccttgggtaaagccatctcggaagcggaggaaacgcgaacctccccgtgctaaagaaccgcgtggagtgtcgaacgacacgtcttcattggaaaccgagagagggtttgaagagttgcccctttgttcgtgtaggatggaggccccaaagatcgacaggataagtgagcgggctggacacaaatgtatggccactgagtctgtggatggtgagttgtctggatgcaacgctgcaattctgaaacgggaaaccatgcggccttcgagccgcgttgcgttaatggtcctgtgtgagactcatagagctcgcatggtcaagcaccactgttgtccaggctgcgggtacttttgtactgctgggacctttctcgagtgccaccctgattttagggtggcgcacaggttccacaaagcctgtgtctcccagcttaatggcatggttttctgtcctcactgcggggaggacgccagcgaggcacaggaggtaactattccaaggggagacggggtgacgccgccagctggcaccgccgctccagccccaccccctctctcacaggatgttccaggacgggcagatacatctcaaccctctgcgcgaatgcggggacacggcgagcctagaaggcctccttgcgatccactcgccgatacgattgacagctctggcccaagcttgaccctgccaaacggaggatgtctgtcagcggtcggcctgcccctcggtcctggcagagaggccctggaaaaggccctcgtgatccaggagtccgagcggagaaagaagcttagattccaccctagacaactgtatctgagcgtgaagcaaggcgagctgcagaaagtgatactgatgctgttggacaacctcgatccgaacttccagtccgaccagcagagtaaacgcacaccactccacgccgctgcacaaaaggggtccgtagaaatctgtcacgttttactacaagctggggcaaacatcaacgccgtggacaagcaacagaggacaccactgatggaagcagtggtaaacaatcaccttgaagttgccaggtacatggtgcagcgtgggggatgtgtttactcaaaggaggaagatggctcgacatgcctccatcatgcagccaaaatcggcaacctggagatggtcagtctactgctttctacggggcaggtcgatgtgaatgcccaggattccggtggctggacacctataatctgggccgctgagcataagcacatagaagtgattcggatgctgctgaccaggggggctgatgtgactctcaccgacaacgaagagaacatctgcctgcattgggcctcattcacgggctcagcagcaattgccgaggttctcctgaatgcacgctgtgacttgcatgcagtgaactaccacggggacacccccctgcacattgcagcccgagagtcatatcatgactgcgtgctgctgtttctgtcacgaggcgctaacccagaattgagaaacaaggaaggcgacaccgcctgggacctgactcccgaacgaagtgatgtgtggttcgcactccagctcaatagaaaactcaggctgggcgttggaaaccgagcgataagaaccgagaaaatcatatgtagggatgttgcgcgaggttacgaaaacgtgcctataccctgcgtgaacggcgtcgatggcgaaccgtgcccggaagattacaaatacatatccgaaaattgcgagacttctaccatgaatattgatcggaacataacccatcttcagcattgtacctgtgttgatgattgctcatccagcaattgcttgtgcgggcaactctcgatccgatgctggtatgacaaagatgggcgattgctgcaagaattcaataagatcgaacccccactcattttcgagtgtaaccaagcatgcagctgttggcgcaactgtaagaacagggttgtgcagtccgggattaaggtgcgactgcagctgtaccgcaccgccaagatgggctggggggtcagagcactacagactataccccagggaacattcatatgtgaatacgtgggggagttgatctctgacgcagaggcagacgtgagagaggacgattcatatcttttcgatttagataataaggacggggaagtgtactgtatcgacgctcgatactatggaaacatcagtcgctttattaaccatctgtgcgatcctaacattattccggtgcgtgtcttcatgctgcatcaagacctgcgttttccgaggatcgcgtttttctccagtcgagatatcagaacgggtgaagagctcggctttgactatggggaccggttctgggacatcaagtccaaatactttacatgtcaatgcgggtccgagaagtgtaaacacagcgcggaggctatcgctttagaacagagtcggttagccaggctcgacccccacccagaactgctgcccgagctggggtccctcccaccagtcaacacctag

SEQ ID NO: 222348 - DNA, 3633 bp, Artificial Sequence
  Description of Artificial Sequence: Synthetic coding sequence
atggctgccgctgccggtgctgcagccgcagccgcagctgaaggagaggctccagccgagatgggagcgctgctactggagaaggaaactaggggagcgactgagcgagttcacggctccctaggagacaccccacggagcgaggagaccttgcccaaagcaacacccgactcactggagcctgctggaccctcttccccagcctccgtgactgtgacagtaggagatgaaggcgctgatactcccgtgggcgcaacaccgttgattggtgatgagtccgagaatctggaaggcgacggagatctgaggggcggacgcatcttactcggtcacgccacaaaaagctttcctagcagtcccagcaaaggcggttcctgtcccagtcgggctaagatgtctatgaccggagcaggtaagagtccaccctccgtacagagcttggccatgaggctgctgtctatgcctggggcacagggcgctgccgctgccggaagtgagccaccgcctgccacaacaagcccagaggggcaacctaaagtgcatagggcaagaaaaaccatgtctaaacccggaaatggccagccacccgtgccggagaaaaggcctcctgagatccagcactttagaatgtcagacgacgtccatagcctggggaaggtgacgagcgatctagcaaagaggaggaaactgaattccggaggtggactcagtgaagagctgggatctgcacgaagaagcggcgaggttacgctgaccaaaggagaccctggctcacttgaggagtgggagacagtggtcggagacgatttcagtctatattatgacagttactcagtggacgaacgcgtggatagcgattcaaaatctgaagtagaggccctcaccgagcagctttccgaagaggaggaggaagaagaggaagaagaagaagaagaggaagaggaggaggaggaagaagaagaggaggaggatgaagaatcagggaatcaatctgaccgaagcggaagcagcggacggaggaaagcgaagaagaaatggcgtaaagattctccctgggtgaaaccttctcgcaagcggaggaagagagagcctcccagggcaaaggagccgaggggagtcaacggcgttgggtcatccgggcctagcgagtatatggaggtccccctcggctccttggagttgcccagcgagggtacactgtctcccaaccacgctggcgtttctaatgatacctcatcactggaaaccgaaagaggttttgaggagctgccactgtgctcttgccggatggaggcccctaaaattgatcgtatcagcgaaagggcaggacacaaatgcatggccacggaaagcgttgacggcgagctttcaggctgtaatgctgccatccttaaacgggaaacaatgcgacctagctcgagggtggcactgatggtattatgcgagacccatcgtgctaggatggttaagcatcattgttgccccggatgcgggtacttctgtaccgctgggacctttttagaatgtcaccccgattttagggtagcccacagattccataaggcatgcgtgtcgcaactgaatgggatggtgttttgtccccactgcggtgaggacgcctcagaagcccaggaggtgacaattccacgcggagatggcgtgacgcctccagctggaacggccgcacctgctccccctccattgtctcaggacgttccagggagagctgacacctcgcagccatccgctcgtatgcggggtcatggcgagcccagaagaccgccatgtgatcctttggcagacacaatcgactcgtctggacctagtctcactctgccgaatggaggctgcctatccgctgtggggctccctctggggccaggacgtgaagcccttgagaaggccctggtgatccaagagtcagagcgacgaaagaaactccgattccacccaagacagctttacctgtcagtgaaacagggcgagctgcaaaaagtgatcctgatgctgctggataacctagatcctaattttcagagcgaccagcagtccaagagaacgccactccacgccgctgctcaaaaggggagcgttgagatttgccacgtgcttctgcaggctggggcaaacatcaacgccgtcgataaacagcagagaacaccgctgatggaagctgtcgtgaataatcacctggaggtcgcacgatatatggtgcaaaggggaggatgcgtgtattcgaaagaggaagatggatcaacttgccttcatcatgcagctaagattgggaacttggagatggtcagcttactattatctacaggccaggtggacgtcaatgcgcaggacagtggcggatggacacctatcatctgggcagccgagcacaagcacatagaggtaatcaggatgctactgactcggggagcagacgtcactttgaccgacaatgaggaaaatatctgcttgcattgggcttctttcacggggtccgctgcaatagccgaagtcctcttgaacgcccgttgtgacttacacgccgttaattaccacggcgacaccccgctgcacattgctgccagagagagttatcatgactgtgtgttgttatttctcagccgaggcgcaaatcctgaactacgcaacaaggagggagacaccgcatgggacttgacaccggagcggtccgacgtgtggttcgcactgcaactaaataggaaacttaggctgggggtgggaaatagagcaataaggacagagaaaattatctgtcgggacgtggcgaggggttatgagaatgtaccaatcccctgtgtcaacggcgttgacggtgaaccttgcccggaggactacaagtacataagtgaaaattgtgagacatcaacgatgaatattgaccgtaacatcactcacctgcagcactgcacctgtgtagacgactgctctagctctaactgtctatgtggacagcttagtatcagatgttggtatgataaggacggcaggctccttcaggagtttaataaaatcgaaccaccactgatcttcgaatgcaatcaggcatgcagttgttggagaaactgcaagaaccgggtcgttcagtcagggattaaggtgaggcttcaactgtacaggaccgcaaagatgggatggggtgtccgagcactgcagactattccccagggcacctttatttgtgagtacgtgggtgaactgatctccgacgcagaagcagacgtgcgcgaagacgactcctacctgtttgatctggataacaaggacggcgaagtgtattgtatcgacgcacggtactacggcaacatctcacgcttcatcaaccacctgtgcgaccctaacattattccagtccgagtgtttatgcttcatcaagacctcagattccctaggattgccttcttctcatcgagagatatacgcaccggagaggagctaggattcgactatggagatcgattttgggatatcaaaagtaagtacttcacctgccagtgcggctccgaaaaatgtaagcacagcgccgaggccattgccttagagcagtccaggctcgcccgactggacccccatcccgagttactgccagaactcggcagtctccctcctgtgaatacatag

SEQ ID NO: 222349 - DNA, 3804 bp, Artificial Sequence
  Description of Artificial Sequence: Synthetic coding sequence
atgcggggattgccgcgtggcagaggattgatgcgcgctcgagggcgaggccgagccgctccgccagggagccggggtaggggccgtgggggaccccatcgaggccgtgggcgaccaagatctctgttgagtctcccaagagcacaggctagctggactcctcagctcagcacaggactaacatctccccctgtgccatgcctgcccagccagggcgaggctcccgcagagatgggcgctctcctgctggagaaggaaacgcggggagccactgaaagagtgcatgggagcctgggggatacccccagatccgaagaaacattacccaaggccaccccagatagcctcgagccagccggaccctcttcacccgcttctgtaacagtcacagtgggtgacgaaggagctgacacacctgtgggcgcaactccccttatcggcgacgagtccgaaaacttggaaggggatggcgatctgcggggtggaagaatccttctgggtcacgcaaccaaaagttttccatccagcccctccaagggtggctcttgtccttctagggccaagatgtcaatgacaggtgcagggaagtccccaccaagcgtacagagcttagctatgcgcctgctctctatgcctggggctcagggggctgccgctgcaggaagcgaaccccctcctgccactacgtcacccgaaggacagccaaaagtgcatagagccagaaaaaccatgtcaaagccaggcaacgggcaacccccagtccctgagaagcggccaccagaaattcagcattttcggatgagtgacgacgtccattccctgggaaaagtgacaagtgacttagctaagcgacgtaagctgaactccggcggagggttatcagaggaactgggctctgcccgacggtcaggggaagtgacactgaccaaaggtgatcccggaagtctggaggagtgggagacggttgtcggtgatgacttttccctgtattatgattcttacagcgtggacgaaagagtggattcagattctaaatcagaggtagaagccctaaccgaacagctttccgaagaggaggaagaggaggaagaagaggaagaagaagaagaggaggaggaggaggaagaggaggaggaagaagatgaagagtcaggcaatcaatcggatcggtcggggagctccggcagacgtaaagcaaagaaaaagtggcggaaagattctccgtgggtgaaaccttcacgaaagcggcgtaagagagagccgcctcgggcaaaggaaccacggggagtcaatggagtcggatcctccggtcccagcgagtatatggaagtgcctctcgggtcactagagctgcccagtgaagggaccctgagtccaaatcatgcgggagtgtctaatgatacatcttccctcgaaactgagcgagggttcgaagaacttccactttgtagctgtagaatggaggcccctaagatcgaccggattagtgaaagggctgggcacaaatgcatggccaccgagtctgttgacggtgagctctcggggtgcaacgcagcaatacttaagagggagaccatgaggccgtctagcagagtagcgctcatggtactctgtgaaacacaccgcgcacgcatggtgaaacaccattgctgtccaggctgtggctatttctgcaccgcaggaaccttcttagaatgccatccagacttcagggtggcgcaccgatttcacaaggcctgcgtgagccagctgaatggcatggtgttctgtccccattgcggggaggatgctagtgaagcccaggaggtaaccatccctaggggggacggtgttacacccccagccggaacagccgctcctgcacccccacctctgtcacaggacgttcctgggagagctgatacttcccagccaagtgcgaggatgcgcggacacggcgagccccgacggcctccatgtgaccccctggctgacactatcgattcctccggccctagtctcaccctgccaaacggcggttgtctctcggccgtgggcctccctttagggcctggcagggaggcattagagaaggcacttgtgatccaggagtctgagcgtcggaaaaagctcaggtttcatcctcgccagttatacctgtctgtgaagcagggcgaactgcagaaggttattctcatgctcctcgacaaccttgaccccaactttcaatctgaccagcaatcgaaaaggacgcctttacatgccgcagcgcagaaaggttccgtggaaatctgtcacgtgttattgcaagccggtgctaacatcaatgctgtggacaaacagcagcgcactccacttatggaagctgtggtcaacaatcacttggaagtggctaggtacatggtacagaggggaggctgtgtgtattccaaggaggaggacggtagtacttgcctgcaccacgcagctaaaatcggtaacctggaaatggtgtcactgctgctctctacgggacaggtggacgttaacgctcaggattccggtggctggacccctattatatgggccgctgaacacaagcatattgaggtgatcaggatgttactcacgcgcggagccgacgtgaccctcacagacaatgaagagaacatctgcctgcactgggcttcgttcacagggtcggctgctatcgctgaggtgctgctgaacgcccgttgtgacctgcacgctgttaactaccacggcgacacccctcttcatatagcggcacgggaaagctaccatgactgcgttttgttattccttagccggggtgctaatccagagcttcgcaataaggaaggtgatacagcttgggacctgacacctgagcgcagcgatgtctggtttgctctccagctcaaccggaaactgcgcctgggcgtgggtaatcgtgcaattcgaaccgagaaaattatttgccgcgatgtggcaagaggatatgagaacgtacccataccttgcgtgaatggagtggacggtgaaccatgccccgaagattataagtatatctcagagaactgtgagacttcaactatgaacatcgacagaaacatcacccacttgcagcactgcacatgcgttgacgactgctcctcctcaaattgtttatgtgggcagctctcaatccgatgttggtatgataaggacggcagactgctgcaagagtttaacaaaattgagccacctctgatcttcgagtgcaaccaagcttgtagctgttggagaaactgtaaaaatagagtcgtgcagagcggcatcaaggtgagactccaactgtaccggacggctaaaatggggtggggagtgagggccctgcagacaattccacagggcacattcatttgtgagtacgtgggtgagcttatctccgacgctgaggcagatgtgcgcgaagacgattcgtatctatttgatctggacaacaaggacggagaggtctactgtatagatgcgcgatattacggtaatatttctcgctttattaaccatttatgtgatcctaacattattcctgtgcgcgtgttcatgcttcatcaggacctgcgcttccccagaattgcatttttttctagccgggacatccgaacaggcgaggagctgggctttgactacggagaccggttctgggatatcaaatctaaatactttacatgtcaatgcggaagcgaaaagtgcaaacattcagcagaagcaatagcccttgaacagtctcgactggctcgactggacccacaccctgagctgctgcctgaattggggtctctgccccctgtcaatacctag

SEQ ID NO: 222350 - DNA, 3804 bp, Artificial Sequence
  Description of Artificial Sequence: Synthetic coding sequence
atgagggggctccctcggggacggggactcatgagggccagggggcgtgggcgtgccgcacccccaggcagtcgcggtagaggcaggggagggccacaccggggaagaggacgcccacgcagcttgttgtccctgcctcgcgcacaggcttcctggaccccccagctgagcacagggttgactagtccccctgtgccttgtctgcccagtcaaggcgaggcgcctgcggaaatgggcgcactcttattagagaaagagacgaggggggctactgaacgtgtgcatggctctcttggggataccccacgaagcgaagaaacactgcccaaggccaccccggattccctcgagccagctggcccttcttccccggcttctgtgactgtgaccgtaggcgatgaaggcgcagatacacctgtaggggcaacaccccttattggcgacgaaagcgagaatctggaaggtgacggcgacctacgcggaggacgaatcctgttaggccacgcgactaagagcttcccttcctctccttccaagggcggatcctgcccctctagagcgaaaatgagcatgaccggggctggcaagagtcccccatctgtgcagtccctggctatgaggctcctctccatgcctggagctcaaggcgctgccgctgcagggtccgagcctccccctgccaccacttcgccagaagggcagccaaaggttcacagggcccgaaaaacaatgtctaaaccgggaaatgggcagccccctgtgcccgaaaagcgccctcccgaaattcagcattttagaatgtccgacgacgtacactctttgggaaaagttacttccgacttggccaagagacgcaagctgaattccggcggagggctgtccgaggagctaggatccgcacgccgatctggtgaggtaacgctgaccaagggagaccctggatccctcgaagagtgggaaaccgtggtgggagacgatttctcactctactatgatagctactcagtcgatgaacgggtcgactccgattcaaaaagcgaagtggaggccctgaccgagcagctgtccgaggaggaagaggaagaggaggaagaggaggaagaagaggaggaggaagaagaggaggaggaagaagaagaggatgaggagtccggaaatcagagtgaccgaagcggctcctcaggcagaagaaaggctaagaagaagtggcggaaggattccccttgggtcaagccatcccggaagcgaaggaagagagagccccctagggccaaggaacccaggggcgtcaatggcgtggggtcaagtggtccttccgaatatatggaggtgcctttgggctctcttgagctgccgagtgagggcaccctgagtcccaatcacgcgggtgtttctaacgatacgtccagcttggaaacagagcgcggattcgaggaattgcccctctgttcttgtcgaatggaagccccaaagattgataggatttctgagcgggctggccataaatgcatggcaaccgagtcagtagatggagagctgagtggatgtaacgcggctattctcaaaagggagaccatgaggccctctagcagagtcgccctgatggttctgtgtgaaactcacagggcgaggatggtgaagcaccattgctgtcctggatgtgggtacttttgcaccgcaggaacctttctagagtgtcacccagacttcagagtggctcaccgttttcataaagcatgcgtttctcagctgaatggtatggtgttttgtccacactgtggcgaggacgcaagcgaggcccaggaggtcactattccccgaggcgatggtgtaacccctcccgcaggaactgctgccccagctccacctccattgagtcaggacgtgcctggcagagcagatacttcacaaccctccgctaggatgagaggtcacggtgaaccgagaaggcctccctgcgaccctctggcagataccattgacagctccgggcctagtctgacactgccaaacggaggctgcttgtctgcggtgggacttcccctggggcctggccgtgaagcgttggagaaagcgttggtgatccaggagagtgagcgccgaaagaagcttcggttccaccctaggcagctctaccttagtgttaagcagggggagttgcaaaaagtcattttaatgcttttagataatcttgatccgaatttccagagtgatcaacagagtaaacgcactcccctacacgcggctgcccagaaggggtcggtggaaatctgccacgtcctcctccaagccggagcaaacattaacgccgttgataaacagcaacgcacccccctgatggaagcagtggttaataatcacttggaggtcgccaggtacatggtccagcgtggcggatgtgtgtactcgaaagaggaggatggcagcacatgcctccaccacgctgctaagataggtaaccttgagatggtgtcacttttgctgtctactggccaggtcgacgtgaacgcacaggactccggcggatggacccccattatctgggcggctgagcacaaacatatcgaagttatccggatgctactgaccaggggagcagatgtaacactcaccgacaacgaggaaaacatctgtctacattgggcttcatttacgggatctgccgcaattgcggaagtgctcttaaacgcgagatgtgacctgcacgctgtgaactatcacggcgacaccccgctgcatattgccgctcgcgagagctaccacgactgcgtgttattgtttttgtccagaggagctaaccccgaactgcgcaacaaggaaggggataccgcctgggatctgacccccgagcgcagtgatgtctggttcgctctgcaactaaatcgtaagttgcggctgggggtcggaaacagggccattcgcactgaaaaaattatatgccgcgatgtggcaagaggttacgagaatgtaccaataccatgcgtcaatggcgtggatggggagccttgcccagaagactacaagtacatcagcgaaaattgcgagaccagtaccatgaatattgaccgaaatatcactcatctgcagcactgcacctgtgtggatgactgttcctctagtaactgcctttgcggccagctgtccatccgctgttggtatgataaggacggtaggttgcttcaggagtttaacaagatcgaacctcctttgatctttgagtgtaaccaggcatgcagctgctggaggaactgcaagaatagagtggtccagtcaggaattaaggttcgtttgcagctctacagaactgcgaaaatggggtggggcgtcagagcattacagactatcccccaaggaactttcatttgcgagtacgtcggtgaactgatttctgatgcagaagctgatgtgagggaggacgactcctatcttttcgacctggataataaggatggcgaggtgtattgcatcgatgccaggtattacggaaatataagtagatttattaatcatttgtgcgatcccaatattatccctgtccgggtctttatgctgcaccaggatctgcgtttcccacggattgcatttttcagttctcgggatatcaggaccggagaggagctggggtttgattatggggaccgattctgggatattaagtctaagtacttcacatgccagtgtggtagtgagaagtgcaagcattcggcagaggcgatcgccctcgagcaatcgcgactcgctcgtctagatccccatcctgagttattgcccgagttgggaagcctgcctccagtgaacacttag

SEQ ID NO: 222351 - DNA, 3702 bp, Artificial Sequence
  Description of Artificial Sequence: Synthetic coding sequence
atgagagggcttcccaggggacgtggcctgatgagggctcgcggaagggggagggccgctccgcctggaagccggggaagaggacgcggaggtccgcatcgcggaaggggcagaccacgatccctcctatctttgcctcgcgctcaggcttcttggacgccccagctgtctaccggcctgacgagtccgccagtgccgtgcctgccctctcagggagaagcccctgctgagatgggagccctgctcctggaaaaggagacgaggggagcaacggaacgggtccatggctctctcggcgatacaccaaggagcgaagaaacattaccaaaagctacacctgactctctcgaaccagctgggcctagctcgccagccagcgtcaccgtaacagttggagacgaaggggcagatacgcctgtgggagcgacacctctaattggggacgaatctgagaacctcgagggtgatggggatctcagagggggaagaatattactaggacatgccaccaagagtttccccagctctcccagcaaggggggatcctgccctagccgcgcaaaaatgagtatgactggtgcaggaaaatcaccaccatccgtccagtctttagcaatgcgacttcttagcatgcctggtgcccaaggcgctgctgccgctgggtccgagcctcctccggcaacgacctcccctgaaggacagcctaaggtgcacagagctcgcaagaccatgtccaaaccaggtaatggtcaacctcctgttccagaaaagaggccaccagaaatacaacacttcagaatgagtgatgacgtccactcattagggaaagtcacttcagatctcgcaaaacggaggaagctgaactccggcggaggactcagcgaagagctgggaagcgcccgtagatccggggaggtgacactcaccaagggggatcccggaagcttagaggaatgggaaactgttgttggtgatgatttcagtctttattatgactcttatagcgtcgatgagagggtggactccgacagcaagtcagaagtcgaggctctaacagagcagctctccgaggaggaggaggaggaggaggaagaggaggaagaagaagaagaggaggaggaggaggaagaggaagaggaagacgaggagagcggcaaccagtctgacagatctggctcctccggccgaaggaaggctaagaaaaagtggcgaaaagactccccctgggttaagcccagccgaaagcgtaggaagagggagcccccacgcgcaaaagagccacggggtgtttccaacgatacttcttcactggagacggaacgtgggttcgaagagctccctttgtgctcctgtcgcatggaggccccaaagattgaccgtatctccgaacgggcaggccataaatgtatggccactgaaagtgtcgatggagagctctcagggtgtaacgccgcaatccttaaaagggagactatgcggcctagttctagagtcgctctcatggttctatgtgagacgcaccgtgccaggatggtcaagcaccattgctgccctgggtgcggatacttctgtacagcgggaaccttccttgagtgccaccccgacttccgtgtcgcacataggtttcacaaggcatgcgtcagccagctcaacggaatggtgttctgtccacattgcggcgaggatgcctccgaggcacaggaagtgactatcccgaggggcgacggagtgactccccctgctgggactgccgctcccgctccacctcccctgtctcaggacgttccaggcagggctgacacatctcagccatctgctcgcatgcgcggtcacggagagcccaggcggccaccgtgcgatccattggcggataccatcgactcctctggacccagtctgactctgccaaatggcggttgtctttccgcagttggacttcctctgggcccaggtagggaagcgctggagaaggccctcgtgattcaggaatctgaacggaggaaaaagctcaggttccacccacgtcaactgtacttgagtgttaaacagggcgaactacagaaggtgatcttgatgctgctggacaatctggaccccaatttccagtccgaccaacagtcaaagagaacgccgcttcacgctgccgctcagaagggctccgtcgagatttgtcacgtattactgcaggccggagccaatattaatgccgtggacaagcaacaacggacccccctcatggaggcagtggttaacaaccacctggaggtcgccagatatatggtgcagaggggcggatgtgtgtactccaaggaagaggacggatctacgtgtttgcaccatgcagctaagattgggaatctggaaatggtcagcctgttgctgagtaccggacaggttgatgtgaatgcccaggattcgggagggtggacgccgattatctgggcggcagagcataagcacattgaggtcatacggatgctgctgacccgaggtgccgacgtaacgctgactgacaatgaggaaaatatttgcctgcactgggcctcattcactgggagtgcagcgatcgcagaggttctgctcaacgcaagatgcgatcttcatgccgtgaactatcacggggacactccccttcacattgctgcaagagagtcctatcatgactgcgtcctgctcttcctctcgcgaggcgctaatcctgagttgaggaacaaggagggggatacagcttgggatcttacacccgaacgatcagacgtgtggtttgcactgcaattgaatagaaaacttcgcctgggggtagggaaccgggctatcaggactgagaaaattatttgtagagacgtcgcacgtggctacgagaatgtgcctattccatgtgtgaatggtgtggacggggaaccttgcccggaggattacaaatacatctccgagaattgcgagaccagcactatgaatattgataggaatatcacacatttgcagcattgtacttgcgtggatgactgcagctcatccaactgtctgtgcggacagctgtcaatccgatgctggtacgacaaggacgggaggttgctgcaagagttcaataaaatcgaaccaccactgatctttgaatgcaatcaggcttgctcgtgttggaggaactgcaagaaccgcgttgttcagagcggcattaaggtccgtttgcagctttaccgtactgcgaagatggggtggggggttcgcgcactgcagactatcccacagggaacattcatctgtgagtatgtaggtgagcttatctccgacgcagaggcggacgttagggaagatgactcatacctgtttgacctggacaacaaggacggcgaggtttactgtatcgatgcaaggtactacgggaatatcagcagattcatcaaccatctgtgtgaccctaatatcatcccggtgcgggttttcatgctgcatcaagatcttcgcttccccaggatcgccttcttctcttctcgagacatacgtacaggagaggagttgggattcgattatggggatcgtttctgggacatcaaatctaaatactttacttgccagtgcggctccgaaaagtgcaagcatagcgctgaagccatcgctctagagcagagccgcctcgctcgcctcgatcctcacccagaattgcttccagagttaggatcactgccccctgtcaacacctag

SEQ ID NO: 222352 - DNA, 3804 bp, Artificial Sequence
  Description of Artificial Sequence: Synthetic coding sequence
atgaggggactgcccaggggccgtggcctgatgcgggctcggggtcggggacgtgcagccccacccggatctaggggtagaggaaggggcggtccacacaggggcaggggcagaccccgtagcttgctgtcactaccaagagctcaagctagctggacccctcagctgtccaccgggctcacatccccacccgtgccttgcctgccttcgcagggcgaggcccctgcagagatgggcgcattactcctcgagaaggaaacccggggagccactgagagggttcatggttcattgggagatacccccagatccgaagagactttgcctaaggctaatccagattccctggaacccgcaggcccatcatcccccgcttccgtcacagtcaccgtgggagatgagggcgctgacacccccgttggggctactcctttaattggcgacgagtcagagaatctggaaggagatggagatctgcgaggcggaagaattctgctcggacatgcgaccaaatcttttccatcctctcccagcaagggcggtagctgccctagtcgcgctaaaatgtcaatgacaggcgcaggtaagtccccacccagcgttcagtctctggctatgcgcctgctctctatgcctggagctcaaggcgctgcggctgcaggctccgaaccgcctccagctaccacaagcccagaaggtcagcctaaggtgcatagagcgcgaaaaacaatgtctaagcccggtaatggccagcccccagtgcccgagaaaaggccccctgaaatccaacacttcagaatgagcgatgacgtacactccctggggaaggtcacctccgatttggccaaaagaaggaagctgaattccgggggtggtctgtcagaagagctgggatccgctcggcgatcaggggaggtgactttgactaaaggggaccctgggtccctggaagaatgggaaacagtagttggggacgatttcagcttgtattatgattcctactctgtcgacgaaagagtcgatagtgatagtaaatcagaagtcgaggctctgaccgaacagctatctgaagaagaggaggaggaggaagaggaagaagaggaagaagaggaagaggaagaagaagaggaggaagaggaggacgaggagtccgggaaccagtctgaccgaagcgggtcctccggtaggcgaaaggcaaaaaagaagtggaggaaggactccccttgggttaaaccctcacgaaagcgtagaaagcgcgaaccgccaagggcgaaggaaccacggggagttaacggcgtgggttcttctggccctagtgagtacatggaggttcccctggggtcgcttgagctgcctagcgagggcacactctcgcctaaccacgccggtgtgtccaatgacacatcctccctcgaaaccgaaagagggttcgaggagctacccctgtgctcctgccgtatggaggctccaaagatagataggatctcagaacgggctggccacaagtgcatggcaaccgaatccgtggacggcgaactgtccggttgtaatgcagcaatcttgaagagagaaaccatgagacccagttccagggtggctttgatggtgttgtgcgagacacaccgcgcacgcatggttaagcaccactgttgccccggatgcggttatttctgcaccgccggaacttttttggagtgtcaccctgattttagagtggcccatcgttttcataaagcatgcgtgtctcagctgaacgggatggtcttctgcccacattgtggcgaggacgcttccgaagctcaagaggtgaccatcccaagaggagatggggtgactccaccagctggcactgcggcacccgcaccaccgcctctgagccaggacgtgcccggaagggcagataccagtcagccaagcgccagaatgcgcggtcatggggagccgagacggcctccatgcgatccgctcgccgacactatcgactcctcaggtccctctctcaccctccccaacggcggatgcttgagtgccgtcgggttacccttgggtccaggacgcgaagccttagaaaaggcactagttatccaggagtctgagcggagaaagaagctgcgcttccacccacgccaactttacctgagtgtgaagcagggcgagcttcagaaggtcatcctaatgctactggataacctggaccccaatttccagagcgaccagcagtcaaaacgcaccccgttgcacgcagcggcacagaaagggtccgtcgaaatttgtcacgtactgttgcaagctggagccaatattaacgcagtggacaagcagcagcggacccccctcatggaggctgtcgtgaacaaccatttagaagttgcccgatatatggtgcagagaggcggatgtgtgtacagcaaagaggaagatggcagtacttgcctccatcacgccgctaagatcggcaacctggagatggtgtccttgttgctctctacaggtcaagtggacgtcaacgcgcaagactccgggggatggactccaataatttgggctgctgaacataagcacattgaggttattaggatgctgctgaccagaggagccgacgttactttaaccgataacgaggaaaacatttgtctgcactgggcatccttcacaggtagtgccgctatcgctgaggttctgcttaacgcacgatgtgacctgcacgccgtcaactaccacggggatacacctcttcatatcgccgctagagagtcctatcatgattgtgtgctgctctttctttcccggggagctaaccccgaactgcgtaacaaggagggcgacaccgcctgggatctgacgcccgaaaggagcgatgtgtggtttgctctccaactgaatagaaagctcagactgggtgtggggaacagggccattagaactgagaaaatcatctgcagggatgtggccaggggctatgagaacgttccaattccctgcgtcaatggagttgatggggaaccatgccctgaggactacaagtatattagcgaaaactgtgaaactagcactatgaatatcgaccgcaacatcacgcacctgcagcactgcacttgtgtcgatgactgtagctcctcaaattgcctctgcggccagctctcaattcggtgctggtacgacaaggatggtcgcctattgcaggagttcaacaagatcgagcctcctctcatttttgaatgtaaccaagcctgctcctgctggcggaattgcaaaaacagggttgtccaatcagggatcaaggtgcgcctccagctgtatcgcaccgcaaagatgggctggggtgtcagagccctgcagaccattccccagggcacgtttatttgtgagtatgtcggagaactcatcagtgacgccgaggctgacgtccgggaagacgactcttacctgttcgacttggataacaaagacggtgaggtgtattgtatcgacgcacgctattacggaaatatatcaaggttcattaaccacttgtgcgatccaaatatcattcctgtcagggtgttcatgttgcatcaggacttgcgcttccccagaatagctttttttagctcacgagatatacggacaggagaagagctggggttcgattacggagaccgcttttgggatatcaaatccaaatatttcacgtgccaatgtggttctgaaaagtgtaaacactctgctgaggctattgccttagagcagtctaggctagcgcgtttggatccacaccccgagctactgccagagttagggtctttgccacctgtgaatacttag

SEQ ID NO: 222353 - DNA, 897 bp, Artificial Sequence
  Description of Artificial Sequence: Synthetic coding sequence
tagtcaaagcgtacccccctgcatgcagcggctcagaaaggctctgttgagatctgtcatgttctgctccaagccggagcgaatatcaatgcggtggataagcagcagcggactcctctgatggaagcagtggtgaacaaccacctggaggtggctaggtacatggttcaaaggggcggatgcgtgtatagtaaggaggaagacggttccacctgccttcaccacgctgctaagataggaaatctggagatggtgagcttgttactgtccacagggcaggtagacgttaacgcccagggtcaactgcctcccccaagcctgcctagccatcctcaagattcaggaggctggacaccgatcatttgggcagctgaacacaaacacattgaagtgatacgcatgctcctgacgaggggcgcagacgttaccctgaccgacaacgaggaaaatatctgcctccattgggcgagcttcaccggctctgccgcaatcgcagaggtgttgctcaatgccagatgcgacctgcatgctgtaaattatcatggggatactcctctgcatatcgccgcaagagagagttatcacgactgcgttctgctttttctttctcgcggtgccaacccagagctaagaaataaggaaggtgatacggcgtgggatttaacacccgaacgtagcgatgtatggtttgccttacagctcaacagaaagctgagacttggagtagggaatagggccattcgcacagaaaaaattatatgccgcgacgtagccaggggctatgaaaacgttcccatcccttgtgtgaacggcgttgacggggagccatgccccgaggactacaagtacatctccgagaattgcgaaacaagcactatgaatattgatcgcaattag

SEQ ID NO: 222354 - DNA, 3633 bp, Artificial Sequence
  Description of Artificial Sequence: Synthetic coding sequence
atggccgcagcggctggagcagcagctgccgcagcagccgagggcgaagcacccgcagaaatgggagccctgctgttagagaaggagacccgcggagctacagaacgcgtccatggttcccttggagatacaccaagatctgaggaaacattaccaaaagccaatcccgatagtctggaaccagctgggccttccagtcctgcgagcgtcacggtcacagtcggtgatgagggggctgatacaccggtcggcgctacccctcttatcggagatgaatccgaaaacctagaaggtgacggcgaccttcgcggagggaggatactcttaggccacgccaccaagtcgttcccaagtagcccgtctaagggcggtagctgccctagtagggctaagatgtcaatgactggagctggtaagagtccaccctccgttcaatctctggcaatgcgcttgctgtctatgcccggagcacagggcgcagctgccgcagggtccgagccgccacctgcaacaaccagccctgagggccagcctaaggtgcacagggcccgtaaaactatgtctaaaccaggcaatggtcagcctcctgttccagagaaacgtcctcccgaaatccagcactttcgaatgtcagacgacgtgcattccctggggaaggttacgtcggatctggctaaacgaagaaagctcaactcaggcggagggttgtccgaggagttagggtcagccaggcgctctggcgaggtgacattaaccaagggcgaccccggatccctagaggaatgggaaacagtagtcggggatgacttttctctatattacgattcttatagcgtcgatgagagggtcgactcagacagtaagagtgaggtggaggccttgacggagcagctgtccgaagaggaagaggaagaagaggaagaagaagaagaagaagaagaggaggaggaagaggaggaggaagaagaagacgaggaaagcggcaaccagagtgaccgcagtgggtcaagcgggagaaggaaggctaagaagaagtggcgtaaagactccccatgggtgaaacccagtcgtaagagacggaagagggagcctcccagggctaaggagccgcgaggcgtgaacggcgtgggaagctctggcccttcagaatatatggaagtgcccctcggcagcctcgagctgcccagtgaaggcaccctgtctccaaaccatgcaggtgtctccaatgacacttccagcttggagactgagcgcggttttgaggaactgccactgtgttcctgcagaatggaggctccaaagattgatcggatttcagagagggccggacacaagtgtatggccacagagagcgttgacggcgagctcagtggctgtaacgctgctatattaaagcgggaaacaatgaggccttccagcagagtcgcgctcatggtcttgtgcgagacacatcgggcacggatggtgaagcaccactgttgtcctgggtgtggctacttttgtacggctggcacttttctggaatgtcacccagactttagagtcgcccatcgattccacaaagcctgtgtgtcccagctaaatggcatggtgttctgccctcactgtggagaagatgctagtgaggctcaggaggtcacaatcccaaggggtgatggcgtgacacccccagccggtacagccgctccagccccaccccctctgagtcaagatgtccccggaagggctgataccagccagccttctgctcggatgcgaggtcacggcgaacccagacgtcctccttgtgacccgctggctgataccatcgattcaagcgggccatctctgacgctgcccaatggcggttgcctgagtgccgtgggtctgcctttaggcccaggaagagaagccttggagaaagcgctagtaattcaggagagtgagagaaggaaaaaacttaggtttcacccgagacaattatatctgagcgtaaagcagggggagctgcagaaggtcattctgatgcttctggataacctcgacccgaattttcagtctgaccagcagtccaaacggactcctctgcatgccgctgcacagaaaggcagtgttgagatttgtcatgtgttgctccaggccggagcaaacatcaatgcagttgacaaacaacaacgcaccccattaatggaggccgtggttaacaaccatctggaagttgctcgctatatggttcagcgaggagggtgcgtttatagtaaagaggaggacggatcaacatgtcttcaccatgccgctaagatcggcaacttggagatggtgtctctgctgttatccactggacaggtagacgtgaacgcccaggattcaggcggttggactccaataatttgggctgctgagcataaacacatcgaggtcattcgcatgctgttgacacggggtgctgatgtgactcttaccgacaatgaagagaatatttgcctgcattgggcatcattcaccgggagtgctgccatagcggaggttctgctcaatgccagatgtgacctccacgctgtgaattaccatggagacacccccctgcacatcgcagcccgagaatcctaccatgactgcgtcttgctgtttttgtcacgtggggctaatcccgagcttcgcaacaaggaaggagataccgcatgggatctgacccctgaacgcagtgatgtgtggttcgcgctgcaactgaacaggaagctaaggctgggcgtgggcaacagggccatcagaacagaaaaaatcatttgccgtgacgtggctcgaggttatgagaatgtgcccattccatgcgtgaatggagtggacggggaaccctgccctgaagactataagtatatctcggaaaactgtgagacctcaacgatgaatattgaccgcaatatcacccatctacaacactgcacatgcgttgatgactgttcctcatccaattgtctctgcggacaactgtctatccggtgctggtatgacaaagacggtcgcctgctgcaggagtttaacaaaatagaacctccccttattttcgaatgtaatcaggcgtgctcctgctggagaaattgcaaaaacagagttgtgcagtcaggaattaaggtccgccttcaactgtatcgcacggccaaaatgggttggggagtcagagccctccagaccatcccccagggaacatttatctgcgagtatgtcggcgagctgatctccgatgccgaggccgacgtgcgcgaagacgatagttacctgttcgatctggacaataaggacggtgaggtgtactgcattgacgcccgttactacggaaacataagccggttcattaaccacctctgcgaccctaatattattccggtgcgagtgttcatgcttcatcaagacctgagattccctcgaatagctttcttcagctcaagagacatccgaaccggcgaggagctcggcttcgattatggagaccggttctgggacatcaaatccaagtatttcacgtgtcagtgcggatccgaaaaatgtaagcacagcgcagaagctattgccctagagcagtcccggctggctagattggatcctcatcccgagctgctacccgaacttgggtctctgccacctgtcaatacttag

SEQ ID NO: 222355 - DNA, 897 bp, Artificial Sequence
  Description of Artificial Sequence: Synthetic coding sequence
tgatccaagagaacgcctctgcatgcagcagctcagaaagggtctgtggagatttgccacgtgcttctgcaggcgggtgctaacatcaatgcagttgacaagcagcagcggaccccgttgatggaggccgtcgtcaacaatcaccttgaagtcgccaggtatatggtgcagagaggaggttgcgtctattccaaggaggaggatgggtcgacatgcttgcaccatgcggctaagatcggaaacttggaaatggtgtccctgctgctgagcaccggtcaggtagacgtgaacgcccagggccaactgccgcctccctctcttccaagccatccccaggatagcggaggttggacacctatcatatgggccgctgagcacaagcatattgaggtgattcggatgctgctcacaagaggcgcagacgtgaccctgacagataacgaggagaacatttgtctccactgggcttcattcacgggtagtgcagccatcgctgaggtcctgctaaacgctagatgcgatctccacgctgtgaattaccatggagacactcctctgcacatagctgccagggagagctatcacgattgcgtgctgctgttcctaagcaggggcgcaaaccccgaacttcgcaacaaagaaggggacaccgcctgggatctcacacctgagagatcagatgtatggttcgccctgcagctgaatagaaaacttcgattgggtgttggaaatcgtgctatccgcacggagaagattatttgtcgggacgtggcgagaggttatgagaacgtgccaataccctgtgtgaatggagtggatggtgaaccttgtccagaagattacaaatatatctccgaaaactgcgagacaagcactatgaacatcgataggaattag

SEQ ID NO: 222356 - DNA, 3531 bp, Artificial Sequence
  Description of Artificial Sequence: Synthetic coding sequence
atggccgctgccgctggggctgcggcagccgctgcagcggaaggcgaagcacccgctgagatgggagctctgctgctcgaaaaagagaccagaggagccacggagagagtccacggatccctgggtgacactccacggagcgaggagactctccccaaggcgacccccgattccctggagcccgcaggtccatcaagtcctgcctctgtgacagttacagttggtgatgagggagcagacacacccgtcggagctaccccactgattggggatgagtctgaaaacctggaaggcgatggggatcttaggggaggccgaatcctgctcggtcacgctacgaaatcttttccaagcagtccgagtaaggggggttcctgcccgtcaagagccaagatgtctatgaccggggcaggcaagtctcctccttccgtgcagagtctcgccatgagattgctatccatgccaggagcccaaggcgcagcggctgctggcagcgagcctccccctgcaactacatcaccagagggtcagcctaaagtccacagggcccgaaagacaatgagcaagcccggaaatggccaacctcccgtacctgagaaaagacccccagagatacagcactttagaatgagcgatgacgtgcactccctaggtaaagtgacctccgacctagccaagcggaggaagcttaactccggaggagggctcagtgaggagttgggttctgcccgacggtcaggtgaggtgacactaaccaagggagatcctggctctcttgaggaatgggagacagtcgtgggagacgatttcagcctttattatgactcctactctgtggatgagagggtggattctgactccaagtcagaggtcgaggctctgactgaacagctgagcgaggaggaggaggaagaggaggaggaagaggaggaggaggaagaggaggaagaggaggaagaggaagaagaagacgaggagagcggcaatcagtctgatcggagtggatcaagtgggaggagaaaggcgaaaaagaagtggcggaaggacagcccgtgggtgaaaccttcaagaaagagaaggaagcgggaacctccaagagcaaaggaacctcggggtgtgtctaatgatacaagctctcttgagacagaaagaggctttgaagaactgccgttgtgtagctgcagaatggaagcgcctaaaatagacagaataagtgagcgggcaggccacaagtgcatggccaccgaatccgtcgacggagaactatccggctgtaacgctgccattctgaaaagagagactatgaggcccagcagtagggtggcgctgatggtcctgtgcgaaacccacagagcgagaatggttaaacaccattgctgtcccggttgcgggtacttctgcacagcgggaacctttctcgaatgtcatccagactttcgggtggctcatcgtttccataaagcttgtgttagccagctgaatggaatggtgttttgtcctcactgcggcgaagacgcttccgaggcccaggaggtaacgatacctaggggggatggggttacacctcccgcagggacagcggcaccagcccctccacctttaagccaggatgtgcccggtcgtgcagacacttcccaaccttccgccagaatgcgtggccacggtgagccacgtagaccaccttgcgaccccctcgctgacaccatcgattcttcaggtccaagtcttactctgccaaatgggggttgtctttcagccgtaggcctgccgttgggtccgggaagggaagcccttgagaaggctctggtgatacaggaaagcgaacgcagaaagaagctgcggttccacccaaggcaactctacttatcagtcaaacagggggagctgcaaaaggtgatcctgatgcttctcgacaacttagaccctaatttccagtccgatcaacagagcaaaagaactcccctacacgcggcagcccagaaggggagcgtcgagatctgccacgtgctcctccaggctggcgcaaatatcaatgcggtcgataagcagcagcgaactcccctgatggaagcggttgtgaacaatcatctcgaggtggctcggtatatggtgcaacggggtggctgcgtgtattccaaggaagaagacggcagcacttgtctgcaccacgccgctaaaatcgggaacctcgaaatggtcagtcttttattatctacaggacaggtagatgtcaacgcccaggactccggcggatggacaccaattatttgggccgctgaacacaagcatattgaggtgatcaggatgctattgacccggggtgcggatgttaccctgaccgacaacgaagagaacatatgtttacattgggcatcctttaccggaagtgccgctatcgctgaggtgctcttaaatgccagatgtgacctgcacgccgtgaactatcacggcgacacccctttacatatcgccgctcgggagagctaccacgattgtgttcttttgttcttgagcaggggcgctaaccctgagctaaggaacaaggagggagacactgcctgggacctgacacccgagcgatctgacgtgtggtttgcactacaactcaatcgaaagttacggcttggagtggggaatcgggctatccggacagagaaaatcatctgtcgggacgtcgcgagaggctacgagaatgtgcctataccgtgtgtgaatggagtagacggcgagccctgtcccgaagattacaagtacattagcgaaaattgtgagacgtccaccatgaatattgatcgcaatatcacacaccttcagcattgtacatgcgtagatgattgcagcagctctaattgcctctgcggccagctaagcattcgctgttggtatgacaaggacggcagactgctgcaggaatttaacaagattgaacccccactgatttttgagtgcaatcaggcttgctcttgttggcgcaattgtaaaaatagggtcgtccagagcggaatcaaagtgcgtctacagctttataggacagctaagatgggctggggggttagagccctccagacaatccctcagggaacatttatttgcgaatatgtcggcgaacttatcagcgacgcagaggccgatgtccgggaggatgactcttatttgtttgatctggataacaaagatggggaggtgtattgcattgatgcacgttattatggtaacatcagcagatttattaaccatctctgcgatcccaacatcattccagtccgtgtgttcatgctgcatcaggacctgcgttttcccaggattgctttctttagtagccgagatattcggaccggcgaggaactgggtttcgattatggcgatcggttctgggacatcaaatccaagtatttcacttgtcagtgtggttccgagaaatgtaaacatagtgcagaagcgatcgcacttgaacagtctcgtttagcgagactcgatccccaccctgagttgctgccagagctgggttcgcttccgcctgtgaacacatag

SEQ ID NO: 222357 - DNA, 3804 bp, Artificial Sequence
  Description of Artificial Sequence: Synthetic coding sequence
atgagaggtctccccagaggaaggggcctcatgagggctcgcggtcggggacgggcagccccacctgggagcaggggacgcggtcggggtggaccgcaccggggtcgcggacgcccacgttccctgctgtccctccccagggctcaagcaagttggacaccccaactcagcaccggcctgacctccccaccagtcccttgtcttccatctcaaggagaggcccctgcggaaatgggagctttgctccttgagaaggaaacccgcggagcaacagagcgtgtccatgggtctctcggcgacacaccccgtagtgaagaaactctgcccaaagctaccccggacagcctggagccagcagggcctagtagtcctgcctccgtcactgtgaccgtgggcgacgagggcgctgacactccagttggtgctactccactcattggcgacgagtctgagaacttagagggcgatggcgatctcagagggggacggattctcctgggacacgcgaccaaaagttttccctcaagcccctccaagggtggatcttgtccgtcacgagccaagatgtctatgacgggtgccggaaaatcccccccatccgtgcagagcctggcaatgcgtctgttgtccatgcctggagcacaaggggcagctgcagccggttccgagccccctccggcaacaacatcccccgagggccagccaaaagtccaccgcgctcgtaaaacaatgtccaaaccgggaaacggccaaccgccagtgcccgagaaaagacctcctgagattcagcattttaggatgagtgatgacgtacactctcttggtaaggtgacaagtgacctggccaagagaaggaaactgaacagtgggggagggctcagcgaagaacttggatcagcaaggcggtccggcgaggtaacgctcacaaagggggatcccggaagtctggaggagtgggagaccgtggtcggcgatgatttcagcctctactacgactcctatagcgtcgacgagcgcgttgactcagattccaaatctgaagtggaggctcttacggagcagctctccgaggaggaagaggaagaggaagaggaggaggaggaggaggaagaagaggaggaggaggaagaggaggaggaggacgaggagtcggggaaccagtctgacagatccggctcctcaggacgcaggaaagccaagaaaaaatggagaaaagacagtccttgggtaaaaccttcccggaagaggcggaagagagagccgcctagagcaaaggaacctcgtggtgtcaatggagtgggctcaagcggacccagcgagtatatggaggtgcctttagggagcctggagctccctagcgaaggtactttgagtcccaaccacgcaggcgtgtccaatgacacatctagtcttgagactgagaggggctttgaggagctgcctctgtgctcttgcaggatggaggccccaaaaatcgatcgcattagcgagcgggcaggccacaagtgtatggccacggaaagtgtggatggggagctgtctggatgcaatgcagccattcttaaaagggagacaatgcggccatcatcgcgggtcgccctgatggtcttatgcgaaacacaccgtgcccgaatggttaagcaccactgttgtcccggttgcggttatttttgcaccgcgggaacctttcttgagtgtcatcccgactttagggttgcccatcggttccacaaagcttgcgttagccagctaaacggcatggttttttgtcctcactgcggcgaggacgccagtgaggctcaggaggtgaccattccgagaggtgacggcgtcactcctcctgccggaactgctgcccctgcccctcctccactgtcccaggacgtgcctggcagggctgatacgtctcagccaagtgctaggatgcgagggcacggagagccacggcgacctccttgtgaccccctggcggacactattgactcctcagggccatcgctaactctgccaaatggaggatgtctgagcgctgtaggcttaccactggggcctggcagggaagcgctggaaaaagccttagtcattcaggagagcgagagacgcaagaaattgcgattccaccctcgccaactttatcttagcgttaaacagggtgaactgcagaaggtgatccttatgctgctggataacctagatcctaactttcagagcgatcaacagagtaagaggacacctctgcatgccgcagcccagaaaggaagcgtggagatctgtcacgtcctgctccaggccggagctaacatcaatgccgtcgacaaacaacagcgtacaccacttatggaagcagtggtgaacaaccatctcgaggtagctaggtacatggtacaacggggagggtgtgtgtactccaaagaagaggacggcagcacttgcctgcaccacgctgctaagattggcaatctagagatggtgtccctgctgctctccacagggcaggtggacgttaatgctcaggactctgggggatggaccccgataatttgggccgcagagcacaagcatatagaggttataagaatgctgttgacccgtggtgccgacgttacgctcacggacaacgaggagaacatctgcctgcactgggcttcttttactggcagcgccgctattgctgaggttctcttgaacgcacgctgcgatttacacgcagtgaactatcacggggacacaccactgcacattgcagcgcgagaatcttaccacgattgtgtgctcctctttctgtcccgcggtgcaaacccggagttgcgaaacaaagagggtgatactgcgtgggacctaacccccgaaagatcggatgtctggttcgcattgcagctcaaccgtaaactgaggctcggggtgggtaaccgggctatcagaactgagaaaatcatatgtagagatgttgccagaggttacgagaatgtccctatcccttgtgtaaatggagtcgacggggagccttgtcctgaggactacaagtacatcagtgagaattgcgaaacatcaaccatgaacatcgataggaatattacccacctgcagcactgtacatgtgtggatgactgttctagctcaaactgtctgtgtggtcagcttagcatccggtgctggtacgacaaggacggtaggctgctgcaggaatttaataagatagaaccaccactgattttcgagtgcaatcaggcctgctcatgttggcggaactgcaagaaccgcgtggtgcagagcgggattaaggtaaggctgcagctgtacagaactgccaaaatgggatggggcgtgcgggcactgcagaccataccccagggaacgttcatttgcgaatatgttggggagttgatctccgatgctgaagcggatgtacgcgaagatgattcctatctatttgatctcgataataaagatggagaggtttattgcattgacgctagatactacggcaatatctcccggtttatcaatcacctgtgtgatcctaacatcattccagtgagggtattcatgctgcaccaggatttgcgcttcccccgaattgcttttttttccagtcgggatattcgaacgggtgaagagctcggcttcgactacggagaccgcttctgggacatcaagtccaagtacttcacatgtcaatgcggctcagagaagtgcaagcatagcgctgaggcaatagctcttgaacagagtcgccttgcgcgtcttgaccctcatccagaactgctgccagaattgggtagcttgcctcccgtcaacacatag

SEQ ID NO: 222358 - DNA, 3633 bp, Artificial Sequence
  Description of Artificial Sequence: Synthetic coding sequence
atggcagcagccgctggggctgcagctgcagccgctgccgagggtgaagcccctgccgaaatgggtgctttgttactggagaaagaaaccagaggcgcaacagaacgggtgcatgggagcctgggggataccccacggagtgaggaaacgctgcctaaggcgaatccagacagtctagagccagccggtccttctagtcctgccagtgtgacagtgacagttggggacgaaggagctgacacacctgtgggggctacccctctgatcggcgacgagagcgagaacctggaaggtgacggtgacctgagaggagggagaatcctgctcggccacgcaactaagagctttccaagtagcccgtctaagggcggatcttgtcccagcagggctaagatgtctatgacgggggctggaaagagtcccccaagcgtgcagtctctggctatgcgtttgctgagcatgcctggcgcacagggcgctgcagcagccggtagcgagccccctcccgctacgactagcccagagggacagccaaaagttcatcgggcacggaagaccatgagtaagccaggaaatgggcagccacccgttcctgaaaagagaccgccagaaattcagcattttcgcatgtcagatgatgttcactctcttggcaaagtgaccagcgacctagcaaagagaagaaaactcaactccggaggcggtctgagtgaagaactgggaagtgcccgtcgatctggcgaagtcactctcactaagggcgaccctggatccctcgaggagtgggagaccgtggtaggggacgacttttcactctactatgattcatactcagtggacgaacgagtggactccgattccaagtcagaagtggaagccctgactgagcagctttcagaagaggaggaggaggaggaggaggaagaggaggaagaagaggaggaagaagaggaggaggaggaggaggaagacgaggagagtgggaatcaaagcgataggagcggatcttccggcaggcggaaggctaaaaaaaagtggcgcaaagactccccatgggtaaagccctcgaggaaacggaggaaaagggagccgccaagagctaaggagccccgtggagtgaatggggtgggttcctcaggacccagcgaatacatggaggtgcctttgggatccctggagttgccgtccgaaggtaccttgtcccctaaccacgctggcgtaagcaacgataccagctcactagaaacagagagggggtttgaggagctgcctctttgttcctgtaggatggaagcacctaagatcgataggatcagtgaacgggctggacacaagtgcatggccaccgagagcgttgacggcgagctgagcgggtgtaatgccgctattttaaagagagagactatgaggccgagctccagggtcgcactgatggttctgtgtgagacacatagggcacgaatggtgaagcaccattgctgtccaggatgcggttacttttgcaccgctgggacattccttgagtgccaccccgacttccgagtggcacacaggttccataaggcatgcgtcagccagctgaatgggatggttttttgcccccattgtggtgaagacgcttcagaagctcaggaggtcacaatcccacgaggagatggggtgacacccccagctggaactgcagccccagctccacccccattgagccaagatgtccccggtagggccgacacttcacagcctagtgcacggatgcgaggacacggcgagccccgaagacctccttgcgatccgctggccgatactatcgattccagcggcccatccttgacactccccaatggaggatgtttaagtgccgtcgggttacccctcggacctggcagagaggcgttggaaaaggcgcttgtgattcaggaaagcgagcggaggaagaagcttcgttttcaccccagacaactctacctctctgtgaaacagggcgaacttcagaaagtcattctgatgctgctcgataacttggacccaaattttcagtcggatcagcaatctaagcgaaccccacttcacgctgcagcgcagaagggctctgttgagatctgccatgttctcctgcaggccggagcgaacatcaacgcagtagataaacaacagcgcactccactcatggaagctgtcgttaacaatcatctcgaggttgctagatatatggttcaaaggggcggatgtgtgtactctaaggaggaggacgggtctacctgtctgcaccacgctgccaaaatcgggaacctcgagatggtctcactgctactttccacgggccaggtcgacgtcaatgcgcaagactcaggaggatggacaccaatcatctgggccgcagagcacaagcacatagaagtgattaggatgcttctgacgcgcggagcagacgtgacgcttaccgataatgaggaaaacatctgccttcactgggcatcctttacaggctccgccgcaatcgccgaggtgctgttgaacgccaggtgtgatttgcatgcagtgaactatcacggggatactcctctgcacatcgcagctcgggaatcatatcatgattgcgtgctcctgtttttgtcaaggggtgccaaccctgagctccgaaataaggagggtgacaccgcttgggaccttacgcccgagaggtccgatgtctggtttgcccttcagctaaatagaaagcttcgcctgggggtcggaaacagagctattagaactgaaaagatcatctgcagggatgtcgcacggggatatgagaatgttccaatcccctgtgtcaatggcgtagatggggaaccatgccctgaggattacaaatatatttctgagaactgcgaaaccagcacaatgaacattgacagaaacatcactcatctacagcactgcacctgcgtggacgattgctcgtcctccaattgcctgtgtggccagttgagcatcagatgttggtacgataaggatggcaggctactgcaagagttcaataagatcgagccccctctcatatttgagtgcaaccaggcttgctcctgctggagaaattgcaagaatagagtggtacagagcggtattaaggtccggttacagctgtatagaactgctaaaatgggctggggagtccgcgctctacagactatcccacaaggcacttttatctgcgagtatgtaggtgaactgatctctgacgcagaggcggacgtaagggaggatgacagctatctttttgaccttgataacaaagacggagaagtatactgcatcgacgcaaggtactacggcaacatcagtagatttattaaccacctgtgtgatccgaacatcatcccagttcgtgtgtttatgctgcaccaggacttgaggttccccaggatcgcttttttctcatcccgcgatattagaaccggtgaggaattgggcttcgactatggtgacagattttgggacattaagagcaagtattttacctgtcaatgcgggtcagaaaagtgcaaacactccgccgaggcaattgcactggaacaatcacgactggccagactggatcctcaccccgagcttctacccgagctcgggtcactgcctcccgtgaatacgtag

SEQ ID NO: 222359 - DNA, 897 bp, Artificial Sequence
  Description of Artificial Sequence: Synthetic coding sequence
tagtctaagcggaccccactacacgctgcggcacagaaaggcagtgttgagatctgtcacgttttgttgcaggctggagctaatatcaacgctgtggacaagcaacagaggacgcccttgatggaagcagtggtgaacaatcatttagaggtagcccgatacatggtgcagagggggggatgtgtctactctaaagaagaggacggctcaacctgtctgcaccatgcagctaagataggaaatttggagatggtgagcttgctgctttcaacaggtcaggtggatgttaacgcgcaaggccaattgcctcccccaagcttaccctcgcatccgcaggatagtggaggctggactccgatcatctgggcggcagagcataagcatatcgaggtcatccggatgcttctgaccagaggtgcagacgtaacattgactgataatgaggaaaatatttgtctgcactgggcctcattcacggggagcgcagcaattgccgaggttctgctcaacgcacgctgcgacctccatgccgtgaactaccacggcgacactccgctgcatattgctgcacgtgagtcctatcatgactgtgtactgctcttcctcagtaggggggctaatcccgaactgcggaataaggaaggcgataccgcttgggaccttactcctgaacggtccgacgtctggttcgccctgcagttgaaccggaaactccgcttgggggtcggaaacagggctattaggaccgagaagattatatgccgggacgttgctcgcggatacgaaaatgtgcctatcccttgcgttaacggggttgacggggaaccatgcccggaggactataaatatatctctgagaactgcgagaccagcactatgaacatcgaccgaaactag

SEQ ID NO: 222360 - DNA, 2769 bp, Artificial Sequence
  Description of Artificial Sequence: Synthetic coding sequence
tctgaggtggaagctctcaccgagcagctgtccgaggaggaggaggaggaggaggaagaagaagaggaagaagaagaagaggaagaagaagaggaggaggaggaggacgaagagagcggaaatcaaagcgataggagcggctcttcgggtcgcaggaaggccaagaagaaatggcgaaaggacagcccctgggtaaagccctctcggaaacggagaaaaagagagccgccaagggcaaaggaaccacgcggagtaaacggagtaggttcatccggccctagcgaatatatggaggtcccattaggctcgctggagttgccgagtgaggggaccctgagtcccaaccatgcaggcgtttcaaacgatacttcgagtttggagacagagcggggtttcgaggagctgcctctgtgcagttgccgaatggaggcccctaagatcgatcgcatctctgagagggcaggacacaagtgcatggccaccgagagcgtggacggggagctgtcaggatgcaatgccgcaatcctgaagcgggagaccatgcggccaagcagcagggtggcactcatggtcctgtgcgagacccatcgggctcgcatggtgaaacaccactgttgccccggatgtggctatttctgtactgcaggtacattcctggagtgccaccccgatttccgagtggcacaccgattccacaaagcttgtgtgtctcaacttaatggcatggtgttttgtccccactgtggagaagacgcctccgaagctcaggaggtcacaataccacgcggagacggggtcacaccccctgctggaactgcggctccagccccacctccactctctcaggatgtccccggaagggctgatacctctcaaccatcggcgcgaatgcgtggccacggagagccccgacggccaccttgtgacccactcgctgataccatagattcctccggaccaagcttgaccctgcccaatggcggatgcttgtctgccgtgggcttgccactcgggcctggacgggaagccttggaaaaggccctagtgatacaggagtctgaacgcagaaagaaactgagatttcatccaaggcagctctacttaagcgtcaagcagggcgagctccaaaaagtgatacttatgctgttagacaacctggacccaaacttccagtctgaccagcagagcaaaaggacaccattgcacgcagctgcacagaagggcagcgtcgagatctgccatgtgctccttcaagctggggcaaacataaacgctgtggacaaacagcagcgcactcctttgatggaggctgttgtgaacaaccaccttgaagtggcccgttacatggtgcagcggggaggttgcgtgtactctaaggaggaggacggatcaacctgccttcatcacgctgcaaaaattggcaacctcgagatggtgagtctgttactgtctacgggccaggtcgatgtgaatgcgcaggattccggtggatggacccccataatatgggcggcagagcacaagcatattgaagtgattcgtatgttactgactcggggagcagacgttactctcaccgataacgaggaaaatatttgtttacattgggctagtttcaccggctccgctgcaatcgccgaggtattattaaatgccagatgcgacctgcatgccgtgaactaccacggggatacccctctgcacattgctgccagagaatcctaccacgactgtgtcctgctgtttctgtcccgcggagccaaccctgagcttcgcaataaggagggcgatacagcatgggatctgacccccgagagatccgacgtgtggttcgcccttcaattaaaccgcaagcttcgcctgggcgtgggaaatcgagccatccgcacagagaaaataatctgccgggacgtggccaggggctatgaaaatgtgcctatcccctgcgtgaacggtgtggacggcgagccatgtcctgaggactacaagtacatctcagaaaattgcgagacgagtaccatgaatattgaccggaacataactcacctccaacattgtacctgtgtcgatgattgctcctcctccaattgtctctgtggccagctctccattcgttgctggtatgacaaggatggtcgcttattgcaggagttcaacaagattgaacctccactcatttttgaatgcaaccaggcctgtagctgttggagaaactgtaagaatagagtggtccaaagcggcataaaggtgcgcttgcagctgtaccgcactgctaagatgggttggggggtacgtgcactccagacaatcccacagggtacctttatctgtgaatatgttggagaacttatctccgacgccgaggctgatgtacgggaggacgattcgtatctgttcgacctggacaataaggatggcgaggtctactgcatcgacgccaggtactacgggaatatctcccgttttattaatcacctctgtgaccccaatataataccagtcagggtgttcatgctccatcaggatctgagattccccagaatagccttcttttcaagcagagatatccgcacgggagaggaattgggttttgattacggggatcgattttgggacataaaaagtaaatactttacttgccagtgcggctccgagaagtgtaaacatagcgcagaggcgattgctctggagcagtctcgtttggcacgcctggacccccacccagagttgctaccagagctgggctcgctgccacccgttaacacatag

SEQ ID NO: 222361 - DNA, 3702 bp, Artificial Sequence
  Description of Artificial Sequence: Synthetic coding sequence
atgaggggactgccacgcggtcggggtctgatgcgcgctcgcggtagaggacgcgcagccccacctgggtcccgcggtaggggtcggggagggcctcataggggcagagggcgaccccgaagcctcctgtctctccctcgggctcaggccagctggactccccagctctccactgggctgaccagcccgcctgtgccgtgtctgccatctcagggggaggcacctgctgaaatgggcgctcttcttctggaaaaggaaactcgcggagccaccgagagggtgcacggcagtctgggtgatacacccagatccgaggagacactgccaaaggctaaccccgattcactcgaaccggctggtcctagtagccctgcttcagtcaccgtcaccgttggcgacgagggcgctgatacccctgtgggcgcaactcctctcatcggggacgagtcagagaacctggagggcgacggcgacttgagagggggacgcatcctactcggccacgcgactaagagctttccaagctcaccttccaaaggaggctcttgtcccagcagggccaagatgagcatgacgggcgcaggaaagagcccgcctagcgttcagagcctggcaatgcgtctgttgagtatgcctggtgcccaaggcgcagccgctgcaggaagtgagccaccccctgctaccacatcccccgagggacaacctaaagttcacagggcgagaaaaactatgagcaagcccggtaacggtcaaccgcctgtccccgaaaaacgaccacctgagatccagcattttagaatgtccgacgatgttcatagcctgggcaaggtgactagtgatctggctaagagacggaaactgaacagtggtggagggctctccgaagagctgggctctgctaggagatcaggcgaggtgaccctgaccaaaggtgatcctggctcgcttgaggaatgggagacggtggtcggggacgattttagcctatactatgactcctactctgtggacgagcgagttgattccgatagtaaatccgaggtggaggccctcaccgagcagcttagcgaagaagaagaggaggaggaggaagaagaagaggaggaggaggaggaagaggaggaggaggaagaggaagaggatgaggagtccggaaatcagtcagatcggagtgggtcctctggtagacgcaaggctaagaagaaatggcggaaggattctccctgggtgaaaccttctaggaagagacgaaagcgggagccaccaagagccaaagagccgaggggagtctctaatgacacaagcagtctggagactgagaggggttttgaagaactgccattatgcagctgccggatggaggcccctaaaatagacaggatctctgagcgggctggacacaagtgcatggccactgaatcggtcgacggtgaactgtcaggttgtaatgcggctatactcaagcgcgaaacgatgcggccttctagccgcgtggctcttatggtgctatgcgaaacacatcgggcaagaatggtaaagcatcactgctgtccaggctgcggttatttttgcaccgctgggaccttcctggagtgccacccagattttagggttgcgcataggttccataaggcatgcgtgagccagctcaacggaatggtattctgtccccactgtggcgaggacgcttcagaggcccaggaagtgacgatccctaggggtgatggtgtgaccccccctgccggtaccgctgcccctgcccctcctccccttagccaggacgtccccggtagagctgatacttctcaacccagcgccaggatgcgaggtcacggagagccacgacgccctccttgtgatccactcgccgatactatcgattcttctgggcctagcctaacattgcccaatggcggatgtttgtctgccgtgggtctgcctcttggtcctggccgagaggcactggaaaaagccctggtgattcaagagagtgagcgaagaaagaaactccggtttcacccaaggcagctgtacctctccgtaaaacaaggcgagttacagaaagtcattttgatgcttttggacaacctcgatcccaattttcagtccgaccaacagagtaagcgaacccccctacatgccgctgcccagaagggctccgtcgaaatctgccatgtcctgctccaagccggagctaatattaatgccgtggacaagcagcagaggacccctctcatggaagccgtggtaaacaatcacctggaagtggcgaggtatatggttcagagaggaggatgcgtgtacagtaaggaggaagacgggtccacctgccttcatcacgctgctaagatcgggaatctcgagatggtatccctgttactctcaactgggcaggtggacgttaacgctcaggatagcggagggtggaccccgattatctgggctgcggaacacaagcacattgaagtaatacggatgctgctgactcggggtgcagatgtgactctgaccgacaacgaggaaaacatttgcctgcactgggcttcattcactggctcagcagcaatcgctgaggtcctgctcaacgcgaggtgcgatcttcatgcagtgaattatcacggcgataccccactgcacatcgccgcaagggagtcataccacgactgcgtgttgctgttcctgtcacgtggggcaaatcccgagcttcgcaacaaagagggagacaccgcctgggatctgacacctgagcgcagtgatgtttggtttgccctacagcttaataggaaactgaggctcggggtcgggaatagagccatccggaccgaaaaaatcatttgcagggacgtggcacgcggttacgagaatgtgcccattccttgtgtcaatggggtcgatggggaaccctgtcccgaggactacaagtacatatcagaaaattgtgagactagcacaatgaacatagatcggaacattacacacctgcagcactgcacatgcgtggatgattgcagttcatccaactgtctgtgtggacaactttcaatcaggtgttggtacgacaaggatggcagactgttgcaagaattcaataagatcgaacccccactcatctttgagtgcaaccaagcttgctcctgctggcggaactgcaaaaaccgggtggtccagtctggcatcaaggtgcggctgcaactttacaggaccgcaaagatgggctggggagtacgagcacttcagaccatcccacaaggaacgtttatatgcgagtatgtaggggagctgatttcagatgcagaggccgatgtaagggaggacgactcatatctgtttgacctggacaacaaggacggtgaagtttattgtatcgacgccagatactatggaaatatcagcaggttcattaaccacctgtgcgatccaaatattattcctgtaagagtcttcatgcttcaccaagacctaaggtttccacgtattgccttcttcagctcaagagacatacggaccggggaagagctgggtttcgattatggtgacaggttctgggatattaagagtaagtattttacttgccagtgtggatcagagaaatgtaaacacagcgccgaagccattgcgttggagcagagtagactggcaaggctcgatccacaccccgaactactgccagaactcggcagtcttccacctgtgaatacctag

SEQ ID NO: 222362 - DNA, 3702 bp, Artificial Sequence
  Description of Artificial Sequence: Synthetic coding sequence
atgcgagggctgcccagaggacgagggcttatgcgcgcacggggaaggggcagggcagcaccaccaggctcgcgaggtcgcggacggggtggaccccaccggggtcgcggacgcccaaggtctctcctctccctccctagagcgcaggccagttggacgccccagctgtcaactgggctgacatcacctcccgtgccatgcttgcccagtcaaggggaagccccagctgagatgggtgccctgctactcgaaaaggagacacggggtgccaccgagcgggtgcacggaagcctcggtgatacaccacgatcagaggaaaccctaccaaaggccacccctgatagcctggaacctgccggtccatcctcacccgctagtgtgaccgtgactgtgggcgacgaaggcgcagacacccccgtcggggcaactccgctcatcggagatgagtcagagaatctcgaaggtgacggggatctgagaggcggtcggattctgctgggtcacgctacaaaatctttcccgtcctcccctagtaaggggggatcctgcccctctagagctaaaatgtcaatgacaggagctggcaaaagcccaccatccgtgcagtcgctggcaatgcgtcttttatcaatgccaggagcacaaggggcagcggctgctgggtcagagccgccaccagctaccacgtccccagaaggacaaccgaaagtacacagagctagaaagaccatgagcaagccagggaatgggcagccccctgttccggagaaacgaccacccgaaattcaacactttcgcatgagcgatgacgtgcactccctggggaaagtgacttccgaccttgcaaaacggcgaaagctaaactccgggggtggcctgagtgaggaattgggctccgcccgtcggtccggcgaagtcacactcaccaaaggggatcctggaagcctcgaagagtgggagaccgtggtgggggacgatttctcgctatattacgacagctactcagtggatgaacgagtcgacagtgactctaaatcagaggtcgaggccctgactgagcagctctcagaggaggaggaggaagaagaagaggaggaagaagaagaggaggaggaagaggaggaggaagaggaggaagaggacgaagagtcagggaatcaatctgaccgctctggaagctcaggacgtagaaaggctaagaagaaatggcgaaaagactcaccttgggtgaagccctctagaaaacgccgtaagagagagccccctagggcgaaggagccacggggtgtgtctaatgacacatcttctctggagacggaacgcggttttgaagagctgcctttatgctcttgccggatggaagctcccaagatcgatcgcatttctgaaagagctgggcacaaatgcatggccacagaatcagtggatggcgagctaagcggctgcaatgctgctatactaaagcgcgaaaccatgcgaccatcctctagggtagcccttatggtcctctgcgaaacacaccgagcccgaatggtaaagcatcattgctgtcccggttgtggctacttctgtactgctggcacgtttttagagtgccatccggatttccgtgtggctcaccgctttcacaaggcatgtgttagccaacttaacggcatggtcttttgcccccactgtggggaggacgctagtgaggcccaggaggtgacgattcccagaggcgacggggtgacacccccagccggtactgcagctcctgcgcctccgcctttgtcccaggacgtccctggtcgggcagacacaagtcagccctcagcccgtatgcgcggacatggtgagccgagacgcccaccttgtgaccccttggccgacacaatcgattcttccggcccatctctcacgcttcccaatgggggttgtttgagcgccgtcgggctgcctctaggacccggtagggaggctctggagaaagccctggtgatacaggaatcggagagacgaaaaaagctaagattccatcctagacagctttatctctctgtgaagcagggcgaactgcaaaaggtgattctcatgctgctcgataacttagacccaaacttccaatcagaccagcagtcaaagcggacacctctccacgctgccgcacagaagggcagcgtggaaatttgccacgttttgctgcaagcaggtgccaacatcaatgctgtagacaaacagcaaaggacccctttgatggaagccgtcgtgaataatcatctggaggttgccagatatatggtgcaaagaggagggtgcgtgtactctaaagaagaggacgggtccacctgcctccaccacgcagctaagatcggaaatttagagatggtcagtctcctacttagtacgggacaggtcgatgtgaatgctcaagattccggaggatggacgcccatcatctgggctgcagagcacaagcacatcgaggtgattcggatgctgctgacacgaggggctgatgttaccctgactgacaatgaggagaatatatgtcttcactgggccagttttaccgggtcggccgcaattgccgaggtgctgctcaatgctcgatgtgacctccatgcggtgaattatcatggcgatactccactacacatcgcagccagggagtcctatcacgattgtgtcctgctgttcctatctcgcggagcaaatcctgagctgagaaataaggaaggagacacagcatgggatctaactccagaaagaagtgatgtttggttcgccctccagcttaataggaagctgcgactgggcgtagggaatagggcgatacggactgaaaaaatcatttgtcgcgatgtagctcgcggatacgaaaacgtgccgattccctgtgtgaatggcgtagacggggaaccctgtccagaggattataagtatatctctgagaattgtgagacttcgaccatgaatatcgacagaaacataacacatttacagcactgcacctgcgtggatgactgctcttctagcaactgtctgtgcggccagctgtccattcgctgttggtacgacaaagatggacgcctcttgcaggagttcaacaaaattgagccccctctaatctttgagtgtaaccaagcgtgtagctgctggcggaactgcaagaaccgtgtggtgcagagcggcatcaaggtacgcttacagctgtaccggactgctaaaatgggatggggcgtgcgcgcactgcagacaataccccagggaacattcatctgtgaatacgttggagaactgatcagcgatgctgaagctgacgttagggaggacgattcatacctgttcgatctcgacaacaaggacggcgaggtatattgcatcgatgctaggtactacggcaatatcagtcgcttcattaaccacctgtgcgatccgaatatcatccccgtgcgggttttcatgctgcaccaggacctcagatttccacgcatagctttcttcagctcacgggatattcgcaccggcgaggagctaggatttgattatggggatagattttgggatatcaagtccaagtactttacctgtcagtgtggttcagaaaaatgcaagcacagcgcagaggcaatagcacttgagcagagcagactagccaggctggatccccaccccgagttgttaccagagttaggctccttgccacctgtgaacacatag

SEQ ID NO: 222363 - DNA, 3633 bp, Artificial Sequence
  Description of Artificial Sequence: Synthetic coding sequence
atggccgcagcagccggagccgcagcagccgctgccgcagagggggaggccccagccgaaatgggcgctcttctgctggagaaggagacgcgtggagccaccgagagagttcatgggtctttgggggatacaccaaggtccgaggaaactttaccaaaagccacacccgactcattagagccagccggaccatcttctcccgcaagtgtcacagtgacagtcggtgacgaaggcgcagacacccccgtcggggcaactcctctgatcggggatgagtccgaaaatttagaaggcgatggcgatctccgaggcggacgtatcttgctgggccatgctaccaaatcatttccatcttcgccgagcaagggtggctcttgccctagtcgggctaaaatgtccatgacaggggcaggtaaatctccaccatcagttcagagtctcgctatgagattgttaagcatgccaggggcacaaggcgctgctgcagccggatccgaacctccaccagctaccacatctccggaaggccaacctaaggtccacagggctagaaagacaatgtccaaaccagggaacggtcaacccccagtccccgagaagcgtccgcctgagatccagcattttcgcatgagtgatgacgtgcattcactaggcaaggtcacaagcgatctggccaagcggaggaagcttaactctggcggtggcctgagcgaggagcttgggtctgcaagacgaagtggtgaggtcactctcacaaagggggatcccggatctcttgaagaatgggagactgttgtcggcgatgactttagcttatattacgactcatatagcgtggatgaacgggtcgactctgatagtaagagtgaggtcgaggctcttacagagcagttatctgaggaggaggaggaggaagaggaagaggaggaagaagaagaagaggaagaggaagaagaggaggaggaagaggacgaagagagtggaaaccagagcgaccgctctggctcaagcggccgacgtaaggcgaagaagaagtggcggaaagacagcccttgggtaaaaccctctcggaaacggagaaagagggaaccgcctcgcgcaaaggagccccgaggtgtgaacggtgtaggcagctctggccctagcgagtacatggaggtgcctctcggaagtttagagcttccatcggaaggcaccctgagccctaatcatgcgggagtctccaatgatactagttccctggagacagagcgcggattcgaggaactgccgctctgctcgtgccgcatggaggcccctaagatcgatcggatctccgaaagagccggtcacaaatgtatggctactgagagcgtcgatggagaactttcaggctgcaacgccgcaatcttgaagagagaaacgatgagacccagttcccgcgtggctctgatggtgctctgcgagacccatcgcgcaagaatggtcaagcatcattgctgtcctggatgtggctacttttgtaccgccggaactttccttgagtgccatccagacttccgggtggcccatagatttcataaggcatgtgtcagccagctgaacggcatggtcttttgccctcactgtggggaggatgcatcagaagcccaggaagttaccattcccagaggagatggggtgacccctccagcaggtacggccgcaccagctccccctccactgagccaggatgtgccgggacgggcagacacctctcagcccagtgccaggatgcgcggtcacggcgagccacgaagacccccttgcgatcccctggccgacaccatagacagttcgggtcctagtctgaccctgccgaacggtggatgcctgagtgcagtcggcttgccactcggtcccggtcgtgaggcactggagaaggccctcgtgatccaggagagcgaacgacgtaaaaagctccggtttcatccgagacaactttacctgtccgttaaacaaggagagttgcagaaagtcatcctgatgctgctcgacaatcttgacccaaatttccaatcggatcagcagagcaagaggactccacttcacgctgcagcccagaagggctctgtggaaatatgtcacgtgttgctccaggcgggtgccaacattaatgctgtggacaaacaacagcgaacgccccttatggaagccgtcgtcaataatcacctggaggtggctaggtacatggtgcagagaggcggatgcgtgtatagcaaagaagaggatggcagcacttgtttgcatcatgctgccaaaatcgggaatctggaaatggtgtcccttttgctgagtacgggccaggtcgatgtcaacgcccaggactctgggggttggactccaattatctgggctgcagaacacaagcatatcgaggtcatcaggatgctgcttacccgaggcgcagatgttactctcacagataatgaggagaacatttgcctccattgggcttcatttactggctccgccgctatcgccgaggtgctgctgaacgcccgatgcgacctgcacgccgtcaactaccacggcgacacacctctgcacatcgctgccagggagtcctatcacgactgtgtcctcttgttcctgtcccgcggagccaaccccgaactacggaacaaggaaggcgataccgcctgggacctcacacctgagaggtctgatgtgtggtttgccctgcagctgaatagaaagcttcgtcttggcgtcggcaatagggccattcgcaccgaaaagataatttgtcgcgatgtcgcgcgaggatacgaaaacgtcccaattccctgcgtgaacggtgttgacggtgaaccgtgtccagaggactacaagtacatttccgaaaactgtgagactagcactatgaacatagatcggaatatcacccatctgcagcattgcacttgtgtggatgactgcagttcaagtaattgcctgtgcggccagctcagcatccgatgttggtatgacaaggacggccgattgctgcaggaattcaataaaattgagccccctctcatttttgagtgcaaccaagcctgttcctgctggcggaactgcaagaacagagttgtgcaatccggcattaaggtccgcctgcagttataccgcacggcaaagatgggttggggggtccgggctctgcagactattccccagggcacattcatttgcgaatatgtcggcgagcttatctcggatgccgaagccgacgtccgtgaggatgacagctacctgttcgatctggataacaaagatggtgaggtgtactgtattgacgcccgatactacggcaatatttccagattcatcaatcatttgtgtgacccaaacattatcccagtgagggtttttatgttgcatcaggatctgaggttcccccgtatagcgttttttagctcccgcgacatccgcactggggaggagctcggcttcgattatggcgaccggttctgggatattaagtccaagtatttcacctgccaatgtggctctgaaaagtgtaagcactctgcggaagcaatcgccctggaacaatcccggttggctcgactcgacccccacccggagctcctgccagagttgggatcgttgccccctgtgaacacgtag

SEQ ID NO: 222364 - DNA, 897 bp, Artificial Sequence
  Description of Artificial Sequence: Synthetic coding sequence
tagtcaaagcgaacccctctccacgccgctgcgcagaaaggctccgtggagatttgccatgtgttacttcaggctggcgcaaatatcaacgcagtcgataagcaacagcgtaccccactcatggaggctgtggtcaataatcatctggaagtggctcgatatatggtgcagcgtggaggttgtgtatacagcaaggaggaagatggtagtacatgtctccaccatgccgctaaaatcggcaacctagagatggtcagtctgttattgtccaccggacaagtcgatgtaaatgctcaaggtcagctgccaccaccgagcctcccctctcatccacaagactcggggggatggacacctataatttgggccgctgaacacaaacacatagaggtgattcgcatgctgctgacccgcggagcggatgttactttgaccgataacgaggaaaacatatgtcttcactgggcctcctttaccgggtccgcagcaattgccgaggtgctgctgaatgctagatgtgaccttcacgctgtgaattatcacggagacactccgctgcacattgctgcgcgtgaaagttaccacgactgcgtcctgctgttcctctcaagaggggctaatcccgagctcaggaataaggagggggatacagcctgggacctgactcccgagagatccgatgtttggtttgcgcttcaacttaataggaaactccgcttgggagtggggaaccgagctattcgaaccgagaaaataatttgtcgcgacgttgcaagggggtatgaaaatgttcccattccttgtgttaacggggtggacggggagccctgtcctgaagactataagtacatttcagaaaattgtgagacgtccaccatgaacattgatcggaattag

SEQ ID NO: 222365 - DNA, 3804 bp, Artificial Sequence
  Description of Artificial Sequence: Synthetic coding sequence
atgcgcggactcccacggggtcgtggtctcatgagagctcgcggtcgcggacgggctgcgcctccagggtcaagaggtagaggaagagggggaccacatcgcggtcggggacggccacgtagcctgctgagcctgcctcgagcccaagctagttggacaccccaactctccacaggattaacctcacctcctgtgccctgcttacctagccaaggagaggctccagctgagatgggtgcactcctgttggagaaggagactcggggtgctaccgaacgggtccacggatcactcggagacacccctcgctcagaagaaacgctgccaaaggccacccctgacagcctggagccagccggacctagctcccccgcatctgttaccgtcaccgtcggcgatgaaggcgctgacacacctgtgggcgctacgcctttgattggagacgagtcagagaaccttgagggagatggcgaccttagaggtggccgaatactgttggggcacgccactaaatcgttcccatcgagtcccagcaaagggggatcttgtcccagcagagctaagatgagtatgacaggtgctgggaaatctccaccatccgtccagtctctggccatgcgtctcctgagcatgcccggagctcagggggctgcagcggctggaagcgagccaccgcctgcaaccacgtcgcccgagggtcagccaaaagttcatagggctagaaagactatgtctaaaccaggtaatgggcagccaccagtacccgagaaaaggccccctgaaatccagcactttcgcatgagtgacgatgtccatagtcttggcaaagtgacttcagatctcgcaaaaagacggaagctgaactcaggcggtggcttgagcgaggaacttggatctgctagaagaagtggtgaagttacacttactaagggtgatcccggtagcctggaagagtgggaaacagtcgtgggcgatgacttctccctctattacgactcttactcagtggatgaaagggttgacagcgatagcaagagtgaggtggaagcgctgacagagcagctgtccgaagaagaggaggaggaagaagaagaagaggaagaggaggaggaggaggaggaggaggaggaggaggaagaagacgaagagtctggcaaccagtctgatcgctccggtagttctggcaggaggaaggctaagaaaaagtggcgtaaggactcgccttgggtcaagccgtcacggaagaggcgcaagagagagcccccaagggctaaagaacctaggggggttaatggggtaggctcctccggaccctcagagtacatggaggtcccattgggttctcttgagctgccatccgaggggaccctgtcacccaatcatgcaggagtgtccaatgatacaagctctttggagaccgagagagggtttgaggagctgccgctctgctcctgcagaatggaagcgccaaagattgacaggatctccgagagagcgggtcacaagtgtatggctactgaatctgttgatggcgaactgagtggttgtaacgctgccatcctgaagagggagactatgagacccagctctagagtggccctcatggttttgtgcgaaacacacagggctagaatggtcaagcaccattgttgccccggttgcggctatttctgcaccgctggaacgttccttgagtgtcatccggactttagggtggcgcacaggttccacaaggcatgcgtctcacaacttaatggtatggtgttctgcccccactgcggcgaggatgcaagtgaagcgcaggaggtcactataccaagaggggatggtgtgacaccaccagccggaaccgctgctccagcacctccacccttgagccaggatgtgcccggtcgggcagacacctcgcagccatccgctagaatgcgagggcatggtgagcctcgaaggccaccttgcgatccactagcagatactattgatagcagcgggccttctctcactctccctaacggaggctgcctatcagcggtcggactcccactgggtcccggaagggaggctctggaaaaagctttagtgatccaggaaagcgagcgccgtaagaagcttcgctttcatcccagacagttgtatcttagtgtaaagcagggagagcttcagaaggtcattcttatgctgctggacaatcttgatcccaacttccagtccgatcaacagagtaaaaggacccctcttcatgctgccgcacagaaaggatcagttgaaatatgtcacgtgctactccaggcaggcgcaaatattaatgccgttgataagcaacagcgcactcccctcatggaggcagtagtaaataaccacctcgaagtcgcccgatacatggttcaacgtggcggatgcgtgtacagcaaagaggaagacggctccacatgcctacaccacgccgctaagataggaaatctcgagatggtaagcctgttactgtctactggacaggtggacgttaatgctcaggacagtgggggatggacaccaattatttgggctgccgaacacaagcatatcgaagtgatcaggatgctcctcactaggggagccgacgtgactctaaccgacaacgaggagaatatctgtctgcattgggcttccttcaccggctccgcagccatcgccgaagtattactaaacgcacgttgtgatctgcacgccgttaattatcatggtgacactccactgcacatcgccgctcgtgagtcttaccacgactgcgttctactctttctatccagaggcgctaatcctgaactgcggaataaggaaggcgacactgcatgggatctgacacctgagcggtctgatgtgtggtttgccttgcagctgaaccgcaaactgcgactgggagtcggaaatagggctatccgcactgagaaaattatttgtcgagacgttgctagggggtatgagaacgtgccaataccttgtgtcaacggtgtggatggggaaccatgccccgaggactataaatacatctctgaaaattgcgaaacaagcaccatgaatatcgaccgcaatattacgcacctgcaacactgtacatgcgtggacgactgtagctcctccaattgcctttgcggacagctgagtattcgatgttggtatgacaaggatggtaggctgcttcaagagttcaacaagattgaacctcccttaatctttgagtgtaaccaggcttgctcctgctggcgcaactgtaaaaaccgagtcgtgcagtctgggattaaagtgcggcttcagttgtaccgcaccgccaagatgggatggggggttagagcactgcagacaatccctcagggtacatttatttgcgaatacgtgggcgaacttatttcagatgcggaggctgacgttagggaggatgactcatatctgtttgacctggacaataaggacggcgaggtgtactgcattgacgccaggtactacggcaacatcagccgtttcatcaatcacctctgcgaccctaatataattcccgtccgagtcttcatgcttcaccaggatcttaggtttccccgtatagccttcttttcttcacgagatattcgcactggggaggaacttgggtttgattacggcgaccgcttctgggatatcaaaagtaagtatttcacatgtcagtgtggcagcgaaaaatgcaaacactctgccgaagccatagctctggaacaaagcaggcttgcacgcctggaccctcaccccgaactgctgccagagctcggttctttgccgccagtcaacacatag

SEQ ID NO: 222366 - DNA, 2667 bp, Artificial Sequence
  Description of Artificial Sequence: Synthetic coding sequence
tcagaagtggaggcactgaccgagcagctctccgaagaggaagaggaagaggaagaggaagaagaggaagaagaggaggaagaggaggaagaagaggaggaggaggacgaggagtctggcaatcaatctgacaggtcaggctcaagcggtcggagaaaagccaagaagaaatggcgaaaggattcaccgtgggtcaaaccatccagaaagcgtcgaaaacgcgaaccaccacgagccaaagaacctagaggcgtgagcaacgacacgagcagtcttgaaacagaacggggattcgaggaactccctttgtgcagctgcagaatggaagctcccaaaatagatcggatctctgagagagccggacacaaatgcatggcgacggaaagtgtggacggggagctcagcgggtgcaacgcggcaattctaaagagggaaacgatgcggccatcttctcgagtggccctcatggtactctgcgaaacacaccgggctcggatggtcaaacatcattgttgccctggttgcggatatttctgcacagcaggcacgttcctggaatgtcatccagacttccgggttgcacaccgattccacaaggcctgtgtgagtcagctgaatggcatggtgttctgccctcattgcggtgaggatgcttccgaggcccaggaggtcaccatccccaggggtgatggcgtcaccccgccagcaggcacagccgctccggcacctccaccactgagtcaagacgtccctggcagggctgacaccagccaacccagcgctcgcatgcgtggtcatggcgagccccgtcggcctccatgtgaccctctcgctgataccatcgattcatcaggtccaagcctcaccctaccgaacggcggttgccttagtgccgtgggactgcctctgggacctgggagagaagctttagagaaggccttggttattcaggaatccgagcgacgcaagaaactgcgctttcatccgaggcagctgtacctcagcgtgaagcagggcgaactgcagaaagtaatattaatgctcctcgataacctggaccccaatttccaatccgatcagcaatccaagagaacacctcttcatgccgctgcccagaaggggtccgtggagatctgtcatgtactgctacaggccggtgccaacatcaacgccgtggataagcagcagcggacaccgcttatggaagccgtggtcaacaaccatcttgaggtggctagatatatggttcaacggggtgggtgcgtgtattcgaaggaagaggacggaagtacttgtttacatcacgccgctaaaatagggaacctggaaatggttagtctattgcttagcacaggacaggttgacgtgaacgcacaagattccggtggctggacgcctatcatctgggcagccgaacacaagcatattgaggtgatccgcatgctgctgacgagaggcgctgacgtgaccctcaccgacaacgaagaaaacatctgtctccactgggcctcattcaccggttcggccgcaattgccgaagtgctcctcaacgccagatgcgacctgcatgcagtgaattatcatggcgacacgccgcttcacattgctgctcgagaatcatatcatgactgtgttctgttgttcctgagccgtggagccaacccagagttgcgcaataaggagggcgatactgcctgggacttgacgcctgaacgtagtgacgtgtggtttgcgctccagctgaacagaaagctgcggttgggcgtaggaaatagagcaattaggacagagaaaatcatctgcagagatgtagcgaggggttacgaaaacgttcccattccttgcgttaatggcgttgatggggaaccatgccctgaagattataaatatatatccgagaattgcgagacatctaccatgaatatagacagaaacatcacccacctccaacattgcacctgtgtcgatgattgttcgtctagcaattgcctctgcggccaactcagcattcgctgctggtatgataaagacgggcgtctgcttcaggagttcaacaagatagaacctccactgattttcgagtgcaatcaggcctgctcctgctggcgcaactgtaagaatagggtagtgcaatccggaataaaggtgagattacaattgtatagaacagcgaagatggggtggggagtcagagctttgcagaccattccacaaggcaccttcatctgtgagtacgtcggggagttaattagcgacgctgaggccgacgttagggaagacgattcgtatctgtttgacctggataacaaggacggtgaagtgtactgcatcgacgcacggtactatgggaacatcagcagatttattaatcacttatgcgacccgaatatcatacccgtgcgggtatttatgctccatcaggacctgagattcccgcgtatcgccttcttttctagccgtgatatccgcaccggcgaagagctggggtttgactacggcgacagattctgggacatcaagtccaaatatttcacatgtcagtgtgggagcgaaaaatgtaagcacagtgcggaagccattgcccttgaacagtcccggctcgcacgcctcgacccgcaccctgagctgctcccagagctggggtcccttccaccagttaatacctag

SEQ ID NO: 222367 - DNA, 3531 bp, Artificial Sequence
  Description of Artificial Sequence: Synthetic coding sequence
atggcagctgcagctggggcagcggcagctgccgcagcggagggggaggcaccggcagagatgggggctctcctgctagagaaagaaacacgcggtgccactgagcgggtccatggatctctgggcgacaccccacgcagcgaagaaaccctgcctaaggccaatccagactcgctggagcccgctggaccttcttcacctgctagcgtcacggtgaccgtgggggacgagggcgctgatacccctgttggtgccacacctttgataggggatgagtctgagaatctggagggagacggggatctcagaggtgggagaattcttttgggccatgcaaccaagagttttccgtcatcacccagcaaagggggatcctgcccctcccgcgctaagatgtcaatgactggcgctggcaagagtccgcctagcgtccagtctttggctatgcggttactttcaatgccaggggctcagggggctgcagctgcaggttccgaaccaccacctgccaccacgtctccggaggggcagccgaaagtgcaccgggcaagaaagaccatgtccaagcccggaaacgggcagccccctgtccctgaaaagcgccctcctgagattcagcattttcgtatgtcagatgatgttcactcattggggaaggttaccagtgacctcgccaagcggcgtaagcttaatagcggagggggactgagtgaagaacttggcagtgcacgaagatctggggaagtgacactcactaaaggggacccaggatccctagaagagtgggaaacagtggttggggatgactttagtctgtattatgactcctatagtgtggatgaaagggtcgacagcgatagtaagtccgaggtggaggctttaactgagcagctctcagaggaggaagaggaagaggaagaggaggaagaagaagaagaagaggaagaagaggaagaagaagaggaggaagatgaggagtctggaaatcagtctgacaggagcgggtcaagtgggagaagaaaagccaagaagaaatggcgcaaggatagtccttgggtaaaaccttcaaggaagcgaaggaagagagagccgcctcgagctaaagagcctagaggggtctctaatgacacctcttctctcgaaaccgagaggggctttgaggagctgccattatgctcctgtcgcatggaggcccctaaaatcgaccgaatctccgaacgtgccggacacaaatgtatggcaacggaaagcgtcgatggggagctgtcaggctgtaatgccgctattctgaagagagaaactatgcgtccctcatcacgggtcgcgctcatggttctctgtgaaacccacagggccagaatggtgaaacaccattgctgtccgggatgcggctacttctgcactgccggtacattcctggagtgtcacccggatttcagagtggcacatcggtttcacaaggcctgcgtgtctcaactaaatgggatggtgttctgccctcattgcggtgaagacgcttcggaagctcaggaagtcaccatcccccgtggcgatggggtgacgccaccggctggaacagctgcaccagctccgccaccactgtcccaggatgtccccggacgcgcagacacatctcagcccagtgccaggatgcgcggacatggagagcccaggcgtcccccttgcgatccactggccgatactatcgatagctcaggcccttccctcacactgccgaatgggggttgtttgtctgctgtgggcttacctctgggacccggaagagaggctctagaaaaggccttagtgatccaagagtcagagcggcgaaaaaaacttaggttccaccccagacagttatacttatcagtgaaacagggggagttacagaaagtgattcttatgctcctcgataaccttgatccaaactttcagtctgaccagcagagcaagaggacgccgctacatgcggctgcccagaaaggcagcgtcgagatttgtcatgtgctgctgcaggcaggcgctaatattaatgctgtggataagcagcagcggacccctctgatggaggccgtggttaacaaccacctggaggtggcccgatatatggttcagaggggagggtgcgtttacagcaaggaagaggatggatccacatgccttcatcatgcagctaaaatcggaaatctagagatggtcagtctcctgttgagcactggccaagtcgacgtcaacgcacaagactcgggaggttggaccccaattatttgggccgctgaacacaagcacatcgaggtgattagaatgctcctgactcgcggagcagatgttacactgactgataatgaagagaacatttgcttgcactgggcctccttcaccggcagcgctgctattgcagaagttctactgaacgcacggtgtgacctgcatgccgtcaactaccatggggatacacccctgcatatcgctgccagggaaagttaccatgactgcgtgctcctgttcctgtctcggggtgcaaaccctgagcttagaaataaggagggggacactgcctgggaccttacacccgagcggagcgatgtatggttcgccttacagctcaacaggaaactccgactaggagttggtaaccgcgctatccgtacagaaaaaatcatctgtagggatgtcgcaaggggttacgagaatgttcctatcccttgtgtgaacggagtggatggagagccctgcccagaagactataagtacatctccgagaactgtgagacgagcactatgaacattgatagaaatattacacatctgcagcattgtacatgcgtggacgattgcagctcctccaactgcctctgtggacaactatcgatcaggtgttggtacgacaaagacggcaggctgttacaagaattcaacaaaattgagccccctctgatttttgaatgcaatcaggcatgttcctgttggaggaactgcaaaaacagggtagtgcagagtggtatcaaagtaaggctgcagctctatcggacagccaaaatgggctggggtgttagagccctgcagacaataccccagggaacattcatttgtgaatatgtcggggagctcatctctgatgctgaggcagatgtgagagaagacgactcatatctgtttgacctagacaacaaggatggagaggtatactgtatagatgctaggtattatggcaacatctctcggttcatcaaccacctctgtgacccgaacattatccccgtgcgggtctttatgctgcaccaggatctgagatttccaagaatagcattcttctctagtcgggatataagaactggtgaagagcttggcttcgattacggtgacagattttgggacataaagtccaagtacttcacatgccagtgcggctctgagaaatgtaaacacagcgcagaagctatagcgttggaacagagtcgtctggcaaggctcgatcctcatcctgagctcctccctgagctggggtccctaccacctgtcaatacctag

SEQ ID NO: 222368 - DNA, 3096 bp, Artificial Sequence
  Description of Artificial Sequence: Synthetic coding sequence
agctgtcactgtacaccttcatggccccctgtgccggagaagagaccccctgagattcagcactttcgcatgtcggacgacgtgcacagccttggcaaggtgacctctgacctggcaaaaagaaggaagttaaactcgggaggcggacttagcgaggagctgggcagcgcccgaaggagtggcgaggtaacccttactaagggtgatcccggttcgctcgaggaatgggagactgtagttggcgatgacttcagtctttactatgacagctattctgtggacgaaagggtggacagcgactcaaaaagcgaagtggaagccttgacagaacaattaagcgaagaagaggaagaggaggaagaggaggaggaggaggaggaggaggaggaggaagaggaggaggaagaggaggatgaagagagtggcaaccaatccgatagatctggatcatcaggccgtaggaaggccaagaaaaagtggcgtaaagattctccttgggtcaagccgtccagaaaacgcagaaaacgtgagcctcctagggccaaagaacccagaggggttaacggcgtcggatcatctggccctagcgaatatatggaggttccacttggctctctcgagcttccaagcgaggggactctcagtcccaaccacgctggagtaagcaacgatacatcttcgttagagaccgaaaggggatttgaggagttgccattgtgctcctgccgtatggaagccccaaagatcgataggatttccgaaagggctggacacaaatgtatggccactgagtccgtggatggcgagctcagtgggtgtaacgccgcaatattgaagagggaaaccatgcgacctagtagccgcgtggccctaatggttctgtgcgaaacccaccgagcccgtatggtgaaacatcattgctgccccggttgcggctatttctgcactgcaggcacattcttggaatgccaccctgatttccgtgtcgcgcatcgctttcacaaagcgtgcgtcagccaactgaacggcatggtcttttgtccacattgcggagaggacgcatcagaggcccaggaagttacgatcccaaggggagacggggtgaccccccctgctggcactgccgctcccgcacccccaccactttcacaggacgtgccaggtagggccgatacatcccagcccagcgctcgaatgagagggcatggagaacccaggcgaccaccctgtgatccactcgctgacactatcgacagcagcggcccaagtctcacccttcccaatggaggctgtctgtccgccgtcggactgcccctcgggcctggtcgcgaagcactggaaaaagctctcgttatacaggaatctgaaagacgcaaaaaactgaggttccaccctcggcaactgtatctgtccgttaagcagggagaactccaaaaggtgatcctcatgttgctggataatctcgaccctaatttccagtccgaccaacagagcaagaggactccgcttcacgctgccgctcagaaagggtccgtagagatctgtcatgttctgctccaggcaggcgctaacatcaacgctgtggataaacaacaaagaacaccgctcatggaagctgtcgtgaataaccacctcgaagtggcacgttacatggtgcagagaggcggatgcgtttacagcaaggaagaggacggatcaacatgtctgcatcacgccgcaaaaataggcaacctcgagatggtctcattgctcctcagcacagggcaagtagatgtgaatgcccaagattctggaggttggacgccgattatttgggcggctgaacacaaacacatcgaagtgatccggatgttgctgacaagaggtgcagatgtgactctgactgacaacgttagcgagagattagtcgaggaggaaaatatctgtctgcactgggcctcttttaccggcagcgcggcaatcgctgaggttctgctcaacgcaagatgcgatctgcacgccgtgaattaccatggggacacacctctgcacattgcagcgagggaatcctatcacgactgtgtccttctctttctgtcacggggtgcaaatcccgaactgcggaataaggaaggcgacactgcctgggatctgacacctgagcgcagtgacgtgtggtttgccttacagctgaatcgcaaacttaggctgggcgtgggcaatcgagcaatccgtaccgagaaaataatctgccgggatgtggcgagaggttacgaaaacgtacctataccttgtgtaaatggggtggatggcgaaccctgcccagaggattacaaatacatcagcgaaaattgtgaaaccagcactatgaacatcgaccgaaacattacacacctgcaacactgcacctgtgtggacgactgttctagttccaactgcttgtgcggccagctgtccattcggtgctggtatgacaaggacgggaggctgctgcaggagttcaataagatcgagcccccactcatttttgaatgcaatcaggcttgtagttgctggagaaactgtaaaaatcgagtcgtacagagcggcattaaggttcgcttgcagttgtatcgaacagccaaaatgggatggggagtcagggcattacagacaattccccagggcacctttatctgtgagtatgtgggtgaactgatttctgacgcggaggccgatgtccgcgaagatgacagttacctctttgatctcgacaacaaagatggagaggtctattgcattgacgcacgctactatggcaatattagtcggttcatcaaccacctgtgtgacccgaacatcatccccgtgcgtgtgtttatgctccaccaagatcttaggtttccccgtatcgcctttttcagctctcgagatattcgcacgggcgaggaattagggttcgattacggggatcgattttgggatattaaatccaaatacttcacgtgtcagtgtggctcagaaaaatgcaaacattccgcagaagccatcgccctggagcaatcccgcctggccagacttgatcctcaccctgaactgcttcctgagctcggaagcttgccacccgtcaacacctag

SEQ ID NO: 222369 - DNA, 3702 bp, Artificial Sequence
  Description of Artificial Sequence: Synthetic coding sequence
atgcgaggactccccaggggaagggggctgatgcgggctcggggaagagggagggccgctccccctggcagtagagggagggggagagggggtcctcataggggccgaggtagaccacgtagtctgttgtctttaccaagggcacaagccagctggactcctcagttgtctacaggtctcaccagccctccagtcccttgcttaccatcccaaggcgaagcaccggcagagatgggcgctctgcttttggagaaggagactcggggagcaaccgagcgcgttcatggaagtctcggcgatactccacgcagcgaggagacattgccgaaagccacccctgacagcttagagcccgctgggccatcctcccccgctagtgtgacagtgaccgtgggagacgagggagcagacacccctgtgggtgctactccgctcatcggagacgagtctgagaatttagagggtgatggcgatttgagaggtggccgaatactattgggccacgccacaaagtcattcccatcctccccctcgaaaggtggaagctgtccctcccgtgccaaaatgagcatgaccggggctggtaaaagccccccttctgtgcaatctcttgcaatgaggctgctgtcaatgccgggagcccagggtgctgccgctgccggatccgagccgccacctgctacaacctcccccgagggccagcccaaggtgcaccgggctaggaagaccatgtcaaaacctggtaacggtcagcctcctgtccccgagaaacgccctcccgaaatccagcactttagaatgtcagatgacgtgcattccctgggcaaggtaacctctgatctcgctaagagacgaaaacttaatagtggaggtgggttgtccgaggaacttggttctgcacgcagatcgggggaggtgacccttaccaaaggcgatcccggttccttagaagaatgggagaccgtggtgggcgacgacttttctttgtactacgatagctactcggtggatgaacgtgttgacagtgatagtaaaagcgaagttgaagctttgactgagcagctgtccgaggaagaggaagaagaagaggaggaggaagaggaggaggaagaggaagaggaagaggaagaggaggaagaggacgaggagtccggcaaccaatcggatcgttccggaagcagcgggaggaggaaggctaaaaaaaagtggcgtaaagattccccctgggtgaaaccttctagaaaaagaaggaaacgcgaacctccccgtgccaaagagcccagaggcgtttccaatgacaccagctccttggaaacagagcggggtttcgaagaattgccactgtgttcttgtaggatggaagctccaaaaatcgatcgaatctctgaacgcgcaggccataagtgtatggcaaccgaatccgtggacggagaactgtccggctgcaatgccgctatcctcaaacgcgaaaccatgaggcccagctcaagggtagccctgatggtgctctgcgaaacacacagggcccgaatggtaaaacaccattgttgccccggttgcggttatttttgcactgcagggaccttcctggagtgccatccagacttcagggttgcccatagatttcacaaggcatgtgtgagccagcttaacggaatggtgttttgccctcactgcggcgaggatgcctctgaagctcaggaggtcacaatacctcgtggggacggcgtgacaccccctgcaggcaccgctgctcccgctccacctcccctaagccaggacgtaccaggacgggcagatactagccagccatctgcgaggatgcgaggccacggggagccacggagaccaccctgcgatccgttagccgacaccatcgacagcagtgggcctagcttaaccttgcccaacggtggatgtttaagcgccgtcggactgcccctcgggccaggcagagaggcactggagaaggccctggtcatccaggaaagtgaaaggaggaagaagctgcgtttccaccctcgtcagctttacctcagcgtcaaacagggagaactccagaaggtgatattaatgctccttgataatctggacccaaacttccagagcgaccagcagtcaaagagaaccccgctccacgccgctgcacagaaagggagtgtggagatctgccacgttctgctgcaggcaggtgctaacatcaacgccgtggataagcagcaaaggactccactaatggaagctgtggtgaacaatcatctggaggtggcacggtatatggttcagagaggcggttgcgtatattccaaagaggaggatggatctacctgtctgcaccatgccgctaaaattggaaatctggagatggtcagcctgcttttgagcactgggcaggttgacgtgaacgcgcaagacagcggaggttggactcctattatctgggctgccgagcacaagcacatcgaagtgatcagaatgttgcttacaaggggtgcggatgtgacgctgaccgacaacgaggaaaatatttgcttgcattgggcctccttcaccggaagcgctgcgattgctgaagtgctactcaacgccagatgtgacttacacgctgttaactatcatggcgacacaccgctacatatcgcagccagagaatcctaccatgactgcgttcttctgttcctgtctaggggcgcaaatcctgagttaaggaataaagaaggagacaccgcttgggacctgacgcccgagcgaagcgacgtgtggttcgctctgcagctgaaccgaaagctgcggctcggagttggcaatcgtgctattcgcacagagaagattatctgccgcgacgtcgccagaggatacgagaacgtgcctatcccatgtgtcaatggggtcgatggtgagccctgccctgaggactacaagtacatcagcgagaactgtgaaacctcaacaatgaacattgatcgtaatataacccacctgcagcactgcacctgtgtggatgattgttcctcctctaactgcctttgtggacaattgagcatccgatgctggtatgacaaagacgggaggttgcttcaagagttcaacaaaattgagccaccccttatatttgagtgtaatcaggcctgctcttgctggaggaactgcaaaaatcgcgtcgtgcaatctggcatcaaagttcgactgcaactttaccgaaccgcaaagatggggtggggggtgcgtgctctgcaaactattccacaggggacatttatctgtgaatatgttggagaattaatttcggacgccgaggccgatgtcagggaagacgattcttacctgtttgacctcgataacaaagacggtgaggtgtattgtatcgatgctaggtactacgggaatataagccgcttcatcaaccacctgtgtgacccaaacatcattcctgtgagagtgttcatgctccaccaggacttaaggtttcctcgcatcgcctttttttcaagtcgcgacattcgcacgggcgaggaactcgggttcgattacggggatcgcttttgggacattaaatccaaatacttcacttgccaatgcggttctgaaaaatgcaagcactcagctgaggcaatcgcacttgagcaatccaggcttgccagactcgacccccatccggaactcttacccgagttaggctccctccctccagttaacacgtag

SEQ ID NO: 222370 - DNA, 3804 bp, Artificial Sequence
  Description of Artificial Sequence: Synthetic coding sequence
atgcgcggtctacctcgcggtcgtggcctcatgagggctcggggaaggggcagggcagcacctcctggtagccgcggtcgagggcgtggagggccacacagaggacggggtcggcctaggagtttgctctcactccctagagcacaagccagctggacgcctcagctgtcgacaggcctgacttctcctcctgtgccttgcttgccatcacaaggtgaggcacccgcagagatgggggctctgttgctggagaaggagacccgcggagcaactgaaagagtccacgggtcgttgggagacacccctcgtagtgaggaaacactgcctaaggccaaccctgactcactggaaccggcaggaccatcgtcccccgcatcagtcacagtgaccgttggtgacgaaggagcagacactcctgtcggggcaacaccactcatcggggatgagagtgagaatctcgaaggtgacggggacctgcgcggtggtaggattttactagggcacgccacaaagtctttcccctcatccccgagtaaaggtggatcatgcccttcaagggctaaaatgtctatgactggggctggaaaatcaccccctagcgttcagagtttggctatgagattactgtctatgcctggagcccaaggtgcagctgccgctgggtctgagccacctcctgccacaacatctcctgaaggccagccaaaagtccatcgggcacggaaaaccatgtccaagcctggtaacggacaacctccagttccagaaaagagaccacccgagatacaacactttagaatgtcagatgatgttcacagcctgggaaaggtaaccagcgacctggcgaagaggagaaaattaaactccggtggaggtctctcggaggaattgggctctgcgcgtcggagcggcgaggtgaccctgaccaaaggtgacccaggatctttagaagaatgggaaactgttgttggagacgattttagcctctactatgacagttactctgtggacgagcgggtcgactccgattcaaagtcggaggtggaggctcttaccgagcaactctctgaggaggaggaggaagaagaggaagaggaggaagaggaggaggaggaggaagaggaagaggaggaggaagaggatgaagaatcgggcaatcaaagtgacaggtccggcagctcaggaagacgaaaggctaaaaaaaaatggaggaaggacagcccttgggtgaaacccagtcgcaagaggcggaaaagagaaccaccaagggccaaagaaccacgcggtgtaaatggcgtgggctctagtgggcctagcgaatacatggaggtgcccctggggagcctagaactcccgtccgaggggaccctgagtccgaatcacgctggagtgtcaaacgataccagctcactggaaacagaacggggatttgaggagcttccactgtgtagctgtagaatggaagcgcctaagattgatcgcattagcgagcgggctggccataaatgtatggcaaccgagtccgtggatggagagctgtccggctgtaacgctgcgatcctgaagagagagaccatgcgcccatctagccgcgtggccctcatggtgttgtgcgagactcaccgggctagaatggtaaagcaccattgctgtccaggttgtggatacttctgcactgcagggacatttctcgaatgccaccccgacttcagggtggctcaccgtttccacaaggcctgcgtctcccagctgaatgggatggttttttgccctcattgtggcgaggacgccagcgaagcccaggaggttactatacccagaggggacggagtcactcccccagcgggtaccgctgctccggctccccctcctctcagccaggatgtaccaggaagagccgacacctcacagcctagcgccaggatgcgaggccacggagagccacggagaccgccatgcgatcccctggcagacactatcgattccagcggtcccagccttacgctacctaacggcggttgcctcagcgccgttggcctgccacttggaccgggacgggaggctttggagaaagcactggtaattcaagagtcagagagaaggaagaaattaagattccaccccaggcagctctacctaagcgtcaagcagggcgagctgcagaaagtgattttgatgcttttggataacctggaccccaactttcagtcagaccagcaatccaaacggaccccattacatgctgcagcgcagaaaggttctgttgaaatttgccatgttctactgcaggccggagcgaacataaatgccgtcgataagcagcaacgcacaccgctaatggaagctgttgtgaacaaccacctggaagttgctagatacatggttcagcggggtggttgcgtatacagcaaggaggaagacggtagcacctgtctgcaccatgcagccaagatcggtaatttagagatggtctctctgttacttagtactggacaggtggacgtcaacgcccaggacagcgggggttggacccccatcatttgggctgccgaacacaaacacattgaggtcataagaatgttactcacacggggagcagatgtgaccctgactgataacgaggaaaacatctgtttgcactgggcttctttcaccggctctgcggctatcgcagaagtgctactgaacgccagatgcgatctgcatgccgtgaactatcatggggatacccccctccacatcgccgcaagggaatcatatcatgactgtgttctgctgttccttagtagaggcgctaatccggagctccgaaacaaggagggagacacagcttgggatttaacaccagagcgtagtgacgtgtggtttgctctgcagctgaataggaaactgaggctgggagtagggaacagggcgatccgcaccgaaaagattatatgccgtgatgtggctcgcggttatgaaaatgtgcctattccttgcgtgaatggagtggatggagaaccctgccccgaggactacaaatatatttcggaaaactgtgaaactagcacaatgaacattgacagaaacattactcacttgcagcattgtacatgcgtcgacgattgtagttcaagcaattgcctgtgcggtcaattatccattaggtgttggtacgacaaggatggccgactgttgcaggagttcaacaaaatcgagccaccactgattttcgagtgcaatcaggcctgctcatgttggagaaattgcaaaaaccgagtggtccagagcggaattaaggtgaggttgcagctctatcggaccgctaagatggggtggggtgtaagggcgttgcagaccatcccacagggcacattcatttgcgagtatgtgggggaactgatctctgacgcagaagccgatgtgagggaggacgattcttacttgtttgacctggacaacaaagacggagaggtgtattgcatcgacgctagatattacggcaacatttcgcgtttcatcaatcacttgtgcgatccaaatatcatcccagtgcgagtgttcatgctccaccaagaccttaggtttcccagaatcgcattcttttctagccgcgacattcggacgggcgaggagttaggctttgattatggcgaccgtttttgggacatcaaatcaaaatacttcacctgtcagtgtggctccgaaaaatgcaagcatagtgctgaggccatcgcactcgaacagagccgactagccaggctcgatccccatccggagctgctgccggaactcggttcactgccacctgttaatacttag

SEQ ID NO: 222371 - DNA, 897 bp, Artificial Sequence
  Description of Artificial Sequence: Synthetic coding sequence
taatcaaagaggacgcctctgcacgctgccgcacagaaagggtctgtggagatctgtcacgtactcctgcaggcaggcgctaatattaatgccgtagacaaacagcagaggactccgcttatggaggccgtggtaaacaaccacctggaggtggccaggtacatggtgcagcgcggtggttgtgtttacagtaaggaagaagacggatccacatgtctccatcacgctgctaaaattggcaaccttgagatggtttcactgctcctgagcaccggccaagtcgatgtgaatgcccagggtcagcttccccctccttccctgcccagccaccctcaggactctggcggttggactcccataatttgggctgcggaacacaagcacatcgaggtcatccgcatgcttctgacgagaggagccgatgtcaccctcactgacaacgaggagaacatttgcctacattgggctagcttcacaggctccgctgctatagccgaggtccttctgaatgcacggtgcgacctccacgcagtgaattaccacggggacacacctctgcacattgccgcaagggagagttatcacgactgtgtgctcctcttcctctcccggggagccaaccctgagcttagaaataaggaaggtgacacagcctgggacctcacacccgagaggtccgatgtttggttcgccctccaactgaataggaagctgcgtctcggggttggtaaccgagctattagaaccgaaaaaatcatatgtcgggatgtggcaagaggctacgaaaacgtcccgatcccctgcgtgaatggagtggacggcgagccatgccccgaagactataaatacatcagcgaaaattgcgagacctccaccatgaatatcgataggaactag

SEQ ID NO: 222372 - DNA, 897 bp, Artificial Sequence
  Description of Artificial Sequence: Synthetic coding sequence
tgaagcaagagaactccgctgcatgccgcagcgcaaaaagggtccgtggagatctgccacgtccttctgcaggcgggagccaacattaatgcagtggataagcagcagcggacaccattaatggaggccgtcgtgaacaaccatctcgaggtggctaggtacatggtccagcgcggtggctgcgtgtatagcaaggaggaagatggctccacttgtcttcaccacgctgccaaaatcggcaatttggaaatggtgtccctcctgctctcaactggccaagttgatgtaaatgcccagggacagctcccccctccgagcctcccctcccaccctcaggactccggtggatggacccccattatatgggccgcagagcacaagcatatagaggtaattaggatgctgcttactcgcggagccgatgtcacattgactgacaacgaggagaacatctgcctgcattgggcttcattcactggttcagctgctatcgcagaggtgctgttgaacgcccgatgtgacctgcatgcagtgaactaccatggagatacaccactgcatattgccgctcgcgagtcataccatgactgcgtgctgttattcctgtctcgaggtgctaaccccgaactgcggaacaaagaaggcgatactgcctgggatctgacaccggaaaggtcagatgtatggtttgctcttcaacttaatcgtaaactccgtttgggagtaggcaatagggccatcagaaccgagaaaattatttgcagagacgtcgcgagaggatatgaaaacgtgcctataccgtgtgtgaacggagtggacggggaaccttgccccgaggactataagtacatctctgaaaactgcgaaaccagcacaatgaatatagaccggaactag

SEQ ID NO: 222373 - DNA, 3633 bp, Artificial Sequence
  Description of Artificial Sequence: Synthetic coding sequence
atggccgctgccgctggcgctgcagccgcagccgctgctgaaggcgaagctcccgcagagatgggggcactcctccttgagaaggaaactagaggagctactgagagggtgcacgggagcctcggggacactccgagaagtgaggagacactgccaaaagcgacccctgactccctggaaccggcaggcccatcatccccggcaagcgtgacagttaccgttggcgatgagggagctgacacccccgtgggcgctacaccattgattggtgatgagagcgaaaacctcgagggggacggagacctccgtggtgggcgaatcctgttgggacacgcaaccaaatcctttccgtcctcaccctccaaggggggatcttgcccctcgagagccaagatgagcatgactggagcaggcaagtccccaccatccgtccagagtctggcaatgcgcctcctcagtatgcctggcgctcagggggctgctgccgctgggagtgaacccccaccagcaaccacaagcccagaggggcagcctaaggtgcatagggctaggaagacaatgagcaagccaggcaacggacaacccccagttcccgagaagaggcctccagaaatccagcacttccgcatgagcgacgatgtgcattccctggggaaggtgacgtccgatctcgcaaagcggcgaaagctgaacagcggtggtggattatccgaagaactgggctctgcacgacgttcgggcgaggtcactctgaccaaaggggatcctggcagcttggaagaatgggaaactgtagtgggcgatgacttttccctctattatgattcatatagtgtcgatgaacgtgttgatagcgactctaagagcgaagtcgaggccctcacagaacagctgagcgaagaagaggaagaagaggaggaggaggaggaggaagaggaagaagaagaagaagaggaggaggaggaggaagatgaggagagcggaaaccagtccgaccggtcaggatctagcggcaggcgaaaagctaagaagaaatggcgcaaggattctccttgggtgaagccttctcggaaacgcagaaagagggaaccaccacgcgcaaaggaaccaaggggagttaacggtgtggggtccagtgggccttctgagtacatggaggttcctttggggtctttagagttgccgtcagaagggacgctcagccctaaccacgctggagtgtcaaacgatacgagctccctcgagaccgaacggggttttgaggagttgcctttgtgctcttgtaggatggaggcccctaaaatagaccgcatatctgagcgcgctggacataaatgtatggcgacagagtccgtagatggcgagctgtcaggctgtaatgccgctattttgaagcgcgaaacaatgagacctagcagtcgtgtagcactgatggtactctgcgaaacacacagggcacgcatggtcaagcaccattgctgccccggttgcggatacttctgtacagcgggaacattcttagaatgccatcctgacttcagagtagctcatcggttccacaaagcatgcgtctcccaattgaatggcatggtcttttgtccacattgcggggaagatgcctccgaggcgcaggaggtgacgatcccacgcggtgatggtgtgacccccccagctgggacggctgccccagcaccccctccgctcagtcaggacgtgccaggtcgcgctgacaccagccagccatccgcgagaatgaggggtcatggtgagccgagaagacccccttgcgatcctcttgctgatacaatcgattcctcagggccttctttgactctgcctaacggcggttgcctgtctgctgtggggttgcccttgggcccaggtcgggaggctctcgagaaagcgttagtcatccaagagtctgagcgcaggaaaaaactgcgctttcacccaaggcagctgtacctgagcgtcaagcagggggaactgcaaaaagtcatcctgatgcttctcgataaccttgaccccaatttccagagtgaccaacagtctaagcggacacctctgcacgcggcagcacagaagggttctgtggagatctgtcatgttttactccaagcgggagccaatataaatgccgtagacaaacagcaacgcacccccctgatggaagcggttgtgaacaaccacctggaggtggcgagatacatggtccagagaggtggctgcgtttacagcaaggaggaggacgggtctacttgccttcaccatgcagccaagatcggtaatctggagatggtgagtcttttattgtctacggggcaggtggacgtcaacgcccaggacagtggaggctggaccccaatcatctgggccgctgagcataagcacattgaagttatccgcatgcttctgactaggggggcagatgtgactctgactgacaatgaggagaacatatgtttgcactgggcatcatttaccggcagtgcagctatcgcagaggtccttctcaacgccaggtgcgacttacacgctgtcaattaccacggtgacacaccacttcacattgctgcaagggagtcgtaccacgattgtgttctgcttttcctcagcaggggtgccaatccagagctgaggaacaaagaaggcgacacagcttgggatcttactcccgaacggtctgatgtctggttcgcccttcagctcaaccggaagctccggcttggggtcggcaacagagccattagaaccgaaaaaattatctgtcgggacgtggcacgagggtacgagaatgtaccaataccttgcgttaatggcgtggatggcgaaccctgcccagaggactataagtatatttcggagaactgtgaaacatcgacaatgaatattgacaggaacattacacatctgcagcactgcacctgcgtggatgattgtagctcgagtaactgcctgtgcggccaattatctatccgctgctggtatgataaggatggcagactgcttcaggaatttaacaagattgagcctcctctaatcttcgaatgtaaccaggcatgcagctgttggcgaaactgtaagaatcgtgtagtacagtctggcataaaggtacggctgcaactctataggaccgcaaaaatgggatggggggtgcgcgctctacagacaattcctcaggggacatttatatgtgaatacgtgggggagctcatctctgacgccgaagctgacgtgcgggaggacgacagttacttgtttgacctcgataacaaggacggggaagtgtactgcatcgatgcacgatactatgggaacatctcccgtttcatcaaccacctgtgtgaccccaacattatccctgtgagggttttcatgctgcatcaggatcttcgtttcccgaggattgcatttttttcttcgagggatatcagaacaggggaggagctgggcttcgattacggtgatcggttctgggacatcaaaagtaaatatttcacctgtcagtgcggatctgagaaatgcaagcacagcgccgaagctatcgcgctggaacagtcccggctagctcgcctggacccacacccagagctgttgccggagctaggctctctgccgccagtgaatacctag

SEQ ID NO: 222374 - DNA, 3531 bp, Artificial Sequence
  Description of Artificial Sequence: Synthetic coding sequence
atggcagcagccgctggcgctgctgccgcagccgcagcagagggcgaggcgcctgccgagatgggggcactcctgctggaaaaagagacgagaggcgctacggagagagtgcatggttctctgggggacacgccacgaagtgaggagacattgcctaaagcgacccccgactcactcgagcctgctggcccatctagtcctgcctccgtcactgttaccgtcggcgacgaaggggcagatacacctgtaggtgccacacccctgattggtgatgagagtgagaacctggaaggcgacggcgacttgaggggaggtaggatcctgctcgggcacgctacgaaatccttcccgtcttctcctagtaaggggggtagctgcccatcccgcgctaaaatgagtatgactggcgcaggaaagtcgcccccttcagtgcagagcctcgccatgaggttgttgtcgatgcccggtgctcaaggcgcagcagccgctgggtccgagcctccgcctgctactacttctcctgaaggccagccaaaagtgcacagggccagaaaaaccatgtcaaagccgggtaacggccaaccaccagttcccgaaaaacgccctcctgaaattcaacatttcaggatgtccgacgatgttcactctcttggcaaagtgactagtgacctggcaaaacgtcgtaaattgaatagcgggggagggttatctgaggagctgggaagcgccagacgatctggagaggtaacacttaccaagggagatcccggttctttggaagagtgggagacagtcgtcggggatgacttctctctgtattacgatagttatagcgtggatgagagagtcgacagtgactctaagtccgaggttgaagcgcttactgagcagctatccgaagaggaagaggaggaggaagaagaggaggaagaagaggaagaggaagaggaagaggaagaagaggaggaggatgaagaaagcgggaatcagagcgatcgctccggatccagcggcaggagaaaagcaaaaaagaagtggagaaaagattccccctgggtcaagcctagtcggaagagacgcaaaagggaacccccaagggcaaaagagccccgaggcgtcagtaatgacacatcatctttagaaaccgaaagaggctttgaggagctgccactgtgctcctgcagaatggaggctccaaaaattgaccgcatcagcgagcgtgccggacacaagtgcatggcaactgagagtgtggatggggaactgtccggatgcaatgctgcaatcttaaaaagagagaccatgcggcctagcagcagggtggctcttatggtgctctgcgagacccacagagccagaatggttaagcatcattgttgtcctggttgcggatacttctgtaccgcaggaaccttcctggagtgccacccagacttccgggttgctcatagattccacaaggcatgtgtgagccagctgaacgggatggtcttctgcccccactgtggtgaagacgcctctgaagctcaggaagtgactattccaagaggcgacggagtaacacctccagcaggaaccgcagccccagctccccctcccttaagtcaggacgtgcccggacgtgccgacacttcacagcccagcgcccgtatgcggggacatggtgagcctaggaggcctccttgcgatccactcgctgacacaatagactccagtgggccatccctcacattgcctaacggcggatgcttgtccgcagtggggcttccactgggtcctggtagagaggccctggaaaaggccctggtcatccaagagagcgaacggaggaagaaacttcggttccaccctcggcagctgtacctcagcgtgaaacagggagagctgcagaaggtgatactgatgctgttggataatctcgatccaaatttccagtccgatcagcagagcaaaagaaccccgctccacgccgcagctcagaaaggatctgtggagatctgccacgtgctgcttcaggctggagctaacatcaacgcggttgacaagcagcaacggaccccactgatggaggcggtagtcaacaatcatctagaagttgcgaggtacatggtgcagcggggtgggtgtgtatattccaaggaggaagatggttctacctgccttcaccacgctgctaaaatagggaacctggagatggtgagtctcttactctccacggggcaggtggatgtgaacgcacaggacagcggcggttggacaccaatcatctgggccgctgagcataagcacatagaggtaatcaggatgctgcttactcgcggagcagatgttacactgacagataacgaggagaacatctgccttcactgggcctctttcaccggctcagcagccattgccgaggtgctgttaaacgccagatgtgacttgcacgccgtgaactatcatggcgacactcccttgcatattgccgcaagagaaagctatcacgattgcgttctcctctttctctcccgcggtgcaaaccctgagcttaggaataaagaaggcgacacagcttgggatctcacgcccgaaagatctgacgtctggtttgccctgcaactgaacaggaaactgaggctgggcgtgggcaatagagccattagaaccgagaagatcatctgtagagacgtggccaggggctacgaaaacgtgcccattccatgtgtgaatggcgtggacggagagccatgtccagaagactataagtatatctctgagaattgcgagacctctacgatgaatattgatagaaacattactcatctccaacactgcacctgcgtggacgattgttcatccagtaactgcctttgtggacagctgtccatccgctgctggtatgataaagacgggagacttctgcaggagtttaataagatcgagcctcctttgatcttcgagtgcaaccaggcctgcagttgctggagaaactgtaaaaaccgggtggtgcaaagtggaatcaaggtgagactccaactgtaccggacggcgaagatgggctggggagtgcgggcactgcagacgattcctcaaggaacatttatctgcgaatacgtgggtgaactgatctccgacgctgaggcggatgtacgggaagacgactcttacctctttgatttggacaacaaagacggggaagtgtattgtatcgacgccagatactatggaaacatctcccgttttattaaccacctgtgcgaccctaacatcattcctgtccgcgtatttatgttgcaccaggatctgcgtttccctcgaatcgcttttttctcctcccgcgatattcggacaggtgaagaactcgggtttgactacggggatcgcttctgggatattaagagtaaatacttcacatgccaatgtggatcagagaagtgtaagcattcggctgaagccattgccttggagcagagcaggctggcccgtctcgaccctcacccagagctcctgccggaactgggttctctgccaccagtgaatacttag

SEQ ID NO: 222375 - DNA, 3702 bp, Artificial Sequence
  Description of Artificial Sequence: Synthetic coding sequence
atgagaggtctgccaaggggtagaggcctgatgagagctcgcggtaggggacgcgctgctcccccagggtctaggggtagaggccgaggcggacctcaccggggacgcggaagaccacgctcactgctgagccttccacgggcacaggcatcttggactccgcagctgtccacggggctgaccagccccccagtaccgtgtctgccttctcagggcgaagctcccgctgaaatgggcgcactgttgctggagaaggagacccgcggagcaaccgagcgcgtccatggttctctcggagatacaccaagatctgaggaaaccctgccgaaagcaaatcctgactccctggagccagccggtccaagtagcccagctagcgtaactgtgaccgttggggatgaaggagctgatacaccagtcggcgctaccccactcatcggcgacgagtccgagaacctggagggcgatggcgacttgcggggtggacggattttgctggggcatgcaacgaaatccttcccttcttcgccgagcaaagggggatcttgtcccagtcgggctaagatgagcatgaccggagcaggcaaaagcccaccatcggtccaatctcttgccatgcgcctgctgtccatgcccggagcacagggtgcagctgccgctggaagtgagccccctcctgcaaccacctcccctgagggccaacccaaggtgcacagagcacgtaagacaatgtctaagcccggtaatggccagccgccagttcctgagaaaagaccaccagagatacagcacttccgaatgtctgatgatgttcactccttggggaaggttacatctgaccttgcgaaaaggaggaagctgaatagtggcggaggtttgagtgaagaactaggcagcgccagacgctcaggggaggtgactttgactaagggggatccgggaagtctagaagagtgggagacagttgtgggagatgatttttctctatactacgattcctactccgtggatgaacgcgtggatagcgactcaaaatcagaggttgaggccctgacagagcagttgtctgaggaggaggaggaagaggaagaagaagaggaggaggaagaggaggaggaagaagaggaggaggaagaagaggacgaggaatccggcaatcaaagtgatcggtccgggtcatcagggcgacgtaaagctaagaagaagtggcggaaggattcaccatgggtgaagccttcccgtaaacggcgaaaacgagagcctccacgagctaaggagccacgcggagtgtccaacgatactagctctttggagaccgagaggggattcgaggagctgccgttatgctcttgtaggatggaggccccaaagattgaccggatctctgaacgggctggccacaagtgcatggcgaccgagagtgtcgacggcgaactgagcggctgcaacgctgcaattttgaagagggaaacaatgcggcctagctcgagagttgctttgatggttctgtgtgaaacgcacagggcgaggatggtcaagcaccactgctgccctggctgtggttatttttgtaccgccggtacttttttagaatgccatcctgactttcgggtcgctcatcggttccacaaggcatgcgtgagccagttgaacggcatggtcttttgcccacattgcggagaggatgccagtgaagcccaggaagtgaccattcctaggggagatggcgtgacacccccagctgggacggccgctccagcgccacccccactgagccaggatgtgccaggaagagctgacacatctcaaccctccgcaagaatgagagggcacggcgaacctcgaagacctccctgcgatcctcttgcagacacaattgacagtagtgggcctagcctgacattgccgaatggtggctgcctctccgccgtgggcttgcccctaggcccaggccgtgaagccctcgaaaaagcgcttgtaatccaggaatctgagcggagaaagaaactgcgatttcaccccaggcagctctacctctcagttaaacagggcgagctccagaaagtgatactgatgctcctggacaatctggatccgaatttccagagcgaccaacaatctaaaagaacaccactgcatgccgcagctcaaaagggcagtgtcgaaatctgtcacgtacttcttcaggctggtgcgaatataaacgctgtcgataagcaacagcgaacccctctgatggaggccgttgtgaataaccatctggaggtcgccaggtatatggttcagcgcggagggtgtgtgtacagcaaggaggaggacgggtccacgtgcctccaccacgctgcaaaaatcgggaacctggagatggtgtctctgctattgtcgaccgggcaagtcgatgttaatgcgcaggatagcgggggatggactcccatcatctgggccgcagaacacaagcacattgaggttatcagaatgctgctgacacggggagctgatgtgaccctcactgacaacgaggaaaatatttgcttgcattgggcatcatttactggatccgcagcgatagctgaagtcctgttaaacgccaggtgcgacctgcatgctgtgaattaccacggcgacacccccttgcacatagccgctagggagagttatcacgactgcgtgctacttttcctctcaaggggcgctaacccagagctgaggaataaggagggtgacaccgcatgggacctcacaccagaacggtctgacgtgtggtttgcacttcagctaaatagaaagttgaggcttggagtagggaatagggcaattcgcaccgagaaaatcatttgccgggatgtggccaggggctacgaaaatgtgcccataccctgtgtgaacggggtggatggggagccttgccccgaggactacaagtatatcagcgagaactgtgagacatcaacaatgaatatcgaccgcaacattacacacctccagcattgcacctgcgtagacgactgttctagtagcaattgcctgtgcggccagctatctataaggtgttggtatgacaaagacggacgtctgctgcaggagtttaataagatcgaaccccctctgatctttgagtgcaatcaagcctgttcctgttggcgtaattgtaagaatcgggtggtccagtccggcattaaagtaaggctacaactgtaccgcaccgcgaagatggggtggggggtgagggcgctgcagacaatcccccagggcactttcatttgtgagtacgtgggcgagctgattagcgatgcggaagctgacgtgcgcgaagacgactcgtacctgttcgatcttgacaataaggatggagaagtctactgtatcgatgccagatattacggcaacatctcacggtttataaatcacctctgcgatcccaatatcataccagtgcgggtgtttatgctgcaccaggacctgagattcccccgtatcgcgtttttcagctcccgggacatccggaccggcgaagagctggggttcgattacggagacaggttttgggacataaaaagcaagtactttacctgccaatgcggtagcgagaaatgtaaacactccgctgaggccatcgcacttgagcagtctcgactggcacggcttgacccgcacccagagctgttgcccgagttgggctccctcccgcctgtgaatacgtag

SEQ ID NO: 222376 - DNA, 897 bp, Artificial Sequence
  Description of Artificial Sequence: Synthetic coding sequence
taatctaaacgcactcccctacacgcagccgcacagaaggggtctgtggaaatatgccacgtgttgttacaggccggagccaacatcaacgccgtcgataaacagcaaaggaccccactgatggaggcagtcgttaacaaccatctggaagttgccaggtacatggtccagaggggaggatgcgtgtactcaaaggaagaggacgggagtacatgtctacaccatgccgcaaagattggaaatcttgaaatggtaagcctactgttgtcaaccgggcaagttgatgtcaatgcacagggtcagctcccccctccatccctgccatctcaccctcaagattcagggggatggaccccaatcatctgggctgcagagcacaaacacatcgaagtgatacgcatgctgctgacgcgcggtgctgacgttactctgacagataatgaagaaaatatctgcctgcactgggccagcttcactggttctgcagctattgccgaagttctgctcaacgcaagatgtgacctacacgccgtgaattaccacggggacacccctctgcatatcgccgctagagaatcctaccatgattgcgtgctcttattcttgtctcggggagcaaaccccgagttaaggaataaagaaggtgataccgcatgggacctgaccccggaaaggtccgatgtttggttcgcccttcagcttaacaggaagttaagactgggcgtcggaaatagagcaatccgtaccgagaaaatcatatgtagggacgtcgccagagggtatgagaacgtgcccattccctgcgtcaacggtgtggatggcgaaccatgtcctgaagattacaagtatatcagtgagaactgtgagacgagtaccatgaatatcgaccgtaattag

SEQ ID NO: 222377 - DNA, 3531 bp, Artificial Sequence
  Description of Artificial Sequence: Synthetic coding sequence
atggccgcagccgctggagccgcagccgcagctgccgctgagggcgaggctcctgctgaaatgggagccctgcttctggaaaaggagacccgcggtgccacagaacgcgtgcatggcagtctgggggatactcctcggagtgaagagactctgcccaaagccaaccccgatagccttgaacctgctgggcctagctcgccagcaagtgtcacagtgaccgtgggcgatgaaggtgccgacactccggtaggcgcaacccccctcataggtgatgagtccgagaaccttgagggtgatggagacctgagaggcggaaggatactgctgggtcatgcgaccaagtccttcccctcatccccatcgaagggcggaagctgccctagcagggcgaagatgagcatgacgggagcaggtaagagccctccaagtgtacagagcctggctatgcgcctactgtctatgcctggggctcagggtgcagccgcagccggttctgagccaccgccagcaacaacatcgccagagggacagcccaaagtacatcgcgcacgaaagactatgtcgaagcccggtaacgggcagccccctgtgcctgagaagcgtcccccagaaatccaacatttccgtatgagcgacgatgtgcactcgttaggaaaagtcacatctgacttagccaagaggcgtaagctcaattccgggggaggcttaagtgaagaactaggcagcgcccgtaggtccggcgaggtcactttgactaaaggcgacccagggtcgttggaagagtgggagacagtagtaggcgacgatttcagcctctattatgatagttactccgtggacgagagggtagatagcgattcgaagagtgaagtcgaggccctgaccgaacagttgtcggaggaggaagaggaagaggaagaagaagaggaggaggaagaagaagaggaggaggaggaggaggaggaagaagacgaggagagtggcaaccaatctgataggtctggctcatccggtagacggaaagccaagaagaagtggcgcaaggactccccctgggtgaaaccgtctagaaaacgcagaaagcgcgagccccctcgcgcaaaggaacctagaggcgtcagcaacgacactagttccttagaaacagagagaggatttgaggaattacccctgtgctcatgcagaatggaggcccctaaaatagataggatttccgagagggccggacacaaatgcatggctaccgaatctgttgacggtgagctctccggttgcaacgctgctatactgaagcgcgaaaccatgcggccaagcagcagagtcgcactgatggtgctctgtgaaactcatcgtgccagaatggtgaagcatcattgctgtcctggatgcggatacttttgtactgccggaacttttctagagtgtcaccctgactttcgcgtagcccaccgattccacaaggcttgcgtctcgcagctgaatggcatggtcttttgccctcactgcggagaagatgcttccgaggcccaagaggtcactattcctcgtggcgatggggtcactccaccggctggcactgctgccccagccccacctccactatctcaggatgtgccaggtagagccgatacatctcagccatccgctcggatgaggggacatggtgaaccccgacggccaccttgcgaccccttggcggatactattgattcgtccggtccatccctaacgctgcccaacggcggatgcctgtctgccgtggggttgcccttgggtccaggacgcgaagccttggagaaagctctagtcatccaggagagcgaaagacggaagaagctaaggttccatccacgccaactctacctgtctgtcaaacagggtgagctgcagaaggtgatccttatgctgcttgacaacctggacccgaatttccagagcgatcagcagagtaagcggactccactgcacgccgctgcccagaaagggtctgtggagatctgccatgtcctgctccaggccggagccaacattaatgccgtggacaagcaacagcggacaccccttatggaggccgtggtgaacaaccacctcgaagtggcacggtatatggtgcagcgcggaggctgtgtgtactccaaagaagaggacgggtccacatgcctccatcatgctgcaaaaataggcaacctagaaatggtgtcgcttctcctctctacgggccaggttgacgtgaatgcacaggattctggagggtggaccccgatcatttgggcggctgaacataagcatatagaggtgatccgtatgctccttactcgaggggctgatgtcacacttacggataatgaagaaaatatctgcctgcactgggcttcctttactggctccgctgccattgctgaggtcctcctcaatgccagatgcgacttacacgccgtgaactatcacggcgacacacctctgcacatcgccgcaagggagtcctatcatgactgtgttcttctctttttgtcacgtggcgcaaatccagaactgagaaacaaagaaggagatactgcctgggacctcactcccgaaagatctgatgtgtggttcgccctacaactgaataggaaactccgcttgggagtcgggaacagggccatacgcacagagaagataatctgtagagacgtggcccgaggctacgagaatgtgcccatcccctgtgtgaacggtgtggacggtgagccatgtccagaagattataagtacatttctgaaaactgtgaaacatctactatgaacatagacaggaatattacacatttacagcactgcacatgcgtggacgattgtagtagtagtaactgcttgtgtggtcagctctccataagatgttggtatgacaaggacggcaggctgctgcaggaattcaacaagatcgagccaccacttattttcgaatgcaaccaggcctgttcctgttggagaaattgtaaaaatcgcgtggtgcagagcgggattaaggtgcgcttgcagttgtacagaacagccaagatgggttggggcgttagggcactgcagactattccccagggcactttcatctgcgaatacgtgggtgagttgatctcagacgctgaggctgacgtacgcgaggatgactcctacctcttcgacctggacaacaaagatggtgaagtgtattgtattgacgctaggtattacggaaatatcagccggtttataaatcacctgtgcgacccaaacatcattccggtcagggtgtttatgctgcatcaggacttgcgatttcctaggatcgcattcttctccagtagagatataagaaccggggaagaattgggcttcgattacggtgaccgcttctgggatatcaagagcaaatactttacgtgtcagtgtggtagcgagaaatgcaaacactctgcagaggccatcgcccttgaacagtccagattagcccgtctggacccacatcccgaattgctgcctgaattggggagcctgccccctgtgaacacttag

SEQ ID NO: 222378 - DNA, 2667 bp, Artificial Sequence
  Description of Artificial Sequence: Synthetic coding sequence
agtgaggtggaagccttgaccgagcagttatccgaagaagaggaggaggaagaggaggaagaggaagaggaggaggaggaggaagaggaggaagaagaggaggaggatgaagagtctggcaaccaatctgacagaagcggatcttcaggcaggaggaaggccaagaagaagtggagaaaagactcgccctgggtgaaacccagcagaaagagaagaaaaagagagcctcccagagctaaggaaccacgcggagtcagtaacgacactagcagtttggagacagaaagggggttcgaggagttacctctttgttcttgcaggatggaggcgcctaaaatagatagaatttccgagcgagccggtcacaagtgcatggctacagagagtgttgacggagagctgtcaggatgcaacgccgctatcctgaagcgggaaacaatgagaccttcctcacgggtggccctcatggtgctgtgtgaaacacacagagccagaatggtcaagcaccattgttgccccggttgtggatacttttgcacagccggtacctttctggaatgccatcccgatttcagagtggcccatagattccacaaggcatgtgtctcacagctgaatggaatggtcttctgcccccactgcggggaagatgcgagtgaagcccaggaggtaaccatcccccgaggagacggcgtcacacccccagcaggtaccgctgccccagccccaccccctctgtcgcaggacgtccctggccgtgcggacacgagccaaccaagcgccaggatgagaggacacggagagcccaggagacccccatgcgaccccttggccgataccatcgatagcagcggacctagcctaacactgcctaacggaggatgtctgtctgcagtgggcttaccactgggccctggtagggaggcgctggaaaaagctttagtaattcaggagtcggagagaaggaagaaactgcgtttccaccccagacaattatacttaagtgtcaagcaaggggagctgcagaaggttatcctgatgctccttgataatttagacccaaattttcagagtgaccagcagtcaaaaaggaccccactgcacgctgctgcacagaagggctccgtggagatctgtcacgtgctgctgcaggcaggcgcaaacattaatgctgtggacaagcagcagcgcacaccgctaatggaggcggtggttaataatcatctggaggtggctcggtatatggtccagagaggcggatgcgtatattctaaagaagaagatgggtccacatgcctccaccacgccgctaagatcgggaacctggaaatggtgtcgctgctgctgtccacaggacaggtggacgtcaatgcgcaggattctgggggatggacccctatcatctgggcagcagagcacaaacacatcgaggtgatcaggatgctactgactagaggcgctgatgtcaccctcaccgacaacgaggaaaacatttgtctgcactgggccagctttaccgggtcagcagctattgcggaagtcctcctcaacgcaaggtgcgacctccatgctgtgaattaccatggagacaccccgctgcatatcgcagccagggagtcataccacgactgcgtccttcttttcctatcacggggtgccaaccctgaattacgtaataaggagggcgatacggcttgggacctgacccctgagagatctgacgtctggttcgctctccaactgaaccgcaagctgaggctgggggtcgggaacagggccatcaggacagaaaagatcatttgtcgtgatgtggcaagggggtacgaaaacgtcccaatcccctgcgttaatggtgtcgatggggagccttgcccggaggactataaatacatctctgagaactgtgaaacaagcaccatgaacatagaccgaaacatcactcatctgcagcattgtacgtgtgtggatgactgctcaagcagcaactgcttgtgtggacaactttctatcagatgttggtatgacaaggatggacggcttttgcaggagttcaataaaattgagccacccctgatttttgagtgtaatcaggcatgcagctgctggagaaattgcaaaaatcgggtcgtgcagtctggcatcaaagttcgactgcagctgtaccgcactgctaaaatgggttggggcgtgagggctctgcagacaattccccagggcactttcatttgtgagtacgtgggagaattgatctcagatgctgaggctgacgtccgcgaagatgactcctacctgttcgaccttgacaataaagatggcgaagtttactgtatagatgcccgatactacgggaacataagtcggtttattaaccacctgtgtgaccccaacatcatcccagtcagagtctttatgctccaccaggatctgaggtttccacgcattgctttcttcagttcacgggatatcaggacgggagaggagctagggtttgattatggagatcgcttctgggacataaaatcgaagtattttacatgtcagtgcggcagcgagaaatgtaagcattcagctgaggccatagccctcgagcagtctcgcctggcccgacttgaccctcaccccgagttgcttcccgagcttgggtcccttcctcccgtcaacacatag

SEQ ID NO: 222379 - DNA, 2769 bp, Artificial Sequence
  Description of Artificial Sequence: Synthetic coding sequence
agtgaggttgaggctctgacagagcagttatctgaagaagaagaagaagaagaagaagaggaggaggaggaagaggaggaggaggaagaggaggaagaggaagaagatgaagagagtggaaatcagagcgaccgctccggttcctctggccgtagaaaggcgaagaaaaaatggcgcaaggattctccctgggtaaagccatctcgaaaaaggcgtaagcgggagccccctagggccaaagagcccagaggggtcaacggagttgggagctcgggcccaagtgaatacatggaggttccactgggctcacttgaactcccgtccgaaggcacgctgagtcctaatcatgctggcgtgagcaacgacacaagctccctcgagacggaaagaggcttcgaagagctgcccctttgttcatgtcgaatggaagctcccaagattgataggatctctgagcgtgccggacacaaatgtatggctactgaaagcgtggatggggaactgtctggctgcaatgccgcaattttaaagagggaaaccatgagaccaagctcacgggtcgccctaatggtgctgtgtgagactcatagagctaggatggttaaacaccactgttgtcccggatgtggatacttttgcactgccggtaccttcctcgagtgccaccctgacttccgcgtagcccaccggttccataaggcttgtgttagtcagttaaacggtatggtgttctgccctcattgcggagaggatgccagcgaggcccaggaagttacaatccccaggggtgatggcgtgactccacccgctggtacagctgctccagcacctccacctcttagccaggacgttcccggaagggcggatacaagccagccgtcagcccgtatgcgcggtcatggtgagccacgacgtcccccttgcgatcctcttgcagacacaattgactcctccggcccttcccttactctcccgaatgggggatgtctgtccgcagtgggtctcccgttaggtcccggaagggaggcccttgagaaggccctggtgattcaggagagtgagaggaggaaaaagctcaggttccacccaaggcagctctacctgagtgtgaagcaaggcgagctgcagaaggtgatccttatgctgctggacaacctcgacccaaactttcagtccgaccagcagtctaagcggactccactccacgctgctgctcagaaaggctctgttgagatctgtcatgttttgctacaagcgggagctaacatcaacgcggtggataaacagcaacgcacacccctgatggaggcagtggtgaacaatcatctggaagtggccagatatatggttcagcgaggcggttgcgtgtattctaaagaggaagatgggagcacatgcctccatcatgctgccaaaatcggaaacttggaaatggtgtcacttctgctgtccaccggacaagtggatgtgaacgcccaggattcaggtggctggacacccatcatttgggctgctgagcataaacacatagaggtgataaggatgctcctgactcggggagcggatgtcactctcacagataatgaggaaaatatctgtctacattgggcgagttttactggttcagccgcaatcgccgaagttttgctgaacgccaggtgcgatctacatgcggttaactaccacggggacacccccctccacatcgctgcacgcgaaagctatcatgattgtgttttgctgttcctctctcggggagccaatccagaactacgtaacaaggagggcgataccgcctgggaccttacacccgagcgtagcgatgtgtggttcgccctgcaattgaatcggaaactccgtctcggagtcggaaaccgggctattcgcaccgagaaaatcatttgtagagatgtggcacgaggctacgagaacgtgcccattccctgtgtcaatggcgtggacggcgaaccgtgtcctgaagattataaatatattagtgaaaattgtgaaaccagcacaatgaacatcgaccggaatattactcatttgcagcactgtacatgcgtcgacgactgtagctcttccaattgtctgtgtggccagctgtctattagatgctggtacgacaaagacgggagactactgcaggaattcaacaagattgagcccccacttatctttgagtgtaaccaggcgtgcagctgctggcgcaattgcaagaacagagtcgtgcagtccggcatcaaagtgcggctgcagttgtatcgtacagccaaaatgggttggggcgtgcgggcattgcagacaatcccccaggggaccttcatctgtgagtacgtgggagaactcatatcggatgccgaggccgacgttcgggaagacgatagctacctgtttgatctagacaacaaagatggagaagtctactgtatagacgctagatattacggcaacatttcaagatttatcaatcatttgtgtgacccaaatattataccagttcgggtatttatgctccatcaggacctcagattccctcggattgccttcttctcctctcgagacatccgtacgggcgaagaattgggcttcgattacggagacaggttctgggacattaaatccaagtatttcacttgccagtgtggtagcgagaaatgcaaacactccgccgaagcaatcgcactggaacagtcaaggctggcgaggttggatcctcacccggagttactcccagaactcgggagcctaccgccagtcaacacatag

SEQ ID NO: 222380 - DNA, 3096 bp, Artificial Sequence
  Description of Artificial Sequence: Synthetic coding sequence
tcttgtcactgtacaccatctagaccacccgtgcctgagaagcgacctcctgagattcagcatttccgaatgtctgatgatgttcatagcttaggtaaggtgacaagtgacctggcaaagagaaggaaactgaattctggaggcggtttgtctgaggagctaggcagtgccagacgcagtggagaagtcactcttaccaagggtgacccagggtccttggaggaatgggaaacagtggtcggagacgacttttctttgtattatgatagctactcagtggatgagcgtgtggattccgactcaaagtctgaagtggaggccctcacagaacagctctccgaagaggaggaagaagaagaggaggaggaggaggaagaggaagaggaggaagaggaggaagaggaagaagaggacgaagagtcagggaatcagtcggatcgtagtggaagcagcggcaggagaaaagctaaaaaaaaatggaggaaggattcgccctgggtgaagcctagcaggaaacgacggaagcgcgagccccctagggcgaaggagcctaggggcgttaacggggttggcagcagcgggccatcagagtacatggaggttcctctgggctcactcgaactgccctccgaaggcacgttgagtcccaaccacgcgggagtatccaatgacacttcttccctagaaacagagcgtgggttcgaggagctgcccctgtgttcttgtagaatggaggcccctaaaatcgatcgaataagtgagagagccggacacaagtgtatggcgactgagtccgtggatggcgagctttcagggtgcaatgcggctattttgaagcgcgagacaatgcgtccttcctccagggtagctctgatggtcctgtgcgagacccaccgcgctcgcatggtcaaacatcactgttgcccgggttgtgggtatttttgcaccgctggaacattcctggagtgccatcctgattttcgcgttgcccataggttccataaagcatgtgtgagccagctgaacgggatggttttctgccctcactgcggagaggatgcttcggaggctcaggaggtgacaattcctaggggcgacggcgtcacgccccctgccggtacagccgcacccgctcctcctccactgtctcaggatgtgcctggcagagctgacaccagtcaaccatcagcacggatgcggggtcatggtgagcctaggcgtcccccatgcgacccactggctgacactattgatagctccggccctagccttacattaccaaatggaggatgtctatccgccgtgggcctgccccttggcccaggccgagaggcgctcgagaaagctctggtgatccaggaatccgagcggcgtaagaagctgcgtttccaccccaggcagctgtatctgtcagttaaacagggggaattgcagaaagtaattcttatgcttctggataatttagaccccaatttccagtctgaccaacaaagtaagcggacacctctgcacgctgcagcacagaaaggttctgtggagatctgtcacgtgctgctgcaagccggagccaacattaatgcagtggacaagcagcagagaacgccactcatggaggcagttgtgaataatcacctcgaggtggccaggtatatggttcagaggggaggatgcgtctacagcaaagaggaggacggttccacatgtctccaccatgcagcaaaaataggaaatctcgaaatggtgtccctgctcctctcaaccggccaggtcgacgtgaacgcccaagactcaggcggttggacgccaatcatttgggcagcggagcacaaacatattgaggtcatcagaatgttattgactaggggggcagatgtgaccctaactgacaatgttagcgaacgtctggtggaggaggagaatatctgcttacattgggcaagctttaccggatccgctgcgattgctgaagtgctgctaaacgccaggtgcgacctgcatgctgttaactaccatggtgacacgccactacatatcgcggctcgggaatcttatcatgactgcgtcctgttgttcttgtcccgaggcgcaaatccggagttaaggaataaagaaggtgacaccgcctgggacctcacgccagagcgtagcgatgtgtggttcgctctccaactaaatcgtaaactacggctgggtgtaggcaatcgtgccatccgcactgagaaaatcatttgccgggacgtcgcgagaggctatgaaaacgtgcccataccgtgtgtaaacggtgtggacggggagccttgtcccgaggattataaatatatatcggagaactgcgagacgagtacgatgaatatcgatagaaacattacacatctccagcactgtacctgtgtggatgattgcagctcaagtaattgcttgtgtgggcaactctctatacggtgttggtatgataaggatggcagacttctgcaagagttcaataagatcgagccaccactcatctttgagtgtaaccaagcttgttcgtgctggcgaaattgtaagaatagggtggtgcaaagcggaataaaggtccggttgcagctataccggacagccaagatggggtggggggtgagggcactccagacaatccctcagggaacattcatttgcgaatacgttggagagctgatcagtgatgctgaagccgacgttcgcgaagatgatagctacctttttgatctcgataacaaagacggtgaggtctactgcattgacgcccgatactatggtaacatatctcggttcattaatcatctgtgtgaccccaacatcatccccgtgagggtatttatgctgcaccaggatttgaggtttccgaggattgcttttttttctagccgagacatcagaactggggaagaactcgggtttgattacggtgataggttctgggacattaagagcaaatactttacttgccagtgcggttcggaaaaatgcaaacacagtgccgaagcgattgcactcgaacaatcaaggcttgctaggctcgatcctcaccctgagcttcttccggagctcgggtctctgccacctgtgaacacgtag

SEQ ID NO: 222381 - DNA, 3096 bp, Artificial Sequence
  Description of Artificial Sequence: Synthetic coding sequence
tcctgccactgtacacctagctggcctcctgtacccgagaaacgacctcctgaaatccagcacttcagaatgtccgatgatgtgcatagcctgggcaaggtgacgtccgatctcgctaagaggaggaagctcaactccgggggtgggcttagcgaagagcttggatccgcacggcgtagtggggaggtgacattgaccaaaggcgatccagggagcctggaagagtgggagactgtagtgggtgatgactttagcctatattatgacagctactccgtggatgagagagtcgactcggactctaagtcagaggtcgaggcactgaccgagcaactatcagaagaagaggaagaagaagaggaggaggaagaggaagaggaggaagaggaggaagaggaagaggaggaagaggatgaggaaagtggtaatcagagcgacaggtctggtagcagcggcaggaggaaggcgaagaagaagtggcgcaaagacagcccatgggtgaaaccatccagaaagaggcgcaaacgtgagccacctcgtgccaaagagccccgtggggtgaatggagtcggctcgagtggtccttcagaatacatggaagtgccactgggatcactggaactaccctctgaaggaacattatcaccaaaccatgccggagtatccaacgatacctcttccctagagacagagagaggctttgaagagctgccactgtgtagttgtcgtatggaggcccctaagattgataggatcagcgaacgcgcaggccacaaatgtatggccacagagtcggtggacggagagctgtctggttgtaacgccgctatactaaaacgcgaaactatgaggccatcatcaagagtggcgctgatggtgctgtgcgagacacatagagctaggatggttaagcaccattgttgtcctgggtgcggctacttctgtacagccggaacctttttagaatgccaccccgatttccgggtcgcacaccgttttcacaaggcttgtgtgagccaactcaatggaatggttttctgcccacactgcggggaggacgcttccgaggcccaggaagtcacaattccgagaggtgatggagtcactccccctgccggaacagcggcaccggcaccgcctccgctgagccaagacgtgccaggacgtgccgatacgtctcaacctagcgccaggatgagaggacacggcgaacctcgcaggccaccctgcgacccgttagccgacactatcgattctagcggcccttcactgaccctcccaaacggcggatgcctcagcgccgttggactgcccttggggccaggtcgcgaggccctagagaaagccctggtgatccaggagtccgaaagaagaaaaaaactcagatttcaccccagacagctgtatctgagcgtgaagcagggagagctacagaaggtgattctgatgctgcttgacaatctcgatcctaatttccagtctgaccagcaaagcaaacgcacccccctgcacgctgccgctcagaaggggtctgtggagatatgtcacgtgttactccaggccggagcaaacatcaacgcggttgacaagcagcaaaggacacccttgatggaggcggtggtgaataaccacctcgaggtggcccgatacatggtccagcgcggaggttgtgtttacagcaaagaggaagatggatccacatgccttcatcatgctgccaagatcggaaaccttgagatggtctcactcctgctgagtactggacaagtcgacgtaaatgcacaagactctgggggttggacaccgattatctgggctgccgagcacaagcatatcgaagtgattcgcatgttgctgactcggggtgccgatgtgacgttaaccgacaatgtctcggagaggctggtggaagaagaaaatatctgtctgcattgggcgtcattcacgggctctgccgcaattgccgaggtactgctcaatgctcggtgtgacctccacgcagtgaattaccacggcgacactcccctccatatcgccgctcgtgaatcctatcatgactgtgtccttctgttcctgtctcgaggcgcaaacccggaattgaggaacaaagagggtgataccgcctgggaccttacccccgaacgctccgacgtttggttcgcactacagctgaataggaagcttcggctgggtgtgggaaacagggcaatacgcactgagaaaatcatttgccgggacgtcgctagggggtatgagaatgtgcctatcccatgcgtgaatggagtagacggagaaccttgtcctgaagactataagtacatctcagagaattgtgagacatctacaatgaacattgatcgtaatatcacgcatctgcagcactgcacatgcgtcgacgactgctccagctccaactgcctgtgcggccagctgtctatcagatgttggtacgacaaggatgggaggctgctccaggagtttaataagattgaaccaccacttatctttgagtgcaaccaggcatgttcctgctggcggaattgtaagaatcgcgtggttcagtcaggcatcaaggtgagattacaactttataggacagccaagatgggatggggggtacgtgctttgcagaccatcccccaagggacctttatttgtgagtatgtcggtgaacttatctctgacgcggaagccgacgtgagggaagatgacagctacctattcgatctggacaataaggacggggaggtgtactgcatagatgctagatactatgggaatatcagccgattcattaatcatctatgtgaccccaatattattccggtgagagtgtttatgctccaccaggatctgcgatttccaaggattgccttcttctcctcccgtgatattcgcactggggaagaactgggctttgattatggggaccggttttgggacatcaagagtaagtatttcacttgccagtgcggctccgaaaagtgcaaacactctgccgaggccatcgcccttgagcagtctcggctggcaaggctcgaccctcaccccgaactcctgcccgagttgggcagcttaccccctgtcaacacctag

SEQ ID NO: 222382 - DNA, 3096 bp, Artificial Sequence
  Description of Artificial Sequence: Synthetic coding sequence
tcttgtcactgcactccatcatggccacccgttcctgaaaagaggccccctgagatccagcattttaggatgagtgacgatgttcactctctgggaaaggttacttctgacctggccaaaaggcgcaagttaaattctgggggtggtttgagcgaggagctgggctctgccagacgctcgggagaggtcacacttactaagggtgaccctggctctttagaggagtgggagacagtggtgggtgacgactttagcctgtactacgacagttattccgtggatgaacgagtagacagcgacagcaagagcgaagtagaggcgttgacggaacagctttccgaggaggaagaagaagaggaagaagaggaagaggaagaagaagaagaagaagaagaggaggaagaagaagaggatgaggagtccggcaatcagtcagaccggtccggctcatctggcagacggaaggcgaaaaagaagtggaggaaggattccccttgggtcaagccttcacggaaacgcaggaagagagaacctccacgggcaaaagagccacgaggggtgaacggagtgggatcgagtggcccatccgaatacatggaggtacctctgggctccctcgagcttcctagcgagggaactctgagccctaaccacgccggtgtatccaacgacacttcgtcgctggagacagaaagaggatttgaagaactgcccctttgctcctgtaggatggaggcccctaaaatagaccgaatttctgagagggcagggcacaagtgcatggcaaccgaaagtgtggatggagagcttagtggctgtaacgctgccattctcaaacgcgagacaatgcggccaagctcaagggttgcgctaatggtgctctgcgaaactcacagggcaagaatggtcaaacaccactgctgtccgggatgcggctatttctgcactgccggaacattcctggagtgccaccccgacttccgggtcgctcacagatttcacaaggcgtgcgtaagccagctaaatggaatggtgttctgcccacactgcggcgaggatgcgagcgaggctcaggaggtgaccattccacggggagacggggttactccgcctgctggcactgccgcacctgcccctccacctttgtcacaggacgtgcccggaagagccgacacatctcaaccgtcagcccgtatgagaggccacggagagcctagacgccctccgtgcgacccactcgctgacaccatcgacagttcagggcctagcctgacactacccaacggaggctgcctatccgcggtaggtttgccacttggtcccggtcgggaggctttggaaaaggccctcgtgatccaggaaagcgaacgccgtaaaaagcttagattccatccgagacagctgtatctgtctgtaaagcagggcgagttgcagaaggtgatcctgatgctactcgacaacttggaccccaacttccagtccgaccagcaatccaagagaacccccctgcacgctgccgcacagaagggcagtgtggaaatctgtcacgtactgctacaggccggtgcaaatattaacgccgttgacaagcagcaaagaacacccctcatggaggcagtggtcaacaatcacctggaggttgccagatatatggtgcaacgcggagggtgcgtttactcaaaggaggaagacggcagcacatgcctccatcatgcagccaagataggaaacctggagatggtgtcgttactcttatctaccggccaggtggacgtgaacgcacaggactctggcggatggacaccgattatatgggctgcggagcataagcatattgaggtgattcggatgctcctgactcgtggggctgatgtcacattgacagataacgtaagtgagaggcttgtcgaagaggagaacatatgtctgcactgggcgagcttcaccgggtctgccgctattgccgaggttctgttaaacgcccgttgcgatctgcatgcagtaaattaccacggggacacacctctgcacattgctgcacgagagagttaccacgattgcgttctgctgttcttgagccgcggagccaatccagaattacgcaacaaggaaggcgacacagcctgggatctgactcctgagagatcggacgtgtggtttgcactacagttgaatcgcaagttacgcctgggggtgggaaatcgggctatccggacggagaaaattatctgtagagacgtcgctcggggatacgagaacgtccccatcccttgtgttaacggcgttgacggagaaccctgtcccgaagactacaagtacatttctgaaaactgtgaaacctcaactatgaatattgaccggaacataactcatctccagcactgtacttgtgtagatgattgctccagctccaactgtctttgcggtcagttatcaattagatgttggtatgataaggatggaagactcctgcaggaatttaacaagatagaacccccacttatatttgagtgtaatcaggcatgctcctgctggcgcaactgtaagaaccgggtcgtccagagcggtataaaagtccgactgcagctgtacaggaccgcaaagatgggatggggcgttcgggctctgcagacaatccctcagggaacatttatttgcgaatacgtcggcgagctgatttctgatgcagaggctgatgtaagagaggatgattcttatctattcgacctggacaataaggatggtgaggtgtattgtatcgacgctagatactacggaaatatcagcaggtttattaaccatctttgtgaccctaacatcattcccgtgcgcgtgttcatgctgcaccaggatctgcggttccctcggatcgctttttttagctccagggacatcagaactggagaggagctcggatttgattacggcgaccgcttttgggacatcaagagcaaatatttcacctgtcagtgcggctccgaaaagtgcaagcacagtgcagaggccatagcgctcgaacaaagccgcttagccagactagatccgcacccagagctgctccctgagttgggatccctgccgccagtaaacacgtag

SEQ ID NO: 222383 - DNA, 3096 bp, Artificial Sequence
  Description of Artificial Sequence: Synthetic coding sequence
agctgtcactgcacaccatcccggcctcctgtgccggagaaacggcctcctgagatccagcactttaggatgtccgacgatgtccattccctgggcaaagtcacctcggatctggcaaagagaagaaagctgaatagcggaggaggtctcagcgaagagctcggtagtgccagaaggtccggcgaagtaacccttacaaaaggcgatccagggagcctcgaggagtgggagaccgtagtcggcgacgatttctcgctctattacgactcttattctgtggacgagcgggtggactccgatagcaagagtgaagttgaggcccttacggaacagctgagtgaggaggaagaagaagaggaagaagaggaagaggaagaggaagaagaagaggaagaagaagaagaggaggaggacgaagaatccggcaaccaatctgaccgttcagggagttctggacggaggaaagctaagaagaagtggaggaaggattcaccctgggtcaagccgtctcgcaagcgcagaaaacgcgaacctcccagagcgaaggagcctcgaggggtcaacggcgtgggctcctctggccctagtgagtatatggaggtgcctctcggctcattggagttaccatccgagggcactctcagtcctaatcacgctggcgtctccaacgacacctcatccctggaaacagagcggggatttgaagaacttcctttgtgctcttgtcgtatggaagctcctaagattgaccggatctccgagagggctggccacaagtgcatggccaccgagagtgtggacggcgaactatccggctgcaatgctgccatactgaagcgcgagacaatgcgcccttctagcagggttgcattgatggtcctgtgcgagacccacagggctcggatggttaaacatcactgttgcccgggatgcgggtatttctgtaccgcagggactttcctagaatgccaccccgactttcgggtggcgcacaggttccataaggcttgcgtgtcacagttaaatggaatggtattttgtccacattgtggagaggatgccagcgaagctcaggaggtgacaattcctcgaggggatggcgtcacacctcccgctggtactgctgcgccagctccaccaccattgagccaggatgtgcccggtcgagcagatactagtcagccatctgcgcgtatgagagggcacggcgaaccacggaggccgccatgcgatccactggcagacaccatcgattcctccggaccatctctgacacttccgaatggtggatgtctgtcggctgttgggctgcctctggggccaggacgcgaagccttagagaaggccttagtaatccaggaaagtgaaagaaggaagaagctgagatttcatccacgacagctatatctgtcggtaaaacagggcgaacttcaaaaagttatcttgatgctgctggacaatctggacccaaatttccagtcagaccagcaatcaaagagaacacccctccacgccgctgcacagaaaggatctgtcgaaatctgccatgtgctgctgcaggccggagccaacataaatgcagtagataagcagcagcggacgccattgatggaggcagtggttaataaccacctagaggtggcacggtacatggtccagcggggaggttgtgtgtatagcaaggaggaagacgggtcaacctgcttacatcatgcggcaaaaattggcaacctggagatggtctccttattactgtctactggacaagtggatgtcaacgctcaggacagcggtgggtggacccctattatttgggctgctgaacacaagcatatcgaagtgataaggatgctattaacgcgaggcgctgacgtgacactgactgacaacgtctcggagcggttggtggaggaggaaaatatctgtttacactgggctagctttacaggtagcgccgcaatcgcagaagtgctgctcaatgccagatgcgacttgcatgccgtgaactaccatggagatacacccttgcatatcgctgcgagagaatcctaccacgactgtgtgctgctgtttttatcccgtggcgctaacccagaactccggaacaaagagggcgacaccgcatgggatctcacaccagaaagatcagacgtctggtttgctcttcagttgaaccgaaaattacgcctcggggtcggcaatagagctatacgaactgagaagatcatttgcagggatgttgccaggggctacgaaaatgtcccgattccgtgcgtcaacggggttgatggtgagccatgcccagaagactataagtacatctccgagaattgcgagaccagtacaatgaacattgaccgtaatatcacccacctgcagcactgcacgtgtgtggacgactgtagctccagtaactgcctgtgcggccagctgagcattcgctgctggtacgataaagatgggaggctgctgcaggaattcaataaaatcgagccgcctttaattttcgagtgcaaccaggcctgcagttgctggagaaactgcaagaatagggtcgtgcagtccgggattaaggtcaggctccaactgtaccgcacagcaaagatgggctggggggtgcgggctctacagaccattccccagggaacctttatctgcgaatacgtgggtgagctcataagcgatgccgaagctgatgtgagagaagacgacagttacttattcgacttagataataaagatggggaggtctactgcattgacgcaaggtattacggcaatatttcacgttttatcaaccatttatgcgatcccaatatcattccagtcagggtttttatgctccatcaggacctgcgattcccgagaatcgccttcttcagcagtagggacatccgcaccggtgaagagctgggctttgactacggagaccgcttttgggatattaaaagcaagtattttacttgccaatgcggatccgaaaaatgtaaacatagcgcagaggccatcgcactggagcagtcccggttagcccgtctggacccacaccccgagctcctccctgagctggggagcctccctcctgtgaatacttag

SEQ ID NO: 222384 - DNA, 3096 bp, Artificial Sequence
  Description of Artificial Sequence: Synthetic coding sequence
tcgtgccattgcactccaagctggccacctgttccagagaaacggcctccggaaatccaacactttagaatgagcgatgacgtgcatagcctgggaaaagtgacctctgatctggccaaaagacgcaagctgaatagtggcggaggactgtccgaggaactgggttccgcaagacggagtggagaagtaacccttaccaagggggatcctggcagcttggaagaatgggaaacagtggtgggcgacgactttagcctgtattacgattcttactctgtagacgagcgcgtcgactccgactctaagagtgaggtagaagccttgacagaacagttgagcgaagaagaagaagaagaggaggaggaagaggaggaggaagaagaggaagaagaagaagaagaggaggaagaggacgaggagtccggcaaccagagtgatcggtctgggtcaagtggcaggcgcaaagccaagaagaagtggcggaaggattcaccatgggttaaacccagcagaaaaaggcgcaagcgggagccaccccgagcaaaagagccaagaggtgtcaacggcgtgggcagctctggtccttcagagtatatggaagtccctttgggcagcttggaacttccctcggaggggaccctgagtccaaaccacgccggagttagtaacgataccagctccctggagaccgagcgaggattcgaagagcttcctctatgttcctgtaggatggaggctccgaaaatcgaccgaatttcggaaagagcgggacataagtgcatggctacagagagtgttgacggggagctgagcggatgcaatgccgcaatcctgaagagagagacaatgaggccttctagccgtgtagcgctaatggttttgtgcgagacacatcgggcaaggatggtcaaacatcactgctgtcctggttgcggatacttctgtacagccggaacatttcttgaatgtcaccccgacttccgggtggcccacaggtttcacaaagcgtgtgtctcccagctgaatgggatggtgttctgtcctcattgcggagaagatgctagtgaggcacaagaagtcacaatccccagaggcgatggggtgactcctccagccggaacggctgctcccgctccacctccactaagccaggacgtccctggcagggctgacacatctcaaccaagcgcccgtatgcgaggacatggcgagccaaggcggcctccctgcgatcccctggctgataccatagattccagcggcccatcacttactttgcctaatggcggatgcttgagcgctgtggggctgcccctgggcccaggaagggaggccctggaaaaggcactggtgattcaggagtccgagaggcgcaagaaactccggttccatcctaggcagctgtatctcagcgttaaacagggggagttgcagaaagtaatccttatgttgcttgataatctagaccctaacttccagagtgatcagcagagtaagcgcacacccctccatgctgccgcacaaaaggggagcgtggaaatttgccacgtccttctgcaagcgggtgctaacataaacgccgtggataaacaacagcgaactcccctaatggaagctgttgtgaacaatcacctagaggtggcgagatacatggtccaaaggggcggatgtgtgtattcgaaagaggaggatggcagcacctgtctgcaccacgccgctaaaatcggcaatctggagatggtttccctactgcttagtacgggtcaggttgacgtgaacgctcaggactctgggggatggacaccgattatctgggccgcagaacacaaacacattgaggtcatcaggatgttgctgaccagaggggctgatgttacattaaccgataacgtgagcgaaagactggtggaagaggagaacatttgcctccattgggcttctttcacaggctctgccgcaatcgcagaggtcctgctgaacgccaggtgtgaccttcacgccgtaaactaccatggagacacgcctctgcatattgctgccagagagtcttatcacgactgtgtgctactctttttgtcaaggggtgccaatcctgagctccgaaataaggaaggtgacactgcctgggacctaactccagagagatcagatgtgtggttcgccctgcagctcaacaggaaacttaggctcggggtgggcaatcgagctatccgcacagagaaaatcatctgcagagatgtggccagaggatacgagaatgtacccataccatgtgtgaacggtgtggatggggagccctgccccgaagattacaagtatatctccgaaaattgtgaaactagcaccatgaatatcgacaggaacatcacccacttacagcactgtacctgtgtggacgactgcagctctagcaattgtctttgtggacagctgtccatccgctgttggtacgacaaggatggcaggctgctgcaagagtttaataagattgagcccccactcatttttgagtgtaatcaggcctgcagctgttggcgcaactgtaaaaatagggtcgtccaatctggcattaaggtaaggctgcagctttaccggacggcaaagatgggatggggagtcagggcccttcaaacgattccccagggcaccttcatctgcgagtatgttggcgagcttataagcgacgccgaggccgatgttagggaagacgacagttatctgttcgacctagataacaaggatggagaggtgtattgcatcgatgcacgatattatgggaacatttcacgcttcatcaatcatctatgtgatcctaacatcattcccgtgagagtatttatgctgcaccaggacctgcgcttccctaggatcgcgttcttttcctcccgcgatattagaaccggagaggagctgggcttcgactacggcgaccgtttttgggatataaagtctaaatacttcacatgccagtgtggcagtgagaaatgtaagcacagtgctgaagccattgccctggaacaaagtcgcctggctcggctggacccccaccccgagctgctccctgagctgggtagcctgcctcccgtcaatacatag

SEQ ID NO: 222385 - DNA, 2178 bp, Artificial Sequence
  Description of Artificial Sequence: Synthetic coding sequence
atggcagatgaagacctgatttttagattggagggtgtggatggaggccagagccctagagccggacatgatggagactccgacggcgattctgatgacgaggaggggtatttcatttgtcctataactgatgatccaagcagtaaccagaatgttaactccaaggtgaacaagtattattccaacttgaccaaatcagagcggtacagtagtagtggttcacccgctaatagctttcactttaaggaagcatggaagcatgctatccagaaggccaaacatatgccggacccctgggcagaattccacctcgaggacatcgccactgagagagcaacaaggcatcgctataatgccgtgactggggagtggctggacgatgaagtcctgataaaaatggcttcacaaccttttggaaggggcgctatgcgcgaatgttttcggacaaagaagctgtcaaattttttgcatgctcagcagtggaagggtgccagcaactacgtagccaagcgatacatcgagcctgtggatcgcgacgtgtactttgaggatgttaggctgcagatggaggcaaagctgtggggagaggagtacaatcggcataaaccaccaaaacaggttgacatcatgcagatgtgtatcatcgagttaaaagatagacctggcaaacccctcttccacctcgagcattatatcgaaggaaagtatataaagtacaacagcaactcgggctttgtacgagacgacaatatccggttgacaccccaggcgttctcccactttacgttcgaaagaagtgggcaccagctcatagtagtcgacatccagggtgtaggggatctctacactgatcctcagatacacaccgaaacaggcactgacttcggcgatggtaacttgggggtgaggggtatggctctcttcttttacagtcacgcttgtaatagaatctgcgagtcgatgggactggctccctttgacctttctcccagggagagagatgccgtcaatcaaaacacgaagcttctgcagtcagccaaaaccatcctccgtggtacagaggaaaaatgtggctccccacaggtgcgcactctcagtgggagcagaccccctctgctccggcctctctctgagaattcaggagatgaaaacatgtctgatgtgacatttgactctctgccatctagtccatcctcagcgacacctcactcacagaagctagaccacctgcactggccagtattctccgacctagacaatatggcgtctagggatcatgaccacctagataatcatagggaatcggaaaactccggtgacagtggctatccttccgagaaacgaggcgaactagatgaccccgagccgagagagcatggccactcttactcgaacaggaagtacgaatctgatgaagattcactgggctcaagtgggcgagtctgtgtggagaagtggaatctgctgaacagtagcagattgcatctgcctagagcttctgctgtggctctcgaggtgcagagactgaacgccttggacctggagaaaaaaataggaaagtccattcttggaaaggtgcaccttgcaatggtgcgttaccatgagggtggacgattttgcgaaaaaggcgaggaatgggaccaggaatcagcagtgtttcacttagaacatgccgctaatctaggcgaactcgaggcgattgtgggacttgggcttatgtactcccaattgcctcaccacatccttgccgatgtttcccttaaggagacggaggagaataaaacaaaagggttcgattatctgctcaaggcagccgaagcaggggacaggcaatccatgatacttgtggcaagagccttcgactccggacagaatttgtctcccgatagatgtcaggattggcttgaagcactccattggtataatactgcactggaaatgaccgactgtgacgaaggcggtgaatacgatggcatgcaagacgaacctcgatatatgatgcttgccagggaggcagagatgctcttcaccggcggatacggtttggaaaaggacccccagaggagcggcgatctgtatactcaggcggcagaggcagctatggaggcaatgaaaggcaggctcgcgaatcaatactaccagaaagccgaggaagcttgggctcaaatggaggagtag

SEQ ID NO: 222386 - DNA, 1389 bp, Artificial Sequence
  Description of Artificial Sequence: Synthetic coding sequence
atgggaaaggaaaagacacacatcaatatcgtcgtcatcggccatgttgactcagggaagtcaaccactactgggcacctcatctacaaatgtgggggtatcgataaacgtaccattgaaaaattcgaaaaagaggccgctgaaatgggcaaaggcagctttaagtatgcctgggtgctggataaacttaaggctgagcgggagcggggaatcactattgacataagcctatggaagtttgagacttcgaagtattacgtcacgataattgatgcaccgggacacagggactttataaagaatatgataacaggaacttcccaggcagattgcgccgtgttaattgtggctgccggagtgggggaatttgaagctggcatctccaagaatggacagacgagagaacatgctctgctagcttataccctcggggtgaagcaactaatcgtcggggtgaacaagatggacagcactgaaccaccttatagccagaagaggtacgaagaaatcgtgaaagaagtgtctacttatatcaagaaaatcggatacaatccagacaccgtagcattcgttcccatctctggctggaatggggacaacatgctagaaccatcggccaacatgccttggtttaaagggtggaaagtgacacggaaggatgggaatgcttccggcacaactctccttgaggccctcgactgtatactacctccgaccagaccaacagataagccacttaggctccccctacaagacgtgtataagatcggtggaatcgggacagtccctgtaggccgtgtcgaaacaggggtcctgaagccaggaatggtcgtgacgtttgcccctgtgaacgtcactactgaagtgaagagtgtagagatgcaccacgaagctctgagtgaagccctccccggtgacaatgtaggctttaatgtgaagaatgtgtctgtaaaggacgtaaggcgcggtaacgttgcaggcgacagtaagaacgatccccctatggaagccgctgggttcactgcccaggtgatcatccttaatcatcccggacagatctccgccggttatgctcctgttctggattgtcatactgctcatatcgcatgtaagtttgctgagctcaaagagaagatcgaccgcagatcaggcaagaagttggaggacggccctaaattcttgaagtctggtgatgctgctattgtggacatggttcctgggaaaccaatgtgcgtcgaatcctttagcgattacccccctttagggcgatttgcagtccgcgacatgcgccagactgttgctgttggagttattaaagcagttgataagaaggcagccggtgcaggtaaagtgaccaagagcgcccaaaaggcacagaaggctaaatag

SEQ ID NO: 222387 - DNA, 1389 bp, Artificial Sequence
  Description of Artificial Sequence: Synthetic coding sequence
atgggtaaagaaaagacccatatcaacatcgtcgtaatcggacatgtcgatagcggtaagagcacgacaaccggtcacctgatatacaagtgtgggggaatcgataagaggacgattgagaaattcgaaaaggaggctgcagagatgggcaagggctcatttaaatacgcctgggtgctggataagctgaaggccgagcgggagcgcggtatcacaatcgacatctctctttggaaatttgaaacatccaagtactatgtgactatcatagatgcacccggacatagagacttcatcaagaacatgattaccggtacaagccaagctgactgtgcagtcttaatcgtagcagcaggtgttggagagttcgaggccggaataagtaagaatgggcagacaagagagcatgctctccttgcctacaccctgggtgttaaacagctcattgtgggtgtgaataagatggattcaacggagcccccttacagtcagaagaggtacgaggagatcgttaaagaagtgagtacttatataaaaaagataggctataatcccgacacagtggcatttgtgcccattagcggatggaatggggataacatgttagaaccttccgcgaacatgccttggttcaagggatggaaggtgaccagaaaggacggaaacgcatctggaactactctacttgaggccctggactgtatactcccacccaccagacccaccgacaagcccttacgtctccctctccaggatgtctacaaaattggtggaattggcaccgtaccagtgggtcgggtggaaactggtgtgctgaagcccggaatggtagtgacattcgctcctgtgaacgtcacaacagaggtgaagtccgtggaaatgcaccatgaggcgctgagcgaagctctgccaggggacaatgttggcttcaacgtcaagaatgtgagcgttaaggacgtgcgccgagggaacgttgctggcgattctaagaatgatcctcccatggaagcagctggctttaccgcccaggtcattatcctgaaccaccctggccaaattagcgcagggtatgcacccgtgttagattgccatacagcgcacatcgcctgtaagtttgctgagcttaaggagaaaatcgataggcggtccggcaaaaagctggaagatggacctaagttcttaaagtcgggagacgctgccatcgtggacatggtgcccggaaaaccaatgtgcgtggaatcattttccgactatcccccacttggtaggtttgcggtgagagatatgcgccagacggtcgcggtcggagtcatcaaagctgtcgataaaaaagctgccggagccggtaaggtgaccaagtctgcccagaaggcacaaaaagccaagtag

SEQ ID NO: 222388 - DNA, 1389 bp, Artificial Sequence
  Description of Artificial Sequence: Synthetic coding sequence
atgggaaaagaaaaaactcatatcaatattgtcgtaatcgggcatgttgattccggcaaaagcactactaccggtcacctaatatataaatgtggtggtatcgacaaaaggaccatcgaaaagttcgagaaagaagcggcagaaatgggcaagggttcttttaagtacgcctgggtactggataaattaaaagctgagagagaaaggggtattactatcgatatttcattatggaagttcgagacttctaagtattatgtgacaatcatagatgccccaggccaccgagatttcataaagaacatgatcaccggcacgagtcaggctgactgcgctgtgctgatagtcgccgcaggtgtcggcgaattcgaggctggcatcagcaagaatggccagacgagggaacacgccctcttggcatacacactgggcgtcaaacaactgatcgtgggcgtgaataaaatggattccacagagccaccctattcccagaaaagatacgaggagatcgtcaaggaagtatctacatacataaaaaagattggctacaaccctgatacagtggcatttgtgcctatctctgggtggaacggcgataacatgctggaaccttctgccaatatgccttggttcaaagggtggaaggtcactaggaaagacggaaacgcttctggaactacactgctcgaggcactggactgtatcctcccccctactaggccgacagataaacccttgcgcctccctttgcaggacgtgtataagatcgggggtattggaaccgtgcctgttggcagagttgagaccggcgtcctgaagcccggaatggtggtgacattcgcgcctgtcaacgtaactactgaggttaaatcagtggagatgcatcacgaggccctgtccgaggccctacctggtgacaatgtgggcttcaatgtgaagaacgtgtccgtcaaagatgtgcggagagggaacgtagccggagattcaaagaacgaccctccaatggaggccgctggatttaccgcccaggtgatcattttgaaccacccaggacaaatctccgccggttatgcccctgtacttgattgccatacagcccacatagcatgcaagtttgccgagcttaaagagaaaatagatagacggagcggtaagaaacttgaggatgggccaaagttcctcaaatcgggtgacgccgctatcgtagatatggtgcccggtaagcctatgtgcgttgaatccttttccgattatcctccactcggaaggtttgcagttagagatatgaggcaaaccgtagcagtcggggtcataaaagctgtggataagaaggctgcgggagcaggcaaggtgactaagagtgcacagaaagcacagaaggccaagtag

SEQ ID NO: 222389 - DNA, 438 bp, Artificial Sequence
  Description of Artificial Sequence: Synthetic coding sequence
atgggcaaagaaaaaacacatatcaatatcgtggttataggacatgtggacagcggcaagtctacaacgactggtcacttaatctataaatgcggtggtattgataagcgaaccatcgagaagttcgaaaaggaagctgccgagatgggcaaaggatcgttcaaatacgcatgggtcctggacaaactgaaagctgaaagggaacgagggatcactatcgacataagcctgtggaagtttgaaaccagcaaatactatgttaccattattgatgctcccggtcatagagacttcatcaagaatatgattactggaaccagccaggccgattgtgccgttctgatcgttgcggcaggagttggagagttcgaggcagggatttcgaagaacgggcagactcgcgagcacgcattgctagcctatactctgggggtctag

SEQ ID NO: 222390 - DNA, 1281 bp, Artificial Sequence
  Description of Artificial Sequence: Synthetic coding sequence
atgggtaaggagaagacacacatcaacattgtcgtgatcgggcatgtggatagtgggaagtcaacaacaacagggcacctcatatacaaatgtggcggaatcgataagaggacaatcgagaaattcgagaaagaagcggcagagatggggaagggaagctttaaatacgcctgggtattggacaagcttaaagccgaaagagagcgtggcatcacgattgacatttcgctctggaaatttgaaacgtcaaaatattatgtgaccatcatcgatgcccctgggcaccgtgactttatcaaaaacatgattaccggcaccagccaggccgactgcgcagtgcttatcgtagcagccggagtgggtgagttcgaagccggtatctcgaagaatggtcagacacgggagcatgcccttctggcatacaccctgggcgtgaaacagttaatcgtaggcgtgaataaaatggactcgactgagcccccatattctcagaagcggtatgaggagatcgtcaaggaggtctccacctatatcaaaaagatcggttacaacccagatactgtagccttcgtcccgatcagtggctggaacggagataatatgttagagcccagtgccaatatgccatggttcaaggggtggaaagtcactcggaaggacggaaatgcttctggaaccaccctgttggaggcattggactgcatattaccacctactcgccctacagacaaaccccttcgcctgccactgcaagatgtctacaagatagggggtattggaaccgtccccgtacctagcggagattggtgttcccctggaatggttgtgacgttcgcaccggttaatgtaaccactgaggtcaaatctgtggaaatgcaccacgaagctcttagtgaggccctcccaggcgataatgttggcttcaacgtcaagaatgtaagcgtgaaggatgtgagacgcggaaatgtagctggcgactctaagaatgacccccctatggaagccgcaggcttcactgcgcaggtgattatcctgaaccatccgggacagatatcagccggatatgctcccgtactggactgtcacaccgcccacatagcctgcaaattcgctgagttgaaggaaaagattgatcggagaagtggcaagaagctggaggatggcccaaagttccttaaatccggtgacgccgcaattgttgacatggtccccggaaagcccatgtgtgtggagagcttttccgattacccacctcttgggaaaagtttatgttgttcctag

SEQ ID NO: 222391 - DNA, 1326 bp, Artificial Sequence
  Description of Artificial Sequence: Synthetic coding sequence
atgggtaaagagaagactcacatcaacatcgtggtcatcggtcatgtggactctggcaagtctacgaccaccggccacttaatatacaagtgcggtggcatagataagcgcaccattgaaaagttcgaaaaggaagcggcagagatgggcaagggcagctttaagtacgcctgggttcttgataagttgaaggcagagcgtgaacggggtattactatcgatatatctctctggaaattcgaaacctccaaatattacgttaccattattgatgcccctggccacagggatttcataaagaacatgataaccggaactagccaggccgactgtgctgtattgatcgttgcagccggagtcggcgagtttgaggcagggatctcaaaaaatggtcagacgagggaacatgcgttactggcttatagccagaaacgttatgaagagatcgttaaggaggtttccacctacattaaaaaaattgggtataatcctgatactgtggcctttgtccccataagtggctggaacggtgacaatatgctcgagccaagcgccaacatgccctggttcaagggctggaaggtcacacgcaaggacggtaacgcatctggcaccacactacttgaggcgctggattgtattttacctcccactcgacctacagacaaaccgctgcgcctccctcttcaggatgtgtataagattggcggaattggcacagtgcccgttgggcgtgtggagaccggcgtactgaagcctggtatggtagtaaccttcgctcctgttaacgtgactacagaggtcaaatcagtggagatgcaccacgaggccctgtccgaggcgctccccggagacaatgtgggcttcaatgtgaaaaacgtcagtgttaaggatgttcgaagaggcaatgtggctggcgattccaagaacgacccacccatggaggctgcaggcttcactgcgcaggttattatcctcaatcatccgggacagatctcagcaggctacgccccagtgctggactgccacacggcccatatcgcctgcaaattcgctgagctgaaagagaaaattgaccggagatccgggaaaaaattagaagacggacctaagttcttgaagagcggtgacgccgcaatcgtcgatatggttccgggtaaaccaatgtgcgttgagtccttttccgactatccgcctttgggcagattcgcagtaagagatatgagacaaactgtggctgtaggagtgattaaggccgtcgacaagaaggccgctggggctggaaaggtgacaaagtctgcgcagaaggcacaaaaagcaaaatag

SEQ ID NO: 222392 - DNA, 324 bp, Artificial Sequence
  Description of Artificial Sequence: Synthetic coding sequence
atgggcaaggagaagactcacataaacatagtggtgatagggcacgtggatagtggcaagtccaccaccaccggtcacctaatatataaatgtgggggtatcgacaaaaggaccattgaaaagtttgaaaaggaggcagcggaaatggggaaaggatcctttaagtatgcctgggtcctggataagctgaaagccgaacgcgagcgtggtattacaatcgatatctcattatggaagtttgagacctctaaatactatgtcaccatcattgatgcgcctggacatcgcgacttcataaaaaatatgattactggcacgagctag

SEQ ID NO: 222393 - DNA, 336 bp, Artificial Sequence
  Description of Artificial Sequence: Synthetic coding sequence
atgggcaaagaaaaaacccatattaacatcgtggttattgggcacgttgacagcggcaagtctacaactacgggtcatctaatctataaatgcggcggaatagataagcgcaccatcgaaaaatttgagaaggaagccgcagagatgggcaaaggaagcttcaagtacgcgtgggtcctggacaagttgaaagctgaaagagaaagggggattacaattgacatcagcctttggaagtttgaaaccactaaacagtggaccagacggctgctggaactggctaggagcccaagtctccctcgcaagttgcgaaggctgaatgagtattacccgtag

SEQ ID NO: 222394 - DNA, 1626 bp, Artificial Sequence
  Description of Artificial Sequence: Synthetic coding sequence
atggtcatcaatctgtgcctgccccagttccggccaaggattcactgtaataaaattagcgctgacggctacgaggtagagaatctgataagcgaagatcttacgaaaaggagtcacggttttcgaaccgaatattttattaaaccacccgtgtacgtgacagtcagtttcccatttaacgtagagatttgtagaatcaacatcgatttgacagccggtggcggacagaatgtgactggcttggaaatgtatacgagtgcatcgtctagccgggtcagctggaataccccacagtgccgaactttggggccagccgaaccttccgtaccagacaaagaagcatttaccctcgtcggtaaagtgctcctgaagaatcagtcccaggtggtgtttagtcaccggggattcaaggcgagacctcccttcggggctatggaggccaccctcccaagcccagcagtcgtagcacaggagctgtggaataaaggagccctgtctctgtcccacgtggcccaccttcggatctgtataacccatgtcacaggcggtggaatcccctgcattaagagactggaggtttggggccagccagctaagacgtgttctcaggaggtgatcgattccattttgttggtgacatctgagaacctgcctcaggatgtggctttgcaggcaccagcgcttcctatggaatccgattgtgatcccggagatcagccagagagccagcaagctccatcttcccttcaaaagctagctgaaatcattcaagatgtgcccgaggagtttctggatccaattacattagagattatgccttgccctatgctgctgccctccggaaaagtgatagatcagtctaccctggagaagtgcaacagaagtgaagctacctgggggagagtgccttccgatccctttacaggggttgctttcacaccgcatagtcagcctttgccacatccctcactaaaggccagaattgatcactttctgctgcagcattcgataccaggctgtcacctgctgggacgcgctcagaccgcactcgctgtgatacctagttccatcgttctgcccagccagaaacgcaaaatcgaacaggccgaacacgtgccagatagcaatttcggcgtgaacgcctcatgcttttcagcaacctcacccctcgttttgcctacaacgtcagaacacaccgcaaagaagatgaaagctactaacgagccttcccttacacatatggactgctccaccggcccactcagccacgaacagaaactgtcccagtctcttgagattgccctggccagcaccttaggttctatgccatcgtttaccgcccgtctcacccggggacagctgcagcacctgggcactcggggatcgaatacctcatggcggccaggtaccggctctgagcaaccgggaagcatactgggacccgagtgtgcttcatgtaaacgtgtatttagcccctattttaagaaggaacccgtgtatcagttgccatgcgggcatctgctctgtcgcccatgcctcggcgagaaacagcggagcctccctatgacttgtacagcatgccagagacctgtagcctcccaagatgtgctgagagtccatttttag

SEQ ID NO: 222395 - DNA, 1392 bp, Artificial Sequence
  Description of Artificial Sequence: Synthetic coding sequence
atgggcaaagaaaagacccacattaacatagttgtgattggccacgtcgacagtggcaaatctaccaccacagggcatcttatctacaagtgcggagggattgataaaaggaccatcgagaaatttgagaaagaggcagcagagatggggaagggttccttcaagtatgcttgggtgctggataagctcaaggctgagagggaaaggggcatcaccattgatatttcactatggaagtttgaaaccaccaaatactacattactattattgatgcacccggtcatcgcgactttattaagaacatgataactggcacaagtcaagccgattgtgctgttttgatcgtcgctgcaggcgtgggggaatttgaagctggcataagcaaaaacggtcagactagggagcacgcccttctggcctacacccttggggtgaagcaactgattgtaggcgtaaacaaaatggattctacagagcctgcgtatagcgagaaacgctacgacgaaatagttaaggaggtgagtgcctacattaagaaaattggttataatccggctaccgtcccttttgttccgatttcggggtggcatggcgacaacatgctggaaccatcacctaacatgccttggttcaaaggctggaaagtggagcggaaagagggcaacgcctcgggcgtctcactgttagaggccttggacaccatacttcctccgacaaggcccacggataagccactcagattgccactgcaggatgtgtacaagataggaggcattggaaccgtccccgttggaagagtggagaccgggatactgagaccagggatggtggtaacatttgctcccgtgaatatcactacggaggtgaagagcgtcgagatgcaccacgaggcactgagtgaggctcttcccggagacaacgtaggatttaatgtgaaaaacgtgagcgtgaaggatatccggagaggaaatgtgtgcggcgacagcaagtccgacccccctcaagaggccgctcagtttacttctcaggttattattctgaaccatcctggccagataagtgcagggtactcacccgtgatcgattgtcacacagcccacattgcatgtaagttcgctgagctgaaggagaaaatcgataggcgttctgggaagaagctggaagacaatcctaaaagcctgaaaagcggcgatgctgcgattgtggagatggtacctggcaaacctatgtgtgtcgagtcctttagtcagtacccccctctcggtcgatttgcggttagagacatgagacagacagtggctgtcggcgtcattaaaaacgttgagaaaaagagcggtggagctggaaaagtgaccaaaagcgcacaaaaggcacagaaggccggaaagtag

SEQ ID NO: 222396 - DNA, 678 bp, Artificial Sequence
  Description of Artificial Sequence: Synthetic coding sequence
atgggtttcggcgacctgaagtcccctgcaggacttcaggtccttaatgactatctcgctgataagagttatatcgaagggtacgtgcccagtcaagccgatgtggcagtgtttgaggccgtgtcgagcccacctccagctgatctatgtcacgctcttagatggtataaccatataaaaagttacgaaaaggagaaggcctctctccccggagtcaaaaaagccttggggaaatatggacccgctgatgtggaggatacaaccggcagtggcgctacagattcgaaggatgacgacgacattgatttatttggatctgatgatgaagaagaatcagaagaggccaagcgtctgagggaagagaggcttgctcagtatgagtctaagaaagcgaaaaagcctgcactggtggctaagtcctctatactattggacgtcaagccctgggacgacgagaccgacatggcaaagctggaagaatgtgtccggtcaattcaggcagatggactagtctggggttcgtctaagctcgtgccagtcggttacggtattaaaaagctccaaattcagtgcgttgtggaggacgataaagtgggaacggacatgctggaagaacagatcactgcatttgaggactacgtacagtcaatggatgtggccgcttttaataagatatag

SEQ ID NO: 222397 - DNA, 678 bp, Artificial Sequence
  Description of Artificial Sequence: Synthetic coding sequence
atgggattcggggatctaaagagtccagccggtttgcaggtgctgaatgattacctggcggataagagttacattgaaggctacgtaccctctcaggcagacgtcgccgtcttcgaagctgtgagctcgccccctcccgctgatctgtgtcatgcactccgctggtacaatcacataaaatcttacgagaaggaaaaagccagcttgccaggcgtgaaaaaagccctgggcaagtatggccctgccgatgtggaagataccaccggttctggggcaacagattccaaggacgacgatgatatcgacttgtttggctctgacgacgaagaagagtctgaggaagccaagcgcctcagggaggagaggcttgcccagtacgaatccaagaaagcaaagaagccggcactagttgcaaagagttccattctcttggacgtgaagccatgggacgatgaaaccgatatggccaagctggaagagtgtgttagatccatacaagccgacggccttgtgtgggggtcttcaaagctcgtaccagtggggtacggcatcaaaaagcttcagatccagtgcgtggtggaagatgataaggtggggacagacatgctggaagaacagattacagcctttgaggattatgtgcaatctatggacgttgcagcatttaacaaaatctag

SEQ ID NO: 222398 - DNA, 678 bp, Artificial Sequence
  Description of Artificial Sequence: Synthetic coding sequence
atgggtttcggggaccttaagtctcctgcaggcctccaagtacttaatgattacctggcagataagtcttacatcgaaggctatgtgccttcgcaggctgatgtcgctgtgtttgaggcagtgagcagccctcctccggcagacctgtgtcatgcccttagatggtacaatcacattaagtcctacgagaaggagaaggcatctctacccggtgtcaaaaaggccttgggaaaatatgggcctgcagacgtggaagataccacaggctccggggcaaccgatagtaaggacgatgacgatatcgatctgtttggatcagacgatgaagaagagtctgaagaggcaaaacggctgcgggaggagagactggcacagtatgagagcaagaaggctaaaaagcccgctctggttgctaagagcagtatcctgctggacgttaagccatgggacgacgaaaccgacatggcaaagttagaagagtgtgtcagatctatccaagccgacgggctcgtctggggcagctccaaattagtgcccgttggatacggtatcaaaaaattgcagatccagtgcgtggtggaggacgacaaggtaggaacagacatgctggaggaacaaattactgccttcgaggactacgtccaatcaatggacgtggccgctttcaataagatctag

SEQ ID NO: 222399 - DNA, 372 bp, Artificial Sequence
  Description of Artificial Sequence: Synthetic coding sequence
atgggcttcggcgacctgaagtcccccgcaggtcttcaagtactgaatgattacctggccgacaaaagctatattgagggctatgtcccatcccaagcggacgtcgccgtcttcgaagccgtctcgagccccccacctgccgacctctgccatgccctgcgttggtacaatcacatcaagtcttacgaaaaagaaaaggcctcactccccggagtaaagaaggcactgggtaagtacggccctgcagatgttgaagatactacagggtctggggctactgacagcaaggacgacgatgacatagacctatttggcagtgacgacgaggaagaatccgaggaggcaaagcgcctcagggaggagcgcttgtag

SEQ ID NO: 222400 - DNA, 846 bp, Artificial Sequence
  Description of Artificial Sequence: Synthetic coding sequence
atggcgactaatttccttgcacatgagaagatctggtttgacaaattcaagtatgacgacgctgagaggagattctatgagcagatgaacggccctgtggccggtgcctcacggcaggagaacggagcctctgtgatacttagggacattgcccgtgctagagaaaatattcagaagtctctcgccggaagtagcggccctggggctagctcgggtacgagcggagaccatggcgaattggtcgtccggatagcatctttggaggtggagaaccagtctttacggggtgtggttcaagagctgcaacaagctatttcaaagctggaggcacgtctcaacgttctggagaaatcatccccaggccaccgggctacagcacctcagacacagcatgtctccccaatgagacaagtagaaccaccagctaagaaacccgctacgccagccgaggatgatgaggatgacgatatcgacttgttcggaagcgataacgaggaggaagacaaggaggccgcacagctcagagaagaaagactgcgacaatacgcagagaagaaggctaagaaaccagcgctggtggcgaagagctcgatactgctggacgtgaagccgtgggatgatgaaaccgatatggcacagctggaggcctgcgtgcgtagtattcagctggacggtttggtttggggagcctccaagctggtgccagttggttatgggatccgtaagttacagatacagtgcgtggtggaagatgacaaagtcggtacagacctcttagaggaggaaatcacaaagttcgaggaacacgtgcaatcagtagatatagcagccttcaacaaaatctag

SEQ ID NO: 222401 - DNA, 1896 bp, Artificial Sequence
  Description of Artificial Sequence: Synthetic coding sequence
atgcgcagtggaaaggcctcctgtacactagagactgtatgggaggacaagcacaaatatgaagaggctgagcgcagattttatgaacacgaagccacacaagcagccgcatctgcccagcaattaccggcagagggaccggctatgaacgggccagggcaggatgaccccgaggacgccgatgaggccgaggcgccagacggcggaagccgaagagatcctagaaaatcacaagacagtcgcaaaccactgcagaaaaaacggaagcgttccccaaagtcaggcctgggacctgccgatctggcactccttggcctgagcgcggagcgggtgtggctcgataagagtctcttcgatcaggctgagagctcctatcgccaaaaactggctgatgtggctgctcaagccgcatggccaccagctctcgccccatggggtctgtgcactcacggaaatcaggtggcctgccaccatgtcacttggggcatttgggttaataagtccagtttcgatcaggccgagcgagcttttgtcgagtggagccaagcattgctcctcgcccctgatggcagccgcagacaggggactccgaacacagggcagcaagtggcggttcctgatttagcgcaccagccttcacctccagtgaatgggcagccaccgttgggctccctccaggcgttggtcagagaagtgtggcttgaaaaaccaagatacgatgccgctgagcgcggtttctatgaggccctgtttgacggtcaccctcctggtaaagtacgacttcaggagagagccggattggcagagggggcacgcaggggacgcagggaccgacggggacgcaacattctcgggaataagagggcaggattgcgccgagctgacggagaagcgcctagcgctctcccttactgttatttcctccaaaaggatgcagaagctccctggctgtcaaagcctgcgtacgacagcgcagagtgccgccaccacgctgccgaagcactgagggtggcgtggtgcctggaggcggcttcactaagccacaggcccggacctaggtcaggactgagtgtgagcagtcttagaccaaatcggaagatggccacaaatttcctggcccatgagaaaatatggttcgacaagttcaagtacgatgatgctgaaaggcgattttacgaacagatgaacgggccagtggctggagcatctagacaagaaaacggcgcttccgtgattctcagagacattgctagagcccgtgagaacatccagaaatccctcgctggttcttccgggcctggggcatcctcgggcacgagcggcgatcatggcgagttggttgttagaatcgccagcctcgaggtcgaaaaccaatctctgcggggtgtcgtccaggagctccaacaagctatctcaaaacttgaggccagactcaatgtcctagaaaagtctagcccgggtcaccgagccactgcccctcaaacccagcacgtgtctcccatgagacaggttgaacccccagctaagaagcctgccacgcctgcagaggacgatgaggatgacgatattgatctgttcggtagtgataatgaggaggaagacaaggaggctgctcagcttagagaggagagacttcgacagtatgcagaaaagaaggctaagaaacctgccctggttgcaaagtcgtccatacttctcgacgtcaagccatgggacgatgaaactgacatggctcagctggaagcatgtgtgcggtcaatccaactggatgggttagtctggggcgcttccaaactggttccggtaggttacggcattagaaagctgcagattcaatgcgtaggcggaaggcagggaggcgaccgtctggccggaggcggtgatcatcaggtctag

SEQ ID NO: 222402 - DNA, 1728 bp, Artificial Sequence
  Description of Artificial Sequence: Synthetic coding sequence
atgaatggcccagggcaggatgatcctgaagacgcggacgaagcagaagcccctgacggcggaagccgcagagacccgcgaaagtcccaggatagccgcaaaccgctgcagaaaaagaggaagaggagtcctaagtccggcctgggccctgccgacctcgctctgctggggttgagcgccgagagagtatggctcgataaatctttgtttgatcaagcagagtcttcctatcgacagaaactggcagacgtggcagcacaggctgcttggccgcctgctctcgcgccatggggcctgtgcacccacggaaatcaggtggcttgtcaccatgttacttggggtatatgggtgaacaagtcaagtttcgaccaagctgaacgcgcttttgtagaatggtcacaagccctcctcctggccccagatggctctaggcggcaaggtacccccaatactgggcagcaggtcgccgtgccggatttagcccatcagccctctcccccagtaaacggccagcctcctctcggcagcctccaggccctggtcagagaagtatggctcgagaagcccagatacgatgctgccgagcgaggcttctatgaggccctttttgatggccaccctccagggaaggtaagactgcaggaacgtgccggactggccgaaggcgctcggaggggcaggagggatcgacgcggaaggaacattctcggaaacaagcgggcagggctgcgtagggcagacggtgaggcacctagtgctctcccatactgttactttttgcagaaggacgctgaagctccctggttatccaaacctgcctacgacagcgcagaatgccggcatcacgctgctgaagcactgagagttgcttggtgtctggaggccgcttctcttagtcatcgccctggtcctcgcagcggcctcagtgtgtcctctctgagacccaacaggaagatggctaccaattttctggcccatgagaaaatatggttcgataaattcaaatatgacgatgcagagcggagattttacgaacaaatgaacggcccagtcgctggcgcttctagacagtctagtggccctggtgcctcctcgggcacctctggcgaccatggagaactggtggtgcggattgcctccctcgaggtggaaaaccagtcactgcgtggagtcgtgcaagaattacagcaggccatctctaaactggaggcgaggctgaacgtgctcgaaaagtcttctccaggccaccgggcaacagcaccacaaacccaacacgtgagcccgatgcggcaagttgagccacccgcaaagaagccagccacccccgctgaggatgacgaagatgacgatattgacctgtttggctcagacaacgaagaagaggataaggaagccgcacaacttagagaagagcggttgaggcagtatgccgagaagaaagctaagaagcctgcattagtggccaaaagctccatattacttgatgtcaagccctgggatgatgaaacagatatggcacaattggaggcgtgcgtgcgtagcatccaattggacggtttggtgtggggggcttccaaacttgttccggttggttacggcattcggaaacttcagatccagtgtgtggtggaggatgacaaggtggggacggatttactcgaggaagagattaccaaatttgaggagcacgttcagagcgttgatatcgccgctttcaacaaaatctag

SEQ ID NO: 222403 - DNA, 846 bp, Artificial Sequence
  Description of Artificial Sequence: Synthetic coding sequence
atggcgacaaacttcctggctcatgaaaagatatggtttgacaagttcaagtacgacgacgcagagagaagattttacgaacagatgaatgggccagtggcaggcgcatcccgccaggagaacggagcaagcgtaattctgcgtgatatagcaagggctagggagaatattcagaagtcactggcgggaagttctggtccaggagccagtagtggtacatctggggatcacggcgaactcgtcgtgaggatcgcgagtttggaggtagagaatcagagtctccgtggggtggtgcaggagctgcaacaggcaatctctaaactggaagccagactgaatgtgctggaaaagtcctctcctggccaccgcgctactgcgcctcagacccagcacgttagccctatgcggcaggtagaaccacctgcaaagaagccggcaacaccagctgaggacgacgaggacgatgatatagatttgttcggttccgacaatgaggaagaggacaaggaagctgctcaacttcgtgaggagcgcctgagacagtacgcagaaaaaaaagctaaaaaaccagcactggtagccaagtcatccatcctgttagatgtcaagccgtgggatgacgaaaccgatatggcacaactggaagcttgtgtccgctcgatacagctggacggcctagtgtggggcgcatctaaactggtaccagtagggtacggcataagaaagttacagatacagtgtgttgtcgaggatgacaaggtaggcaccgatcttttagaagaagagataaccaaattcgaagaacacgtccaaagcgttgacatagcagccttcaacaaaatctag

SEQ ID NO: 222404 - DNA, 846 bp, Artificial Sequence
  Description of Artificial Sequence: Synthetic coding sequence
atggcaacaaactttctcgcccacgaaaagatctggtttgataagtttaaatatgatgatgccgaaaggagattctatgagcaaatgaatggcccagtcgcaggagcctctcgccaggaaaacggcgctagtgtaattctgcgagacatcgctagagctcgagagaatattcagaagtccctagcagggagctcaggtccaggtgcaagctctggcacttccggagaccacggggagctggtggtgagaattgcctcactagaagtagaaaatcaaagtctgagaggcgtggtacaggaactccagcaggccatcagcaagctcgaagcgagactcaatgtgctggagaaatcttccccagggcacagagcgactgctccacagacacagcacgtgagcccaatgagacaggtggagccacccgcaaaaaagcccgcaacgcccgcagaagacgatgaggacgatgacatcgacctgttcggtagcgacaatgaggaagaagataaggaggccgctcaactgcgcgaggagaggttgcgccagtacgcagagaagaaggccaagaagcccgctctggttgccaagagctccattctgctagacgtgaagccatgggacgacgaaaccgatatggcgcagctggaagcctgcgtccggagtatccaattggatggcctcgtgtggggtgcttccaaactggtacctgtgggttatggcattcgcaaattacaaattcagtgtgttgtggaggacgataaagtggggaccgacttgcttgaggaggagattacaaaatttgaagaacacgtccagtctgtggatatcgcggctttcaacaaaatctag

SEQ ID NO: 222405 - DNA, 1944 bp, Artificial Sequence
  Description of Artificial Sequence: Synthetic coding sequence
atgcgcagcggaaaggcctcatgcacactggaaactgtgtgggaagataaacacaaatacgaggaggcagagcgcaggttttacgagcacgaggctactcaagccgcagcaagtgctcagcagttgccagctgagggccctgcaatgaatggtcccggacaggatgacccagaagacgccgacgaggctgaagctccagatggaggtagtcgccgagatccacgaaagtcccaggattcccgtaaacccctgcaaaagaaacggaagaggtcgcctaaaagcggattgggccctgccgatttggctctgctgggactgagtgctgaacgtgtctggctggacaaatccctgtttgaccaagcagaaagctcataccggcaaaaacttgccgatgtcgctgcccaggcggcttggccccctgccctcgccccttggggattgtgtactcacggcaaccaggtggcgtgccatcacgtaacatgggggatatgggttaacaagagtagctttgaccaggcggagcgtgcctttgtagaatggagtcaggctctactgctggctccagacggatcccgacgacagggcacgcccaatacgggtcaacaagtggcagtccctgatcttgcccaccagccttcaccccctgtgaatggccagcccccactggggtcactgcaagccctcgtcagggaagtatggctggagaagcctagatatgacgctgcagagagaggtttttacgaagcactctttgacgggcaccctcccggaaaggtgcggttgcaggagagagctggtctggccgagggggcacgtcgaggtcgacgcgatcgaagaggcaggaacatcctgggtaataagcgggcaggcctgaggagagccgatggggaggcaccctcggctcttccatattgctactttctgcagaaggatgcagaggccccatggctgtcaaaacccgcttacgacagtgcagagtgcagacaccacgctgccgaggctctccgagtcgcctggtgcctagaagccgcttccttaagccaccgaccagggccaagatctgggctgagcgtgagcagcctgcggccaaataggaaaatggctacaaacttcctggcccacgagaaaatttggtttgataagtttaaatacgacgatgctgagcggaggttttacgaacagatgaacggccctgtggcgggagcgagccgccaggagaatggggcatcggtgatattgagggacatcgcacgggcacgcgagaacattcagaaaagtttggctggatcttccggcccaggtgcgtccagtgggactagtggggaccacggcgagctggtcgttcgtatagcctccctggaggttgaaaaccagagcttacggggtgttgtgcaagaactccagcaggctattagcaagctggaggcacgtttgaacgtgttagaaaaatcaagtcctggccacagggcaaccgctccccaaactcagcatgtgtcacctatgcgacaagttgaaccccctgctaagaaacctgctacacccgcagaggatgatgaggacgacgacattgatcttttcggctctgataatgaagaagaagacaaagaggcagcacagctgagggaagaaaggctccgccagtacgccgagaaaaaggcaaagaagcccgctttggtggccaagtcttccatcctcctagacgtaaaaccgtgggacgatgaaacagacatggcccagctagaagcatgtgtgcggagcatacagctggacgggcttgtgtggggagcctccaagctggtgcccgtgggatatggaattagaaagctacagattcagtgcgtggtggaggacgacaaggttggaactgaccttctggaggaggagattacaaaatttgaagaacatgtacaatctgtggatattgccgcttttaacaaaatatag

SEQ ID NO: 222406 - DNA, 1944 bp, Artificial Sequence
  Description of Artificial Sequence: Synthetic coding sequence
atgcgctccggtaaggcctcctgtactctcgagaccgtgtgggaagacaagcataagtacgaggaggccgaacggagattctacgaacacgaggcaactcaagcggctgctagcgctcagcagctgcctgctgaaggacccgcaatgaatggcccaggacaggacgatccagaggatgccgacgaagctgaagctcccgacgggggaagcaggcgagacccccgtaaatcccaggacagtagaaagccgctgcaaaagaagaggaaaagaagccccaagtccggcctgggacccgctgacctcgctttactggggctttctgctgagagagtatggttggataaaagtttgttcgaccaggcagaaagctcataccgacagaaacttgcagacgtcgcagctcaggcggcatggcctcctgccctcgctccttgggggctgtgcacgcatgggaaccaagtcgcatgccatcacgtcacttggggcatctgggtgaacaagtcaagtttcgaccaggcagagcgtgcctttgttgaatggtctcaggcgctgctgcttgcccctgacggatcaagacggcaaggtacacccaacaccggtcagcaggttgccgtcccagatctggctcaccaaccctctccccctgtcaatggacagccacccttaggcagtctgcaggcgctagtgagagaggtgtggctcgagaagccaaggtacgatgccgcagagcggggtttttatgaagcactttttgatggtcacccacccggaaaggttaggctacaagagcgcgcaggacttgcggagggcgcacgcaggggaagacgggacaggcggggtagaaatattctgggaaacaaacgagccggactgcggagagctgacggcgaagccccttccgctcttccatactgctacttcttgcagaaagatgcagaggcaccctggctatcaaagcccgcatacgacagcgccgagtgtcgtcatcatgccgctgaggccctgcgcgttgcctggtgcctggaagccgcttctctgagccacagaccaggccctcgcagcggcctctcagtgtcaagtttgcgtccgaacaggaaaatggcaactaattttctagctcacgaaaagatatggttcgacaaatttaagtatgatgacgcagagcgccgattttatgaacagatgaatgggcctgttgcaggagcctcccggcaagagaacggggcttccgtgatcctccgggacatagcacgcgcacgggagaatatccaaaagtcgctggccggatcatccggccctggggcttcgtcaggcactagcggtgaccacggggagctggtggtccggatagccagcctcgaggtggagaaccagtccctcaggggcgtcgtgcaagaactgcagcaggccatcagtaagttggaggcccgactgaacgtgctagaaaaatcttcacctgggcatcgtgctacagcccctcagacgcaacacgtgagccccatgcgtcaggtcgaacctcccgctaagaaaccagctacccccgcagaggatgatgaagacgacgatattgatctgtttgggagcgataacgaggaagaggacaaagaggccgcacagctgcgagaggagcggttacggcagtatgcagagaagaaggccaagaagcccgcactagtcgccaagagttctattctgttggacgtcaaaccctgggacgacgagactgacatggctcagcttgaagcctgcgtccgctccattcagctcgacggcctcgtatggggggcatcaaaacttgtccctgtggggtacggcattcgcaagctgcagattcagtgcgtcgttgaagatgataaagtgggaaccgatcttctggaggaggagatcaccaagttcgaagagcacgtgcagtcagtggatatcgcagccttcaataagatctag

SEQ ID NO: 222407 - DNA, 774 bp, Artificial Sequence
  Description of Artificial Sequence: Synthetic coding sequence
atggcaaccaacttcctggcacacgaaaaaatttggttcgataagtttaagtatgatgatgctgagaggcggttttatgagcagatgaacggcccagtggccggagccagccgacagtcttccggcccaggagccagcagtggtacaagcggcgaccacggagaattggtggtgcggatcgccagtctggaagtcgaaaatcaatcactgagaggggtggtccaggagctccagcaagcgatatcaaaattggaggcaagactgaatgtcttggagaagtcctcaccaggccaccgggctaccgcgcctcagacccagcacgtgtcaccgatgagacaagtcgagcctcccgctaagaagcccgctacccccgctgaggacgacgaggacgacgatatcgacctgtttggctctgacaatgaggaggaagacaaagaggccgctcagctccgcgaggaacgcctcaggcagtatgcagagaaaaaggcaaagaagcccgctctggtagcaaaatctagtattcttctggatgttaaaccatgggacgacgagacggacatggcgcagcttgaggcatgcgttcggagcatccagctggacggtctcgtttggggtgcctccaaacttgttcctgtgggctacggcatccgcaaactgcagatacagtgtgtagtggaagatgacaaagtgggtactgatttgcttgaggaggaaattaccaagtttgaagagcacgtgcagagtgtagatattgcggcttttaacaagatctag

SEQ ID NO: 222408 - DNA, 546 bp, Artificial Sequence
  Description of Artificial Sequence: Synthetic coding sequence
atgcggtctggtaaagcctcatgtaccttagaaacagtctgggaagacaaacacaagtacgaagaggccgaaagaagattctatgagcatgaagcaacgcaggccgcagcttcagcacaacagttaccagcagaggggcctgcaatgaacgggcctggacaggatgacccagaggatgcagacgaagcagaggctcccgacggcggaagcaggagagaccctagaaagagccaggattctagaaagcccctgcagaaaaaacgtaagcgctcccctaagtctggtctaggtcccgctgatctggcactactgggtctctcagcagagagggtgtggctagataaaagcctgttcgaccaggccgagagctcctacaggcagaagctggctgacgtagctgctcaggccgcatggccacctgcactcgccccttggggactctgtactcatggcaaccaggtcgcatgccaccacgtgacgtggggcatctgggtcaacaagagttctttcgaccaggccgagagagcttttgtggaatggagctag

SEQ ID NO: 222409 - DNA, 192 bp, Artificial Sequence
  Description of Artificial Sequence: Synthetic coding sequence
atgcgaagtgggaaagccagctgtacactggagacagtgtgggaggacaagcacaaatacgaggaggcagagaggcgtttttacgaacacgaggctacccaggctgccgctagcgcacagcagctaccagccgaaggcccagccatgaacggcccaggccaggatgatcccgaagatgccgatgaagcctag

SEQ ID NO: 222410 - DNA, 120 bp, Artificial Sequence
  Description of Artificial Sequence: Synthetic coding sequence
atggccaccaatttcttagcgcacgaaaagatttggttcgacaagtttaagtatgacgatgcggaacggaggttttacgaacaaatgaacggtccagtggccggtgccagccgccagtag

SEQ ID NO: 222411 - DNA, 246 bp, Artificial Sequence
  Description of Artificial Sequence: Synthetic coding sequence
atgaggtcaggtaaagccagctgcacactcgagacagtttgggaggataaacataagtacgaagaggctgagaggcgattctacgagcatgaagctacccaggccgctgcatccgctcaacagctgcctgcagagggaccagccatgaacgggcctggtcaggatgatcccgaagacgccgatgaggcagaagccccagacggtgggtccagaagagatccgcgtaagagccaggacagcaggtag

SEQ ID NO: 222412 - DNA, 114 bp, Artificial Sequence
  Description of Artificial Sequence: Synthetic coding sequence
atgaggtcaggaaaagcatcctgcaccctcgagacggtttgggaagacaagcataagtacgaagaagccgagcgtcggttttacgagcatgaggctacacaggcagcagcctag

SEQ ID NO: 222413 - DNA, 162 bp, Artificial Sequence
  Description of Artificial Sequence: Synthetic coding sequence
atgagaagcggcaaggcgtcttgcacgctcgaaacagtttgggaggacaaacataagtatgaggaagcagaacgcaggttttacgagcacgaagccactcaggctgctgctagcgcgcagcaactccctgctgaaggccctgccatgaacggccctggatag

SEQ ID NO: 222414 - DNA, 192 bp, Artificial Sequence
  Description of Artificial Sequence: Synthetic coding sequence
atggccaccaatttcctagcccacgagaaaatctggttcgataaattcaagtacgacgatgctgaacggaggttctacgagcagatgaacgggccagtggctggcgcttctagacaggagaatggcgctagtgttatactgagggatatagcaagagccagagaaaacattcagaagagccttgcagggtag

SEQ ID NO: 222415 - DNA, 903 bp, Artificial Sequence
  Description of Artificial Sequence: Synthetic coding sequence
atgagatctggcaaggcgtcctgcaccctggaaaccgtgtgggaagacaaacacaagtacgaagaagcagagcgacgcttctatgaacatgaagcaacccaggctgccgcatcagctcagcagctgcccgctgaggggccagccatgaatgggcctggccaggacgatccagaggatgctgatgaggctgaggccccagacgggggttcacgcagggacccacggaagagtcaggatagccggaaaccgctgcagaagaagagaaaaaggagtcctaagtctggcctcggacccgcagatctcgctctgcttggtctttccgcggagcgggtgtggttagataaatctctctttgatcaggctgaatccagctataggcagaaactggcagacgtggcagctcaggccgcatggcccccagctcttgctccttggggcctctgcacacacggtaaccaagtcgcgtgtcaccatgtgacgtggggcatctgggtgaataagagttcatttgatcaggccgagagggcttttgtggaatggagccaggcgctcctcttggctccggacggctcgcgacggcagggcactcccaataccggccaacaggtcgctgtgcctgatctggcccatcagccctccccaccagtgaatggccagccaccgctcggctcactacaggcattggtgagagaggtgtggctggaaaaaccgcgatacgacgccgcagaaaggggcttttacgaagccctgttcgatgggcacccccctggcaaggttaggctccaagaaagggccggactcgccgaaggggctagaaggggcagacgtgacaggcggggaaggaacatcctcggcaataaacgtgccggactgaggcgggcagatggcgaagctccatcttag

SEQ ID NO: 222416 - DNA, 66 bp, Artificial Sequence
  Description of Artificial Sequence: Synthetic coding sequence
atgaggtctggcaaagcatcctgtaccctcgaaaccgtctgggaagataaacataagtatgagtag

SEQ ID NO: 222417 - DNA, 474 bp, Artificial Sequence
  Description of Artificial Sequence: Synthetic coding sequence
atgaggtcaggcaaggccagctgtactttagaaacagtctgggaagacaagcacaaatatgaggaagccgagcggcgattctacgagcatgaggcaacccaggcagcagcttcagcacagcagctgcctgcagaaggcccagccatgaatggtccgggacaggacgaccctgaggacgcagacgaggctgaggctcctgacgggggaagtcggagagacccacggaagtcccaggactcacgcaagccactgcaaaaaaaacgaaaaagatctccaaagtccgggctgggccctgctgatttggccctgctgggactgtctgctgagagagtttggctcgacaaaagcctattcgaccaggcagagtcttcataccgtcaaaagctggccgacgtagccgctcaggcagcatggcccccagctctagcgccttggggcttgtgtacgcatggtaatcaggttgcctgtcattag

SEQ ID NO: 222418 - DNA, 774 bp, Artificial Sequence
  Description of Artificial Sequence: Synthetic coding sequence
atggccaccaatttcctcgcccacgagaagatttggtttgataagtttaagtacgacgacgcagaacgtagattctatgagcaaatgaacggccctgttgccggagcgagtcgccagtccagcggtcctggcgctagctcaggtacgagcggcgaccatggcgagttggtcgtgcgcatcgctagccttgaagtggagaaccaaagtctccggggtgttgtacaggagctgcaacaagccatcagcaaactcgaggctaggctcaacgtcctggaaaaaagttctcccggacaccgtgccactgccccacaaacccaacatgtgagccctatgagacaagtagaacccccagctaagaaacctgccacaccagccgaggatgacgaagacgatgacattgaccttttcggatccgataatgaggaggaggataaggaggccgctcagttaagagaagaaaggctccgccagtatgcagaaaagaaagccaagaagccagccctggtggcaaagtcctctattttgctcgatgtgaagccttgggacgacgagacggatatggcccagctcgaggcttgcgtgcgtagtatacagcttgatggcctggtttggggggcttcgaagcttgtacctgtgggttatggcattcgcaagctgcagatacaatgcgtagtggaggacgataaggtaggtaccgacctccttgaagaagagatcaccaagtttgaggagcacgtgcagagcgtcgacatcgccgcttttaataaaatatag

SEQ ID NO: 222419 - DNA, 846 bp, Artificial Sequence
  Description of Artificial Sequence: Synthetic coding sequence
atggctacaaacttccttgctcatgaaaaaatttggttcgataagttcaagtacgacgacgccgagcgcagattttatgaacaaatgaatggccctgtcgccggagcttcacgccaagaaaatggggctagtgtgattctaagggacattgccagagcacgcgagaacattcagaaatccctggccggaagtagcggtccgggtgcatcatccggcactagtggcgaccacggagagctggtcgttaggatcgcatcactggaggtcgaaaatcagtccctccgcggagtagtccaagaactccagcaggcgatctctaagctcgaagctagactgaatgtcctggaaaagtcctcacccggacatcgggcaacagctccccaaactcagcatgtgtcacccatgcgacaggttgagcctcccgcaaaaaaaccagcgacccccgcagaagacgacgaggacgatgatatagatctgttcgggtcagacaatgaagaggaggataaggaggccgctcagctaagggaagagcggctgaggcagtacgctgaaaagaaagctaagaaacctgcactggtggctaagagctctatactgctcgacgttaagccttgggacgacgaaacagatatggcccagctggaggcctgtgtgcgttcaatccagttagatggccttgtgtggggagccagcaagctggtaccagtgggatacgggatccggaaactccagatccagtgtgtggtcgaagacgataaagtcgggacagacttgctggaggaggaaattacaaaattcgaggagcacgtgcaatccgttgacatcgctgctttcaataaaatctag

SEQ ID NO: 222420 - DNA, 441 bp, Artificial Sequence
  Description of Artificial Sequence: Synthetic coding sequence
atgcgatcaggtaaggccagctgtactcttgagaccgtatgggaggataaacacaagtacgaggaagcggagcgcagattttatgaacatgaggctacacaggcagctgctagcgcccagcagctacctgccgagggtccggctatgaatggccctggacaagacgaccctgaggatgctgacgaggcagaggccccagatggagggagcaggagagacccacgtaaaagccaggactcgcgcaaaccactacaaaaaaaacggaaaagatctccaaagtcaggccttgggcctgccgacctagcgctgcttggactctctgcagagagagtttggctggataaatctctctttgatcaggccgagtcctcatacagacagaaactggccgacgtcgcggcacaggcagcctggccacccgcactagcgccatggggttag

SEQ ID NO: 222421 - DNA, 615 bp, Artificial Sequence
  Description of Artificial Sequence: Synthetic coding sequence
atggcaactaattttcttgctcacgaaaagatttggttcgacaaattcaaatatgacgatgccgaaagaagattttacgagcagatgaacggacccgtcgcaggggcttctcgccaggaaaatggagcttccgtgattttacgtgatattgcacgcgctagagagaatattcagaaaagtctagcaggcagcagcggacccggtgcatcatcaggtacctcaggggatcacggcgaattggtggtccggatcgccagcctagaagtggagaaccagagtctcaggggcgttgttcaggagctgcagcaggccatttccaagctggaggcaaggctaaatgtcctggagaagagttcccccggacaccgagccacggccccacagacccaacatgtcagtcccatgcgccaagtggaaccgcctgccaagaaacccgctaccccagctgaagacgacgaggatgacgatattgatctatttggctcagacaacgaagaagaagacaaagaggctgcccaactgagagaagagcgactcagacagtatgctgagaaaaaggcaaagaagcccgcactagtcgccaagtctagcatccttcttgacgtgaaaccttag

SEQ ID NO: 222422 - DNA, 390 bp, Artificial Sequence
  Description of Artificial Sequence: Synthetic coding sequence
atgcgctctggtaaggccagttgcactctcgagacagtctgggaagacaaacacaaatacgaggaagctgaaaggcgcttctacgaacacgaggctacgcaggcagcagctagcgcccagcaactgcctgctgagggtcctgctatgaatgggccaggacaggatgacccagaggacgccgacgaagccgaggcccctgacggaggcagtcgtcgcgatccccgtaagtctcaggatagccgaaaaccacttcagaaaaagcggaagcgcagtcccaaaagcggtctaggaccagccgacctggctctgttggggctgtccgcagaacgggtttggcttgataaatctttgttcgaccaggccgagagctcttaccggcaaaagctttag

SEQ ID NO: 222423 - DNA, 501 bp, Artificial Sequence
  Description of Artificial Sequence: Synthetic coding sequence
atggcgacgaacttcctggctcacgaaaagatttggtttgataaatttaagtatgacgacgctgagcgacggttttacgagcagatgaatgggcctgtcgctggcgcaagccggcaagagaatggggcatctgtgatcttacgcgacattgcacgagcaagggagaatatacagaagtccttggctggatcttctgggccaggcgcaagcagcggaaccagcggggaccacggggagttggttgtacgtattgcatcactggaggtcgagaaccagagtttgagaggggtggtgcaggaactccagcaggcaattagtaaactcgaggctcgcctcaacgtgttagaaaagtccagccctggccacagagctacggccccacaaacccagcacgtgtcccctatgcggcaagtggaaccacccgctaagaaaccagcaacgcctgcagaagacgacgaggacgacgacattgacctctttggttcagacaatgaagaatag

SEQ ID NO: 222424 - DNA, 255 bp, Artificial Sequence
  Description of Artificial Sequence: Synthetic coding sequence
atgcggtcgggtaaggcgagctgcacactggaaaccgtttgggaggacaagcacaaatatgaagaggccgaacgaaggttctacgaacatgaagctacacaagccgcagcatcagcacagcaactgcccgcagaaggaccagccatgaacgggccaggccaggatgacccggaggacgccgacgaggctgaggcccctgatggtggaagccgaagagatccccgaaaatctcaggatagtcggaagcccctgtag

SEQ ID NO: 222425 - DNA, 600 bp, Artificial Sequence
  Description of Artificial Sequence: Synthetic coding sequence
atggcaaccaactttttggcacatgaaaagatatggtttgataagttcaagtatgatgatgctgagaggcgattttatgaacaaatgaatggccctgtggctggtgccagccgccaagaaaacggggctagcgtgattctacgcgacattgctcgcgcacgtgagaatatccaaaaatcactggctggctcgtctggacctggcgctagctccgggacgtctggtgaccacggcgagctggttgtgagaatcgcgagcctcgaagtggaaaatcaatcactgcgcggagtcgttcaagagctacagcaagccatctccaagctggaggccaggctgaatgtgctggagaagagctcccctggtcacagagctactgcaccacagactcagcatgtttcccccatgaggcaggtggagcctcccgctaaaaaacctgccactcccgctgaagacgacgaagacgacgatattgatttgtttggaagcgacaacgaggaagaagataaggaggccgcacaactacgagaggagaggctgcgccagtatgctgaaaagaaggccaagaagccagcccttgtggccaaatcctctatcctgtag

SEQ ID NO: 222426 - DNA, 774 bp, Artificial Sequence
  Description of Artificial Sequence: Synthetic coding sequence
atgcgctctggtaaggccagctgcacactggagacagtgtgggaagacaagcataagtatgaggaagcagagcgcagattctatgaacacgaggccacccaagccgctgcatccgctcaacagctgccggctgaaggacctgctatgaatgggcctggacaggatgaccccgaggatgccgatgaagcagaggctcccgatggcggttctagacgagaccccaggaagtcccaggactcccgcaagccgttgcagaagaaaagaaagaggagccctaagagcggcctaggcccagccgatctggcgctgctaggcctgagcgcggagagagtatggctggacaaaagcctttttgaccaggcagagtcctcatacagacaaaagctggccgacgttgccgcacaggcggcttggcctcctgctctggcgccatggggcctgtgtacccatggtaaccaggttgcatgtcatcatgtgacttgggggatttgggttaacaagtcttcttttgatcaggccgaaagggccttcgtcgagtggtcccaggccctcctgttggcacctgacggcagccggaggcaaggcactccaaataccggccagcaagtcgctgtgcccgatctcgcacaccagccatcccctcccgtcaatgggcagccacccctaggctctcttcaagcactggttagagaggtctggttagaaaagccaaggtacgacgccgcagaaagaggtttttatgaagctttgtttgatggccatcccccagggtag

SEQ ID NO: 222427 - DNA, 540 bp, Artificial Sequence
  Description of Artificial Sequence: Synthetic coding sequence
atgcgttcaggaaaggcatcgtgcaccctggaaaccgtgtgggaagacaaacataaatacgaggaggccgagaggcgcttttacgaacatgaagccacccaggccgctgcatcagcccagcaactgccagcagagggacccgctatgaacggtcccggtcaagatgatccagaggacgcagatgaagctgaagctccagatggagggtctagacgggaccctcggaaaagtcaagacagccgcaaaccactccagaaaaagaggaagcgatctccgaagtcaggtctcggacccgcagatctggctctgctgggactgtccgccgaaagagtatggctggacaaatccttgttcgatcaggccgaatcctcgtatcgtcaaaagctcgcagatgtggccgcacaggccgcatggccaccagcactagctccctggggtttgtgcacacacggtaatcaagtagcatgtcaccacgttacttggggcatttgggttaacaagagcagttttgaccaggccgagcgcgctttcgtggaatag

SEQ ID NO: 222428 - DNA, 108 bp, Artificial Sequence
  Description of Artificial Sequence: Synthetic coding sequence
atggccactaactttctggcacatgaaaagatttggttcgacaagttcaagtatgacgatgccgagaggaggttttacgaacagatgaatggtccagtggccggatag

SEQ ID NO: 222429 - DNA, 150 bp, Artificial Sequence
  Description of Artificial Sequence: Synthetic coding sequence
atgcgttctgggaaagcaagctgcacattagaaaccgtgtgggaagataagcacaagtatgaggaggcagaacgcaggttttacgaacacgaggctactcaggccgctgcatcggcccagcaacttcctgcagagggccctgccatgtag

SEQ ID NO: 222430 - DNA, 120 bp, Artificial Sequence
  Description of Artificial Sequence: Synthetic coding sequence
atggccacaaatttcttggcccatgagaaaatctggtttgataagtttaagtacgatgatgccgagagaaggttttatgagcaaatgaacggcccagttgctggcgcatctagacagtag

SEQ ID NO: 222431 - DNA, 573 bp, Artificial Sequence
  Description of Artificial Sequence: Synthetic coding sequence
atgcggtctggcaaggcgagctgtacgctggagaccgtgtgggaagacaagcataagtacgaagaagcagaacgtcgattttatgaacacgaggcaacccaagccgctgccagcgcccagcagttgcccgcagaaggtcctgcgatgaatggtcctggacaggacgacccagaggacgctgatgaggcggaagcgccagatggagggagtcgtagggatcccaggaagagccaggattcacgcaagccgcttcaaaagaaaaggaaaaggagcccaaagagtggacttggcccagcagacctggctcttcttggcctcagtgcagaacgagtctggctcgataaaagtctcttcgatcaggcggaatcgtcttatcggcagaagttggcagatgtcgcagcacaggctgcctggccacccgctctggccccttggggcctgtgcacacacgggaaccaggtggcgtgccatcatgtgacatggggaatttgggtgaacaaatcaagctttgaccaggccgaacgcgcattcgtggaatggagccaagcactcctccttgcgccagacgggtag

SEQ ID NO: 222432 - DNA, 2094 bp, Artificial Sequence
  Description of Artificial Sequence: Synthetic coding sequence
atggaggcacctcttgggagcattctgagcccttgtccaggtcgcgcagcaaccggccgtgccggtaccggaagagtcggaaccggcctgagaccaccagcagtgctgcagctgtgccctctcctcgccttctatagatgtgtccgcaaaatgcgctcgggaaaggcatcttgcacattagagaccgtctgggaggacaaacataagtatgaggaagctgagaggcgcttttacgaacacgaggcaactcaggctgctgcctctgctcaacagctgccagccgaggggccagcgatgaatggccctggtcaagacgatcccgaagatgcagacgaggcagaggctcccgatggaggctcaaggcgagatcctcgcaagtctcaggattctcgtaaaccactgcagaaaaagagaaaacggtcccctaaaagcgggctcgggcctgccgatctggcattgctcggcctcagcgcagagagagtttggcttgataagagcctgttcgatcaagctgaaagctcctaccgacagaaactcgctgacgtggccgcacaggccgcatggccgccagcactagccccatgggggctctgcactcacgggaaccaagtcgcatgtcatcatgtgacctggggcatctgggtcaataagagtagctttgatcaggctgaaagggccttcgtggagtggagccaggccctgctcctggcgcctgatggctcccgacgtcaaggcacacccaacaccggccaacaggtcgctgtccccgatcttgcacaccaaccatcaccgccagtgaatggccagccccctctggggagcctccaggccctggtgagggaggtttggctcgaaaaacctcggtatgatgccgctgagcgagggttctacgaagccctctttgacggccacccccctggtaaagtgagacttcaagagcgggctgggttggctgaaggagccagacgcggacggagggacagacgaggaagaaatatcttaggaaataagagagccggtctgagacgagcagacggggaagcaccgtccgcattgccttattgctacttcctgcaaaaagacgctgaggcaccgtggctcagcaagcctgcctacgattccgccgaatgcagacatcacgcagcagaagctctgcgcgtagcgtggtgtctcgaggccgctagtttaagtcatagaccgggaccacggtccggtctcagtgtgagcagcctcaggccaaatcgcaaaatggcaaccaacttcctagctcatgaaaaaatatggtttgacaagttcaagtatgacgacgctgaacgaagattctacgaacaaatgaacggcccagtagccggagcgtctcgccaggagaatggagcctccgtgattctccgtgatatcgctcgcgcacgggagaacatacagaagtcactggccggatccagcggaccgggagcaagttccggcacaagcggtgatcacggagagctggtagtgagaattgccagcttagaggtcgaaaaccagtccttgcgcggagttgtacaagaactacaacaggcaatctcaaaactggaagcacggctgaacgtgctcgagaagtcctcgcccggtcaccgcgctactgccccacagacccagcacgtgagcccgatgcgccaggtcgagcctccagctaaaaagcccgctacacccgcagaggacgatgaagacgacgacattgacctgttcggaagcgacaacgaagaggaagacaaagaggcagctcagctgagagaggaacggctccggcagtacgccgaaaaaaaggccaaaaaacccgctctggtggctaagtcttctattctgctggacgtaaagccttgggacgacgaaaccgatatggcccagctggaggcctgtgtgaggtctatacaattggacgggcttgtctggggggcatctaaactggttcccgtggggtatgggatcaggaaattgcagatccagtgcgtagtggaagatgataaagttgggaccgatctattagaggaggaaatcacaaagtttgaagagcatgtgcagtccgtggacatagctgcctttaataaaatctag

SEQ ID NO: 222433 - DNA, 615 bp, Artificial Sequence
  Description of Artificial Sequence: Synthetic coding sequence
atggcaacaaattttctggcccacgagaaaatctggttcgacaaattcaagtatgacgacgctgagcgaaggttttatgaacaaatgaacggtcctgtggctggggcatctcgccaggaaaacggggctagcgtgatccttagagatattgcaagagcccgagagaatatccagaaatctctagccggttccagcggtcccggtgcttccagtggaacctctggagaccacggagagttggtggtccgcatcgcttccctggaggtcgagaatcagagcctgcggggagtcgtgcaggaactacaacaagccatctctaaattagaggccaggctgaatgttctagaaaaaagctccccgggacacagggccaccgccccacagacccaacatgttagccctatgagacaggtggaaccgcctgcaaagaagcccgctactcccgcagaagacgatgaagacgatgacattgacctcttcggcagcgataacgaggaggaggacaaggaagcagcacagctgagagaggagagattaaggcaatatgccgaaaagaaagccaaaaaacctgccctcgtggcaaagtcctccatattactcgacgttaaaccatag

SEQ ID NO: 222434 - DNA, 507 bp, Artificial Sequence
  Description of Artificial Sequence: Synthetic coding sequence
atggccactaattttttggcacacgagaaaatttggtttgataagtttaagtatgatgatgccgagcgcagattctacgaacagatgaacggtccagtcgccggtgcttcacgtcaagaaaatggcgctagcgttatactccgggatattgccagggccagagagaacatacagaagagcctggcagggagttcagggccaggtgccagttcgggcacaagcggggaccatggcgagctggtggtgcgcatcgcctccctggaagtcgagaatcagtctctgagaggcgttgtgcaggagttgcaacaggccattagtaagctggaggcacgtctgaatgtactagagaagagttcacccggtcatcgcgcaacagcccctcaaacccagcatgtcagtcccatgaggcaggtggagcctcccgctaagaagccagccactcccgctgaagatgatgaagacgatgacatagatttgtttgggagtgacaacgaggaagaggactag

SEQ ID NO: 222435 - DNA, 786 bp, Artificial Sequence
  Description of Artificial Sequence: Synthetic coding sequence
atggcgaccaattttctggcgcacgagaagatttggtttgacaaattcaagtacgacgatgcagaaagaagattttatgaacagatgaacgggcctgtcgcaggggcatccagacaagagaacggcgctagcgtgatattgcgtgatatcgctagagcccgagagaacatccaaaaaagcctcgccggaagtagtggcccaggagccagctccgggacttcaggggaccatggagaattggtggtgcgtatcgcgagcctagaggtggaaaaccaaagtctgcgtggcgtggtgcaagagcttcagcaagctattagcaaactggaggctagattgaatgttcttgaaaagagtagtcctggtcacagggccacagcgccacaaacgcagcatgtcagtcccatgcggcaggtggagccccctgctaagaagcctgctactcccgcagaggacgacgaagacgacgacatcgatctcttcggctccgacaatgaggaggaagataaagaagccgcacaactaagggaagagagactacgacagtacgccgaaaagaaagccaagaagcctgccctggtggcaaaatctagcattctactggatgtcaagccctgggatgacgagacagatatggcacagctggaagcatgcgttcggtccatccagctggatggcctggtgtggggtgcatcgaaattggtcccagtggggtacggcattaggaaactccagatacagtgtgtggtggaagatgataaggtaggaaccgatctccttgaagagtag

SEQ ID NO: 222436 - DNA, 96 bp, Artificial Sequence
  Description of Artificial Sequence: Synthetic coding sequence
atgcggtccggaaaggcctcatgtaccctggagacagtctgggaagataaacacaagtacgaagaggcagaaagaagattctatgaacatgagtag

SEQ ID NO: 222437 - DNA, 207 bp, Artificial Sequence
  Description of Artificial Sequence: Synthetic coding sequence
atgcgttctggcaaggcatcatgtaccctggagaccgtgtgggaggacaaacacaagtatgaggaggctgaacgcaggttttacgagcacgaggccacacaggcagctgcctcagctcaacagctgcctgccgaaggacctgccatgaatggcccagggcaggatgaccccgaagacgcagatgaagctgaggcccctgacggttag

SEQ ID NO: 222438 - DNA, 789 bp, Artificial Sequence
  Description of Artificial Sequence: Synthetic coding sequence
atggccaccaatttcttggctcacgaaaaaatttggttcgacaaattcaaatatgacgacgccgagcggaggttctatgagcagatgaacggtccggtggctggtgcttcccgacaggagaacggcgcatcggtcatcttgcgtgacatcgcgcgagccagagaaaacattcagaaaagccttgccggttcttctggacctggagcatctagcggaacaagcggtgaccatgtggttcaagagctccaacaggcaatttccaagctggaggctcggcttaatgtgttagaaaaaagtagccccggacacagggctacagcgccacagacacagcacgtgtccccaatgagacaggtggagccacccgctaaaaagccagccacgcccgcagaggacgacgaggacgatgacattgatctgttcggctctgataacgaagaggaagacaaagaggcagctcagctccgggaggagcgcctccgacagtacgccgagaagaaagccaagaaaccagctctggtggctaaatcctcaattttgctggacgtgaagccttgggatgatgagacggacatggcgcagttagaggcatgcgtgcggtcaatccagcttgatggactcgtttggggtgctagcaaacttgtccccgtgggttacggaatcaggaagctgcaaattcagtgcgtggttgaagacgacaaagtcggcacagacctacttgaagaggagatcaccaagtttgaagaacacgttcagagtgtggatatagccgcattcaataagatttag

SEQ ID NO: 222439 - DNA, 525 bp, Artificial Sequence
  Description of Artificial Sequence: Synthetic coding sequence
atggccgctgccgctgaactgtcactcttggagaagtccctggggttgagtaaaggcaataaatactctgcccagggcgagagacagataccggtgctccagaccaacaacggcccttccctgaccgggctgacaactatagctgcccatctggtcaagcaggccaataaggaataccttctgggtagtacagccgaggagaaagcgatcgtgcaacagtggctggagtatagggtaacccaggttgatggacacagctcgaagaatgacatccacacactgcttaaagacctgaatagttatctggaagacaaggtatatctcacaggctacaacttcaccttggctgacattttactgtactacggactgcacaggttcatcgttgacttaacagtacaggagaaggagaaatacttgaacgttagcagatggttttgtcacatccagcattaccctggaatccgtcagcatctttcgtcagtggtgttcattaagaaccgtctgtacaccaatagccactag

SEQ ID NO: 222440 - DNA, 420 bp, Artificial Sequence
  Description of Artificial Sequence: Synthetic coding sequence
atggcagcggcagctgagcttagcctgcttgaaaagtctcttggcctctctaagggaaacaagtactcagcacaaggcgaaaggcagattccggtgttgcaaaccaacaacggaccaagtcttacaggcctgactactatagctgctcatcttgtcaagcaggccaacaaagagtatctattggggagtacagctgaggagaaagccatcgttcagcagtggcttgagtatagagtgactcaagttgatgggcactcaagcaaaaacgacatccacacgctgcttaaggacctgaatagctatctagaggataaagtctatctgaccgggtacaattttacattggccgatatcctgctctactacggactgcaccgtttcatcatcagaaaattaaggcacacggaggtcggcaactag

SEQ ID NO: 222441 - DNA, 1314 bp, Artificial Sequence
  Description of Artificial Sequence: Synthetic coding sequence
atggctgccggtaccctgtatacttacccggaaaactggagagcttttaaagcattaattgccgctcaatactcaggtgcacaggtccgtgtgctgtcagctcccccacacttccattttggccagacaaaccgcacccctgaattcctcaggaaatttcccgctggcaaggtaccagccttcgaaggtgatgatggcttttgtgtgttcgaatcgaacgccatcgcctattatgtgtctaacgaagaacttcgtggctccactcctgaggccgcagcccaagtggtgcagtgggtctctttcgccgattctgacatcgtgccacctgcgtccacctgggttttccccactctcggcattatgcaccacaacaagcaggcaaccgagaatgccaaagaggaagtgcggagaatcctcggcctgttagatgcctatctgaaaacaagaaccttcttagtaggtgagcgggtcacccttgccgatattaccgtcgtatgtacactgttgtggttgtataaacaagtcctcgagccgtcctttcgtcaggctttccccaatactaatagatggtttctcacgtgcataaatcagcctcagtttagggcagtacttggtgaagtgaagctgtgtgaaaagatggcacagtttgacgctaagaaattcgcggaaacccagcctaaaaaagatacgccaagaaaagagaagggttcccgcgaagaaaagcagaaaccccaggcagagcgcaaagaagagaagaaggcggcagcccctgcacctgaggaggaaatggacgaatgcgaacaagctctagccgctgagccaaaagcaaaggatccattcgcccacctcccaaaaagtacattcgtccttgatgagttcaagcgtaagtactccaatgaagatactcttagcgtcgctcttccttatttctgggagcactttgacaaggatggttggagtttgtggtattccgagtatcgtttccctgaagagctgacacaaacctttatgtcctgcaaccttatcaccgggatgttccagcggctcgacaaactcaggaaaaatgccttcgctagcgtgatattgtttgggactaataacagtagcagcatatcaggagtttgggtctttcggggacaagagttggctttccctctgtcacccgactggcaagtggattacgagagttacacatggcggaagctggatcctggatctgaggagactcagactttggttcgggaatactttagttgggagggggcttttcaacacgtgggtaaagctttcaatcagggcaagatctttaagtag

SEQ ID NO: 222442 - DNA, 1464 bp, Artificial Sequence
  Description of Artificial Sequence: Synthetic coding sequence
atggccgaaaggtgggtggccccagcagtgttaagacgagccagattcgcctcaaccttcttcctgagcccgcagatatacgctcacaaggatggcgacttgcgttcggccttttttatccttagcttcaaacgcggagagtttatcccctttctgaactggacactatacacataccctgaaaattggagggcttttaaggccctgatcgccgcacagtattccggagcgcaggtgcgggtgctgtctgctccaccacacttccatttcgggcagaccaatagaactcccgaattcctcaggaagtttcccgctggcaaggtaccagccttcgagggagacgacggtttctgcgtgttcgagagcaacgcaattgcgtactacgtgtctaacgaggaactgagaggcagcacccccgaagccgctgctcaggtggttcagtgggtgagctttgctgattcggatattgtcccgccagcgtcaacctgggtctttccaacgctgggcatcatgcaccacaacaaacaggctaccgaaaacgcaaaagaggaagtccgtagaatcctggggctcttggacgcttacctgaaaactcggacgttcttggtcggagagcgagtcactctggccgatatcacagtagtgtgtacactactgtggctgtacaaacaagtgctggaaccaagctttagacaggccttcccaaacaccaacaggtggttcctcacctgtataaaccagcctcaatttagggctgttttaggggaagtgaagctctgcgaaaagatggcccaatttgacgccaaaaagttcgccgaaacccaaccgaagaaagacacccccaggaaggagaaggggagtagagaagagaagcaaaaaccgcaggcagagagaaaagaagaaaaaaaggcggctgccccagctccggaagaagaaatggatgaatgcgagcaggcactggctgctgaacctaaggcaaaggatcccttcgcccacctgcccaaatcaacctttgtcctcgacgagtttaaaagaaaatatagtaacgaagatacgctgtccgtcgcattgccctatttctgggagcactttgataaggatgggtggtccctgtggtacagcgaatacagattccctgaggagttaacacagaccttcatgtcctgtaacctcattacaggaatgtttcagcgtctggataagctccgcaagaacgccttcgcaagcgtgatcttgttcggtactaataacagtagctctatctccggagtatgggtcttcaggggacaggagctggcctttcctctgtcccccgattggcaggtggactatgaaagctacacctggagaaagctggatcccggatctgaggagacacagaccctcgttagagagtatttcagctgggagggggcattccagcacgttggcaaggcttttaaccaggggaaaatttttaagtag

SEQ ID NO: 222443 - DNA, 621 bp, Artificial Sequence
  Description of Artificial Sequence: Synthetic coding sequence
atgcaccacaacaaacaggccacagagaatgctaaagaggaggtaaggcgcatcttaggcctgctggatgcctacctgaagaccagaaccttcctggtgggggagagggtcacactggccgcagagcctaaggccaaggaccccttcgcccacttacccaaatcgacattcgtgctagacgaatttaagcgcaaatactcaaacgaagacaccctctccgtagctttgccttatttctgggagcacttcgacaaggacggctggtcactgtggtactccgagtacagattccccgaggaacttacacaaacgttcatgagctgcaatttgatcacagggatgtttcaacgactggataagttaaggaagaacgccttcgctagcgtgattctattcggtactaataattcttcttccatctctggcgtctgggtatttagaggacaggagctggcattcccactttctcccgattggcaagtggattacgaaagctacacctggcgaaagttagacccaggatctgaagagactcagaccttagtgcgcgagtacttctcatgggagggggcatttcagcatgtcgggaaagccttcaatcaagggaaaatttttaagtag

SEQ ID NO: 222444 - DNA, 2577 bp, Artificial Sequence
  Description of Artificial Sequence: Synthetic coding sequence
atggtaaactttactgtagaccagatccgtgccatcatggataagaaagccaacatcaggaacatgagcgtcatagctcatgtcgatcacggcaagagcaccctgaccgacagtctcgtgtgcaaagcgggtatcatagccagcgctcgcgctggcgagaccagatttaccgacacgcgtaaagacgaacaggagagatgcataactattaaaagtactgccatttcattgttttacgaactcagcgaaaacgacttgaacttcatcaaacagagcaaagacggagccggatttttgattaacctgattgattcccccggacacgttgattttagcagcgaggtcactgcagccctccgggtgaccgacggagcactggtggtcgtggattgcgtgagcggcgtgtgcgttcagactgaaacagttcttagacaggcaattgcggagagaatcaagcctgtgctaatgatgaacaaaatggaccgagcactgttagaacttcagctggagcccgaggagctctaccaaacctttcagcgcattgtagaaaacgtgaatgtgatcattagtacttatggagagggggagagtggacctatgggaaacatcatgatagacccagtgctggggacagtgggctttgggagtggtctgcacggttgggcgtttaccctgaagcaattcgccgaaatgtacgtggccaagtttgccgcaaagggcgagggacagttaggcccagccgagcgcgctaaaaaagtcgaggacatgatgaagaaactgtggggggatagatactttgatcccgcaaacggcaaattttccaaaagtgccacaagtcctgaggggaagaagctgccaagaaccttttgccagctgattctagatcccattttcaaggtgttcgacgcaattatgaacttcaaaaaggaagagacagctaagcttatcgaaaagctagatatcaaattggacagcgaggacaaagacaaagagggtaagccacttcttaaagccgtgatgagacgctggctgcccgctggagacgctttactgcagatgataaccatccacctgccttccccagttacggctcagaagtacaggtgtgaactcttgtacgaagggccaccagatgacgaggccgcaatggggatcaaatcttgcgaccctaaaggccctctgatgatgtacattagcaaaatggtgcctaccagtgataagggtcgtttctacgccttcggaagggtcttttctggcctggtctcgaccggcctgaaggtccggatcatgggtcccaactatacacctgggaagaaggaggacctgtatctgaaacctattcagcgtactatacttatgatggggcgatatgtcgaacccattgaggatgtaccttgtggaaatattgtggggctcgttggagtcgaccagttcctcgtgaaaactggcaccataaccacatttgagcacgcccacaatatgcgagtcatgaaattttccgtcagtccggtggtccgcgttgccgttgaggcaaaaaatcctgcagatcttcccaagctggtggagggactcaagcgactggcgaaatctgaccctatggtccaatgtataatcgaagagtcgggagagcacatcatcgccggagctggagaactccacctggaaatttgcctgaaagatctggaagaagaccacgcatgcatccctattaaaaagtccgacccagttgtgagctatcgggagaccgtctccgaagagtccaacgtgctctgtctgtccaaatcaccaaataagcataataggctttacatgaaggccagaccctttcccgatggcttagcagaagatatagataagggagaggttagtgcaaggcaggaactgaaacagcgcgctcgctatttagcggaaaaatacgagtgggacgttgccgaggccaggaaaatatggtgctttggaccagacggaacaggacccaatattttgacagacatcacgaagggagtgcagtacctgaacgagattaaggacagtgtcgttgccggtttccagtgggctaccaaagaaggggcactgtgcgaggaaaatatgcgtggggtcaggtttgatgtgcatgatgtgactctgcacgcggacgcaattcaccgcggaggcggtcagatcattcccacagctagacggtgcctgtatgcgtccgtacttaccgcccaacccagactgatggaaccgatctaccttgtggaaattcagtgtcccgaacaggtggtgggagggatttacggtgtcctgaatcgaaaaagggggcacgtgttcgaggagagtcaggtggctgggactccaatgttcgtggtcaaggcctacctcccagtgaacgagtccttcggtttcaccgccgatctcaggagtaacactggtggacaggctttccctcagtgcgtattcgaccactggcaaattctgccaggcgatccattcgacaactcttcaagaccttcacaggtagtggcagagacaaggaagcgtaaggggctaaaagaaggaatccctgcactcgataacttcctcgacaaactctag

SEQ ID NO: 222445 - DNA, 1752 bp, Artificial Sequence
  Description of Artificial Sequence: Synthetic coding sequence
atggtcaacttcacggtggaccaaattcgcgctattatggacaaaaaggcaaatataaggaatatgtccgtcatcgcgcatgtagaccacggaaagagcactcttaccgatagcctggtctgtaaggcagggattatcgcttcggctcgagcaggagagaccaggttcactgacacacggaaggacgaacaagagcgctgcatcactattaaaagcactgccatttctctgttttatgagctctctgaaaatgacttgaactttattaagcagtcaaaggacggcgctggattcttgataaatctcatagattcgccaggtcacgtcgactttagctccgaggtaaccgcagccctccgggtcacagatggtgcactggtggtcgtggattgcgtgtcaggcgtgtgtgtccaaactgaaactgtgcttcggcaggcgatcgctgagcggattaaaccagtgctcatgatgaacaaaatggacagagctctgctagagctgcagctggaacccgaggagttgtaccaaacctttcagagaatcgtggaaaacgtaaatgtgattatcagtacctacggggagggtgaatcagggccaatgggtaatatcatgattgatccagtccttggcactgtcggttttggttccggtctgcatggctgggctttcactcttaaacaattcgctgagatgtatgttgctaaatttgccgcaaagggcgagggccagctcgggcctgccgaacgcgcaaaaaaagttgaggacatgatgaaaaagctctggggagacaggtacttcgaccctgccaatggtaaattctcgaagagtgcaacgtcccctgagggtaaaaagcttccccgaaccttctgccagcttatcctagaccccatttttaaggtgtttgatgccattatgaactttaaaaaagaagaaaccgctaagttgattgagaagctcgatataaagctggatagcgaagataaggataaggaaggcaagcctcttctgaaggccgtaatgcgcaggtggctgcccgctggagatgcccttctccaaatgattacaatccacctgcccagccccgtcacagctcagaaataccgctgtgaactgttgtatgaggggcctccggatgacgaggcggctatgggtataaagtcctgcgaccctaaagggcctctgatgatgtacatttcgaagatggtgcctaccagtgataaaggccgtttttacgcattcggcagggtgttcagtggtctggtgtccacagggttaaaagtgcgcatcatgggccctaactatacccctggaaaaaaggaagacctgtacctaaagccaattcaaaggaccatccttatgatgggaagatacgtggaacccatcgaggatgtgccttgtggaaacatcgtcggactagttggagtggaccagtttctggtgaagacaggtaccatcacaacttttgagcatgcccacaacatgagagtgatgaaattctctgtgtcacctgtggtcagggtcgccgtagaggcaaagaatcccgcagacctgccaaagcttgtagaaggccttaaacggctggctaagtctgaccccatggtgcagtgcataatcgaagaaagcggtgagcatatcatcgcaggggctggggagcttcatctcgagatctgtctcaaagatctagaagaggaccacgcgtgtatccctatcaaaaaagaaaccgtcagtaaaaagaaaaaaaaaaaaaaatag

SEQ ID NO: 222446 - DNA, 351 bp, Artificial Sequence
  Description of Artificial Sequence: Synthetic coding sequence
atgcccaagaataaagagtatgctcaggtgattaaaatgttagggaatggaaggctcgaagcgatgtgctttgacggtgtgaaacggttatgccacattcgcggaaaattgagaaagaaagtctggatcaacacatccgacattattctggtcggcctacgggattaccaagacaataaggcagacgtcattctcaaatataatgcggacgaagcacggtcccttaaggcatatggggaactgcctgagcacgcaaaaatcaatgaaacggacactttcggcccaggggatgacgatgaaatccagttcgacgacataggcgacgacgatgaagatatagacgacatctag

SEQ ID NO: 222447 - DNA, 435 bp, Artificial Sequence
  Description of Artificial Sequence: Synthetic coding sequence
atgcccaagaacaaagggaaaggtggaaaaaaccgcaggaggggtaagaacgaaaatgagagtgagaaacgtgaactggtgttcaaggaagacggacaggaatacgcacaggtcattaagatgctgggaaatgggcgactggaggctatgtgcttcgatggggtcaaaagactctgccacataagagggaaattacggaaaaaagtctggattaatacaagcgatattattttagtcgggcttcgcgactatcaggacaacaaggcggacgtgattctgaagtataatgccgatgaagcaaggtcactaaaagcatacggagagctgcccgagcacgctaaaattaatgagactgacaccttcggacctggcgatgatgatgagatccagtttgacgatataggcgacgacgacgaggatatcgatgacatttag

SEQ ID NO: 222448 - DNA, 435 bp, Artificial Sequence
  Description of Artificial Sequence: Synthetic coding sequence
atgccaaagaacaagggcaaagggggtaagaatcgcagaagaggaaagaatgagaatgaaagcgaaaaacgagaactggtgttcaaagaagatggtcaggaatatgcccaggtcattaaaatgctggggaatggtcggctggaggccttatgcttcgatggcgtgaagcgcttgtgtcatattcggggaaaactgcgtaagaaagtctggatcaatactagtgatatcattctggtaggactgcgggattaccaagataataaggcagacgtcatcctgaaatacaacgccgacgaagctagaagtctgaaggcatatggagaattgccggaacacgcaaagattaatgagacagacaccttcggccctggagacgatgacgagatccagtttgacgacatcggggacgacgatgaggatattgatgatatctag

SEQ ID NO: 222449 - DNA, 384 bp, Artificial Sequence
  Description of Artificial Sequence: Synthetic coding sequence
atgcctaagaataagggcaagggcggaaagaatcgcagaagggggaagaatgagaatgaaagtgaaaaacgagaactagtcttcaaggaggacggtcaggaatacgctcaagtgattaagatgctgggtaatgggcgactcgaagccttgtgtttcgatggggtgaagcgactgtgtcacatccgcggaaaacttcgaaagaaagataacaaggctgacgttatcttaaagtataatgccgacgaggcccgttccctcaaggcatatggtgaattaccagaacacgccaagatcaatgagaccgatacgtttggacccggagatgacgacgagatacaatttgacgacatcggggatgacgatgaggatattgacgatatttag

SEQ ID NO: 222450 - DNA, 1419 bp, Artificial Sequence
  Description of Artificial Sequence: Synthetic coding sequence
atggccggtggagaagcaggcgtgacacttggccagccccacctctcacggcaggatcttactacactcgacgtgacaaaactgacgccactttcacacgaggtcatttcccggcaagccaccattaatataggaactataggtcatgtggcccacggtaagtcgacggtagtcaaagcaatttctggtgtccatacagttagatttaaaaatgaactcgagcgcaatatcacaataaagctgggctatgctaatgcgaagatctataaactcgatgatccatcttgcccgcgtcccgaatgctatcgatcttgtggctcttccacacctgatgaattcccgaccgatatccccggtaccaagggcaactttaagctcgtgaggcacgtgtccttcgttgattgccccggtcacgacatcttgatggctaccatgctcaacggcgctgcagtgatggacgctgcactgctgttaattgctgggaatgagtcatgtccccagccgcaaacctcggagcatctcgccgcaatcgaaatcatgaagttgaagcatatcctgatcttacaaaacaagattgatctcgttaaggaatctcaggcaaaggagcaatatgagcagattcttgccttcgtgcagggtacagttgcagaaggcgcaccgataatcccaattagcgctcaattaaagtataacatcgaagtggtttgtgagtatatcgtgaaaaagattcctgtgccgcctcgagatttcacatccgagcctcggctgattgtgatccgcagcttcgacgtcaacaaaccgggatgcgaagttgacgatctaaagggaggagtagccggtggttctatcctgaaaggggtgctgaaggttggccaggaaatcgaggtgcggccaggaattgtaagtaaagactcagaaggcaaacttatgtgcaaaccgatcttctccaaaatcgtgtctctttttgctgagcataacgacttacagtacgcagctcctgggggactgatcggggtgggtacaaaaatcgaccccaccctgtgccgggcagatcggatggtgggccaggtgttgggcgctgttggcgcattacctgagatctttacagaactggaaattagttatttccttctgcgacgcctgctcggagttagaactgagggcgataagaaggcggctaaggtgcagaaactaagcaaaaatgaagtgctgatggtgaatattggctccttgtctacgggaggccgtgtgtcggccgttaaggcggacctcggcaaaatcgtgctcaccaatcccgtgtgtaccgaggtgggggagaaaatcgccctaagtagaagggtggagaaacattggaggttgatcggatgggggcagatccgaaggggcgttaccattaagcctaccgtggatgacgactag

SEQ ID NO: 222451 - DNA, 552 bp, Artificial Sequence
  Description of Artificial Sequence: Synthetic coding sequence
taagctggaggcgaggcaggtgtgacgcttggccaaccacacctctctaggcaggacctgactacactggatgtaaccaaactgactcctctgtcccatgaggtcatttcccggcaggctacaatcaatattggcaccataggccatgtcgctcacggcaagagtactgtcgtgaaggcaatatccggggtgcacaccgtgaggttcaaaaacgaattagagcgcaatatcacgatcaaactggggtacgcaaacgccaagatctacaaactggacgatccatcctgtccaaggcccgagtgctatcggagctgtggctccagcaccccagacgaatttcccaccgatattccagggacgaagggcaactttaagctggtgcgacacgtgtcatttgtggattgcccaggacacgatattctgatggccaccatgttaaacggggcagcagttatggacgccgcactgctgctgatcggcaaatacctcactatcggtctggacaaatccatgtggaacaagagcaagatgaaatatctaaaaggaaattag

SEQ ID NO: 222452 - DNA, 1116 bp, Artificial Sequence
  Description of Artificial Sequence: Synthetic coding sequence
atgtttcaggaagtcaaagctgacaaggtgactatgctatggaataaaaaagcaaccgctgtgcttgtcattgcgtccactgatgtcgacaagacaggagcatcttattacggcgagcagacccttcactatatcgccactaacggtgagagtgctgttgtgcagttgcccaaaaatggacctatctatgatgttgtatggaactcctcaagcactgaattttgtgccgtgtacggcttcatgccagccaaggccactatcttcaaccttaagtgtgatccagttttcgactttggcactggacccaggaacgccgcttactactcacctcacgggcatattctggtcctggcgggtttcgggaaccttaggggacagatggaggtgtgggacgtaaaaaactacaaactcatctctaagccagtggcaagcgactccacctacttcgcctggtgtcccgacggggagcatatacttaccgccacgtgtgcacctaggcttagagtgaacaatggttacaaaatctggcattacacgggctcaattctgcataaatacgatgtaccttccaacgcggaactttggcaggtgtcctggcagcccttcctcgatggcatcttccctgcaaagacgatcacataccaggctgtcccatccgaggtccccaacgaggaacccaaagtagccaccgcttaccggccaccagctcttagaaataaacccatcacaaattcaaaactacatgaggaggaaccccctcaaaacatgaagcctcagagcggaaacgataaaccattgtctaaaacggccctaaaaaaccagcggaagcacgaggctaaaaaagcggctaagcaggaggctcgatccgacaagtcccctgatctggctccaactcccgctccacagtccacgcctaggaatactgtcagccagtccattagcggcgacccagaaattgacaagaaaattaaaaatctcaaaaaaaagctgaaggccatagagcagctgaaggagcaagccgcaaccggaaagcagctggaaaagaatcagcttgagaaaatacaaaaggagactgccctgctgcaggagctcgaagacttagagctcggcatctag

SEQ ID NO: 222453 - DNA, 1758 bp, Artificial Sequence
  Description of Artificial Sequence: Synthetic coding sequence
atggccccttcaactccactgctgacggtcaggggatccgagggactgtacatggttaacggtccacctcatttcacggaaagcacagtgtttccaagggaaagtggtaagaactgcaaagtgtgcattttttctaaagacggaaccctatttgcctggggcaacggtgagaaagtgaatattatctccgttacgaataagggtcttctgcacagtttcgaccttctgaaggccgtttgcctggaattttcccctaaaaacaccgttctggccacttggcagccatacacgacctcaaaggatggcacagcaggtatccccaatctccagctgtatgatgtgaaaaccggcacctgtttaaagagcttcatccagaagaagatgcagaactggtgccctagctggtctgaggacgaaacattgtgtgccaggaatgtgaataacgaggtgcatttcttcgagaacaacaatttcaataccatcgcaaacaagttgcatttgcaaaaaattaatgattttgttctatcccctgggcctcagccttataaagtcgccgtttacgtgccagggtctaaaggagcaccatcatttgtccgcctgtaccagtaccctaacttcgctggcccacatgccgctttagcaaataagtccttctttaaagccgacaaagtcacaatgctgtggaacaaaaaggcgacagcagtactagttatagccagcaccgatgtggataaaactggagctagctactatggcgaacagaccctacactacatcgcgaccaacggtgagtcagctgtggtgcagctgcctaagaatggccctatttacgacgtggtgtggaatagcagcagcaccgagttctgtgcggtttacggttttatgcccgctaaagccaccatcttcaacctgaagtgcgatccagtgtttgacttcggcactggaccacgcaacgccgcatactacagcccgcacgggcacatcttggtcttggctggctttggcaacctccgtggccaaatggaagtttgggatgttaaaaattataaactgatcagcaaacccgttgcatccgatagtacctactttgcatggtgtccagacggtgaacatatcctgactgccacctgcgcacctcggcttagagttaataacggctacaaaatctggcattataccgggagtatcctgcataaatatgacgtgccaagcaacgcagaactttggcaggtgtcctggcagccatttctggatggcatctttccagccaagacaatcacgtaccaggctgtacctagcgaagttcccaatgaggagccaaaagtcgctacggcttatcgccctccagccctccggaacaagcctattaccaattctaagctgcatgaggaggagccgccacaaaacatgaaaccacagagcggcaatgataaacctttgagcaagaccgctttaaaaaaccagagaaagcacgaagctaaaaaggccgctaaacaggaggcgagaagcgacaagagccctgacctggctccaacccccgcaccgcaaagcactcctcgcaataccgtttcccagtccatatccggcgatcccgagatagacaagaagatcaagaatctgaaaaaaaaactgaaggctattgaacagttgaaggagcaggctgccaccggaaaacagttggagaagaaccagcttgaaaaaatccagaaggaaaccgccttgctgcaagaattggaagatctcgaacttggaatatag

SEQ ID NO: 222454 - DNA, 1893 bp, Artificial Sequence
  Description of Artificial Sequence: Synthetic coding sequence
atgcagggtgggaattcaggcgtccgtaagcgtgaagaggaaggtgacggtgccggagctgtggccgcacctcctgcgattgattttccagctgagggacctgacccagaatatgatgagtccgacgtcccagctgagatccaagtgttaaaagagccactccagcagccaaccttcccatttgctgtcgccaaccagctcctgctggtgtctctcctcgaacacctgagccacgtccacgaacccaaccccttacggtctcggcaagtcttcaagctgctgtgccagacgtttattaagatggggctactctcttccttcacatgtagcgacgagttttcatccctgcgcctgcaccacaacagagcaattactcatctgatgcggagtgccaaggagcgcgtgagacaggatccatgcgaggacatttccagaattcagaagatacgctctagggaggtagccctagaggcacagacttcacggtacctcaacgaattcgaggaattggccatcctgggaaagggcggatatgggagagtttataaagtaaggaacaaactggacgggcagtattatgcaatcaaaaaaatcctgataaagggcgctacaaaaaccgtgtgtatgaaggtgcttagggaagtcaaggtgctcgccggactacagcaccctaatattgtgggctatcatacagcttggatcgaacatgtccatgtaatccagcctagagctgaccgcgcagcaatcgaactgccttctctagaagtacttagtgatcaagaggaagacagggaacagtgtggcgtcaagaatgacgaatcttcaagctcatccatcatcttcgccgagcccacccccgaaaaagaaaagagatttggggagtcagacactgagaaccagaataataagtctgtaaagtataccacaaatcttgtgatacgcgagagcggggaactagagtctacactagagctccaggaaaacggattggccggactgagtgcttcctccattgtggagcaacaattaccattaaggcggaactctcatctggaggaatcctttacctcgacagaagagagctccgaagaaaatgtcaacttcctgggccagaccgaggctcaatatcacttaatgctgcacattcaaatgcagttgtgcgaactatccctatgggactggatcgttgagcgcaataagcgtggaagggagtatgtcgatgagtctgcctgcccctatgtgatggccaacgttgcaaccaagatcttccaggaactggttgaaggagtgttttacattcataacatgggaatcgtgcaccgcgatcttaagccgaggaacatctttcttcacgggccagaccagcaagtgaagatcggtgatttcgggctggcttgtaccgacatcctgcagaaaaacacagattggactaatagaaacggcaaaaggacccccacgcacacctctcgcgtgggcacttgtttgtatgcgagccctgagcagctagaaggatcggagtacgacgctaaatctgatatgtacagtcttggggtagtgctattagagctctttcaaccgtttggcactgagatggagagagccgaagtcctgactggccttaggaccggacagcttcccgagagtctccgcaaaagatgcccagtgcaggcaaagtacatccaacacctcactaggagaaattcatctcagaggccatccgccatacagttgctccaatccgaactgtttcaaaattcaggcaacgtcaatttgacccttcagatgaaaatcattgagcaagagaaggagattgccgagctgaaaaaacagctcaacctattgagccaagacaagggagttcgggacgacggaaaagacggcggagttggctag

SEQ ID NO: 222455 - DNA, 1734 bp, Artificial Sequence
  Description of Artificial Sequence: Synthetic coding sequence
atgaaccagacgcatttcgtacaggaccggtgcttgagtgatccttgcgaggatatttctagaatccaaaaaatccggtctcgcgaagtggccctcgaggcacaaacatcccgctatcttaacgagttcgaggagctggctattttgggaaagggcggatatgggagagtgtacaaggtgagaaacaaactcgacggccagtactacgccatcaagaaaatcttaataaaaggagctactaagaccgtgtgtatgaaggtcctgcgggaagttaaggtcttggctggccttcagcacccaaatatcgtgggctatcacaccgcgtggatcgagcacgtgcacgttattcaacccagagccgatagggcggcaatcgagctgccttccttagaagttttgagcgatcaagaagaagaccgcgaacagtgcggtgtaaagaatgacgaatctagcagctcttcaatcattttcgctgagcctactccggagaaagaaaagcgctttggagaaagcgacactgagaatcagaataataaatctgtgaagtacacaactaaccttgtcatacgggagtcaggagaactggagagtaccctagagttgcaggagaacggccttgccggactttccgcctcaagcattgtcgagcagcaactgcctctgcggagaaatagccacttggaagagagtttcacatcaacagaggagtcttcagaagaaaatgtgaattttctgggacagaccgaagctcagtaccatctgatgctgcacattcagatgcagctatgtgagctgtccctctgggactggatagtggaacggaataagcggggtcgcgagtatgtggatgagtccgcttgcccttacgtcatggcgaatgtcgcaacaaagatcttccaggagttggtggaaggtgtgttctacatccacaacatgggtatcgtccatagagatctcaaaccgagaaacatcttcttgcacgggccagatcagcaagtgaagatcggcgacttcgggctcgcatgcacagacatcctccagaagaataccgactggaccaaccgaaacgggaaacggacgcccactcacacgagcagggtcggcacctgtttgtacgcctctcccgaacaactcgaagggagcgaatacgatgcaaagtctgacatgtactccctgggcgttgtcttgctcgagcttttccagcctttcggtactgaaatggagagggcagaggtcctgacaggattgcgtactggacaactgccggaaagcctccggaagcggtgcccagttcaggcaaaatacatacaacacctgacccgacggaacagttcccaacgcccttcagcaatccagctgcttcagtcagagttattccagaactccggaaatgtcaatttgactctgcagatgaagattatcgagcaggagaaggaaattgctgagcttaaaaagcagctgaacctcctgagtcaagataagggtttcagcgttatcccaaaaccccacccttgcaaagcgctgtactctgcaccccagatgatttctcggcagctaagatccctcagctgcctctgtcccgctctgttccccggtacttcctcattcatcgttgccttgtcttcccctgccaatctgtacattccccagcggcagaggagtgatgagctggtgttcgagtcccaaaaaggatctgccatggagctggctgtgattactgtagacggggtctag

SEQ ID NO: 222456 - DNA, 3351 bp, Artificial Sequence
  Description of Artificial Sequence: Synthetic coding sequence
atggaacgagccatttctccgggacttctggtccgggcactgctgctcctgttgcttctccttggacttgccgcacgtaccgtagccgctggcagagctcgcggtcttcccgcaccgaccgccgaagccgcatttggccttggagcggctgccgctccaacgagcgcaacaagagttccagcagcaggcgcagtggctgctgccgaagtgaccgtcgaggatgccgaggccttgccagccgctgccggagagcaagagccaagaggcccagaacctgacgatgagaccgaacttaggccgagaggcaggagcctcgtcatcatatcaaccctcgacggaagaatcgctgctctcgacccagagaaccatggcaaaaagcagtgggacttagatgttggatcaggatccttggtgagcagctccctgagtaagcctgaggtcttcggcaacaagatgattatcccctctcttgacggagctctgttccagtgggatcaagatagggaatccatggagactgtacccttcacagtagaatctctcctggaatcgtcatacaagttcggagatgatgtggtgctagtaggcggtaagtcactgactacatatggactgtctgcctattccggaaaagtccgctacatttgctcagctctggggtgccggcaatgggacagtgatgaaatggaacaggaggaagacattcttttgctgcagaggacccagaagaccgttagggcagtcggacccagatctggcaacgaaaagtggaatttctcagtgggtcactttgaactgcgctatatccccgatatggagaccagggcgggtttcatcgaaagtactttcaagccaaacgagaacacagaggaaagtaagataattagcgacgttgaggaacaggaggcagcgatcatggatatcgtgatcaaagtgtcagtagctgactggaaggttatggcttttagcaagaagggcggacatctggagtgggaataccagttctgcacacctatcgctagcgcgtggctgcttaaggatgggaaggttatacctatttcgttgttcgacgacacatcgtatacaagcaacgacgatgtgctcgaagacgaggaggatatcgtggaagctgccagaggagcaacagagaactccgtctacctagggatgtacaggggccaactctacctgcaatccagtgtaagaatttctgaaaagttcccatcttccccgaaggcactggagtccgtaaccaatgagaatgcaattattcctctcccaacaatcaagtggaaaccactgatccattccccctccagaaccccggtgctggtgggatctgacgaatttgataagtgcttatctaatgacaaattttcccacgaggagtactcaaacggggctctctccatcctgcagtacccatacgataacgggtactacctgccgtattacaagcgtgagagaaacaagagatccacccagattacagttcgattcctggacaatccacattataataagaatattcgaaagaaagatcccgtgctgctgctgcattggtggaaggaaatcgtcgcaacaatactgttctgtatcatcgccaccacattcatagtgaggcggctctttcatcctcacccacaccgacagagaaaggagtccgaaacacagtgccagacagagaataaatacgatagtgttagtggagaagctaacgattcaagctggaacgacatcaagaatagtgggtacatatcccgctacttaactgatttcgagcctatacagtgtctgggaagaggcggtttcggtgttgtgttcgaagcgaaaaacaaagttgacgactgtaactacgcaatcaaaagaatccggctgcctaatagagagctcgcaagagagaaagtaatgagggaggtcaaggccctggcaaagctcgaacacccaggtatagtgcgttattttaacgcgtggctggaggccccacccgagaaatggcaggaaaagatggatgagatatggctgaaggatgaatctaccgattggcccctgtcgtcaccaagtcccatggatgccccttctgtgaagattcgcagaatggatcctttcgccactaaagagcatatagagatcatcgcaccctccccacagaggtcaagaagttttagcgtagggatcagttgtgatcagacaagctccagtgagagtcagttctcaccgctcgagttctccgggatggaccacgaggacatctctgaatcagtggatgctgcctataatctccaggatagttgtctcacagactgtgatgtggaggatggcactatggacggaaacgacgagggccattcttttgagctgtgcccaagcgaagctagtccatacgtgcgtagccgcgagagaacttcttcatccattgtgttcgaagacagcgggtgcgataatgccagctctaaggaggaacctaaaaccaaccgtcttcatattggcaaccattgcgcgaataagctgactgccttcaagcccaccagctccaagagctcatctgaggccactctcagcatctcgcccccacgtcctaccacattgtccctcgaccttacaaagaacacgaccgagaaactccaacctagctcccccaaagtgtacctttacatacaaatgcagctttgcaggaaagagaatctgaaggactggatgaatggtagatgcactatagaggagcgcgaacggagcgtgtgcctccacatcttcctacagattgcagaggccgtcgaattcctgcactctaagggactgatgcaccgcgatcttaagcccagcaacatcttcttcacaatggatgatgtcgtaaaagtgggtgatttcggcctcgtgacagccatggatcaagacgaggaagaacagacagtcctgacccctatgcctgcgtacgcacggcacacggggcaggtgggaacgaagctctacatgtctcctgaacagatacatggcaattcgtacagtcataaggtggatatcttttccctgggactgatactctttgagctgttatatcccttcagtacccaaatggagcgcgtgcgtacattgacagacgtcagaaatctgaaattccccccattgtttacccagaagtatccatgtgagtatgtgatggtgcaggatatgttatccccctcacctatggagcgacccgaggccattaacatcattgaaaacgccgtgttcgaggatttggattttcctgggaaaacggttctgagacagagatcccgaagtctgtccagctctggaactaagcactcgaggcagagtaacaactcccatagcccgctgccgtctaattag

SEQ ID NO: 222457 - DNA, 2898 bp, Artificial Sequence
  Description of Artificial Sequence: Synthetic coding sequence
atgattataccttctctggatggcgctcttttccaatgggaccaagatagagagagcatggaaactgtacctttcacggtagagagtctcctagaatcctcttacaaattcggggacgacgtggttctggtcggcggtaagagtctgacaacctacggtctctccgcctacagcgggaaggtgcgttacatttgctcagctctaggatgtaggcagtgggactcggatgagatggaacaagaggaggacattctcttgttgcagcgaacccagaagacagttagagcggtgggcccaaggtccggaaatgaaaaatggaatttctcagtcgggcattttgagctgaggtatatacccgatatggaaactagggctggtttcattgaaagcacttttaagccaaacgaaaacaccgaagagtcgaagatcattagtgacgtagaagagcaggaggcggctattatggacatcgtgatcaaggtctctgtagccgactggaaggtcatggcgttcagtaagaagggcggtcaccttgagtgggagtaccagttctgtaccccaattgcgtcagcctggctgctgaaggacggaaaggtgatccctatcagcctgtttgatgacacctcttacacaagcaatgatgacgtgttagaagacgaggaggacatagtggaggccgctagaggagcaaccgagaactccgtatacttaggcatgtacagaggtcagctctatctccagagttcggtaaggatttctgaaaaatttccatctagtcctaaggctctcgaatcagttaccaatgagaacgcgattatcccactgccaacgataaaatggaagccactaatccactctccaagtaggacaccggtgctagtaggatctgacgaattcgacaagtgcctaagcaatgacaagttttcgcatgaggagtactctaacggcgctctgtccatattgcagtatccatacgacaacggttactatctgccttactacaagcgggaacggaacaagagatcaactcagatcactgtccggttcttggataacccacactataacaagaatatcaggaagaaagacccagtgctgctgctccattggtggaaagagatcgtggccacaatacttttctgtatcatcgcaactacttttattgtgcggcgactgttccatccgcacccacatcgccagcgaaaagaatccgagacccagtgtcagactgagaacaaatacgactccgtatcaggcgaggccaatgactcctcttggaacgacataaagaattctggatacatcagcaggtacctgaccgattttgaaccgattcaatgcctaggccgtggagggtttggggtggtctttgaagccaaaaataaagttgatgactgtaattatgccattaagaggatccgcctgccaaatagggaactggcaagagagaaagtaatgagggaagtgaaggccctggccaaacttgagcatccaggcattgttcgttactttaacgcctggctcgaggctccaccagagaagtggcaagagaagatggacgagatctggttaaaagacgagtcaactgattggcccctctctagtcctagcccaatggatgccccttccgtaaaaattcgaaggatggatccctttgctacaaaggaacacattgagataatcgctcccagcccgcagcggtcccgctcatttagcgtgggtatctcatgtgaccagactagctcaagcgaaagtcaattttccccgctggaattcagcggcatggatcatgaagatataagcgagtcagtggacgccgcttacaatttacaggatagctgtctgactgactgcgatgttgaagatggaaccatggacggtaacgatgaaggtcactccttcgaactttgcccaagtgaggcctccccctatgtgaggtccagggaacggacctcctccagtatagtcttcgaggactccggttgtgacaacgcatccagcaaagaagagcccaaaactaatcgcctgcacatcgggaaccactgtgccaataaacttaccgctttcaagcccacttcctccaagagctcctcagaggccacactgagcattagcccgcctcgccctactactctgtcacttgacctgacaaagaacaccaccgagaaactgcagcctagttctccgaaagtgtatttatacattcaaatgcagttgtgtcggaaggagaacctgaaagattggatgaatggcaggtgcactattgaggagcgagagaggagcgtgtgtcttcatattttcctgcagattgctgaggccgttgagtttctgcacagcaaagggttgatgcaccgggatcttaaaccctcaaacattttctttacgatggacgatgtggtgaaggtgggcgactttggactggtcaccgcgatggaccaggacgaggaagaacaaaccgtgctaacgcccatgcccgcttatgcacgacatactggacaagttgggaccaagctgtacatgagccctgaacagatccatggaaatagctatagccataaggttgacatctttagcttgggcttaatccttttcgagctattgtatccattttcaacccagatggagcgtgtgcgcaccctgaccgatgtccgcaatctgaaattcccccctctcttcacacagaagtacccttgcgaatatgtgatggtgcaggacatgctatcgccatcaccaatggaacgcccagaggccataaacattatcgaaaatgccgtctttgaggatctcgatttccccggtaaaaccgtgctccggcagaggagtagaagtctgtcctcttccggcaccaagcactcacgccaaagcaataatagtcacagccctttaccaagcaattag

SEQ ID NO: 222458 - DNA, 1569 bp, Artificial Sequence
  Description of Artificial Sequence: Synthetic coding sequence
atggccgcagttgccgtggctgtgcgagaagatagtggtagtggcatgaaagcagagctgccaccaggcccaggagccgttggaagagagatgacaaaagaggagaaattacagctcagaaaagagaaaaaacagcagaaaaagaaacgcaaggaagaaaagggcgcagagccagagacaggctccgccgttagcgctgcgcagtgtcagggacccacacgcgagcttcccgagagcggcatccagctgggaactcctagagaaaaagttcccgctgggcgatcaaaagctgagttgcgggctgagagacgtgccaagcaagaggcagagagagcactgaaacaggctagaaagggggagcagggcggtccacccccaaaggcctcaccatccaccgctggtgagaccccaagtggcgtgaaaagactgccagagtaccctcaagttgatgacctgctcttaagaagattggtgaaaaagcctgagaggcagcaagtacccacgcgcaaggattacggttccaaagtgagcctatttagtcacctgccccagtacagcagacagaattctcttacccagttcatgtctatcccatccagcgtgattcaccctgcaatggtccgtttggggcttcagtactcgcagggactcgtatctgggtctaatgcacggtgtatcgcattgctgcgggctttgcagcaggtaattcaggattacacaaccccgcctaacgaggagctctctcgggacctagtgaacaagctcaaaccctacatgtcctttttgacccaatgccgacccctgagcgcctccatgcacaacgctattaagttcctgaataaagaaatcacatctgttggctccagcaagcgcgaagaagaagcaaagtccgaactgcgtgccgctatcgacagatatgttcaggaaaaaatcgtgctggccgctcaggctatttcgcggtttgcctaccaaaagatttccaatggagacgtgatcttggtgtatggttgtagttctttagtgtccagaattctgcaagaggcatggactgagggcagacgcttcagagtcgtggtggtggactcacgaccctggctggagggcagacacaccttgcgcagcctcgtgcacgctggggtaccagcatcatacttgctcataccggcagcttcctacgtgctgcctgaggtgtcaaaagtgcttctcggagcccacgccctgcttgcaaacggttctgtgatgtctcgggtgggtacagcgcagctggctctcgtggctcgggctcacaatgtgcctgtgttggtatgctgtgagacttacaagttttgcgaaagggttcagacagacgctttcgtgtcaaacgagcttgacgatccagacgatttgcagtgcaagagaggagagcacgtcgctttggcaaattggcagaatcacgcctcccttcgactgcttaatttggtctatgatgtgactcctcctgaactggtagatctcgtgattaccgagctgggcatgattccatgttcttctgtcccagtggtgctccgggttaaatcgagcgatcaatag

SEQ ID NO: 222459 - DNA, 1632 bp, Artificial Sequence
  Description of Artificial Sequence: Synthetic coding sequence
atgccgactcagcagccagccgcaccatccactcgtgcccctaagccatcgaggagtctgtctggctccctgtgtgctttgttttctgatgcagattctggctccggcatgaaggccgagctcccccctgggcctggagctgtcggtcgagaaatgactaaggaggaaaagctgcagctccgcaaggagaaaaaacagcaaaagaagaaaagaaaagaagagaaaggggctgaacccgagacgggttctgccgtttcagctgcacagtgccagggccctactcgagaactgcctgagtctggcattcaactggggacacccagagagaaagtgcccgctgggagaagtaaagccgaactgagagccgaacgcagggccaagcaagaagccgagagagcgctgaagcaggcgaggaaaggcgaacagggcggacccccaccaaaggcgagcccatccacagcaggggaaactccctccggagttaaacgcttgcccgaatatccgcaggttgacgatctgctcctccgacgactcgtcaaaaagcccgagcgccagcaggttccaacacggaaagattacgggagtaaggtgagtctcttttcccatctgccgcagtattctcggcagaactcactgactcagtttatgtccattccctcatctgtgattcacccagccatggttcggctgggcctgcagtatagtcagggactggtctcagggagcaacgccaggtgcattgccctgctgcgcgctctgcagcaggttatccaggactacacaacacccccaaatgaggagctaagcagagacctagtgaacaaactgaagccctatatgtctttcttgactcagtgccggccactgtcagcatctatgcacaatgccattaaattccttaacaaggaaataacgagtgtgggcagttctaagagggaagaggaagccaagagcgaactacgcgcagccattgaccgctatgtgcaggagaagatagttctggccgcacaggcaatctccaggtttgcttaccaaaaaatttcgaatggggatgtgattctggtgtatgggtgttctagcctggtgtccagaattcttcaggaagcctggactgaaggcaggcggttcagagtagtggtggttgatagcaggccctggctggaaggccgtcacacattaaggagcctggtgcacgcgggtgtaccagcaagctatctgctgatcccagccgcttcctatgtgctgccggaggtgagcaaggtcctgctgggtgcccacgcactgcttgcgaacgggagcgttatgtctcgggtcggtactgctcagctggccttggtggcacgggcacacaacgtgcctgtcctggtgtgttgcgaaacatacaaattctgcgaacgagttcagacagacgcattcgtgagcaacgagctggacgatcccgacgatctacagtgtaaacgcggagagcacgtcgcacttgccaattggcagaatcacgcctctcttaggctactgaacctcgtctacgatgtaactccgcctgaacttgtggaccttgttatcacagagttgggaatgattccctgttcaagtgttcctgtggttcttcgggtgaaaagcagcgatcagtag

SEQ ID NO: 222460 - DNA, 918 bp, Artificial Sequence
  Description of Artificial Sequence: Synthetic coding sequence
atggacgataaagagctgattgaatatttcaaatcccagatgaaagaggatccggatatggcttctgccgttgctgcaatccggactttactagaattccttaagagagataaaggtgaaaccatccagggcctccgcgcaaacctgacgtcggccatcgagactctttgtggcgtggatagcagcgtcgccgtgagcagtgggggtgaactgttcctgaggttcatctcacttgctagtctcgagtattcagactatagcaaatgcaaaaaaataatgattgagaggggtgaactgttcttacgaagaatcagcctatcaagaaacaagattgccgatttgtgccatacctttattaaggacggggcaaccatcctgacccatgcgtactctagagtcgtcctgcgagtgctggaggctgcggtggcagcaaagaagcgcttttcggtgtatgtgaccgagtctcagcctgacctttccggaaaaaaaatggctaaggcgttgtgccacttaaatgtgccagtgaccgtcgtcctcgacgcagcagtggggtatattatggaaaaagctgatctcgtcattgtgggcgcagaaggagtggtagagaacggcggtatcatcaataaaattggaacgaaccagatggcagtgtgcgcaaaggcccagaataagcctttctatgtcgttgctgagagttttaaatttgtcaggttattccccttgaatcagcaggacgtgcccgacaaatttaagtataaagctgatacgcttaaggtcgcacagactggccaggaccttaaagaggagcacccatgggtggattatacagccccaagtctgataacactactattcaccgacctgggcgtccttactccaagtgccgtatctgacgagttgattaagttgtacctgtag

SEQ ID NO: 222461 - DNA, 1056 bp, Artificial Sequence
  Description of Artificial Sequence: Synthetic coding sequence
atgcccggatctgcggcaaaaggctcagaactgtccgagcgaatagagtcgtttgtagagaccctgaaacgaggtgggggaccccgttcaagcgaggaaatggcccgtgagaccctcggtctgctgaggcagatcatcactgatcataggtggagcaatgcgggagagctgatggagttgatacgcagagagggaaggagaatgaccgccgctcagccctcggagacaaccgtgggcaacatggtcaggcgggtgctcaagatcatacgggaagaatacggaaggctgcatggacgctctgacgaaagcgatcagcaggagtcactacacaagctgctaacgtcgggagggctgaacgaagactttagctttcactatgctcaattgcaaagcaatattatcgaggccatcaatgagcttctggtcgagctggaggggactatggaaaacattgccgcacaggccttggagcatatccactccaatgaagtcatcatgactattgggttttctagaacagtggaggcattcctaaaggaagctgccaggaaacgcaagtttcatgtaatcgtggccgaatgtgcccctttctgccaggggcacgagatggcagttaatttgtctaaggcaggcatcgagacgacagtgatgaccgacgccgcaatttttgcagtaatgagtcgtgtgaacaaggtcatcatcgggactaagactatactggccaacggagctttgcgagccgtgacagggacccacacgctcgctcttgccgcaaagcaccactcaacaccactgatagtctgtgctcctatgttcaagctatctccccagttccccaatgaggaagatagttttcataagtttgtagctcccgaggaggtcttgccattcactgagggagacattctggaaaaagtcagcgtgcactgtccagttttcgattatgtcccccctgaattgatcactctctttatttccaacataggaggaaatgcaccatcctacatctacaggctgatgagcgagctctaccatccagacgatcatgtactgtag

SEQ ID NO: 222462 - DNA, 1359 bp, Artificial Sequence
  Description of Artificial Sequence: Synthetic coding sequence
atggagtttcaggctgtggttatggccgtaggcggagggtcccggatgacggatctgaccagctctatcccaaaaccgctgctgccagtgggcaataagccactaatatggtatccccttaacctgctggagcgggtgggatttgaggaggtcattgtggtgacaaccagggatgtgcagaaggctttgtgcgccgagtttaagatgaagatgaaacctgacatcgtgtgtatccctgatgacgccgacatgggtaccgccgacagccttcgctacatctaccctaagctgaaaactgacgtgctcgttctgtcttgcgacctaatcaccgatgtggccctgcacgaagtggttgatttattccgagcctatgacgcaagcctggccatgctgatgcggaaaggccaggacagtatcgagcctgtccccggtcaaaaggggaagaagaaggccgtggagcagagggattttattggcgtggatagcactggaaagcgtttgttgtttatggcgaacgaggctgacctggatgaggaactggttataaagggtagtatcctgcagaagcaccctcgcatcaggttccatacagggctcgtcgacgctcacctgtactgtctcaaaaagtatatcgtggactttctgatggagaacggcagtataacaagtattcgcagcgaattaataccttatctggtccgtaagcagttctcctcggcgtcttctcaacagggccaggaggaaaaagaggaggacctaaaaaagaaggagctgaaatccctagacatctatagctttatcaaggaggccaacaccctaaacctagccccttacgatgcgtgttggaacgcttgcagaggagacagatgggaagacttgagtaggagccaggtaaggtgctacgtgcatatcatgaaggagggcctttgttcacgcgtgtccactttaggactgtacatggaagccaatagacaagttcccaagctcctgtcagctctgtgccctgaagaaccgcctgtccactcctcagcgcagattgtctccaaacacttagtgggcgttgattctctgatcgggccagagacccaaatcggagagaagtcttctattaagagatctgtgataggctcctcttgcctaattaaagatcgggtcaccatcaccaattgcttgctcatgaactcggtcacggtggaggagggcagcaatattcaaggctctgttatctgcaacaacgcggtcatcgagaagggcgctgacattaaggactgtctgattggttctggccaaaggatcgaggccaaggccaaacgagtcaatgaagtgattgtcggcaacgaccagctgatggaaatttag

SEQ ID NO: 222463 - DNA, 594 bp, Artificial Sequence
  Description of Artificial Sequence: Synthetic coding sequence
atggaatttcaggccgttgtgatggcggtgggtgggggttccagaatgacagatttaaccagctctatcccaaaaccactattgcctgtgggcaacaagcctctgatatggtaccctctgaacctactggaaagagttgggttcgaagaggttatagtggtcacaaccagagatgtgcagaaggctttgtgcgccgaatttaagatgaagatgaagcccgacattgtgtgtatccccgatgacgctgatatgggcacagccgatagcctcagatacatctatccgaagttgaagactgacgtgcttgtcttgagttgcgacttgatcactgatgttgcccttcacgaggtggtggatctgtttcgggcttatgacgcttccctggcgatgcttatgaggaaaggccaggacagtatcgagccagtgccaggacagaagggaaagaaaaaggccgacggcgactcactttgctgtcaggcaggcgtgcagtggcaccacttgggatcccttcagtctcccccacccggattcaagcatttcacatgcctgtccttgccttcatcttgggattacatgcatatgccaccccactag

SEQ ID NO: 222464 - DNA, 1239 bp, Artificial Sequence
  Description of Artificial Sequence: Synthetic coding sequence
atggaattccaagcagtggtaatggccgtgggcggaggctcccggatgactgatttaacctcatctatccctaaaccacttctccctgtcggaaataaacccctcatctggtaccctcttaatctccttgaacgggtgggctttgaagaggtcatcgtggtcaccacaagagatgtccaaaaagcactgtgtgccgaatttaagatgaagatgaagcccgatatcgtttgcatcccagacgatgcggatatgggaacagctgatagtctgagatatatctaccccaagctgaagactgacgtgcttgtgctctcttgcgatctgattaccgatgttgccctccacgaagtcgtagatctatttagggcctatgacgcaagtttggcgatgctgatgcgcaaaggccaggacagcattgagcctgtgcctgggcagaagggaaaaaaaaaagccgtcgagcaaagagattttatcggagtagatagtactggaaagaggctcctgtttatggctaatgaggccgatctggatgaagaactcgtgatcaaagggtccattttgcagaaacaccccagaatcaggtttcacacgggtctcgtagacgcccatctttactgtctgaagaaatatatcgtcgattttctgatggagaatgggagcatcacatctattcggtccgagctgatcccctatttggtgcgtaagcagttttcgtcagcctcttcccagcagggccaggaggaaaaagaagaggacctgaaaaagaaggagctgaaaagcctggacatctactccttcataaaggaggctaacacactgaatcttgctccatatgatgcctgctggaacgcctgtcgaggggacagatgggaagatctttctcggagtcaggtccggtgctacgtgcacattatgaaggagggcctctgttctcgcgtttccacactcggattatacatggaagctaatcgccaggtgcccaagttattgtcagcactctgcccggaagaacctccagtgcactcgtccgcccagatcgtgtccaaacatctggtcggcgtggactctctgattgggcctgagacccagatcggtgaaaaatcttctatcaaacgctctgtgattggcagctcatgtctaatcaaagaccgtgtgaccattaccaactgtctgctgatgaattcagtcactgtagaggagggctacgtcagcccgtgtacccacctgaggcagagatag

SEQ ID NO: 222465 - DNA, 669 bp, Artificial Sequence
  Description of Artificial Sequence: Synthetic coding sequence
taggtgatcaaaggctctattctgcagaaacatccacggattaggttccacacaggtctagtggacgcccacctgtattgcctcaaaaaatacatcgtggacttccttatggagaatggctccatcacttcaatcagaagcgaactgatcccttatctggttcgaaagcagttctcgagtgcatcctcccagcagggacaggaggagaaggaggaggacctcaagaagaaagaactcaagtccctggacatatacagttttataaaggaagcaaatacactgaatctggctccatatgatgcctgctggaacgcctgtcgtggggatagatgggaagacttgtcaagatctcaggtgaggtgctacgtccatataatgaaggaaggcctctgcagtagggtttcaacgctgggcctgtatatggaggctaatcgccaagtgccaaagctgctcagcgccctgtgtcccgaggagcctcccgtccactctagtgcccagatcgtctccaagcacctcgtgggcgtggacagtctaattggccctgaaacccagatcggtgagaagtcaagcattaagcgaagtgtgattgggtcctcctgcctgatcaaggacagagtcaccatcaccaactgtctcttaatgaactccgtgacggtggaagaaggatag

SEQ ID NO: 222466 - DNA, 1572 bp, Artificial Sequence
  Description of Artificial Sequence: Synthetic coding sequence
atggctgccgtagctgtggctgtgagagaggattctggctctgggatgaaagcagagctcccgccaggtcctggagccgttggtagagaaatgaccaaggaagagaaactccagctgcgcaaggagaaaaagcagcagaagaaaaaacgcaaagaggaaaaaggggctgaacctgagaccggctcagctgtttccgccgcacagtgccaggtgggtcccacacgtgaacttcccgagtctggtatccaactgggaacacccagggaaaaggtacccgctgggaggtccaaagctgagcttagagcagaacgacgtgccaaacaggaggcagagcgggctctgaaacaggcccgtaagggtgaacagggaggcccacctccgaaggcctcccccagcacagctggtgagaccccttctggggtgaaacgcttgccagagtatccccaagtagacgacttattgttaagacgcctggtaaagaaacccgagagacagcaggtcccaacccggaaggattacgggagcaaagtgtctttatttagccacctcccgcagtacagtcgacagaactcccttacacagtttatgtctatccccagctcggtgatccacccggcaatggttcgcctgggactgcagtactctcagggattggtgtctgggtcaaacgccaggtgcatcgccctgctacgcgcactgcagcaggtgatccaggactatactacaccacccaatgaggaattgtcaagggatttggtaaataagcttaagccatacatgtccttcctcacccagtgcagacccctctccgcctcgatgcataatgcaatcaaatttttaaataaggaaataacatctgtgggttcatccaaacgcgaggaagaagccaagtctgagctccgcgcagccatcgataggtacgtgcaggagaagatcgtcttagctgctcaggccatctcccgattcgcataccagaaaatctccaacggagacgtaattctggtttacgggtgtagcagccttgtgtctaggattctacaggaagcatggaccgagggacgaagatttagagtggttgttgtagactcacggccttggttggagggtcgacacacactcagatcattagttcatgctggagtgcccgcatcatatctcctaattccagccgcatcttacgtattaccagaagtcagcaaggtcttactcggggcacatgctctactcgcgaatggatcagtcatgtcgcgggtggggacagcccagctggcactggtggcccgagctcataacgtaccagtgctggtctgctgtgagacttataaattttgtgagcgcgttcagacagatgcattcgttagtaacgaactggacgacccagatgacctgcaatgtaaacggggtgagcacgtagctctggctaattggcaaaatcacgcatcactgagacttctgaatttggtgtacgacgtgacacctcccgaactagtcgatctagtgattactgagctaggcatgatcccatgtagttcagtccccgttgtgttgagggttaaatctagcgatcagtag

SEQ ID NO: 222467 - DNA, 1563 bp, Artificial Sequence
  Description of Artificial Sequence: Synthetic coding sequence
atggccgctgtagctgtcgcagtaagagaggatagcggctccggcatgaaagctgagtcgccgtgggcctgggttggccgagagatgacaaaggaggagaagctccagctgcggaaagagaagaagcagcagaagaaaaagaggaaagaagagaagggagctgagcccgagaccggctctgccgtgagcgctgctcaatgtcagggaccgactagggaactgcctgagtccggcatccagttgggcactcccagggagaaagtgcctgcaggccgatctaaagccgagctgcgggctgagaggagggctaaacaggaggccgagcgcgctctgaagcaggcaaggaagggtgaacagggcggaccccctcctaaggcctcgccctccacagccggagaaactccttctggagtgaagaggctccccgaatatcctcaggttgacgatctactgctacggagattggttaagaagcctgagaggcagcaggtgcctactcgcaaggattatggcagtaaggtgtctctgttctctcacctcccccagtacagcagacagaattctctgacccagttcatgtctatacccagttcagtcattcatcctgcaatggtgcggctgggattacagtactcccaggggttggtctcaggctctaatgccaggtgcatcgccctgctccgcgcactgcagcaggtcattcaggattacacgacacctccgaacgaagaactgtctagagatctggtaaacaagctgaagccgtacatgagctttttaacgcagtgcagaccgctgtcagcgtctatgcataatgcaattaaattcctcaacaaagagatcaccagtgtagggtcctcaaaacgtgaagaagaagccaaatccgaattgcgtgcggcaatagataggtatgttcaggagaagatagtgttggccgctcaggccatatcaagattcgcctaccaaaagattagtaacggggacgtaattctcgtctatggctgtagcagtctggtgtcgcggattctgcaggaagcctggaccgaaggcaggaggttccgcgtggtcgtggtcgatagccggccttggctggagggccgtcacaccctgcggtctttggtgcacgcgggtgttcccgcatcttatcttttgataccagctgcttcttacgttttgccagaagtttcaaaggtgctgttaggtgctcacgccctgctcgccaacggtagcgtcatgagccgggtcggaacagcccaattggccttggtcgctcgggcacacaacgttccagtgctagtgtgttgcgaaacttacaaattctgcgagagagtgcaaactgacgcgttcgtgtcgaatgaacttgacgaccccgacgacttacagtgcaaacgtggtgagcacgtggcactggcaaattggcagaaccacgcttctctcagattattgaacctggtgtatgatgtgacaccccctgaacttgttgatttggtgataacagaactagggatgatcccttgctcatctgtgcctgtagtgctcagagtgaagtctagcgatcaatag

SEQ ID NO: 222468 - DNA, 2166 bp, Artificial Sequence
  Description of Artificial Sequence: Synthetic coding sequence
atggccgcacccgttgtggccccacccggagtggtggtgtccagggcaaacaagcgatctggcgcaggacctgggggatccggcggaggcggtgccagaggcgcagaagaggagccaccgcctccattgcaagctgtgctcgtggcggacagttttgacagacgtttcttcccaatctcgaaagatcaaccaagggtgctccttccactagccaatgtggccctgattgactacaccctggaattccttacagctacaggcgtgcaggagacatttgtcttttgttgctggaaggctgcccagatcaaggagcatttgctgaagtcgaagtggtgccgtccaacttctctgaacgtcgttaggatcatcacctccgagttatataggagcttgggagacgtgctccgggacgtggatgccaaagctttggtgaggtcagactttctgctggtgtatggagacgtcattagtaacattaacatcacccgggctttagaggagcaccggctgagacggaaacttgagaaaaacgtctccgtgatgactatgatctttaaggagtcgtctccatctcaccccactcgttgtcacgaggacaacgtggtcgtggcagtcgactctaccaccaatcgggtgttgcattttcagaagactcaggggcttcgcagattcgccttcccattgtcactgttccagggcagcagtgatggcgtggaggtccgctatgacttgttggactgccatatctcaatctgttcaccccaagtggctcaactgttcaccgataactttgactaccagacacgcgatgattttgtgagaggactcctggtgaatgaggagatccttggaaaccagatccatatgcatgtgaccgccaaggaatatggggctcgggtgtccaatcttcatatgtattcagcagtgtgcgcagacgtcattagacggtgggtgtatccgctgacacctgaggccaacttcacggatagcactactcagtcatgtacgcacagtcgtcacaatatctatcgaggcccagaggtttccctgggtcacggaagcatcttggaggagaatgttcttctgggtagcggcactgtaataggttccaattgttttataacaaacagcgtaattggccctggctgccacataggggataacgtggtgctggatcagacctacctatggcagggagtgagagtggccgctggcgcacagattcatcagagcctgttgtgcgataatgccgaagtgaaagaacgcgtaactctcaagcccagatctgttctgacatcacaggttgtggtcggacccaacatcacactgccagagggttctgttatatcacttcacccacctgatgcggaggaagatgaggacgatggggaattctctgacgattccggcgctgaccaggagaaagacaaggtcaagatgaaagggtacaatccggcagaggtcggtgctgccggtaagggttacctgtggaaagctgccggaatgaacatggaggaggaggaggagcttcagcagaatctctggggcctgaagatcaacatggaggaagagtccgagagtgaatcagagcagtctatggacagcgaggagccagacagcagaggtgggtcgcctcagatggacgatattaaggtttttcagaacgaggtactggggacattacagaggggcaaagaggagaacatctcatgcgacaatttggtgctggaaatcaattctctgaagtatgcctacaatatttcactgaaagaggtcatgcaggtgctttctcatgttgttctcgagtttcccctccaacagatggacagtcctttagattctagtcggtattgcgctttgctgctgccacttctgaaggcttggagcccagtgtttcgcaactacataaagcgtgcagccgatcacctggaagcactcgccgctatcgaagatttctttcttgagcacgaggctttagggatttctatggccaaggtcctgatggctttctaccagctggagatccttgcagaagagacgattctttcatggttcagtcagcgggataccacagataaggggcagcagctcaggaaaaaccagcaactccaacgcttcatccagtggctcaaggaggccgaggaggagagtagcgaagacgattag

SEQ ID NO: 222469 - DNA, 1014 bp, Artificial Sequence
  Description of Artificial Sequence: Synthetic coding sequence
cccccacagccaagtaagatgctgggacttcaggtagcccagctcttcacggacaactttgattatcagacgagagatgacttcgtcagaggcctgctcgtgaatgaggagatccttggcaatcagattcacatgcacgtcactgcaaaggagtacggcgctcgtgtgtctaatttgcatatgtatagcgccgtgtgtgcagacgtgataagaaggtgggtctaccctctgactccagaggccaatttcactgattctaccactcagtcatgtacacattctcggcataacatttaccgcggacctgaagtgtctttgggtcacggcagtatactcgaagagaacgttctcctgggtagcggcaccgtaatagggagcaactgctttatcacaaattctgtgattgggcctgggtgtcatatcggggacaatgtggtgctcgaccaaacctatctatggcagggagtgagggtcgccgctggcgctcaaatccatcaatctctgctgtgtgataacgccgaagtgaaagaacgcgttacactgaagccgagaagtgtgttaactagtcaagtcgtggtgggcccaaacatcaccctgcctgagggcagcgtgatttctctgcaccccccagacgccgaggaggatgaggacgatggagaattctccgacgactccggcgcagaccaagaaaaagataaggtaaaaatgaagggatacaatcctgccgaggttggcgcagcagggaagggatacctgtggaaagccgcaggaatgaacatggaagaggaagaagaactccagcagaacttatggggccttaagataaacatggaagaggaatctgagtccgagtctgaacagagcatggactccgaagaacctgattctaggggtgggtctccacagatggacgacatcaaggtgtttcagaatgaggtcttgggcactctacaaaggggcaaggaggaaaacatctcctgtgataacttggtcttagagatcaacagcctgtag

SEQ ID NO: 222470 - DNA, 2574 bp, Artificial Sequence
  Description of Artificial Sequence: Synthetic coding sequence
atggaagcgggtccgtccggggcagccgctggagcctacctgccccctctccagcaagtgttccaggcacctagacgaccaggtatcggaaccgtcggaaagccaattaagctactggcgaactacttcgaggtggacatacctaagattgacgtgtaccactacgaggttgacatcaaacctgacaagtgcccacggcgagtgaatcgtgaggtcgtggagtacatggtgcagcatttcaagccgcagatctttggggaccgcaaacctgtatacgacggaaagaaaaatatctacaccgttacggctcttcccataggaaatgaacgcgtagattttgaggtgacaattccgggagagggaaaagaccgcatatttaaggttagtatcaagtggctggcgatcgtgtcatggagaatgctccacgaagccctggtgtccggccagatccctgtgccccttgagtccgtgcaggctcttgatgtggcaatgcgccacctagcatccatgcgatacaccccagtgggccgtagcttttttagtccccctgagggatattaccatcccctgggcggaggaagggaggtctggtttggctttcaccagtcagtcaggcctgcaatgtggaagatgatgctgaacattgacgtgagtgcaaccgctttctataaggcccagcctgttatagagttcatgtgtgaagtcctggatattagaaacatagatgagcagcccaaacccctgacagattcccagagagtgcggtttacaaaagagataaagggtcttaaagtggaagtaacgcactgtggccagatgaaacggaagtaccgagtttgcaatgttacccgaagaccagccagccaccagaccttccctcttcaacttgaaagcgggcaaacagtggagtgcacggtggcccagtactttaaacagaaatacaacctgcaactgaaatacccgcaccttccttgcttgcaggtgggccaggaacaaaaacatacctatctgcctctggaagtgtgcaatatcgtggcgggtcagcgatgcataaagaagctgaccgacaaccaaacctctaccatgattaaggcgacggctaggtccgcgccagatcgtcaagaggagattagtcgcttaatgaagaatgcctcctataatctggatccctacatccaggaattcggaatcaaggtcaaggatgacatgaccgaagttaccgggagggtcctccctgccccaatccttcaatatgggggacggaatcgtgccattgcaaccccgaatcagggagtctgggacatgagaggaaaacagttctataacggtatcgagatcaaggtgtgggcaatcgcgtgctttgcgcctcagaagcagtgccgtgaggaggtgctgaagaattttacagatcagctgagaaagatttcaaaagatgccggtatgcctatccaggggcaaccttgcttctgcaagtatgcacaaggggctgattccgtggagcccatgttcagacacctcaagaacacctattctggcctgcagttgatcattgttattctgcccggtaaaaccccggtatacgccgaggttaaacgggtgggtgacaccctgctgggcatggccacacagtgtgttcaagtgaaaaacgttgttaaaacctctccgcaaacactgtccaacctgtgcctgaagataaacgtgaaactgggcggaatcaataacattttggtgccacatcagcggagcgcggtgttccagcagcctgtcattttccttggcgctgatgttacacatcctcccgctggtgatggaaagaagccttccataactgcagtggtcggctccatggatgctcaccctagtcgttactgcgctactgtacgggtccagagaccgagacaagaaattatcgaggacctgagctatatggtgcgtgaactcctgattcagttttacaaatccacaagattcaaaccaacccggatcattttctacagagacggagtgccggaagggcagctgccacaaattttgcactatgagctgctggccatccgggatgcctgtatcaagcttgagaaagactatcagcctgggatcacctacatcgtggtgcaaaagcgccaccacactagattattctgtgcagataaaaatgagcgtattggtaagagcggaaacatacccgctggaactaccgtggacacaaatattacacaccctttcgagttcgatttctacctgtgcagtcacgctgggatccaggggacctctcggcctagtcattactacgtcttatgggacgataacaggttcacggccgatgagttgcagatcctgacgtatcaactgtgtcatacgtatgtgaggtgcactcggtcggtgagtatccctgccccagcctactatgctcgccttgttgcattccgggctcgatatcatctggtggataaagagcatgattccggtgaaggctcgcatataagcggtcagagcaacggacgtgatccccaggctcttgccaaagcagttcaggtgcaccaagacactttgcggactatgtacttcgcctag

SEQ ID NO: 222471 - DNA, 2349 bp, Artificial Sequence
  Description of Artificial Sequence: Synthetic coding sequence
atggtgcagcattttaaacctcaaatttttggagatcggaagcccgtgtatgatggtaagaagaatatttatacagtgacggccctccccatcgggaacgaacgcgtggacttcgaggtgactattccgggagagggaaaagaccggatttttaaggtaagcataaagtggctggctatagtcagctggaggatgctgcacgaagctctggtgtcaggacagattccagtcccgcttgagtcagttcaggccctggacgtggcaatgcgtcatctggcatcgatgcgctacactcccgttggcaggagctttttttctcccccagaagggtactatcacccgcttgggggtggcagggaggtctggttcggctttcaccagtcagtgcggccagccatgtggaaaatgatgctcaatattgatgtctctgccacagctttctataaagctcagccagtaatcgaatttatgtgcgaggtgctggacataagaaatatcgatgaacagcctaaacctctgaccgactctcagagagtgcggttcaccaaggaaataaaaggtcttaaagtggaagttacccactgcggacagatgaaaaggaagtaccgtgtctgcaatgtcactcgcaggccggcaagccatcagacttttcctctgcagctagagagcggccagacagtcgagtgtacggtagctcagtactttaaacagaagtacaacctgcaactgaagtacccgcacctgccctgcttgcaggtagggcaggagcagaaacacacttacttgccactagaggtctgcaacatcgtcgcgggacagcggtgtattaagaagttgaccgacaaccagacttctacgatgatcaaagccacggcacgttctgcgccagaccgacaggaagaaatatctaggcttatgaagaacgctagctataacctggatccctatatacaggaatttggcatcaaggttaaagatgatatgaccgaggtgaccggcagagtgctaccagctcctatcctccagtatggaggccgaaatcgggctatcgctacccccaatcagggtgtatgggacatgcggggtaaacaattctacaacggtatcgaaatcaaggtgtgggccattgcctgctttgccccacagaagcagtgccgcgaagaggtacttaaaaacttcacagatcagctgcgtaagatttccaaggatgccggaatgccgattcaaggccagccctgtttttgtaagtacgctcagggtgctgatagcgtcgaacccatgttccggcatctgaaaaacacatacagtggtctgcagctgattatcgttatcctgccaggcaagaccccagtctatgctgaagtaaaacgtgtaggggacactctgctgggtatggccacccagtgcgtacaggtcaaaaacgtggtcaagacatccccgcagaccctgtcaaacctgtgcctgaagatcaacgtcaaattaggcggtatcaacaacattctggtgcctcatcagcgatccgcggttttccagcagccggtgatatttctcggcgctgatgtcacccacccacctgctggggacggtaaaaaaccttctatcactgcagtggtgggctccatggatgcccacccgagcaggtactgtgctaccgtgcgagtgcagaggccacgtcaagaaattatcgaggacctcagttatatggtcagagagctgttaatccagttttataagagcacccgctttaaacccacacggatcatattttaccgtgacggcgtgcccgagggacaactgccgcaaatcctccattatgagctgctcgccatccgcgacgcctgcatcaaactcgaaaaggattaccagcctgggatcacatacatagtcgtccagaaacggcaccacactaggcttttttgcgccgataagaacgagcgcatcgggaaaagcggtaatatcccagccggaacaaccgtggacacaaacataactcatcccttcgaattcgatttttacctgtgcagccatgcaggcattcaggggacctcacggcctagtcactattatgtactgtgggatgataaccggtttacagccgatgagttgcagattctgacatatcagttatgccacacgtatgttcgatgcacacggtctgttagtatcccagccccagcctactatgcccgattagttgccttcagggctcggtaccatttggtggataaagaacacgactccggcgagggaagtcacattagtggacaaagcaacggtcgtgacccgcaggctctggcaaaagctgtgcaagtccaccaggacactctccgtacaatgtactttgcctag

SEQ ID NO: 222472 - DNA, 1254 bp, Artificial Sequence
  Description of Artificial Sequence: Synthetic coding sequence
atggagttcgtcaagtgcctgggtcaccccgaagaattttacaatctagtgaggttccgcataggaggaaagcggaaagtaatgccgaaaatggaccaagactcgctatcgagtagcctgaagacatgctacaaatacctgaatcaaacttcccggtcgtttgccgcagttatccaggctttagacggagagatgagaaacgccgtgtgtatcttttaccttgtactgagagccctcgacacgctggaggatgatatgaccattagcgtggagaaaaaggtccccctgttgcataactttcactcctttctttatcagcccgactggcggttcatggaatccaaggagaaagatcgccaggtgctggaggattttcctaccattagcttggagttcagaaacttggctgagaaatatcaaacagtgatcgccgacatttgtcggaggatgggaataggaatggccgagtttctggacaagcacgtgaccagcgaacaagagtgggacaagtattgccactatgtcgccggtttagtgggtattggcctgtccaggctgttctccgcttcagagtttgaagaccctctggtgggcgaagacacagagagggccaatagtatgggcttgttcctccagaagacaaacattatacgggactatttggaggatcagcaaggcggacgggaattctggcctcaggaggtatggagccggtatgtgaaaaagcttggagactttgccaaacctgagaatatcgatttggctgtacagtgcttgaacgaactaatcaccaatgcactgcaccacataccggacgtaattacatacctgagccggctgagaaaccagtcagtgtttaacttctgcgctatccctcaggttatggccatagcaacgcttgccgcttgttataataaccagcaggtgtttaagggcgctgtgaagatccggaagggtcaggctgtaacacttatgatggacgcaaccaacatgcctgcagtgaaggctattatctatcagtacatggaggagatctaccacaggatccctgacagtgatccctctagctcaaagacccgacagataatatccactataagaacccagaacctgcccaattgtcaactgattagccgcagccactactcacccatctatctgtcattcgtcatgctgctggctgccctctcgtggcagtacctgactacgctgtcgcaggtgaccgaagactacgtgcaaaccggggagcactag

SEQ ID NO: 222473 - DNA, 2478 bp, Artificial Sequence
  Description of Artificial Sequence: Synthetic coding sequence
atgtacagcggagccggtcctgctctggcccctcccgctccaccgccacccattcagggatatgcattcaaaccccctccacgcccagacttcggtacttcaggcagaaccatcaagctccaggcaaacttttttgaaatggacattccaaaaattgatatttatcactatgaactcgatattaagcccgagaagtgtccccgtagagtgaatcgggagattgtggaacatatggtgcagcacttcaaaacacagatcttcggggatcgtaagccagtatttgatggccgaaaaaatctgtacaccgcgatgccactgccaatcggacgtgacaaggtggagctggaggtcactctgcccggtgagggaaaggacagaattttcaaagtaagtattaagtgggtctcgtgtgtttctttgcaggcactgcatgatgctctgagcggaaggctgccgagcgtgccattcgaaaccatccaggcattagacgttgtaatgagacatctgcctagtatgcggtacacaccagtgggtaggagctttttcaccgctagtgagggttgtagtaacccactcggcggagggagggaggtctggtttggattccatcagtcggtgagaccttcgctttggaagatgatgttaaacattgacgtgtctgccacagcgttctataaggcccagcctgtaatcgagtttgtttgtgaggtcctggacttcaaatccatcgaggagcagcaaaaaccccttacagactctcaacgagttaaatttaccaaggagattaagggactgaaagtcgagattacccactgcggccagatgaagaggaaataccgcgtctgcaacgtgacccgacgcccagcttctcatcagacttttccattgcaacaggaatctgggcaaaccgttgagtgcacagttgcccagtattttaaggacagacacaagctggtgctacgctacccacatctgccttgtttacaagtaggccaggagcaaaagcatacttaccttcccctggaggtgtgcaacattgtagccggtcaacgatgcatcaagaagcttaccgacaatcagacttccaccatgattcgagccacagctcggagcgccccagacaggcaagaggaaatcagcaaactcatgcgatctgcgagctttaacacagatccctatgtgcgggagttcgggattatggtgaaggatgaaatgaccgatgtcacaggacgagtgttgcagccaccaagcatattgtacggcggacggaataaggctatcgccacacccgtacagggcgtgtgggatatgcggaacaaacaatttcataccggaattgagataaaagtgtgggccatcgcttgtttcgctccccagcgccaatgcactgaggtgcatctgaaaagttttacagagcagttgcggaaaatctcccgggacgctggcatgcctatccagggtcagccttgtttctgcaagtacgcccagggtgccgacagtgtggaaccgatgttccgccatctgaagaatacatacgccggtttgcagctagttgttgtgatccttccaggaaagacaccagtttatgcagaagtgaaaagggttggcgatactgtgttaggcatggcaacacagtgcgtgcagatgaagaacgtgcaacgcacaaccccccagacactttcaaatctctgtttaaaaattaacgtaaaactgggtggggttaacaatattcttctgccacagggtcgccctcctgtcttccagcagccagtaattttcttgggcgctgatgttacccatcctcctgccggagatggcaaaaaacctagtatcgccgctgtggtgggtagtatggacgcgcacccaaatcgctattgtgctacagtgagagtacagcagcaccgtcaggagattatccaggatctggccgctatggttagggagctgctgatccagttttataaatccacccgcttcaaacctactaggatcatcttctacagagacggtgtgtcagaggggcaatttcagcaggtcctccatcacgaactgctggcaatcagagaggcctgcattaagttggagaaggactatcagcccggaattacctttatcgtggtgcaaaaacgtcaccacactcggctgttctgtacggacaaaaatgaacggggaacatcgcgcccaagccactatcacgtcctatgggatgataacaggtttagctcggacgagctgcagatcctcacatatcaactgtgccacacatatgttcgctgtacacggtccgtgagcattcccgcaccagcatattacgctcacctggtggcgtttagagcgaggtaccaccttgtcgataaggaacacgactcagccgagggctctcacaccagcggacagtccaatggacgagatcaccaagcccttgctaaagccgtgcaggtgcaccaggacacattgcggacaatgtacttcgcctag

SEQ ID NO: 222474 - DNA, 1881 bp, Artificial Sequence
  Description of Artificial Sequence: Synthetic coding sequence
atgtgtgaggttttggatatccataatatcgacgaacagcctcggccattgacagactctcacagggtgaaattcaccaaagagatcaaaggtctgaaggtcgaggtcacacattgcggcactatgagaagaaaatacagagtctgcaacgtaactagacggccagcttcacaccagacatttcccctgcagcttgagaatggccaaaccgtcgaacggaccgttgcgcagtactttcgggagaagtatactctgcagctcaagtaccctcatctgccatgtctccaggtggggcaggaacagaaacatacctatttacccctagaggtttgcaacatcgtagctggccagcggtgtatcaagaagctgactgataatcagaccagtaccatgattaaggcaacagccaggagcgcccctgaccggcaggaggaaatttctcgtctggttaggagcgcaaattatgagactgatccatttgtgcaggagtttcagttcaaagttcgagatgagatggctcatgtgaccgggagagtgctgccagcacctatgcttcagtacgggggacggaatcgcactgttgccacgcccagtcacggggtctgggacatgaggggaaagcagttccacactggtgtggaaatcaaaatgtgggccatagcatgctttgcgacccagcggcagtgccgcgaggaaattctgaagggcttcacagaccaactccggaagatctcaaaggacgcgggtatgccgattcagggacagccttgcttttgtaagtatgcgcaaggcgcagacagcgtggaacctatgtttcgccatttaaaaaacacctattcagggttgcagctgatcatagtaattctacccggaaagacaccagtctacgcagaagtcaaaagagtcggcgacaccttgcttggcatggcaacccaatgcgtgcaggtgaagaatgtcatcaagacttctcctcagacactttcaaatctgtgcctcaagattaatgtgaagttaggaggaatcaacaacattctggtgcctcaccaacgccctagcgtgtttcagcagcctgttatattccttggggctgatgtcactcacccacccgcaggagatggtaagaaaccatccattgcagctgtggtgggctcaatggacgcacatcccagccggtattgtgccaccgtcagggtccagcgcccaagacaggagattatccaagacctggctagtatggttagagagctactaatccaattttacaaatctactcggttcaagccaactcgcattattttctacagggacggtgttagtgaggggcagtttcgacaagtactgtattacgagctgctggccattcgcgaggcctgtatcagtctcgaaaaagattaccagccaggaataacctacattgtggttcagaaacggcatcacaccagactgttctgtgctgaccggacagagcgcgtcgggagatcaggtaatattccggcaggtactactgtggatactgatattactcacccctacgagtttgatttctacttatgtagccacgctgggatccagggtactagcaggcccagtcactatcacgtattgtgggacgacaattgtttcaccgcagatgaacttcagctgttaacttaccagctctgccacacctacgttaggtgcacaaggagcgtttccatccccgctcccgcttattacgcacatctcgtggcatttagagcacggtaccaccttgtagacaaagaacacgactccgccgagggttcacatgttagtggacagagtaacggtagagatccgcaggccctcgctaaagccgttcagattcaccaggatacattacggaccatgtacttcgcctag

SEQ ID NO: 222475 - DNA, 690 bp, Artificial Sequence
  Description of Artificial Sequence: Synthetic coding sequence
atggaaatcggctcagccggacccgctggggctcaaccactgttaatggtccctagaagacccggatacggaactatgggaaagcccattaagttgctcgctaactgcttccaagttgagatccctaaaattgacgtgtatctgtacgaagttgacatcaaaccagacaaatgccccaggcgagtgaaccgtgaggtggtcgatagcatggtgcagcactttaaggtgacaatctttggcgatagaaggcccgtatatgatggcaaacgttcgctgtacaccgctaaccctttacccgtggccacaaccggcgttgaccttgatgtgacgcttccaggcgagggaggtaaggataggccattcaaggtctctattaagtttgtctcccgcgtgagttggcaccttttgcacgaagtgttaacaggacgcacactgcctgagcctctggagttagataaaccgatttctaccaaccctgtgcacgctgtggatgtagtgctgcgccatctgccgtctatgaagtacactcccgtggggcgttcttttttctctgcgccagagggatacgatcacccattagggggtggtagagaggtctggtttggattccatcagagtgttcgaccggcaatgtggaagatgatgctaaatatcgatgagcgggacctctggcagcagtgtggggaatag

SEQ ID NO: 222476 - DNA, 2583 bp, Artificial Sequence
  Description of Artificial Sequence: Synthetic coding sequence
atggaaatcggctccgccggacctgctggagcccaaccgctgttgatggttccgaggcgacctggttacggtaccatggggaagccaatcaagctgctggcaaattgctttcaggtggaaatcccaaagatcgacgtttatctgtatgaagttgatatcaagccagataagtgtccacgcagggtcaatagggaggtggtggattccatggtccaacattttaaggttaccatcttcggggatagacgtcccgtgtacgatgggaagcgtagtctttacaccgctaatccactccctgtcgctactactggcgtggatcttgatgttactctcccgggagaggggggtaaagaccgtccttttaaggtcagtatcaaattcgtctctagggtaagctggcacctactgcacgaggtgttaacaggacgaaccctgcctgagcccctggagctggataagccaatctcgacgaacccggtgcacgcagtggacgtcgtgctccgacatctgccctccatgaagtacacgcctgtgggtagatccttcttttccgctcctgagggttatgatcatccccttggcggagggagggaggtatggttcggtttccaccaatccgttcgccctgccatgtggaagatgatgctgaacatagatgtgagtgcaactgcattctataaagctcagcctgtgatacagtttatgtgtgaggtgctggacatccataacatcgacgaacagccacgaccactgaccgactcacacagagtcaagttcacgaaggaaataaagggactgaaggtagaggttactcactgcggtaccatgcgccgtaagtatagagtctgtaacgttactaggcggccagcatcgcatcagacatttcctcttcagctagagaacggtcagaccgttgagagaacagtggcccagtacttccgtgagaaatatactctacaactgaaatacccacacttgccatgcttacaagtagggcaggagcagaagcacacttatctccccctggaagtgtgtaacattgttgctggccagcggtgtatcaaaaaactgactgacaaccagacttctactatgatcaaggcaactgcgcgatctgccccagaccgacaggaggagattagtcggttagtaaggagcgccaattacgagaccgatccctttgtgcaagagtttcaattcaaggtccgggacgagatggcccatgtgacagggagagtgctgcctgctcccatgcttcagtatggtggaagaaatcgcacagtcgctacaccaagccatggcgtctgggatatgcggggtaaacagttccacacaggggtggaaattaagatgtgggcgattgcatgctttgcaactcaaagacagtgccgagaagaaatcttgaaggggtttacagatcagttgcgcaagatttccaaagacgctggcatgccaattcagggtcaaccatgtttctgcaaatacgcccagggagcagattcggttgagccgatgtttcgacacctcaagaacacatacagcgggctacagctcatcatagtgattctcccgggaaagacaccagtctacgcagaagtgaagagggttggggacactctcctgggtatggcgactcagtgtgttcaggtgaaaaacgtcatcaagacctcaccacagaccttatccaacctgtgccttaaaatcaacgtgaaattgggcggaatcaacaacattctagtgcctcaccagcgccctagtgtgtttcaacagccagttatatttctgggagcagacgtcacccacccacctgctggggacggcaagaagcccagtatcgcagcagtcgtggggtccatggacgcacatccgtcccgttactgcgccactgtgcgcgtccagcgtcctcggcaggaaataatccaggatttggcatcaatggtgcgagaactgcttatacaattttataaaagcaccaggttcaaaccgacacgcatcatcttttaccgcgatggggtttccgagggacaatttagacaggtgctgtactatgagctcctggcaatcagagaagcttgtataagcctagagaaagactaccaacccggaatcacctatatagtggtgcagaagaggcatcacacgaggctgttctgcgctgatcgcaccgaaagagtgggaaggtctggaaacatcccagccggaactaccgtggacactgatatcacccatccatatgagtttgacttctatctgtgcagccacgcgggaattcagggtacttcccgtcccagccattaccacgtcctgtgggatgacaactgtttcacggccgacgaattgcaactactcacttatcagctctgtcatacctatgtgcgctgcacgaggtctgttagcataccagcccctgcctactatgcgcatcttgtcgccttccgcgcacgttaccatctcgtcgataaagaacatgacagcgccgaaggcagccatgtttcaggccagagtaatgggcgtgaccctcaggctcttgccaaagcagtgcagattcaccaagatacattacggaccatgtattttgcatag

SEQ ID NO: 222477 - DNA, 690 bp, Artificial Sequence
  Description of Artificial Sequence: Synthetic coding sequence
atggaaattggatccgcagggcctgctggtgcccagccactgctgatggtgccgagacggccagggtacgggaccatgggcaagcccattaaattgttggccaattgtttccaggtagagatccccaaaattgatgtttacctatatgaggtggacataaaaccagacaaatgcccgaggcgggttaaccgggaggtagtggattcaatggtccagcacttcaaggtgacgatattcggggacagacggccagtgtatgacggtaaaagatcactgtatacagcaaacccgctgccagtagccacgacaggcgtggatctggacgtcaccttgccgggagaggggggaaaggacagaccctttaaagtctctataaagtttgtgtccagggtgtcatggcacctccttcacgaagtgctcaccgggcgaacactcccggagcccctcgagctggataaacccattagcaccaatcccgttcacgccgtagatgttgtcctgcggcatctgccctctatgaagtatacaccagtgggcagaagttttttcagcgctcccgaaggttacgatcacccactgggtggaggcagggaagtttggttcgggttccatcaatccgtccgcccagccatgtggaaaatgatgttgaacattgacgagagagacctgtggcagcagtgcggtgaatag

SEQ ID NO: 222478 - DNA, 2586 bp, Artificial Sequence
  Description of Artificial Sequence: Synthetic coding sequence
atggaggcactgggacctggaccccctgcctccctttttcagcccccacgaaggcctggcctcggaacagtcggaaagcccatcaggctgctagcgaaccacttccaggtgcaaatacctaagatcgatgtttaccactatgacgtcgatattaagcctgagaagcgacctagacgcgtgaaccgggaggtggtggataccatggtgagacatttcaagatgcaaatcttcggagacagacagcctgggtacgatgggaaacgcaacatgtatacagcccacccactgccaattggtagggatcgggtggatatggaagtgacattgcctggcgaagggaaagaccagaccttcaaggtgtccgtgcagtgggtttccgttgtatcgctgcagctccttttggaagctctggcgggtcacctgaatgaagttcctgacgacagtgttcaggccctggacgtgatcacacgtcatttaccaagcatgcggtataccccagtgggaaggtcctttttttccccgcctgagggttattatcatccgttaggaggcggtcgcgaagtctggtttggatttcaccagagcgtgagacccgctatgtggaacatgatgctgaatattgatgtctctgccacagccttttacagggcccaaccaatcattgagttcatgtgtgaggtcctcgacatccagaacatcaatgaacagactaagcctcttacggattcccagcgggtaaagttcacaaaggaaattcgtggacttaaggtagaagtgacacattgcggacaaatgaagcgcaaataccgggtgtgcaatgtgacccggcgtcctgcctcccaccagacattccccttgcaactcgaaaacggccaggcaatggaatgtaccgtcgctcaatactttaagcagaagtattccttacaactaaaatacccccacctcccctgcctgcaagttggacaggaacagaaacacacctatcttccattagaggtgtgcaatattgtcgccggtcaacgctgtattaaaaagcttacagataatcaaacgagcacaatgatcaaggctactgcccgttcggcccctgatcgccaagaagaaatttcccgtctggtgaagtctaatagcatggtgggcggacccgacccctatttgaaagagtttgggatcgtggttcacaacgagatgactgagctgaccggccgagtgctgcctgccccaatgcttcagtacggcggtcggaacaaaactgttgccactccaaaccaaggggtctgggacatgcgcggaaagcagttctacgcgggaatcgaaattaaagtttgggctgtggcctgttttgctcctcagaagcagtgccgcgaagatttactaaagtccttcaccgatcagctgcggaaaataagtaaggacgccggaatgcctatccaggggcagccatgcttctgtaaatacgcccaaggggctgacagtgttgagcctatgttcaaacacttaaagatgacttatgttggcctacagctgattgtggtcatactcccaggcaaaacccctgtttacgctgaggtcaagagggtgggagacaccttactgggaatggcgacccagtgtgtgcaggtcaagaacgtggtcaagacgagcccgcaaaccctcagcaatctttgcctgaaaataaatgccaaacttggcggaattaacaatgtgctcgtacctcatcagagaccatctgttttccagcaacccgtgatcttcctgggggcagatgttacccacccacccgcaggggacggtaaaaaacctagcatcgccgctgtggtaggaagcatggacgggcatccttcgagatattgtgctacagtccgtgtccagacttctcgccaggaaatcagccaggaacttttatattcccaagaagttatccaggatctgacaaatatggtgagggagctgctgatccagttttataagtcgacacggtttaaacccaccaggattatctattaccgtggtggcgtttccgagggacagatgaaacaggtggcgtggcccgaactgatcgcaattcgcaaggcctgcattagcctcgaagaagattaccgcccagggattacctatattgtggtgcaaaaacggcatcacacaagactgttctgcgccgataagacagaaagggtgggcaaatcggggaacgtgcctgcaggcacgacagtggacagcacgatcacccacccatcagagttcgacttctatctgtgcagccacgccggtatccaggggacctctcgtccttcccattaccaggtgttatgggatgacaattgctttactgcagacgaactccaacttctgacctaccagctgtgtcatacctacgtgagatgtacccggtccgtctccatccccgctccagcctactatgcgagactggtagcttttcgtgcaagatatcacctagtggacaaagaccacgactcggctgaggggtctcacgtgagcggacagtccaacggtcgggacccccaggcgttggcaaaagcggtgcagattcaccacgacacccagcacactatgtatttcgcgtag

SEQ ID NO: 222479 - DNA, 1755 bp, Artificial Sequence
  Description of Artificial Sequence: Synthetic coding sequence
atgttcgccaaggcttttagagttaaaagcaataccgccatcaagggaagcgataggcgtaaactcagagccgatgtgaccacagccttccccaccctgggaaccgatcaggtgtctgaactggtcccgggtaaagaggaactgaatatcgtcaagctctacgcgcacaaaggcgatgccgtgactgtttacgtcagcggcggaaacccaatactgtttgagctggaaaaaaacctgtacccgacagtttataccctttggtcctacccggacctacttcccacttttaccacctggccgctggtcctcgagaagctggtcgggggagctgacctcatgttgccagggctggtgatgcctcctgctggccttcctcaggtgcagaaaggcgatctctgcgcgatatccctggttggcaatagagcacctgttgccattggtgtcgctgccatgagcaccgccgagatgctaacaagtggtcttaagggtaggggattcagtgtgcttcacacatatcaagatcacttgtggcgtagcggcaataaatccagcccccctagcatagctcctctggcgcttgacagtgccgatctgagcgaggaaaaaggctcggtacagatggattctacactccagggggacatgcggcacatgacgttagaaggggaggaagagaacggagaggtccaccaggctcgggaagataaatcattgtctgaagcacccgaggatacaagtacgcgtggactgaaccaggattcaacggactccaagacccttcaggaacagatggacgagctattgcagcagtgttttctgcacgctcttaagtgcagagttaagaaagccgacctgcctctgcttacctctaccttccttggttctcacatgttcagttgctgtcctgaaggacgtcaactggatataaagaagtccagctacaagaagttaagcaagtttttacaacaaatgcaacaggagcaaatcatccaggtgaaagaactgagtaaaggtgtggaatcaattgtagctgtggactggaaacaccccaggatcacatcatttgttatccctgagccatcaccgacctcccaaaccattcaggagggctctcgcgagcagccataccatccacccgacattaaacctctgtactgcgtcccagctagtatgactctcttgtttcaggagagtgggcataaaaaaggatccttcctcgaagggagtgaagtgcgcactatcgtcattaactacgcaaaaaagaacgatttggtggacgccgataacaaaaacctggttcggttggatcctatcttgtgcgactgtatcctggagaagaatgagcagcacaccgtgatgaaattaccttgggatagcttactgacgagatgccttgaaaaactgcagccagcctaccaggtgacactgcctgggcaggagccaattgtaaaaaagggacgtatctgtccaattgatatcacactcgctcaacgcgcatctaacaagaaggtcaccgtggtgcggaatctggaggcttacgggttggatccatattccgtggcagctatacttcagcagagatgtcaggcctcgacaactgtgaacccagcccctggcgctaaagatagtctgcaggttcagatccaagggaatcaggtgcaccatctgggatggctcctcctggaagaataccaactgccccgtaaacacatccagggtctggagaaagctttgaaaccaggaaagaagaaatag

SEQ ID NO: 222480 - DNA, 816 bp, Artificial Sequence
  Description of Artificial Sequence: Synthetic coding sequence
atgtttgccaaagcattccgggttaagtcaaacacggcgatcaagggttccgaccgccgaaaattgcgcgctgacgtgacaactgccttccctaccttggggacagatcaagttagtgagctggtacctggcaaggaggagctcaacatcgtgaagttgtatgcccacaaaggcgacgctgtgactgtgtatgttagcgggggaaatcctatcctctttgagctggagaagaacctgtatcccactgatctgatgctgccaggtctggtgatgccaccagccggactgccccaggtgcagaaaggtgacctatgcgctatcagccttgtaggaaaccgggcacctgtggccatcggggtggctgccatgagcactgcagaaatgcttacttcggggctgaagggaaggggcttttctgttttgcatacttatcaagaccatctctggagaagcggtaataaatcctcaccaccgagcattgcacctcttgcactcgacagcgctgatctatccgaggaaaaagggtctgtccagatggattcaaccctccaaggggacatgagacatatgaccttggagggcgaagaagagaatggggaggtgcaccaggcgagagaagacaaaagcctcagcgaagcccctgaggacacaagcactcgaggcttaaaccaggactccacagacagcaaaactttgcaggagcagatggacgagctgttacagcaatgctttctacacgctctgaagtgtagggtgaaaaaggcagacctcccacttctgacatctacattcctgggatctcacatgttcagttag

SEQ ID NO: 222481 - DNA, 1383 bp, Artificial Sequence
  Description of Artificial Sequence: Synthetic coding sequence
atgtttgcaaaggcgtttagggtcaagtcgaataccgccattaagggctctgatcggcgtaaactgcgcgcagatgttactacggcttttccaacacttggtacggatcaggtgtccgagctggtgcccggtaaggaagagctgaatatcgtcaagctctatgcgcacaagggcgacgccgtcactgtgtacgtgtcaggcggaaaccctatcctatttgaactcgagaaaaatctctatcccaccgtctatacactgtggtcgtaccctgatttgctgcccacttttacaacctggcccctagtgctcgagaaattagtaggtggagcagatctgatgctgcctggtttagtgatgcctcctgcaggcctgccgcaggttcagaagggagatctgtgtgccattagtttagttggcaaccgcgcaccagtagctatcggagtggccgcaatgtccacagccgagatgctgacgtcaggacttaaaggtcgcggattcagtgttcttcacacgtaccaggatcatctgtgccctgaaggacgtcagctcgatataaaaaagtcttcgtacaaaaagctcagcaagttcctgcaacagatgcagcaggaacagatcattcaggtcaaggagttgagcaagggggtggaatccatcgtcgccgttgactggaagcatccgagaattacaagctttgtgattcccgagccgtccccaaccagccagaccatccaggaaggatcccgagaacagccctatcaccctcctgacattaagcctctctactgcgtacctgcctccatgacactacttttccaggagtctggtcataaaaaaggatcctttctagagggaagcgaagttcggaccatcgttattaactatgcgaaaaagaacgacctcgtcgatgccgacaacaaaaacctcgtgcggctcgatccgattttgtgtgattgtattctggagaaaaatgagcagcacaccgttatgaaactgccgtgggacagcttgctcactagatgccttgagaagctgcagcccgcatatcaggtgacgcttccaggccaggagccaattgtcaagaaggggcgaatctgtcccatcgacataaccctggcacagcgagcatccaataagaaggttactgtcgttcgtaacctagaggcatacgggctggacccctatagtgtggctgctattctacagcagcgctgtcaggcatctacaactgtgaaccctgcccctggtgctaaggactctcttcaagtgcagatccaagggaaccaagtccatcacctgggctggcttctcctggaggagtaccagttaccccgtaagcacatccaggggctcgaaaaagcactcaaaccagggaaaaaaaagtag

SEQ ID NO: 222482 - DNA, 816 bp, Artificial Sequence
  Description of Artificial Sequence: Synthetic coding sequence
atgttcgccaaagccttccgagtgaagtctaatacggcgattaagggatcggaccgacgcaagttgcgtgcggacgtcaccacagctttccccactcttggcacagatcaagtaagtgagctggtcccaggcaaagaggagcttaatatcgtaaaactctacgcccacaaaggggatgccgtgacagtctatgtctcgggaggaaaccccatcctgttcgagttggagaagaatctgtaccccaccgatctgatgctccctggcttggtgatgccaccagccggactcccacaggtccaaaagggggatctctgcgccatcagcctggtgggtaaccgcgcacccgtcgctattggggtagctgccatgtctactgctgaaatgctgacatctggacttaagggaagaggattttccgtcttacatacataccaggatcacctgtggcgtagcggcaataaaagctctcctccgagcatcgctccactggcccttgactctgccgacctctccgaggagaaaggcagtgtacaaatggacagtactcttcaaggtgatatgaggcacatgaccctagagggggaagaagaaaatggcgaggttcaccaggccagagaggataagagcctgagcgaagccccagaagacactagtaccaggggactgaatcaggactccaccgacagtaaaaccctgcaagaacagatggacgaattattacagcagtgtttcctgcacgcgcttaagtgtcgcgtcaaaaaagcggacctgcctctgctgacctccacattcctaggctcgcacatgttctcatag

SEQ ID NO: 222483 - DNA, 2742 bp, Artificial Sequence
  Description of Artificial Sequence: Synthetic coding sequence
atgagcagattctttactacgggcagcgattccgagagtgagtcgtccctgagcggcgaagagttggtcaccaaacctgtcggcggaaactatggtaagcagccccttctgctcagtgaggacgaagaagacactaaaagagttgttagatcagctaaggacaagcggttcgaggaacttaccaacctgatcagaaccattaggaacgccatgaagatcagagacgtaacgaagtgcctcgaagagttcgaactgctcggaaaagcctacgggaaggccaaaagcatagtggacaaagaaggggttccaaggttctacatcaggattctggcagacttagaagactatctgaacgagttatgggaggataaggagggcaaaaagaaaatgaataagaataacgcaaaggcattaagtacacttcggcagaagatccgcaagtataacagggactttgaatcacacattactagctacaaacagaatcctgagcagagtgccgatgaggatgccgaaaaaaatgaagaggactcagaaggcagctccgacgaagacgaggatgaggatggggtgtcggctgcaacttttcttaaaaaaaaatcggaggctccctctggcgaatcccgaaagttccttaagaaaatggatgatgaggacgaagactccgaggatagcgaagatgacgaggattgggataccggctcaacatctagcgacagcgactcagaggaagaagagggcaagcagaccgccctcgcttcaaggttcctgaaaaaagctcccacgactgacgaggataagaaggccgctgaaaaaaaaagggaggataaggcaaaaaagaagcacgaccgcaagtctaaaagactggatgaggaggaggaggacaatgagggcggtgagtgggaaagagtgcgtgggggtgtgcccctcgtgaaggagaagcccaaaatgtttgctaaggggacggaaatcacccacgcagtggtgatcaaaaagctgaatgagattttacaggcccgaggcaagaagggtactgaccgcgctgctcaaatcgaattgctgcagctccttgtgcagattgccgctgagaacaatctgggcgaaggagtgattgttaaaatcaagtttaacatcatcgccagtctgtacgactataatcctaatctggccacgtatatgaagccggaaatgtggggcaagtgtctggattgcataaacgagctcatggatatcctcttcgccaaccccaacatctttgtgggcgagaacattttggaagagagtgagaatctgcataatgcagatcagcctctcagggtgagaggctgtatccttacactcgtagaaagaatggacgaggagtttacaaaaatcatgcagaacaccgatcctcatagccaggagtacgtggaacaccttaaagatgaggcccaagtttgcgccatcatcgagcgcgtgcagcgttatcttgaagagaaaggaactacggaagaagtgtgccgcatttacttgctgagaattctgcatacttattacaaattcgactataaggcccatcagagacagttaacgcccccagaggggtcttcgaaatctgagcaggaccaagcagagaatgagggagaggatagcgcagtgctaatggaacgcttgtgtaagtacatctacgctaaggataggacggataggatacggacatgtgcaatcttgtgccatatttatcaccacgctcttcatagccggtggtatcaagcaagggatcttatgttgatgtctcaccttcaggacaacattcagcacgcagacccacctgtgcagatactttataaccgaaccatggttcagctgggcatctgcgcattcagacaaggactcacaaaggacgctcataacgcactcttagacattcagagtagcggacgggcaaaagaactgctgggtcaagggctgttgttgagatcacttcaggaacgcaatcaggagcaagaaaaggtggagagacgacggcaggtgccatttcacctgcatataaacttagaattgctggagtgtgtgtaccttgtgagcgccatgctgctggagatcccctacatggctgcccatgagtctgatgcgaggcgtcgtatgatatcaaaacagttccaccatcagctgagggtcggagaacgccaacctctgctcggaccacccgaatcaatgagagaacatgttgtagccgcatctaaagctatgaagatgggggactggaaaacctgccattcctttattatcaatgaaaagatgaacggcaaggtgtgggatctatttcccgaagctgacaaagttcgcaccatgctggtgcggaaaatacaggaagagtcactgagaacttatctgtttacatattccagcgtctatgacagcatatcaatggagactctgagcgacatgttcgaactagacctccccacggtgcactccataattagtaagatgataattaacgaggagctgatggccagcttggaccagcccactcagaccgtcgtgatgcaccgcactgagcctacagcccagcaaaacctggccttgcagctagcagagaaattgggaagtttggtggaaaacaatgagagagtcttcgatcataagcagggcacgtacggcggatatttcagagatcagaaggatggatacagaaagaatgaggggtacatgaggagggggggttataggcagcagcaaagccagaccgcgtattag

SEQ ID NO: 222484 - DNA, 4149 bp, Artificial Sequence
  Description of Artificial Sequence: Synthetic coding sequence
atgccggcttacttccaacggccagagaatgccctcaaaagggctaacgagttcctcgaggtcggcaagaagcagccagccctcgacgttctatatgatgtaatgaaatctaagaagcatcgtacatggcagaagattcacgagccaattatgctgaaatacctggaactgtgtgtggatctccggaaatcacacctcgcaaaggagggtctgtatcagtataaaaatatatgccagcaggtgaacatcaagagtctggaggatgttgtgagagcttacctgaaaatggcggaggagaagaccgaggctgccaaggaggaatcacaacagatggtactggacatcgaagatttggacaatatccaaactccagagagcgttctcctgtctgccgttagcggtgaggatacacaggatcgcaccgatcgcctactcctcaccccctgggttaaattcctgtgggaatcctacaggcagtgtctagatctgcttcgcaacaactctcgcgtcgagcgcctgtaccacgacatagcccagcaagcgttcaagttttgcctccagtatacacgcaaggccgagttcagaaagttgtgtgacaacctgcgcatgcacttaagccagatccagcgacaccacaaccagagcaccgctatcaacctcaacaacccagagtcacagtctatgcatcttgagacgcgtctggtgcaactggattccgctatctccatggaattgtggcaggaagcctttaaggcagtcgaagacattcacggcttgttttccctgtcgaagaagcccccaaagccgcagctcatggctaactactacaacaaagtgagtactgtattttggaaatccggaaatgccctcttccacgcatccactctgcaccggttataccacctgagcagggaaatgcggaagaatctgacgcaagacgaaatgcagaggatgagtacacgggttctgctcgccacgttaagcatcccaatcaccccagaaagaaccgacatcgctaggctgctggacatggacggcataatcgtcgagaagcagcgtaggctggcaactttgcttggcttacaggcccctcccacccgcatcggcctcatcaatgatatggttaggttcaacgttctgcagtacgtcgtgccagaggttaaggatctctataactggctagaagtagagtttaatcctctgaaactgtgtgagagggtcactaaggtgctcaactgggtgagagagcagcccgagaaagagcccgagctgcagcagtacgtcccgcaattgcagaataatactatcctccgcctgctgcaacaggtgtcccagatataccagagcatcgagtttagccgactaacatccctggtgccattcgtagacgctttccagctggagcgcgctatcgtcgatgcggcaagacattgtgacctacaggttcggatcgatcatacgtcacggactctgtcttttggaagtgacctgaactatgctacgcgggaggacgcgcctatcggacctcacctgcaatctatgccgtcagagcagattaggaatcagctgaccgccatgagcagcgttctggccaaggctctcgaggtgatcaagcccgctcacattctgcaggaaaaggaagaacaacaccagctggctgtgaccgcatatcttaagaattctcggaaggagcaccagaggatcctcgcaaggcgtcagaccattgaagaacggaaagaaagactcgaatctctgaatattcagcgagagaaggaagagttggagcagcgtgaggctgaactgcagaaggtgcgaaaagccgaggaggagagactaagacaggaagctaaagaaagagaaaaggaacgtattctgcaggagcatgaacagattaaaaaaaagaccgtgcgagagcgcctggagcagattaagaaaacagagttgggagctaaggctttcaaagatatcgatatcgaggatctcgaggaactggatcctgatttcataatggctaagcaggtggaacagctggagaaggaaaaaaaagagctccaggaacgccttaagaatcaagaaaagaaaattgactattttgagagggcgaaacggctagaggagatccccctgattaaaagtgcctatgaggagcagcgcattaaggatatggacctatgggagcagcaggaagaagagagaataactacaatgcagttggagcgcgaaaaggcccttgagcacaaaaatagaatgtcgagaatgctggaggaccgggatctgtttgtgatgcggttgaaagccgctcggcagtcagtgtacgaagagaagctgaaacaattcgaagaaagacttgcggaggaaagacataaccgcctcgaagagagaaaaagacagcgcaaggaggaaaggcggatcacttactaccgggagaaggaagaggaagagcagaggcgggcagaagaacagatgctcaaggagcgggaggagagggagagggctgaaagagccaagcgcgaggaggagttgcgtgagtaccaggaacgcgttaagaagttggaagaggtggaacgcaagaagcgacagcgcgagctagagatcgaagaaagagagcgaagaagggaggaggagaggaggctgggggattcttctctctcccgtaaggatagccggtggggggaccgtgattccgagggtacgtggcggaagggcccagaagccgacagcgagtggaggagggggcctccagaaaaagaatggcgcagaggggaagggagagatgaggatcgctctcacagacgcgacgaagagaggcccaggcgtctgggcgacgatgaggatagagagccctcccttcggccagacgatgatcgcgtgccacggagaggcatggacgacgaccgagggcctcggagaggcccagaggaggacagattctctcgacggggagctgacgatgatcgaccaagttggagaaatactgatgacgacagacctccacgacggattgcagacgaggatagaggcaattggcgccacgcagacgacgaccgtccaccacgaagaggcctggatgaggacagaggttcatggcgaaccgcagacgaggatcgagggcctcgcaggggcatggacgatgatcgcggtccaagacgaggtggggcagatgatgaacggagttcctggagaaacgctgacgatgacagaggccctcggcgaggtctggatgacgatcggggaccgcgaagaggcatggacgatgaccgagggcctcgcagaggaatggacgatgatcgaggcccacggcgaggcatggatgacgatcggggaccgagaagaggcctggatgatgatcgcggaccttggaggaacgccgacgacgacaggatccctagacgaggagcagaggacgaccgaggcccatggagaaacatggacgatgacagactcagtagacgagccgatgatgaccgctttccaagaaggggtgatgattctagacccggaccatggaggcccctggtcaagcccggaggctggcgtgaaaaagagaaggcaagggaggagtcttggggccctcccagggaatcccgcccttctgaggagcgtgagtgggaccgcgaaaaggaaagagatcgcgataaccaggaccgagaagagaacgataaagatcctgaacgtgaacgggacagagaaagggacgtggacagagaggataggttccgtcgcccacgtgacgaaggtggttggcgaagagggcctgccgaagagagctcaagctggcgagattcgtcgcgccgtgacgaccgggatagagacgatcgcaggcgggaacgtgacgaccggagagacttgcgtgagagacgggatctgagggacgatcgggacagacgcggaccccctcttcggtcggagcgtgaagaggtttcctcatggaggcgcgctgacgaccggaaagatgaccgcgtggaagagagagacccaccacggcgtgtgccacccccagccctatccagagaccgcgagagggatcgtgatagggaacgcgaaggggagaaggaaaaggcgtcatggagggccgaaaaggaccgagagtccctgcgaaggaccaagaacgagaccgatgaagatggctggaccacagtgagacgttag

SEQ ID NO: 222485 - DNA, 4047 bp, Artificial Sequence
  Description of Artificial Sequence: Synthetic coding sequence
atgaaatcgaaaaagcacagaacatggcaaaaaatccatgaacccatcatgctaaagtacctcgagttgtgtgtggacttgcggaagagccacctcgccaaggaaggtctctaccagtacaagaacatatgtcagcaggttaatatcaagtcactagaagatgttgtgcgagcttacctgaaaatggcggaagagaaaactgaagcggctaaagaagagagccagcagatggtgctagatatcgaggaccttgataacatccagacccctgaatcagtacttctttccgctgtgagcggtgaggacacccaggacagaactgatagactgctactcacaccatgggttaagttcctgtgggagtcatatcggcagtgcctggatctgctgagaaacaattctagggttgaacgcctgtaccatgacattgctcagcaggccttcaagttttgcctgcagtatacccgaaaggccgaattcaggaaactctgcgataatctgagaatgcatctgtcgcaaattcaaagacatcataaccagagcaccgctattaacctgaataaccctgaaagccagtccatgcaccttgaaacacgtttggtccaactcgactccgcaatttctatggagctttggcaggaggcattcaaagcagtggaggacattcacggcctgttttcattgtccaaaaagcctcccaaaccacagcttatggccaactactacaataaggtctctaccgtgttttggaaaagcggcaacgctttatttcatgcaagtactctgcaccgcctctatcacctgagtagagagatgcgtaagaatctgactcaggacgaaatgcaacgtatgagcacgcgggtgcttctggcgacccttagcattcctatcaccccagagagaaccgacatagcgcgactgctagatatggacggaattatcgtagagaaacagcgtcgactggccaccttgctgggactgcaagccccaccgactcggatcggccttatcaatgatatggtgcgatttaacgttcttcagtatgtggtgcccgaagttaaagatctctacaactggctcgaagttgaattcaaccctctgaaattatgcgagagggttaccaaagtcctgaattgggtgcgcgagcagcccgagaaggagcccgagttgcagcagtatgttccccagctacagaacaatacaatcctcagactcctgcagcaggttagtcagatataccaaagtatcgagtttagtcggctgacaagtctggtccccttcgtggatgcttttcagctggagcgcgcaattgtcgatgccgcacgtcattgcgatctccaggtccgtatcgaccacacatcgaggacactgtctttcggcagcgatctgaattatgcaacacgtgaagacgccccaatcggcccacatcttcagagtatgccttccgaacagatccgtaaccagcttacagcgatgtcttccgtgctcgcaaaggccctggaagtgataaaaccggctcacattcttcaggaaaaggaggagcaacaccaattggccgtgaccgcttacctgaaaaatagtcggaaggaacaccaaaggatactcgccaggaggcagaccatagaagagcgtaaagaacgactggagagcctcaacatacagcgagaaaaggaagaacttgaacagcgcgaggctgaattacagaaagttaggaaagcagaggaagagcgactgcgtcaggaggccaaagaacgggagaaggaaagaattctccaggaacatgaacagatcaaaaagaaaactgtgcgggagagactggaacagataaaaaagactgaacttggggcaaaggcctttaaggatattgacattgaggatctcgaagaactagatcccgatttcattatggctaagcaagtggagcagttggaaaaggagaagaaggagttacaggagcgactgaagaaccaagaaaagaagatagattacttcgaaagggcaaagcgactagaagagatccccctgattaaatcggcttacgaagagcaaagaattaaggatatggatctatgggaacagcaagaggaggagaggataacgacaatgcagctggagagagagaaggcattggaacataaaaatagaatgtctcggatgcttgaagaccgcgatctgtttgtgatgcggctcaaggctgctagacaaagcgtttacgaagaaaaacttaaacagtttgaggagcgcctggccgaggagcgccataaccgtctggaagagcgcaaacggcagaggaaggaggaaagaagaatcacttattaccgagagaaggaagaagaagaacagagacgcgcagaggagcaaatgctcaaggaaagggaggagcgggaacgagcagagcgcgctaaaagagaggaggaactgagagagtaccaagaacgcgtaaagaagctggaggaagttgagcgtaaaaagcggcagcgtgagctagaaattgaggagcgcgagaggcgcagggaggaggaaaggcgcctgggagacagctccctgagccgaaaggactcaagatggggtgaccgggattctgaaggaacgtggcgaaagggccctgaagcagatagcgagtggcggaggggcccacccgagaaagagtggcgacgcggtgagggcagagatgaagacaggagccatcggagagatgaggagcggccacggcgtctcggcgacgatgaagatcgggagccctcattgagacccgacgacgatcgggtaccacggagaggaatggacgatgaccgcggtccaaggagaggccctgaagaggatcggttctctcggaggggagcagacgacgatcgtccctcttggcgtaatactgacgatgacaggcctccacggaggatcgccgatgaagatagagggaattggaggcacgccgacgatgaccgacccccaagacgcggactggatgaagatagaggctcctggagaacagccgacgaagatcgtggtcctcgacgtggcatggatgacgatagaggacccaggcgcggtggtgctgacgacgaacgatcctcatggaggaatgccgacgacgataggggacctcggagaggtctggatgatgataggggccctcgtcgtggaatggatgatgatcgaggacccaggaggggaatggacgatgaccgcggtcccagacgtggcatggacgacgaccggggaccgcgacggggattagatgatgacaggggcccatggcgaaatgccgacgatgacagaattcctagacgaggcgctgaggacgaccgtgggccttggcgtaacatggacgatgaccgcttatccagacgcgctgacgacgatcggtttccaagaaggggcgatgactcccgacctggaccgtggcggccactggtgaaacccggtgggtggcgagaaaaagagaaggccagggaggagtcctgggggccacctcgggagtcgcggccaagtgaggagcgcgagtgggatagagaaaaggagcgcgatagggacaatcaagaccgtgaagagaacgataaagaccctgagagagagagggatcgtgaaagggatgtcgacagagaggataggtttcggcgtcctcgcgacgagggagggtggcggcgagggcctgctgaagagagcagttcatggcgcgactctagccgcagagacgaccgggaccgcgacgatagacggcgtgaaagggacgatcggagagatctgcgcgaaaggagggatcttagagatgacagggacaggcgcggaccccctttacgcagcgaacgggaagaagtgagttcatggcgccgtgcagacgatcgcaaagacgacagagtcgaagagagagaccccccacggagggttccacctcccgcactcagccgtgaccgtgagagggatagggacagggaaagagaaggcgagaaagagaaggcttcctggagagccgaaaaggaccgagagagcctgagaagaaccaagaacgaaaccgatgaagatggctggaccacggtgaggcggtag

SEQ ID NO: 222486 - DNA, 2619 bp, Artificial Sequence
  Description of Artificial Sequence: Synthetic coding sequence
atgcaggacgcagagaatgttgccgtccccgaagccgcagaggaacgtgccgagcctgggcagcagcaaccagccgcagaaccccctccagcagagggattgctacggccagctgggccaggcgctcccgaagcagccggtaccgaggcgagttctgaggaggtaggtatcgctgaggcaggacctgagagtgaagtgcgaaccgagccggctgctgaagcagaagccgcttccggtccatcagaatccccaagtcccccagccgctgaggagctgcctggttcacacgccgagccacctgtccccgctcagggagaggctccaggcgaacaggccagagacgagcggtcagacagcagggcgcaggctgtctcagaagatgctggtggcaatgaaggcagagcagcagaggcagaaccaagagccctggagaatggagacgcagacgaaccttccttcagtgaccccgaagatttcgtggatgacgtcagcgaagaggagttgctcggggacgtgctcaaagataggccacaggaggctgatggcattgactcagtgattgtggttgataacgtgcctcaggtggggccagacaggctggagaaactgaaaaacgtgatccacaaaattttttctaagttcggaaagataaccaacgatttctatccggaggaagatgggaaaacaaaggggtacatcttcctggaatatgcgagtccagctcacgcggtcgacgccgttaagaatgccgacgggtacaaactggataaacagcatacgtttagggtaaatctctttacggacttcgacaagtatatgaccataagcgacgaatgggatatccccgaaaaacagccattcaaagatctgggaaatctgcggtactggctggaggaagccgagtgtagagaccaatactccgtgattttcgagtctggcgatcggactagcatcttttggaacgatgtgaaggatcccgtgagcatcgaggaaagggcaagatggaccgagacctacgtcagatggtcacccaaggggacatatctcgctacttttcatcagcggggaatcgcactatggggaggcgagaaatttaagcaaatccagcgattcagtcaccagggtgtgcagctgatcgatttctctccctgtgaaagatacctggtgacgtttagtccccttatggatactcaggacgaccctcaagctataatcatctgggatattctaacggggcataagaagcggggattccactgcgaaagttccgcccactggcccattttcaagtggtcccatgatggcaagttctttgcccgaatgacattggataccctttccatctacgagacaccttccatgggcctgcttgacaagaaatcccttaagatctccggcatcaaagatttttcatggagtcctggagggaatatcattgcattctgggtccctgaggacaaagacatccctgccagagtcaccctgatgcaattacccacaagacaagagatccgggtgcggaacctgtttaacgttgtcgactgcaagcttcattggcaaaagaatggggactacctgtgtgtgaaagtcgacagaaccccgaaggggactcaaggcgtggtgaccaacttcgagatcttcagaatgcgggagaagcaggtgcctgtagacgtggtggagatgaaggagacaattattgctttcgcttgggaaccaaacggcagcaaatttgcagttctccacggggaggccccacggatcagtgtgtccttctatcatgtgaaaaacaatggcaaaatagaactaattaaaatgtttgacaaacagcaggccaacaccattttctggagcccacaaggacagttcgtggtcctcgcaggtctgagatccatgaatggcgctcttgcctttgtagataccagcgattgtacagttatgaatatcgccgaacactacatggctagtgatgtagagtgggaccccacgggtcgctacgtcgtaacaagcgtctcttggtggtctcacaaagttgacaacgcatattggttgtggacttttcagggaaggttgctgcagaagaacaacaaggatcggttttgtcaattgctctggcggcctaggccccctactctgctgtcacaagaacagataaaacagatcaaaaaggacctgaagaagtactcaaagatcttcgagcagaaagatcgcctctctcagtccaaggcatcaaaagaactggtcgaaagacggaggaccatgatggaagatttcaggaagtacaggaaaatggctcaagaactttacatggaacagaaaaatgagagactggaactgcgcggaggggtggatactgatgagctggacagcaatgtcgacgattgggaagaagaaacaatcgagttctttgtcacggaagaaattatcccaggaatacggtccgacctggaacattgcgcccagccctgcgtgctttggagtagaggacggcctgcagggtctcgggtcacacctgcatccagcctgtgctccctggccctagattgcgattgcgcttggatcctcccactgaggcacatctttgtcccattcagtccgtggtgtctgcagtggggcatttag

SEQ ID NO: 222487 - DNA, 2445 bp, Artificial Sequence
  Description of Artificial Sequence: Synthetic coding sequence
atgcaggatgccgagaacgtggctgtacccgaggcagcggaagagagagctgagcctggtcagcagcagcccgcagcagagccccctcctgccgaaggcctcctgagaccagcaggtcccggtgcccctgaagccgcaggaactgaagcaagttctgaagaagtggggatcgcggaggccggtcccgagagcgaagtcagaactgaacccgcagctgaagctgaggccgcatctgggccttcagagagcccctcccctccggctgcagaggaactccctgggtcacacgcagagcctccggttcccgctcagggagaagcccctggggaacaggcacgagatgagaggtcagatagtagggcgcaagccgtgtctgaagatgcagggggtaacgaagggagagccgcagaggccgaacctcgtgcattagaaaacggagatgccgatgaacctagtttcagtgatcctgaggacttcgtggatgatgtgagcgaggaagagttactcggggatgtgttaaaggaccggcctcaagaagcagacggaattgactctgtcattgtcgtagacaatgtcccacaggtcgggccagatagactcgaaaaactcaaaaacgtcatccataagattttctcaaaatttggtaagattacaaatgatttttatcccgaagaggacgggaaaacaaagggatacatctttcttgaatacgcttcgccggctcatgctgtggatgctgtgaagaacgcagatggttacaagttagataagcaacacacattcagggttaaccttttcacggactttgacaaatatatgaccatctccgatgaatgggatataccagaaaaacaaccctttaaggacctaggcaacttgagatactggctcgaagaggctgagtgtcgggaccagtacagcgtgatcttcgagagtggtgaccggacaagcatcttctggaacgatgtgaaagacccggtgtcaattgaagagagggccaggtggacagagacttatgtgcggtggagcccaaagggaacctaccttgcaacattccatcagcgcggaatcgccctgtggggtggcgaaaagttcaagcagatacagaggttttcgcaccagggagttcagcttatcgacttttcaccatgtgagaggtatctggtcacattcagcccattgatggacacccaggacgacccccaagcgatcatcatatgggacattcttaccgggcacaagaaaagagggttccactgtgagtcgagtgcccattggcccattttcaagtggtcccatgacggcaagttttttgcccgtatgactctagataccctgtcaatttacgagacaccatctatggggttattagacaagaaaagtttgaagatctccggaattaaagattttagctggagtccaggcggaaatatcattgccttttgggtgcctgaagataaagatatccctgcccgagtgaccctgatgcaacttcctactcggcaggaaattagagttcgcaatctgtttaatgttgtggattgtaaactccattggcagaaaaacggtgattacctgtgtgtcaaggtggaccgcaccccgaagggtactcagggcgtggttacgaacttcgagatttttcgaatgagggaaaagcaagtgcctgtggacgtggttgagatgaaagagactattattgcgtttgcatgggaaccgaatggttccaagtttgcagtcctccacggagaagccccacggatctctgtttctttttatcatgtgaagaacaacgggaaaatcgagctgataaaaatgtttgacaaacaacaagcgaataccattttctggtctcctcagggtcagttcgtggtgctggcgggactgcgcagcatgaatggagctttggccttcgtcgacacatcggactgtacagtgatgaatatagcagaacattatatggcctcagacgtcgagtgggatccaaccggcagatacgtcgtaacatcagtctcttggtggtctcacaaggtagataacgcatattggctgtggacatttcaaggaaggctcctgcagaagaataataaggaccgattttgccagctcctgtggaggcctaggccccctactctcctgtctcaagagcagatcaagcagatcaagaaggatcttaaaaaatattccaagatatttgagcagaaggaccgccttagtcaaagtaaagcctctaaggagcttgtggaaagaagaagaactatgatggaggactttcggaaatacagaaagatggctcaggagctgtacatggagcagaaaaatgagcggctcgaacttcggggaggcgtggacacggacgagctggactctaatgtggatgattgggaggaggagactattgagttctttgtcaccgaggagattattcccttaggcaaccaagagtag

SEQ ID NO: 222488 - DNA, 2445 bp, Artificial Sequence
  Description of Artificial Sequence: Synthetic coding sequence
atgcaggatgccgaaaacgtggcagtgcccgaggctgcagaggaacgggcagagcccggacagcagcagcccgcagctgagcctcccccagcagagggactcttgcggcctgcaggacccggagcccctgaagctgctgggactgaggcctcaagtgaagaggtagggatcgcagaggcaggacccgagagcgaggtgcggaccgagcccgcagccgaagccgaggccgcttcaggcccatcagagagtccttcacccccagcagccgaggagctgcccggatcccacgctgagccgccagtgccagcacagggcgaagccccaggagagcaagcaagagacgagcgttctgactcccgcgctcaagctgtctccgaggatgccggtggcaacgagggtagggcggctgaggcagagccacgcgctctagaaaacggagacgccgacgagccaagcttttctgacccagaggacttcgtggatgatgtatcggaagaagaattgctgggcgacgtactgaaggaccgaccccaggaggcagacggcatcgacagtgtgatagttgttgataacgtcccacaggtggggccagacaggctggagaaactcaaaaatgtgattcacaagatctttagcaaattcgggaagattacaaacgatttctaccccgaagaggacggaaagaccaaagggtatatttttctggaatatgcctccccagctcatgccgtagatgcagtcaagaacgctgacggatataagctggacaagcaacacacttttcgcgtaaatctgttcactgatttcgacaaatacatgacgattagcgatgaatgggacatcccagagaagcagccctttaaagacctgggaaacctgcgatactggctagaggaggcagagtgccgtgatcagtactccgtcatcttcgaaagcggtgataggacaagcatcttctggaatgacgtcaaggaccctgtttcaattgaggagcgcgctagatggaccgagacttatgtaagatggagccccaaagggacctatcttgctacctttcaccagagaggcatcgcactctggggcggtgaaaagttcaagcaaattcagcggttcagtcaccagggggtgcagttaatagacttcagcccttgtgagcgctacctggtcacatttagccctctgatggacacccaggatgaccctcaggcaatcatcatctgggacatattaaccgggcataagaagaggggctttcattgtgaatcttccgcccactggcctatcttcaaatggagccatgatggcaagttcttcgccaggatgaccctagataccttatccatttacgagacaccatcaatgggtctgctggacaaaaaatccctgaagatatcaggcattaaagatttctcctggtccccagggggaaatatcatagccttttgggtgccagaagacaaagatataccagccagagtgacgctaatgcagctgccaacaagacaggagatccgagtgcggaatctgttcaacgttgtggactgcaaactgcattggcagaagaacggagattacctgtgcgtgaaggtagatagaacgcctaagggcacacagggggttgtgaccaactttgagatatttaggatgagggaaaagcaggtgcccgttgacgttgtggagatgaaagaaacaatcatcgccttcgcgtgggagcccaatgggtcaaagttcgccgtcctacatggcgaagctccccgtatatcagtatccttttaccacgtaaaaaacaatggcaagatagagttaattaaaatgtttgacaagcagcaggccaataccattttttggtcacctcagggccagttcgtggtgctggctggcctgcgtagtatgaatggagcactggcattcgtggacacctccgattgcacagtgatgaatatagctgagcattatatggcaagcgatgttgagtgggaccctaccggaagatacgtggtgacaagtgtgtcctggtggtctcataaagtagacaacgcctactggttatggactttccagggtagacttctccagaaaaacaacaaggatcgcttttgtcaactcttatggaggccccgacctcctaccctgttgtcacaggagcagattaagcagatcaaaaaagatctgaagaagtacagcaagatttttgagcagaaggataggctgtcccagagtaaagcctctaaagaattggttgagcggaggcgtacaatgatggaagacttccgcaagtacagaaaaatggcacaggagctttatatggaacagaaaaatgaacgtctcgagttgcgcggtggagtggacactgacgagttggactccaacgtggacgactgggaggaggaaactatcgaatttttcgtgaccgaagagatcatccccctggggaatcaggagtag

SEQ ID NO: 222489 - DNA, 2217 bp, Artificial Sequence
  Description of Artificial Sequence: Synthetic coding sequence
atgcaggatgccgagaatgtggctgtgcccgaggccgcagaggaacgtgcagggagccacgccgaacccccagtgccagcgcagggcgaggcccctggagagcaggcacgcgatgagaggtctgattctcgggcacaggctgtgagcgaggacgcaggaggcaatgagggccgagcagccgaagccgagcctagagcactggaaaacggagacgccgatgaaccgtcattcagtgacccggaggacttcgtggacgatgtttcagaagaggagctgctgggcgatgtgctgaaagacaggccacaggaggcagatgggatcgactccgttattgtcgtggacaacgtcccacaggtgggaccagataggcttgaaaaattaaaaaatgtcattcacaagattttttctaagttcggcaagattaccaatgatttctatccagaggaggacgggaagacgaagggatatatcttcctggagtacgctagcccagctcatgccgtagatgccgttaagaacgctgacggttacaagttggacaagcagcacaccttcagggtgaatctgtttaccgacttcgacaaatacatgaccatctccgatgagtgggatatccccgagaagcagccttttaaggacctcgggaatctgaggtattggctggaagaagcagaatgcagagatcagtacagtgtgatttttgaatccggcgacaggacctcaatcttctggaacgatgtaaaggatccggttagtatagaggagcgggctcgctggaccgaaacatatgtgagatggagcccaaaggggacctacctcgcaacattccaccagcgcggaattgctttatggggcggagagaagttcaaacagattcaaaggttcagccaccagggtgttcagctgatcgacttttctccctgtgaaagatacctggtgaccttctccccactcatggatactcaggatgacccgcaggctattattatatgggatattctgacaggccacaaaaaacgcggatttcactgtgaatcctcagctcactggcctatctttaaatggtcacacgatggcaaattcttcgctcggatgaccctggacactctttctatatacgagaccccctccatgggcctcctagataagaaatccctgaaaatcagtggcattaaggacttcagctggagtccaggcggtaacattatcgctttctgggtccctgaggacaaagacatcccagccagagtaaccttgatgcagctgccaacaagacaggaaatcagagtccggaacctgttcaatgtggtcgattgcaaattacactggcagaagaatggcgattatttgtgcgtcaaggttgatcgaaccccaaagggtacacaaggtgttgttacaaattttgaaatttttaggatgagggagaagcaggtgccagtggacgtggtagagatgaaagagactattatagcgtttgcttgggagcccaatgggagtaaatttgctgttctgcatggagaggctcctagaatcagcgtctcattttatcacgtgaagaacaatgggaaaattgagctcatcaaaatgttcgacaagcagcaagccaacaccatcttctggagtccccagggtcaatttgtggtgctggcaggtcttagaagtatgaatggggcactggcatttgtagacacctcggactgtactgtcatgaatattgcagaacactatatggccagcgatgtggagtgggaccctaccggcagatatgtggtaacgagtgttagttggtggtctcacaaagttgacaatgcctattggctgtggacatttcaaggcaggttactgcaaaagaataacaaggaccgcttttgtcaactgctgtggcggccaaggcctcccacacttctgagccaagagcagatcaagcagatcaaaaaggacctcaaaaagtactcaaagatctttgaacagaaagaccgactgagccagagcaaggctagcaaagaactggttgagcgaagacggaccatgatggaggatttcagaaagtatcgtaaaatggcccaggagctgtacatggagcaaaagaatgaacgcttagagctccgtggcggagtggacacagatgagctcgactcgaatgtcgatgactgggaggaggaaacaatcgaattctttgtcaccgaagaaattatacccctgggaaaccaggagtag

SEQ ID NO: 222490 - DNA, 2742 bp, Artificial Sequence
  Description of Artificial Sequence: Synthetic coding sequence
atgagcaggttcttcacgactgggtcggattcagagagtgagagctcactgtctggggaagagctggtaaccaaacctgtgggaggtaactatgggaaacagccactcttgttgtcagaggatgaagaagatacaaaacgggtcgttcgaagcgctaaagataagaggtttgaggaactaactaaccttattcgcaccatcagaaacgctatgaagatacgcgacgtcaccaagtgcctggaagaatttgagctcttgggaaaggcgtatgggaaagccaaaagcattgttgataaagagggagtgccacgcttctacatacggattttggccgacctggaagactacctgaacgagctgtgggaagacaaggagggcaaaaagaaaatgaacaagaacaacgctaaggccctaagtaccttgcggcagaagatacggaagtacaaccgagattttgaaagtcatattacgtcttataagcaaaaccctgaacagtccgctgatgaggacgcagagaagaacgaggaagactcagaagggtcatccgacgaggacgaggatgaggacggagtttctgcggcaacattcttgaaaaagaaatctgaagccccatccggggagtcccgcaaattcctcaagaagatggatgacgaggacgaggactcagaagattccgaggacgatgaagactgggacactggaagtacatcctcggacagcgattcagaggaagaagaagggaaacagaccgccctcgccagtcgatttctgaaaaaggcccctactacagatgaagataaaaaggccgcagaaaagaagagagaggataaggcgaaaaagaagcatgataggaagagtaaacggctggacgaagaggaggaagacaacgaaggtggagagtgggagagagtgagaggcggtgtaccgctagtgaaagagaagccaaagatgtttgctaaggggactgaaattacccacgctgtcgtgattaaaaaacttaatgagattctccaggccagagggaagaagggaaccgacagggcagctcagattgaactgctgcagctgctcgtacagattgccgctgagaataatttaggagagggcgtgatcgtcaagataaagtttaacattatagccagtctgtatgattacaatcctaacttggctacatatatgaagcccgagatgtggggcaagtgcctggattgtattaacgaacttatggatattctgtttgccaaccccaacatatttgttggtgagaatattttggaagaatctgaaaacctgcacaacgctgaccagcctctccgtgtcagaggctgcatcctcaccctggttgagcggatggacgaggagttcactaagattatgcagaacacagatccccattctcaggagtatgtggagcatctcaaagacgaggctcaggtctgcgcgattatcgagcgcgtacagaggtatctggaagagaagggtacaactgaggaggtttgcagaatatatctgctccgcatcctgcatacatattataagttcgactataaggcccatcagaggcagctcacgccacccgagggatcctctaagagcgaacaggaccaggctgagaatgagggcgaggactctgctgtattaatggagaggctatgcaagtatatctacgccaaggacagaaccgacagaatcaggacctgtgcgattctatgtcatatataccaccatgccctccacagtaggtggtaccaagccagagatttgatgttgatgagccatctgcaagataacatccagcatgccgatccccctgtgcagatcctctacaaccgcaccatggttcagctgggaatatgcgccttccgccaaggactgaccaaggacgcgcataatgcattgcttgacattcaatccagcggtcgggcaaaggagctcctgggccaggggctcctcctgcgatcacttcaagaacgaaatcaagaacaggagaaggtggaaaggcgtcgtcaagtgccctttcacctgcacatcaacctcgaacttctagagtgcgtctatctggtgtcggcgatgctgctggaaatcccgtatatggcagcacacgaaagtgatgcgaggagacggatgatctccaagcagtttcatcaccagctacgggtgggcgagcgccagccgttactgggccctccagagagcatgcgggaacacgtagtcgccgcttctaaggcaatgaagatgggtgactggaagacatgccactccttcattattaacgagaaaatgaacggaaaggtctgggacttattcccggaagccgacaaggttagaacgatgttggtgcgaaagatccaagaagagagtctgcgcacttatctgtttacttattcatccgtttacgatagtattagcatggagaccctatcagatatgtttgaacttgacctgccaaccgtccactcaatcatcagtaagatgattataaacgaagagcttatggcctctctggaccagccgacacaaaccgtggtgatgcaccgaactgagcctaccgcccaacagaatctggcccttcagttggccgaaaagcttggcagcctggtggagaacaacgagagagtttttgatcataaacaggggacatacggcggttatttcagagaccaaaaagatggctatcggaagaatgaaggatatatgcgacgaggagggtatagacagcagcagtcgcaaactgcatattag

SEQ ID NO: 222491 - DNA, 2286 bp, Artificial Sequence
  Description of Artificial Sequence: Synthetic coding sequence
atgtcgagattcttcaccactggaagtgattctgagtcagaatcttctctctctggagaagagctggtcaccaaacccgttgggggaaattatggcaaacaacctttgctcctgtctgaagacgaagaggacacaaagcgcgtggttagatccgcgaaagacaagagatttgaggaactgactaatctaatcagaaccatccggaatgcaatgaagatcagagacgtgacaaaatgtctcgaggaatttgagctgctgggcaaggcctacggtaaagctaaaagtatcgtggataaagaaggggtgccccgattttatattcggatcctcgcggacttagaagactacctgaacgagctgtgggaagacaaggaaggcaagaagaaacacgatcggaagtccaagcgtctcgatgaggaggaggaggataacgagggcggagagtgggagagggtgcgcggaggcgtgccattggtgaaagagaagccaaaaatgtttgcaaaaggcaccgagatcactcatgctgtggtgataaagaaacttaacgagattctgcaggctcggggaaaaaaagggacggatcgtgccgctcagatcgaactgctccagttgctcgtccagatcgcagcagagaacaacttaggagaaggggtgattgtgaaaattaaattcaacattatcgcttcattatatgactacaacccaaatttggctacttatatgaaaccagagatgtggggcaaatgcctcgactgcatcaacgagctaatggacatccttttcgccaaccctaatatttttgtgggggagaatattctggaagagagcgaaaacctgcacaacgccgatcagcccctccgagttcggggttgtattctcactctggtggaacgcatggacgaggagttcaccaagattatgcagaatacagatccgcactctcaggagtacgtggagcatctgaaggatgaagcccaggtctgcgcgatcatcgaaagggtgcagaggtacttggaagaaaaaggcacaactgaggaggtttgccgcatttatctgttgaggatcttgcacacctattataaattcgattacaaggcacatcaacgccagctcactccacctgagggatcgtcgaagtccgagcaggaccaggccgaaaacgagggcgaagatagcgccgttctgatggagcggctgtgtaagtacatctatgctaaggaccggaccgaccggattcgcacgtgcgcaattctgtgtcatatctatcaccacgcccttcacagcagatggtaccaagcaagagatcttatgctgatgagtcacctccaggacaatatccagcacgccgacccacctgtacagattctatacaacaggaccatggtccagctcggcatctgtgccttcagacagggtttaactaaggatgctcataatgccctgctggatattcagagcagcggaagggccaaggagctactgggacaggggctgctgctgcggtctctgcaggagcgaaatcaagaacaggagaaagtcgagcgaaggcgccaggtaccattccacctccacatcaaccttgagttgctggaatgcgtgtacctggtgtcggcaatgttactggaaattccatacatggcggcacacgaaagtgatgcgagaaggaggatgattagcaagcagttccaccaccagctgcgggtcggggaaagacagcccctgctcggacccccagagagcatgagagagcatgtcgttgctgcttcaaaagcgatgaagatgggagattggaagacttgtcattcgttcattatcaatgagaagatgaacggcaaggtgtgggacctctttccagaggcggacaaggtgcggaccatgctcgtgcggaaaatacaggaggagagtctaaggacatatctgtttacctactcatctgtttatgatagtatttcgatggagacgctatccgatatgttcgagcttgacctgcccactgtacatagcatcatcagcaagatgataattaatgaggagcttatggcctccctcgaccagcccactcaaacggttgtaatgcatcggactgagcccacagcccaacagaacttggccctccagctcgcggaaaagctcgggtctctggtcgagaacaacgagcgcgtttttgaccataagcagggcacatacggaggctactttagagatcaaaaagatggataccgtaaaaacgagggctatatgagaagaggaggctaccggcagcagcagagccaaaccgcctactag

SEQ ID NO: 222492 - DNA, 2742 bp, Artificial Sequence
  Description of Artificial Sequence: Synthetic coding sequence
atgtctcgcttctttaccaccggttcagacagtgagtctgagtcatctctttcaggggaagagctggtgaccaagcctgttggcggaaactacggaaaacagccactgctcctgtctgaggacgaggaagatacgaagagagtagtacgttccgccaaggataaacgttttgaggaactaacaaatctgatccgcacaatacgaaacgccatgaaaattcgagatgtcacaaagtgtctggaagagtttgagctactgggaaaggcatacgggaaagcgaagagcatcgtggacaaagaaggtgtgcctcggttttacatccgcatcctggccgacttagaggattacctcaacgaattgtgggaagacaaggaaggtaagaaaaaaatgaataagaataacgcaaaagcattgtccacactcagacaaaaaattcggaagtacaatcgagattttgagtcacacattacctcctataagcagaatcctgagcaatcggccgacgaagacgctgagaagaatgaggaggattctgaaggaagctcagatgaggatgaggacgaggacggggtgagcgctgccacctttctgaagaaaaagtctgaggcaccaagtggggaaagccgcaagttcctgaagaagatggacgacgaggacgaagacagcgaggatagcgaagatgatgaggattgggacaccggcagcacttcttcagacagcgattccgaggaggaagagggcaagcagaccgctttagctagtcgttttttaaaaaaggcgccaacgacggacgaggacaaaaaagccgcagagaagaagcgggaagacaaggccaagaagaagcatgataggaaatcaaaaaggctggacgaggaagaagaagataacgagggtggggaatgggagcgggttagaggcggagtaccactggtgaaggagaaacccaagatgttcgctaaggggacggagatcacacatgcggtagtgattaagaagctgaacgaaatacttcaggctcgtggtaagaaaggtactgatcgggctgcacagatcgagctcttgcagcttctggtgcagattgccgctgaaaacaatctgggggaaggagtgatcgtgaaaataaaattcaacattatagcttccctatatgattacaaccccaacctggcgacctatatgaagcccgagatgtggggaaagtgcctggattgtattaacgaactcatggacattctcttcgcgaatcccaacatctttgtcggagaaaacattctcgaggagtcagaaaatctccataatgcagaccagccactgagggttagaggatgcatactgacgttagtggagcggatggacgaggaattcacgaaaattatgcagaacacggatcctcacagccaggaatacgtggaacatctcaaggacgaggcccaggtgtgcgccatcattgagcgagtgcagagatatctggaggaaaaaggtaccaccgaggaggtgtgtcgaatctacctgctcagaatccttcatacgtattacaaattcgactacaaggctcatcagcgacagttgacccctccggagggatcatctaagagtgagcaggaccaggccgagaatgagggagaagattcagctgtgctgatggagcggctttgtaagtacatctatgctaaagatcgaacagaccggatccgaacttgcgctattctgtgccatatttaccaccacgctctgcatagccggtggtaccaagctagggatctgatgctaatgtcccacctccaggacaatattcagcacgccgaccctccagttcagatcctgtacaatcggactatggtgcagctcggcatctgtgcctttcgccagggcctgacgaaagatgcccacaacgctctcctagacatccagtcctccggtcgggctaaggaactgcttggacagggcttactcctccgaagcctgcaagagaggaatcaggagcaggagaaagtggaaagacgcagacaggttccttttcatctgcacattaacctcgaactgctggaatgcgtgtatcttgtatcagccatgttactggagattccatacatggccgctcacgaatctgacgccagacgcaggatgatctccaaacagttccaccatcagctgagagtgggcgagcggcagccgctgctcggacctcccgagagcatgcgcgaacacgtggtggcggcaagcaaggctatgaagatgggtgactggaaaacttgtcattcttttataattaatgaaaagatgaacggcaaagtctgggatctgttcccagaagcagataaggtcaggactatgctcgttagaaagatccaggaggagagtctcaggacttatttgttcacctattcatctgtgtatgattcaattagcatggagacactgagcgacatgttcgaactggatctgccaactgtgcattcaatcatcagcaagatgatcatcaatgaggaactcatggcaagcctggaccagcctacacagacagttgtaatgcaccggacggaacctacagcacagcagaacctggctttgcaactcgcggagaaactagggagtctcgtggagaataatgagcgtgtcttcgaccacaaacagggtacctacgggggttactttcgagatcagaaagacggataccgcaagaacgaaggatatatgcgacgcggaggatacagacagcagcagagtcagactgcctattag

SEQ ID NO: 222493 - DNA, 2208 bp, Artificial Sequence
  Description of Artificial Sequence: Synthetic coding sequence
atgagtcggttctttactacagggtccgattccgaatccgagtcaagtcttagtggggaagaactggttaccaagcctgtggggggtaactatggaaagcagccactgcttctttcagaagatgaagaagatactaaacgtgtggtgaggagcgccaaggacaaacgattcgaagaattgacaaatctgatacgtacaattcgcaacgcaatgaaaattcgcgatgtgaccaagtgcttggaagagtttgagctgcttggaaaagcttatggaaaggccaagtccatagtggataaggcgaaaaagaagcatgacagaaaatctaagagactagatgaagaagaagaggacaatgagggtggtgagtgggaaagagtgcggggaggcgttcccctagtgaaggaaaagccaaagatgttcgccaagggtacagaaatcacccatgccgtggtgatcaagaagttgaacgaaatcctacaagccagaggcaagaaaggaaccgatcgggctgctcagatcgaattactgcagctgctggtgcaaattgcagccgagaacaacctaggcgagggcgtgatcgttaagataaagttcaacatcattgcaagcctctacgactacaaccctaatctggccacatatatgaagccagagatgtggggcaaatgcttagactgcataaatgagcttatggacattctattcgctaaccccaatatttttgtgggtgaaaacatactggaggagtccgaaaatcttcacaacgcagatcaacctctgcgagtgcgcggatgtattttgaccctggtggagcggatggacgaggagttcacaaagatcatgcagaacaccgatcctcactcccaggaatatgttgaacaccttaaggacgaggcgcaggtgtgcgctattattgagcgggtccaaagatacctggaagaaaagggcactacggaagaggtgtgtaggatttatctgctgagaatactgcatacatattacaagttcgactacaaggcacatcagcgacaactcacaccgccagagggctcctcgaagagtgagcaagaccaggctgaaaacgagggtgaggatagcgcagtacttatggagcgcttgtgcaagtacatctatgcaaaagaccgtacggacaggatccggacatgcgcaattctgtgtcacatataccatcatgctctgcacagcaggtggtatcaggcacgcgatctcatgttaatgtcccaccttcaggataatatccaacatgccgatccaccggtgcaaatactgtacaatcgtaccatggttcagctggggatctgtgctttcagacaaggattgaccaaggacgcccacaacgcccttctggacatacagtcatcagggagggctaaggaactactgggacaagggttgctcctgagaagtctgcaagaacggaaccaagagcaggagaaggtggagcgcaggcggcaagtccctttccatttgcacatcaacttggaacttcttgagtgcgtatacctggtatccgcaatgttgcttgagatcccatacatggcggctcacgagagcgatgcacgaaggagaatgatttctaaacagttccatcatcagttgcgcgtgggtgagcgccaaccacttctgggccctccggagtctatgcgagagcatgtggtggcagcatcaaaagccatgaaaatgggcgactggaagacctgtcattctttcataatcaatgaaaaaatgaatggaaaggtgtgggatctttttcccgaagccgataaagtgagaaccatgctggtgcgaaagattcaagaagagagtctcagaacatacctgttcacctacagctctgtgtatgactccatctccatggaaaccctatccgacatgttcgagttggacctgccaacagttcatagcatcatttctaagatgataatcaatgaggagctgatggcttcactggatcaacccacacagaccgtcgtaatgcatcgcactgagcctacagcacaacagaatctggcactccagttagcagagaaactaggatcactggtggagaacaatgaaagagtgtttgatcacaaacaggggacttacggcggttatttcagggatcaaaaagacggctaccgcaagaatgaagggtacatgcgcaggggcggttatcgacagcagcagtctcagacagcatactag

SEQ ID NO: 222494 - DNA, 2697 bp, Artificial Sequence
  Description of Artificial Sequence: Synthetic coding sequence
atgtcccggttttttactaccgggtcagacagcgagagcgaaagtagcctgtctggagaggagctggtgacgaagcctgtgggaggcaactatggcaagcaaccactattgttgtccgaggacgaagaggacacaaagcgagttgtcagatctgcgaaggataagagatttgaggagcttacaaatttgatcaggaccataagaaatgccatgaagattcgcgacgtgaccaagtgtctggaagaatttgagctcctggggaaggcatacggcaaggccaaatccatcgtggataaggaaggcgtgccaaggttttacatcaggatattggcagatctcgaggattatctcaatgaactttgggaagacaaagagggaaaaaagaagatccgcaaatacaaccgcgatttcgaatcccatatcaccagctacaaacagaatccagagcagagtgcagacgaggacgccgaaaagaatgaagaagactccgaagggtcttccgacgaggacgaggatgaggatggtgtaagcgccgctacattcttgaagaaaaaatccgaggcaccatctggtgagtccagaaagttcttaaagaagatggacgacgaagacgaggactccgaagactccgaggatgacgaggactgggacactggttctacctccagtgactcagactcagaggaggaggaagggaagcagactgccctcgcctctcggttcttgaaaaaagcgcctacaacagacgaggacaaaaaagcagctgaaaaaaagcgcgaggataaagctaagaaaaagcacgaccgaaagtcaaaaagacttgacgaggaagaggaagataacgaaggaggagagtgggagagggttcgcggaggggttcctttggtaaaggaaaaacctaaaatgttcgccaagggaacagagatcacacacgcagttgtgatcaagaagttgaacgagatacttcaggcccgtggaaagaagggcaccgatagagccgctcagatcgagttgctgcaacttctggtgcagattgcagccgagaacaatctgggcgaaggcgtgattgtcaagatcaagtttaatattattgcaagcctctacgattataaccctaatttggcaacttacatgaagccagaaatgtgggggaagtgtctggattgcatcaatgagctcatggatatcttgttcgccaaccctaatatcttcgtcggcgagaacattctggaagaaagcgaaaatttgcacaatgccgatcaaccattacgagttcgcggatgtattttgactcttgtggagaggatggatgaggagttcacaaagataatgcaaaacacagatccgcacagtcaagagtatgtcgagcaccttaaagacgaagcccaagtttgtgctattatcgagagagtgcagcggtacttggaggagaaaggcactactgaggaggtgtgtagaatctacttgctgcggattctccacacctactacaagtttgactataaggctcaccagagacagttgacgccccctgaaggatcttccaagtctgaacaggaccaagcagaaaacgagggcgaagactctgcagttctgatggaaagactgtgcaagtatatctacgcaaaagatagaaccgacagaatcaggacctgcgctatactttgccacatctatcaccatgctcttcactcccggtggtatcaggcaagggacctgatgctaatgagccatctgcaggataatattcagcacgctgatccaccagttcagatattgtataatcgcactatggtgcagctgggtatctgcgccttcaggcaagggctgacgaaggacgctcacaacgcactcttggacatccagagttcaggaagagccaaggagctgctcgggcaaggactgctcttgcgctctctgcaagaaagaaatcaggaacaggagaaggtcgaacggcgacgccaggtgccttttcacctgcatattaatttggaactgcttgagtgtgtgtaccttgtgagtgctatgctccttgagataccctacatggcggctcacgagagtgacgcacgcagacgcatgatctccaaacagttccaccatcagttgcgggtaggtgagaggcagcccctgctggggcctccagagtccatgcgcgaacacgtagtagctgcttctaaggcgatgaaaatgggtgattggaaaacatgtcatagcttcataatcaatgagaaaatgaacggaaaggtctgggacttgtttccagaggcagataaggtgagaactatgctggtccggaaaattcaagaagagtcccttcggacttacctgttcacatattctagtgtgtacgactccatttcaatggaaaccctgtctgatatgtttgaactcgatctgcccacagttcacagcattattagcaagatgatcataaatgaagagctgatggctagcctggaccaaccaacccaaacagtggttatgcatcgcaccgaacctaccgctcagcaaaacttggcccttcagctggccgaaaaactagggtcactggtagagaacaatgaacgcgttttcgatcacaagcagggaacgtatggaggatactttcgcgaccagaaggacggttaccgaaaaaacgagggatatatgcggaggggagggtatcgacagcagcagtcacagaccgcgtattag

SEQ ID NO: 222495 - DNA, 2055 bp, Artificial Sequence
  Description of Artificial Sequence: Synthetic coding sequence
atgggcctgtcagccgctgcgcctctgtggggcccaccgggtttacttttggcaatcgcgctgcaccctgctttgtcagtgccacccaggcgcgactactgtgtcctaggtgcgggtcctgccggtctgcagatggcatacttcctgcagagggccggtagggactatgcagtcttcgaacgcgcacctaggccaggctctttctttacacgataccccaggcacaggaagttgatcagcatcaacaagcggtataccgggaaggccaatgccgaattcaaccttcggcatgactggaattcactgctgagtcatgaccctagattgctgttccggcactacagtcgcgcttactttcccgatgccagagacatggtgcgatacctgggcgacttcgctgatacactgggactgcgcgtgcaatacaacacgaccatcgcacatgtgacacttgataaagatcgtcaggcctggaatgggcactactttatacttactgatcagaaaggccaggtccatcaatgcagcgtgttgtttgtggccacgggactgagcgtacctaatcaagtggatttcccaggaagtgagtacgcagagggttacgagtccgtttcagttgaccctgaggattttgtcggtcaaaacgtgctgatactcggtaggggcaatagcgcctttgaaactgccgaaaacattctcggcgtgaccaatttcattcatatgttgagccgcagtcgggtgagactgagctgggcaactcactatgtcggtgatttgcgagccatcaataatggcttgctagacacctaccagctgaagagcctggacggcctgctggaaagcgacctgaccgatctggctatccttaaggattccaaagggaaatttcatgtgaccccaaaattttttctggaagaagcaaatactaaccagagcgcagactcgataaccctacctcaagatgacaatgacaatttcgccatgagagtgccatacgatcgtgtgatacgttgtctggggtggaactttgatttctccattttcaataagtccctcagattaaactctggaaatgccttcggtaagaaataccctttaattcgggcttcctatgagagcaaggggtcgcggggattgttcatcttgggaactgccagtcactcggttgactatcgcaaatctgccggaggctttattcatggtttcagatatactgtcagggcagtccaccgcctgttggaacacagacatcatagtgtgacatggcccgctactgagctgccaatcacacaactgacctcttcgattgtaagaagagtaaatgaggcaagtggactctaccagatgtttggggtactcgcagacgtgatcctactcaaagaaaatagcaccgcctttgagtacctggaggagttccctatacaaatgctagcccagctggagactctcacgggcagaaaagctaagcacggcctgtttgtcatcaatatggagtatgggagaaacttctccggtcccgataaggatgttttttttgatgacaggagcgtgggccacacagaggatgcatggcagtccaatttcctgcaccccgtgatctactactaccggtatctgccaaccgagcaggaggtcagatttcggccagcccactggcccctacccagacccaccgccattcaccatattgtcgaggatttccttactgactggacagcacccataggacatatactgccgctccgcaggtttctggaaaactgtctggataccgacctgcgaagcttctatgcggagtcctgctttttgtttgccctgaccagacaaaaactacctccgttctgccagcagggatatctgaggatgcagggactggtgagtactgagtcactgtggcagcacagggtagaatcaaggttgctgcgcgactacgctcccaccggcaggagactggaagatagctcccagcagctgggcgaccaggaaccactaggcagtccgctggctcccggacctctggcccagagcgtggacagtaataaggaggagctatag

SEQ ID NO: 222496 - DNA, 1602 bp, Artificial Sequence
  Description of Artificial Sequence: Synthetic coding sequence
atggccaaattcatgaccccagttatccaggataacccgagcggctgggggccatgtgccgtgcccgagcagtttcgcgacatgccttaccagccattttccaagggggacagactgggcaaagtggccgattggacaggggctacctaccaagacaagcgttacaccaacaagtactcttcccagtttgggggtggatctcagtatgcatactttcatgaagaggatgagtcttcgtttcagttggtggacaccgcccgtacacagaagacagcctaccagcggaaccgcatgcgcttcgctcagcgcaacctcaggcgagacaaagatcggagaaacatgttacagttcaatctgcaaattttgccaaagagcgcaaagcagaaggaacgggagaggattaggttacagaaatcccaaaagcccagagattcaagtgtggaagtgcggtccgattgggaggttaaggaggagatggacttcccacagttgatgaaaatgagatacttggaagtatccgagccacaggatatcgagtgttgtggcgctttggaatattacgataaagccttcgacaggatcaccacacgttcagagaaacccctccggagtattaaacggatcttccataccgtgactacaaccgatgatccggtgatcaggaagcttgcaaaaacacaggggaacgttttcgcaaccgatgctatcttggctacacttatgtcgtgcacgcggagtgtctacagctgggatatcgtggtccagcgggtgggatcaaagctgttcttcgacaaaagggacaactctgatttcgatctgttaacggtctctgaaactgctaacgagcctccgcaggatgagggaaacagctttaattctccacgtaacctcgcaatggaagcgacatatatcaaccataacttttcacagcagtgcctgcgcatgggtaaggaacgatacaactttcccaacccgaaccctttcgtcgaagatgatatggacaagaatgagatcgccagtgttgcctatagatatcggagatggaagctgggcgatgatattgatctcatagtgagatgcgaacatgatggagtgatgacaggagccaatggcgaagtcagcttcattaatatcaagactctgaatgagtgggatagccgccactgcaacggagtcgattggcggcagaagctggactctcagcgaggcgctgtcattgctactgagctgaagaacaatagttacaagctggcccgatggacgtgttgtgcgctcttagcgggatcagaatacttaaagctaggctacgtgagtagatatcacgtgaaggatagttcaaggcacgtcattctggggacccagcagtttaaacctaacgagtttgcaagtcagatcaatctaagtgtcgaaaacgcctggggaatcctgaggtgtgtgattgacatttgtatgaagcttgaggagggcaagtatctgatccttaaggaccctaataaacaggtcatccgggtgtacagtctgcccgatggcacattttccagtgatgaggatgaggaggaggaagaggaagaggaggaagaagaggaggaggaggaaacctag

SEQ ID NO: 222497 - DNA, 372 bp, Artificial Sequence
  Description of Artificial Sequence: Synthetic coding sequence
atggctaagttcatgactccggtgattcaggataacccatccggttggggtccatgcgcagtcccagagcaattccgtgacatgccataccagccgttttccaaaggggaccgcctaggcaaagttgcagactggactggggctacataccaggacaagcgctacacaaataaatactcctcacagttcgggggagggtcccagtacgcctacttccacgaagaggacgagtctagcttccagctggtggacactgcacgcacccaaaagaccgcttatcaaaggaaccggatgcgattcgctcagcggaacctgaggagagataaggataggcggaatatgctccagtttaacctgcagattctcccttag

SEQ ID NO: 222498 - DNA, 1647 bp, Artificial Sequence
  Description of Artificial Sequence: Synthetic coding sequence
atggccaagtttatgactcccgtgatacaggacaacccatcagggtggggcccatgcgccgtgcctgagcagttcagggatatgccttatcaacccttctcaaagggcgaccgccttggcaaagtcgcggactggaccggagccacctaccaagacaagagatataccaacaagtacagcagtcaattcgggggtgggagccagtacgcctacttccacgaagaagatgaaagcagtttccagctggtggatacagctcgcacccagaagaccgcgtaccagcggaacagaatgcgattcgcgcaacggaatctccggagagataaggatcggaggaatatgcttcaatttaatctgcagatcctgcccaaatctgctaaacaaaaagaacgggagagaattcggctccagaaaaaattccagaagcagtttggcgttaggcaaaagtgggaccaaaagtcccagaagcccagagactcctctgtcgaagtgcggagcgactgggaagttaaagaggaaatggatttccctcagttgatgaagatgcgatatctggaggtttcagaacctcaagatattgagtgttgcggggctctagagtactacgacaaggctttcgatagaataacaacaagatcagaaaagcccctgcgatcgattaaaagaatcttccacactgtgacaacaaccgatgatccagtcatccgcaaactggccaaaactcaggggaacgtctttgccaccgacgcgatactggcaacgctcatgtcctgtaccaggagcgtgtatagctgggatatcgtcgtgcagcgagtgggatcgaagttgttctttgacaagcgcgacaatagcgattttgacctcctcaccgtgtccgaaacggccaacgaacctccacaggatgaaggcaatagtttcaactcccccaggaatctggccatggaagcaacctacatcaatcacaatttcagccagcaatgtctgaggatgggtaaggagcgctacaatttcccaaaccccaatccatttgttgaagacgatatggacaaaaacgaaattgcaagtgtggcctaccggtacagaaggtggaagctgggcgacgacatagacttgatcgtaaggtgtgagcacgacggcgtgatgacgggggctaacggagaggtcagctttataaatatcaagactttgaacgagtgggattctagacactgcaacggcgtggactggcgacagaaactcgatagccaaagaggcgctgtcatcgctacggagctgaaaaacaactcctacaaattggccagatggacttgttgtgctctcttagcagggtccgaatatctgaaactcggttacgtgagtcgctaccacgtgaaagattcctcacggcatgttatcctcggtacccaacagttcaaacctaatgaattcgcaagtcaaattaatctgtccgttgagaatgcatgggggatcctacggtgcgtgattgatatatgtatgaaattagaagagggaaaataccttatcctgaaggaccctaacaaacaagttattagagtctactcgttgccagatggcaccttcagtagcgacgaggatgaggaggaagaggaggaagaagaagaagaagaggaagaagaagagacctag

SEQ ID NO: 222499 - DNA, 519 bp, Artificial Sequence
  Description of Artificial Sequence: Synthetic coding sequence
atggacaagaacgagattgcctccgtagcataccggtatcgcagatggaaactgggggacgacattgatctgatagtccgctgtgaacacgacggagttatgaccggagctaatggagaagtcagcttcattaatataaagacgctgaacgagtgggatagccgacactgtaatggggttgattggagacagaagctcgactctcagcgaggagcagtcatcgccaccgagcttaagaacaactcctacaaactggccaggtggacttgttgcgcacttctggccggatcagaatatctcaaactgggttatgtgtcccgctatcacgtgaaagactccagcagacatgtgatcctcggcacacagcaatttaagcctaacgaatttgcatctcagattaatctgagcgtggagaacgcctggggtatactccgctgtgtcatcgacatttgcatgaagctggaggaaggtaagtatttgattttaaaggatccaaataagcaggttatccgggtgtag

SEQ ID NO: 222500 - DNA, 561 bp, Artificial Sequence
  Description of Artificial Sequence: Synthetic coding sequence
atggcaaagttcatgacccctgtgatccaagacaatccttcaggttggggcccatgcgccgttcctgaacaattccgggatatgccctatcagcccttctcaaaaggggatcgccttggaaaggtggccgattggacaggcgctacttatcaggataagcggtataccaacaagtatagtagccagttcggcggagggtcgcaatacgcttactttcatgaagaggacgagtcgagctttcagcttgtggacaccgccaggacgcagaagacggcctaccaacgaaaccggatgcgattcgctcagcggaatctgagacgggacaaagatagacgcaacatgctgcagtttaatcttcaaatccttcccaaatccgctaagcagaaagagcgggagcgtatccgcctgcagaagaagttccagaagcagttcggtgttaggcaaaagtgggaccaaaagtcccaagtgatgtacttgtaccaaaatagcgcgctggagtttggaagcgtgtacctggtggtgtttatcaatagcctggacgagatatacttcacttattag

SEQ ID NO: 222501 - DNA, 810 bp, Artificial Sequence
  Description of Artificial Sequence: Synthetic coding sequence
atggcaaaattcatgaccccagtgatccaggacaacccctccggctggggcccttgcgccgtgccagaacagtttcgggacatgccgtaccagccgttttccaaaggggatcgcctgggtaaggtcgcagattggacaggggctacataccaggataagagatacaccaacaagtattcctctcaattcggtggagggtctcaatacgcttatttccatgaggaagacgaatctagtttccagctggttgatacggcccgtacccagaagacggcgtaccagagaaaccggatgagatttgcacagcgcaatttgcgacgcgacaaggacaggcggaatatgcttcagtttaatctgcagatcctgccgaaatctgccaagcagaaagaaagagaacgcatcaggttgcagaaaaaattccagaaacagtttggtgttagacagaagtgggaccagaagagccagaagcccagagacagcagcgttgaagtgcgtagtgactgggaggtgaaggaggaaatggactttccacaattgatgaaaatgcgctacttagaggtctccgaaccccaagatattgaatgctgtggagcactggaatattatgataaggcgttcgaccgcatcaccacgcgatccgaaaagccgctccggtctattaaaagaattttccacactgttacaacaaccgatgatccagtgatcagaaaactggcaaagactcaggggaatgtgtttgccacggacgccatcctcgcgacactaatgagctgtacacgatctgtgtacagctgggatattgtggtctag

SEQ ID NO: 222502 - DNA, 522 bp, Artificial Sequence
  Description of Artificial Sequence: Synthetic coding sequence
atggctaagtttatgactcccgttatccaggacaatcctagcggatggggcccttgtgctgtgcctgaacagttcagagacatgccctatcagccctttagcaagggggacagactcggcaaggtggctgactggactggtgccacctatcaggacaaaagatacactaataagtattcctcccagttcgggggagggtctcagtatgcttatttccacgaggaggatgaaagtagctttcagttggtggacactgcccgaactcagaagacggcctatcaaagaaacagaatgcgtttcgcgcagcgcaatcttaggagggacaaggatagaagaaatatgcttcaattcaacttacagatactgccaaaatcagctaagcagaaagaacgtgaaaggatacgcctacagaaaaaatttcagaagcaattcggcgtgaggcagaaatgggatcagaagtcgcagaagccaagagacagcagtgtggaggttaggtctgactgggaggttaaagaggagtag

SEQ ID NO: 222503 - DNA, 498 bp, Artificial Sequence
  Description of Artificial Sequence: Synthetic coding sequence
atggaggcaacctatattaaccacaactttagccagcagtgtctcaggatgggcaaagagaggtacaactttcctaatccaaatcctttcgtagaagacgacatggataaaaacgagattgcctcagtggcgtatcggtatagacgctggaagttgggtgacgatatcgatctgattgtgcggtgcgaacatgacggcgttatgacaggagctaatggcgaagtatcttttataaacattaagacactcaatgaatgggacagtcgccactgcaacggcgtggactggcgccagaaactggactctcagcgaggagctgttatcgctacggaactcaagaataactcttacaagctcgctcgctggacctgttgcgcgctgctcgccggaagtgagtatctgaaactgggctatgtttccagatatcatgtgaaggactctagtcgccacgttattctgggaacccagcaatttaagccaaatgaatttgcctcttag

SEQ ID NO: 222504 - DNA, 1500 bp, Artificial Sequence
  Description of Artificial Sequence: Synthetic coding sequence
atggccaaatttatgacaccagtcatccaagataatccctctgggtggggaccatgtgcagtgcctgaacagttccgggacatgccataccagccctttagcaagggagatcggctcgggaaagtagccgattggaccggtgctacttatcaggacaagcggaatttaaggcgggacaaggatcggagaaatatgctccagttcaacctgcaaatcctgccaaaaagcgccaagcaaaaagaacgagagcggattaggctgcagaaaaaatttcagaagcagttcggagtgagacagaagtgggatcaaaaatcccagaagcctcgggactctagtgtggaggtgcggagtgactgggaagttaaagaagagatggatttcccacaattaatgaagatgaggtacttagaggtgtcagagccacaagatattgagtgttgtggggcactggagtattacgacaaggcgtttgatcgcatcactacccggagcgaaaagcccctacggagcatcaagcgtatattccatactgttacgaccaccgatgaccccgttatccgcaaactcgctaaaacgcagggcaacgtttttgctacagatgccatcctggctaccctgatgtcttgcacacggtctgtgtatagctgggacattgttgtgcaacgcgtcggctccaaactgttcttcgataagcgcgataattccgacttcgacctgctcactgtgagcgaaacggccaatgagcccccacaggatgagggtaactccttcaacagtccacgcaacttggccatggaggccacctatattaaccataacttttctcagcaatgcctcaggatgggaaaagaacggtataacttcccaaatccaaatccctttgttgaagacgacatggacaaaaatgaaatagcttccgtggcgtaccgctaccgcagatggaaactgggagatgatattgacctgatagtgcgatgcgaacacgatggtgttatgacgggcgcaaatggggaagtgagtttcattaatattaaaaccctcaatgagtgggacagtaggcactgtaacggtgtggactggcgccagaaactggattcgcagcgaggagctgtgatagccaccgagcttaaaaacaattcctataagcttgctcgctggacttgctgcgcacttctcgcgggttcagaatatcttaagcttggctacgtatcccgatatcatgtcaaggacagttcgaggcacgtgattctcggcactcaacagtttaaaccaaacgagttcgcttcccagatcaacctgtctgtggagaacgcttggggaatcctccggtgcgtgatagacatttgcatgaagctcgaggagggcaagtacctgattctgaaggacccaaacaagcaagttattagagtatattctctgcctgacggaacatttagcagtgacgaggacgaggaggaagaagaggaggaagaggaggaagaagaagaagaagaaacctag

SEQ ID NO: 222505 - DNA, 1215 bp, Artificial Sequence
  Description of Artificial Sequence: Synthetic coding sequence
atgttcaccgagaagacaactacttaccagtacccacgtgcaattttgagtgtagacctgtccggagaaaatctttctgacgtggattttctggacgactctagtactgaaagcctgctgctgtcaggagatgagtacaaccaggactttgactcaacaaactttgaagaaagccaagacgaagatgatgccctgaacgaaattgtgaggtgcatatgcgagatggacgaggaaaacggctttatgatccagtgtgaggagtgtctgtgctggcagcacagtgtgtgcatggggctcttagaggagtccatcccagagcagtatatatgctacatatgtcgggatcctccgggacagaggtggtctgctaaatatcgctacgacaaagaatggctgaacaatggtcgcatgtgcggcctgagcttttttaaagagaactactcgcacttgaatgccaagaaaatagtatctactcaccatctcctggcagatgtgtatggagttaccgaagtcctgcacggcctccaacttaagattggaatcctcaagaataagcaccatcctgatctacatctgtgggcctgctccgggaagagaaaggatcaggatcaaataatcgccggagtggagaaaaaaattgcccaagacactgtgaaccgcgaggaaaagaagtatgttcagaaccataaagagcctccaagactacctcttaaaatggagggtacgtatatcacctctgaacactcataccaaaagccgcagtcttttgggcaggactgcaagagcctagcagaccccggttcctctgatgatgatgacgtctcgagtttggaagaggaacaagagtttcacatgaggtcgaagaattcactgcagtatagcgctaaagaacacgggatgcctgaaaaaaatccagccgagggcaacaccgtgttcgtgtataacgataaaaaagggactgaggaccctggcgattcacatcttcagtggcaactgaacctgctgacacatatcgagaatgtccagaacgaggttacttcgaggatggatttaatcgagaaagaggtcgatgtactggagtcttggttagacttcacaggtgaactggagcctcccgatccattggccagacttccgcagctgaagagacatatcaagcagctgctgattgacatgggaaaggtgcagcaaattgctacgctgtgcagtgtgtag

SEQ ID NO: 222506 - DNA, 1074 bp, Artificial Sequence
  Description of Artificial Sequence: Synthetic coding sequence
atggcaacacctgctgtgcccgtgagcgcacccccagccacaccaaccccagtgcccgctgcagccccagcatcggtgcctgcacctacgcctgctccggctgccgcaccagtgccggctgcagcacccgcttcgagttctgatcctgcagcagctgctgctgcaactgccgctcccggtcagactcctgctagcgcacaggccccagcccagacaccagcacctgcccttcccggaccagccctgcccggacctttccccggtggccgagtggtgcggttgcaccccgtgatattagcctcaatagtggattcttatgaacgcagaaacgagggcgctgctagggtcattgggaccttgctagggacagttgacaagcactctgtggaggtaaccaattgcttttccgtgccccacaatgagagtgaggacgaggtggcagtagacatggagtttgccaagaacatgtacgagttgcacaaaaaggtgagtccgaacgagctgatccttgggtggtatgcaaccgggcatgatattacagagcattccgttctcatccacgagtactacagcagagaagcgcctaaccccatccacctcaccgtcgacacgagcctacaaaacggaaggatgtcgatcaaggcctacgtcagcacactgatgggtgtcccaggcaggaccatgggcgttatgtttactccccttaccgtgaaatacgcctactacgacacggaaaggatcggtgtcgatcttatcatgaagacatgcttcagccccaatagggttattggcctttcttctgacctccaacaggttggtggggctagtgctcgcattcaggatgccctaagcaccgttcttcagtatgccgaggatgtcctgagtggaaaggtctctgccgataacaccgtggggcgattcctgatgtcgctcgtgaaccaggtccccaagatcgtccctgatgactttgagactatgctaaactccaatatcaacgacctgctgatggtgacctacctggccaacctgacacagagccaaattgctctgaacgaaaagctggtaaacctctag

SEQ ID NO: 222507 - DNA, 627 bp, Artificial Sequence
  Description of Artificial Sequence: Synthetic coding sequence
atggaatttgcaaaaaacatgtatgagcttcacaaaaaagtgagtcctaatgagctcatcttaggatggtacgccaccggtcatgacatcacagagcactccgtcttgattcacgagtattattctagagaggccccaaatcccatccacctcaccgtggatactagtttacagaacggaaggatgtctataaaggcatacgtgagcacattgatgggggttcctggacgaacaatgggtgttatgttcactcccctcactgtcaagtacgcttactacgacaccgagagaattggcgtggaccttatcatgaagacttgtttctctccaaatagggtcataggcctcagctcggacctgcagcaggtgggcggtgcctccgccaggatacaggatgcactcagcacggtgctgcagtacgcagaagatgtcttaagcggaaaggtgtctgcggataacaccgtggggagatttctaatgtcactggtgaatcaggtgccaaaaatcgttcctgatgactttgaaactatgttaaattccaatattaatgatcttcttatggtcacctatctcgccaacttgacgcagagccagattgcgctcaatgaaaagctggttaacttgtag

SEQ ID NO: 222508 - DNA, 1074 bp, Artificial Sequence
  Description of Artificial Sequence: Synthetic coding sequence
atggcaacaccagcagtgcccgtgtctgccccacccgcaacccctactcctgttcctgcagctgctcctgccagtgttccggctcccacaccagctcctgctgccgcaccagtacctgcggcagctccagcttctagttccgatcctgccgctgcagctgccgctacagccgcacccggacaaacaccagcgtctgcacaggcacccgctcagacacccgctcccgcattacccggaccagctctgccaggtcctttccctggaggccgtgtcgtccgtctacaccccgtgatacttgcctccatcgtggacagttacgaacgcagaaatgaaggagccgcacgcgttattggaacattacttgggacggtggacaagcattccgtcgaggtcaccaattgtttctcagtgcctcacaatgaatcggaagatgaagtcgccgttgatatggagtttgcaaagaatatgtacgaactgcacaaaaaagtctcccctaacgagctcattctgggctggtacgcaacggggcacgatattaccgagcatagtgtgttaattcacgaatattatagtcgcgaagcacctaatcccatccacttgactgtggacacttccctgcagaatggccgaatgagcataaaagcctacgtgtcaacccttatgggcgtgcccggaagaacaatgggggtgatgtttacgcccctgactgtgaagtatgcctactatgatacagaacgaattggagtggatctcataatgaagacttgcttctccccaaacagggtcatcgggcttagttcagatctgcaacaggtcggaggcgcatcagccaggatacaggacgctttatccactgttctgcagtacgcggaagatgttctgagtgggaaggtctctgccgataatacagtaggtcgatttctgatgtctttagttaaccaagtgccgaagatcgtccctgatgacttcgaaacaatgctgaacagcaatatcaacgacctgctcatggtgacatacctggctaatctcacacagagccagattgcacttaacgaaaaactggttaacctttag

SEQ ID NO: 222509 - DNA, 1119 bp, Artificial Sequence
  Description of Artificial Sequence: Synthetic coding sequence
atgaatgcagtgatttccgcatctgccagcttctttcttgacaaaatggctactcctgctgtgccagtgtctgccccaccagctacccctacgcctgtacccgctgctgccccagcttctgtgcctgccccaactccagccccagccgcagctcctgtgccagcagccgctcccgcttcaagctccgatcctgcagccgcagccgctgccactgccgctcccggacaaacgccagccagcgcgcaggccccagctcagactcctgcaccggctctgccgggacccgcacttccaggcccattccctggtggaagagtggtccgtctgcacccagttatcctggcatccatcgtggattcttatgagcgcaggaatgaaggtgctgctagagtcatcgggactctgcttgggaccgtcgacaaacattccgtcgaggtgaccaattgtttttcagtgccccacaatgagtctgaagatgaggttgcagtggatatggagtttgccaagaatatgtacgagctgcacaaaaaggtctcccctaacgagctgatcctcggatggtacgcaactgggcacgatataacggaacacagcgtcttaattcacgagtactactctcgcgaggcaccgaacccaatccacctcactgtcgatacatccctccagaatggtcgaatgtctattaaagcctacgtttcaaccttaatgggagtacctggacggactatgggggtcatgttcactcccttaaccgtgaaatatgcatattatgataccgagaggatcggagtggacctgataatgaaaacctgcttctccccaaatcgagtgattggcttgtccagcgacttgcaacaggttggaggcgcaagcgctcgcattcaggatgcactaagcacggtcctgcaatatgccgaagatgtcttaagtgggaaagttagcgccgataacaccgtgggcaggtttttaatgtccttagttaatcaagtaccgaagatcgtgcccgatgactttgaaacgatgctaaatagtaatatcaacgacctgctgatggtgacctatctcgctaatcttacacagtctcagattgcactgaatgagaaactcgttaacctgtag

SEQ ID NO: 222510 - DNA, 924 bp, Artificial Sequence
  Description of Artificial Sequence: Synthetic coding sequence
atggccacgccagctgtgccggtgtctgcccctcctgccactccaacccccgtaccagccgctgctcctgctcccgcactacctggcccagccttacctggtccattccctgggggaagagtcgttaggttacacccggtcattttagcttctatcgtcgactcttatgagagaagaaacgagggtgctgcacgcgtaataggaacactgctcggcactgtagataaacattcagtagaggtgacgaactgtttctcggttcctcacaatgagtccgaagacgaagttgccgtagacatggagtttgcgaagaacatgtacgagctccataaaaaagtgtctccaaatgaattaattctgggttggtatgcgaccggtcacgacatcactgagcatagtgtgcttattcacgaatactatagccgcgaagcccctaaccctatacatcttaccgtcgacacgtccctgcaaaacggacgaatgtccatcaaggcctacgttagcacactgatgggagtcccaggacgcactatgggagtgatgtttacaccacttactgtgaagtatgcatactatgatacggagcgaattggtgtggacctcatcatgaagacatgcttttctcctaatcgagtgataggactgtcttcggacttgcaacaagtgggcggtgccagtgcccgtatccaggacgcgctgtctacggttttacagtatgctgaggatgtacttagtggtaaggtgagcgcagataataccgtcggccgattcttgatgagcctcgtgaaccaagtccccaagattgttccagacgacttcgagaccatgctaaattcgaacattaatgatctgctgatggtgacttatctcgccaacctcacccagagccagatagccctgaatgagaagctggtcaacctgtag

SEQ ID NO: 222511 - DNA, 963 bp, Artificial Sequence
  Description of Artificial Sequence: Synthetic coding sequence
atgcccacaggagacttcgattctaagccatcatgggctgatcaagttgaggaagagggcgaggacgataagtgcgtgacttccgaattgctcaaggggattccactagcaactggagacacaagtcctgagcccgagctcctgccgggagccccacttcctcctcccaaggaggtaatcaacgggaacataaaaaccgtcaccgaatataaaatcgatgaggacggaaagaagtttaaaattgttcgaactttccgtattgagacaagaaaggccagcaaggctgtggcgagacgcaagaactggaagaagtttggtaacagcgagttcgatccacctggtccgaatgtggctactaccactgtatctgatgatgtaagtatgacatttatcaccagtaaggaggatctcaattgccaggaggaggaggatcccatgaataaactcaaaggacagaagattgtgtcatgcaggatctgtaagggcgaccattggaccaccagatgtccatataaggatacacttggcccaatgcagaaggagttagcagagcagttgggtctttcaactggagaaaaggagaagctgcctggagaacttgagccagtacaggcaacgcagaacaagaccgggaaatatgtgcctcccagtctgcgtgacggcgcttcaagaaggggcgaatccatgcagccaaaccgacgtgccgacgataacgctactatccgcgttacgaacctcagcgaggacactagggagaccgacctgcaggagctcttccggccattcggttccatttctcgcatctacttagcgaaagacaaaaccacgggccagtcaaagggatttgcctttatctcatttcatagaagggaggatgcagctcgtgctattgcgggagtatccgggttcggttacgaccacctcattttgaacgtggagtgggcaaagccaagcaccaactag

SEQ ID NO: 222512 - DNA, 1101 bp, Artificial Sequence
  Description of Artificial Sequence: Synthetic coding sequence
atgtacagtagacacgctcagcggatcccacccggaaagaagatggccagtcgtaaggagggcaccggatcgacagccacctcgtccagctccacagcaggcgctgcagggaagggaaagggcaaaggaggctccggggattccgcagtgaagcaagtgcagatcgatggtttggtggtcctcaagatcatcaaacactatcaggaagaggggcagggcacagaagtggtgcagggcgtgttgcttggcctggttgttgaagatcggctcgaaatcactaactgtttccctttcccccagcatactgaggacgacgctgactttgatgaggtacagtatcagatggagatgatgagaagtctgcggcacgtgaacatcgaccatctgcacgtagggtggtaccagagtacttattacggttcttttgtaacccgggcattgctggacagccagtttagctaccaacacgctatcgaggagtccgtcgtgctgatttacgatcctattaagactgcccagggtagtctctccctgaaagcctatagactcactccaaagttgatggaggtctgtaaagagaaagacttcagccctgaggcccttaagaaggcaaatatcacattcgagtacatgttcgaggaagtgcccatcgtaatcaaaaatagccacctgattaacgtccttatgtgggagcttgaaaaaaaatctgcagtagccgacaagcacgagttactgtcactggcctcttctaatcatctcggaaagaatctgcagctgctgatggatcgcgtcgacgaaatgtcacaagacattgtaaagtataacacatacatgcggaatacatcaaagcagcaacagcagaagcaccagtatcagcaaagaagacaacaggagaatatgcaacgtcagtctaggggggaaccgcctctcccggaggaggatctcagtaaactttttaaaccccctcagccacctgcccgaatggattcgctcctcatagccggacaaataaacacatactgtcaaaatataaaagagttcactgctcaaaacttaggtaagttgttcatggcgcaggctcttcaggagtacaacaattag

SEQ ID NO: 222513 - DNA, 1059 bp, Artificial Sequence
  Description of Artificial Sequence: Synthetic coding sequence
atggcatcccgaaaagaaggcactgggtcaacagctacttctagctcgagcactgctggagccgcagggaagggcaaaggaaaaggcggatccggcgactcagccgtgaaacaggtacagattgatggtttggtagtcctcaagataatcaagcactaccaggaggaaggacaaggtacagaagtagtccagggcgtccttctcggcttagttgtggaggatcgacttgaaatcacgaactgttttcctttcccacagcacaccgaggacgacgctgacttcgacgaggtacagtaccaaatggaaatgatgcggtctctacgccatgtgaacatcgaccatctgcacgtgggctggtaccagtctacttactacggatctttcgtcacccgtgccttactggatagtcagttttcctaccaacatgccatcgaggaatcagtcgttttgatttacgacccaatcaagaccgcccagggttctttgtccctgaaagcctatcggctcactcccaagctcatggaagtgtgcaaggagaaggactttagtccggaagctctgaagaaggccaatatcacattcgagtatatgttcgaagaggtgcccatcgtcataaagaactctcacctcatcaacgtacttatgtgggaactagaaaagaaatctgcagtggccgacaaacatgaactgctgtccctggcttcctcaaaccatcttggaaagaacctacagcttctgatggacagggtggatgagatgtctcaggatattgtgaaatacaatacctatatgaggaacacatccaaacaacagcagcaaaaacaccaataccagcagaggagacagcaggaaaatatgcagcgccaaagtcgtggagaaccaccactccctgaagaagatctgagtaagcttttcaagccgccacaaccacctgcaaggatggattctctgctcatcgcaggacagatcaacacatactgccaaaacatcaaggagtttacggcccagaatctgggcaagctgttcatggctcaggcactgcaggaatacaataattag

SEQ ID NO: 222514 - DNA, 378 bp, Artificial Sequence
  Description of Artificial Sequence: Synthetic coding sequence
atgaaaccaatcctgctgcaagggcacgagcgctccatcacccagatcaagtacaatcgtgagggtgatctcctctttaccgttgccaaggacccgatcgtaaatgtatggtacagcgtcaatggagaacgtttgggcacctacatgggtcacaccggtgctgtgtggtgtgttgacgccgactgggatactaaacatgtcctgacagggtctgcggacaatagttgcaggctgtgggactgtgagactgggaagcaactcgccctgttgaagaccaattctgccgtcaggacatgtggattcgatttcggaggaaacatcataatgttctccactgacaaacaaatgggctatcagtgctttgttagctttttttag

SEQ ID NO: 222515 - DNA, 978 bp, Artificial Sequence
  Description of Artificial Sequence: Synthetic coding sequence
atgaagccaattctgctacagggccacgagcggtctataacgcagatcaagtacaatagggagggcgacctgctgtttaccgtggccaaagatccaattgtgaatgtgtggtattcagtcaacggcgagcggttaggcacgtatatgggccatactggagcagtgtggtgtgtagacgcagactgggatactaaacatgtactcaccggctctgcagacaattcttgtcggttatgggattgcgaaacagggaagcagctggctctgctgaagacaaatagcgcggttcgcacatgcggatttgactttggtggtaacatcatcatgttcagtaccgacaagcaaatgggataccagtgtttcgtgtctttcttcgatttgagagatccatcccaaattgacaataacgaaccatatatgaagattccttgtaacgatagtaaaatcacgtccgccgtgtggggtcctcttggcgaatgcatcatcgcaggccatgaaagcggcgaattgaaccagtattctgccaagtcaggcgaggtcctggtgaacgtcaaggagcatagtagacagatcaacgatatccagctgagccgcgacatgacgatgttcgtgacagcctcaaaggataataccgcaaaactctttgactccacaacacttgaacaccaaaaaacattcagaacagaacggccagttaactccgcagcactctccccaaactacgaccacgtggtgttgggaggtgggcaggaggcaatggatgtaacgaccacttctacccgcatcgggaaattcgaggccagattttttcatctcgccttcgaggaagaatttggtcgggttaaaggacactttggtcctattaactccgtggcgtttcatccagatggtaagtcctattcctccggaggggaggatgggtacgtcaggattcattacttcgacccacagtacttcgagtttgagtttgaggcatag

SEQ ID NO: 222516 - DNA, 777 bp, Artificial Sequence
  Description of Artificial Sequence: Synthetic coding sequence
atggcagctgcagccgctgccgctggcgattcggatagctgggacgcagacgccttcagtgtggaggatccagtgaggaaggtgggcggaggtgggactgcgggaggggaccggtgggaaggagaagacgaggatgaagacgtaaaagataactgggacgacgatgacgatgagaaaaaagaggaagccgaagtaaaacccgaggtgaagatcagtgagaaaaagaaaatcgctgaaaagatcaaggaaaaagagcgccagcaaaaaaagcggcaagaagaaatcaagaaaaggctggaggaacctgaggaacctaaagttctcacacccgaagagcagctcgccgacaaactgaggttaaagaaactccaggaagaatccgatttggaactagctaaggagacatttggagtgaacaacgccgtgtacggcattgatgcaatgaatccgagcagcagagatgattttaccgagttcggaaagttgctgaaagacaaaattacccagtacgagaagtccctctattatgcctcatttctggaagtgttggtcagagatgtatgtattagtctggaaatagatgacttgaagaagattacaaactctctgacagttctgtgtagcgagaaacagaaacaggagaagcagtcaaaggccaagaagaagaagaaaggagttgttcctggaggaggacttaaagccactatgaaggacgacctggctgactacggagggtatgacggaggatatgtgcaagactatgaagatttcatgtag

SEQ ID NO: 222517 - DNA, 657 bp, Artificial Sequence
  Description of Artificial Sequence: Synthetic coding sequence
atggctatgtttgaacagatgcgagcaaatgtggggaagctgttaaagggcatcgaccggtacaatcctgagaacctggccactttggagcgctatgtggagactcaggccaaggagaacgcctatgacttggaggcaaatctagccgtcctgaagctgtatcagttcaaccccgcattcttccagaccactgttacggctcagatcctgctgaaagctctcactaaccttccccataccgattttacactgtgcaaatgtatgatcgatcaggctcaccaagaggagagacccatccggcagatcctctatctgggtgacctgctggagacatgccacttccaagcgttttggcaagcactcgacgagaacatggacctgttggaaggtatcaccggctttgaggacagtgtgcgaaaatttatttgtcacgtggttgggataacgtaccagcacatagacagatggctgttggcggaaatgctgggggacctgtccgattcacaactcaaggtgtggatgtctaaatatgggtggtctgctgatgagtccgggcaaatcttcatttgtagccaggaggagagcataaaacctaaaaatatcgtcgaaaagattgactttgattctgtcagctccataatggccagttcccagtag

SEQ ID NO: 222518 - DNA, 375 bp, Artificial Sequence
  Description of Artificial Sequence: Synthetic coding sequence
atgatcgaccaggcccaccaggaggaacgcccaatcagacaaatcctgtacctcggagatcttctggaaacctgtcactttcaggccttctggcaagccttagacgagaatatggatctactggagggaataaccggttttgaggattcagtccgcaagttcatctgtcacgtggtggggattacctaccagcacatcgatcggtggctgctagcagagatgctgggagatctgagtgacagccagttgaaagtttggatgtctaagtatggatggtctgcggatgagtcaggccagatttttatctgctcccaagaagagagcataaagccaaaaaatatcgtagagaagattgacttcgacagcgaatggtag

SEQ ID NO: 222519 - DNA, 636 bp, Artificial Sequence
  Description of Artificial Sequence: Synthetic coding sequence
atggcaatgtttgagcagatgcgagcaaacgtgggtaaactgctcaaaggtatcgacagatacaatcctgaaaatttagccaccctggagagatacgtggagactcaagccaaggaaaacgcttacgatctcgaagctaatttagccgtgttgaagctttaccagtttaacccagccttctttcagaccacagtgaccgcccagatcctgctgaaggctctgactaatctgccacataccgatttcactctgtgtaagtgcatgattgaccaagctcaccaagaagaacgccctatcagacagatcctgtatcttggtgacttgttggagacatgccacttccaagcattctggcaagcccttgatgagaatatggacctcctagaaggaatcaccggctttgaggactctgtcagaaagttcatctgtcacgtggtcggcattacgtaccagcacatagaccggtggttacttgccgagatgctcggggacctttccgactcgcagttaaaggtgtggatgtctaaatacggatggagcgctgatgaatccggccagattttcatctgttcacaagaggaaagtatcaaacccaaaaacattgttgagaaaattgacttcgattcagagtggtag

SEQ ID NO: 222520 - DNA, 1125 bp, Artificial Sequence
  Description of Artificial Sequence: Synthetic coding sequence
atgagtgtgccggcatttatcgatatttctgaagaagatcaggcagccgaactaagagcgtacctgaaatctaagggcgctgagatctcggaggagaacagtgaagggggactgcacgtggatctcgcccagattatcgaagcctgtgacgtgtgcctgaaagaagatgacaaggacgttgaaagtgtcatgaacagcgtggtgtccttactgcttatcttggagccagacaaacaagaagctctgattgagagtctttgcgagaagctggtgaagtttagggaaggagagagaccatccctgaggctgcagctgttatcaaatctctttcacggtatggacaaaaacacccctgttaggtacactgtgtactgctcactaatcaaagtggccgcatcctgcggagctatacagtacatccctactgagcttgaccaggtgcggaaatggatcagtgactggaacttgactaccgaaaagaagcatacacttttgcggctcctctatgaagcgttggtcgattgcaagaagagcgacgctgcctccaaagtgatggtcgaattgctgggaagctatacagaggacaacgcctcacaggcacgcgttgacgctcacaggtgtattgttagagcgttaaaagaccctaacgcatttctgttcgatcatctgctgaccttgaaacctgtgaaatttctagagggagagcttattcatgacttactgacaatctttgtgagcgctaaactggccagctacgtcaagttctaccagaacaataaggattttatcgatagcttgggacttctgcatgaacaaaatatggcaaaaatgagacttctgacttttatgggcatggctgtggagaataaggagataagcttcgataccatgcagcaggagctccagatcggagctgacgatgtggaagccttcgttatcgacgctgtccggactaagatggtgtattgtaaaattgatcagacccaaaggaaggtagtcgtctcacattcaacccatcggacattcggtaaacaacagtggcagcagttgtacgacaccttgaacgcttggaaacagaatttgaataaagtgaaaaactcccttctctctctgtctgatacctag

SEQ ID NO: 222521 - DNA, 2724 bp, Artificial Sequence
  Description of Artificial Sequence: Synthetic coding sequence
gtggagtctgctatcgcagaagggggagcaagcaggttttcggcgagttctgggggaggcggtagccggggagcgccacagcattatcctaagacagctggtaactcagaatttctcggaaaaaccccgggacagaatgcccagaagtggattcccgctagatccacgcgccgtgacgataactccgctgcaaacaacagcgccaacgagaaggaacgccacgacgccatattccgtaaggttagagggatcctgaataaattgacaccagagaaatttgacaagctgtgcctcgagcttctgaatgtcggagtcgagtcaaagctgatcctcaagggagtaatcctgttaatcgtcgacaaggcactagaagaacccaagtattctagcttgtacgctcagctgtgcctgagattggccgaggatgccccaaatttcgatggccctgcagcagagggccagcccggtcagaagcagtcaactacgtttcggaggttgttaatctcgaagttgcaggatgaattcgaaaatcggacccgaaatgtggatgtgtacgacaaacgcgagaaccccctgctcccagaggaggaagagcaacgcgcaattgcaaagatcaagatgctcggtaacattaaatttattggcgaactgggcaagctcgatttgatacacgagtctatcctgcataagtgcattaagacgctgctcgaaaaaaagaaacgtgttcaactgaaagatatgggtgaggatctagaatgcctttgccagatcatgaggacagtggggccaagactggatcatgagcgtgccaagtctcttatggaccagtactttgccagaatgtgctcactgatgttgtcaaaagaactgcccgctcgcatccgcttcctactgcaagatacagtagaattgagagagcaccactgggttcccaggaaagccttcctagataacggaccaaagacaataaaccagatccggcaagacgccgtgaaggaccttggagtgttcatccccgctcctatggcgcagggaatgcgcagtgactttttcctggaagggccattcatgccccctcgaatgaagatggacagagatccacttggtggactggctgatatgtttgggcagatgcctggcagtggcattggcaccggccctggggtaattcaggatcggttttctcctaccatgggccgtcacaggtcaaaccagcttttcaacgggcatgggggtcatatcatgcctcccacacagtcacaatttggcgagatgggtggaaagtttatgaagagtcaggggttgtctcagttataccacaaccagtcccaggggttgctgagtcagctgcaaggacaatccaaggatatgcctccgaggtttagtaagaaagggcaactcaacgctgacgagatctccctccggcctgcacagtcctttcttatgaataagaatcaggttcccaaactccagccacagattacaatgattcctccttccgcacagcctccaagaactcagactcctcctctcggtcagacccctcagctaggcctgaaaacaaatccacctctgatccaagaaaaacctgccaaaacttcaaagaagcctcccccttccaaggaagagctgctgaaattgactgaaaccgtggttacagagtacttaaacagcggcaacgctaatgaggcagtgaacggggtgagagagatgcgcgcacccaagcactttctgcctgagatgctgagcaaagttataattcttagcctcgacagatctgatgaggacaaggaaaaggctagttccctgattagcctcctgaaacaggaggggatcgcaacttctgacaatttcatgcaggcgtttcttaatgtgttagatcagtgtcctaagctggaagtggatatcccactggttaagagctacctggcacagtttgccgctagggcaataatttcggagctggtttcaataagcgagctagcacagccgctcgaaagcggaacccacttccctctgttcctgctctgtctgcagcagttggcgaaactgcaggacagagaatggctgaccgaactgtttcaacagtctaaggttaacatgcagaaaatgctgcctgagatcgatcagaataaagacagaatgctggagatcctcgagggtaaggggctctcctttttgtttcccttgctgaaactcgaaaaggagctcctgaagcagattaagctcgacccatcccctcagactatctataagtggatcaaggataatatcagccccaagctccatgttgataaaggattcgtcaacatactgatgaccagtttcctgcagtacatcagtagtgaagtgaatccccctagtgacgagaccgacagttcttctgcaccttccaaggagcaattagaacaggaaaaacagctgcttctgagttttaagccagtcatgcagaaatttctccatgatcatgttgatttgcaggtgtctgccttgtacgcactgcaagtgcattgctacaattcaaacttccctaaaggcatgctcctacggtttttcgttcacttctacgacatggaaatcatcgaggaagaagcgttcctcgcttggaaggaggatataacacaggaatttcccggtaagggcaaggccttgttccaggttaaccagtggttgacgtggctcgaaacagccgaggaggaggagtcagaagaggaagccgactag

SEQ ID NO: 222522 - DNA, 762 bp, Artificial Sequence
  Description of Artificial Sequence: Synthetic coding sequence
atgcaggccttccttaatgtactagatcagtgtccaaaacttgaggtggacattccacttgtcaaatcctatctggctcaatttgcggctagagccatcatatcagagctggtgagcatttctgaattagcgcagcctctcgagtccgggactcattttccactgtttttgctatgtctacaacagctcgccaaactgcaggaccgggagtggttgacagagctgttccagcaaagcaaggtcaatatgcagaagatgttaccggagattgaccagaataaggatcgcatgctagagattttagaggggaagggactgagctttctctttcccttgctgaaactggagaaggaattactgaagcaaatcaagctcgatccgtctccacagacaatttacaagtggattaaggacaatatcagtcctaagctgcacgttgataagggattcgtgaacattctaatgaccagctttcttcaatacatcagcagcgaggtgaacccgccttccgatgaaaccgattcaagttccgcaccaagtaaagagcaactagagcaggagaagcaactgctcctgtcctttaaacccgtgatgcagaagttcctgcacgaccatgtcgacctgcaagtttcggcactctatgccttacaagttcattgttacaatagcaacttccccaagggtatgttgctttttctgtgcacatcaatgacatggaaattgctcaagaagaagctctcttggttgggaaagaaaatctag

SEQ ID NO: 222523 - DNA, 2610 bp, Artificial Sequence
  Description of Artificial Sequence: Synthetic coding sequence
gtggagtctgccattgcagagggtggcgctagccggttttccgcctccagcggtggagggggatcacggggagccccacagcactatcctaaaactgctggtaattctgagtttctcggaaaaacaccgggacagaacgcccagaagtggattccagctaggagcacccgacgggacgacaattccgcagcaaacaattccgcaaatgaaaaggaaaggcacgatgcgatttttaggaaggtcaggggaattcttaataaactcactccagagaaattcgacaaattgtgcctggagcttctgaatgtgggagtggaaagtaagcttattctgaagggcgtgatactgcttatcgtagataaagctcttgaggagcctaaatattcctccctttacgctcagttgtgcctcagattggctgaggatgctccaaactttgatggacctgcggcagagggccagcctgggcagaagcagtccacaacattcaggcgactgctcatttctaagctgcaggatgagtttgaaaacaggactcggaacgtcgatgtatatgataagcgcgaaaatcctctgctgcccgaagaggaggagcagcgggcaatagctaaaatcaagatgctaggcaacatcaaatttatcggggaattaggaaaacttgatctaatccacgagtccatcctccataaatgtataaaaacacttctggaaaagaagaaacgggtccaactgaaagacatgggggaagacctggagtgcctgtgccagatcatgcggaccgtcgggcctagactggatcatgaacgggctaagtcactgatggaccaatactttgcgaggatgtgttcccttatgctatctaaagaacttccggcaagaataaggttcctgctacaggacacggtagagctgcgtgaacatcattgggtgccacgcaaggccttcctggataacgggccaaagaccatcaaccagatccgccaggacgctgtgaaggacctcggcgtgttcatcccggctccaatggcccaagggatgagaagcgatttctttttggagggcccatttatgccccctcggatgaagatggaccgggacccattggggggactggccgacatgtttggtcaaatgcccggttcgggcattggtacaggcccaggcgtgatccaggaccgattcagtcccactatgggtcgtcatcgtagtaatcagttgttcaacgggcatggcggacatatcatgcctcctactcagagtcagttcggagagatgggaggaaagttcatgaaatctcagataagtctgaggcctgctcagtcattcctcatgaataaaaaccaagtcccaaaactacagccccaaatcacaatgattccccctagcgcccagcctccaaggacccagacgccacccctgggccagactccacagctgggactgaagactaatcctcccttgattcaggagaagcccgcaaagacatcaaaaaaaccgcctccctctaaggaagagctactcaagttaaccgaaacagtggttactgaatacttaaacagtggcaacgccaatgaagcggtaaacggcgtgcgcgagatgagagcacctaaacactttttacctgaaatgctgtccaaagtaatcattctgagcctggataggtcagatgaggacaaagagaaggcatcgagccttatttctctcctcaaacaagagggcatcgcaacttctgataattttatgcaagcatttctgaacgtgttggaccaatgcccaaaactcgaggtcgacataccgttggtgaagtcttacctcgcccagttcgccgctcgggcaattatttcggaactcgtctcaatctctgagctagctcagccccttgagagcggtactcacttcccactctttctattgtgccttcagcaactcgcgaagttacaagatcgtgagtggttgacagaactgtttcagcaaagcaaggtcaatatgcagaagatgctgccagagatagaccagaacaaagatcgaatgctcgagatactcgagggtaagggactgagcttcctgttccccctgcttaagttagagaaagagttgttaaaacagattaagctggaccctagtcctcagaccatctacaagtggattaaagacaatatctcccccaagcttcatgtggacaagggttttgtgaatattttaatgacttctttcctgcagtacatctcatctgaagtcaacccccctagtgatgagactgatagctcctctgcgccaagtaaagagcaattggagcaggagaagcagcttctgctttcctttaagcccgtgatgcagaagtttctccatgatcatgtagatctgcaggtttctgccctttacgccctgcaagttcactgctacaactccaatttccccaaaggtatgctcttgcgcttctttgtccacttttacgatatggaaatcattgaagaggaggcattcctcgcatggaaggaggacatcacgcaagaattccccggaaaggggaaagccctcttccaagtcaaccagtggttgacatggctggaaaccgctgaggaggaagaaagcgaagaggaagctgattag

SEQ ID NO: 222524 - DNA, 2943 bp, Artificial Sequence
  Description of Artificial Sequence: Synthetic coding sequence
atggctggatggcccacccctgccggtaccagaccatggagaacggaggccaggttgtgctctgatggagagggggcatggctgggtcctctagccccttggagggaggcgcgacttgctagtcgccgagggggaatttcctttctcttgtcacccccactgcccaccccgagtatcaacattatcctcttaaagatcctcaggtgccaagcggctaaggtcgagagcgccattgctgagggaggcgcatcccgcttctcagcatctagtggtggagggggaagtaggggagcaccacagcattatcctaagaccgcgggaaacagcgaatttctgggtaaaacccccggacagaatgcgcaaaaatggattcccgcaagatctactagaagagacgataatagcgctgccaataactccgccaatgaaaaggagaggcacgacgcaatttttcgaaaggtgcggggaattctgaataaactaacccctgaaaaatttgacaagctatgcctggagctgcttaacgtgggtgttgaatcaaaactgattctaaaaggcgtgatcctcttaatagtggacaaagctttggaggaacccaagtactcttccctgtacgcccagctgtgtctgcgcttggccgaagatgcacctaactttgacggacccgctgccgaaggtcaaccaggtcagaagcagagcaccacttttaggcgcctattgatctccaagctccaggacgagttcgaaaacagaaccagaaatgtggacgtctatgataagagggaaaatcctctccttccagaagaagaggaacaacgcgcaatcgccaaaattaaaatgttgggcaatattaaatttatcggcgagttgggcaagctagatcttatccacgaatctatcttgcacaaatgcatcaagactctgctggagaagaagaaaagagtgcaacttaaagatatgggggaggatctcgagtgcttatgtcagatcatgaggactgttgggcctcggctggaccacgagcgcgctaaaagcttaatggatcagtacttcgcccgaatgtgttcccttatgctttccaaggaactgcccgcaaggatcaggtttcttctgcaggatacggtagaactccgggaacatcattgggtgcccaggaaggcctttctcgataacgggcctaagacaatcaaccagataagacaggatgctgtcaaagatctgggagtgttcattcctgccccaatggcacagggcatgaggtcggacttcttcctggaggggccttttatgccccctcgaatgaagatggacagggatccccttggaggcttagcagatatgttcggacagatgcctggctccggtattgggacaggtcccggagttatccaagatcggttttctcctaccatggggcgacaccgctctaaccaactctttaacggccatggagggcatataatgccaccgacacaaagccagtttggtgaaatgggtgggaagttcatgaaaagccagggactgtctcagctctatcacaatcagagccaggggttgctctcccaactgcagggacagagtaaggatatgcctcctcgtttttcaaaaaaaggacagctaaacgcagacgaaatcagtctgagacccgcacagtcatttctaatgaacaagaaccaggtcccaaaactccagccccagatcactatgattcctccaagcgcacagccccctcggacacagacaccaccgctaggacagacaccccagcttggactgaagactaatcccccactcattcaggagaagccagctaagacaagcaaaaaaccccctccctccaaggaggagctgctcaagctaacagaaaccgtggtcactgagtatttaaactcaggcaacgcaaatgaggccgtgaacggggtgagggagatgagagctccaaagcattttttacccgagatgctgtcgaaagtgattatcctttctttggaccggtctgacgaggacaaagagaaagcaagtagtttgatcagcctgctgaagcaagaggggatagctaccagcgataactttatgcaggcattcctcaatgtcctcgatcagtgtcctaagctggaggtcgatatacccctggttaagagctatctggcacagttcgccgcacgagctatcatttcggagctcgttagcatctctgagctggctcaaccactggaatcaggcacacatttcccactgttccttctctgcctgcagcaactagctaagttgcaggaccgagagtggctgaccgagctgttccagcagagcaaagttaacatgcagaagatgcttccagagatcgaccagaacaaagacagaatgcttgaaatattagagggaaaggggcttagctttctattccccttactcaagctggagaaggaactgctgaagcagattaagctcgacccctctcctcagacaatatataagtggattaaagacaacatctccccgaagctgcacgtggacaagggtttcgttaatatactcatgacctcattcctacagtacataagcagcgaagtgaacccaccttctgatgagacagactcgtcttcagctccatcaaaagagcagctagaacaggaaaaacaactgctcttgtcatttaaaccggtcatgcaaaagtttctccacgaccacgtcgacctgcaagtgtccgctctctatgccctgcaggtacactgctacaattccaatttccccaaaggcatgttgctcaggttttttgttcacttttacgacatggagatcattgaggaagaggctttcttggcttggaaagaggatatcactcaggagttcccaggcaagggtaaagccctcttccaggttaatcagtggttaacttggctcgaaacagcggaggaggaggagtctgaggaagaagctgactag

SEQ ID NO: 222525 - DNA, 735 bp, Artificial Sequence
  Description of Artificial Sequence: Synthetic coding sequence
gtggagagtgccatcgccgaggggggagcttcacggttcagcgcctcaagtgggggaggtggttccaggggcgctccacagcactatcccaaaacagctggcaactcagagtttcttggtaaaactccgggacagaacgctcagaagtggatccccgctcgctcaacgcgaagagacgacaactctgctgccaataactccgcaaatgaaaaagagagacacgacgctatattccgtaaggtgcggggaatcttaaacaaactgacacctgagaagttcgataagctatgtctggaactgctcaatgttggagtggaaagtaagttaatactcaaaggagtcatcttgctgattgtggataaagccctggaggagccaaagtactcatcattgtatgcccagctgtgcctgaggttggccgaagatgctccaaactttgatggccctgcagctgaggggcagccaggacaaaagcaatccactaccttccgtcgacttctgatcagcaagctgcaggacgagtttgagaatcgcaccaggaacgtcgatgtttatgataagcgggaaaaccctctgttacctgaggaggaagagcagagggccatcgctaagattaagatgttaggcaatatcaagttcattggcgagctgggcaaacttgacctcattcacgaatcaatcctccacaagtgtatcaaaacgctcctggagaagaagaagcgcgtgcagctttag

SEQ ID NO: 222526 - DNA, 2724 bp, Artificial Sequence
  Description of Artificial Sequence: Synthetic coding sequence
gtagagtctgcaatcgctgaggggggagctagcagattttctgcttcctcaggaggaggcggatcccgcggtgcgcctcagcactatcccaagactgcgggtaactcggaattcctgggaaaaaccccgggacagaacgcacagaaatggattcccgcacggagtacacgccgagacgacaattccgcggctaacaattcggcaaatgagaaggagaggcatgacgccatcttccggaaagtgcgaggcatcctaaataagctgacgcccgagaagttcgacaaactatgtctggagctgctgaacgtcggcgtggagtcaaaattaatcctgaagggtgtgatactcctgatcgtggataaggctctagaggagccgaaatattccagtctttacgcccaactctgcctgcgtctggctgaggacgcgcctaattttgacgggccagccgcagaaggacagcctggtcagaagcagtccaccaccttccggagactgctgatctccaagcttcaggacgagtttgagaaccgcacccgaaatgtggatgtgtacgacaaaagagagaatcctcttttacccgaggaagaggagcaacgcgcaattgcaaaaattaagatgctcggcaatattaagttcatcggggagctcggcaagcttgatttaatacacgaaagcatcctccacaagtgcattaagaccctcctcgaaaagaaaaagagggtgcaactgaaagatatgggcgaagacctcgagtgcctgtgtcagatcatgcgcaccgtcggtccaaggttggaccatgaaagggccaagtccttgatggaccagtattttgcgaggatgtgttctctcatgctcagtaaggaactgcctgctcggatacggttcctactgcaggataccgtggaacttcgggaacaccactgggtcccacgaaaggcattccttgacaatggtcctaagacgattaatcagattagacaggatgccgtgaaagatctgggtgtgtttatccccgctcccatggcccagggtatgcgctctgatttcttcttagaagggccattcatgcctccgaggatgaagatggaccgcgacccccttgggggtctcgctgatatgttcggccaaatgccaggcagcgggattggcacagggcctggagtaattcaagataggttcagccccactatgggcaggcacaggagtaatcagctatttaacggacacggaggtcatataatgcctcccacgcaaagccagttcggggaaatggggggaaagtttatgaagtcacaagggctatctcagttgtaccataatcagagtcaggggctccttagtcagctgcagggacagtcgaaggacatgccaccaaggttttctaaaaaaggacaactcaacgcagatgaaatcagtttacggcctgcccagtcgttcctgatgaataaaaaccaagtacctaaactgcagccgcagatcacgatgattcctcccagtgctcaaccccctcggacacaaacccctcccctcggccagacccctcagttggggttgaagaccaaccctccactgattcaggagaagcccgctaaaactagcaaaaaacccccaccaagcaaagaggagttgctgaagctgacagaaacggttgtcaccgaatatctaaactccgggaatgcaaatgaagctgtaaatggagttagggaaatgcgagctccgaaacactttcttcctgagatgctcagtaaagtgatcattcttagccttgatcgcagcgatgaggataaagagaaggcctctagccttatctcactgctgaagcaggagggaattgctacctcagataactttatgcaggcattccttaacgttctggaccagtgccccaaactggaggtggacattcccctggtaaagagttatctcgcgcagtttgcagcacgggctattatcagtgagttggtgagtatatccgagcttgcacaaccactggaatcaggaacccactttcccctgtttttattatgtcttcaacaattggcgaaactacaggatagagaatggctgaccgaactgttccagcagagcaaggtgaatatgcagaaaatgctgcctgagatcgaccagaacaaggatcgaatgcttgagatcctcgaggggaaggggctgtccttcctctttcctctcttgaaactcgaaaaggagttactgaaacagattaagctagatccctccccacaaacgatctacaagtggatcaaggacaacatctccccaaagttgcacgttgacaagggattcgtgaacatactgatgacatccttcctccaatatattagcagcgaggtcaacccgcctagtgacgaaaccgacagttcttccgccccatctaaggaacagctcgagcaagaaaaacagctgttgcttagttttaaaccagtgatgcaaaaatttcttcatgaccatgtggatttgcaggtaagtgcactctacgcactgcaggtccactgttacaattccaacttccctaagggcatgctactgcgattcttcgtgcacttttatgacatggagattatcgaagaggaagcttttctggcctggaaggaagatataacgcaggaattccccggaaagggaaaggcgctgtttcaggtcaatcagtggctaacctggctggagaccgccgaagaggaggagtcagaggaggaggcagactag

SEQ ID NO: 222527 - DNA, 2724 bp, Artificial Sequence
  Description of Artificial Sequence: Synthetic coding sequence
gtagaatctgcgattgcagagggcggtgctagcagattttcagctagttctggtggaggcggttctaggggcgctccacagcattatcccaagactgccggaaactctgagttcttgggtaagacccccggacagaatgcacaaaagtggattcccgctcgcagtactcgcagggatgacaatagcgccgctaacaattccgccaacgaaaaagaaaggcacgacgctatatttcgcaaagtgagaggcattcttaacaaactcacccctgagaagtttgacaagttgtgtctagaactgctcaacgttggcgtggaaagcaagctcattctcaagggagttatcctgctcattgtggacaaagcattggaagaacctaaatatagcagtctatatgcgcagctgtgtctgagactggctgaggacgcccctaattttgatgggcctgctgccgaggggcagccaggtcagaaacagtctaccactttccgcaggctcctgatcagcaaactccaggatgagttcgagaaccggacacgcaatgttgacgtgtatgacaagagggagaatcccctgctaccagaagaggaggaacagcgggcaatagccaaaattaaaatgctgggaaacatcaaattcatcggggagctcggcaagctggatctgatccacgaatcgattctccacaagtgcattaagaccctccttgagaagaagaagagagtacagttaaaagacatgggcgaggacctagagtgcctttgccagattatgcggaccgtgggaccaaggcttgatcatgaacgggcaaagtctttaatggaccaatactttgcacggatgtgctccttgatgctgagtaaagaactcccagccaggatacggttcttgctgcaggatacagtggaactgagagagcaccattgggtcccaagaaaagctttcctggacaacggtcccaaaacaattaatcagatcagacaggatgctgttaaagacctgggagtcttcatccctgcccctatggctcagggcatgagaagcgacttttttctggagggaccgtttatgcccccacgtatgaagatggatagagaccctctgggaggcctggcagacatgtttggccagatgcccggaagcggaattgggaccggaccaggtgttatccaggacagattcagccccactatgggcaggcatcggagtaatcaactgttcaacggacatggtggccacatcatgccacctacgcagagccaattcggggaaatggggggaaaattcatgaagagccagggtttgtcccaattgtaccacaaccaatcccaggggttgttgagccaactgcagggacagtcaaaagatatgccgcctcgattctctaaaaaagggcagctaaatgctgacgagatttctctccggccagcccagagttttctgatgaacaaaaaccaggtgcccaagctgcagccccaaatcaccatgatacccccttccgcacaacccccaagaacccagaccccccctttaggccaaacgccccagttggggctcaagactaatcctccactcattcaggagaagccggctaagaccagtaaaaaaccccctccctccaaagaagaattgctgaagctgaccgagaccgtggtgaccgagtaccttaattccgggaacgccaatgaggccgtgaatggggtgagggagatgcgggcacctaaacacttcttaccagaaatgctgtccaaagtgatcatcctctccctcgatagatccgacgaagataaggaaaaggcgtcctctctgatctccctattgaagcaagagggcatcgccactagtgacaatttcatgcaggcatttctaaacgtgttggaccagtgccctaagctagaggtggatataccactggtgaagtcgtacctggcacaatttgctgcgagagcaatcatttcagaactggtgtccatcagtgagctggctcagccactggaatccggcacgcacttccccttatttctgctgtgtttacagcaactggcgaaactccaggatcgtgaatggctcacagagttgtttcagcagagtaaagttaatatgcagaagatgttgccagagattgaccagaacaaggacagaatgctcgagattctcgaggggaaaggcttatccttcctcttccccctgctgaagttagagaaagaactcctcaaacagataaagctggatccaagtcctcagacaatttacaagtggattaaggataacattagcccaaagctgcatgttgacaagggatttgtgaacatcctaatgaccagctttctgcaatatatctcaagcgaggtcaatccccctagcgatgagacggatagctccagtgccccatccaaagagcagttagaacaagagaagcagctgctcttgtctttcaaaccagtcatgcaaaagtttctgcacgaccatgtggatctgcaggtgagcgctttgtacgctctccaagtgcattgctataacagcaactttcccaaaggcatgcttttgcgcttctttgtccacttttacgacatggagatcatcgaggaagaggctttcctcgcttggaaagaggatatcactcaagaattccccggtaagggcaaagccctgttccaggtaaaccagtggttaacttggctcgagaccgccgaggaggaagagtccgaagaagaggcagactag

SEQ ID NO: 222528 - DNA, 375 bp, Artificial Sequence
  Description of Artificial Sequence: Synthetic coding sequence
gtggagagcgccatagccgaaggaggagcttctagattcagcgccagtagtggcggaggcggttccaggggtgctccgcagcactaccccaaaaccgccggaaactcagagttcctcggaaagactccaggccagaatgcccagaagtggattccggcaaggtcgactagaagggacgacaacagcgcagcaaacaattcagctaatgagaaagagagacacgacgcaattttccggaaggttagggggatcctgaacaagctgacacctgaaaaattcgacaagctatgcctagagctcctcaacgtaggggtggagagtaagctcatcctgaagggtgtgatccttctgatcgttgacaaagccctggagtag

SEQ ID NO: 222529 - DNA, 339 bp, Artificial Sequence
  Description of Artificial Sequence: Synthetic coding sequence
gttgagtcagcaatagcggaggggggagcatccaggttttctgcaagtagtggcggaggcggatcgagaggggcaccgcagcactaccctaaaaccgccggaaattccgagtttctaggaaagactccaggccagaatgcccagaagtggatccctgcgagatctacgcgccgagatgataatagtgccgcaaacaactcagccaatgagaaggagcggcacgacgccatctttcgaaaagtgcggggaatattgaataaattgacgcctgagaagtttgataagctctgtctggagctgctgaatgttggggtggaatctaagctcattctaaaatag

SEQ ID NO: 222530 - DNA, 351 bp, Artificial Sequence
  Description of Artificial Sequence: Synthetic coding sequence
gtggagagcgcaatcgccgaagggggagcaagtcgattctccgcatctagcgggggtgggggaagtcggggagctccccagcattaccccaaaactgcaggcaatagtgagttcctggggaaaacccccggtcagaatgcacagaagtggattcccgctcgttcaacgaggcgcgacgacaattctgctgccaataattcagccaacgaaaaagagcggcatgatgcgatctttaggaaagtgcggggaattcttaacaaattaacccccgagaagttcgataagctttgcctggagctcttaaacgtcggcgtggagagcaaacttatacttaaaggcgtaatcctgtag

SEQ ID NO: 222531 - DNA, 1335 bp, Artificial Sequence
  Description of Artificial Sequence: Synthetic coding sequence
gtagagtctgccatcgccgaagggggagccagccgattttctgccagttccggtgggggaggctctagaggcgcaccccagcattacccgaagactgccggtaattctgagtttctgggcaaaactccaggccagaatgctcagaagtggattcctgccaggtccactagacgtgacgacaattcagccgcaaataactccgcaaacgagaaagaacgccacgatgcaatattccgcaaggtgaggggaattctcaacaagcttacgccggaaaagttcgataagctgtgcctggagctgttaaatgtgggggtggaatccaaattgattctcaagggagtcatactgctgattgtggataaggcactagaggaaccaaagtacagctcactgtacgcacagttatgcctgaggcttgctgaagacgcccctaactttgatggaccggctgcagaaggtcagcctggacagaagcagagcactacctttcgtcgtttactaatttccaagcttcaggacgaattcgagaatcgcacacggaacgtggacgtctacgataaaagggaaaatcctctgctgcctgaagaggaagagcagcgggctatagccaaaatcaagatgttaggaaacattaaattcatcggcgagttgggcaagttagacctcatccacgaaagtatcctacataagtgcatcaaaacactgctggagaagaagaagcgagtccaacttaaggacatgggcgaagatctggagtgtctctgtcagataatgagaactgtggggcctaggctggaccacgaacgcgctaaaagtcttatggatcagtactttgcaagaatgtgcagtctgatgctgtctaaggaattgcctgcacggatcagattccttctgcaggatactgtggaactgagggaacatcactgggtgcctagaaaagcgtttctggacaacggaccaaaaacgatcaaccagattcggcaggatgccgtgaaggatctaggagtcttcatccctgcccctatggctcagggtatgcgatccgactttttcctggaggggccattcatgcctccacgaatgaagatggaccgcgaccctttgggaggcttagctgatatgtttggccaaatgcctggatccggcataggcacgggccctggtgtgattcaggaccgcttttctcctaccatgggccgacaccgttcaaatcaactgtttaacggccatgggggacacataatgccccctactcagtcccaattcggagagatgggcggaaaatttatgaagtcccagatttcactcaggcccgctcaaagttttctgatgtag

SEQ ID NO: 222532 - DNA, 849 bp, Artificial Sequence
  Description of Artificial Sequence: Synthetic coding sequence
gtagaaagtgccatagcagaaggaggagcctcaaggtttagtgcttcttctggcggaggaggatcaaggggtgcccctcaacattaccccaagacggctggcaattccgagttcctcggcaaaacccctggccaaaacgcacagaagtggatccctgctcggtctacccgccgagacgataatagtgccgctaataatagcgccaacgagaaggagcggcacgacgctatcttcagaaaagttcggggaatactgaacaaactgacccccgaaaaattcgataagctctgtcttgaattactgaatgtaggcgttgaatctaagctgattctgaaaggagttatcctgctgatagtggataaggccctcgaggagccgaaatattccagcctatacgcccagttatgtctgcggctggctgaggacgccccaaacttcgatggccctgctgcagagggacagccaggacagaaacaaagcaccacttttcgaaggctgctgatttcaaaactgcaggacgagtttgagaatcgtacccgcaacgtagatgtgtacgacaaaagggaaaacccacttctgcccgaagaagaagagcaaagagctatcgcaaaaatcaaaatgctcggaaacataaagttcattggcgagcttgggaagctggatctcatccacgaatctatcttgcacaaatgtatcaagactttactagagaagaagaagcgcgtgcagcttaaggacatgggagaagacctggagtgcctatgtcaaataatgcggaccgtcggcccaagactggaccacgaaagggccaagagcttgatggaccagtactttgccaggatgtgctag

SEQ ID NO: 222533 - DNA, 393 bp, Artificial Sequence
  Description of Artificial Sequence: Synthetic coding sequence
gtagagtcagcaatcgccgaagggggagcctcccgtttttctgcatccagtggagggggaggatctaggggtgctccacagcattaccctaagaccgccggtaactccgagttccttggcaagactcccggacagaacgctcagaagtggattccagctcgctccacccgcagggatgataattcggccgcaaacaacagcgccaacgagaaagagagacacgatgccattttcaggaaggtgagaggtatccttaataagctcacccccgagaagtttgataagctgtgcctggagttgctgaatgtgggggtcgagtctaagctgattctgaagggcgtaattctgctgattgtagacaaagccctcgaagagcccaaatattcaagctag

SEQ ID NO: 222534 - DNA, 1221 bp, Artificial Sequence
  Description of Artificial Sequence: Synthetic coding sequence
atgtctgctagccaagactcgaggagtcgagataacggccctgacgggatggaacccgagggcgttatcgagagcaattggaatgagatcgtggacagcttcgacgacatgaacctgtccgagagtctcttgaggggaatatatgcctacggcttcgagaagccttctgctatccagcaaagagcaattctgccctgcatcaagggatacgacgtcatagctcaagctcagagcgggaccggcaagacagccacttttgctatcagtattctgcagcagattgagcttgatttgaaggcgacgcaggccctggtgctggcaccaacgagagagctcgcccagcagatccagaaggtagtaatggctctgggggactacatgggtgccagctgtcatgcttgtatcggagggaccaatgttagggccgaggtacaaaaactacaaatggaagcaccccacatcatcgtgggaacgcccggacgagtcttcgacatgctgaaccgccgatatctgagtccaaagtacattaaaatgttcgtgctggatgaggcagacgagatgctatccagaggatttaaggaccagatttatgatatttttcagaagctaaattctaatacccaggtggttttgctgtcagccacaatgccaagcgatgtgctggaggtgacaaagaagtttatgagggacccaattcggattctagtcaagaaggaagaactaacactcgagggaatcagacagttttacatcaacgttgagcgagaggaatggaagctggataccttgtgcgatttgtatgagactctgactattacgcaggccgttatattcataaacacccgcagaaaagttgactggctcacggagaagatgcacgctcgggattttaccgtgagcgctatgcatggagatatggaccagaaggagcgggatgttatcatgagggaattcaggagtggtagttcacgggtgttaattaccaccgatcttctcgccagggggattgacgttcagcaggtcagcttggtcatcaactatgatctgccaactaaccgagagaactacatacatcggattgggagggggggacggtttggcagaaaaggcgttgctatcaacatggtaaccgaagaggataaacgaaccctgagagacatcgagactttttacaacacaagcattgaagaaatgcctctaaatgtggccgatctgatatag

SEQ ID NO: 222535 - DNA, 441 bp, Artificial Sequence
  Description of Artificial Sequence: Synthetic coding sequence
atggagcctgagggggtgattgaaagtaattggaatgaaatcgtggattcctttgacgacatgaacctgagcgaatctctgttgcgcggtatttacgcctacggcttcgaaaaacccagtgcgatccaacagagggcaattttaccctgtattaaaggatacgatgtgattgcccaagcacagtcgggtaccgggaagacggccacctttgctattagcatcctgcagcaaattgaactggacctgaaagctacccaggcactggtgctcgcccctacccgggagttggcccagcaggtacgggtagctagcattccaagtttccgggcagacctgggaatgatgagcattatacagggccctgagaagtcctccctgatcactactcttggcggtaggcatggctgtcctaacacactggagacctgttgggtcaactag

SEQ ID NO: 222536 - DNA, 603 bp, Artificial Sequence
  Description of Artificial Sequence: Synthetic coding sequence
atgttcgtgcttgacgaagctgacgagatgcttagcagaggcttcaaggaccagatttatgacatatttcaaaagttaaattccaacacccaggtagtgctgcttagtgcgaccatgccttccgacgtgttggaagtgaccaaaaagttcatgagagatccgatccgtatcctggtgaagaaagaagagcttaccttagaagggatccggcagttttatattaacgtagagcgtgaagagtggaaattggacactctgtgtgacttgtatgaaactctaactatcactcaggccgtgatttttattaacacaaggaggaaagttgactggctcaccgaaaagatgcacgctcgtgactttaccgtttcagcaatggtttgcctgcccgctgcgagcctgttgtgggtgtgtccctccgaggtatcatatctgaaacccggttttctggagcctcgatgcctcccgggattgcttcacatttgtttcttgttccagcatggcgacatggaccaaaaagaaagggatgtaatcatgcgggaattcagatctggaagcagcagggtgctgattacgacagacctactggtttcccgaggcaactag

SEQ ID NO: 222537 - DNA, 1026 bp, Artificial Sequence
  Description of Artificial Sequence: Synthetic coding sequence
atgagcgcgagccaagacagtagaagtcgtgataatggccctgacggaatggaacctgaaggcgtcatcgagtctaactggaacgaaatcgtggattcctttgatgatatgaatttgagcgaatcactcctacggggtatatatgcttacggatttgaaaagccatccgcaatccaacagagagccatcctgccatgtattaaggggtatgacgtaatcgcgcaggcccagtccggcacggggaagactgccacgtttgcaatcagcatactacaacagatcgagcttgacctgaaagcgactcaggcactcgtgctcgctccaacgagggaattggctcaacagatccagaaggtggtaatggcgctcggggattacatgggagcatcatgtcatgcatgcataggcggaactaatgtgagagctgaggtgcagaagctgcaaatggaggctccacacatcattgtgggcacacccggacgcgtattcgacatgctgaatcgtcgctatctttcacccaaatacataaagatgttcgtcttagatgaggctgatgagatgctgtcgagaggttttaaggaccaaatttacgacatttttcagaaacttaactcaaacacccaggtcgtgctgctgtcagcaaccatgccttcagacgttctggaagtcacaaaaaagttcatgagagatcccattaggatattggtgaagaaggaggagcttacattggaggggatccgtcagttctatattaatgttgagagggaagagtggaagttggatactctgtgtgacctgtatgagactctgactatcacccaggccgtcatattcataaacacccgtagaaaagttgactggctgactgaaaagatgcatgccagagatttcaccgtctctgcaatgcacggagacatggaccagaaggaacgagacgtcattatgagggagtttcgctcagggtccagcagagtcctgataactaccgatctgctgaacaggagccgatggaccgtgtggccctag

SEQ ID NO: 222538 - DNA, 1224 bp, Artificial Sequence
  Description of Artificial Sequence: Synthetic coding sequence
atgtccggcggtagcgctgactataaccgtgaacatggtggacctgagggaatggaccccgacggtgtaatcgaatctaattggaatgagatcgtagataatttcgacgacatgaacttgaaagaatcactccttcgcggaatttacgcttacggatttgagaagccttcagccatccaacagcgcgcaatcataccatgtattaagggctatgacgtgattgcccaggctcagagcggaaccggcaagactgccacttttgcgatatccattctccagcagctggaaattgaatttaaagaaacccaagcccttgttttggcccctacccgcgagcttgcacagcaaattcaaaaggtcattctggctctgggagattatatgggcgctacttgtcacgcctgtatcggaggaactaacgtacgtaacgaaatgcagaagcttcaagcggaagctccgcacatagtggtcggcactccagggagggtgttcgacatgctcaacagaagatacctgagtcccaagtggattaagatgttcgtcctggacgaggctgacgagatgctttcaaggggatttaaggaccagatatatgagatctttcaaaagctgaacaccagcatccaagtggtgctacttagtgccacaatgccgactgacgtgttagaggtcactaaaaaattcatgcgggatcctatccgcatccttgtcaaaaaagaggagcttactctggagggtataaagcaattctacattaacgtggagagggaagagtggaagcttgataccctctgcgacctctatgagacactaaccattacccaggcggtgatctttctgaacactagaagaaaagtggactggctgactgaaaagatgcacgcccgtgatttcacggtctcagctctgcacggggacatggaccagaaagagagggacgtgatcatgagagagttccggagcggctcttcgagggtcctcatcacaaccgacctgcttgctaggggtattgatgttcagcaagtctccctagttatcaattacgatttgcccacaaacagggagaactacattcacagaattggtcgcggagggcgatttgggcgaaagggagttgctatcaactttgttaccgaggaggataagcgtatcctgagggacattgaaacgttttataacaccacggttgaggagatgccaatgaacgtggcagatctcatttag

SEQ ID NO: 222539 - DNA, 939 bp, Artificial Sequence
  Description of Artificial Sequence: Synthetic coding sequence
atgctaacggtgctccggagtctgccattattctcaagggagctcttatttcccgtgctgaaaatccagaaggttatcctggcactgggcgactacatgggtgccacctgccacgcttgtattggaggcactaacgtcaggaatgagatgcagaagttgcaggccgaggcaccccacatcgtagtaggtaccccaggtcgcgtcttcgatatgcttaatagacggtacttgtcccccaagtggattaagatgtttgtgctcgacgaggccgatgaaatgctatcccggggtttcaaggaccagatttacgaaatctttcagaagttgaataccagtatacaggttgtcctcctcagtgccaccatgcccaccgatgttctggaggtcactaagaagtttatgagagacccaataagaatcctggtgaaaaaagaggagctgactctggagggaataaagcagttctatatcaacgttgaaagagaagaatggaagttggacactctctgcgatctgtatgaaactctaacaatcacacaagcagtgatctttctgaacaccagaaggaaggttgactggctgacagagaagatgcacgcacgtgacttcaccgtgagcgccctgcatggcgacatggatcagaaggagcgggacgtgataatgagagagttccgctccggctccagcagggtcctgatcaccaccgatctcttagctagagggattgacgtgcaacaggtttctcttgtcatcaattatgatttaccaacaaacagagaaaactatatacatcgcattggcaggggtgggaggttcgggaggaagggcgtggcaattaattttgtgactgaagaagacaagcgaattctgcgagacattgaaactttttacaacacgacggtggaggaaatgccaatgaacgtggcagatctcatctag

SEQ ID NO: 222540 - DNA, 1227 bp, Artificial Sequence
  Description of Artificial Sequence: Synthetic coding sequence
atgagcggagggagcgctgattataatagccgcgagcatggaggacctgagggtatggaccccgacggcgtgattgagtcaaactggaatgagatcgtggacaacttcgatgatatgaatttaaaagagtctttactgcggggaatctatgcctacgggttcgagaagcctagcgctatccaacaacgtgccattatcccctgcatcaaagggtacgatgtgatcgctcaggcgcagagcgggacaggcaagactgccacgtttgctatctctatcctccaacaattagaaatagagtttaaggagacccaagccttggtgttggcccctacgcgcgagcttgctcaacaaatccagaaggttattctcgccctgggggactacatgggcgctacatgccacgcttgtatcggagggacaaacgtccgcaacgagatgcaaaaactgcaagctgaagccccacatattgtggtagggacccccggaagggtattcgatatgctcaatcggcgatatctaagccccaagtggataaagatgttcgtgttagatgaagctgacgagatgctatctcggggtttcaaggatcagatctacgagatcttccagaagctgaatacgtcaatccaggtcgtgttgttgagcgcaactatgcctactgatgtgctggaggtcaccaagaaatttatgagggatcctatccgtatcctagttaagaaagaggagttgactctggaagggattaagcagttctatatcaatgtggagcgcgaggagtggaaactcgacaccctatgtgatctttatgaaacactcacaataacgcaggccgtgatctttttaaacacccgcaggaaagtggattggcttaccgaaaaaatgcatgcccgtgatttcaccgtctccgctctgcacggagacatggaccagaaagaaagagacgtaataatgcgggagtttaggtctggctctagcagggtactaatcaccacagatttgctggctcgcggtatcgatgtccagcaagtgagcctcgttataaactatgacctcccaaccaatcgggaaaactacatccataggatcggccgaggaggcagattcggtagaaaaggagtagccatcaattttgtgactgaggaagacaagcgcattctgcgcgatatagaaacattctacaacaccaccgtggaagaaatgccaatgaacgtggccgatttgatctag

SEQ ID NO: 222541 - DNA, 174 bp, Artificial Sequence
  Description of Artificial Sequence: Synthetic coding sequence
atgagcggcggatctgcggattataatcgtgaacacgggggacctgaagggatggaccctgatggtgtgatcgaatccaattggaacgaaatcgtggataactttgatgatatgaacttaaaagagagtttgttgcggggaatttacgcatacggattcgagaaaccgagttag

SEQ ID NO: 222542 - DNA, 297 bp, Artificial Sequence
  Description of Artificial Sequence: Synthetic coding sequence
atgtcgggagggtccgccgattacaaccgcgaacacggcggtcctgagggcatggacccagatggcgtcatcgaatccaattggaacgagatagtcgacaactttgatgatatgaatcttaaagagtctctgctgcggggaatctacgcctatgggttcgaaaaaccctccgcaattcagcaacgcgcaattatcccttgcatcaaggggtacgatgtgattgcgcaggcccagtccggaaccggcaagacagctacctttgccatctctatactccagcaactggagatcgaatag

SEQ ID NO: 222543 - DNA, 363 bp, Artificial Sequence
  Description of Artificial Sequence: Synthetic coding sequence
atgtcatcatccgcaggctccggccaccagcctagtcagagcagggcaattccaacacggactgtcgccataagtgatgcagcccagctgccacacgactactgtacaaccccgggaggtaccttgttttctactactccgggaggcacaaggataatctatgataggaagttcctcctggataggcggaactcgcccatggcacaaactcccccttgccatttaccgaacattccaggtgtaactagcccaggaacattgatcgaagactccaaggtggaggtcaacaatttgaacaatctgaataaccacgaccggaagcatgccgtgggcgacgacgctcagtttgaaatggatatctag

SEQ ID NO: 222544 - DNA, 738 bp, Artificial Sequence
  Description of Artificial Sequence: Synthetic coding sequence
atgaataataaattcgacgccctgaaagatgacgactcaggggatcacgaccaaaatgaggagaacagcactcagaaagatggcgagaaggagaaaacagaacgcgacaagaaccagtctagctccaagcgcaaagcagtcgtgcctggacccgcagaacaccctctacagtacaactacacgttttggtattcacggcgtacacctggcaggcctaccagttcccaaagctatgagcagaatatcaagcagattgggactttcgccagcgtggagcaattctggagattttactcgcacatggtaagacccggtgatctgactgggcactcagattttcatctcttcaaagaaggcatcaagcccatgtgggaggacgacgccaataaaaacggaggtaaatggataatcagactgaggaagggcttggctagcagatgctgggaaaaccttatcctcgcaatgctaggggaacaatttatggtaggtgaagagatatgtggtgccgttgtaagtgttcggttccaagaagacattatatctatctggaataagacagcctctgatcaggctacaactgcacgaatcagggataccttgaggcgggtcctcaatttgccccctaacaccattatggagtacaagactcataccgatagtataaagatgccaggaagacttggccctcagaggctactcttccagaatctgtggaagcccaggctgaacgtgccttag

SEQ ID NO: 222545 - DNA, 705 bp, Artificial Sequence
  Description of Artificial Sequence: Synthetic coding sequence
atgaataataagtttgacgctttgaaggacgacgattccggcgaccacgaccagaatgaggagaattccacacagaaagatggggagaaagagaagactgagcgcgacaagaaccagtccagcagcaagaggaaggcagtggtacccggtcctgccgaacaccccctgcaatacaactatacgttctggtatagccggagaaccccagggagaccaacctcctcccagtcatacgagcagaacataaagcagatcgggacctttgcctctgtcgagcagttctggcggttttatagccatatggtgcgccctggggacctcactggccactcagacttccacctgttcaaggaggggatcaagccgatgtgggaagacgacgcaaacaagaatggaggaaaatggatcatccgtttgagaaagggtctggcttcgaggtgctgggagaacctgatcctggcgatgctgggtgaacagtttatggtcggtgaggagatctgtggtgctgtcgtgtccgtccggtttcaagaagacattatcagtatttggaataagactgcgagtgaccaggccacaaccgctcgcatccgggacacgcttaggcgagtccttaacttgccaccaaacactataatggagtataagacccacactgacagtattaaagacaattctagtttccgcaacacaaaaatcacgctgtag

SEQ ID NO: 222546 - DNA, 567 bp, Artificial Sequence
  Description of Artificial Sequence: Synthetic coding sequence
atgaataacaaattcgatgcccttaaagacgatgatagtggagaccatgaccaaaacgaagagaatagcacccagaaagacggggaaaaggaaaaaaccgagcgtgacaaaaatcaatcaagttcgaaacggaaagtggagcagttttggcgcttctatagccatatggtgcgcccaggagacttgacaggccactcggattttcatttattcaaagagggcatcaagcctatgtgggaagacgatgctaataaaaacgggggaaagtggataatccgacttcgcaagggtctcgctagtagatgttgggagaaccttatcttagcgatgctgggcgagcagttcatggtgggcgaggaaatctgcggcgcagttgtctccgttagattccaggaggatattatcagcatctggaacaagaccgcaagcgaccaggcgaccacagcaaggattcgtgacaccttgaggcgtgtgttaaacctcccacctaataccatcatggaatacaagactcatacagatagcattaaatacgttcttggagggtatggtcggacgtgcccctag

SEQ ID NO: 222547 - DNA, 357 bp, Artificial Sequence
  Description of Artificial Sequence: Synthetic coding sequence
atgcggggagagcgccgtccactgtgggaggaggaaagtaacgccaaggggggagtgtggaaaatgaaggtccccaaagactcaaccagcacggtatggaaggagctgctgctggcaacaatcggagagcagttcaccgactgcgccgctgcagacgatgaagtgataggggtgagtgtttcagtcagggacagagaggatgttgttcaggtgtggaatgtgaatgctagtcttgtgggtgaggccaccgtcctcgaaaaaatttacgagctgctgcctcatatcaccttcaaggcggtcttttacaaacctcacgaggaacaccacgccttcgaaggagggaggggaaagcactag

SEQ ID NO: 222548 - DNA, 357 bp, Artificial Sequence
  Description of Artificial Sequence: Synthetic coding sequence
atgcgcggagagcggaggcccctgtgggaggaggagtcaaatgcgaaggggggtgtctggaaaatgaaggtgccaaaggatagcaccagcactgtgtggaaggaactgctcctggcaaccatcggtgaacagttcaccgactgcgcggctgcagacgacgaggttatcggggtgagtgtgtctgtccgcgatagagaagacgtggtgcaagtttggaatgtgaatgcttccctcgtgggcgaggctacggtgcttgagaaaatctatgagctgttgcctcatattaccttcaaggcagttttctacaagccccatgaagaacatcatgcctttgagggaggcagaggaaagcattag

SEQ ID NO: 222549 - DNA, 357 bp, Artificial Sequence
  Description of Artificial Sequence: Synthetic coding sequence
atgcgtggcgagcggagacccctgtgggaagaggagtccaatgcgaaagggggtgtgtggaagatgaaagtgcccaaggactcaaccagcactgtctggaaagagctcctgctcgcgacaattggtgaacagtttacagattgtgctgcggcagacgatgaagtcatcggagttagtgtaagcgtgcgggacagggaggacgtcgtacaggtctggaacgtcaatgcttccctggtgggcgaggcaacagttctggagaagatatacgagcttctaccacacatcaccttcaaggcagtcttctataagccgcacgaagagcaccacgcttttgagggcggtcggggaaaacattag

SEQ ID NO: 222550 - DNA, 675 bp, Artificial Sequence
  Description of Artificial Sequence: Synthetic coding sequence
atggctctgcctcccgcagcggctccacctgccggtgctcgggaaccacctggtagcagagctgcagcagctgctgcagctccagagcctccgctcggtctgcaacagctgtctgcgttgcaaccagaacccggaggggtgccactgcattctagttggactttttggcttgaccggagtctgcctggtgcgactgcagcagagtgtgcaagcaacctgaagaagatctacaccgttcagaccgtacagatattttggagcgtatacaataacataccacccgtgacatctctgcccctgaggtgttcttaccacctgatgcgcggagaacggaggcctttgtgggaggaagagagcaacgctaaggggggagtgtggaaaatgaaggtacctaaggattctacttctactgtgtggaaggagctgctcctggctaccattggagagcagttcactgattgtgctgcagccgacgacgaggtcatcggagtaagtgtgtccgttagagatagggaagatgtggtgcaggtctggaatgtcaatgcatcattagtgggcgaggctactgttctcgagaaaatctacgagctgctgccccacataacctttaaggcggttttttataaaccacatgaggaacatcatgcattcgagggagggagaggaaaacactag

SEQ ID NO: 222551 - DNA, 357 bp, Artificial Sequence
  Description of Artificial Sequence: Synthetic coding sequence
atgaggggggaaagacgccctttgtgggaagaggagtccaatgccaaggggggtgtttggaagatgaaggtgcctaaggattccaccagcactgtgtggaaagaactcttgctcgctacaattggggagcagttcaccgactgtgccgctgccgatgatgaggtcattggggtgtcggtatcagttcgtgaccgggaagatgtagtccaggtgtggaatgtgaacgcaagtctagttggcgaagcgaccgtcctggagaaaatttacgagttgctgcctcacattacttttaaggccgtgttttataaaccccacgaagagcaccacgcatttgagggagggagggggaagcactag

SEQ ID NO: 222552 - DNA, 135 bp, Artificial Sequence
  Description of Artificial Sequence: Synthetic coding sequence
atgagaggggagcgtaggcccctatgggaggaggaatccaatgccaagggtggggtctggaaaatgaaggtccccaaagattcaaccagcacagtgtggaaagagctgctcctggcgacaatcggcgagcaatag

SEQ ID NO: 222553 - DNA, 156 bp, Artificial Sequence
  Description of Artificial Sequence: Synthetic coding sequence
atgcgcggagaaaggcgaccactgtgggaagaggaaagtaatgccaagggcggtgtatggaagatgaaggtgcctaaggactccacttccactgtttggaaggagttactactggccacgatcggcgaacagtttaccgactgcgcagcggcttag

SEQ ID NO: 222554 - DNA, 282 bp, Artificial Sequence
  Description of Artificial Sequence: Synthetic coding sequence
atgcgaggggagagaaggcccctgtgggaggaggagagcaacgcaaagggaggggtctggaagatgaaggtgcctaaggattccacctccacggtatggaaggagctgctgttggctacgatcggagagcagttcaccgattgcgccgcagccgacgatgaggtcattggcgtctctgtctcagttcgcgatagggaggatgttgttcaggtgtggaacgtgaatgcttctctcgtgggcgaggctactgtccttgagaagatctatgaactgctgccgtag

SEQ ID NO: 222555 - DNA, 2958 bp, Artificial Sequence
  Description of Artificial Sequence: Synthetic coding sequence
atggatcggcgtagtatgggagaaaccgaaagcggggacgccttcctggacctcaagaagcctcccgcttccaaatgccctcataggtacaccaaggaggaactcttggacataaaagaactcccacacagtaaacagagacccagttgtctctcggaaaaatatgactcagacggtgtctgggacccggagaagtggcacgcttcactataccccgcaagtgggagatccagtcctgtggaatccctgaaaaaggaacttgatacggataggcccagccttgtaaggcggatcgtggaccccagggaaagagtgaaggaagacgacctggacgtggtcttgtctcctcaaaggaggagttttggaggcggttgccacgtcactgctgcagtcagttctcgtagaagcgggtctcctctcgagaaggactctgacgggctgcggttattgggaggccgaaggattggcagtggcagaatcatttccgccaggacttttgagaaagatcaccggctatcagacaaagacctgcgtgacctccgggatcgggatcgggaaagagatttcaaggataaaaggttccgcagggagttcggcgactcaaaaagagtgttcggcgaacggcgaagaaatgattcatacaccgaggaggaacctgaatggttctctgccggacccacctctcagagcgagacaatagaactaacaggattcgatgataaaatcttggaggaggaccacaaaggtcggaaaagaacacggagacgtacagcctccgttaaggagggaatcgtagagtgtaacgggggtgtagccgaggaagatgaggttgaggtgattctcgctcaggagccggcagcagaccaggaggtacccagggatgcagtcttgccagaacagagtcccggtgactttgactttaacgagttctttaacctcgacaaggtaccgtgcctggccagcatgatcgaagacgttctgggtgagggatccgtgagcgcttcacggttcagtcgctggttcagcaacccaagtaggtcagggtcaaggagcagctcactgggcagcactccgcatgaggaactagaacgcctcgccggtctcgaacaagcgatcctgtcaccgggacagaattctggcaactattttgctcctatccctttagaggaccacgcagaaaacaaggtagatatccttgagatgttgcaaaaagcaaaggtggacctcaagcccctgttgtcctcactgtctgcgaataaggagaaactgaaagaatctagccactccggcgtggtgttgagtgtggaagaagttgaggctggactgaagggtctcaaagtcgatcagcaggtcaaaaattctaccccctttatggctgagcacctggaagagactctgtccgctgtgactaataatcgccagttgaaaaaagacggtgatatgaccgccttcaacaagttagtgtctaccatgaaggcatcagggaccctgcccagccagcccaaagtaagtcgtaatctggaatctcatctgatgtctccagccgaaatccctggccaacccgttcctaagaacatactgcaagagttacttgggcagcctgtccaacgtcccgctagctccaacttactcagcggattaatgggtagtctggagccaactacatccctgttaggacagcgggctccaagcccacctttgtctcaggtgttccaaacaagggctgcaagtgcggattatcttagacccagaatcccttcgcctatagggttcactcccggaccacagcagcttctcggtgacccattccagggcatgagaaaacctatgtcaccaattaccgcccagatgtctcagttggaattgcagcaggctgccctggagggtttagccctgccgcatgatctggctgttcaggctgccaacttctaccagccaggcttcggaaagccgcaagtggacaggacccgtgacggttttcgcaaccggcaacagcgggtcaccaagagtcccgcacctgtacacaggggcaattcctcttcacctgccccagccgcttctataacttcgatgctgagccctagcttcacacctacctcagtgatacgcaagatgtacgaatccaaagaaaagagcaaagaggagcccgcatctggcaaagcggctttgggagattccaaggaggacactcagaaggcgtctgaagaaaatcttctgtccagcagctcagttccttctgctgatcgagactcatcccctacaaccaactctaaactatccgcccttcaaaggtcaagctgctctacccccctgtctcaggccaaccggtatactaaggagcaggactataggcctaaagccacgggccgaaaaacaccaacactggcatctcccgtaccaactacacccttcctcaggcctgtccaccaggtgcctctagtccctcacgtgcctatggtcaggccagcacatcagctgcacccaggacttgttcagcggatgctggcccagggcgtccacccacagcaccttccttcgctcctgcagacgggagtcctgcccccaggcatggatctgtctcatttgcagggtatctctggacctattctcgggcagcctttctaccccttgccagccgcttcccacccgctgttaaacccccgaccagggactccactgcacctggcgatggttcagcagcagctacagagaagtgtgcttcacccacccggatctggctctcatgcggcagccgtgtctgtgcagaccacgcctcagaatgttccatctcgtagcgggctccctcacatgcacagtcagctagaacataggccttcacagaggagcagcagcccagttggcctcgcaaagtggttcggctccgacgtcttgcaacagcccctcccttcaatgcctgccaaagtgattagtgttgacgaactggaatatcggcagtag

SEQ ID NO: 222556 - DNA, 2436 bp, Artificial Sequence
  Description of Artificial Sequence: Synthetic coding sequence
atggatcggcgatcaatgggagagactgaaagcggggacgccttcctggaccttaaaaaaccacctgcttctaagtgcccacacaggtatactaaggaggagttattggacatcaaagagctgccacactccaagcagcggccatcatgtctaagtgaaaaatacgatagtgatggggtgtgggatcctgaaaaatggcacgcttccctatatcccgcatctggccgaagctccccagtggaatccctcaaaaaggaactggataccgacaggcctagccttgttcgaaggattgtgggaattgttgagtgcaatgggggagtggctgaggaggacgaagtagaggtgatcctcgctcaagagccagcagcagatcaggaggtgcctagagacgccgtgctgccagaacaatccccaggcgattttgatttcaacgagttcttcaaccttgacaaggtcccttgtttggctagcatgattgaggacgttcttggggaggggtctgtgtctgcaagccggttttcccggtggttttcaaacccatcccgcagtggatcccgatcctcttctttgggcagcacgccacatgaagagctggaaaggcttgccggtttagaacaggccatcctgagcccaggacagaactccggtaattattttgccccaatccctctcgaagatcacgctgagaacaaggtcgacatcctggagatgctccaaaaagccaaggtggatctaaaacctctactgtctagcttgtctgcgaacaaggagaagctgaaggaatcctcacacagcggggtggtcctgtctgttgaggaggttgaggctggacttaaagggctaaaagtggaccagcaggtcaaaaattctacacctttcatggcagaacacttggaggagaccctgtctgccgtgaccaataatagacagcttaagaaggacggggatatgactgctttcaacaagctggtaagcactatgaaaaggaaccttgaaagccacctgatgagcccagcggaaatccctggtcagcccgtgccaaaaaacattttgcaggagcttttgggccagcctgtgcagcgtcccgcttctagcaacctcctgtccggcctcatgggatctctggagcccacgacatctctattgggacagcgcgctccctccccccctttgtcacaggtgttccagaccagggcggcaagcgccgattacctgcggccaagaatcccctcaccaatcggattcacccctggtccacaacagctgttgggcgacccattccagggtatgcggaagccaatgagccccattacagcccagcagatgagccaactggaactgcaacaggccgcattagagggcctggctcttcctcacgacttagcagtgcaggccgctaacttctaccagccagggtttggcaagccgcaagtggacaggactcgggacggatttcgaaatagacagcaacgagttaccaaatcccctgcgcctgtgcaccgagggaatagcagctccccagcaccggcagcttccatcacaagcatgttgtccccttctttcacgcctacaagcgtgatccggaagatgtatgagtcaaaggaaaaaagcaaagaggagcctgcctccggcaaggccgctctgggagattcaaaagaggacacacagaaagcgagtgaagaaaacttactgagcagctcctccgtgccctccgctgaccgggattctagtcccacgacgaacagtaagttatccgcattacagcggtcctcctgtagcaccccactctcacaagccaatcgctacacaaaagaacaggactaccgaccgaaagccactggtagaaagacaccgaccctggcctctccagtgccaacaacgccttttctgaggccagtacaccaggtgcccctcgtgcctcatgttccgatggttcggccagctcatcagctgcaccctggcctcgtgcagaggatgttggcacagggggtgcaccctcagcacctgccctccctgctgcagacaggagtccttccacctggaatggatctaagccaccttcaaggtatttctggacccatcttagggcagcctttctatcccctgcccgctgccagtcaccctctgctcaaccctcgcccaggcaccccacttcacttggcgatggtgcagcaacagttgcagagaagtgttcttcatccccctgggtccgggtctcatgccgctgccgtttctgtacaaactactcctcagaacgttccgtcgcgttctggcctgcctcatatgcactcccagctggagcacaggcctagtcagcgcagctcaagccccgtgggcctggcgaagtggttcggcagcgatgtcctgcagcagcctctgccgtcaatgcccgctaaggtcatttcagtcgatgaactcgaataccgacagtag

SEQ ID NO: 222557 - DNA, 1923 bp, Artificial Sequence
  Description of Artificial Sequence: Synthetic coding sequence
atgatcgaagacgtactaggtgagggctcagtttctgcatccagattttctcggtggtttagtaatccttctagaagcggatcgagaagctcaagtctcggcagcactcctcatgaagaacttgaaagattagctggactggagcaggctattctttctccaggtcagaacagtgggaattatttcgcccctattccacttgaggaccacgccgaaaacaaggtggatatactcgaaatgctgcagaaggccaaagtcgatctgaaacctttactttcttctctcagcgcaaataaggagaagttgaaggaatcctctcactctggcgtggtcctgtcagtcgaggaagtggaggcaggattgaaaggcttaaaagttgaccaacaggtgaagaactctacccctttcatggccgaacacctggaggaaacactttccgccgtgaccaataatagacagctgaaaaaggacggcgatatgactgcatttaataagctggtgtcaacaatgaaggcttcgggtacgctgccatcccagcccaaggtctccgaacttctcggtcagccagtccagagacctgcatcatccaacctgctgagcgggttgatgggtagcctggaacccacaacaagtctactaggacagagggccccatctccacccctgtcacaggtcttccagacacgggctgcctctgcggactacctgcgaccacggattcccagcccgattggatttacccccggaccccaacagctgctgggggacccctttcaaggaatgcgaaagccgatgagtcccatcactgcccagatgtctcagctggagctccagcaggcggctctggaaggccttgctctgcctcatgacttggctgtgcaggctgcgaatttttatcagccagggtttggtaagcctcaggttgaccgcacacgggatggattccggaacaggcagcagcgcgtgactaaaagccctgcccctgtgcatagaggaaactcctccagcccagcccctgccgcaagcatcacctccatgctgtctccttcttttacccctacctccgtgatacgcaagatgtatgaatctaaagagaagtcaaaagaagagcctgcttcgggcaaagctgctctgggcgattcaaaagaggatactcagaaggctagcgaagaaaacctgcttagcagttccagcgtgccctccgcggacagagactcaagcccaaccaccaatagcaagctctcagctctgcagcgctcatcctgtagcacccccctgtcacaggcaaatagatacacaaaggagcaagattaccggccaaaagccactggaagaaaaacacctacactggcttctcccgtccccacaacacccttcttacgccctgtgcaccaggtgccgttggtgccccatgttccgatggtaagacccgcacatcagctgcacccgggactcgtccaaagaatgctggcccaaggtgttcacccccagcacctcccatcattgcttcagacaggagtcctaccccctggcatggatttaagccaccttcagggcatctccgggccaattttgggacagccattctaccccctgccggcagctagtcatccgctgctgaacccgaggcccggaacccctctgcatttggccatggtgcagcaacaactccaaagaagcgttctgcaccctccgggaagcggtagtcacgctgcagccgtgtccgtgcagactactccacagaacgttcccagcagatcaggtctgccgcacatgcactctcaactggagcatcggccttcacagcggagcagttccccagtcggactcgcgaaatggttcggtagcgatgtgctccaacaaccgctgccctccatgccagcgaaagtgataagtgtcgacgaattagagtaccggcagtag

SEQ ID NO: 222558 - DNA, 192 bp, Artificial Sequence
  Description of Artificial Sequence: Synthetic coding sequence
atggaccgcagatccatgggcgaaacagaatccggcgatgcgtttctggacctcaagaaaccaccagcaagcaagtgtccccatcgatacaccaaggaagagctcttagatattaaagaactgccccacagtaagcagcgtccttcctgtctctccgagaaatatgatagtgatggtgtttgggatccctag

SEQ ID NO: 222559 - DNA, 192 bp, Artificial Sequence
  Description of Artificial Sequence: Synthetic coding sequence
atggatcgacgctccatgggagagaccgagtcaggggatgcatttttggacctgaaaaagccacctgcctcgaaatgtccccatagatacacgaaagaagagctcctggacataaaagagctccctcatagtaaacagcgaccctcctgtctgtctgagaagtacgatagtgatggcgtctgggatccctag

SEQ ID NO: 222560 - DNA, 2886 bp, Artificial Sequence
  Description of Artificial Sequence: Synthetic coding sequence
atggatcgacgcagcatgggggagactgagtcaggtgacgcttttttagacctgaaaaagccccctgcctcaaaatgccctcatcgttacaccaaggaggaactccttgatatcaaggagctgccccacagtaaacagagaccttcctgtctgagtgagaaatatgactcggacggggtgtgggaccctgagaaatggcacgccagcctgtaccccgcttcaggacgctcttctcccgtagaaagtctgaagaaggagctggacacagatcgaccctcactagtgcggagaatcgtcgaccctcgcgaaagagtcaaggaggatgacctcgacgtcgtgctatcaccccaaaggaggtccttcggaggtgggtgtcacgtcacggccgcagtgtcaagtagacgttctgggtctcctctggagaaggattctgacggcttgaggttgctcggagggagaagaatcggctcagggagaattatttccgccaggacctttgagaaggatcataggttgtctgacaaggacctcagagatctaagggaccgggaccgggagcgtgattttaaagacaagcgattccgtagagagttcggcgatagcaagcgtgtgtttggcgagagaaggcgcaatgactcctacaccgaggaagaacctgaatggttcagcgcgggacccacctcccaatcagagactatcgaactgaccgggttcgatgacaagatcttagaggaagatcacaaaggacgcaagaggacacgcagacgaactgctagcgtcaaggaaggcattgtcgaatgcaacggcggagtggccgaggaggatgaggttgaagttattttggctcaggaaccagcagcagaccaggaggtcccccgagatgcggtgctgcctgagcagagccccggagacttcgactttaacgaattcttcaatctagacaaggttccgtgtctcgctagcatgattgaggacgtgctgggggagggttcagtgtctgcctctaggttctcccgttggtttagcaaccctagtcgtagcggctcccggagcagttcactgggttcaactccgcatgaggaattggaaaggctggcagggctggagcaggccattctgtcgccaggtcagaactctgggaactattttgcaccaatccccctggaggaccacgccgagaataaagtcgatatcttagaaatgctgcagaaagcgaaagtggatctcaaaccactcttgagcagcttgtcagccaataaggagaagctgaaagagagcagccattccggagtcgtgctgagtgtggaggaggttgaggccggtctgaaaggcttaaaagtagaccagcaggtcaagaacagcactcccttcatggctgaacaccttgaagagacattatcggcggttactaataaccgtcagctcaagaaggatggggatatgactgctttcaacaagctcgtctcgactatgaaggcgtcgggaaccctgccttcccagcccaaggtctccgaactgctggggcagcccgttcaacgacctgcttcctctaatttgctctccgggctgatggggagtctggaaccaactacctcactcctgggacaacgtgcaccgtcccccccactgtcacaggtctttcagactcgcgctgcttcagcagactatctgaggccacggattccctctcccattggatttacacctggacctcagcaacttcttggagacccttttcaagggatgaggaaacccatgagcccaatcacggcccagatgtcccagctggaactgcagcaggccgctctcgaagggctcgccctgcctcatgatctggctgtccaagcagccaatttttaccaaccaggcttcgggaaacctcaggtcgatcgtacaagggacggcttcagaaatcgacagcagcgggtgactaagagccccgctcccgtgcatcgtggtaatagcagctctccggcaccagccgcaagtattactagcatgctgagtccctctttcactcctacctcagtgatccgtaagatgtatgagagtaaagagaaatccaaggaggaacctgctagtggcaaggcagctctcggcgacagtaaagaggatactcagaaagccagtgaagagaatctgctctccagctccagcgttcccagcgccgatagagattcctcaccaaccaccaactctaagctgtccgctctccagcgctcatcatgctctacccccctctcccaagctaaccgatataccaaggagcaggactaccgccctaaagccactggcagaaagacaccaaccttggcctctccggttccaaccaccccctttctgagaccagtgcatcaggtgcctcttgtgcctcacgtgccaatggtgcgcccagcccatcagctccaccccggactggttcagcggatgctcgcccagggcgtccatccacaacacctcccgtccctgctccagacaggagtcttaccccctggcatggacttatcacatttacagggaatctccgggcctatcctggggcagcccttctatcctctaccagctgcatcacatcccctgctgaatcctcggcctgggaccccacttcacttggcaatggttcagcagcagcttcagcggagcgtactccacccccctggatctggctctcatgcagcggctgtatctgttcaaacaactccccagaatgttcctagtcgcagtggactacctcacatgcacagccagctcgagcaccggccttctcagcgcagctcttcacctgtgggcctggccaagtggtttggctcggacgttctccagcagcctctgcctagcatgcccgctaaggtgatcagcgtagatgagctggaataccgtcaatag

SEQ ID NO: 222561 - DNA, 2958 bp, Artificial Sequence
  Description of Artificial Sequence: Synthetic coding sequence
atggaccggcgaagtatgggggagaccgaatccggggatgctttccttgacttaaagaaacctcctgcatcaaagtgtccacatagatacaccaaggaggagctcctcgatataaaggagctgccgcattcaaagcagcggccaagctgcctcagcgaaaaatacgattccgatggagtgtgggatcctgagaaatggcatgcttcactctatcctgcctcgggcaggtctagtcccgtggaaagtctcaaaaaggaactggatacagacagaccttccctcgtgcgccgaattgtggatccgagagagcgagtgaaagaagatgatcttgatgtcgtgctttccccccagagaaggtcctttgggggaggttgccacgtcaccgccgctgtcagctctaggcggtcaggctctcctctagagaaggactccgatgggttacgtctcctcgggggtagacgcattgggtctggaagaataatctctgccagaacctttgaaaaagatcaccgtctgtcagataaagacctgagagacctgagggatcgagaccgggagcgcgactttaaggataagagatttcgcagagagtttggggattctaagagagtgttcggggaaagaagacggaatgattcctatactgaggaggagcccgagtggttcagtgccggaccaacctcacagagcgaaacgattgagttaactggattcgacgacaaaatactggaggaggaccataaaggcagaaaaaggacacggcgacgcaccgcctccgttaaggaggggattgtggaatgcaatgggggagttgcagaggaggacgaggttgaagtcatcctggcacaggagccagctgcagaccaggaagtgcccagagacgccgtgttacccgagcagtctcctggggactttgattttaatgaattttttaatctggacaaagtcccctgtctggctagcatgatagaggacgtcctcggcgagggatccgtgtccgcctccagattttcacgatggtttagtaatccgtctaggtccgggagccgcagtagctctctgggaagcaccccccatgaagagctcgagagattggccggacttgagcaagccatcctgtcccccggtcaaaattcggggaattactttgccccaatccccctcgaagatcacgccgaaaataaagtggatatcctcgaaatgctgcaaaaggctaaagtcgaccttaagcctctgctaagctccctttcagccaacaaggaaaagctcaaagagtctagccatagtggtgtggtgctgtccgtggaggaagtcgaagctggcctcaagggactcaaggtggaccagcaggtaaagaattccactcctttcatggccgagcacctggaggaaactctgtcggctgttactaacaatcggcagttgaagaaggatggggacatgacagcgtttaacaagctggtgagtactatgaaagccagtgggactcttccttcccagccaaaggtgagtcggaatttagagtctcacttgatgagtcccgctgaaatccctgggcagccagtgccaaagaatattttacaggagctactggggcagcccgtccaacgtcctgccagcagcaacttattgtccggcctgatgggctccctggagcccaccacctccctgttaggccagcgtgcccctagcccacccttgagtcaggttttccaaaccagggccgctagcgcagactacctgaggcccagaatcccatcacccataggtttcacacctggcccacagcagctgctgggtgatccctttcagggcatgcgtaaacctatgtcaccaatcactgcacaaatgtctcagttggagcttcagcaggcggctctggaaggcttggctctcccacacgatttggctgtgcaagcggcaaatttctatcaacccggattcgggaagccccaggtcgataggaccagggacggattccggaaccggcagcagagggtaaccaaatcacccgcaccagtgcacagaggaaacagtagctccccagcaccagctgcgtctattacaagtatgctgagtccctctttcacccctacgagcgtcatcagaaagatgtacgagtctaaagagaagtccaaggaagagcctgccagcggcaaggctgctttgggtgactccaaagaggatacacagaaggcgagtgaggaaaacttactctcatctagcagcgttccatccgcggatagggactcctcccctaccactaactcaaagcttagtgccctgcagcgctctagctgttcaacaccactttcccaagcaaaccgctacaccaaggaacaagactacagaccaaaggccaccggcaggaagactcccacattggcttcaccggtcccaacaaccccttttttgcgacccgtgcaccaagtgccccttgtcccgcatgtgcccatggtgcgccctgctcaccagttgcatcctggtctggtgcagcggatgctggcacaaggggttcacccgcagcacctgccatctctattacagactggggttctccccccaggtatggacctgagccacctgcaggggatctcaggccctatcctggggcaacccttctacccactccccgcagccagccatcctctgcttaaccctcggcctgggacaccattgcatttggcaatggtgcaacagcagctgcaacggtccgtactccatcctcctggatccggctcacacgctgcggctgtctctgtgcaaaccacacctcagaatgtcccctccagaagtggtctccctcacatgcactcccagctggaacacagaccgagccagcgttcttcttcgccagtaggcctcgccaagtggtttggcagcgatgtgctacaacagccactcccatcaatgcctgccaaagtgatcagcgtggacgaactggaatatcggcaatag

SEQ ID NO: 222562 - DNA, 1311 bp, Artificial Sequence
  Description of Artificial Sequence: Synthetic coding sequence
atggacaggcgaagcatgggcgagaccgaaagcggagacgccttcttggatctgaaaaaaccaccagccagtaaatgcccccaccggtatactaaggaagaactgctggacatcaaggagctgcctcacagtaaacagaggcccagttgtttgtctgagaagtacgattcggatggggtatgggatcccgagaaatggcacgcaagcctttacccggcttcaggacgttcctcccctgttgaatcactcaagaaggaactcgatacagaccgaccatcactagtgcgcagaatagtggacccgagggagcgggtcaaagaggacgatctcgacgtcgtcttgtccccgcagagaaggagcttcggtggagggtgtcacgtgacagctgccgtgagttcaaggcgatcgggttcgcctctagaaaaagacagtgacggcttaagactgctgggcggacgcagaatcggatctggtaggattattagtgctcgcactttcgagaaggaccatcgcctgagcgacaaagatctgcgggatctgcgcgatagggatcgtgaaagggacttcaaggataagcggtttcgtagagagttcggcgatagtaaacgggtcttcggggagcgcaggaggaatgattcgtacacggaggaggaaccggaatggttttctgcaggcccaacctcccagagcgagaccatcgaactaactggttttgacgataaaatcttagaggaggaccacaagggtaggaaaaggacccgtcgcagaacggcatcagttaaagaaggcatcgtggagtgtaacgggggagttgcagaggaggacgaggtggaggttattctggctcaggagcctgccgctgatcaggaagtacctagggacgccgtcctccccgagcagagcccgggagacttcgatttcaacgaattcttcaatctcgacaaagtgccttgcctggcaagcatgatcgaagatgtgttaggggaagggagtgtgagtgcctcccgatttagccgctggttttcaaacccatcgcgatccgggtctcgatcatcttccttggggagtactccccacgaagaactggagaggttagcaggactcgagcaggctatcctgagccctggacaaaactcaggaaattattttgcccctatccccttggaggatcatgccgagaataaggtggacatcctggagatgctgcagaaggccaaagtggatcttaaaccgctgctgtcctctctgagcgctaataaggaaaaactgaaggagagccttaggttgtcacccaaaaagaagaagaaatag

SEQ ID NO: 222563 - DNA, 567 bp, Artificial Sequence
  Description of Artificial Sequence: Synthetic coding sequence
atggaccgtcggtcaatgggcgagactgaatcgggcgacgcctttttggatctcaaaaaacctcctgccagcaagtgcccacatcgttacaccaaggaagagctcttagacatcaaagaactcccccattctaagcagagacctagctgtctgtcggaaaagtacgacagcgatggggtgtgggaccccgaaaagtggcacgcatcactatacccagcatcaggacgttcaagtccagtggaatcgctgaaaaaggaattagataccgaccgcccatcactggtgcggcgtatcgtggacccaagggaacgtgttaaggaagatgatctggatgtggtgttgtcaccacaacggaggagtttcggcggaggttgtcatgtgacagctgcagtgagctcgagacggtccggaagtcccctagagaaagacagcgacggcttacggttgcttgggggtagacgcatcgggagtggcagaatcataagtgctcggactttcgagaaggaccatagactttctgacaaggaccttagagacctgcgagaccgggatcgcgagagggactag

SEQ ID NO: 222564 - DNA, 747 bp, Artificial Sequence
  Description of Artificial Sequence: Synthetic coding sequence
atggcagatttcgatacttacgatgaccgagcatattcatccttcggcggaggacggggaagcaggggcagtgctggaggtcacgggagtaggtcccaaaaagaactcccaaccgaacccccatacaccgcatatgtcgggaacctgcctttcaatactgtgcagggcgacattgacgcgatctttaaagatcttagcatacggagcgtgaggctcgtgcgcgacaaggatacagacaaatttaaaggcttttgttacgtggagttcgacgaagtggatagtctaaaagaggctttgacttatgacggagcacttttaggggacaggtctctgagggtggacattgccgaaggcagaaagcaggataaagggggattcggcttccgcaaaggcggacccgacgatcgagggatgggcagctctcgagaaagccggggaggctgggactctcgagacgattttaattccggcttccgcgatgatttcctgggaggacggggtggatccagaccaggtgatcgcagaacaggccctcctatgggcagccggtttagggacggaccgcctttaagaggaagcaatatggacttcagggagccaacggaagaggaacgcgcacaaagaccgcgtctgcaattaaagcccaggacagttgccacacccctaaaccaggtggcaaacccaaattccgctatcttcggcggagcccgaccacgagaggaagtcgtccagaaagaacaggagtag

SEQ ID NO: 222565 - DNA, 687 bp, Artificial Sequence
  Description of Artificial Sequence: Synthetic coding sequence
atggccgacttcgatacgtacgatgacagagcgtactcatcttttggcggaggccgaggcagtagaggaagtgccggtgggcacggctctcggtcccagaaggaattacccactgagcctccctacactgcctatgtcggcaatcttcccttcaatacggtccagggcgacatcgatgccatattcaaagatctctccattaggtccgtgcgccttgtgcgcgacaaagacacagacaaattcaagggattctgctacgttgagttcgatgaggtggatagtctcaaagaggctcttacctatgacggggctctgctgggagatcgtagtttacgggtggacatcgccgaaggtcggaagcaagacaaaggcggtttcggctttagaaaggggggacccgatgatcgtggattcagggacgacttcctcggaggtcggggaggctcacggccaggggacaggaggacggggcctcccatgggatcccggttccgagatggccctccactgaggggttcaaacatggattttagagagcccactgaggaggagagagcccagcgccctcggttgcagctgaagccacgtaccgtggctacccctcttaatcaggtcgctaatcctaactcagcaatattcggcggtgctagaccacgcgaggaggttgtgcagaaagaacaggaatag

SEQ ID NO: 222566 - DNA, 1050 bp, Artificial Sequence
  Description of Artificial Sequence: Synthetic coding sequence
atggaagctcacaacgcatcagccccattcaactttaccctcccacctaactttggcaagaggccaacagatctggctctttcagtgatccttgtgttcatgttatttttcatcatgctgagtctcgggtgcaccatggagtttagtaagattaaagcccatctctggaagcctaaaggtctagcaatcgcgcttgtggcacagtacggaatcatgcccctcaccgccttcgtgctgggcaaagtgttccggctgaaaaacatagaggctctggctattctggtctgcggatgctcacccggtgggaacctgagcaatgtattctcgctggcaatgaagggtgatatgaatctgtcaatcgtgatgaccacctgcagtactttttgtgccttaggaatgatgcctttgctgttatacatttatagccggggaatttacgacggtgatctaaaggataaagttccatacaagggtatagtgataagcctggtactagtgcttattccctgcacaattggcatcgttctgaagagcaagcgccctcagtacatgaggtacgtgataaagggaggaatgattatcatcctgctgtgtagcgtagccgttactgtgcttagcgcgattaacgtggggaagagtatcatgttcgctatgacacctctgttgatcgcaacctcctcacttatgccctttatcggctttctgcttggatatgtgctcagcgcgctattctgtctgaatggacgctgcaggagaacagtttcaatggagactggctgtcagaatgtacagctgtgctccacgatcctcaacgtcgcttttccacccgaagtcattggacccctttttttcttccccctcttatacatgatttttcagctgggagaaggcttactcctcatcgccattttctggtgctatgagaagttcaaaacccccaaagacaaaaccaagatgatctacactgctgccactacagaagagacaatcccaggcgcattaggaaacgggacatacaagggggaggattgcagcccttgcaccgcttag

SEQ ID NO: 222567 - DNA, 1296 bp, Artificial Sequence
  Description of Artificial Sequence: Synthetic coding sequence
atgtctgtgaatgtaaatagatctgtaagcgatcagttctaccgttacaaaatgccaagactgatcgccaaagtggagggtaagggcaatgggattaagacggtgattgtgaacatggtagacgtcgcgaaagcccttaaccgacctcctacctatcctactaaatacttcggttgcgagctgggtgcccagacacaatttgacgtcaaaaacgatcgctatatcgtgaacggctcccatgaagctaacaaattgcaggacatgctggacggttttataaagaagttcgtgctgtgccctgaatgcgagaacccagaaaccgatttgcacgttaatccaaaaaaacagaccataggaaactcctgcaaggcctgtggttatagagggatgttagatacccaccacaaattgtgcacattcattctgaagaaccccccagaaaatagcgattctggcaccgggaagaaggaaaaagaaaaaaagaaccgaaaaggtaaagacaaagagaatggatccgtgtcatcctccgagacccctccgcctccccctccccctaatgaaataaaccccccaccacacacaatggaagaggaagaggatgatgactggggggaagacacgactgaggaagcccaaagacgacgaatggacgagatctcggatcacgccaaggtgttgaccttgagcgacgacctggagaggacgattgaggagagggtcaacattctgtttgactttgttaagaagaagaaggaagagggcgtcatcgattcttcggataaggaaatcgtggcagaagctgagcgccttgacgtcaaggccatgggccctcttgtgctaacggaggtgctgtttaacgagaaaattcgcgagcagattaaaaaatacagaaggcactttctgcgattctgtcacaacaataagaaagctcagagatacttactccacgggttagaatgtgtggttgctatgcatcaagctcagctgatttccaagatcccccacatactgaaagagatgtatgatgccgatttactggaagaagaggtgattatctcttggtcagagaaggcttcaaagaagtacgtcagcaaagaactggcaaaagagattagggtgaaagccgaaccgtttatcaagtggctaaaggaggccgaggaggaatccagcgggggagaggaggaagacgaggatgagaacattgaggtggtgtatagcaaggccgcttctgtcccgaaggtcgaaacagtgaaatccgacaacaaagacgatgacattgacatagatgctatctag

SEQ ID NO: 222568 - DNA, 603 bp, Artificial Sequence
  Description of Artificial Sequence: Synthetic coding sequence
atgagcgtcaacgtgaaccggagcgtgtctgatcagttttacaggtacaaaatgcctcgcctgattgcaaaggtcgagggtaaagggaatgggattaaaaccgttattgtaaacatggttgatgtggctaaagctctcaaccggcctcctacttatcctactaaatacttcggatgtgaactcggtgcccagacccaatttgatgtcaagaacgaccgatacatcgtgaatgggagccacgaggctaataaactgcaggatatgttggacggttttatcaagaagttcgtgctttgccctgagtgtgaaaaccccgaaacggatctgcacgttaaccccaagaagcagactatcgggaacagctgtaaggcatgtgggtaccgagggatgcttgatactcaccataagctgtgtacctttatccttaaaaatccccctgagaacagcgactccgggacgggcaaaaaagaaaaggagaaaaagaatcggaagggcaaagataaggaaaatgggtccgtctcttcctcagagaccccaccacctcccccacctccaaacgagattaacccacccccacatacgatggaggaagaggaggattag

SEQ ID NO: 222569 - DNA, 441 bp, Artificial Sequence
  Description of Artificial Sequence: Synthetic coding sequence
atgtcagtcaatgtgaacagaagcgtctctgatcaattctacagatacaaaatgcctcgccttattgctaaggtcgagggtaagggaaacggaattaaaaccgtcatcgttaatatggtagacgtggcaaaggcccttaatcggcctccaacgtatcccacaaaatacttcggatgcgagctcggcgcacagacacaatttgacgtgaagaatgaccgttacatcgtcaatggctcacacgaggcaaataaactgcaagacatgttagatggattcattaaaaaattcgtcctttgtcccgaatgcgagaatcctgaaaccgacctgcacgttaaccccaagaaacaaactatcggtaacagctgtaaggcatgtggctatcggggaatgttagacacgcaccacaagctgtgcacttttatcctcaagaatcccccatag

SEQ ID NO: 222570 - DNA, 1296 bp, Artificial Sequence
  Description of Artificial Sequence: Synthetic coding sequence
atgagtgtgaatgttaatcgctctgtctcggaccagttctatcgttacaagatgccacggctgattgctaaggttgagggaaagggaaatgggatcaaaaccgtaatcgtcaatatggtagacgttgccaaagccctcaacagaccgcctacgtatccaacaaagtactttggctgtgagctcggcgctcagacgcaatttgatgtgaagaacgatcgatacatcgtgaacgggtcccacgaggccaacaagctccaggatatgttagatggcttcatcaagaagtttgttttgtgtcccgaatgtgagaacccagaaaccgacctgcatgtgaatcccaagaagcagacaattggaaactcgtgtaaagcttgtggctaccgaggcatgctcgacactcaccataagctctgtacatttatcttgaagaacccccctgaaaatagcgattcaggaacagggaaaaaagagaaggaaaaaaagaacaggaagggcaaggataaggaaaatggaagcgtgtcaagtagtgagacacctcctccccctcccccacccaatgagatcaatcctcccccacacacaatggaagaagaagaagatgacgactggggcgaagataccactgaggaggcacagagaaggcgcatggacgagatttcagaccacgctaaagtcttgacactttctgacgatctggaaaggactattgaagaacgagtcaatattctgtttgacttcgttaagaagaagaaggaagaaggcgtcatagactctagtgataaagagatcgtcgcagaggctgaacggctggatgtgaaggctatgggacctctagtgctgacggaggtcctgtttaacgagaagatacgcgagcagataaagaagtatagacgccatttcctccgtttctgccacaacaacaaaaaagcacagaggtatctcttgcatggtcttgagtgcgtggttgccatgcaccaggctcagctgatttccaagatccctcatattttaaaagaaatgtatgacgccgacctgctcgaagaagaagttatcatctcctggagtgaaaaagccagtaaaaaatatgtatccaaagaacttgcaaaggagattcgagtgaaggcagaaccctttatcaagtggctgaaagaagccgaggaggaatcctcaggtggtgaggaggaagatgaggacgagaatatcgaggtcgtgtacagtaaagccgcaagcgtgcctaaggtcgaaacggtcaagtccgataataaagatgacgacatcgacattgatgccatctag

SEQ ID NO: 222571 - DNA, 210 bp, Artificial Sequence
  Description of Artificial Sequence: Synthetic coding sequence
atgtccgtcaacgtgaaccggagcgtgtcagaccagttttacagatacaagatgccacgcctcattgccaaagttgaggggaagggcaacggaataaagacagtaatcgtcaatatggtggacgtagccaaggcactgaaccgcccacctacataccccacaaagtactttggatgcgagcttggtgcccaaacacaattcgacgtgtag

SEQ ID NO: 222572 - DNA, 330 bp, Artificial Sequence
  Description of Artificial Sequence: Synthetic coding sequence
atgtccgtgaacgttaaccgctcggtgtctgaccagttttatcggtacaaaatgccacgactgattgcaaaagtggagggaaagggcaacggaataaagaccgtgatagtcaatatggtggacgtggccaaagcccttaaccgacctcccacgtatcctactaaatattttgggtgtgaacttggagcacagacccagttcgacgttaagaacgaccggtacattgtgaacggaagccacgaagcaaataagctgcaggacatgttggatggcttcataaagaaatttgtgctctgccctgaatgtgaaaaccccgagaccgacctgtag

SEQ ID NO: 222573 - DNA, 306 bp, Artificial Sequence
  Description of Artificial Sequence: Synthetic coding sequence
atgtcagttaacgtgaacagatccgtttctgatcaattttataggtacaagatgcctcgcctcatcgccaaagtggaaggaaagggtaacgggatcaaaaccgtgatcgtgaatatggtggacgtcgccaaagcccttaatcgtcctcccacctatccgaccaaatatttcgggtgtgaactgggagctcaaactcagtttgatgtgaagaacgatcgttacatcgtgaacggcagccacgaggcaaacaagctacaggatatgctggacggattcataaagaaattcgtgctctgccccgagtag

SEQ ID NO: 222574 - DNA, 156 bp, Artificial Sequence
  Description of Artificial Sequence: Synthetic coding sequence
atgtccgttaacgtgaaccggagcgtctccgatcagttctacaggtacaaaatgcctagactaattgcaaaagtcgagggaaagggcaatggcatcaaaacagttatcgttaatatggttgacgtggcaaaagccctgaataggccccctacctag

SEQ ID NO: 222575 - DNA, 330 bp, Artificial Sequence
  Description of Artificial Sequence: Synthetic coding sequence
atgtccgtgaatgtgaatcgtagcgtgtcggatcagttctatagatacaagatgcctcggctgattgcaaaagtggagggaaaggggaacggcattaaaacggtgatcgtgaacatggtagatgtagccaaagcactgaacagaccacccacctacccaacgaaatacttcggatgtgaactgggagctcagactcagttcgatgtgaaaaatgatagatacatagtcaatggatcgcatgaggccaataagctgcaagatatgctggacggcttcataaaaaaatttgtgctctgcccagagtgtgagaatcctgaaaccgatctgtag

SEQ ID NO: 222576 - DNA, 555 bp, Artificial Sequence
  Description of Artificial Sequence: Synthetic coding sequence
atgtgtgggactggaggtactgattccaaaacaagacgaccccctcacagagcaagttttctaaagcggctggaatcgaagccactcaagatggctgatgatctggactttgaaacgggcgacgccggtgcctctgcaactttcccaatgcagtgtagcgcactccgtaagaatggtttcgtggtgttgaaagggagaccctgcaagattgttgagatgagtacaagcaaaaccgggaagcacggtcatgcaaaagtgcatcttgttgggatagatatcttcactgggaagaagtatgaagatatatgtccatcgactcacaacatggatgtcccaaatataaagcggaatgatttccaattgataggtatccaggacgggtacctctccctgttacaggactcaggagaggtgcgcgaggatcttcggctgcctgagggggatttgggcaaggagatcgagcagaagtacgactgcggggaggagattttgatcactgtgctctccgccatgacggaggaggccgcagtggccattaaggcgatggccaagtag

SEQ ID NO: 222577 - DNA, 465 bp, Artificial Sequence
  Description of Artificial Sequence: Synthetic coding sequence
atggcggatgacctagacttcgaaacaggtgatgcaggcgcaagcgctaccttccccatgcagtgttctgcacttcgtaaaaacggattcgtggtgctgaaagggaggccatgcaaaattgtggagatgagtactagtaaaaccggaaagcacggacatgccaaggtgcatttagtgggaatcgatatcttcactggcaaaaagtacgaagacatctgtccatccactcataacatggatgtgccaaatatcaagaggaatgacttccagctgattggaattcaggacggatatctaagtctcctgcaggattcgggggaggttagagaggatctgcgtctgcctgagggcgatctgggtaaagaaattgaacaaaaatatgactgcggcgaggaaattcttatcaccgtgttaagcgctatgacggaagaagctgcagtcgccatcaaagctatggcaaaatag

SEQ ID NO: 222578 - DNA, 645 bp, Artificial Sequence
  Description of Artificial Sequence: Synthetic coding sequence
atgacttggacatcccgtcaggaaatgcagggccctcaacctccttctcaatgttctgcccaacattatgtgaggatggcactgtggtgctctaaggctggccacgtgaggtcatcacgctgtctgttgcgcaggcttgcttctaccgcgacacctcgactggagttccacttgcggatcttgcctagtccctgtctccaatatctttggaggtctcagcaacaagcagccaattcagccgattttccgctgacactgttactcctgagcgactgcttctgtcttgccctgtcgctccatacccatagtgacaactacacctgttccccggtgttcagcctgttttgtggttacccatccgtgccagccagcttctctggctctcccagtgtctcacctgccctctgccaatccttgcagttcatcggcctttatgcactggcgatccagctgctgttgccctattcatggttcagcttatttctgtcgagcctggaaccactgctgtccggctgctttcatcacgttgcacagggtttcagtaactctacaccttcccctggcggtactccagcatctattctgtccttccaggtcacactgctgctgaggagccccgtcctcgccttcccactggagttgtag

SEQ ID NO: 222579 - DNA, 465 bp, Artificial Sequence
  Description of Artificial Sequence: Synthetic coding sequence
atggcagatgatctggattttgaaaccggtgacgcgggagcttcagctacatttccaatgcagtgttccgccctgcgtaaaaatggattcgtagtcctgaaagggcgaccctgcaagatcgtcgagatgtcaacaagtaagactggcaaacacggccacgccaaagtccatctcgtgggtatcgacatcttcactggaaaaaaatacgaggatatatgcccgagcacacataacatggacgtccctaacattaagcgtaatgacttccagctgatcgggatccaagacggatacttaagtctgctgcaggatagcggggaggttcgagaagacttgagattgcctgaaggagacctgggaaaagaaattgaacagaagtacgattgtggggaagaaatcctgattaccgtcttatcagcgatgaccgaggaagccgcagtggcaattaaagccatggcaaaatag

SEQ ID NO: 222580 - DNA, 465 bp, Artificial Sequence
  Description of Artificial Sequence: Synthetic coding sequence
atggcagacgatcttgattttgaaaccggtgacgccggagccagcgcaactttccccatgcaatgcagtgcgctgcggaaaaacgggtttgtggtgctgaaggggaggccttgcaaaatcgtcgaaatgtccacttctaaaaccggtaagcacgggcatgctaaggtacatcttgttggcattgacatctttacagggaagaaatacgaagatatctgtccatcgacacacaacatggacgtgcccaacatcaaacgcaatgactttcagctcatagggatacaggacggctacctcagtctccttcaagatagcggcgaggtgcgggaagacttaagacttccagaaggggacctcggcaaggagattgagcaaaagtacgactgcggagaagagatattgattactgttctgtcagccatgaccgaagaggccgcagtcgctatcaaagccatggcaaaatag

SEQ ID NO: 222581 - DNA, 462 bp, Artificial Sequence
  Description of Artificial Sequence: Synthetic coding sequence
atggcagacgagattgacttcaccactggagatgcaggcgcatccagcacctatcctatgcagtgctctgccttaagaaagaatgggttcgtggtcctcaaaggtaggccatgtaaaatcgtggagatgtctacctcgaagacagggaagcatggacacgccaaggtgcacctcgtggggattgatatttttaccggaaagaagtacgaggacatctgcccatctacacataacatggacgtgcccaacatcaaaagaaatgactaccagctgatctgtattcaagacggatatctgagtttactcactgaaaccggtgaagtcagagaggacctgaagctgcctgagggtgagctaggcaaggagattgaaggaaaatacaacgccggagaggacgttcaagtgtccgttatgtgtgcgatgtcagaagagtacgcagtcgctataaaaccgtgcaagtag

SEQ ID NO: 222582 - DNA, 738 bp, Artificial Sequence
  Description of Artificial Sequence: Synthetic coding sequence
atggctgtccgggcttcctttgagaacaactgcgagattgggtgtttcgccaaactgaccaatacgtattgcctggtagccattgggggttccgaaaacttctactcagtcttcgagggggaactgagcgacacaatccctgtggtgcatgcgtctatcgccggatgccgcataattggaaggatgtgcgtgggaaaccgtcacggtctgctggtccccaacaatacgactgaccaggagttacaacatattaggaatagcctgcctgatacggtgcagatcaggagggtggaggaacgactgagcgcattggggaacgtgaccacttgcaacgactacgtagcccttgtgcaccccgacttagaccgcgagacggaagagatcctggccgatgtgctgaaggtagaagtgtttaggcagacggtggccgaccaggttctggtggggtcctactgcgtattctccaatcagggcggtttggtccatcccaagacatccattgaagaccaagatgaattatcatccctcttgcaggtgccgctggtggctggaaccgtaaatcgcggatccgaagtgatagcagccggaatggtggtcaatgattggtgcgctttttgcggtttggataccacatcaacggaactcagtgtggtagagagcgtctttaaacttaacgaggcccagccctcaacaattgctacctcaatgagagacagcctgatcgatagcctgacgtag

SEQ ID NO: 222583 - DNA, 681 bp, Artificial Sequence
  Description of Artificial Sequence: Synthetic coding sequence
atggccgtgagggcttcattcgaaaacaactgcgaaatcgggtgcttcgccaagctgaccaacacatactgccttgtcgctatcgggggatctgagaacttttataggtgcggaggctcgcccggtgcttacggtgggggtgaggcctgtgccggagtgaaatcttctggctccggaagggtgccagcccctctcccgcgacaccacagagtccatgtccccacagtttgctcaagagccagcagtccgatacctagcccatggtgtactcgtctgagtcctgccgctgcttcaagcggggcatgtgtgtgggagaccgaggagatccttgccgacgtgctcaaggtggaggtgttcaggcaaaccgtggcggaccaggtcctggtcggctcctactgcgtcttttccaatcaaggcggattggtgcacccaaagacttccatcgaagatcaagacgaactgagttcacttctccaagtgccactggtcgcaggaaccgtcaataggggcagtgaggtgatcgcagccggtatggtggtgaacgattggtgtgcattctgcggtctggacactacaagtacagagctgagtgtagttgaatccgtgttcaagctgaatgaagcgcagccaagcaccatcgcgacctcaatgcgggattcgcttattgacagcctgacttag

SEQ ID NO: 222584 - DNA, 738 bp, Artificial Sequence
  Description of Artificial Sequence: Synthetic coding sequence
atggccgttagagccagcttcgaaaacaattgtgaaataggttgcttcgccaagctcaccaatacctactgtcttgtggccatcgggggtagcgagaacttttactccgtctttgagggggagctgtctgataccatccccgtcgtccatgcctctatcgcagggtgcaggataatcggacggatgtgtgtcggaaatcgccatgggcttctggtgcccaataatacaactgatcaggagctgcagcacataaggaactcactccccgacacggttcagatccgaagagtggaagagcgcctgagcgccctcggcaatgtgaccacttgtaacgattacgttgccctcgtgcatccagatctggaccgagaaacagaggagatactggctgatgtgctgaaggtagaagtatttcgtcagactgtggctgaccaggttctagtgggatcgtactgcgtgttctctaatcaggggggacttgtgcaccctaagacgtcaatcgaagaccaggatgaactcagctccttactgcaagtacctttggtggcaggaaccgtcaatcggggtagcgaggtaatcgctgccggaatggtggtcaacgattggtgtgctttctgtggtcttgacaccacctcaactgagctaagcgtcgtggagtctgtctttaagttgaatgaagcccagccatccacaatcgccacctcaatgagggatagtcttatcgactcgctgacatag

SEQ ID NO: 222585 - DNA, 327 bp, Artificial Sequence
  Description of Artificial Sequence: Synthetic coding sequence
atggcagtccgtgccagcttcgaaaataactgcgaaattggctgttttgctaagcttaccaatacgtactgcttggttgcgataggcggaagcgagaatttttatagcgtctttgaaggcgaattgagcgatacgatcccggtcgtccatgccagcatcgcaggctgtcgcatcattggacgtatgtgcgtgggtaatagacacggactgcttgtacctaataacactaccgaccaagaactgcagcacattcggaacagcctgcctgatactgttcaaatccggcgagttgaggagcgcctgtcagcactagggaacgttacttag

SEQ ID NO: 222586 - DNA, 1314 bp, Artificial Sequence
  Description of Artificial Sequence: Synthetic coding sequence
atggcagacgatccgtctgcagccgacaggaacgtggagatctggaagatcaaaaaactgattaagtctctagaggccgctcgaggcaatggaaccagcatgatttctcttattatccccccaaaagaccagatcagcagagtggcaaagatgttagctgatgagtttggtacggccagcaatataaagtcccgggttaatcgcctgtctgtgctgggtgcaattactagcgttcaacagcgtctcaaactgtacaacaaagtgccaccaaatggcctggtcgtttactgcgggactatcgtgaccgaggagggaaaggagaagaaggtgaatattgatttcgagccattcaaacccataaacacgtccttatatctgtgcgacaataagttccatacagaagctctcaccgctctgttaagcgacgactctaagttcggattcatcgtcattgacggatccggagccttgttcggcacactgcagggcaacactcgggaagtacttcacaagtttacagttgatttgccaaagaaacatggcaggggcggtcagagtgcacttcgattcgcacgtctccggatggagaagaggcacaattatgtccgtaaggttgccgaaaccgccgtgcagctctttatctcaggcgacaaagtgaacgtagccggactcgtcctcgcagggtctgccgactttaaaacagaactgtcacagagtgatatgttcgaccagagactgcagagtaaagttctgaaattggtggatatctcatatggaggagagaacggatttaatcaggccatcgagctctcaaccgaagtgctgagcaatgtaaagttcatacaggaaaagaagctgatcgggcgatacttcgatgaaatcagccaggacacaggcaagtattgctttggtgtggaagacaccctcaaagcactggagatgggcgctgttgaaatactgattgtttatgaaaatttagatataatgcgttacgtattacattgtcaagggacggaggaggagaaaattctttacttaactcctgagcaggagaaggacaagagccattttacagacaaggagaccggtcaggaacacgaactgatcgaaagtatgccactgctggaatggtttgccaacaattataaaaagtttggagctactctcgagattgtgactgacaagagtcaggaaggcagtcagttcgtgaaagggttcggcggaatcgggggaattctgaggtatcgagtcgactttcaaggaatggaatatcaggggggagacgacgagttttttgacctagacgactactag

SEQ ID NO: 222587 - DNA, 1215 bp, Artificial Sequence
  Description of Artificial Sequence: Synthetic coding sequence
atgatttctctcatcattccccctaaggatcaaatatctagagtcgccaagatgctggcggacgagtttggaaccgcctctaatatcaagtcccgggtgaatcgtctgtcagtgttgggagccatcacgagtgtacagcaaagattaaaactgtacaacaaagtccctcccaatgggctggttgtctactgtggaaccatagtaaccgaagaaggcaaagaaaagaaggtgaatatagattttgagccgtttaaacctatcaacacttccttgtacttatgcgataacaagttccacaccgaggcactaactgctctactgagtgatgattcaaaatttggcttcattgtgatcgatggctcgggtgctctcttcgggacacttcagggcaacaccagagaggtactgcacaaattcactgttgacttgcccaagaagcacgggaggggtggccagtcggccctgcgtttcgctcggttgagaatggagaaaaggcacaattacgttagaaaggtcgcagagaccgctgtccaactgtttatatctggcgacaaggtgaacgtggctggcctagtactcgcagggagcgcagatttcaagaccgaactgtcccagagcgatatgttcgaccagagattacagtctaaagtgctcaaacttgtggatatctcttatggcggagaaaacgggttcaatcaggcgatcgaactgtcaaccgaggtgttatcaaatgtcaagttcatccaagaaaaaaaactgatcgggagatattttgacgaaatttctcaggacactggcaagtactgcttcggggtcgaggacactcttaaggcccttgaaatgggtgctgttgagatactgattgtgtacgagaacctggatatcatgcggtacgtgctgcactgtcagggaactgaggaggaaaagatactctacctgactcctgagcaggagaaagataaaagccatttcaccgataaggaaaccgggcaggagcatgagcttatagagagcatgcctctcctggaatggtttgcaaataactataagaaattcggggcaacactggaaatagtgacagacaaatcacaggagggcagtcagtttgttaaggggttcgggggaatagggggaatcctgagataccgggtggatttccaggggatggaatatcagggcggagatgatgagttttttgacttggacgactactag

SEQ ID NO: 222588 - DNA, 1272 bp, Artificial Sequence
  Description of Artificial Sequence: Synthetic coding sequence
atgaagcaggacgtactcaattgcaccgagggcccaatccacagtaatggaacctccatgatctccttaattatacctcccaaggaccagatctcccgggtggctaagatgctggccgacgaattcggcaccgccagtaacatcaaatctcgcgtgaatcgactgtccgtactcggggctataactagcgtgcagcaacggctgaagttatataacaaggtcccaccgaacggcctggtggtctattgcgggaccatagtgaccgaagagggaaaggaaaagaaggtgaacattgattttgaacccttcaagccaattaacacatcactgtatctctgcgacaataaatttcataccgaagcactaacagccctactatcagatgattccaaatttggctttattgtgatcgatgggagcggagccctgtttggaacgttacagggcaacacaagagaggtcctgcacaagttcaccgtggacttgccaaagaaacacgggaggggcggacaatctgcactgcggttcgcgagactgcggatggagaaaaggcataactacgtgcgtaaagtagccgaaacagctgttcagctgttcatatccggggacaaggtgaacgtcgccggacttgtgttggctgggtcagccgacttcaagaccgaacttagtcagtcagatatgttcgatcagcgcctgcaatccaaggtgttgaaactcgtcgacataagctatggcggagaaaacgggttcaaccaggcaattgagctctcaaccgaagttttatccaacgtgaagtttatccaagagaaaaaattgattggccgatacttcgacgagatcagccaggataccggcaagtattgtttcggcgtggaagatactttgaaggccttagaaatgggcgcagttgaaatcctcattgtgtacgaaaatctggatatcatgagatacgtgttgcattgccagggcaccgaggaggagaagatactctatctgacccccgagcaggaaaaggacaagtcacacttcaccgataaagagaccggacaggaacatgagctgatagagtccatgccacttctggagtggtttgctaacaactacaaaaaatttggcgcaactcttgagattgtgaccgataagtcccaggaagggagtcaattcgtaaagggatttggagggattggaggcatcctgcgctaccgcgttgatttccaggggatggagtatcagggcggagacgacgagttcttcgacctggacgactactag

SEQ ID NO: 222589 - DNA, 1224 bp, Artificial Sequence
  Description of Artificial Sequence: Synthetic coding sequence
atggagtcccgcaaggacatggtggtgtttctagacgggggacagctgggcaccctggtgggaaagcgggttagcaatttgagcgaagctgtcggttctccgctcccagaaccgccagagaagatggtgccaaggggttgtctttcaccacgcgctgtgccacctgctactcgcgagaggggcggaggaggccctgaggaagagccagtggatggcctggcaggcagtgccgctgggcctggagctgagcctcaggtggctggggcagccatgctgggtcccggacccccagccccttccgtggattcactttcagggcaaggccaacctagcagttctgacaccgaaagcgatttttacgaggagatcgaagtttcctgcacccctgattgcgccaccggaaacgctgagtaccagcactcaaaggggtctggcagtgaagcccttgtgggcagtcctaacgggggatctgaaacccccaagagtaatggaggttctgggggaggtggctcacagggcacgctggcctgcagtgcgagcgaccagatgcgcaggtatcgtacggcattcactcgcgaacagattgctagacttgagaaggaattctatagggaaaactacgtctcgcggccacgcagatgtgaactggccgcagcactgaatctgccggagactactattaaggtgtggttccagaatcggagaatgaaggacaagaggcaaagattagcaatgacctggccccacccagcggaccctgctttttatacatacatgatgtcacatgccgcagccgctggcggactcccttatccgttcccttcccacctgcccctgccgtactatagcccagtaggcctgggggctgcctcagccgctagtgcggctgcaagccctttttccggttcactaaggcccctcgacacatttcgagttctgtcccagccttaccctagacccgaactgctgtgtgcctttcgacacccccctctgtatccagggccagcacatggtctcggtgccagtgccggaggcccttgttcttgtttggcctgtcatagtggtccggcaaatggactcgcaccgcgagctgcggcagcgagcgattttacatgcgcttccacctctcgttctgattcatttcttacatttgcccctagcgtgctatccaaagcatcctccgtcgcgctggatcagcgggaagaagtgcccttgacccgctag

SEQ ID NO: 222590 - DNA, 678 bp, Artificial Sequence
  Description of Artificial Sequence: Synthetic coding sequence
atgaggcggtaccggacagcatttactcgggaacagattgcacgtctcgagaaggagttctacagggagaattatgtgtccagaccccgtcgatgcgagctcgctgctgcccttaatctgccagaaacaactatcaaggtgtggttccagaaccgtcggatgaaagacaagcgacagcggctcgccatgacgtggccccaccccgctgacccagccttttacacctacatgatgtcacatgccgctgccgctggcggacttccctatccattcccatcacatctcccgctgccctactatagtccagttggactcggagccgcttccgcggcatcagctgcggcaagtcccttctctgggtcacttcgacccctcgatacattcagagtgcttagtcagccatatcctcggcctgaactgctctgtgcctttcgccacccccctttataccctggacctgcacacgggctgggagctagcgccggtggcccttgcagttgccttgcttgccactcaggcccagcaaacggtctcgctccaagagcagctgctgccagtgattttacatgcgcctcgacctccaggagtgactcatttctgacctttgcacctagtgtgttgagtaaggcctcctccgtggcgcttgatcagcgggaggaggtccctctgactcgctag

SEQ ID NO: 222591 - DNA, 1431 bp, Artificial Sequence
  Description of Artificial Sequence: Synthetic coding sequence
atgatggagaggatccgtaaagaaatgatcttgatggagcgcggactgcacagcccgaccgctgggaagcggtttagcaatctatcaaacagcgccggaaacgccgtactggaagccctcgaaaattcacagcaccctgcccgactctcccctaggttacctagcgccccattacactccgctttgggagagctgccagccaaagggaagttcgagattgatacactcttcaacctacagcataccggaagcgaatccactgtgtccagcgagatctcgtccgctgccgaatcccgaaaaaagcccggtcattacagcgaggcagcagccgaggcagacatgagtagcgatgtggaggtgggttgctccgctctgcgtagccctggcggtcttggggctgcacagctaaaagaaaataacggaaagggatatgcagagagtggctcggccgctggcactacaacatctgcatctggttcaggacttggaagtttgcacggaggaagcggcggatctggcggatcagccgctctcggcggatccgggtccggagctgaccaggttaggcggtatcgaactgcatttacccgcgagcaaatcgcaagactggagaaggaattttatagagaaaactacgtctctcggcctagaaggtgtgagcttgccgcagcactcaacctgcccgaaactaccattaaggtatggtttcagaaccgacgtatgaaagataaacgtcagcgtctcgccatgtcatggcctcatccagcagacccatctttttacacatacatgatgacacacgctgccgctacaggaagcctaccttacccttttcacagccatgtacccctgcattattacccccacgtgggagtaacagccgcagcagccgcagccgcagcaagcggcgcagcagccgcagctagttccccgtttgccacatctataaggccgcttgacacattcagagcactttctcacccgtattccaggcctgaactcctgtgttcatttcgccatcccggtctgtaccaggcccctgccgctgctgctggtttgaatagtgctgccagcgccgctgcagccgcagccgcagccgcagctgccgcatccagcgcagctgcagccggagcaccacctagtggcggatcagccccttgcagttgcctcagctgccatagcagtcagtccgcagccgcagcagcagccgctgccgctgccgctctcggttcaagaggagggggagggggaggagggggaggtggaggaggtggcggaggcggagcaggagcaggcggtggatcagacttcggctgctcagcggctgcaccccgtagtgaaagcggattcttgccatactcggcggcagtgctctctaagactgccgtgagcccacccgaccagcgggatgaagcacccttgactcgctag

SEQ ID NO: 222592 - DNA, 2781 bp, Artificial Sequence
  Description of Artificial Sequence: Synthetic coding sequence
atgtcccgcagacggaaacacgacgactccccctctccaaaaaaaaccccccacaagaccgtagctgcggaggagtgtggatcggtggtggagccaggccgaagacgactgcggtctgccagaggctcatggccatgcggagcacgagagggtccgccaggacctgttcggcagcgcgaacaaccacccacggctgccctgtgcagcaaatctaacccagaggaacggtatgagacccccaaacgggctctgaaaatggattccctatccagcagtttttccagcccaaacgacccagacggccagaatgacattttctgggatcaaaattcccccttaacaaagcagctgggaaaaggacgaaaaaagcagatatacactaccgacagtgacgagattagccatatcgtgaaccgaatagcccctcaggacgagaaaccgacaacgaactccatgttggacatgtggattggcgagacggctatcccctgcacccccagcgttgctaaaggtaaaagtagagccaagatctcttgcaccaaactgaagacccaatcacaggaggaggagctgatgaaacttgccaagcagttcgacaagaatatggaggaactcgatgtgatacaggagcagaacaaacgtaattatgacttcacacagatgatttccgagacggaaattttgtcaaactataaggataacatccagatgtggtctctacataacattgtacccgaaatcgacaacgccacaaaaaagccaatcaagggtaataccaaaatttcagtagcgaacaaccaaaacagttcccaaaaaccattcgatcaaatcgctgaagcagccttcaacgcaattttcgacggctccactcagaagtgtagtggccaactgtcacaggagctgccagaggcattctggtcaactagtaacaccacatttgttaagacaaacgctctcaaagaagaaaagatcataaccaatgagaccctagttatcgagaagctaagcaacaagaccccaaggtccctatcttctcaggtggacacgcctattatgacaaagtcatgtgttacaagctgcacgaaagaacccgagacctcaaacaaatatatcgatgcttttacaacttctgactttgaagacgattgggagaacctgctgggaagcgagcctttcgccatgcagaatattgatatgcccgagctcttcccttccaaaacagcccacgtcaccgaccagaaggaaatttgcacttttaatagcaaaactgtcaagaacacctcaagggcaaacacaagccctgacgcaaggctaggtgacagcaaggttctgcaggacttgagctcaaaaacatacgaccgagaactcatcgacgccgagtaccgcttttcccctaacagcaacaagtcaaacaaactgagcactggaaacaagatgaagttcgaaaattcttccaataagatcgtcattcaggacgagattcaaaactgcatagtcacttccaaccttacaaaaattaaggaagacattctgactaactcgaccgaagcttccgagaggaagagcgcactcaacaccagatacagtaatgaacagaagaacaaatgcattctgaaccagtctatcaaggctcccgtgaataccgacttgttcggctccgcaaatctgggttcgaaaacatctgtgagcaaccccaatcaaacttccgcctccaaggtcggaagcttttttgacgattggaatgatccctcatttgccaatgaaatcatcaaggcctgtcaccagctggacaacacgtgggaagcagatgacgtggatgatgacctgttatatcaggcgtgcgatgatatagagcggctcacccagcaacaagatatcaggaaggatagcaaaacttccgagagtatctgcgaaattaataacaacagtgagcacggtgccaagctgacccagcagcaagatataagaaaagactctaagacttctgagagcatttgtgaaattaacaataacagcgaacatggggcaaaaaacatgttcgctattagtaaacagggaagtaatctggttcagagcaagcatctgaatccaggctcgatctcggtgcaaacaagtctgacaaattccagtcagattgacaagcccatgaagatggagaaaggagagatgtacggcaatagccctaggtttctgggagccaccaatctcacgatgtactccaaaatttccaactgccagatcaataacctccacgtatcatacaccaacacagatgtgccaatccaagtgaattcatcaaagctggtgctgccagggtcttcatccctcaatgtgacatccgaccatatgaacaccgagattacaacttataaaaaaaagttgagcaccaaccaaccatgtcataaaaccgtgactgacgaagctcagagcaacctgaacactactgttggcttttcaaagtttacgttcacaaggatgaaaaattcccagatcctcagtcagtttaatcagaactgtattacagggtcaatgtccgacaccaagatcactcagggcgtggagaaaaaaaagggcgtgaatcctttactcgaagaggcagtgggacagcagtccctggtgaagctgtccgaaagcctgaagcaaagctctaaggaggaggaggaaaagaaccgtaagtgttctcctgaagagattcagcgtaagaggcaggaagctcttgtccggagaatggccaaagcacgggcatcgtccgtgaacgcggctccaacttcattcttgtag

SEQ ID NO: 222593 - DNA, 2349 bp, Artificial Sequence
  Description of Artificial Sequence: Synthetic coding sequence
atgggcaagcgagaccgggctgatcgagataagaagaagagtcggaagaggcattacgaggacgaggaggacgacgaggaggacgctcctggcaacgacccgcaagaagctgtgcctagtgcggctggaaaacaggtggacgagtctgggacgaaggtagatgaatacggagctaaggactaccgcctccagatgcccttaaaggatgatcacacatctagacccctctgggtggctcccgatggccatatctttttagaagctttcagccccgtttacaagtacgctcaggacttcctcgtcgccattgccgaacctgtgtgcagaccaactcacgtgcacgaatacaaattgaccgcttattcactctacgctgccgtgagtgtcggcctgcagacatcggacatcactgaatacctgcgcaagctgagcaagacgggggtgcctgacggcatcatgcagtttattaagctgtgtacagtcagctacggaaaagtgaagctcgttttgaaacataacagatacttcgtggagtcctgccaccctgatgtgattcagcatctgctgcaggatccggtgattagagagtgtcgtcttaggaacagcgagggggaagcaacggagctgataacagaaactttcaccagtaagtcagccattagcaagacagcggaaagctcagggggacctagtacatcaagggtgacggacccccagggaaaatcagacatccccatggacctgttcgacttttatgagcagatggataaggatgaggaggaggaggaggagacccaaacggttagtttcgaggttaaacaggaaatgattgaggagctgcaaaagcggtgcatccatttagagtatcccctgctagctgaatacgatttcaggaatgactcagtgaatccagacattaacatcgacctgaagccaacagcggtgcttcgcccataccaggagaagtctcttcgcaagatgtttggtaatgggcgagcccgatcaggggtaattgttctcccctgcggcgcaggaaagagcttagtgggggttacagctgcatgcacagtgcgaaaacgttgcctggtgctaggaaactccgccgtgagcgtcgagcagtggaaggctcagtttaaaatgtggtctactatagacgactctcaaatttgcagattcacgagtgacgctaaagataagcccatcggctgctccgtggcaatttccacttactctatgctggggcacaccaccaagcggagctgggaggcagagagagtaatggaatggcttaaaacgcaggagtggggcctcatgatccttgacgaggttcacactatcccagctaaaatgttcagaagagtcctcaccatcgtacaggcccactgtaagctggggttgacagccaccttggttcgggaagatgataaaattgttgatctgaacttcctgatagggccaaagctgtacgaagccaactggatggagctgcagaacaacggctacatagcgaaagttcagtgcgccgaggtctggtgtccaatgtctccagaattctaccgcgagtacgtggccattaaaactaaaaagcgaattctcctgtacaccatgaatccaaataaattccgtgcttgtcagttccttatcaaatttcacgaacgaaggaatgataaaatcatcgttttcgccgataacgtcttcgccttgaaagagtacgcaattcggctcaacaagccatacatttacggccctacctctcagggagagcgtatgcagatcctccagaacttcaaacacaatcccaaaatcaatacaatctttatctcgaaagtgggtgatacgtcctttgatttgccggaggccaatgtcctgattcaaatatcctcacacggagggtcgcgcagacaggaggcccagaggctggggagagtcttgagggcgaaaaagggcatggtggccgaagaatacaacgcatttttctatagtttagtgtcccaagatacacaagagatggcttacagtaccaagcgccaaagattcttagtggaccaagggtactcctttaaagttatcaccaagctggctggaatggaagaggaagaccttgctttcagtaccaaggaggagcagcaacagttgctgcagaaggtgctcgcagctaccgatcttgacgctgaggaggaagtggttgctggcgaattcgggagcagatcctcgcaggcatcacggaggtttggtaccatgagctccatgtccggagctgatgataccgtatacatggagtaccacagctcgaggagcaaagcgcctagtaagcacgtccaccccctgttcaaaaggtttcggaaatag

SEQ ID NO: 222594 - DNA, 2157 bp, Artificial Sequence
  Description of Artificial Sequence: Synthetic coding sequence
atgcctctgaaggacgatcacacttccagacccctgtgggttgccccagatggacatatcttcctggaggcttttagccctgtttataagtatgctcaggactttctcgttgccatcgccgaaccggtctgcagacctacccacgtacacgagtataaactgacagcttacagcttgtacgcagccgtgtcagtcggactgcagacgtctgacatcacagagtatttgaggaagttgagcaaaacaggagtacccgacggcatcatgcagttcatcaaattatgcacagtgtcttacggtaaggttaagttggtactcaagcacaatcgttactttgtggagtcctgccacccagatgttatccagcacctcctgcaggatccagttattcgggagtgccgactacgaaacagcgagggagaggccactgaacttataaccgagaccttcacatccaaatccgccatcagcaagacagcagaatcctctggcggaccgtctacatcccgggtgactgatccacagggaaagagcgatattccaatggacctgttcgatttttatgagcaaatggataaagatgaggaagaggaggaggaaacccagacggtatcattcgaagtcaagcaggagatgatcgaagaattacagaagagatgcatacaccttgagtacccacttttggccgagtatgatttccgcaacgacagtgtcaaccccgatattaacattgatctgaagccaacagccgtcttgaggccttaccaggaaaaaagcctgcggaaaatgttcgggaacgggagagcccgaagcggcgttatcgtgttaccatgtggtgccggtaaatctctggtgggagtaactgccgcttgtactgtcaggaaacgatgtctcgtgcttggcaactcggccgtctctgtggaacagtggaaggcgcagtttaaaatgtggagcaccattgacgatagccaaatctgtcgattcacgagtgacgccaaggacaagccaatcggttgcagcgttgccattagtacatacagtatgcttggacatacaaccaaacgctcctgggaagccgagagagtgatggagtggctgaagactcaggaatggggtctgatgattttggatgaagtacatacgattcccgcaaagatgttccgcagggtgttgacaattgttcaagctcattgtaaactagggctgacagctactctggtacgggaagacgacaagatcgtggatctcaactttctgatagggcctaaactctatgaggccaattggatggaactgcagaacaacggctatattgctaaggtgcagtgcgccgaagtctggtgtcctatgagccccgagttttacagggagtatgtggctattaaaacaaaaaaacgaatcctgctgtacactatgaatcccaacaagttccgggcatgccaatttctcattaagttccatgagcgcaggaatgataagatcatcgtcttcgccgacaacgtcttcgcgctcaaagaatatgccatcaggctgaacaagccttatatctacgggccaacttcgcaaggcgagagaatgcagatcctccaaaactttaagcacaaccccaagataaatacaatttttatcagtaaggtaggcgataccagtttcgatttacccgaggccaacgtgctcattcagatctcctctcacggaggctcgcgcagacaggaagctcagcgtctcggacgggtccttcgtgccaaaaaaggcatggtagctgaagagtacaatgcattcttttattccttagtatcccaggatacacaagagatggcttactccaccaaacggcagcggtttttggtggatcaggggtattcttttaaagtcatcactaagctggcaggcatggaagaagaagacctggcgttctctactaaggaagagcagcagcagcttctgcaaaaagtgctggcggcaacggacctcgacgccgaggaggaggtcgtggctggagagttcggcagtagatcttctcaggccagcagaaggttcggcacaatgtccagcatgtcaggggcagacgacacagtctacatggagtatcactcaagtagatctaaagcaccatctaaacacgtgcaccctctattcaaacggtttcgaaagtag

SEQ ID NO: 222595 - DNA, 3753 bp, Artificial Sequence
  Description of Artificial Sequence: Synthetic coding sequence
atggaggccagtaggcggttccccgaggcagaggctctgtctcccgaacaggccgcacattacctacggtacgtcaaggaggccaaggaggctacaaaaaatggggacttagaggaggcatttaaactgtttaacctggctaaagatatctttccaaacgaaaaagtattaagcagaatccagaaaatccaggaggctcttgaggaactcgccgaacagggggacgacgaattcacagatgtatgtaacagcggccttcttctgtacagagagctccataaccaactgtttgaacaccagaaagaggggattgctttcctttactccctgtatcgcgacggacgtaagggaggcattctcgcggacgatatggggttgggcaaaacagtccaaatcatcgcatttctgagcgggatgtttgacgcctcgctggtgaaccacgtgctgctcattatgcctactaacctgattaacacctgggtgaaagaatttatcaagtggactccaggaatgagagtgaagacttttcatggcccatctaaagacgagagaactagaaatctgaacagaatccaacaacgcaacggcgtgatcattactacctatcagatgctgataaataattggcagcaactaagctctttcagaggccaggagttcgtttgggattacgtgatcctggacgaggctcacaaaatcaagacttcctcgacgaaatccgccatctgtgcaagggcaataccagcctcaaatcgactgttgttgacaggaacaccaattcagaacaacttgcaggagctctggagtttgtttgactttgcctgtcagggatcgctgctaggcaccctcaagacatttaagatggaatacgagaacccgattacccgcgctagagaaaaggacgccacgcctggcgagaaggcactgggattcaagatctctgagaatctaatggccatcatcaaaccttacttcctacgcaggaccaaggaggatgtccagaagaaaaagtcttctaatcccgaggcaaggctcaatgagaagaatccggatgtggacgctatttgtgaaatgccttcattgtctcggaagaacgacctgattatctggatcaggctggtgccacttcaggaggaaatctatcggaaattcgtgtccctagaccatataaaggagttgcttatggaaactcgcagcccattggccgagctgggagtactcaaaaagttgtgtgatcatcctaggctgctgtcagctcgcgcttgttgcctgctcaacctgggtactttctccgcccaggatggcaacgagggggaggactccccagacgtggatcatatcgatcaggtgactgatgatactctgatggaggaatctggcaagatgatcttcctgatggacctgctgaagaggctgagagacgaggggcaccagacactcgtattttctcaatcaagacaaatattaaacataattgaaagattactgaagaacaggcacttcaagactctccggatcgatgggacggttacgcacttgcttgaacgcgagaaacgcatcaacctttttcagcagaacaaagattactctgtgttcctcctgacaactcaggtgggaggtgtggggctgactcttaccgccgctactcgggtcgtgatttttgacccaagttggaaccctgcgacagatgcccaggctgtggatcgggtatataggatcgggcagaaagaaaatgtcgtagtgtaccgccttatcacctgtgggacagtggaagaaaagatctataggcggcaggtatttaaagattctctgataagacagacgacgggggaaaagaagaatccatttagatacttcagcaagcaggagctccgggagctcttcacaatcgaggatctgcaaaatagtgtgacccaactgcagcttcagtcattgcacgcagcccagcgaaagagtgatattaagctggacgagcatatcgcatacctgcagagtctgggcattgccggtatcagcgaccacgacctgatgtacacctgcgatctgtctgtaaaggaggagctcgatgttgttgaggaatcgcactacattcagcagagagtgcaaaaggcacagtttttagtcgagtttgagagtcaaaacaaggaatttcttatggagcagcagagaacgagaaatgaaggcgcatggttacgcgaaccagtgttcccctccagcacaaaaaaaaagtgtccaaagctgaacaagccccagccccagccatcgccgctgctttctacacatcacacacaggaagaagacatttcttctaaaatggcttccgtggtcatcgacgacctccccaaagaaggagaaaagcaggacctgagttcaatcaaggtgaacgtcacaactctgcaagacggcaagggcacaggcagcgcagactctatcgcgacactgcctaaaggatttggatccgtggaagagttgtgtacaaactcctcattgggaatggagaagtcatttgccactaagaacgaggccgtacagaaagaaacccttcaggagggccctaaacaggaggctctgcaagaagaccctcttgaatcatttaattatgtgctgagcaaatctactaaggcggatatcggtcccaacctggaccagctgaaggacgacgagatcctgcgccactgtaatccatggccgatcatttcaattaccaatgaatcacagaatgctgaaagtaatgttagtattattgagatagctgacgatctgagcgcctcacactctgctctgcaggacgcacaagcctcggaagccaaactggaagaagagccctccgcgtcctccccacagtacgcttgcgacttcaacctgtttctcgaagactccgctgataacaggcaaaacttctcctctcagagccttgagcatgtcgagaaggaaaactccctctgcggatctgcacccaattctagggcaggctttgtgcactcaaagacttgcctgtcatgggagttttctgagaaagacgacgaacccgaagaagttgttgtgaaagctaagattagatcaaaggcacgccgtattgtctccgacggagaggacgaagacgacagttttaaggacacatcctcgataaatccatttaacacaagcctatttcagttttcgtctgttaagcaatttgatgcctccacccccaagaatgacatatcccccccaggcaggtttttctccagccagataccaagcagtgtaaacaagtcgatgaattctcgcagatcactagcttccagaaggagcctgattaacatggttctagaccatgttgaagatatggaagaacggcttgatgactcttcagaggcaaaagggccagaggactatcccgaagagggagtcgaggagtcatcaggggaggccagtaaatacactgaagaggacccctccggagaaactctgagttcagaaaacaagtcttcctggctgatgacaagcaagccgtcagcactggcccaggaaacatccctgggggcacctgagcccctgtccggtgagcaattggttggctcaccccaagataaagcggcagaagccacaaacgactacgaaactctggtgaagcggggaaaagagctcaaagaatgcgggaagattcaggaagccctgaactgtctggtgaaagctctggacatcaaaagcgcggatccagaggtgatgctcctgacactgagcctgtataaacaactgaataataattag

SEQ ID NO: 222596 - DNA, 2685 bp, Artificial Sequence
  Description of Artificial Sequence: Synthetic coding sequence
atgacagccataaaacacgctttgcaacgggatatttttacccccaacgacgagagactgctgtcaatagtcaatgtgtgcaaagctggaaaaaaaaagaagaattgcttcttatgcgcaaccgtgacaactgaacgcccagtccaagtgaaagttgtgaaagtgaagaaatcggataaaggggatttttacaagaggcagatcgcctgggctttaagagacttggctgtcgtagatgcgaaggacgctatcaaagagaacccagagttcgaccttcattttgagaagatctacaagtgggtcgctagcagcacagctgaaaaaaatgccttcatcagttgcatttggaagctgaaccaacgatacctcaggaagaagattgacttcgtgaacgtgagtagccagttgctggaagagagtgtgccgtctggagaaaaccagtccgtcactggaggtgacgaggaggtggtcgatgaataccaggaactcaacgcacgggaagaacaggacatcgagattatgatggagggttgcgagtacgcaataagtaacgcggaagctttcgcggaaaagttaagccgcgagctgcaggtcctcgacggtgccaacattcagtctattatggcgtcagaaaagcaggtcaacatactcatgaaactcctggacgaggcactcaaggaggtggaccagattgaattgaaactttcaagttacgaagagatgctgcagagcgtgaaggaacagatggaccagatttcagagagcaaccatcttattcatctgtctaatacaaataacgtgaagctgttaagcgaaatcgagttcctggtgaaccatatggatctggccaaggggcacatcaaggcgctacaggaaggtgacctcgcctccagccgcggtattgaggcttgtacgaacgctgcagacgctctgcttcagtgtatgaacgtcgcgctgcggccaggccatgacctacttttggctgtgaagcagcaacagcagcggttcagtgacctccgcgaactgttcgctcggcgtcttgcctctcacctgaacaatgtcttcgttcagcagggccacgatcagagcagtacgctggctcagcacagcgtcgagctgaccctgccaaatcatcatcctttccatcgagacctgttgcgctatgcaaagctgatggagtggctcaagtctacagactacggtaaatatgagggccttaccaagaactacatggattatctgagcaggttgtatgaacgcgaaatcaaagactttttcgaagttgcgaagataaaaatgactggaactaccaaagagtctaaaaagttcgccaccttaccaaggaaggagtcagccgtgaagcaagagaccgagagcctgcatggaagctctggaaagcttaccgggtctacatcatcgctgaacaagctgagtgtccagtcttccggaaatcgcaggagccagagctcttccctcctcgatatggggaatatgtctgcctctgacctggacgtggccgaccggacaaagttcgacaagatcttcgagcaggtgttgtccgagctggaaccactctgcctggccgagcaggacttcatcagcaagtttttcaagctccagcagcatcaaagcatgccagggactatggccgaggctgaggacctggatggcggaacccttagtcgtcagcataattgcggtacccctttgcccgtgagttccgagaaagatatgatccgtcaaatgatgattaagatttttcggtgcatcgagcctgaactgaataacttaattgccctgggggacaaaattgatagcttcaatagtctgtatatgctcgtgaagatgtcccaccacgtttggacggcacagaacgtcgaccctgcaagcttcctaagtaccaccctggggaacgtactcgttaccgttaagcgcaactttgataaatgtatctctaatcaaatcaggcagatggaggaggtaaagatatcaaagaagtcaaaagtaggaatcctgcccttcgtcgcagagtttgaggaattcgccggattagcagagtctatcttcaagaatgccgagcggaggggcgacctggacaaggcgtacaccaaactgatccgcggagttttcgtaaatgtggagaaggttgctaatgaatcccagaagactccgagagacgtggtaatgatggagaatttccatcatatcttcgctactctgtcccgcctgaaaatttcctgcctggaagccgaaaaaaaagaagcaaaacaaaaatataccgaccatctgcaaagttacgtaatctatagtctcggacagcctctggaaaagctcaaccacttcttcgagggagtggaagccagggtagcacagggcatccgcgaagaagaagtttcatatcagttggcttttaataaacaggagctccgaaaggtcataaaggaatatcctggtaaggaagtgaagaagggtttggacaatctttacaagaaagtggataagcatctgtgcgaagaggagaatcttctccaagtggtgtggcatagtatgcaagacgagtttattagacagtacaagcatttcgaggggctcatcgcccgttgttatccagggtccggagttacgatggagttcactatccaggatatcttagactactgtagctccatcgcccagagccactag

SEQ ID NO: 222597 - DNA, 2640 bp, Artificial Sequence
  Description of Artificial Sequence: Synthetic coding sequence
atgaccgccatcaaacacgcactgcagcgtgacatctttaccccgaacgacgaacgcctcctgtctatcgttaacgtgtgcaaagccggaaagaaaaaaaagaattgctttctgtgtgcaactgtgactactgagagacccgtgcaggtgaaagttgtgaaagtgaagaagagtgacaagggagacttctacaagcggcagattgcttgggctctgagagacctggccgtggtcgatgctaaagatgctattaaggagaatcctgagttcgatctgcacttcgagaagatctacaaatgggtagcctcttcaacagctgagaaaaatgccttcatttcttgcatatggaaactgaatcagcgctacctcaggaaaaagattgacttcgtgaacgtcagctctcagttgctggaagagtcagtcccttcgggcgagaaccagagtgtgacggggggagatgaagaggtagtggacgagtatcaggaactcaacgctcgcgaggagcaagacattgagatcatgatggagggttgtgagtatgcgatcagtaacgccgaggcattcgccgagaagctgtctcgcgagctacaggtgcttgacggtgcaaatatccagtcaatcatggccagcgagaagcaggttaatatcctgatgaaactgctggatgaggccctaaaggaagtagatcaaatagaactaaaactgtccagctacgaagaaatgctgcagagcgtgaaagagcagatggaccagatctctgagagcaatcatttgattcacctatcaaacaccaataacgtcaagctcctgtctgagattgagtttctggtcaatcatatggatctcgccaaaggccacatcaaagcactgcaggagggtgacctggctagttcccgaggtattgaggcctgtaccaatgctgccgacgctttgctccaatgcatgaacgtcgcactccgcccaggccatgacctgctactggcagtgaagcagcagcagcagaggttttccgacctcagagagttattcgcaaggaggctggctagccatctaaacaacgtgttcgtgcagcaggggcacgatcagtcttctacgcttgcccagcattcagtcgaactgactttacctaaccatcaccctttccacagagatctgctccgctacgccaagctcatggagtggttgaaatctaccgactacggtaagtacgaagggctcacgaaaaattacatggactatcttagccggctctatgagcgtgagatcaaagatttctttgaagtggcaaagataaagatgacgggcacaaccaaggaatcaaagaagtttgggctgcacggatcctccggcaagctaaccggcagcacgtcatctctgaacaaattatccgtccagagttcaggaaataggaggagtcagtcaagcagcctccttgatatgggtaacatgtccgcatccgatctcgacgtagctgatagaaccaaattcgataagattttcgagcaggtgctgagtgagctggaacctctatgcttggccgaacaagattttatttccaaatttttcaaattgcagcaacatcagagcatgccgggaactatggcagaagccgaggaccttgatgggggtaccctgtcccggcagcataactgtgggacccctctcccagtctcttctgagaaggacatgatacgacagatgatgatcaagatctttcgctgcattgagcccgagcttaacaatctaatcgcactgggtgataagatcgactcattcaattcactctacatgctggtcaagatgagccatcatgtgtggacagcccagaatgtggaccccgcatcatttctgagcaccaccctggggaatgtgctggtaaccgtgaaaagaaacttcgacaagtgcatatccaaccagatccgccagatggaggaggtgaagatttctaagaaatccaaggtggggatcctgccatttgttgctgagttcgaagagtttgccggattagcggaatcaatcttcaagaatgcggagcggcgaggggacctggataaggcctataccaagctgataagaggtgtcttcgtcaatgtcgagaaagttgccaatgagagccagaagacgccacgagatgtcgtgatgatggagaatttccaccatatcttcgccaccctgagccgactcaaaatctcctgcctggaggccgagaaaaaagaggctaagcagaagtataccgatcacctacaaagttatgtcatctattccctgggccagcccttagagaagctcaatcattttttcgagggtgtcgaagcacgggttgcccagggaataagagaggaggaggtgagttaccagctggcatttaataagcaggagcttaggaaagtgatcaaagaatacccgggtaaagaggttaaaaagggcctcgataacttgtacaagaaagttgataagcacctgtgtgaagaggagaacttgctgcaggttgtgtggcacagcatgcaggacgagttcatacgccagtataagcacttcgagggtcttattgcaagatgctacccgggatccggagtcacaatggagttcacaattcaagacatcctggattattgcagctccattgctcagtcgcattag

SEQ ID NO: 222598 - DNA, 2685 bp, Artificial Sequence
  Description of Artificial Sequence: Synthetic coding sequence
atgactgccatcaaacacgcccttcagcgcgacatttttacccccaacgatgaacggttgttgtccatcgtgaatgtgtgtaaggccggtaaaaaaaagaagaattgctttctgtgcgccacagttaccaccgagcgccctgtacaggttaaggttgtgaaggtcaagaagtctgacaaaggggacttttataagcggcagattgcctgggccctgcgcgatctggccgtagtggatgccaaagatgcaattaaggagaatccggagtttgacctgcacttcgaaaagatttacaagtgggtcgcatctagcactgcagagaagaacgccttcatttcatgtatttggaagctgaaccaacggtatttgcgaaaaaagattgatttcgtcaatgtgtcatcccaattgctggaggagtcagtcccaagtggcgaaaaccagtccgtcaccgggggagacgaggaagttgttgacgagtatcaggagctcaacgctagggaggagcaagacattgaaataatgatggaagggtgcgagtatgcgatttcgaacgccgaagcctttgcggaaaagctgagtagggagctacaagttctggacggcgctaacatccaaagcatcatggcttccgagaagcaagtgaatattcttatgaaactgttggatgaagcactgaaggaggtggaccaaattgaattgaaattgagctcctacgaggagatgttgcaatccgtgaaagagcagatggaccaaatcagcgaatccaatcatctcattcacctcagtaatacgaataatgtgaagctgctgagcgaaattgagtttttggttaaccacatggacctcgctaagggacatattaaggccctccaggagggtgaccttgcatccagccgcggaatcgaggcgtgtactaacgccgctgacgccttgctacagtgcatgaacgtggctctgagaccgggacacgacttacttttggctgtgaagcagcaacagcagcggttttcagacttgcgggagctgttcgccagacgattggcctcccacctaaacaacgtgtttgtgcaacaggggcatgatcagtcctcaactctggctcagcatagtgtcgagctaacactcccgaatcatcacccgttccatagggacttgctccgttacgctaaactgatggagtggctgaaaagtacagattatgggaagtacgaaggcctgacaaaaaactatatggactatttgagtcggctgtacgaaagagagatcaaagacttcttcgaggtggctaaaattaaaatgactggtacaaccaaggagtcaaaaaaatttgcgaccctccccaggaaggagtctgccgttaagcaggaaaccgaaagcctgcacggttcttcaggtaaattgaccggatctaccagtagtctgaataagctatcagtgcagtcttcgggaaatcgccgtagtcagtcaagttctttgctcgatatgggaaatatgtccgccagcgatcttgatgttgctgatcgcaccaaattcgataagatatttgaacaagtactgtcggaactggaacccctttgcctggctgagcaggacttcatctctaaattttttaaattgcaacagcatcaaagcatgcctggcaccatggccgaagccgaagacctggatggcggaactctgtccaggcagcacaactgcgggaccccactgcccgtgtccagcgagaaggacatgatccggcaaatgatgatcaagatcttcaggtgtatagagccagagctcaacaacctcatcgccctgggggataaaatcgatagtttcaattcactgtatatgctagttaagatgagtcatcacgtatggaccgctcagaacgtagaccccgctagcttcttatcgacaaccttgggtaacgtgctcgttacggtgaaacggaacttcgacaaatgcatctccaaccagattcggcagatggaggaagtgaagatctccaagaagagtaaggtcgggatcctgccgttcgtcgcagaattcgaggagtttgctggcttagctgaaagcatattcaagaatgccgaaaggagaggcgatctggacaaagcgtacaccaaattgattcgaggcgtatttgttaatgttgaaaaggtggcaaacgaatcccagaagacccctcgtgacgtcgtgatgatggaaaattttcaccatatctttgccacgttgtccagactcaagatttcatgtctagaagcagagaagaaagaggcaaagcagaagtatactgaccatctgcagagctacgtgatctactctctggggcagccgctagagaaacttaaccatttttttgaaggggtggaggcacgcgtcgcccaggggatacgggaagaggaagtttcttatcaactggcctttaacaagcaagaactgaggaaagtgattaaagagtaccccggtaaggaggtgaagaagggactggacaacttgtataaaaaagtggataagcatttatgcgaagaggagaatttgcttcaggtagtctggcacagcatgcaggacgaatttatacggcagtataagcacttcgaggggctcattgctcgctgctacccaggcagcggtgttactatggaatttacaattcaggacatactcgattactgctcatctatcgctcagtcgcattag

SEQ ID NO: 222599 - DNA, 2238 bp, Artificial Sequence
  Description of Artificial Sequence: Synthetic coding sequence
atgaaagagacggacagggaggctgtcgctacagccgtccagcgcgttgccggaatgctgcagaggcctgaccagctggacaaggtggaacagtaccgacggagggaagcacggaaaaaagcgtctgtcgaggcaagactcaaagccgctattcaatctcagctcgacggggtacggaccggtctcagccagctgcataacgccctaaacgacgtaaaggacatccagcagagcctagcagatgtgagtaaagactggcgccagtcaatcaacaccatcgaatcacttaaagatgtaaaagacgcagtggttcagcactcgcaactcgctgccgctgttgagaacctcaagaacatcttttcggttcccgaaatagtaagagaaacccaggatcttatagagcagggtgcgttattgcaggctcaccgcaagttgatggacttggaatgctctcgggacggtttgatgtatgagcagtatcggatggactcaggtaataccagagatatgacccttattcatggctatttcgggagtacacagggactgtccgatgaactcgccaaacagttgtggatggtgctccagcggagtctagtaaccgtacggagggaccctacgctcctggttagtgtggttcgtataatcgaacgggaggaaaaaatcgaccggagaattctcgaccgcaagaagcaaacaggtttcgttccaccaggcagacctaagaactggaaagagaaaatgtttacgatcttagaaagaacggttacaactagaatcgaaggcactcaagcggacactagggaatctgacaagatgtggttagtaagacatttggagattataagaaaatacgttctggacgacttgatagttgctaaaaacctcatggtgcagtgctttccacctcactacgaaatctttaagaatttacttaatatgtatcatcaggctttgtcaactcgaatgcaggacctcgcaagcgaggacctagaagcaaatgaaatcgtgtccctccttacctgggtgttgaacacctacaccagtacggagatgatgcgaaatgtggaactcgcaccagaggttgatgtggggaccttagagcctcttctatccccacacgtcgtgagcgagctgcttgatacgtatatgagtactctgacttctaacatcatcgcttggttgagaaaggctctggaaaccgataaaaaagattgggtcaaggaaactgagcccgaggccgaccaggatggatactatcagaccacattgcctgcaattgtttttcaaatgttcgaacaaaacctgcaggttgccgctcagatctctgaggaccttaagactaaggtcctggtcctgtgtcttcagcagatgaattcttttctatcaaggtataaagatgaagcacagttatataaggaggagcacctgcgcaaccgccagcacccccattgttatgtgcagtacatgattgctataattaataactgtcagacctttaaggagagcatcgtcagcctaaaacggaagtatctgaagaacgaagtggaggaaggagtctcgccatcacagcccagcatggatggcattctcgacgccattgcaaaagagggatgcagcggcctgctggaagaagtgtttctcgacctcgagcagcacctgaatgagctgatgaccaagaaatggctcctaggttctaacgctgtagacatcatatgcgtgacagtggaggattatttcaatgattttgctaagattaagaaaccatataaaaagagaatgacagctgaagcgcataggagggtggtagtggagtatctcagggccgtgatgcagaaacgcatcagttttcgatcaccagaagaacgcaaagagggtgcggagaaaatggtcagggaggccgagcagctgaggttcctcttcaggaaactggcgagtggattcggagaagatgtggatggttattgtgatactatcgtggctgtagctgaagtgattaaactcacggacccctcactgctctatttggaggtgtccactctggtcagcaagtaccctgatattagagacgatcacatcggggctttgttggccgtccgcggagacgcaagccgggatatgaaacagactatcatggaaacattagaacagggaccagcccaagccagcccttcctacgtcccactgttcaaggatatcgttgttccaagcctcaacgtggcgaagctgttgaaatag

SEQ ID NO: 222600 - DNA, 1923 bp, Artificial Sequence
  Description of Artificial Sequence: Synthetic coding sequence
cagtgtgaagattctaccagcttttttacaatgaaggagacagatagagaggccgtggctaccgctgttcagcgcgtcgctggaatgcttcagcgtccagaccagctggataaggttgagcagtacagaagacgggaggccaggaagaaggcctctgtggaggctcgccttaaagcggcaatacagagccagctcgacggagtccgcaccgggctgagtcaactacacaacgccctaaatgacgttaaggacatacagcagtcactggccgacgtgagtaaggactggcgccagtccatcaacacaatagagagtcttaaagatgtcaaagatgcggtcgtgcagcattcacagctagctgcagctgtggagaacttaaagaacatattctcagttccagaaattgtaagagagactcaagacctcattgagcagggcgcactactgcaggcccataggaagctgatggacctcgaatgctctcgagacggactcatgtacgagcagtatagaatggacagcggtaacacacgcgacatgacactgatacacggctacttcggatctacccagggactgtcggacgagcttgcaaaacaactgtggatggtgctgcagcgctccctggtcacagtgagacgggacccaaccttgcttgtttctgttgtccgcatcattgagcgcgaagaaaaaatcgataggcgcatacttgaccggaaaaaacagaccgggttcgtcccacctgggaggccaaagaattggaaggaaaagatgtttacaatccttgagaggactgtgacaaccaggattgaaggcacacaggcggatacacgggaaagcgacaaaatgtggctggtgagacacctcgagatcataagaaaatacgtccttgatgacctgatagtcgcaaagaatttgatggtgcaatgctttcctcctcattacgagattttcaaaaatctgcttaatatgtatcatcaggccctctctacaaggatgcaggacctggcttccgaggacctcgaagctaacgagatcgttagcctgctgacctgggttctgaatacctataccagatacaaggatgaagcccagttatataaggaggagcacctgaggaatcggcaacaccctcattgttacgttcagtatatgattgccatcatcaacaattgccagacgttcaaagagagcatcgtttcactgaaaaggaagtacctgaagaatgaggttgaggaaggcgtttcaccttcacagccctctatggacggaatcctggacgccatcgccaaagagggctgtagtggcttgctggaggaggtgttcttggatctcgaacagcaccttaatgagttgatgaccaagaagtggttgctgggcagcaacgctgtggacatcatctgcgtcaccgttgaagactatttcaacgatttcgccaagattaaaaaaccctataaaaagcggatgactgctgaagcgcaccggcgagtcgttgtcgagtatttgcgggcagtgatgcagaagcgaatatccttccgctctcccgaggaaaggaaggagggcgctgagaagatggtgagagaggccgagcaattgagattcttatttcggaaactggcatctggctttggagaggacgtagacgggtactgcgatactatcgtggccgttgccgaggtcatcaagctgacggatccctccctactctacctggaggtatcgacactagtttccaagtaccccgacatccgggatgaccatattggggctctcctcgctgtccgcggagacgcctctcgggacatgaagcagactatcatggaaactctggagcaggggccagcacaggcttcaccttcctatgtgccccttttcaaggacatcgtggtgccttctctcaatgtggcgaagctgctcaaatag

SEQ ID NO: 222601 - DNA, 210 bp, Artificial Sequence
  Description of Artificial Sequence: Synthetic coding sequence
atgaaggaaactgaccgggaggcagttgcaaccgccgtccagcgagtcgccggaatgctgcagaggccagaccagttggacaaggtagaacagtatagacgtagggaagccaggaaaaaggcatccgtcgaggccagattgaaggccgctatacagtcccagctggatggagttcgcactggcctctcgcagttacataatgcactgtag

SEQ ID NO: 222602 - DNA, 2238 bp, Artificial Sequence
  Description of Artificial Sequence: Synthetic coding sequence
atgaaggagacagaccgagaggcggtcgcaaccgctgtgcagagggtggccggtatgttgcagcggcctgaccagttggacaaggtagagcaataccgacgcagggaagccagaaagaaagcaagcgtagaggcccgactgaaagcagctattcagtctcaactggatggggtgcgcaccggactttcgcagctccacaatgctctcaacgacgtcaaagacatccagcaatctctggccgatgtcagtaaagattggcgacagtcgatcaatacaatcgagtccttaaaagacgtgaaggatgcggtcgtgcaacatagccaacttgctgctgcggttgagaatctgaagaacatcttttcagttcccgagattgtgagggaaacacaagacctgattgaacagggcgcattgttgcaggctcataggaagctgatggatcttgaatgcagcagggacgggctcatgtatgaacagtaccgtatggattccggaaacacgcgtgacatgaccctcatacacggttactttggatccacacagggactgagtgacgagctcgctaaacagctgtggatggtactccagagaagcctcgtgacagtgagacgagacccaaccctcctggtctctgtggtgagaattattgaacgagaggagaagatcgatcgtaggattctggacaggaaaaaacagacaggtttcgtgcccccagggcgacctaaaaattggaaggaaaagatgttcaccattttggagcgcacagtgacaacacggatagaggggacccaggctgacactagggaatcagacaaaatgtggctggtgagacacctggagataatcagaaagtacgtactcgacgacctcattgtggcaaagaatctgatggtccaatgttttccaccacattacgagattttcaaaaatctcctcaatatgtaccaccaagccctgtctacacggatgcaggaccttgcgagcgaggacctggaggcaaacgagatcgttagcctcttaacttgggtactgaatacttacacaagcacagaaatgatgcgcaacgttgaattagcacccgaggtggacgttggcaccttagaaccccttctttccccgcatgtggtgagcgaactactcgacacctacatgagcactctcacctccaatatcattgcctggcttcgaaaagccctggaaaccgacaagaaagactgggtcaaagaaacggagcccgaggcagatcaggatggatactaccagacaacgctgcccgcaattgtgtttcagatgttcgaacagaacctacaggttgcggctcagatttccgaagatctgaagacaaaagtacttgttctgtgtctgcagcaaatgaactccttccttagtcgctacaaagacgaagcccagctttacaaggaagaacacctgaggaaccggcaacatccccactgctatgtccagtatatgattgcaattattaataactgtcagacatttaaggagagtatcgtcagtcttaagaggaaatacctcaagaatgaggtggaagaaggggtttctcccagtcagccatccatggatggaattttggatgccatcgcaaaggaaggctgctcaggactacttgaagaggtgtttcttgacctggaacagcatctgaatgagctcatgaccaagaaatggttgctgggctccaatgccgtggatattatatgtgtgacagttgaggactatttcaatgattttgccaagattaagaagccatacaaaaagaggatgaccgcagaggctcataggagggtcgtcgttgaatacctgagagccgtaatgcagaaaagaatctcttttaggagccccgaggagagaaaagaaggcgcagagaaaatggtccgggaagcagaacaactgcggttcctgttcaggaagctggcctcagggttcggggaggatgtcgatgggtactgcgacaccatcgttgcggtcgcagaagtaataaagttgaccgacccctccctgctgtacctggaggtgagcacactggtcagcaaatatcccgacatccgtgacgaccatattggtgcactgctggctgtgcggggagatgcctctagagacatgaaacagacgataatggagaccctggaacaaggacctgcccaggcctcacctagctatgtcccactattcaaagatattgtcgtcccatcgctgaacgtggccaaacttttaaaatag

SEQ ID NO: 222603 - DNA, 2034 bp, Artificial Sequence
  Description of Artificial Sequence: Synthetic coding sequence
atggatagcgctgcgaaagatgaaatgcagcccgctctgtctcccggatccagctttcccggtccagaatggccagaacaggagcgagcggagcagctcgcaaggggcgctgctctcaagtgggcttccggcatcttctaccgacctgagcagctggccagactggggcagtacagatccagagaagtgcagcgaacttgttctctagagtcgcgactaaagagtgttatgcaaagttacttagagggggtgcagactgtccccgctgcggtaagccacacccaaacactcattgatggacagcagttcctggaggcctatgtgtcgttgcgtgagcttgaacagctgcgcgaggatacatgggcaccgctcgggggattagaactgccggtgtttcaggggctagatctattgtttgaagctttggggcaggcagtggaggctgcagcaggggctgccggaaaactcgccagggaggaccccgcacttctcgtggcagcagtgcgcgttgcagaggtcgaaactgggcgtaccacaccactcggccaggttccaagggattggcgacaacggtgcttgagggcacttcaggagggtctggagcaagcccatttcggctccccgctgctgccagcccctggcgctttgcccggatggctggaagccctgcgcgttgccctcccagtggagttggctacggccgaagcactggtggccccttgttgccccccacagtataatgtggtgcaattatgggcccatacacttcacagtggactaaggaggtccctgcagaacctccttgccggaccagaactggaggccgctgatgctttcgctctgttgcattgggccttacacgtttatctgggccaagaaatgatgggatctctggagcttggcccagaggctgacgtgtcccagctggagccactccttacactcgagaacatcgaacagctcgaagccaccttcgtggcaaatattcagatcctggaagaaaacatcagagtcgcgtccctggtaagcgagagcctgcagcagagggtccacggcatggcgcttagcgagcttggcacattcctgcgcagcttcagcgacgctttaattaggttcagtagggatcacttcagaggaaaatccatggctccccactacgtaccctatctgttagctgctcttaatcataagagtgcactatcaagcagtgtcagcgtcctgcagcttgacggagctccaagcggcgctctggcaccagtggaggcagctctggatgagttgcagcggcgaatatacaggctggtcctcgaagccctccaggccgaacttcaacccctttttgcggatctaccctcccgccagtggctgagcagccccgagctgttgcagtctgtgtgtgagcggacaggtcgcttctgtcgagacttctggagagtcaggaacccaactgtgcagttgctactcgcagaagccgagagagccgtcgttctgcagtatctctccgccctcatgcagggtagactggtgtgcaggggagccgacgagcggacccaggccgcagagagactgcgtcatgatgcagctcagctgcagcaattgttcttgagtctggtaagagcctcctgggccggtaggcgcgctcgggtctcagtggccggatgggaacggggtctggcgcgagatcccacacccacatgttccggcccaggaggagagagagcgctgcgagctggcgctgcacggcctgaaggagccgctaagccacctcgacccagagccgcagggcctgggggtggatggcccgcagccacgatttctcgaagagagagagggccaaggctcagacccctcggcccagcaagaggactggtcccaggggcagcacccggacgggcacagcttcccgctggttgcgccgcagcagtcgctcctagagaacccccacggcctcttcagccaagcgccagggccagagctcccgcaagctgccttccaagcggctcgtgtgcccgtgccctgctgttagcagagtag

SEQ ID NO: 222604 - DNA, 2241 bp, Artificial Sequence
  Description of Artificial Sequence: Synthetic coding sequence
atggactcggcggctaaagacgaaatgcagccggcactgtcgccaggcccagagtggcccgagcaggagagggccgagcagctagccaggggggcagccctaaagtgggcttccggcattttctatagacctgagcagctggccagattggggcagtatcgatcccgagaagtccaaagaacctgctcactggaaagccggctgaagtcagtgatgcagtcatacctggagggggtgcagactggcgtgtggcagctggcccaggctatcgaggttgtccaaggcacgagagaggccctctcccaggcgcgtggactcctgcagggaatgagccaggccctgcagacactcgagcctctaagagaaagagtcgcccaacataagcagctccaggctctaagtcacttgctgcccaggttgcgagcagtgccagccgctgtttcccacacacagaccctcatcgacggccaacagtttttggaagcttatgtgagtctgagggaattggagcagctgcgcgaggatacctgggcccctctgggaggcctagaattgcctgtcttccagggcctggatttgctgtttgaggctctgggccaagccgtggaggccgcagcgggagcagcgggaaagctcgctcgggaagatcccgcactgcttgtcgcagctgtgagggtggccgaagtggaaacaggcagaacaacacctctcggacaagtgccaagagactggcgacagcggtgccttagagccctccaggagggactagagcaagcccatttcgggagcccactgctgcccgctcctggcgctctgcctggatggttggaggctcttcgagttgcgctgcctgtggagttggcaacagctgaggctcttgtggccccatgctgcccaccacaatacaatgtcgtccagttatgggctcacactctgcattccggtctgagaaggtccttgcagaacctgctggccggaccagagctggaggctgctgacgcattcgctttgttgcactgggccttgcacgtgtacctgggtcaggagatgatgggatccctggagcttggcccagaagccgacgtctctcagctggagcctctgctcactctcgagaacatagagcaactagaagctaccttcgttgccaacattcaggcttcagtcagccagtggctgcaaaacgctctggatggggaagtggcagaatggggtcgagaacacgggcctaataccgatccaagcggcagttactattctcctatgcctgccatcgtgctgcagatcctcgaggaaaacatacgggtcgcttctttggtgagtgaatcgctgcaacagcgcgtgcacggaatggccctcagcgaactgggcactttcctgagatctttctcagacgccctcatccgtttttcacgtgaccacttccgagggaagtcaatggctcctcattatgtgccatacttactcgccgcactgaaccataagagcgcacttagtagctccgtctcagtgctccagcttgatggcgcaccctctggcgctctggccccagtggaagcggcattggacgagttacagcggcgtatttatcggctcgtgctggaggccttacaagctgaacttcagcccctgtttgctgacctgcccagccggcagtggctgtcctctcccgaactgctgcagtctgtgtgcgaaaggactggcaggttttgtcgcgacttttggcgagtccgaaacccaacagtacagttgcttcttgccgaagcggaaagagccgtcgtactccaatacctgtcagcgctcatgcagggacgtctggtttgtcggggtgccgatgaacggacacaggctgccgagcgcctaaggcacgatgcagctcaattacagcagctcttcttgtctctggggctggaagaaaacgcccactgtgctcccgtgctactagcccttagggagctgctcaatcttagggatccagcactgctgggactggaggtggccggacttagacaacagtttccagatgtttcagaagatcacgtcagtgctctgcttggactccgaggcgacctctctcgagagcagcaccttgcagctctgtcatctctgcaggctgcactgcctcctagcccacgcgcttccagacgagtactgttcagtctggtacccgcaccggctcttgcccctgcatcctgcctccctagtggatcgtgcgctagagctttgctgcttgccgaatag

SEQ ID NO: 222605 - DNA, 2040 bp, Artificial Sequence
  Description of Artificial Sequence: Synthetic coding sequence
atggactctgcggcaaaggacgaaatgcaaccagccttgtcaccgggtcctgagtggccagaacaagagcgcgcagaacaattagcccgaggagctgccctaaagtgggcaagcggaatcttttaccgcccagagcaattggccaggctcggtcaatatcgatctagagaggtgcagaggacttgttcccttgaaagtcggctgaagagtgtgatgcagtcctatctggagggtgttcaaactgtgcctgccgctgtgagccacacccagaccttaatcgacgggcagcaatttcttgaagcgtacgtgtcattacgggagctcgagcaactgagagaggatacgtgggcaccattgggaggcctggagctcccagtgttccaggggctggatttactgttcgaggctctgggccaggccgtggaggccgcagcgggtgccgcaggcaaattggctagagaggatcctgcgctcctggtagccgcagtccgagtggccgaagtggaaaccggcagaactacccccctgggacaggtgccacgcgactggcgccagcgctgcctgcgagccctgcaggaaggccttgagcaggcccattttggttcccctctcctcccggcacccggagccttgcctggttggctggaggctctgagagtagcacttcccgtggaacttgcgaccgccgaggcactggtcgcaccttgttgtccaccccagtacaacgtggtgcaactgtgggctcacaccctgcattctggactcagaaggagcctccagaatcttcttgcagggcctgagctggaggccgctgacgcttttgccctgctccactgggccctgcatgtctacctgggtcaggaaatgatgggctcattggaactgggccctgaagctgacgtgtcacagttggagccgctattaacgttggaaaacatcgaacagcttgaagccacctttgtcgctaatatccaaatcctggaagagaacatccgcgtggcaagcctcgtctccgagagccttcagcagagagtccacggtatggccctaagcgagttgggaacgttcctcagatcattctccgacgccttgattagattttctagagaccattttagaggtaagtctatggcccctcactatgtgccttacctgctggctgctctcaatcacaaatcagcactaagttcatccgtctccgtgttacagctagacggcgcaccctccggagctcttgcccctgtcgaagccgctctcgacgagctgcagagacgcatctaccgactagtgctcgaggcccttcaggcagaactgcagcctctctttgctgatttaccgtctcgacagtggctgtcaagccctgaactgctacagtcagtgtgtgagcgtaccggcaggttttgtagggatttctggcgggtgcgcaatccgacagtccagctcctgttggcggaagccgaacgcgcagtcgtgctccagtaccttagcgctcttatgcaagggcgtctggtgtgtagaggagcggacgagcgaacgcaagccgcagagaggctcaggcacgacgcagctcagttgcaacagctctttctcagcctggtgcgcgcttcttgggcgggtcggagggcccgtgttagtgtcgctgggtgggagcgcggactggctcgcgaccctactcccacctgctctggcccaggcggagaaagggcactgagggctggagctgccagacctgaaggagcggcaaaaccccctcgtccgcgagccgcaggtccgggaggaggctggccagcagctacaattagtcgacgggaaagggggccacgactgcggcctctggggccagcacgcggactagtgccaggggcagcgccaggcagagcgcagctcccagccggatgcgctgcggctgtcgcaccccgagagcctccaagacctttgcaacccagtgcaagagcaagggccagggcgggactactgccagcactgggggtactgagacctagcccagccgcaaggaggattaatcacggttgccggtag

SEQ ID NO: 222606 - DNA, 2925 bp, Artificial Sequence
  Description of Artificial Sequence: Synthetic coding sequence
atggccgctgaggctgccggtgggaaataccgatctacagtctcaaaatccaaggacccctctggactactgattagcgtgattagaaccctgtcaacatccgacgatgtggaagatagagagaatgaaaaaggcagattggaagaagcctacgaaaagtgtgatcgtgacttggacgagcttatagtccaacattatactgaactgacaaccgccatccgcacttaccagtcaatcaccgagcggatcacaaacagcaggaacaaaattaaacaggttaaggaaaacctgctgtcttgcaaaatgctacttcactgtaagcgagacgagttacgcaaactctggattgagggcattgagcacaaacacgtactgaacctgctggacgagattgagaacatcaagcaagtgccccagaagctcgaacaatgtatggcatccaaacactatctgtccgctacagacatgctggtgagcgccgtggaatccctggaggggccactcttacaggtggaggggctcagtgacctcagattggaactccactccaaaaaaatgaatctgcacctcgtgctgatcgatgagctacatagacatctttatatcaagagtacatctcgggtggtgcagcgtaacaaggagaaagggaagataagttctcttgtaaaagacgcctccgtccctttgatagatgtcacaaacctgccaacaccaaggaagtttctggacactagccactattctacagccggatcttccagtgtgcgtgagattaacctgcaggacatcaaggaagacctagagcttgatccagaagaaaattctacattgttcatgggaattctgatcaagggtctcgccaaactgaagaaaatccctgaaacagtgaaagctatcatcgagagactcgagcaggagttgaaacagattgtgaaaagatcaactactcaggtggcagattccggctatcagagaggcgaaaatgtgactgtcgagaaccaaccgagactgcttttggagttgttagaactgttgtttgacaaatttaatgctgtcgctgctgcccactccgtggtgctgggttacctgcaagacactgtggtgactccacttacccagcaagaggatatcaagctgtatgacatggccgatgtctgggtgaagatccaggatgtactgcagatgctgctcaccgaatatcttgacatgaaaaacactcgcactgcttcagaaccttccgcgcaactgtcctatgccagcacgggaagagagtttgccgcttttttcgccaagaagaaaccccagcgacccaagaactcattgttcaagttcgagtctagctcacatgcgattagtatgtccgcctacctgcgggaacagagaagggaactgtacagtaggtctggggagttacaaggcggacccgacgacaacctgattgaagggggaggaaccaagtttgtgtgcaaaccaggcgctagaaatataacggttattttccaccctctcctgaggttcattcaggaaattgagcatgccctgggcctggggcctgccaagcagtgtcccttgcgcgagttcctgactgtttacattaagaacatctttctcaaccaggtgctcgcggaaatcaataaggaaatcgagggagtaacaaagacatctgatcctttgaagattctggcaaatgctgacacaatgaaggtgctcggtgtgcagagaccccttctccagagtacgatcatcgtggagaagacagtacaggacctactcaatcttatgcacgatctgtccgcctactctgaccagtttctgaatatggtatgcgtgaaacttcaggagtataaggatacatgcacagcagcctatcgtgggatagtgcaaagtgaggagaaactcgtcatctcagccagttgggccaaggacgatgacatctcccggctcctgaagtccctgcccaattggatgaatatggctcagccaaagcagctgcgtccaaaacgcgaggaggaagaagatttcatcagggccgcattcggcaaggagtccgaggttcttataggaaatctgggcgacaagcttatcccgccacaggatatcctgagagacgtgtcagacttgaaagcactcgccaacatgcatgagagcctcgagtggcttgctagcagaactaagagcgctttcagcaatctgtctacatctcagatgttatctcctgcccaggattcacatacaaacacagatttacctccagtgtctgaacaaatcatgcagacactgagcgaacttgccaaatcattccaggatatggctgaccggtgcctcctagtgctacacctcgaggtgcgggtccactgttttcattatcttatacctctcgcaaaggaagggaactatgcaatagtagccaacgtggagtccatggactatgatccactggtagtcaagcttaataaggatatcagcgccatagaggaggctatgagtgctagtctgcagcagcacaagttccaatacattttcgaagggctggggcatcttatctcctgcattcttataaacggagcccagtatttcagaagaataagtgaatccggaatcaagaagatgtgtagaaacatcttcgttctccagcaaaacttaaccaatattactatgagtagagaggcggacctggacttcgcccgacagtattatgagatgctttacaacacagcggatgaacttctcaacctcgtggtagatcagggagtcaaatatacagaactcgaatacattcatgctctcaccctgctgcaccgcagtcaaacaggggtgggggaactgactactcaaaacacgcggcttcagcgattaaaagaaatcatatgcgaacaggctgctatcaagcaggccacaaaggacaaaaaaatcactaccgtttag

SEQ ID NO: 222607 - DNA, 1422 bp, Artificial Sequence
  Description of Artificial Sequence: Synthetic coding sequence
atggccgcagaagccgctggaggcaaatatagaagtactgtgtccaagagcaaagaccctagcggattacttatcagtgtgatacggacattgagtacctccgacgacgtggaggacagagagaacgaaaaggggaggctggaggaagcatacgagaagtgtgatcgggacctggacgagctgattgtgcagcactatacggaattgactacggcaatccgaacatatcagagcatcacagagagaataaccaattctaggaataaaattaaacaggtgaaagagaatctactcagttgtaaaatgctcttgcactgtaagcgagatgaattaaggaagctgtggatcgaggggattgagcacaagcatgtgctaaatttgctggatgaaattgaaaatattaaacaggtcccccagaagctggagcaatgcatggccagcaagcactatctgagcgccacagacatgctggtgtctgccgttgaatccttggagggtcccctgctgcaggtggagggactgtctgatctgcgcctagagcttcacagcaagaagatgaacctgcatcttgtgttaatagacgagttgcaccgacacctgtatattaagtctacctctagggttgtccaaagaaacaaagaaaaagggaagatctcgagtctggtcaaagacgcaagtgtgcccttgatcgatgtgaccaacctcccgacccccaggaagtttctagacacctcacattactcgaccgccggatcttcgtctgtacgggaaatcaaccttcaggatattaaggaggatcttgaattggatccggaggagaattccacacttttcatgggaatcctgatcaagggcctcgctaagctgaaaaaaatacctgagacggtgaaggctatcattgagaggctcgagcaggaactgaagcaaatcgtgaagcggagcaccacccaggtcgcggattccggctaccaacgtggggaaaacgtgacggtggaaaatcagcctcgcctgctgctggagctgcttgagctgctgtttgacaagttcaatgccgtggccgcagcccatagcgttgttctgggctatctccaggataccgtagtgaccccactcacgcagcaagaagacatcaaactgtacgacatggctgatgtctgggtgaagatacaggacgttctccagatgcttttaacggagtacctggacatgaaaaataccagaaccgcctctgagccctcagcccaactctcctacgcgtctacgggcagggaattcgccgcattctttgctaaaaagaagccacaaagacctaaaaacagtctcttcaagtttgaatcctcatcacacgctataagtatgtctgcctatctgagggagcagcgacgggaactctacagtcgatccggcgagctacagggctag

SEQ ID NO: 222608 - DNA, 2622 bp, Artificial Sequence
  Description of Artificial Sequence: Synthetic coding sequence
atgctgctgcactgcaaacgcgacgaactgaggaaattatggatcgagggaatcgagcataaacacgttctcaacctgctggatgagatcgaaaatatcaaacaagtgccccaaaagctggagcagtgcatggccagcaagcattatctgtcagctacagatatgctcgttagtgctgtcgaaagcctggagggtccacttttgcaagtagaaggactgtcagatctccggctcgaattacattctaagaagatgaacctgcacctagtactgattgatgaactgcaccggcatctgtatatcaagtcaacctcacgggtggtccagcgaaacaaagagaagggcaagatttcctccctggtcaaggatgcctcagttcctctgatcgatgttaccaatttaccaaccccacggaagtttctggacaccagccactactccaccgccggatcatctagtgttagagaaatcaatttacaggacatcaaggaggacctggagttagacccagaagaaaattccaccctgttcatgggaattctaattaaaggactggccaagttgaagaagataccagagaccgtaaaagccattattgagagactcgaacaggaactgaaacagatcgtgaaaaggtcaacgacccaggtggcagattctggttatcagcggggtgagaacgtcacagttgagaatcaacctcggttgctactggagctccttgaactgctatttgacaaatttaatgctgtcgccgctgcccactcggtggtgctgggatacctccaggatacagtggtgacccccttgacacagcaggaggacatcaaactttacgacatggccgatgtatgggttaaaattcaggatgtgctgcaaatgctgttgactgaatacctcgatatgaagaacacccgtacggcttcagagccttctgcccaattatcctatgcaagcactggccgagaatttgcagctttttttgctaaaaaaaagccccaacgccctaaaaattccctcttcaaatttgagagctcaagccacgccatcagcatgagcgcctaccttagggaacagcggagggagctgtacagccggagcggggaattgcagggaggcccagacgataaccttatagagggcggtggcaccaagtttgtttgtaagccaggcgctaggaacataaccgttatctttcatcccctcctgaggtttatacaggaaatcgagcatgcactcggcctgggtcccgcaaagcagtgtcccctccgcgagttcctcactgtttacattaaaaacatttttttgaaccaggtactcgcagagatcaacaaggaaatcgaaggagtcacaaaaacaagtgatccattaaagattctggccaatgctgacactatgaaggtcctcggcgtgcagaggcccctgctacaatctactatcattgtcgaaaaaacagtgcaggatttgttaaatctaatgcatgacctgtctgcttactccgatcaattcctaaacatggtatgcgtgaagctccaggagtataaggatacatgcaccgcagcctacagaggcatagtgcagtcagaagaaaaactcgttatttccgcttcttgggcaaaagacgacgacatcagtagactgctaaaaagcttgcccaactggatgaacatggctcagcctaagcagttgagaccaaaaagagaggaagaagaggactttattagagccgcattcgggaaggaatccgaggtgctcatcggtaatctaggcgataagctcattcctcctcaagatatcttgcgtgacgtgtcagacttaaaagcactcgcaaacatgcacgagtcattggaatggctggcatcaaggaccaagagcgccttttctaacttgtccacatcccagatgctgtcccctgcccaggatagccacacgaatacagatctgcctcctgtgtccgaacagataatgcagaccctctcagaactggccaagagttttcaagacatggcggatagatgtctgttagtgctccatcttgaggtgcgggtgcattgtttccattaccttatcccactcgctaaagaaggaaactacgcaattgttgccaacgtggaaagtatggactacgacccactggtcgttaagttgaataaggatataagcgccatagaagaggctatgtcggcttccctgcagcagcataaattccaatacattttcgaaggcctcgggcacctaatttcctgcatcctcattaatggggctcagtatttcaggagaatatccgagtctggaatcaaaaaaatgtgccgtaacatctttgttctgcaacaaaatctgacaaacatcacgatgtccagggaagccgatctggattttgctagacaatactacgaaatgctttacaacactgccgacgagttgctgaatctggtcgtggaccaaggtgtgaaatatacagagctggagtacatccatgccctgaccttgctgcacagatctcagacaggtgtgggtgagctgactacacagaacacacgtctgcagcgactgaaggaaatcatttgcgaacaagctgctatcaagcaggccactaaagataaaaagattacaaccgtgtag

SEQ ID NO: 222609 - DNA, 789 bp, Artificial Sequence
  Description of Artificial Sequence: Synthetic coding sequence
atgcacgagagcctggagtggctcgcctcgcgcaccaagtctgctttttccaatctgtctacttcccaaatgctatctccagcccaagatagccacaccaatactgatctcccacctgtctcagaacagatcatgcagacattgtccgagctagctaaatcgtttcaagacatggcggaccggtgcttgctcgtgttgcacctggaggtccgagtgcattgttttcactaccttatccctttggcgaaggagggcaattacgccatagtcgccaatgtagaatctatggattatgacccacttgtggtgaagctgaacaaggatattagcgccatcgaagaggccatgtccgcttctctgcagcagcataaattccaatatattttcgagggcctgggccatctcatctcatgcatactcattaacggagctcagtacttccgacgaatttcagagagtggaatcaaaaaaatgtgtcgaaatatctttgttttacagcagaacctcaccaatattaccatgtcccgtgaggcagacttggatttcgccagacagtattacgagatgctgtacaatacagccgatgagctgctgaacttggtagtcgaccagggagtgaagtatacagagctcgaatacatccacgccctgaccctacttcatcgctctcagaccggggtgggcgaactgactacacaaaacactagattacagcggttaaaagagataatctgcgagcaagccgcaatcaaacaagcaacaaaggataaaaagatcaccactgtctag

SEQ ID NO: 222610 - DNA, 1755 bp, Artificial Sequence
  Description of Artificial Sequence: Synthetic coding sequence
atggcaaatctcgtcacggcatccaagacaaaaatgtcaaaaggagaggatcctaataatccaagaagtatcaagcggattagtcaagggggtagagataaccaccttgctatcgccaagtgcgatttgacccagttaaagaaaaaacagagcgaggtttccaacgggagtagagagaccatcagtatgaagacatgctgtcagcacggagatcgcggttactggagtacgggctactactggcgcggaggcccagatgataatttgatcgaaggaggcggaaccaaatttgtgtgcaagccaggagccaggaatattaccgtgatctttcatcctttgttgcgtttcattcaagaaattgagcacgccctaggactcgggccagcgaagcagtgccccttgcgtgagtttctgaccgtttacattaaaaatatcttcttgaatcaggtgttggccgagatcaacaaagaaattgaaggtgttacaaaaacctccgatcccttgaagatattggcgaatgccgataccatgaaggttctaggcgttcagcgtcccctgctccaaagtaccatcattgtcgagaagactgtacaggatctcctcaatctgatgcacgacctttcggcctattctgatcaattcctgaatatggtgtgcgtcaaacttcaggagtataaagatacgtgtactgcggcatatagaggcatcgtgcagagtgaagaaaaattggtgatatctgcttcttgggccaaggacgatgatatttcaaggctcttaaaatccttacctaattggatgaatatggcccaacccaaacagctacgaccgaaacgagaggaggaggaggattttattcgcgcagcattcggaaaggagtccgaggtgctgattgggaacctgggggataagctcattcccccacaagatattctgcgtgatgtgtctgatctgaaggcgctggccaatatgcacgagagccttgagtggctggcatccagaaccaaaagtgccttttctaatctgagtaccagtcagatgctgagcccagcgcaggattctcacaccaacactgacctaccgcctgtgtccgagcagatcatgcagacactgagcgagttggctaaatcctttcaagatatggccgataggtgtctgcttgtcctgcatttagaggttcgtgtccattgttttcattatctgattcctctcgccaaggagggaaactacgcaattgtcgcaaatgtggagagcatggactacgatccgctggtcgtgaaattgaacaaagatatctccgctattgaggaagctatgtcggcttctctacaacagcacaaatttcaatacatctttgaaggtctcggccatctaatctcatgcattttgattaacggggctcagtatttccggagaatcagtgagtccggaatcaagaagatgtgcaggaatatattcgtactgcagcagaacctgactaacattacgatgagtcgtgaagcagatcttgactttgcacggcagtattacgagatgctgtacaacacggccgacgaactgctgaacttagtggtagatcagggagtgaagtataccgaacttgagtatattcacgctctcacgctgctccacagaagtcagaccggtgtcggcgagctgacaacccagaacactagactgcagagactgaaagaaattatatgtgagcaggccgcaatcaaacaagccacaaaggacaagaagattactaccgtgtag

SEQ ID NO: 222611 - DNA, 1782 bp, Artificial Sequence
  Description of Artificial Sequence: Synthetic coding sequence
atggccgacgtgtgggttaagatccaagatgtccttcagatgcttctgacagaatatctggacatgaaaaacacaaggaccgcttcggaacccagcgcccaactgtcttatgcaagcactggaagagagtttgcggcattctttgcaaagaaaaagccgcagaggcccaaaaattctctgtttaagtttgaaagttcatcgcatgccatttcaatgagcgcctacctgagggagcagcgcagagagctgtattcaaggagcggcgagttgcagggcggacccgatgataacctaatcgaagggggaggaactaagtttgtgtgcaaacctggcgcaagaaatatcaccgttatcttccaccctttgcttcgtttcatacaagaaatcgagcacgcccttggcctgggcccagctaagcagtgcccattaagggagttcctaaccgtgtacataaaaaatatctttcttaatcaggtgctggccgaaatcaacaaagagatcgaaggggtcactaagactagtgatccactaaagattttagctaatgctgatactatgaaagtactgggcgtccagcgcccactcctccagagtaccataattgttgaaaagaccgtccaggacctgctgaacctcatgcacgatctgtcagcttattccgatcagttcctgaacatggtgtgtgttaaactgcaggagtacaaggacacttgtacagccgcttatagaggtatagtgcagtccgaggaaaagctggttattagcgcgtcttgggctaaggacgacgatatctcaagactccttaagtccttaccaaactggatgaacatggcgcagcccaagcaactcaggcctaaacgcgaagaagaagaggattttattagggccgcattcgggaaggagtccgaggtgctgatagggaatctaggggacaaattgattcctccacaggacatcctaagggacgtgtcagatttaaaggccctcgcaaacatgcacgagtcgcttgagtggctggcttcgcggacgaaaagcgccttctctaacttatcaactagccagatgctttcccctgctcaagattcacacaccaatacagacttaccacctgtatcggaacagatcatgcaaactttatccgagttggctaaaagttttcaggatatggcagatcgatgtctgttggtacttcacttagaggtgagagtgcattgcttccattatttgattcctcttgctaaggagggcaattacgctattgtggccaacgtcgaatctatggactacgatcctctagtagtgaagttgaataaggacatttcagccatcgaggaagcgatgtcggcttccctgcaacaacataagtttcagtacatcttcgagggcctgggccacctaatctcttgcatcctgatcaatggagcccagtacttcaggaggataagcgaatccgggattaagaaaatgtgccggaacatttttgtattgcaacaaaacctgaccaacattacaatgtccagggaggcagatcttgacttcgcccgtcagtattatgaaatgctgtacaacactgcagatgagttgctcaacctcgtggtagatcagggagtgaagtacaccgaactggaatatattcacgccctcaccttgcttcaccggagccagaccggagttggagagttaaccacacagaatactcgtctgcagcgcctcaaggagatcatctgcgaacaggcggcaatcaaacaagcaactaaagacaagaagattactacggtctag

SEQ ID NO: 222612 - DNA, 1932 bp, Artificial Sequence
  Description of Artificial Sequence: Synthetic coding sequence
atggctacaaccgcggagctttttgaagagccctttgtggccgatgagtacattgaacggctcgtgtggcgcacacccggtggcggttctcggggaggtcctgaagcgtttgatccaaaacgcctactcgaggaatttgtgaaccacatccaggagcttcagattatggatgagcgcattcagagaaaggtggagaaactcgaacaacagtgtcaaaaagaagccaaggagtttgctaagaaagttcaggaactccaaaagagtaaccaaattaaagaagctgcagacatcatacagaagctgcatctgatcgctcaggagctgccatttgatcgattctccgaggtgaaatccaaaattgcgtcaaaatatcacgatttggaatgccaactgatacaggaatttaccagcgcacagcgacggggtgaaatcagccgcatgcgggaggtcgcggctgttctgctgcactttaagggatactctcattgcgtggatgtatacattaaacagtgtcaggaaggcgcttatctgcgaaacgatattttcgaagacgccggtatcctgtgtcagcgcgtgaacaaacaggtgggcgacatcttttctaaccccgagaccgtcctcgccaagctaatccaaaacgtgttcgagataaagcttcagtctttcgtcaaggagcagctcgaggaatgtcgaaagtccgatgcagagcaatacttgaaaaacctgtatgatctgtacacccgtacaaccaacttgtcctccaaactgatggaatttaacctgggcactgataagcaaacctttctctcaaaactgattaaatctatttttatctcctatctcgaaaactatattgaggttgaaacgggctacttaaaaagtcgtagcgctatgattctccaacggtactacgatagcaagaatcaccagaagagatcaattgggacagggggaatccaagacctaaaagagcgaataagacagcgaacaaacctgccccttgggccttccattgatactcatggggaaactttcttatcgcaagaggtggtggtaaaccttctgcaggaaacgaagcaggcctttgagagatgccaccgactgtctgatccttcagacctgcctcggaatgcttttcggatttttacaatcttggtggagttcctgtgcatagaacacatcgactacgcacttgagacgggactcgctggaataccatccagtgatagccgcaatgctaatttatactttcttgacgtggtgcagcaggccaacaccatcttccacttgtttgataaacaattcaacgaccatctgatgccgcttatctccagttcaccaaaactgtccgagtgtctgcagaagaagaaggagataatcgagcaaatggagatgaagctggacacgggcattgatagaaccctgaactgcatgatcgggcagatgaagcatattctggccgcagaacagaaaaaaacggacttcaagccagaggacgaaaataacgttctcatacagtacaccaatgcttgcgtgaaggtgtgcgcttatgtccgcaagcaggtggagaagattaaaaatagcatggatggcaagaacgtcgatacagtcctcatggagctgggcgtaagattccaccgccttatttacgaacatctccagcagtactcttactcctgcatgggagggatgctggccatttgcgacgtggcggagtacagaaaatgtgcaaaggacttcaagatccccatggtcctgcatttattcgacactctccacgctctttgtaaccttctggtggtggccccagacaatcttaagcaggtctgttccggtgagcagttggctaacttggataagaatattctgcacagtttcgtacagctgagagccgattaccgcagcgcaaggctcgcaagacacttctcttag

SEQ ID NO: 222613 - DNA, 2127 bp, Artificial Sequence
  Description of Artificial Sequence: Synthetic coding sequence
atggccacgacagctgaactgttcgaggagcctttcgtggctgacgagtatatcgagcggcttgtgtggcgaaccccaggaggcggaagccggggagggccagaagcctttgacccaaagagattgttagaggagttcgtcaaccacatccaggaactccagattatggatgaacgcattcagcggaaagtggagaaattggagcaacagtgccagaaagaggccaaagagttcgcaaaaaaagtgcaggagttacagaagagtaaccaggtggcatttcagcacttccaagagctcgacgaacacatatcatacgtggccacaaaagtttgccacctcggcgaccaattagaaggagtgaacacccccaggcagcgggcagtggaggcccagaaactgatgaagtatttcaacgagtttctggatggcgagctgaaatccgatgtgttcacaaactcggagaagataaaagaagccgctgatatcatccagaagttgcacctgattgctcaggagctacccttcgaccgctttagcgaggtgaagtcaaagatagcctcaaagtaccacgacctagaatgtcaattgatccaggagtttacttcggctcagcgcaggggcgagatctcgcgcatgagggaggtcgcagcggtgctactgcacttcaagggatatagtcattgcgttgatgtctatattaaacagtgccaggagggcgcttacctgcgaaacgacatctttgaagacgccggtattctatgccaacgcgtgaacaaacaagtgggagatattttttctaacccggagacagtgctggcaaaactcattcagaatgtcttcgaaattaaactgcaaagctttgtcaaagagcagctggaggagtgtcggaagtcggacgccgagcagtatcttaaaaacctctatgacctgtacacaaggacaacaaacttgagcagcaagctcatggaatttaaccttgggaccgacaagcagacttttctttccaaactaattaagtcaattttcatctcttaccttgaaaactacatcgaagttgagaccggataccttaaaagcagatccgccatgattttgcagaggtactacgactccaagaaccaccaaaagcggtccatcggcactggtggcattcaagatcttaaggaaaggatacgccagcggactaacctgccactcggcccaagtatagacactcacggggagacattcctgtcacaggaggtagtggtcaacctccttcaagaaacaaagcaggccttcgagaggtgccaccgattaagtgacccaagcgacctccccagaaacgcgttcagaatcttcactattctcgtagagttcctttgtattgaacacattgactacgccctcgagacgggcttggcaggaatcccgagcagcgattcacgcaacgcaaatttgtacttcttagatgtggtgcaacaggctaatacaatctttcatctctttgacaaacagtttaacgaccatctgatgccactgatatctagcagtcctaagctgtctgagtgcctacaaaaaaagaaggaaataatagagcaaatggagatgaagttagacactggcatagaccgcacactcaactgcatgataggccagatgaagcatatcttggccgctgaacagaaaaaaacagactttaaacccgaagatgagaacaacgtgctgatccagtatacaaatgcctgtgttaaggtctgtgcctacgttcggaaacaggtggagaaaataaagaattccatggacggaaagaatgtcgacacggtgctcatggaactgggcgtgcggtttcatcggttgatctatgagcacttgcaacagtactcttactcatgtatggggggtatgctggccatttgcgacgtagctgaatatagaaaatgtgctaaggattttaaaattcctatggtgctccatctgttcgacacgttacatgccctgtgcaacctgctagtcgtagcgccagataatctgaagcaagtttgtagtggtgagcagctagcaaatctcgataagaatatacttcattcatttgtgcagctgcgggcagattaccgctcagctaggcttgcgagacatttttcttag

SEQ ID NO: 222614 - DNA, 2415 bp, Artificial Sequence
  Description of Artificial Sequence: Synthetic coding sequence
atggcagagaactctgagagcctaggaacagtgccagaacatgagagaatcctgcaagagatcgagagcaccgacactgcctgtgtgggtcctacacttcggagtgtgtatgatgaccaacctaatgcccataaaaaatttatggaaaagctggatgcctgtattcgcaatcatgataaagagattgagaaaatgtgcaatttccaccaccaaggattcgtggatgccatcacggaactcctgaaggtgcgaaccgatgccgaaaagttgaaggtacaagtcactgacacaaaccggcgattccaggacgctggaaaggaggtaatagtccacactgaagacattattaggtgtcgtattcagcagagaaatattacaacagttgtggaaaagcttcagctctgcttacccgtgctggagatgtactccaaactaaaggaacagatgagtgctaagcgatattacagcgcccttaagacaatggagcagcttgaaaatgtctacttcccctgggtcagtcagtacaggttctgtcagctgatgattgaaaatctccctaaactacgggaagacattaaagaaatcagtatgagcgacctcaaggactttctggagagcatccggaagcattccgacaaaataggcgagacagccatgaaacaggcccaacaccagaagacatttagcgtaagcttgcagaagcagaacaagatgaagttcggaaagaatatgtacattaaccgagatcgcatccctgaagagcgcaacgagaccgtgctgaaacatagcctcgaggaggaagatgagaacgaagaggagatactgacagtgcaggatctggttgatttttccccagtctacaggtgcctacacatttactcagtgctgggagacgaggagacctttgaaaattactatcgtaagcaaagaaaaaaacaagcacggttagtgctacaaccccagtcaaacatgcatgaaacagtggacggatacaggcggtactttacccaaatagtcggcttcttcgtggtagaagatcatattttacacgtgacgcaagggctagttacccgcgcatacactgacgaactttggaatatggcccttagcaagatcatcgccgtgctccgcgcacactccagttactgcactgaccccgaccttgtcctcgaactgaagaaccttactgttatctttgccgataccctgcaggggtacggttttccggttaaccggttattcgaccttcttttcgagattcgggatcagtacaacgagacattgctcaagaagtgggctggcgtgtttcgcgacatattcgaagaggataactacagcccgatcccagtggtgaatgaagaagagtacaaaatcgtaattagcaagtttccatttcaagatcctgatctggagaagcagagctttcccaagaagttccctatgtcacagagtgtgcctcatatttatattcaggtgaaggagttcatatacgcaagcctcaaattttcagagagcctgcacagatcgagtaccgagatagatgatatgctccgtaaaagcacaaatcttctcttgacacgcactctgagcagttgcttgctgaacttaataaggaagccacatataggactcaccgaacttgtgcagatcatcattaacaccacccacctggaacaggcatgcaaatatctggaggattttatcacaaacatcaccaatatctctcaggaaacagtgcacacaaccaggctgtacggcttatctacctttaaggatgcacgtcacgccgctgagggcgagatatacacaaagttgaaccagaaaattgatgagttcgtgcagctcgccgattacgattggacgatgtcagaacccgatgggcgagccagcggatacctgatggacctcattaatttcctgcggtctatatttcaggtttttacccacctgcccggtaaggtggcacagactgcctgtatgtccgcctgccagcatctgtctacttccctgatgcagatgctgctcgactccgaactgaaacagatttctatgggcgcagtccagcaattcaacctggacgtcattcagtgtgagttgtttgcctccagcgagcctgtaccgggattccagggtgacacactgcagctggccttcatagacctgcgacagctcctagacctttttatggtttgggattggagtacatatttggccgactacgggcaaccagcgtccaagtatctgagggtcaaccctaatacggctctcacgctcctggaaaaaatgaaggatacttcaaaaaaaaataatatattcgctcagttcaggaagaacgatagagacaaacagaagctaattgaaaccgtggttaagcagctgcggagtctagtgaacggtatgtcacagcacatgtag

SEQ ID NO: 222615 - DNA, 462 bp, Artificial Sequence
  Description of Artificial Sequence: Synthetic coding sequence
atggcagagaatagcgaatcgctgggaacagtgccagaacatgaaagaatccttcaggagatcgagtcaacagacaccgcctgcgtaggcccaacacttcgctccgtgtacgacgaccagccaaacgcccataagaagtttatggagaagctggatgcctgcatcagaaaccacgataaggaaatcgagaagatgtgcaatttccaccaccagggattcgtggacgcaatcacagaactgctcaaagtccggacagacgccgagaaactgaaggtccaagtcacagatactaatagaaggttccaggacgctggcaaggaagtaattgtccacacggaagacatcattaggtgtagaatccagcaaagaaacatcactacagtggtcgagaagctccagctgtgcctgcccgttctagagatgtactcgaaactgaaagaacagatgagcgctaaacgctag

SEQ ID NO: 222616 - DNA, 2463 bp, Artificial Sequence
  Description of Artificial Sequence: Synthetic coding sequence
atgtgctgcgtgggaggggcagggagctgcagcgataccggaaagctaggggcttgcagagcaatgctggaggaagagactgaccagacatacgaaaacgtgttagccgagattcaatcatttgagctcccagtggaggctaccttacggagcgtgtacgacgaccagcctaacgcccacaagaaattcatggagaaactggacgcttgtatccgaaaccacgataaggagatagaaaagatgtgcaattttcatcatcaggggttcgtggatgcaataaccgaactcctcaaggtgcgcactgacgcggaaaaattgaaggttcaggtcacggacacgaatagaagatttcaggatgcaggaaaagaggttattgtgcataccgaagatatcatccggtgtcggatccaacagcggaacatcaccaccgtggtggagaaactccaactttgcctgccggtgctcgagatgtactcaaagttgaaggagcaaatgagcgcgaaaaggtattattcggctctgaagaccatggagcagttggaaaacgtctacttcccctgggtgagtcaatacagattttgccagctgatgatcgaaaatctgcctaagctgcgtgaggatattaaggagataagtatgagtgacctgaaggactttttggagagcatccgaaagcactctgacaagattggcgagacagcaatgaagcaagctcaacatcaaaagacgtttagcgtgtcactgcagaagcaaaacaagatgaagttcggaaagaatatgtacatcaaccgcgaccggatccccgaggagaggaatgagaccgttctgaagcactctttggaagaagaggatgaaaatgaagaagaaattctgacggtccaggacctggtggacttttcccctgtctaccgatgcctgcacatttacagcgtgttgggtgacgaggagacattcgaaaattattatcgcaaacaacgcaaaaaacaggctcggctcgtgttacaaccgcagagcaacatgcacgagactgttgacggatatagaaggtactttacccagatcgtaggatttttcgtggtcgaggatcacattttgcatgttacccagggtctggtgactcgcgcttacactgacgaattgtggaacatggccctgtcgaaaatcatcgctgtgctgcgcgcacattccagctattgtacagaccccgacctggtactagagctgaaaaatttgacagttatctttgctgatacgcttcagggatacggcttccctgtgaaccgattgttcgaccttctgtttgaaattagggatcagtacaatgagacattactgaagaaatgggccggtgtgtttcgagatatttttgaggaagacaactactcacccattcccgtcgtaaatgaggaagaatataagattgttatctctaaattcccttttcaggatccggatctagagaaacaaagtttccccaagaaattccctatgtctcagagcgtgccccacatctacatccaggtgaaggaatttatttatgccagcttgaagttctctgaaagtctgcataggtccagcaccgagattgacgatatgttgcggaaaagcactaatctgctcctgactcgcacgctaagtagctgccttctcaacttaatcagaaagccacacataggcttgaccgaactcgtgcagattataatcaacactacccacctggagcaagcatgcaaatacctggaggatttcattactaatattacaaacataagtcaggagacagtccatacgacccggctttatggtctgtctacattcaaggatgccagacacgcagccgagggggagatctataccaagctgaatcaaaaaattgacgaatttgtgcaactcgcagactatgattggactatgagtgaacccgacggacgcgctagcggttacttgatggaccttataaatttcctgcggtctatctttcaggtattcactcacctgccgggaaaagtggctcagacagcctgcatgagtgcctgtcaacacctttccacttctctgatgcagatgctgctcgacagtgaactcaagcagatttctatgggcgctgtgcaacagtttaatctggatgtcattcagtgcgaactgttcgccagctctgagcccgttcctgggttccaaggggacacactgcagttggcatttattgatttgcggcagctgctggatctgttcatggtttgggattggagtacatatctcgccgactacggtcagcctgcctcgaagtacctccgggttaatcccaatacagcactcacgctgttggagaagatgaaggatacctccaaaaagaataacatctttgcgcagttcagaaaaaacgatagagataaacaaaagctcatcgaaacggtggttaagcagctcaggagtttggttaatgggatgagccagcacatgtag

SEQ ID NO: 222617 - DNA, 2400 bp, Artificial Sequence
  Description of Artificial Sequence: Synthetic coding sequence
atgttggaggaagaaacagaccaaacgtacgagaacgttctagccgagattcagagctttgagctcccagtggaagccactctgcgatctgtgtacgacgaccagccgaacgcgcacaagaagtttatggaaaagctggatgcctgcattagaaatcatgacaaggagatagagaagatgtgtaacttccaccatcaggggtttgttgacgccattaccgagctcctcaaagtcagaaccgatgccgagaaacttaaagttcaggtaaccgatacaaaccgcaggtttcaggacgcaggaaaggaggtgattgtgcacaccgaagacataatcaggtgccgtatccagcaacggaacatcaccacagttgttgagaagttacaactgtgcctgcctgtgctggaaatgtactcgaaactcaaggagcagatgtccgcaaaacggtattatagcgctctgaaaactatggagcagttggaaaatgtctacttcccttgggtgagtcagtaccggttttgccaattgatgatcgaaaatctccccaaacttagggaggacattaaagagattagcatgtcagaccttaaagatttcctggagtccatccggaagcactccgacaaaatcggggaaacagccatgaagcaggctcagcaccaaaaaacattctcagtgtcgctgcagaagcaaaacaagatgaagttcggtaagaacatgtatatcaatagagataggatccccgaagagagaaacgagactgtcttgaagcactcactcgaggaggaagacgagaacgaggaagagatccttaccgtgcaggacctagtggacttttctcctgtttacaggtgcctgcatatttattcagtattaggggatgaggaaacattcgaaaattactatcggaagcagaggaagaagcaggccagactggtgcttcaaccacagagtaatatgcatgaaacagtggacggctacaggaggtatttcactcaaattgtgggtttctttgtagtggaagatcacatccttcacgtaacccagggattggtcacacgggcttatactgatgaactgtggaatatggcattgagcaagatcattgctgtcctgagggcccattcctcctattgtaccgatcccgatctggtgctggagttgaagaacctcactgttatcttcgcggacacattgcagggctatggattccccgtaaatcgcttatttgatctgctgtttgagattcgtgaccaatataacgagacccttctcaagaagtgggccggagtcttccgcgacatcttcgaagaagacaattattcgcctattcccgtggttaacgaggaagaatacaaaatcgtcatcagtaagtttccttttcaggatccagatctagaaaagcaatcttttccaaaaaaattcccaatgtctcagagcgtgccccatatttatatacaggtgaaggagtttatctacgcttcactaaagttctcagagagccttcatcgttctagcacagagatagatgatatgttgcggaagtcaacaaacctgctgctgactcggactttaagctcttgtttgttaaatttaatccggaagccacacatcggcctcactgaactggtgcagatcatcatcaacactacccaccttgaacaggcttgtaagtatctggaggattttattactaatatcactaacatcagccaggagaccgttcatacaaccagactttacggcctgtcaacctttaaggatgcacgacacgccgcagagggtgagatctacacaaaactgaaccagaaaattgacgaattcgtccagctagcagattacgactggaccatgtctgagccagatggtagagcctctgggtacttgatggacctgatcaactttttaagaagcattttccaagtgtttacccatcttcctggcaaggttgcccagacagcatgcatgagcgcctgtcaacacctgagcacgagcctcatgcagatgttgcttgactctgaattaaagcagatctctatgggcgcagtccaacaattcaaccttgatgtgatccagtgcgagctatttgcatcgtccgagccggtgcctggctttcagggagataccctccagctggcctttatagacttaaggcaattattagacttgtttatggtctgggattggagcacctacctcgccgattacgggcagcctgcctcgaagtaccttcgcgtcaatccaaatactgctcttaccctgttggaaaaaatgaaagacacgtccaagaagaataatattttcgcacaattcaggaaaaacgaccgtgataagcagaagctaatcgagactgtcgtgaagcagctccgatcgctggtgaatgggatgagccagcacatgtag

SEQ ID NO: 222618 - DNA, 2106 bp, Artificial Sequence
  Description of Artificial Sequence: Synthetic coding sequence
atggccgaaaacagcgaaagcttaggaaccgtccccgaacacgagcggatcctacaggaaatcgagtctaccgatacggcatgtgtggggcctaccctccggagcgtctatgatgaccagcctaatgcccacaagaaatttatggaaaaactggacgcctgtataagaaatcatgacaaagagatcgaaaaaatgtgcaacttccaccaccagggattcgtcgatgccataacagagctccttaaggtccgtaccgacgcggagaagctgaaggttcaggttacggacactaacagacgctttcaggacgcaggcaaagaggtaattgtgcacactgaggatatcataagatgccgtatccagcagcggaatattaccactgtcgtggagaaactgcagctgtgcctgccagtactcgagatgtactcaaaactgaaagaacagatgtccgcaaagcgctactacagcgccctgaaaacaatggagcagctggaaaacgtctacttcccttgggtctctcagtacagattttgccaattgatgatcgaaaacctgccgaagttacgagaagatattaaggagatttctatgagtgaccttaaggacttcctggaatctatcaggaagcactcagataagatcggagagacagctatgaaacaggcgcagcaccagaagacattctctgtatcccttcagaaacagaacaaaatgaaattcggcaaaaatatgtatattaacagggaccggattccagaggaaagaaacgaaactgtcctgaaacactccctcgaagaggaggacgagaacgaggaagagggtgatgaggaaacctttgaaaactattatagaaagcagcggaaaaagcaggcacggctggttctacagcctcaaagcaatatgggttatgggtttcccgtgaacaggctgtttgatcttctcttcgaaatccgggaccaatataacgagactttgttaaagaagtgggccggtgtctttcgcgacattttcgaggaggataattatagccccatccccgtggtgaacgaggaggaatacaaaatcgtgataagcaagttccccttccaggaccccgacctggagaaacaaagcttcccaaagaaatttcccatgtcacaatctgtcccccacatctatattcaggtaaaagagttcatttacgccagcctgaagttcagcgagtctcttcatagaagcagtacggagatcgatgatatgctgagaaagagcacaaatttgttgctaacccgcaccttatctagctgcctgctgaatctgattagaaagccccatatcgggctcactgaactggttcagatcattattaatactactcacttggagcaggcctgcaaatatctggaagattttatcactaatattacaaacatctcacaagagacagtgcataccacacggctgtacggtctcagcacctttaaggacgctaggcacgcagcagaaggggagatctacactaagctgaaccagaagatcgatgaattcgtgcagctggccgattacgactggacaatgtcagaaccagacggtcgcgcatccggttacctcatggacttgattaatttcctacggagcatctttcaggtgttcacccatctccctggcaaggtggctcagacggcctgtatgagcgcatgtcaacatctctcaaccagcttaatgcagatgttgctggacagtgagttaaaacaaatctccatgggagccgtgcagcagttcaacctggatgtaatccagtgcgagctctttgctagctccgaaccggtgcctggctttcagggcgataccctgcagttggccttcatcgatttgaggcagctcctcgaccttttcatggtgtgggactggtctacataccttgcagattatggacaaccggcatctaagtaccttcgggtcaacccaaataccgccttaactctgctcgaaaagatgaaagatacgtccaagaagaacaacatctttgctcaattcaggaaaaacgaccgggacaaacaaaagctgatagaaaccgtggttaagcaactgagatccctggtcaacggtatgtcgcagcacatgtag

SEQ ID NO: 222619 - DNA, 219 bp, Artificial Sequence
  Description of Artificial Sequence: Synthetic coding sequence
gggaaggtggcacagacagcctgtatgtctgcctgtcagcacctttcaacatcgctgatgcaaatgctattagattctgaactgaagcaaatctcgatgggcgctgtgcaacagtttaacctagatgtcatccagtgtgagctgttcgcttcatcagaacccgtacccggtttccagggggacaccctacaacttgcattcattgaccttagacagtag

SEQ ID NO: 222620 - DNA, 2436 bp, Artificial Sequence
  Description of Artificial Sequence: Synthetic coding sequence
atggaacgtgggaagatggccgaggctgaatctctcgagacagcagcagaacacgagcgcattctgcgcgagatcgaatcgacagacacggcttgcatcggcccaaccctgcgaagcgtctacgatggcgaggagcatggacgcttcatggaaaaactggaaacacggattcgtaaccacgaccgtgagatcgaaaaaatgtgtaactttcattaccaggggttcgtggattctatcacagaactgcttaaggtgagaggagaggcccagaagctcaaaaaccaggtgacagacaccaaccgcaagctccaacacgaggggaaggagctagtaatcgctatggaggagctgaaacaatgtcgactgcaacagaggaacatatccgctacggtggataagctgatgctgtgcctcccagtcttagaaatgtactctaaactacgcgaccaaatgaagaccaagagacactaccctgccctgaagacattggaacaccttgaacacacatatctcccccaggtctcccactatcgcttttgtaaggtcatggtggacaacattccgaagctgagagaggagatcaaggatgtatctatgtccgatttgaaggacttccttgagtctatccggaagcacagcgacaagattggcgagacagccatgaagcaagcccaacagcagaggaatcttgataatattgtcctgcagcagcccagaattggctctaagaggaaatcaaaaaaagacgcatacatcatctttgacacagaaatcgagtccacctcgcctaaaagtgagcaggactctggcatcttggatgtagaggacgaggaggacgatgaggaagtgcccggagctcaggacctcgtagatttttctccagtgtaccggtgcttacacatatacagtgtactaggtgcaagggagacattcgagaattattaccgaaagcagaggcgcaaacaagctcggctcgtgctgcagcctcccagcaatatgcacgagacccttgatggctaccggaagtatttcaatcagatcgttggattcttcgttgtggaagaccatattctccataccacacaggggctggtgaatcgggcttacattgatgagctgtgggaaatggctctgagcaagaccattgctgccctccggacacacagttcgtattgcagtgaccctaacctggtcctggatctgaagaatttgatagtgctgttcgccgatacccttcaggtttatgggttcccggttaaccaactgtttgacatgttgctggagatcagggatcaatacagcgagacactacttaagaagtgggccggtattttccgtaatatcttggattcagacaactacagcccgatccccgtcacttctgaagagatgtataagaaggtggtgggtcagtttcctttccaggacattgagctggaaaaacagccatttcccaaaaagttccctttcagtgagtttgtgccaaaagtttacaatcagattaaagagtttatatacgcgtgcctaaagttttctgaggatcttcacttaagctcgacagaggtagatgatatgatccggaaatccacgaacctgctccttacccggaccttgtctaatagtctgcagaacgtgattaagaggaagaatatcgggctgaccgagctggttcagataataattaacaccacacatctcgaaaagtcatgtaagtacctggaagaattcatcaccaatatcactaatgtgctccctgaaacagtgcatacaacaaagctgtatggaaccacaacttttaaagatgcccgacacgctgccgaggaagagatctataccaacttgaaccagaaaattgaccagttcctgcagttggccgactacgactggatgaccggcgatttggggaacaaggcatctgattacctggttgacttgattgccttcctgcggtcgacattcgccgtcttcacccatctccccggaaaggtggcccaaactgcttgcatgtcagcatgtaaacaccttgccactagtctgatgcaacttttgctggaagctgaggtgcgtcagctaacactaggcgcactccagcagttcaacctggacgtccgagagtgcgagcagttcgcacgatccggacctgtaccaggctttcaagaagacacgctccagcttgcgttcatcgatctacgccaactgctggatttgtttatccagtgggactggtccacttacctcgcggactatggccagccgaattgcaagtaccttcgcgtgaaccccgtcacagctctgacgctgctggagaaaatgaaggacacatcgcgtaagaataacatgttcgcgcagtttcgtaaaaatgagagggataaacagaaattaatcgacaccgttgccaagcagctgcgtggcctcatctcgagccaccacagctag

SEQ ID NO: 222621 - DNA, 2016 bp, Artificial Sequence
  Description of Artificial Sequence: Synthetic coding sequence
atggaacggggtaagatggcagaagcagaaagtctcgaaacagcggctgagcatgagaggattctgcgcgagattgagagtactgacactgcttgcatcgggccaacgttgcgcagcgtttacgatggcgaagagcatgggagatttatggagaagttggagaccaggatacgtaaccacgatcgcgagatcgaaaagatgtgtaattttcattaccaaggcttcgtggacagcattacagagctcctaaaagtgcggggagaagcacagaaactcaagaaccaggtaaccgataccaatcggaagctgcagcacgagggcaaggagctggtgattgcgatggaggaacttaagcaatgtcggctccaacaacgcaatatctccgctaccgttgataaactaatgctgtgcctgccagtgctggaaatgtactcaaagctccgtgaccagatgaagacaaaacgccactacccggctcttaaaacacttgagcacttagaacatacctacctcccacaggtgagccactacagattctgtaaggttatggttgataatatcccaaagcttagggaggagattaaagacgtttctatgagcgacctgaaagacttccttgagtctattagaaaacactccgataaaatcggagagacagcaatgaaacaagcccaacagcagcgcaacttggacaacattgtcctgcagcagccacgaattgggtcaaaacgtaaatccaagaaagacgcatacatcatatttgatacggaaatcgagtccactagtcccaagtcagaacaggatagtggcattctggacgtggaagatgaggaggacgacgaggaagtccccggagctcaggatctggtagatttctcaccggtgtaccggtgcttgcacatctatagcgtgctcggcgcaagggaaactttcgaaaattattacaggaaacagagacgaaaacaggcaagacttgtcttgcagcccccttcaaacatgcatgagacactggacggatacaggaagtacttcaaccaaatcgttggattttttgtcgtggaggatcacattctgcatacgacacaaggcctcgtcaatagagcctacattgacgagctctgggaaatggcgctctcaaagactatagctgccttgcgcactcattctagctactgttccgatccaaatctggtgctagacctgaaaaatctgattgttctgtttgccgacacactgcaggtatacgggtttcccgtgaaccagctcttcgacatgcttctagagatccgcgatcagtattctgagacgctcctcaagaaatgggcaggaatcttcaggaacattctagatagtgacaactattccccgatccccgtcactagcgaggaaatgtacaaaaaggtcgttgggcaattccctttccaagacatagaattggagaagcagcccttccctaaaaagtttccattctccgaatttgtgcccaaagtctacaatcagataaaagaatttatttatgcctgtctcaagtttagcgaggatctccacctgagcagtaccgaggtggacgatatgatccgcaagtcaacaaatctcctgcttacccgtacactgtctaacagtctccaaaacgtgattaaacgaaaaaatattggcctgactgaactggtgcagattattattaacaccacacatctcgaaaagtcctgtaaatatctggaggagttcattacaaatattaccaatgtgctgcctgagaccgtgcatactactaaactttacggtacaaccacattcaaagacgcaagacacgctgcggaagaagaaatttatacgaacctaaaccaaaagattgaccaatttcttcagctagcagattatgactggatgacaggggatctcgggaacaaagcctcagactacctcgtagacttgattgcatttctgagatccaccttcgcagtgtttacccatctccccgtctccgggagctgttatttcgtgctttacatatag

SEQ ID NO: 222622 - DNA, 5970 bp, Artificial Sequence
  Description of Artificial Sequence: Synthetic coding sequence
atgacgaaggtgcctcccgcattcgatttcagcttcctaaatgacgaggaggccaggaagatactgcaggtgctggaacgtaacgaggagttgcagcgggctgagaaggatcggattagcaagctccaaaagaccaaaagggacattcggtggctacagggagttaccggggagtggttcgaggagatacagaggaaaaagttttgcaacgaaactgatgtgtcccagatgctgaagcagccacttacctatcggctctctaaagagatggccaaaaacgaccccatcgaactccccacatccagatccaagaatgtgactaatcaaaaaaagcctactcctttctcctcacggatgagttttaggagcagcttcgcctccttattcagctttcgaaaaagtggcaaagagactagtaaactgccatcccttggacagaagggctgcgatggccatgcaggaccaccaatgccggttcgaggtgcagcggtccaggctaagatttataacagtccactagaaaatcacttagtggatagtaccttcgtgccgaagcctgcagtgatgcgcgaggaaagcggaatgccccctccgtgggacgcttctcttttggaaaatgagttcttccaggtcttggacgatttagattcaaaacttgctcaagagcaatcagcgagctcagtgaatacacgaactccactgaactacggctctaggactcagttcggtcacttttattcgtcaggcaaccgacacggcaatatcaccgagcgtcacaagaagcactataacgagacatcaaatatgtccatttatgacattctgcgtcccggaacccctcgggaagggttcaagacattcagtccacgaacttctacgatatatgacatgtacaggacccgcgagcccagagtgtttaaggaagattacgtgcagaagaatactttcgggagcacctcgctttgcttcgacagtaggcagcgtagcgcgcttcctgccacaggccattttactgcgcgatcactccatttccctgctaccacccaaagcaagagtggtttcatccccccaaggcaccagcaaagccccaaaagaacgccgctcagtagcataatctggaatcgctccgactcctccagggatagggaaaaccaagaagagttcctgcgagctcccagtccgatggaaattgaccctgcagacaagtacgtatatccaagaggttttcaggaaaacaagaggtatgagtcatatcattctcagaatgtttatcagcgagtgagcctaaacgccccaatggagaatgcgatgtcacctgacacttttgaaaattctgagaacatgcctttctaccaccaaagcaatacgtttacccggtctttcttttcgaacacctttggaaggtcaggtgaacagcggagatttggacagggaccgttttgggggcaagagaaaggacatagcttctggtctgacttccaccgttcaaggaaaagcttttcctcaagtgatcgggatttcgagatgataagcatggaggctaactctgttagcgccatccatggacacaacgtctcctccgaacactgggaaagcttcagcagtgggtacggcactgatgtcagtcggggtcaggaagagccccacccttggcaattcgactttcaacgatcaaccttagacagtatggtcgtgtcccacggaaatgagactcaactgacaccccattttggcaccccaaacgtgtgttctatgacgggaagttcctaccacgtgaaatcctctgagttggtgtcccagcaagattcctcgcccgtagaagtccatatcaataaagaggcttcatccttcggtatagcacagactctggcctcctccttcaagacctcgtttagccagatctccgacgaccgcaggaatccccagtcacccaatctgcagaaccccacagttacacttcagaaaatttttccaaacaaacctgcttcccacccgatgcgctcacataccgaagttactgtaacttcatccaatagcgtggactccctgcctcttgctaagagccagcccaatatcctggtcacagaggtcaataatgaaaaggacctcaacgagagcatctcggaggaagataaacagctctctaagatggatcagactaacaaggccggagagatcccccagcctgtcagccagacgggcatttccaactccttaccagactttcaaaaccctctgagccaggattccgctaagtctaacggctttggtttcaatgcctctacgattatttcttcaaagaaatcaccgcgtgtgttctctagaaaagatacgagcaaaatgtacatcccacataccgataaatctaacgacatcaaacaggacaagaggttcactgaaaatagaaagttaggttccactgcttcacttccgtttatccaggagcaccgtacaccgcctagtttcccccgtacggatcagggttgccaccaggaattaaccgtcaacaacgaagacatctctcgtattattacaaataaccattggtcatccgccctcactgatactcagaatgcccagtatagtaaatgtaaactcacacccggtcataagacctcatgcgactccctggatctcagtagcgctgctcttccagatagcagccccagtaaaaactctagtcttgatgcccctgtcgtgccatcaacgacagtgttctcgcgtagatccccctcagataaggatccttccctaggggaacgcgaggaaaaggacaatgcaggcaagaaccagaaaaaccaatttatcgtctctcactccgaaaaccaggaaaggaacgacagccctgtacctacccatgatgaggtagtggacgtcaagtgccactcacatagtcccttccgcaatgaacggggtaagggcaagataaggcaccacatttcttgtatagagaagctctccaagactgagtctattagtgtgccaaccagcgaccatcgatctctgattgaggccaatcagtccaattccaaggtctctgaactggacacgatctattgcactctgccccgaaaatccagctcttttctgatacatgggagacaaagtggctccaagataatggccgcatctctacggaacggtcccccacctttccagatcaagaacaatgtggaggacgccatggggaactatatgctgaataaattttcaccaagctctcccgaaagcgctaacgagtgctccaaagtgttgtcagactccgctttggaagctccggaggccactgagaggatgacaaatgtgaagagcagcggcagcactagcgtaaggaaaggaccactgccatttctgatcaacagagccatgagctgccctagtggcgagcctcatgcgtccaccgggagggaaggacgaaagaagccactgacctccggcatggatgctagcgaactgacacccagggcctgggagagaattatttcaccagttgagagcgattccagtgtccgggactgcagtttgactaagagacagcaccaaaaggagaattttcaggaatatactgaaaaagagggcaaaatggcggcatcacgccgatctgtatttgctttgagcaatgaggaccccctccccttctgctccgatctctctggcaaggagcggggaaaaacactccataaagttaaaaccacctcaacgttctccgtttcaggagacgaagacaacgtgaaatgcttggaggtggtgtcgatctactacaccctgccacggaagccttcaaaaaagttctgcaacttgctccagcagtatacccagaacacgaacctactcatagaaagtccccaggtcgaaactgagacattccctaacgcgctcgagaaggacaagcagaactactccacgcgcgagcagagcggcactcccagctgcgaaaacctgaaaatgtccgtgaattccgatcagacactaacaaccgagaatatgacagctttccggctatccaatagaggccctctggctcctaccctccaagagatggcgtccgtggaggccgcagtttccttgcctgaagaagagtctaaagctcgggagattttcagcgacaacctggctaagactcccctgggggactctgaaaacaagaaggagcgtggtaagaaactacagagcgagaccctgcacacatctctgatgctgcaacgaaagaatgtgagtgaggagaaaagcgaaaattgtcagcagagcatcaacagctcaaactctggcccaagctcgcttccagcgctatccgaagtgaacattggaaacagtcagaccaggagatcaagctgggaatgtaccggttcaggcagagccattccattcacagggagcgggaaatgccctcagaaggaccacacatcaacggcagtgggggatggatcatcaggaagccagcctagggagggcaggggtgacattggaaccaattgtcagaagatgaccaataagaccctgtcccactccgaatcccaggtttttgccctcaccccggcactccacaagctgcagctgggggaggagacccaatccgatgaaccaaacttggagtccctccagtcagagccgagagaactgcctcaacggtcacaggaggctaacatgaccgaatcacgaaaagcagaggacgagatgcagaagtcagcttgggatcaaccctcccttcctgagggtaacaaaaataagactaaccttgatgacctcgtcaagggtgagaaccgtagctctgtgaaacatcggttagctgcgatgtccaaggcctcaaggaagttcccggcaaaggacgtgtcaccaaggagacacgtagctacaatctttccacaaagtggtagccggagcggatttgaccatttaagcctaggcacggttgagtgtaacccactctttcctgagccgactccaaaatccgcagaatctattggcgagtctcgattaagcgaaaacgggaagcacgtgaagaagagcgagaacttgttgccgattactgtgctgcctaatagggagccctcaactcatgtgagcaaccagaagtccaactccatctcccaaaggcaccagaatgaattcaagaatgtttcagaaagcccaagcaagcacgagaattcgaaggacgtgaccgcggcacagaacctagtgcgggagagtggcgcaccgagccctatcacattcacaagcttgcgtgaggcagaattctctgacaaccagagacgcctgtccccgccattccctctggaaccggcacagaagtccagagtgtctagccccctggcttcattcctgcagcagcagcgaagcgcctctagtctcgagtgggagcccgaaccacatctgtatcgttctaaatcattgaagtccatcaatgtccatggagacctactgcgcaaatctcacccaccaaaggtgagagaacggcacttcagtgaatcaactagcattgataatgcactaagtcggctcaccttgggtaatgagttttcagtcaacaacggttacagtaggaggtttcggtctttttctgaactcccgtcctgcgacggcaacgaatcctgggcgtacagatccgggaccaagaccggccctaggagcgcaatctccatctacagacctatcgattacgggatattcggaaaggagcaacagctcgccttcctggaaaacgtcaaacgatcactcacacaaggccgactatggaagcccagctttctgaagaatcctggctttctgaaggatgacctgcgaaacccacccaatccctccgagtccctttcttcaaattctcctagtagccaagtgcctgaggacgggctgagtccaagcgagccactgaacatatacgaggacgacccggtagatagtaactgcgatactgacacaacgactgatgatgagtactatcttgacgagaacgataaagaatcagaactttag

SEQ ID NO: 222623 - DNA, 5741 bp, Artificial Sequence
  Description of Artificial Sequence: Synthetic coding sequence
atgctgaaacaaccactgacataccgcctgagcaaagagatggccaagaacgaccctatcgaactccccactagccgctcgaaaaatgtcaccaaccagaaaaaacccaccccattctcatcccgcatgtctttccgatcaagcttcgcctctctgttctcgttcaggaaatcaggcaaggagacatcgaaactgccctccctggggcaaaagggctgcgatgggcatgcaggcccaccaatgcccgtgaggggcgcagccgtgcaggccaaaatatacaatagcccgcttgagaaccacttggtggacagcacgtttgtgcctaaaccagcggttatgagagaggagagcgggatgccacccccatgggatgcttccctgctagagaacgagttttttcaggtgctggatgatttggattctaaattggctcaggagcagtcggcctcttccgtgaacacacgaacccccttaaattatggcagcaggactcaatttgggcatttttacagctccggcaacagacatggcaacataaccgaacgacacaaaaaacactataatgaaacctcaaatatgtccatctacgacattcttaggcccggtactccccgtgaggggttcaaaaccttctctccccgtacgtctacaatctatgatatgtaccgcacacgagagccaagagttttcaaggaggactatgtgcagaagaacacattcgggtctaccagtctgtgtttcgactctaggcagcggtccgcactgcccgcaactggacatttcacagctcggagcctgcactttcccgcaaccacccagtctaaatctggttttatcccgcctcgacatcagcagagcccgaagcggacacccctgagctccattatctggaacaggtccgatagtagtagagaccgcgaaaaccaagaggaattcctacgcgcaccttcacccatggaaattgatcccgctgacaaatacgtctaccctcggggtttccaagagaacaagcggtacgagtcctaccattcacagaacgtgtaccagcgagtcagtcttaatgccccaatggaaaacgctatgagtcctgatacgtttgaaaattccgagaacatgcctttctaccaccagagcaatacttttactcgatcattcttttccaacacatttggacgcagcggagagcagaggagattcggtcagggcccattttgggggcaggaaaaagggcactcattctggtccgatttccaccgctccaggaaaagtttcagttccagtgacagagacttcgaaatgatttctatggaggcgaactcagtttccgccatacacggacacaatgtgtcaagcgaacattgggaatctttttctagtggctacggcacagacgtctcgcgtgggcaagaggaaccccatccttggcaatttgacttccaaaggtccaccctcgactctatggttgtgagtcatggcaatgaaacccaattgaccccccatttcggcactcccaatgtctgttccatgaccggatcttcttatcatgtgaagtcttcagagctcgtgtctcagcaagattcttcccccgtggaggtgcatattaacaaggaagcaagctcgttcggcattgcccagactttagcctcctcttttaaaacaagctttagccagataagtgatgatagaagaaatcctcagtcccccaatctgcaaaatcctactgttaccctgcaaaaaatctttccgaataaaccagccagccaccctatgagaagtcacacagaagtcactgtcactagtagtaacagtgtcgactccctcccactggccaaaagtcagccaaacattttggtgactgaagtgaacaatgagaaagacctgaacgagtccatatccgaggaagacaaacagttatctaagatggaccaaaccaacaaggccggagagatcccccagccagttagccaaaccggcatctctaatagcttaccagattttcagaaccccttgagccaggacagtgctaagtccaacggttttgggttcaatgcttctacgatcatctcatcaaagaagtctccaagggtgttttctagaaaagatactagcaagatgtatatccctcacaccgacaagtcgaatgacatcaaacaggacaaacgctttacagagaatcggaaattaggatccacggcctccctgccattcatccaggaacacagaaccccgccttcctttcctagaacggaccagggatgccaccaagaacttactgtaaacaacgaagatatcagcagaattatcacaaacaaccactggtcttcagctttaactgacacgcagaatgctcaatatagcaaatgtaagctcactccagggcacaagacctcctgtgattcactggatctgtcttccgctgcgttgcccgactcctctccttccaagaactccagtctggatgccccagtggtgccctcaacaaccgtgtttagcaggcggagtcccagcgataaagatccgagcctgggagagcgcgaagagaaagataacgctggtaaaaaccaaaagaaccagttcattgtgtctcactcagaaaaccaggagagaaatgatagcccagtgcccactcatgatgaggtggtcgacgtaaagtgccattctcatagtcctttcagaaatgaaagaggaaagggaaagatccgacaccacatcagttgtatcgaaaaactctcaaagacagagtccatttccgttcctacaagcgaccacagatcactgattgaggcaaatcagtcaaatagtaaggtttcggagctggatacaatctactgcaccctgcctcgtaagtcaagcagttttctgatacatggcaggcaatctgggtccaaaatcatggccgcttctctgcgaaatggaccacctccgtttcagattaaaaacaacgtagaggatgcgatggggaactacatgttgaataagtttagtccaagctcgcccgagtcggccaatgagtgctccaaggtcctgagcgatagcgccctggaggcaccagaggcaacagaacgcatgacaaacgtgaagtcaagtggttccacttccgtgagaaaaggacccttacctttcctgattaacagagcgatgtcctgcccatccggcgaaccccacgcctcgactggtagagaaggtaggaaaaagcctctgacttccggaatggacgctagtgagctgaccccacgagcttgggaacgaatcataagtcccgttgagagtgattctagcgtgagggattgcagtttgactaagcgacagcatcagaaagaaaatttccaagagtatacggagaaagagggcaagatggctgctagccgtcgctctgtcttcgccctaagtaatgaggaccccttacctttttgcagcgacttgtccgggaaagagcgaggcaagacccttcataaagtaaagacaacgtctaccttctctgtctcaggtgatgaggataatgttaagtgtttggaggtggtctccatctattacactcttcctcgtaaaccatccaagaagttctgtaaccttttgcagcagtacacacagaacacaaacctcctaattgaatccccccaagtcgaaactgagacattccctaatgctctcgagaaggataaacagaactattccactcgtgagcagagtggtacccccagttgcgagaacctcaagatgagtgtaaacagcgatcagactttgacaaccgaaaatatgaccgcttttcggctttcgaacaggggtcccctggcgccaaccctccaggagatggccagcgtggaggctgcagtgtccctgcccgaggaggaatctaaagctagggagattttcagtgacaacctcgctaagaccccgctgggcgacagcgaaaacaaaaaggagcggggaaaaaaactgcaaagtgagaccctccatacatccctcatgctccagagaaaaaacgtgagcgaggaaaagagcgagaactgccaacagtctatcaattcctcaaactccgggccttcgtccctgcctgccctgagcgaagtaaatattggcaattcccagactaggcgctcctcttgggagtgcacgggcagcggtagagcgatcccattcacaggatccgggaagtgcccacaaaaagaccacaccagtactgctgtcggagatggcagttccggtagccagcctagagagggtcggggagacatcgggacaaattgtcaaaagatgaccaacaagaccctctcccattccgaatcacaggtcttcgccctgacaccagcgctccacaagctccagctgggggaggagacccaatcagacgaaccgaatttggaatcccttcagtctgagcccagggagctccctcaaagatcacaggaggccaatatgaccgagtctaggaaggctgaggatgagatgcagaaatcagcttgggatcaacctagcctaccagagggcaataaaaataaaactaacctggatgatctggtaaagggagaaaatcgatcttctgtgaagcataggcttgccgctatgagtaaagctagtcgcaaatttccggctaaagacgtatctccaagacggcatgtagcgactattttcccccaatcaggcagccgcagcggctttgatcacttgtctctgggaactgtcgagtgcaaccctctttttccagaacccactcctaagagcgccgagtccattggggagtcacgcctgagcgaaaacggcaagcacgtcaagaaatccgaaaatctactgcctatcaccgtgctaccaaatcgggagccatctacacacgtcagcaaccagaaatctaactctattagccagcgacaccagaacgagtttaaaaatgtcagcgagagcccatccaaacatgagaactccaaggatgtgactgccgcacagaatctcgtcagagagagcggggctcccagtccgattacttttacgagtctgagggaagccgagttttctgacaaccagcggagactctcacccccttttccccttgagccagcccaaaagtctagagtgagctcgccattagcttccttcctgcagcagcagcgatcggccagtagcctggaatgggaaccggaaccccatctgtacaggtctaagagtctcaagagtataaacgtgcatggagacctcctgaggaagtcccatcctcctaaggtgagagaaagacacttctcagaaagcacaagcatcgataacgccctctctcggctgacacttggcaacgagttctcagtcaacaacggttacagtcgaaggttccgcagcttctcagagctgccgtcttgcgatggcaacgaatcctgggcctatagatccggcaccaagactggccctagatccgctatcagtatctaccggccaatcgattacggcattttcggaaaggagcagcagctcgcatttctggagaatgtgaaacggtcattgactcaggggaggctgtggaagccaagtttcctgaagaaccccggttttctgaaagacgacctacggaatcctccgaacccatcagaaagtttgtcctctaatagtcccagcagccaggtgccggaggatggcctgtctcccagtgaacctttgaatatttacgaagacgatccggtggactccaattgcgacaccgatactactacggacgatgagtactatcttgacgagaatgacaaggagtccgagctgta

SEQ ID NO: 222624 - DNA, 2460 bp, Artificial Sequence
  Description of Artificial Sequence: Synthetic coding sequence
atgccagttcgaggagcagccgtgcaggccaagatttataactccccactggagaatcatctcgtggattccactttcgtgccaaaacccgcagtcatgcgcgaagagagcgggatgcctcctccctgggacgcatctcttctggaaaacgaattcttccaggtgcttgacgacctggactctaaacttgctcaggagcagtccgcctcatccgtgaataccagaactccactgaactatggctcaagaacacagtttggacacttttatagcagtggcaatcgtcatgggaatattaccgaacgccacaagaagcactacaacgagacctctaatatgtctatttatgatattctacgtccgggaacgcctagagaaggctttaagacattctcaccgaggacgtccactatctatgacatgtacaggacacgagagccacgggtctttaaggaggactacgtgcagaaaaatactttcgggagcaccagtctctgctttgactccaggcagagatcagccttacctgctacgggccacttcacagccaggtctttacactttcctgcgactactcagtctaaatctgggtttatacctccacggcaccagcaatcgcccaagagaacacccctgagcagtattatatggaaccggtctgactccagtagggacagagagaatcaggaagagtttctgcgcgctccctcaccaatggagattgaccccgctgacaaatacgtttatccccgagggttccaggaaaacaagcgatacgaatcctaccattcccagaacgtctatcagagagtgtctctcaatgcacctatggaaaatgcaatgtcacccgataccttcgagaattcagagaacatgccattctaccaccagagtaacacattcacccggtcattcttctcgaacacattcggcagaagtggcgagcagagacggtttggccagggtcctttctggggtcaggagaaagggcactctttttggtctgacttccatcgctcacggaagtcctttagcagctcagaccgcgatttcgagatgatctctatggaagcaaactcagtgagcgctatccatgggcacaacgtgtcttctgagcactgggagtcattttcatctgggtacgggactgatgtatcaaggggtcaggaagaaccacacccatggcaattcgattttcagaggagcaccctcgacagcatggtggtgtcacacgggaacgagacacagcttacaccccacttcggcacccctaatgtctgcagcatgaccgggtccagctaccacgtgaagagttcagagttggtgtcccagcaagattcttcaccagtcgaggtccatataaataaagaggcgtcttcttttgggatcgctcagacactggcctcctcttttaagacaagcttcagccagattagcgatgataggaggaacccccaatcccctaatctccagaaccccacagttactttgcagaagatttttcccaataaaccagctagtcaccccatgagaagccacacggaggttactgtgaccagctccaattcggtggacagcttacccttagctaagagccaaccaaatatcctggtgaccgaggtcaacaatgagaattccaaagacgtcacagccgctcaaaacctggtcagggagtcaggtgccccaagtcccattacctttacaagtttacgcgaggcagagttttcagataaccaaaggcggctcagccctcccttcccgctggaacccgctcagaaatctcgggtgtcgagccccttagcatcattcctccaacagcagcgatcagcttcgagcttggagtgggagccggaaccacatctctaccggtctaaaagcctcaaatctataaatgtccatggagatctactgcgaaaaagccatccaccaaaggttcgcgaaagacactttagtgagagcacttccatcgataatgctctttcgcggcttaccctgggaaacgaattttcagtcaacaacggatacagtcgcaggtttaggagcttctcggagctgccatcctgtgatgggaacgagagctgggcttaccgcagcggtaccaaaaccggtccgagatctgccatcagcatatacagaccgatcgattacggaatatttggaaaagagcagcagctcgctttcctggagaatgtcaaaaggtccttgacacagggcaggctctggaaaccgtcatttctgaagaatcccggatttctaaaagacgaccttcggaacccccctaatccaagcgagagcctgtccagcaattcccccagttcacaggttcccgaggatggactatcaccgagcgagcccctgaacatatatgaagacgaccctgtggacagtaactgcgatacggatacgacgactgatgacgaatactatcttgacgagaacgacaaggagtcggagctctag

SEQ ID NO: 222625 - DNA, 5405 bp, Artificial Sequence
  Description of Artificial Sequence: Synthetic coding sequence
atgagggaggaatcaggaatgcctcccccttgggatgcctcactgctggaaaatgaatttttccaggtcctggatgacttggactcgaaactggctcaggaacagagcgctagtagcgttaacaccaggacacctctgaactatggcagcaggacccagttcgggcatttctactctagtggcaatcggcacgggaacattacggaaagacataagaaacactacaatgaaactagcaatatgagtatttacgacatactcagacccggaactcccagggaggggtttaagacattcagtcccagaacatctaccatctacgatatgtatcgaactagagaacctagggtgttcaaggaagattacgtccagaaaaacacattcggaagcacgtcactctgctttgattcccggcagcggagcgctctcccggctaccggacatttcactgccaggtcccttcatttcccagctacgacccagtcaaagtcgggttttatcccacctcgacaccagcagtcccccaagagaacccctctctcgagcattatttggaacaggagcgattccagccgagatagggagaatcaggaagaattcctgagagcaccgtctccaatggagatcgaccccgcagataaatatgtgtaccctcgcggttttcaagagaacaagcgttacgaatcttaccactcccagaatgtttaccagagggtgtcgcttaatgcacctatggaaaacgctatgtcaccagacacgttcgagaactcagagaacatgcccttctatcaccagtcaaatacatttactcgctcgttcttttcaaataccttcgggagaagtggcgagcagcgccgatttgggcagggtcctttttggggacaggagaaggggcacagcttttggtccgattttcatcgctctaggaagtcattctcatccagcgatagagactttgaaatgatttccatggaggcaaatagcgtcagtgcaattcatggtcacaacgtttcatctgagcactgggagtcgtttagctcaggctacgggacggacgtgtcacggggtcaagaggaacctcatccctggcaattcgactttcaacggagcaccttggattcgatggtggtgtcccacggaaatgagactcaactgactccacattttgggacacctaatgtgtgctctatgacgggttcttcatatcacgtgaagtctagcgagctcgtgagccaacaagatagcagtcccgtggaggtccatatcaataaggaagcatcgtccttcggcatcgctcaaacacttgcctcaagtttcaaaacctcctttagccagatatccgacgaccggaggaaccctcagagtcctaatctgcaaaaccctacagtcacactgcagaaaatcttccctaataagccagcatcccatcccatgagaagccatacagaggtgacagtgacaagcagcaactcagttgactcactgccgctggctaaatcccaaccaaacattctggtgactgaggttaacaacgagaaagacctgaatgagagtatttcagaagaggataaacagctgtccaagatggaccaaacgaacaaggctggggagataccccagccggtcagccagacaggcatcagtaatagccttccagactttcaaaatcccttgagtcaggattccgccaaatctaatggtttcggatttaacgcctccacaatcatctcatctaaaaagagcccccgtgttttcagccggaaagacacttcaaaaatgtacatcccacataccgacaaaagtaacgatatcaagcaggataagaggtttactgagaataggaagctgggaagcactgcatccctgccattcattcaggaacataggacgccaccttcctttcctaggactgaccaaggctgccatcaagaacttaccgtgaataatgaagacatttcgcgaatcattactaacaatcactggtctagcgctcttaccgacactcagaatgctcaatatagcaaatgcaagctgactccagggcataaaacatcttgtgacagtctggatctcagttctgcagccctgcccgacagctctcccagtaagaactccagcctggacgcaccagtcgttccgagcacaactgtcttctcccgacgatcaccttctgacaaggatccctccctgggcgaaagagaggagaaggataatgcaggcaaaaatcagaaaaaccagttcatcgtatcccacagcgagaatcaagaaagaaatgacagccctgtgccaacacacgacgaggtggtggacgtgaaatgccattcacacagtccctttcgtaatgagagggggaaaggcaaaatccgccaccacatcagttgtatcgagaagctgagcaagactgagtctataagcgtccctacctccgatcatcgttccctcattgaggcgaatcagtcgaactcaaaggtttcagagctagacaccatctactgcacactgccgagaaaatcttccagttttctgattcacggcaggcagtccggcagcaagataatggctgcaagcttgcggaatggcccacctccttttcagatcaagaataacgtggaggatgccatgggcaattacatgttaaataaattcagtcccagcagtccagagtctgccaatgagtgttccaaagtcttatcagacagcgccttagaagcccctgaggcaacggagagaatgaccaatgttaagtctagcggaagcacatccgtacgtaagggacccttgccctttctaattaatcgagccatgtcttgccctagcggcgaacctcatgcctctacgggccgtgagggaaggaagaagccactgacaagtggcatggacgcctccgaattaacaccccgtgcatgggaaaggattatttcgcccgtggagagtgacagctcagttagagactgctcattgactaaacgccagcatcagaaggaaaactttcaagagtacactgagaaagagggtaagatggcagcatctcgccgttctgttttcgcactgtctaacgaggatccacttcctttttgctcagatctctccggtaaagaaaggggcaagacactgcacaaagtcaagacaacgagcacattttccgtgagcggcgatgaggacaatgtgaagtgcctagaagtcgtctctatatactatacactgcccaggaagccatcaaagaagttttgtaatctcctccagcaatatacccagaatacaaatctgttgattgagtccccccaggtggagaccgaaacttttccgaatgccctggaaaaagacaagcagaattactccaccagggagcagagcggcacacctagctgcgagaatctgaagatgtcagtcaatagtgaccaaactttaaccaccgagaacatgaccgcctttcggctgagcaatcgtggacccctggcccctacactgcaggaaatggccagtgtggaggcagcagtctccctgcccgaggaggagagcaaggccagggaaatcttctccgacaaccttgccaagacacctctgggggactccgaaaacaagaaggagcggggaaaaaagcttcagagcgaaactttgcacacatccctgatgttacagcgcaagaacgtttcagaggaaaaatccgagaattgccagcagagcatcaattctagcaattccggaccctccagcctgccagctctgtccgaggtgaacatcggcaacagccagactcggcgttcatcatgggaatgcactggctctggaagggccattccatttacaggctcgggaaaatgcccccagaaagaccacacctctacggccgtcggagacgggtcctccggtagccagcccagggaggggcgaggtgacattgggactaactgtcagaagatgacaaacaagacccttagccactcggaatcccaggtgttcgccctgacccccgcactgcacaagttacagctcggtgaggaaacgcagtccgacgagccaaacctggaatctctgcaaagcgagcccagagaactgccacagaggtcccaagaagctaatatgacagagagcaggaaagcagaagacgaaatgcagaagagcgcttgggaccagcccagtcttcctgaaggcaacaagaacaagacaaacctggacgacctggtgaagggcgagaatcgctcttccgtgaaacatagactcgctgcaatgagcaaggccagtagaaagttccccgctaaagatgtgagcccgaggaggcatgtggccacgatctttccccaatccgggtctcggtctggatttgatcatctgtctttggggactgtggagtgtaaccctctgtttcccgaacccactccgaagtccgctgaaagcatcggcgagtcacgccttagcgagaatggcaaacacgtcaaaaagtctgagaacttacttccaattacagtattacctaacagggagccatctactcatgtgtctaaccagaaatccaactcaattagtcaacggcatcagaacgaattcaagaacgtcagtgagtcaccatcaaagcacgaaaattccaaagacgtgacagctgctcaaaacctggtgagagaaagcggagctcccagccctattacattcacatcgctgagagaggccgaattttcagacaatcagagaaggctcagtcctccatttcctctggaaccagcccagaaaagcagggtaagctcccccctggcatcattccttcaacaacagaggtccgcaagcagtctggagtgggagccagagccccatctgtaccgttcgaagtctctcaaatccatcaacgttcatggagatctgcttcggaagagccaccccccaaaggttcgggagcggcatttttctgaatcgactagtattgacaacgctctctcacgattgaccctcgggaacgagttttctgtcaacaatggctacagccgaagatttcgcagtttcagtgagcttccttcctgcgacgggaatgaatcatgggcatacaggagcgggacaaagaccggccctcgttctgccatctcgatttataggcctattgactatggtattttcggcaaggaacagcaacttgcttttctcgaaaatgtgaagcgtagcctgactcagggcagactgtggaaaccatcctttctcaaaaacccaggctttctcaaagacgatctgcgcaaccccccaaaccctagtgaatccctctcaagcaatagccctagcagccaggtgccagaggatggactttctccttccgaaccactgaacatctatgaggacgatccagtcgactccaattgcgacacagacacaacaactgacgatgagtattatctggatgaaaacgataaggagagcgaactgta

SEQ ID NO: 222626 - DNA, 5948 bp, Artificial Sequence
  Description of Artificial Sequence: Synthetic coding sequence
atgagcctttccttcctgaatgatgaagaggcccgtaaaatcctccaggtcctagagaggaatgaagagctgcaaagagctgagaaggataggatcagcaagctgcaaaagaccaaaagagatatacgttggctccaaggagtgacgggcgagtggttcgaggagattcaacgcaaaaagttctgcaacgaaactgatgtcagccagatgctcaagcagcctctcacctaccgactctccaaagaaatggctaagaacgacccaatcgagctgcccactagcaggagtaagaacgtaacgaaccagaagaaaccaaccccgttcagtagtcggatgtcctttcggagcagctttgcaagcctctttagttttcggaaatcgggaaaagaaacaagtaaattgcctagccttggacagaagggctgcgacgggcatgcaggccctccaatgcctgtgcgtggggcagcagttcaggccaaaatctataacagcccacttgagaaccatttggtggactcaacatttgtcccaaagcctgccgtgatgagggaagaatccggaatgcctcccccttgggatgcttctctgctggagaacgagttctttcaggtattagacgatttggactccaaacttgctcaggaacagtcggcttctagcgtcaatacacgtacacctctgaattatggaagcagaacccaattcgggcatttctattcatcagggaatagacatggaaacatcactgagcgtcacaagaagcactataacgagacctcaaatatgagtatatacgacatcttacggcctgggaccccaagggaggggtttaaaaccttttcccccaggactagtaccatttacgacatgtaccgtactcgcgagcccagagtgtttaaagaggactatgtgcagaagaacacgtttggtagcacatccctctgttttgactcccgccagagatcagccctgcccgctaccggccactttacagctcgatcattacactttccggcaaccacccaatccaaatcaggatttattcctcccaggcaccaacaatcccctaagcggacgccactgtcctctatcatttggaatcggtcagattccagccgggacagagagaatcaggaggagtttctcagggctccctccccgatggagattgacccagccgacaaatatgtctacccacgtgggttccaggagaacaagcgctatgagtcttatcatagccaaaatgtgtatcaaagggtttccctcaatgctcccatggaaaacgccatgtctcccgatacatttgaaaattctgaaaacatgcccttctatcatcaatctaacaccttcactaggtcgtttttctcaaataccttcggtcgctcaggcgagcagcggagattcggacaagggccattctggggacaggaaaaaggacatagcttttggtcagatttccatagatcaagaaaaagtttctcctcatctgatcgggactttgaaatgatctccatggaggccaacagcgtgagcgctatccatggacacaacgtctcctccgaacactgggagagcttttccagcggctatgggaccgacgtctctaggggtcaagaggagccacatccatggcagtttgatttccagagatccacacttgattctatggttgtgagtcacggcaacgaaacacagctgaccccgcacttcggaactcctaacgtgtgcagcatgaccgggtcttcgtatcatgtgaaatcgagtgagctggtgagccagcaggactctagccccgtcgaagtccacattaataaggaggcttcctccttcggcatcgcacaaacccttgcgtcctccttcaaaacatccttcagccagatatcggatgacagaaggaacccccaatcgcccaatctccagaatccaacagtcacattacagaaaatctttccaaataagcctgcctcacatccaatgaggtctcatactgaagtgacggtcacttcctctaactcagtggactccttaccccttgccaagtctcaaccaaatatcttggttaccgaggtcaacaacgaaaaggatcttaacgagtcgatctcagaggaggacaagcagctctctaagatggatcagaccaataaggctggcgagattccgcagcctgtttcccagaccggcatttccaatagtttacccgactttcagaacccactgtcccaggatagtgcaaaatccaacggtttcggcttcaatgcctctactataatctcctccaaaaagagtccccgagtgttttcccggaaggataccagcaaaatgtacataccccatacagacaaaagcaatgatatcaagcaggataagcgcttcaccgaaaatcgtaagttgggttccactgcctccctgccgttcatccaggaacaccgaacgccgcctagcttccccagaacggatcaaggctgtcaccaggagctgaccgtaaacaacgaagatatatcccggattattaccaataatcattggtcgtctgctctgacagacacacagaatgcccagtatagtaagtgcaagttaacacccggacataagacgtcttgcgattccctagatctgtcgtcggcagccctgcctgatagttctccctcaaagaattcctcactggacgctcctgtcgtcccgtctacgaccgttttttctaggaggtcaccttctgacaaagaccccagtctcggtgaacgcgaagagaaggacaatgccggaaagaatcagaaaaaccagtttatagtgtcccactctgaaaaccaggagcgaaatgactctccagtgccaacacatgatgaagttgttgacgtcaaatgccattcccacagccccttccgcaacgagcggggtaagggcaaaatccgccaccacatcagttgcattgagaagctatctaagaccgagtccatctcggtccccacaagcgaccaccgctcgctcatcgaggccaaccagagtaactctaaggttagcgaactggacactatctactgtacactgcctaggaagtcgtcctccttcctgatacatggtcggcaaagcgggtccaagattatggcagcctcattgcggaacggtcctcctcctttccagatcaaaaataatgtagaagatgccatggggaactacatgctgaacaaattcagcccatccagtcccgagtctgccaacgaatgtagtaaagtgttgtctgactctgcactggaagctcccgaggcaactgagagaatgacgaacgtgaaatctagcggtagtacttcagtgcgtaagggcccacttccgttcttgattaatagagccatgtcatgccctagcggagagcctcatgccagcacaggcagggagggaaggaaaaagcccctgacgtctggcatggatgcctctgagctaacccccagagcatgggagcgcatcatctcacccgtggagtcggacagctcagtgagggactgcagcctaacaaaacgacaacaccaaaaagagaactttcaggagtacacggaaaaagaagggaagatggcagcatctcgtcgatcagtgttcgcactgagcaacgaggatccactgccgttctgtagtgacctgagcggaaaggaaaggggcaagaccctgcacaaggttaaaaccacaagtactttttccgtttcaggtgacgaggacaatgtcaagtgcttggaagtcgtaagcatctattacactctacctcggaagcccagcaagaaattctgtaatctcttacagcaatatacgcagaataccaatctgctgatcgagagtcctcaggttgagactgaaactttccctaatgcccttgagaaagataagcaaaactattcaactcgggagcagagtggtacccctagctgtgaaaacctgaagatgtctgtcaattctgatcagaccttgacaaccgagaacatgaccgcattcaggttgagcaatcgcggtcccttggccccaacactgcaggaaatggcaagtgtcgaagctgcggtaagcctgcccgaggaagaatctaaggccagagaaatctttagcgacaacctagctaaaaccccactcggggatagtgagaataagaaagagcgcggaaagaagttacagtctgagacgttacatacaagtctcatgctgcagaggaagaatgtcagcgaagaaaagagcgagaactgccagcagtctatcaattcctccaacagtggcccaagttcgttgcctgctttgtccgaggttaatatcggtaattctcagacaagacggagttcctgggagtgtacaggaagcggacgggctatccctttcacgggttctggcaagtgcccacagaaggaccataccagtaccgccgtgggcgatggcagcagcggcagccaaccacgcgagggacgcggtgacatcggtactaactgccaaaagatgacgaacaagactctaagtcattctgaaagccaagttttcgccctgactccggctctccacaagcttcaacttggagaagagacccagtcagacgagcccaatctagaatccttacagtcagaaccacgggaactgccccagcggtcccaggaggcaaacatgaccgaatccaggaaggccgaagatgagatgcaaaaatctgcttgggatcaacccagcctgcctgagggaaacaagaacaagactaatctcgatgacttggtgaagggcgagaaccgatcatctgtgaaacacagattagctgcgatgagtaaagcctcaaggaagttccccgctaaggacgtgtccccccgacgacatgtggccacaatctttcctcagtcgggcagtcgtagcggattcgaccacctttcactgggcactgtggaatgtaatccgctgtttccagaacctacgccaaagtctgccgaaagtattggagaaagcagactgagcgagaacgggaagcacgtgaagaaaagcgagaacttgctcccgataacagtgttacccaaccgtgagccatccacacacgtcagtaaccaaaagagtaattccattagccagaggcatcagaacgagttcaaaaacgtgtctgagtcccccagtaaacacgagaactccaaagatgtcacagcggctcaaaacctggtacgagagtctggagcaccttcccccatcacgtttacctccctgagggaggcagaattttccgacaaccagagacggttatcccctccttttccattggaaccggcacagaaaagccgggtgtcatcaccactcgcctcttttctccagcagcagaggagtgccagcagtctggaatgggaacctgagcctcacctatatcggagcaaaagcctgaagtccattaacgtgcatggcgatctgctgaggaaatctcaccctcccaaggtacgtgagcggcacttctctgaatctaccagtatagataacgccctgagcagattgacactgggtaacgagttctccgttaacaacggctactctagaaggttcaggtcttttagcgagctgcccagctgcgacggtaacgaaagttgggcctatcgaagcggcactaagacaggaccacggtcagctatcagcatttatcggccaatagattatgggatttttgggaaggagcagcagttagccttcctggagaatgtgaaacgcagtctgacccagggtaggttgtggaaaccttcctttctgaagaatcctggctttctgaaagacgatttgagaaatccaccaaacccctcagagagcttgtcctcaaactcccccagcagccaggtgcccgaggatggactttccccgtcagaacccctaaatatctatgaggacgatcccgtggattctaattgtgacacagatacaaccacagatgacgaatattacctggacgagaatgacaaggaaagcgaactgta

SEQ ID NO: 222627 - DNA, 2583 bp, Artificial Sequence
  Description of Artificial Sequence: Synthetic coding sequence
atggcccctcctagtactagggaacctagagttctgagcgccacctcggccaccaagtctgacggcgagatggtgttaccaggttttccagacgcggacagttttgttaagtttgccctggggtctgtggtggcagtaacaaaagcgtcaggcggtctgcctcagttcggcgacgaatacgatttctacagaagctttcccggttttcaggctttctgtgaaacccagggagacagactcttgcaatgcatgtctagggtgatgcagtaccatgggtgtcgctccaatattaaagaccggagcaaggttacagagctcgaggacaaattcgatctactagtggatgccaatgacgtgatcttagaacgcgtggggatcctcctcgatgaagcctctggtgtgaataaaaatcagcagcccgtattgcccgctggccttcaggttccgaaaacagtggtctcttcttggaatcgaaaagctgccgagtatggaaagaaggccaagtccgagacatttcgcttactgcacgcgaagaatattatccggcctcagctgaagtttagggagaaaattgataacagcaacactccctttcttcccaagatcttcatcaagccgaacgcacagaaaccactgccccaggctctgtccaaagagcgacgtgagaggccccaggatcgccctgaggatctcgatgtccctccagctttagcagatttcatccaccagcagcggacgcagcaggttgagcaagatatgtttgcacatccctaccagtacgagcttaaccacttcactccggcagacgctgttctgcagaaacctcagccgcagctgtatcgtcctattgaagagaccccctgccatttcattagctctctggacgagcttgttgaactcaacgagaaactcctgaactgccaggagttcgccgtggacttggaacaccattcgtaccgttctttcctgggattgacctgtctgatgcagatttccactaggacagaggacttcatcatcgatactctggagctaagatctgatatgtacatactgaatgagagcttaacggatcctgctatagtaaaggtgttccatggggctgacagcgacatagaatggctccagaaggacttcggcctctacgtagtgaatatgtttgacactcaccaggctgctagactgttgaacctaggccgacattctcttgaccacctgctgaagctgtactgcaatgtggactccaataagcaatatcagcttgcagattggagaataaggccactgccagaggaaatgctctcttacgcacgggatgacacccactatctgctttatatttatgacaagatgaggttagaaatgtgggaacggggaaatggccagccagtccagctccaggtggtttggcagagaagccgagacatttgtctgaagaagtttatcaagcccatctttacggacgaatcctatctagagctgtatcggaagcaaaagaaacacttgaacactcaacagctcaccgcatttcagctactgttcgcatggagggataagaccgcaaggcgcgaggatgaaagttacggatatgtgctgccgaatcacatgatgctcaaaatcgcagaggagctccctaaggagccccagggaatcattgcatgttgtaatcctgtccccccattagttcggcaacagatcaatgagatgcatctcctgatacagcaagctcgagagatgcctcttctcaaaagcgaggtggctgcgggtgtgaaaaagagcgggccactcccctcagccgaaaggctcgagaacgtgttgttcggcccacatgattgttcccacgctccaccagacggttatcctatcatccctacgtccggcagtgtgcccgtccaaaagcaagccagtctgttcccagatgagaaagaggacaatctcctggggaccacttgtttgatcgcaactgcggtcatcacattgtttaatgaaccctccgccgaagactcgaaaaaagggcctctaactgtggcccagaaaaaagcccaaaacatcatggaatctttcgaaaacccattccggatgatttccaacagatggaaactggcccaagtgcaggtgcaaaaagatagcaaggaagcagtgaagaaaaaggctgccgaacagacagctgccagagagcaggctaaagaagcttgcaaggcagcggcagagcaggcgatatccgtgagacagcaagtggtgttggagaacgctgccaagaagcgggaacgagcaacctccgatccgcgtaccaccgaacaaaaacaagaaaagaagcgactcaaaattagcaagaagcctaaagaccctgaacccccagaaaaagagtttactccttacgactactcacagagcgatttcaaggcattcgccggtaatagcaagtccaaggtaagttctcagttcgatcctaacaaacagaccccgtccggaaaaaagtgcatcgcagccaaaaaaatcaagcaaagtgtaggcaataagtctatgagcttccctacaggcaagtcagatcgtggatttaggtacaactggcctcaacgttag

SEQ ID NO: 222628 - DNA, 2658 bp, Artificial Sequence
  Description of Artificial Sequence: Synthetic coding sequence
atggcacctccatccacaagagagcctcgcgtgctgtctgccacatcggctaccaagagcgacggcgagatggtgctgccaggattccctgacgccgattccttcgtcaagttcgcattgggatccgtggtggctgtgacaaaggcaagcggaggcctaccacagttcggggacgagtacgacttttaccgttcctttcctgggtttcaggctttctgcgaaacacagggagacagattgcttcagtgcatgtcccgagtaatgcagtaccatggctgcagaagtaacatcaaagataggagcaaggtcacggaactggaggataagttcgacctactggtcgacgcaaacgacgtgattctcgaacgcgtaggaattctgctggatgaagcttctggagtaaataaaaatcagcagcctgtactccctgctgggctacaggtacccaagacagtcgtcagctcctggaatcggaaggccgcagagtacggaaagaaagcgaaaagtgagacattcagattgctgcatgccaagaatatcatcagaccccagcttaagttccgagagaaaatcgacaattctaatacgccatttcttccgaagatctttattaaaccgaacgcccagaagcctttgccccaagcactgtctaaagaaagacgcgagcgcccacaagaccgcccagaggatcttgatgtacccccagctctggccgatttcatccatcagcagagaacacagcaggtggagcaagatatgtttgcacacccctaccagtacgagcttaaccactttactccggctgatgccgtactccagaagcctcagcctcagctctatagacctattgaagaaactccatgtcattttataagtagcctagatgaactagtagagctgaatgaaaagttgttgaactgtcaggagtttgcagtggatttggaacaccatagctacagaagctttttgggccttacttgtctaatgcaaatctctaccaggacagaagacttcataatcgacacgcttgagctgcgctcagatatgtatatcctgaatgagtccctgacagacccggcaattgttaaagtgttccacggcgcagactcagacatcgagtggctgcagaaggatttcggtctgtacgtcgtgaatatgttcgacacccatcaagccgctcgccttctgaacctgggaagacactccctggaccatttgttaaaactctattgcaacgttgattccaataaacagtaccagctagcagactggcggattcgccctctaccagaagagatgctgagttatgctagagatgacactcattatttattgtatatttacgacaagatgagactcgaaatgtgggagcggggtaacggccagccggtgcagctgcaagtggtgtggcagaggagtcgggacatttgccttaagaagtttattaagcctatcttcacggacgagtcgtatctggaattgtaccgtaaacagaagaagcaccttaatacccaacagctcacggccttccagttgctgttcgcttggcgcgataagactgcgaggcgagaagatgaaagctacggttatgtcttgccgaatcatatgatgctgaaaatcgcagaggaactgccaaaagaacctcaaggaattatcgcatgttgtaatcccgttcctccactggtgagacagcaaataaatgagatgcacctgttgattcagcaagccagagagatgccccttttgaagtcagaggtggcagccggagtcaaaaagtccggccctctgcctagcgcagaacgtctggagaacgtgctctttggaccacacgattgtagccatgcaccacccgacggctaccccattatccccactagcggatctgtgcccgtgcagaagcaggcttctctgtttcccgacgaaaaggaggacaacctcctggggaccacttgtttaatcgccaccgccgtgataactttgtttaatgaaccttctgcggaagacagtaaaaaggggccactgacagtcgcacaaaaaaaagctcagaatatcatggagtcattcgaaaatcccttccgaatgttcttgccaagccttggacatagggccccagtttcccaggccgcaaaatttgatccctcaaccaagatttatgagataagcaacaggtggaaactggcccaggttcaggttcagaaggacagcaaggaggcggtgaaaaaaaaagccgcagagcagaccgctgcacgggaacaagccaaggaggcatgcaaggcagcagctgagcaagccatctccgtgcgacaacaggtcgtgttagaaaatgccgctaagaagcgcgaaagagctacctctgacccgagaacgacagaacagaagcaggaaaagaagagactgaagatctctaaaaaacctaaggaccctgaaccccctgagaaggaattcacaccatatgattactcccagtccgacttcaaggctttcgccggaaactcgaaatcaaaagtgagctcccagttcgaccccaataagcaaacccctagtggcaagaaatgcatagcagccaaaaaaatcaagcaatccgttggaaataaatctatgtcgtttcctacagggaagtcagatcggggattcaggtataactggccacaaaggtag

SEQ ID NO: 222629 - DNA, 2040 bp, Artificial Sequence
  Description of Artificial Sequence: Synthetic coding sequence
atggcaccaccgtctactcgagagccccgtgtattgagcgctacctcagccacaaagagtgatggcgagatggtcctgcccggatttcctgatgcagactcattcgtgaagttcgctcttggatccgtggttgctgttactaaggcatctggaggacttccacagttcggtgacgaatatgacttctacaggagcttcccgggatttcaggccttctgcgaaacacagggagatcgcttgctgcagtgcatgagtagagttatgcagtaccacggatgccgttctaacattaaagaccgatcaaaagtgactgagctggaggacaagtttgaccttctagtggatgctaatgacgttattctggagcgtgttggtatcctgctggacgaagccagcggcgtgaacaagaaccagcagcccgtcctgccagctggtttgcaggtgcccaaaaccgtggtcagctcctggaatcgcaaagcagctgaatacggaaaaaaagctaaatctgagacgttcaggctcctccacgcgaaaaacattattagaccccaactaaaattcagagaaaagatcgacaactcgaatacccccttcctcccaaaaattttcatcaaaccgaacgcacagaagcccctccctcaggctttaagtaaggaaagaagggagcgaccccaggatcgcccagaagatcttgatgttccccctgcactcgccgattttattcaccagcagcggactcagcaggtggaacaagacatgttcgcccacccctatcagtacgaacttaatcactttactcccgctgacgcagtcttgcagaaacctcaacctcagttatatcgccctattgaagaaacgccctgtcacttcatttcctccttagatgagctagtggaactgaatgaaaagctgctcaactgccaggaatttgccgtcgatcttgagcatcattcctacaggagcttcctgggtctgacgtgcttgatgcagatcagcacccgaactgaggattttattatcgatacactggaactcaggagcgatatgtacatcctgaacgaaagcctaacggaccccgcaatcgtgaaggtgttccacggcgctgattcagacatcgagtggctgcaaaaagactttggactgtatgtggtgaatatgtttgatacccaccaggccgctcggctcctgaacttgggcaggcactcactggaccacttgctgaagctatattgcaacgtcgattccaacaagcagtatcagcttgctgactggcgcatcaggcccctcccggaagaaatgctgagctacgcaagggacgatactcattatttgctctatatatacgataaaatgcgccttgaaatgtgggaacggggtaatgggcagcctgtccagctgcaagtggtgtggcaacgaagtcgggacatatgccttaagaagtttatcaagcctatcttcactgacgagtcgtatctcgaactgtaccgcaaacaaaagaagcacctgaacacccagcagctaaccgcattccagttgttgttcgcctggcgtgacaaaaccgcgaggcgggaggacgaatcatacggctatgtgctcccaaaccacatgatgctgaagatagccgaagaattgcctaaggaaccccagggcattattgcttgctgcaatcccgtgcccccattagttagacaacagataaacgagatgcacctgttgatccaacaggctcgggagatgccattattgaaaagtgaggtggctgccggagtaaagaaatcaggccctttaccatccgccgaggtcgagtgtagaatttgtttcctcccgcaagaaggcaaaaggcaggtcactgcgtctgcttctactccattaaccgaggcctgcgcggatagctggcaaaaagccacagccggactgcacgttctgcacgcttctttactggtctcttttaacgctgaaataggtgagtgtagcctctggacctctagactcttaccttgtccatccggctggctgtctaaccatcctaatcaatggtag

SEQ ID NO: 222630 - DNA, 747 bp, Artificial Sequence
  Description of Artificial Sequence: Synthetic coding sequence
atggctgccggtttcaaaaccgtggaacctttagaatattacagaaggttcctcaaggagaattgcagacccgacggcagggagttaggtgagtttagaactactactgtcaacatcggatccatcagtacagcggacggttccgcactggtaaagcttggcaacaccactgtgatctgtggcgtcaaggctttccggtctggtcctccgggtgaggaggcccaagtagcctcacaatttatagccgatgttattgaaaacagtcagatcatccaaaaagaggatctttgcatctcacccggaaagctggtctgggtgctctattgtgaccttatctgtttagattatgatggcaacatcctggatgcctgcacattcgcgctgttggccgcactcaagaacgtccagctcccagaagtgactatcaacgaagagaccgctttagccgaagtgaatttgaagaagaaatcttatctcaatatcaggacccatccagtggcaacgtccttcgccgtgtttgacgataccctcctcatcgtagaccccacgggagaggaagagcatctggctactggcacactgaccatcgtaatggacgaggagggcaagttgtgttgtcttcataaaccgggtggctccgggctcaccggcgctaaacttcaggactgcatgagccgagcagtgactagacacaaggaagtgaaaaaattgatggacgaggtcattaagtcaatgaagcctaaatag

SEQ ID NO: 222631 - DNA, 831 bp, Artificial Sequence
  Description of Artificial Sequence: Synthetic coding sequence
atggccgctggcttcaaaacagtggaacccctggaatactatcggagatttttgaaggagaactgccgacctgacggtcgggagctcggcgaatttagaactacaaccgtgaacatcgggtctatcagcaccgccgatgggtcagccttagtgaagctgggcaataccacagtgatctgcggggtaaaggcggagtttgctgctccatcaacagatgcccctgacaaaggctacgtagtacccaacgtggatctgccaccattatgcagttcacggtttagatctggcccacctggggaagaggcacaggtggcatctcaatttatcgcagacgtaatcgaaaactctcagattatccagaaggaggacctctgcatctcacctggcaagctggtgtgggtgctgtattgtgacctgatttgtctggactacgacggcaacatcttggatgcctgtacgtttgcactactggcagcactgaaaaatgttcagctcccagaagtcacgataaacgaggaaacagcacttgccgaggtcaacctaaaaaaaaagtcatacctgaacatacggacacatcccgtcgccacctcctttgccgtgtttgacgataccctgcttatcgtggacccgactggggaagaggagcacctcgccacaggcaccttaacaattgtgatggatgaggaggggaaattgtgttgtctccataaaccaggcggtagtggtctgacaggggcaaaacttcaagattgcatgagcagggcagtcacacggcataaagaagttaagaagctgatggatgaagttatcaaatctatgaagcccaagtag

SEQ ID NO: 222632 - DNA, 1320 bp, Artificial Sequence
  Description of Artificial Sequence: Synthetic coding sequence
atgaaagagaccccgctgtccaattgcgaacggagattccttttgagagctatagaggagaagaagcggcttgatggaaggcagacttacgactataggaacattcgaatcagttttggaactgactacgggtgttgcattgtcgaactaggcaaaactagggttttggggcaggtatcttgtgagttggtctcacctaaactcaacagggccacagaaggaatcctgtttttcaacctggaactgtctcaaatggcagcgccagctttcgaacccggacggcagtccgatctcctggttaagctgaatagattgatggagcggtgcctaaggaacagtaaatgtattgataccgagagtctttgtgtggtggcaggcgagaaggtctggcagatcagagtcgacctgcatctgttgaaccacgatggcaatattatcgacgctgctagtatcgcagctatcgtcgcactgtgccactttcgccgaccagatgtaagcgtgcagggagacgaagtcaccctttatacaccagaagagcgggatcctgtgcccctgtctatacatcatatgcccatttgtgtgtcctttgcattcttccagcagggaacatatctgttggtggatcctaatgaaagggaggaaagagtcatggacggcttgctagtaatcgcgatgaacaagcaccgggaaatatgtactatccagtcttcaggcggtatcatgctactgaaggaccaggtgctacggtgtagcaaaattgcgggagtaaaagtggccgaaatcaccgagttgattctcaaggccctggaaaacgaccagaaggttagaaaagaaggcggtaaattcggcttcgcagagtctattgccaaccagaggatcactgcgttcaagatggagaaggctcccatagatacatccgacgtagaagaaaaagctgaggagattattgccgaggctgagcctccttcagaagtggtgtcgactcccgtcctctggactccaggcacagctcaaatcggggagggagtcgaaaatagttggggagatctggaagattctgagaaggaagatgatgagggaggcggtgatcaggccatcatcttagatggcataaaaatggacaccggggtcgaagtctccgatatagggtcgcaggatgctccaattatccttagtgatagtgaggaggaagagatgatcatacttgagcccgataaaaatccgaagaaaattagaacacagactacgtcggctaagcaggaaaaggcacctagcaagaaacccgttaaacgcagaaagaagaaaagagctgcaaattag

SEQ ID NO: 222633 - DNA, 1371 bp, Artificial Sequence
  Description of Artificial Sequence: Synthetic coding sequence
atgaaagaaactccattgtcaaattgtgagcgacgctttcttctgcgcgcaatcgaagaaaagaaaaggctcgacggtcggcagacatatgactaccgtaatatacggatctcctttggcactgactacggatgctgcattgtagagctgggaaagacgagggtactggggcaggtgagttgcgagctagtcagcccaaaactgaatagagcaacggaggggatcctcttcttcaatttggagctatcccaaatggccgcacctgcttttgaaccgggtcggcagtccgacctgctagttaagctgaatcggcttatggagcgttgtcttcgaaattcgaaatgtatagataccgagtccctgtgtgtggtggcaggcgaaaaggtctggcagattcgcgtggatcttcacctcctgaaccacgatggcaatatcattgacgccgcttctattgccgcaatcgttgccttgtgccacttccgcagacctgacgtctcagttcaaggcgacgaggttactctttatacccccgaggagcgggaccccgttcccctaagcattcaccatatgcccatctgcgtttctttcgctttcttccaacagggcacatatctcctcgtcgatccaaatgagagagaggagagagttatggatgggctgcttgtgattgcaatgaacaagcacagggaaatttgcactattcagtcttcaggaggtataatgttgctgaaagatcaagttctccggtgcagcaagattgctggcgtgaaagtagctgagatcacagagttgatcctaaaagcactcgagaacgatcaaaaggtgagaaaagaggggggtaaattcggattcgcagagagcattgccaatcaacgaatcacagcctttaaaatggaaaaagcacctattgatactagcgacgtggaagagaaagccgaagaaattatcgctgaagctgagcctccatccgaggtcgtgagcacacccgtcttgtggacacccggtactgcccagatcggggagggcgtcgagaatagctggggggaccttgaggatagcgaaaaggaagacgacgaaggtggtggcgatcaggcgatcattctggatgggatcaaaatggacacaggcgtggaggttagcgatattgggagccaggagctcggctttcaccatgtggggcagaccggccttgagtttctgactagtgatgccccaatcatcctgagcgattctgaagaggaggagatgattatcctggaaccagacaagaaccccaagaaaatcagaactcagactacatccgccaagcaggaaaaggctccttccaagaagcctgttaaacgccgaaaaaaaaaacgggctgccaactag

SEQ ID NO: 222634 - DNA, 2031 bp, Artificial Sequence
  Description of Artificial Sequence: Synthetic coding sequence
atgcagagttggagacggagaaaatctctctggctggctctgtcagcaagctggttgctcctggtgctcctggggggattttcgctccttaggctggctttacctccaagacccagaccaggagcttcccaggggtggcccaggtggctggacgctgagctcctgcagagctttagccaacccggtgagcttcctgaagatgcagtctcacctccccaggcccctcacggtgggtcttgtaactgggaatcatgcttcgacacctcaaaatgcaggggagatggtctgaaagtcttcgtttatcccgctgtcggtactattagcgagactcacagacgaattctggcctccatcgagggcagcagattttacactttctcaccggctggtgcatgcctcctgctgcttttgtcacttgacgcccagactggggagtgctcaagtatgccgctgcagtggaacagaggaagaaaccacctagtgctacgtttgcacccagcaccttgtccgcgaacttttcagctgggacaggccatggttgccgaggcttcccccactgtggactctttccgaccgggatttgacgtggctctgccgttcctaccggaagcccatccacttagaggaggcgcacccggacagcttcgccagcacagcccacagcccggagtggccctattggcgctggaagaagagagaggcggttggcggactgccgatacaggctcttctgcctgcccatgggatggccgatgtgaacaagacccgggtccaggccagactcaacgtcaggagaccctcccaaacgccactttctgtttgatctctggacacagacccgaggctgcttctaggttcctccaggcgttacaagccggttgtattcctgttctgctgagtccccgatgggagttgcctttttccgaagtaattgactggaccaaagcggctatagttgcggatgagcggttacccctgcaggtgcttgccgctctgcaggagatgagtccggcaagagtcctggccctaagacaacagactcaatttctgtgggatgcttacttttctagcgtggagaaggtgatccatactaccctcgaggtcattcaggacagaattttcgggacttccgcccacccctccttactctggaacagccccccaggtgccctgcttgctctctcaacattttcaacctctcctcaagactttcctttctattatctccagcagggttctagaccagagggacggttctcagcgctgatttgggtcggccctcccggtcagcccccactgaagctgatccaggccgtggcaggatcccaacactgtgcccagatcctcgtgttgtggtccaacgagcggcctctgccttctaggtggcctgagacagccgtcccactgacagttattgacggacaccggaaggtatccgacaggttctacccctactcaacaatcagaacggatgccatactttctctagacgccaggtctagtctttctacgtccgaggtggacttcgctttcctggtgtggcagtccttccccgaacgaatggtgggatttctaacaagctctcatttttgggatgaggcccacgggggatggggatacacagctgaacgaacaaatgagttctctatggtcctgacaacagcagccttttatcaccgctactaccatacgctttttactcatagcctgcccaaggctctgaggacactggcagacgaggcacctacatgtgtggacgtgcttatgaattttatcgtggccgctgtaaccaagctacccccaattaaagtgccctacggtaagcagcggcaggaggctgcccctctagcccctgggggacccggtccccgacccaagcctccggctcccgcaccggactgcatcaatcagatcgctgccgctttcgggcacatgccactactgagctcccgcttgagactggatcctgtcctctttaaagatcctgtttcagttcagcgcaaaaaatatcgctctctagagaagccgtag

SEQ ID NO: 222635 - DNA, 993 bp, Artificial Sequence
  Description of Artificial Sequence: Synthetic coding sequence
atgagatgctgtcacatctgcaaactgcccggacgggttatgggaatccgggtgctacgtctctctttagtggtcattctggtgctgttgctggtggctggcgcattgacagcactgttgccttctgtcaaagaagacaagatgttgatgttacgaagggaaatcaagagccagggcaaatctaccatggattcattcacattgatcatgcagacttacaataggacggacctgctactaaaattgctgaatcactaccaggctgtgcctaatctgcacaaagtcatcgtcgtctggaacaacatcggcgaaaaggccccagatgagctatggaactctctgggtccacatccgattcctgtgatctttaagcagcagacggctaatagaatgcggaatcggcttcaagtattccccgagctggagacaaatgctgtgctcatggtggacgacgatactctcatctcaacccccgacctggtttttgccttcagtgtgtggcagcaatttcccgatcagatcgtcggattcgtgccgagaaaacatgtgtcgacctcttctggcatctattcctacggttcatttgagatgcaagctcccggttctggcaacggggaccagtattcaatggtcctgattggtgcttcattcttcaattcaaaatacctcgaactgttccaacgtcagccagccgctgtgcatgccttgatagatgatacacagaactgtgatgacattgccatgaatttcataattgctaagcatattggaaaaactagtggcattttcgttaagcctgtgaacatggacaatcttgaaaaggaaaccaacagtggctacagtggtatgtggcatcgggcagagcatgccctgcagcggtcttattgtatcaataaactggtcaatatctatgatagcatgccactgagatactccaatatcatgatctcccaatttgggtttccttacgcaaactataaacgcaaaatctag

SEQ ID NO: 222636 - DNA, 993 bp, Artificial Sequence
  Description of Artificial Sequence: Synthetic coding sequence
atgagatgctgccatatctgtaaacttcccggtagggtgatgggaattagagtcctccggctgtccctggtcgtgattcttgtgctgctcttggtggctggagcactgactgccttgcttccatccgtgaaggaggataagatgctgatgttgcgcagggaaatcaagagtcaggggaaaagtacaatggattcattcaccctgatcatgcagacctacaacaggaccgacctattgctgaagcttctgaaccattaccaggccgtgccaaatctgcacaaagttatcgtggtttggaacaacattggggagaaggctcccgacgagctctggaattctctaggtcctcacccaattcccgtaatattcaagcagcagaccgctaaccggatgcgcaaccggctacaggttttccccgaacttgaaaccaatgctgtgctcatggtggatgacgacacattgatatccacaccagatcttgtcttcgcattctctgtctggcagcagtttcctgaccagatcgtgggttttgtgccaaggaagcacgtatccacgagcagcggtatttacagttacggatcattcgagatgcaagcccctggttcaggtaatggggaccaatacagcatggtgcttatcggcgctagctttttcaacagcaagtacctggagctgttccagaggcagccggctgctgtacatgctttgattgacgacacccagaactgtgacgatattgcaatgaacttcatcatagccaagcacattggaaaaaccagtggcatttttgtgaaacctgttaacatggacaacttagagaaagaaacgaattctggttactccggtatgtggcatagagccgaacacgccctccagcgaagttactgtatcaacaagctggtaaacatatacgatagtatgcctcttaggtactcaaatattatgatctcccagttcggcttcccatacgccaactataaaagaaagatatag

SEQ ID NO: 222637 - DNA, 354 bp, Artificial Sequence
  Description of Artificial Sequence: Synthetic coding sequence
atggggatcagggtcctcaggctgtccctggtggtcatcttggtgctgttactcgtagcaggggcactaaccgcccttcttcctagcgtgaaggaggacaagatgctcatgctgagacgcgaaattaaatcccagggaaagagcaccatggattcattcacactgattatgcagacatataacaggactgacctcctacttaagctgctgaaccactatcaggcagtacccaatctccacaaagtgatcgttgtgtggaacaacattggagagaaggcaccggatgagctatggaattccctgggccctcatcccattcccgtgatttttaagcagcaaaccgccaatcggtag

SEQ ID NO: 222638 - DNA, 801 bp, Artificial Sequence
  Description of Artificial Sequence: Synthetic coding sequence
atgaggacgtggaatagcggcggtaccaaatgttgccacatttgcaagcttccaggtcgggtgatgggcatccgcgtgttgcgactgtctctcgtggttatccttgtgcttcttcttgtggctggagcgctgaccgcccttcttccctccgtgaaggaagataaaatgctcatgctcaggagggagattaagagccagggtaagagcactatggattctttcactctcattatgcagacctataacaggactgatctgctcctcaaactgctgaatcactatcaggcagtccctaatctgcacaaggtcatcgtggtgtggaacaatattggggagaaagccccagatgagctgtggaactccctcgggccacaccccattcctgtaatattcaagcagcaaactgcaaacaggatgcgcaacagactccaggtatttcctgaacttgaaaccaatgctgtgctcatggtggatgacgatacattgattagcacaccagacctggtcttcgccttctccgtgtggcagcagtttccagaccagattgtggggtttgtcccacgcaagcacgtcagtaccagcagcggtatttacagctacggatcgttcgagatgcaggcaccagggagtggtaacggtgaccagtactccatggtgctcatcggagcatcttttttcaactctaaatatctggagttattccagaggcagcctgctgccgttcatgccctgatcgatgatacacagaactgcgacgatatcgcgatgaattttataatcgctaagcacatcggcaaatag

SEQ ID NO: 222639 - DNA, 954 bp, Artificial Sequence
  Description of Artificial Sequence: Synthetic coding sequence
atgggaatcagagtactgcgcctgagcctcgtggtgatacttgtgttgttactggtcgcaggggctcttacagctctcttgcccagcgttaaggaggacaaaatgctgatgctgagaagggagatcaagagccaggggaaaagtaccatggattcattcaccctcatcatgcagacctataatcggacagatctgcttctgaagttacttaaccattatcaggcagtccctaatctacacaaggtgatcgtagtatggaacaatattggtgagaaggccccagatgaactgtggaatagtttaggaccccaccctattcctgttatttttaagcaacagaccgctaatagaatgcggaatcgcctgcaggttttccccgagcttgaaaccaatgccgttttgatggttgatgacgatacactgatctccaccccagatctcgtctttgcattcagtgtgtggcagcagtttcccgatcagattgtaggtttcgtcccacggaaacatgtgtccacctcctctggcatctactcatacgggagcttcgagatgcaggccccaggctccggtaatggagaccagtactccatggtgttgataggggcttctttcttcaattccaagtacttggagctgttccagaggcaacccgctgcagttcacgccctgatcgatgatacccagaactgtgatgacatagcgatgaatttcatcatcgccaagcatatcggtaagacatccgggattttcgtcaaaccggttaacatggataatctggaaaaggagaccaacagtggatacagtgggatgtggcatagggctgaacatgcgcttcagagatcctattgtatcaataagttggttaatatctatgactctatgcctttgaggtatagtaacattatgatctctcagtttggtttcccatatgcaaactataaacgaaagatttag

SEQ ID NO: 222640 - DNA, 519 bp, Artificial Sequence
  Description of Artificial Sequence: Synthetic coding sequence
atgtcagtacctggaccctccagccctgacggggctttgactcgtcctccttattgtcttgaggccggagaacccacaccagggctgtccgacacatctcccgatgagggcctaatcgaggatctcaccattgaggacaaagcagttgaacagctggccgaaggcttgctgtcgcactacttacctgacttacagagatcaaaacaggctcttcaagaactgacacagaatcaggtggtgttgctcgacaccctggaacaagagataagcaaattcaaagagtgccactctatgcttgatatcaacgccttattcgcagaagccaaacactatcacgccaaactggtgaacatccgaaaggagatgcttatgctccatgaaaagacctccaaattgaaaaagagggccctaaaactgcagcagaaacggcaaaaagaagaactcgagcgcgagcagcagcgggaaaaggaattcgagagggaaaagcaactgacagccaggcctgcaaagcgaatgtag

SEQ ID NO: 222641 - DNA, 1608 bp, Artificial Sequence
  Description of Artificial Sequence: Synthetic coding sequence
atgttgcacaagagcgaagagggcagagtattagttgagtttacctgcaagaaccagcccaaaccctctttgcccacagaatgggccctttgcggggagagggaggaccgcctggagctgctcaaactatctacattcgcgctcattattactcccggtgacccgagattggtgatttcttccggatgcgccactagactcttcgaggctctcgaggtgggggcagtacccgtggtacttggggaacaagtccagctgccctaccaagatatgctacagtggaacgaagcagcgcttgttgtgcccaaacctcgcgtgactgaagttcatttcctcctccggtcccttagcgattctgatcttctggctatgaggcgtcagggaaggttcttgtgggagacatacttcagcaccgccgacagcatttttaatacggtcctggctatgatacgaactcgcatccagattccagccgctcctatacgggaggaggcagccgcagagatcccccatcggagcgggaaagccgcaggcacggatcctaatatggccgacaacggggacttggatttgggcccagtcgaaaccgagccaccatacgcttcacctcgatacctacgcaatttcaccctaaccgttacggacttctacagaagctggaactgtgccccagggccatttcacctgtttccccacacgcccttcgaccctgtactccccagtgaggcaaaatttcttggcagcgggacagggtttcggcctatcgggggtggtgctggcggatctggcaaagaattccaggctgccctgggcggaaacgtgcctcgagagcagttcactgtggtcatgctgacttacgagcgcgaggaggttttaatgaattccctcgagcgtctgaacgggctgccatacctcaacaaagtcgtcgtggtttggaactcgcctaagctaccaagtgaggacctactgtggccagacatcggggtgcctatcatggtggtgcggactgagaaaaacagcttaaacaatcgttttctcccctggaatgaaatcgaaactgaggctattctgagcatcgacgatgatgctcatttgaggcatgacgagatcatgttcggatttcgcgtgtggcgagaggctcgggacagaatcgttggttttccgggacgttatcacgcctgggatatcccacaccaatcttggctctacaactctaattatagctgcgagctgtcgatggtgttaactggagccgctttcttccacaaatattatgcttatctctactcatacgtcatgccccaggcaataagggatatggtggatgagtatataaattgcgaagatattgcaatgaatttcttggttagtcatattacccggaaaccccctattaaagtgaccagtcggtggacgttccggtgtcctgggtgtccacaggccctgagtcatgacgactcccattttcatgaacggcataagtgcatcaacttcttcgtcaaggtatacgggtatatgccgctcctgtatactcagttccgggtggacagcgtgctgtttaaaacccggctcccgcacgataagaccaaatgctttaagtttatttag

SEQ ID NO: 222642 - DNA, 3216 bp, Artificial Sequence
  Description of Artificial Sequence: Synthetic coding sequence
atgcctgccataatgaccatgctggccgaccacgccgcacgtcaactccttgatttctctcaaaagttagacattaatctgcttgacaatgttgttaactgtctctatcacggcgagggcgctcagcagcggatggcccaagaggtgctgacacaccttaaagaacaccccgatgcctggacaagggttgataccatcctggaattctcccagaatatgaatacaaaatactacggtctgcagatcctggagaacgtgataaagacccgatggaagatattacctcgcaatcagtgcgaagggattaaaaaatacgttgtgggcctgatcatcaaaacatccagtgaccccacatgcgtggaaaaagagaaagtgtacattgggaaactcaacatgatcctggtgcagattctgaaacaagaatggcccaagcactggcccacttttatatcagacatcgtcggggcttctagaaccagtgaatccctatgtcagaacaatatggttattttaaaactgcttagcgaggaggtgtttgactttagctctgggcaaattactcaggttaagtctaagcaccttaaagactctatgtgcaacgaattcagtcagatatttcagttatgccaatttgtaatggagaactctcagaatgcgccacttgtgcacgctacccttgaaacactcctcagatttctgaactggattccactcggttacatctttgaaactaaattgatcagcaccctgatctacaagttccttaatgtgcccatgttccgaaatgtaagtctcaagtgcttgacagagattgccggagtctcagtgagccagtatgaggaacagttcgtcactctgtttacccttactatgatgcagctgaaacaaatgctaccccttaacactaatatccggcttgcttacagcaacggtaaggacgatgaacaaaactttattcaaaatttgtcactgtttctgtgtacgttcctgaaggagcacgatcaactcatcgagaagaggctgaacctgcgcgagaccctcatggaggcccttcactatatgctcctcgtgagcgaggtggaagaaactgaaatatttaagatctgcctcgaatactggaaccatctggccgctgaactctatcgcgaatcaccattcagtacttctgcttcccctctgctctctggatcacagcatttcgatgttccccctaggagacagctgtaccttccgatgttgttcaaggttcgcctcctgatggtgtcccggatggccaaaccagaggaagtattggtcgtggagaacgatcaaggagaggtcgtacgcgagttcatgaaagatacagattctatcaatctctataaaaacatgcgcgagaccctggtttatcttacccatcttgactacgtcgataccgaacggataatgacagaaaaactgcataatcaagtgaacggaacggagtggtcctggaagaacctgaatactctatgttgggcaatagggagtatcagcggagccatgcacgaggaggatgagaaacgatttctcgtaacagtcatcaaggatcttttgggtctctgtgaacagaaaagggggaaggataacaaagctattatcgccagcaacattatgtacatagtgggtcagtatccacggttcctccgcgcacattggaaattcctgaagactgtggtaaacaaactgttcgagttcatgcacgagacacacgacggcgtgcaggacatggcctgtgacacttttatcaaaattgcccagaaatgtcggaggcatttcgtccaagtccaggtgggcgaagttatgcccttcatcgacgaaatcctcaataatattaatacaattatttgtgatctgcagccgcagcaggtgcataccttctacgaggctgtcgggtacatgatcggagcccagacggaccaaacggtgcaagaacacctgatagaaaagtacatgctcctcccaaatcaagtatgggactccatcatacaacaagccacaaaaaacgttgatatcctgaaggatcccgagacggtgaaacagttggggtccattctcaaaacaaacgtccgggcttgtaaggcagtgggacatccattcgtaatccagcttggcaggatttatctggatatgctgaatgtatacaagtgcctttctgagaatatttctgccgctatccaggctaacggcgaaatggtgaccaaacagccgctcattcgttctatgagaacagtaaaaagagaaacactgaagttaataagcggctgggtaagtagatcaaatgaccctcaaatggttgcggagaactttgtgccacctcttctcgacgccgtcttgatcgattatcagcgtaacgtgccagcagcgagagagcccgaggtcctgagcaccatggcaattattgtaaataaactgggaggacacattactgcagagatcccacagatttttgacgctgtattcgagtgtactctaaatatgattaacaaggatttcgaagaatatccagagcataggactaactttttccttctcctgcaggccgtgaactcccactgttttccagccttccttgcgataccacccacccagtttaaactggtgcttgactcaattatctgggctttcaaacatacaatgaggaacgttgccgacacaggcttgcaaatcctcttcaccctgctccagaatgtcgcccaggaggaggcagcagcccaaagtttctaccaaacctatttctgtgatattctacagcatatattctcagtcgtgactgacacgtctcacaccgctggcctgaccatgcatgcttccatcctggcatatatgtttaatctcgttgaggaggggaagatcagtacgagtctaaatccgggaaatccggttaataatcaaattttcctgcaagagtacgtggcgaatttgctgaaaagcgcttttcctcatctgcaggacgctcaggtgaagcttttcgtaactggactattttcactgaaccaggatattccggcatttaaagagcacctccgggacttcctagtgcagatcaaggaatttgccggagaggacaccagcgacttgttcttggaagaaagagagattgcgctgcgacaggccgacgaggagaagcataagcggcagatgtccgtgcccggaatttttaacccacacgaaatccctgaagaaatgtgcgactag

SEQ ID NO: 222643 - DNA, 3216 bp, Artificial Sequence
  Description of Artificial Sequence: Synthetic coding sequence
atgcccgctattatgactatgctggcagaccacgcagctcggcaactgctagatttctcccaaaagttagatataaacttactcgataacgtggtcaattgcctgtaccacggcgagggggcacagcagaggatggcccaagaggtcctgacgcatctgaaagaacatcctgacgcgtggacacgagtcgataccattttggagttcagccaaaatatgaatacaaaatactatggcctgcagattcttgaaaatgtcatcaagacgcgctggaaaattctgcccagaaatcagtgtgaggggattaagaaatatgtagtgggccttattattaagacctccagcgacccaacctgtgtagagaaggagaaggtttacatcgggaaattaaacatgattctagtgcagatcctgaagcaggagtggccaaagcattggccgacctttatatctgatatagtgggggcttcgcgcacctccgagagcttgtgtcagaacaacatggtcatattaaaattactctcggaggaggtttttgacttttcaagtgggcaaattacacaggtgaaatccaagcatctgaaagactccatgtgcaacgagttctcgcagatattccagctgtgtcagtttgttatggagaacagtcagaacgcaccattagtacacgctacgctcgaaacccttcttcgatttttgaattggatccctctcggctatattttcgagaccaaactcatttcaaccttgatctacaagtttctgaacgtccctatgtttcgaaacgtaagcttgaaatgtctgaccgaaattgccggagtctctgtgtcacagtacgaagaacaattcgtcactcttttcaccctcacaatgatgcagttaaagcagatgctgccactgaatacaaacatcagactagcttacagcaatggtaaggatgacgaacaaaatttcatacaaaatctctcgctgtttctatgtacgtttctgaaggagcatgaccagctgatcgagaaaagactcaacctcagagagaccctgatggaggcactgcactacatgcttcttgtctccgaggttgaggaaactgagatttttaaaatctgcctcgagtactggaatcaccttgctgctgaactgtaccgcgagagtccattcagcacttcggctagtcccttactctcgggttctcagcactttgacgtcccacccaggaggcagctgtacttgcccatgctgtttaaagttagactcctgatggtgtccagaatggccaaacctgaagaggtgctcgtagtggaaaatgatcagggtgaggtcgtaagagaatttatgaaggacacagattccattaacctatacaagaatatgcgcgaaactctggtgtatctgacccacctggactatgttgatacagaacgaattatgacagaaaaactgcataaccaggttaacggcacggagtggtcttggaaaaacctcaacaccctgtgttgggccatcgggtccatttcaggagccatgcatgaagaagatgagaaacgcttcctggttaccgttatcaaggacctgttgggactgtgtgagcagaagaggggaaaagacaataaggctataattgcatccaacattatgtatatcgtcggtcagtatcccagatttttgcgtgcacattggaaatttctgaaaacagtggttaataaacttttcgagttcatgcatgaaacccacgacggggtgcaggatatggcatgtgacacttttatcaagatcgctcagaagtgtcggcgtcatttcgtgcaagtgcaagtgggcgaggttatgcctttcatcgatgagatcctgaacaatattaacaccattatctgcgacctccagcctcagcaagtgcacactttctacgaagccgtgggatatatgataggcgcacagaccgatcaaaccgtgcaggagcacctgattgagaaatacatgctgctgcctaaccaggtatgggattctattatccagcaggctacaaagaatgtggacatactgaaagaccctgaaaccgtcaaacaattgggcagtatcttaaaaactaacgtcagggcttgcaaggcagtgggtcatccatttgtcatccagttagggaggatctatttggacatgctcaatgtctacaagtgcctgagtgaaaacatcagcgctgccattcaggctaacggtgagatggttacaaaacagcctttaattaggtcaatgagaactgttaaacgcgaaacactgaagctcatttctggctgggtgagcaggtccaatgatcctcagatggtcgcagaaaactttgtgcccccactccttgatgcggttctcatcgactaccagaggaatgtaccggctgcgagagagcctgaggtgctctccaccatggctattatcgttaacaaacttgggggtcacatcacagcagagatcccacagatatttgatgctgtttttgaatgcacgttaaatatgatcaataaagatttcgaagaataccctgagcatcgcacgaacttcttcctgctactccaggcagtaaacagccactgtttccccgcattcctagccataccaccaacccagttcaagttggtcctggacagcatcatatgggcgtttaagcacacaatgaggaacgttgccgacacggggctccagatccttttcacattgctgcagaatgtggctcaggaggaggcagccgctcagagtttttatcagacgtacttctgcgacatcctacagcacatcttcagcgttgtgactgacacaagccacactgctggcctgacgatgcatgccagcatcctggcctacatgtttaacctagtcgaagaaggaaaaatctcaacatctctcaacccaggtaatcccgtgaataaccagatcttcctccaagaatacgtggccaatctcttgaaatcagcttttcctcatctgcaggacgcccaggtgaagctgtttgtcacgggactcttcagtctgaaccaggacatacccgcattcaaggaacacctgagagatttcctagtgcaaatcaaagagtttgccggagaggacacttccgatcttttcctcgaggagcgagagattgcactgagacaagccgacgaggagaagcacaaacgccagatgagcgtgcccggtatatttaatcctcacgagatcccagaggaaatgtgtgattag

SEQ ID NO: 222644 - DNA, 3216 bp, Artificial Sequence
  Description of Artificial Sequence: Synthetic coding sequence
atgccagccattatgaccatgctggccgatcatgcagctcgtcagctgttggatttctctcagaagctcgatatcaatctgctggacaatgtagtaaactgcctgtaccatggcgaaggagcccagcagcgtatggcacaggaggtcctgacgcacctcaaggaacatcccgacgcttggaccagggtagacactatcctcgaattctcacagaatatgaataccaagtactacggcctgcagatactggagaatgtgatcaagactcgttggaagatacttccacggaaccaatgcgagggaatcaaaaagtacgttgtgggcctgatcataaagacttcctcagaccctacttgcgtcgaaaaggagaaggtgtacatcgggaagctgaacatgattttggtgcagatattgaaacaggaatggccgaagcactggccaacttttatctcagatatcgtgggtgctagccggacttccgaaagcctctgccagaataacatggtgatcctcaagttgctcagcgaggaagtattcgatttttcaagtgggcagataacgcaggtcaagtccaaacatctaaaagattcaatgtgcaacgagttctcgcagatctttcaactgtgtcaatttgtaatggagaacagtcagaacgcgcctctggtgcatgcaaccttggaaacactgctcaggtttctgaattggatcccactcgggtacatcttcgaaacaaaattgatctccacacttatttataagttcctgaacgtgcctatgttccgcaacgtgtccctgaaatgtctcaccgagatcgccggtgttagtgtgtctcagtatgaggagcagttcgtgaccctcttcacactcacgatgatgcagctcaagcagatgctgcccctcaacaccaacatcagattggcatattctaatggaaaagacgatgaacagaacttcatccagaacctgtcgctgttcctgtgcacctttttaaaggagcacgaccagctgatcgaaaagcgactgaacctcagagaaacactcatggaagcactgcactatatgctgctcgtgtccgaagtggaggagactgagatcttcaagatttgcctcgagtactggaatcacctcgcagcggaactgtacagggaatcccctttcagcaccagcgcgagccccctgcttagtggctcccagcactttgacgttcccccacggaggcagctctacctgcccatgctattcaaagtgcggctgttaatggtgtctcggatggcaaaaccagaggaagttttggtggtcgagaacgaccagggggaagtggtccgcgagtttatgaaagacacagatagcatcaacttgtacaagaacatgagggagactctcgtgtatctcacccatctggattacgtcgatacagagcgcatcatgaccgagaagttgcacaatcaggttaatgggacagagtggagctggaaaaatctgaacaccctttgttgggccattggaagcatctcaggcgctatgcacgaggaggatgaaaagaggttcctggtcactgttattaaagacctgctgggcttgtgtgaacagaaacgaggtaaggacaacaaggccatcatcgcgagtaatataatgtatatcgtgggacagtatcccaggttcctgagggctcattggaagtttttaaaaactgtggtgaataagctattcgaattcatgcacgaaacacacgacggagtccaagatatggcgtgtgatacctttattaaaatagcacagaaatgtagaaggcactttgtacaagtccaggtcggcgaggtcatgcccttcatcgacgaaatcctgaacaatatcaacacaataatctgcgacctgcaaccacaacaagtccatactttctacgaggcagtgggatacatgataggcgcacagacggaccagaccgttcaagaacacttgatcgagaaatacatgctattaccgaatcaggtgtgggattctattatccaacaggcgaccaagaacgtcgacatcttgaaggaccctgagacagtgaaacagctcggatcaattttgaagaccaatgttagggcatgcaaagccgtcggtcatcccttcgtgattcaactgggacgaatataccttgacatgttaaatgtctataagtgtctaagcgagaacatttctgctgccattcaggcaaacggggagatggtcacaaagcagccactgatcaggtccatgagaaccgtcaaacgggagaccctcaagcttatcagtggctgggtttctagaagcaacgatccacagatggttgctgagaactttgtgccacctctccttgacgccgtcctaatcgactatcagaggaatgtacctgcagctagggagccagaagtgctcagtaccatggcaattatcgtgaataagttggggggtcatataactgccgagatccctcagatctttgacgcagtattcgagtgtacactaaacatgatcaacaaagatttcgaggaataccctgagcataggacaaacttttttctcctcctccaggcagtgaacagccactgctttccagccttcctagccatcccgcctacccaattcaagctggtgctcgactctattatatgggcctttaagcacactatgcgtaatgtggccgatacagggttgcaaatactgttcacccttctccaaaacgtggcacaagaggaggcagccgctcagagcttctatcagacttatttttgcgatatactgcaacatattttctcagttgtgactgacacttcgcacacagctggtctaacgatgcatgcatcgattctcgcttacatgtttaacctcgtggaggaagggaagatcagcacctccttgaatcccggaaaccccgtgaataatcagatattcctccaggagtacgtcgccaatcttttgaagtccgccttccctcacctccaggatgcccaagtgaaactctttgttacaggacttttttctcttaaccaggacattccagcattcaaagaacatctcagggatttcctcgtgcagattaaagaattcgcgggtgaagatactagtgatttgtttctggaggagcgagagatcgccctgcggcaagcagatgaggaaaaacacaaaagacagatgtcagtgccgggtatttttaaccctcacgagattcccgaagagatgtgcgactag

SEQ ID NO: 222645 - DNA, 303 bp, Artificial Sequence
  Description of Artificial Sequence: Synthetic coding sequence
atgcccgctattatgaccatgttagctgaccacgccgctagacagctgctggacttctcacagaaacttgacatcaatctgctggacaacgtcgtaaattgtttataccacggcgagggcgctcagcagcggatggcgcaagaagtgctgacccacctgaaggaacatccagacgcatggacgcgagtcgacacgattctggagtttagccagaatatgaacacaaagtattacggcctgcagattctggaaaatgtcattaagacccggtggaaaatcttgccacgaaaccagtgcgaatag

SEQ ID NO: 222646 - DNA, 288 bp, Artificial Sequence
  Description of Artificial Sequence: Synthetic coding sequence
atgcccgcaattatgactatgcttgccgatcatgctgccagacaactcctggatttctcacagaagttggatataaacctcctggataacgtagttaactgcctgtatcatggggaaggagcacagcagcgaatggcgcaggaggtcttgactcacctgaaggaacaccctgacgcatggactcgcgtagatactatcctggagttctcccagaacatgaatactaaatattatgggctccagatactagagaatgtgatcaagacaaggtggaagatcctcccctag

SEQ ID NO: 222647 - DNA, 180 bp, Artificial Sequence
  Description of Artificial Sequence: Synthetic coding sequence
atgcccgcaattatgacaatgctagcagatcacgccgctcggcagttgctggacttcagtcagaagctggacattaatttgcttgacaatgtcgttaattgtctttaccacggcgaaggtgcccagcaaagaatggcacaggaggtactgacccatctgaaagagcatcccgacgcttag

SEQ ID NO: 222648 - DNA, 399 bp, Artificial Sequence
  Description of Artificial Sequence: Synthetic coding sequence
atgccagctatcatgactatgttggctgaccatgctgccagacagcttctggattttagtcaaaaactggacatcaacctgttggacaacgtggttaactgcctctatcacggtgagggggcacagcagcgtatggcacaagaggtccttactcacttaaaagaacaccccgacgcctggactagagtggatacgattctagagttcagtcagaacatgaataccaagtactacgggttgcagatcttggagaatgtcataaagaccagatggaagatcttgcctaggaaccagtgcgaaggtattaaaaaatacgtagtcggacttatcatcaagacgagcagcgatcccacttgtgtcgagaaagaaaaagtgtatatagggaaactaaacatgtag

SEQ ID NO: 222649 - DNA, 189 bp, Artificial Sequence
  Description of Artificial Sequence: Synthetic coding sequence
atgcctgccatcatgaccatgctcgccgatcacgcagcacgccagcttctcgattttagccagaaactggacataaacctgttggacaatgtggttaattgcctatatcatggcgagggcgcacaacagagaatggcgcaggaggtcctcacccacctgaaggagcacccagatgcctggactcgctag

SEQ ID NO: 222650 - DNA, 540 bp, Artificial Sequence
  Description of Artificial Sequence: Synthetic coding sequence
atgcccgcaatcatgacaatgttagccgatcatgctgcaagacaactcctcgacttctctcagaagttggatatcaaccttctcgataacgtggtgaactgcctgtaccacggcgaaggtgcacagcagcggatggcccaagaggtcctcacacacttgaaggagcacccggatgcctggactcgggtagataccattctggagttcagccagaatatgaacacaaagtactatgggcttcagatactggaaaatgtaataaagaccaggtggaaaatcttgcctcgcaatcagtgtgaaggaattaaaaagtatgtcgtgggtcttatcatcaagacttcttcagatccaacctgtgtggagaaagagaaggtctacataggcaaactaaatatgattctggtgcagattctgaaacaagagtggcccaagcactggcctacgttcatctccgacatcgtgggagcctcaaggacatctgagtccctgtgtcagaacaatatggttattctgaagttgctatcagaagaggtgttctag

SEQ ID NO: 222651 - DNA, 285 bp, Artificial Sequence
  Description of Artificial Sequence: Synthetic coding sequence
atgccagctatcatgactatgctcgccgatcatgccgctcgccagttactggattttagtcaaaagctggatataaacctgttggacaacgtggtgaactgcctgtaccacggggagggtgcccaacagcgcatggctcaagaagtcctcacacacctgaaagagcaccccgacgcatggactcgggtggacacgattttggagtttagtcagaatatgaacaccaagtactatggactccaaatccttgaaaacgtgataaaaaccagatggaaaatcctgtag

SEQ ID NO: 222652 - DNA, 3615 bp, Artificial Sequence
  Description of Artificial Sequence: Synthetic coding sequence
atggcgatggatcaggttaacgccctatgcgagcagttggttaaggctgtcaccgtgatgatggatccaaactctacccagagatatagactggaggctctcaaattttgtgaggagtttaaggagaagtgtccaatctgcgtgccctgtggactcagactcgctgagaaaacccaggttgccatcgtgagacatttcggactgcagatactggagcatgttgtgaaattccgctggaacggcatgagccggctggagaaggtgtacctcaagaactctgtcatggagctcatcgctaatggcaccctcaacatcctggaggaagaaaatcatattaaggacgcccttagccgcattgtagtcgagatgattaaaagggagtggccgcagcattggcctgacatgctgatcgaattagatacgttatcaaagcaaggcgaaacacagacagaactggtcatgttcatccttctgagactggcagaagacgtcgtcacttttcagactctgcctccacagcggcgaagagacattcagcagactctgactcagaatatggagagaattttttcctttctgttaaacactttgcaggaaaacgttaacaaataccagcaagtgaagacagacacatcccaggagtcaaaagcgcaggccaactgtagagtgggcgtagcggctctcaacaccttagccggatatattgactgggttagcatgtcacatatcaccgccgagaattgtaaactgcttgaaattctatgcctgctgctgaacgaacaagagctgcagctaggcgctgccgaatgcctgctaatcgccgtgtctaggaagggtaaattagaagacaggaaacccctcatggtgctcttcggagatgtcgctatgcattacatactgagtgccgctcaaacggctgacggaggcggactcgtggagaaacactacgtattcctcaaaagactgtgtcaggttctctgtgccttaggaaatcagctgtgtgcactgctgggcgctgacagcgatgttgagactccctctaatttcggtaagtatttggagagtttcctggcatttacaactcacccctcccaatttctgcggtccagcacccaaatgacctggggcgcactgtttaggcatgaaatcctttctcgtgatcctcttctgctggcaattatacctaagtacctcagagcctccatgacgaacctcgtaaagatggggttcccgtccaagacagattcgccttcctgcgagtactcccgattcgactttgactccgacgaggactttaatgccttctttaacagttctagggcacagcagggtgaggttatgcggctggcctgccgtctggatcctaaaacctcctttcaaatggctggagagtggctcaagtaccagctgtccaccttcctggatgctggatccgtgaacagttgttccgctgtggggaccggcgagggatccctgtgctccgtttttagtccctctttcgtgcagtgggaggccatgaccttattcttggagagcgtgattacccagatgttccgcacactgaacagagaagagatccctgttaatgatggcattgaactcttgcagatggtgctgaatttcgacaccaaggatcctctaatcctctcatgtgtgttgaccaacgtgagcgcactgtttccctttgtaacctatagacccgaatttctcccacaggttttttctaagctgtttagctctgttacgtttgagacagtagaggagtcgaaagcccctagaaccagagcagtgcgcaacgtgaggcggcacgcctgctctagcatcatcaagatgtgtcgggactatccccaactcgtgctccctaactttgatatgctgtataaccacgtcaagcagcttctctccaacgaattgctactcacacaaatggaaaagtgtgctctgatggaagccctggtgctgatatccaaccaatttaaaaactatgagaggcagaaagtatttttagaagagctcatggctcctgtggcttctatttggttgtcacaggacatgcaccgggtactgagtgacgtggacgctttcatcgcttatgttggtaccgatcagaaatcatgcgaccccggattggaggacccctgcggactgaaccgggcacgtatgtcgttttgtgtttactcaattctcggagtggtcaagaggacatgctggcctaccgatctggaggaagccaaggctggaggcttcgtggtggggtacactagcagcggaaatccaatcttcaggaacccttgcactgaacagatcttgaagctcctagataatctgctggcactcatcaggacacacaataccctatacgcacctgagatgctggcaaaaatggccgagcccttcactaaggccttagacatgttagatgccgaaaaaagcgccattcttggcctccctcagcccctcctcgagctgaatgactcccctgttttcaaaacagtgctggaacgcatgcagcgttttttcagcaccctttatgaaaattgcttccatatcttaggaaaagcaggcccttccatgcagcaggatttctacacggttgaagacttggcgacacagctgctaagctccgcattcgtgaacctgaacaacattcctgactacagacttaggcccatgctgcgggtcttcgtcaagcctttagtgctattctgcccacccgagcactacgaagccctcgtgagccccatcctaggccctctgtttacctatttgcatatgcggctcagccaaaaatggcaggtgattaaccagagaagcttactgtgtggcgaagatgaggcggctgatgagaaccccgagtcgcaagagatgttggaggagcaattagtgcgaatgctgacccgcgaagtaatggacctgattaccgtctgttgtgtgtccaaaaaaggcgctgatcactcctccgcgcctccggcagatggtgacgatgaagaaatgatggcgactgaggtgactcccagcgcgatggccgaactcactgacctgggtaagtgccttatgaaacatgaggacgtgtgtacagcactccttataactgccttcaatagtttggcttggaaggacactctgtcttgtcagcggacaacttctcagctgtgttggcctctcctgaaacaggtgttgtctgggaccctgcttgctgacgctgtgacatggctatttacctctgttctgaaaggattgcagatgcacggtcagcacgacggatgcatggcttccctggtgcacttggcattccagatttatgaagccctcaggcctcgatacctggagataagagcagtgatggaacagatccccgagatccagaaagactcactggaccagttcgattgtaagctgctaaaccctagcttacaaaaagtcgcagacaaacggaggaaggatcagttcaaacgcctgatcgcgggatgtatcgggaagccgctaggcgagcagtttcgaaaggaggtgcacatcaagaatctgccctccctctttaaaaagaccaagcctatgctggaaactgaagtcctggacaacgatggtgggggactggccacaatctttgagccgtag

SEQ ID NO: 222653 - DNA, 513 bp, Artificial Sequence
  Description of Artificial Sequence: Synthetic coding sequence
atggcaggtgaatggttgaagtaccagctaagtaccttcctagacgctgggtccgttaatagttgttcagcagtaggaacaggagagggctctctgtgttcagtcttttcccccagcttcgtacaatgggaggctatgacgctcttccttgagtctgttataacccaaatgtttcggacgctgaaccgggaggagattcccgttaatgatggtattgagctgctccagatggtcctgaacttcgacactaaagacccactgattctgagctgcgttctcacaaatgtcagcgctctgtttccctttgtcacctatcgccctgagttcctccctcaggtgttcagcaaattattcagttcagtcacttttgagacagtggaagagtcgaagccaccccacttccctccactatccgcatggaaggagatacaggtatggtcatggcgagaacaagcgctgtgtcgcactcgctccaactacactaaggtgagtcgtaagggggttcgagcctag

SEQ ID NO: 222654 - DNA, 2166 bp, Artificial Sequence
  Description of Artificial Sequence: Synthetic coding sequence
atggccggtgaatggctcaagtaccaactctccaccttcttggacgctggcagtgtcaacagttgctcagctgtgggaacaggcgaggggtccttgtgctccgtcttcagccccagttttgtccaatgggaggcaatgaccttatttcttgagagtgtgatcacgcagatgttccggacgctaaaccgcgaagagatcccggtaaacgatggtatcgaactcctacagatggttctgaactttgatacaaaagatcctctgatcttatcctgtgtcctaacaaacgtgagcgcactgttcccatttgtgacttatcgtcctgaatttttgccacaggtcttttctaagctcttcagttcggtcacctttgaaaccgtggaggagagtaaggctccgcgtaccagagctgtgagaaatgtgcgcaggcacgcctgttcttctattatcaaaatgtgtcgcgattatccacagcttgtgcttcccaactttgacatgctatacaatcatgtgaagcagctgctctcaaacgagctattactgacgcaaatggagaaatgcgcgctgatggaagccttggtgctgattagtaaccagttcaaaaactacgaaaggcagaaggtttttctcgaggaactgatggcgccagtcgcttcaatctggcttagtcaggacatgcaccgggttctcagtgatgttgacgccttcatcgcttatgttgggaccgaccagaagtcgtgtgatcctggccttgaagacccctgtggactcaacagagctagaatgtccttctgtgtctactccatcctgggcgtggtgaagcgtacttgttggcccactgatctcgaggaggccaaagccggtgggttcgtcgtgggctataccagctcaggcaaccctatttttcggaatccttgtaccgagcagatactcaaactgctggataatctgctcgcactcattaggacccacaacactctctatgcaccagagatgttagccaaaatggctgagccattcacgaaggcgcttgatatgttagacgcagagaagtccgccatacttggcctgccacagccactactggaactaaacgattctcctgtcttcaagaccgtgctggaaagaatgcagcgtttttttagtaccctgtacgagaattgctttcatatcctcggaaaggctggaccttcaatgcagcaagacttctataccgttgaggaccttgctacacagctactgtcatccgccttcgtcaatctaaacaatatcccagattaccgactccggccaatgctgcacattctctcaaagcctctggtcttgttctgtcctccagaacactatgaggcgttggtcagccctatccttggtcccctattcacttatctccatatgcgtctctcccagaagtggcaggttatcaatcagagatccctgctctgcggtgaggacgaggctgctgatgaaaatcccgaatctcaggaaatgcttgaggaacagttggtccgaatgttaacacgcgaggtcatggacttgattacggtgtgctgcgtgtctaagaagggcgcagaccactccagtgcccctcccgctgacggcgatgatgaagagatgatggccaccgaagtgactcctagtgctatggccgaacttacagacctggggaagtgtctcatgaagcatgaagacgtgtgtacagccctattgataacagctttcaattcgttggcatggaaagacacactaagttgccagagaaccacctcccagctgtgctggccgctgctgaagcaggtcctaagcggtacactgctggccgatgcggtcacctggctgtttacttctgtgctgaaaggtctgcagatgcacggtcagcatgacggatgcatggcttctctcgtgcatctggcattccaaatctacgaagctcttcggccaaggtacctggaaatcagggccgtgatggaacagattcctgagatacagaaagacagcctggaccaatttgactgcaaattactgaatccatccttgcagaaagtagcggacaagcggagaaaggatcaatttaagcgcctcattgccggttgcattggaaaacccctaggtgaacagtttaggaaggaagtgcatattaagaacctcccttttgtcgctgatttatag

SEQ ID NO: 222655 - DNA, 2211 bp, Artificial Sequence
  Description of Artificial Sequence: Synthetic coding sequence
atgcactatatcctttccgctgcacagaccgctgacgggggaggacttgtagaaaagcactacgtgtttctgaagaggctttgccaagtcctctgcgctctgggcaatcagttgtgcgcgctgctgggggctgacagcgatgtggagacacctagcaatttcggaaaatacctagaaagctttctagcattcactacacacccttcccagttcctgaggtcttccacccagatgacatggggggcacttttccgacatgaaatcctctcacgggatccattgctgctagccataatccccaagtatctacgagcatcaatgaccaaccttgttaagatgggattcccgtctaagacagattcacctagttgcgagtactctaggttcgacttcgattcggacgaagactttaacgcattttttaacagctcccgagcccagcagggggaagtgatgcgcctcgcctgcaggctggaccctaagacaagctttcagatggcaggggagtggctgaaatatcagttaagcacctttctggacgctggcagcgttaacagttgttccgccgtgggaacgggcgagggttctctatgtagcgtcttttccccatctttcgttcagtgggaggccatgacccttttcctagagtcggttatcactcagatgttccgcacattaaatcgcgaggaaattcccgttaacgatggcatcgagctgttgcagatggtgcttaattttgatacgaaggaccccctcatcctgtcttgtgtgttgaccaacgttagcgccctttttccatttgtaacctacaggccggaattcctcccacaggtattctcgaagttgttctccagcgtgacatttgagacagtcgaggaatccaaggcccctcgcacacgggctgttcgtaatgtcaggagacatgcgtgctcttcgattattaagatgtgtagagactatcctcagctcgtcttacccaattttgatatgctatataatcacgtgaaacaacttcttagcaatgagctgcttctgacccaaatggagaagtgtgccttgatggaggctctggtgctcatcagcaatcagttcaagaactatgaaaggcagaaggtattcctcgaggagcttatggcccctgttgcaagtatatggctgtcccaggacatgcatagagtgctctccgatgtggacgctttcatagcatatgtcggcaccgatcagaagagctgcgatcccggactggaggatccctgcggtctcaatcgagccaggatgagtttttgcgtctactctatcttaggcgttgtgaaaagaacgtgctggcccaccgacctcgaagaggccaaagccggtgggttcgttgtgggatatacttcatccgggaaccccattttccgcaacccatgtacagagcaaatccttaaattgcttgataacctgctcgccttaatcaggacacacaatactctatatgccccagaaatgctggccaaaatggccgagccatttaccaaagcccttgacatgctggatgcagagaaatctgcaatcctggggctcccccagcctctactggagctgaacgactcccccgtgttcaaaacagtgttggaacgcatgcaacgttttttctccactctgtacgagaattgcttccatatactgggcaaagctggaccatctatgcagcaggacttctatactgtggaagatttggcaacccaattattgtcctctgcctttgtcaacctcaataacatccctgactatcgcctcagaccaatgcttcacatcctctctaaaccactggtgttgttctgccctcctgagcattatgaagcactggtgagtcccatcttgggcccattgtttacttacctgcacatgaggttatcccagaagtggcaggttattaatcaacgaagtttattgtgtggcgaagatgaggccgcagatgagaaccctgaatctcaggagatgctggaggagcagttagttcggatgttgaccagggaggtcatggatttgatcactgtttgttgcgtttcaaagaaaggggctgatcattcatccgctccacctgctgacggggacgacgaggagatgatggccacagaggtaacaccttcagccatggcggagctgaccgacctggtaagcattcaatctaccgacaaacgggtcagtcctagggccgaggtggattag

SEQ ID NO: 222656 - DNA, 2499 bp, Artificial Sequence
  Description of Artificial Sequence: Synthetic coding sequence
atgacgtggggggctctgtttaggcatgagattctcagccgtgatccactcctgttggccatcattcccaaatacctacgcgcttccatgaccaatttagtgaagatggggttccctagcaagaccgatagtcctagctgtgagtattcgaggttcgattttgactccgatgaggacttcaatgcattttttaacagctctcgagctcagcaaggagaagttatgcgtctcgcctgccggctggatccgaaaacctctttccagatggctggcgaatggctgaaatatcaactctctaccttccttgatgcaggcagtgtcaattcctgtagcgcggtggggactggtgagggatccctttgtagcgtgttctcccccagctttgtgcagtgggaggccatgacactatttctggagtctgtcataacacagatgtttaggacactcaaccgggaggaaatcccagtgaacgacggcatcgagcttctgcaaatggtgctgaatttcgacacgaaagaccctctgattcttagttgtgtcctcacaaatgtttccgctttgtttcccttcgtgacttaccgcccagagtttttgccgcaggtgttttctaagttatttagctccgtaactttcgaaactgtcgaagaaagtaaagcccctcggacacgcgcagtgcgcaacgtgcggagacatgcttgtagttcaattatcaaaatgtgtagagactacccccaactcgtactgccaaattttgatatgttgtataaccacgtgaagcagttgctgtctaatgaactgttgctgactcagatggagaagtgcgccctgatggaggctctcgtacttatttctaatcagttcaagaattatgagcgtcagaaggtcttcctggaggagctgatggccccagtcgcaagcatttggctgtcacaagatatgcatcgcgtgttatctgacgtagatgcatttatcgcgtatgtgggtacagaccagaagtcttgcgacccaggtctggaagacccgtgcggcctaaaccgggcaaggatgtccttctgtgtctatagtatccttggggtggtgaaaagaacgtgctggccaaccgatcttgaggaagccaaagccggtggctttgtggtaggctacacatcctcaggaaatcccatcttcagaaatccttgtacagaacaaattctaaagctcctggataacctccttgcacttatcaggactcataatacactgtacgctcccgagatgctggcgaaaatggccgagcctttcaccaaggcactcgatatgctagacgccgagaagtctgcaatattagggctaccccagcctttgcttgaactcaatgactcaccagtttttaaaaccgttctggagaggatgcagaggtttttcagcactctttacgagaattgcttccatatcctgggcaaagctggaccttccatgcagcaggacttctatacggtcgaagatctcgccacccagctccttagttccgcctttgttaacctgaacaatattccagactatcggctgcgcccaatgctccgtgtgtttgtcaagcctcttgtgctgttctgtcctcccgaacactacgaggcgctcgtctcacctattcttgggcctctctttacttatttgcacatgcgccttagccagaaatggcaggtgataaatcagagatctcttctgtgtggcgaagacgaggccgctgacgagaatcccgagagtcaggaaatgctggaagaacagctagtcagaatgcttacaagagaggtgatggatctcattacagtctgttgtgttagcaagaaaggggctgatcactctagcgcaccccctgctgatggagacgatgaggaaatgatggcgacggaggtgacccccagtgcaatggcggagctgaccgatctgggaaaatgcctgatgaagcacgaggacgtgtgcactgcactgctgatcaccgccttcaactccctggcttggaaagatacattaagttgtcagcgaacgacttctcaattgtgctggcccctcctgaaacaggtgctctctggcacccttctggccgacgccgtaacgtggctctttaccagcgtgctcaagggactgcaaatgcacggccagcatgatggctgtatggcaagcttggtacatttagccttccaaatctatgaggccctgcgccctaggtatttggagatacgggctgtgatggaacagatccccgagattcaaaaggatagcttagaccagtttgactgtaaacttctgaacccgagcttgcagaaagtagccgacaagcggaggaaggaccagttcaaaaggctaatagctgggtgtatcggcaagcccttgggggaacaatttcgtaaagaggtgcacattaagaatttaccctcgctgttcaaaaagaccaaaccgatgttggaaaccgaagtactcgacaacgacggcggagggttagctactatttttgagccgtag

SEQ ID NO: 222657 - DNA, 3378 bp, Artificial Sequence
  Description of Artificial Sequence: Synthetic coding sequence
atggcgagcgaagaagcctccttacgggctctggaaagcctcatgacagagttttttcatgactgtacaacaaatgagcggaagcgtgagatcgaagaattactgaataatttcgcacagcagattggcgcttggcggttttgtctatatttcttgtcttccaccaggaacgactatgttatgatgtattcgcttacagtctttgaaaatctgattaacaaaatgtggctgggggtgcctagccaggataagatggaaattagatcctgccttcctaagctcctgcttgcccatcataaaacattgccttactttattagaaataaactctgtaaggtaatagttgatatcgggaggcaggattggcccatgttttaccatgactttttcactaacattctgcaattgattcagtctcccgtcaccaccccgctgggactaatcatgttaaagacaacgagcgaggagctagcttgcccgagggaagacctctccgtggccagaaaggaggagctccgaaagctgctcttggaccaggtgcagaccgtcctgggactccttaccggcatattggaaacagtttgggacaaacatagtgtcaccgccgcaacccccccaccatcaccaacgagcggagaaagtggcgacttgttaagcaacttactgcaaagcccatcgagtgcgaagttgcttaatcaacccatccccatactggacgtggagtccgagtatatttgttctctggctctcgagtgcttagcccacttgttctcgtggatcccattgagtgcatcgatcactccttctctcttgactacaatctttcactttgccaggtttgggtgcgacatacgtgccaggaaaatggcttcagtgaacggaagcagccagaattgtgttagtggtcaagaacgtggcagacttggagtgttagccatgtcttgcattaacgaacttatgtcgaaaaattgcgttcccatggaatttgaagaatacctgctgcgtatgtttcagcagaccttctacctgttgcagaagatcactaaggataacaatgctcataccgtgaagagtcgcctggaggaactcgacgaatcttacattgaaaagtttaccgacttcctgagattatttgtgtctgtgcaccttaggcgtattgaaagctacagccaattcccagtcgtagagtttcttacattgcttttcaaatacacatttcatcagccaacgcacgagggatacttctcctgcttggacatatggacactgttccttgattatctcacttccaaaatcaagtccaggctcggtgacaaagaggcagtgcttaatcggtatgaggatgcgctcgtgttattattgacagaggtgctgaacaggattcagtttagatacaatcaggctcagctagaagagctagacgacgagacgctggacgatgatcagcagacagagtggcaaagatatctccgtcagtctctggaggttgtcgctaaagtaatggaactcctaccaacacacgcgttttcaacactgttcccagtcctgcaggataacctggaagtatacttaggcctccagcaatttatcgtgacttcagggagtggacacagactcaacatcaccgctgaaaatgactgccgcaggctgcattgctcactccgtgatctcagcagtctgctgcaggcagtgggacgccttgccgagtactttattggcgatgtgttcgccgctaggttcaatgatgcactgaccgtcgtcgaaaggctggtgaaagtgactctatacggttcgcagatcaagctctacaatatcgaaactgcagtgccaagtgtgttgaagccagatctgatcgatgtgcatgcccagagcctggccgcactgcaggcctatagccactggttggctcaatactgctccgaggtgcatcggcaaaacactcagcagtttgtcactttaatttcaactaccatggacgccattactccactgatctcaacaaaagttcaagacaagttgcttttgtccgcttgtcatttgctggtgtctctagccacaaccgttagacctgtatttctgatttcgatccctgccgttcagaaagtcttcaacagaataacagacgcctcggctctgaggttagtagacaaggcacaggttctagtctgtagggccctgtccaacatcttgctcctgccatggccaaacctaccagaaaatgagcagcagtggccagttcgctcgatcaatcatgcatcgctcatcagcgccctcagtcgggactatagaaacctgaagccgtccgcggtggctcctcaaagaaagatgcctctggatgatactaaacttataattcaccaaaccctgtccgtactggaagacatcgtagaaaatatctccggggagagtacgaaatccagacagatctgctaccagagcctccaggaatctgtgcaagtctcgctcgccctgttccctgcttttatccatcaaagtgatgtgactgacgagatgcttagtttttttttgactctgttccggggattaagagttcagatgggtgtcccttttacagagcagatcattcagacattccttaacatgtttacaagagagcaactggcggagtcgattctccatgaggggagtaccggctgccgggtggtggaaaagttcctaaagatcctgcaggtcgtggtccaagaacccggacaggtgttcaaaccatttctcccttcgatcatcgccctgtgcatggagcaggtgtacccgataattgctgagagacccagcccggatgttaaagcagaactgttcgagctgctcttccggacccttcatcataactggagatatttttttaagtctaccgtcctggcatccgtccagagaggtatagctgaagagcaaatggaaaatgaaccccaattctccgccatcatgcaggccttcggacagagctttctgcagccagacatccatctcttcaaacagaacttattctatctggaaacccttaacacgaagcagaaactctaccacaagaagatattccggactgccatgctgttccagttcgtcaacgttctcttgcaggtcctggtccacaagtcccatgacctgttacaagaagagataggcatcgccatctataatatggcctccgttgacttcgacggcttcttcgctgcatttttgcccgagtttctcacgagctgcgacggggtggacgccaatcagaaatcagtgctggggaggaacttcaaaatggatcgcgatcttccatcttttacacagaacgtgcaccggttggttaatgatctgcgttattaccgactctgcaatgatagcctgcccccaggcactgtaaagctttag

SEQ ID NO: 222658 - DNA, 3336 bp, Artificial Sequence
  Description of Artificial Sequence: Synthetic coding sequence
atgactgaattcttccacgattgtacaaccaacgagagaaagcgcgagattgaggaactgctcaataacttcgcccaacagataggtgcatggcggttctgcctctacttcttatccagcactcgtaacgactacgtgatgatgtactcccttacagtgtttgaaaatctcattaataagatgtggcttggagtgccttcccaggacaagatggagatcagatcatgcttacccaaactacttctcgctcaccacaagactctgccatattttattagaaacaaactgtgcaaagttattgtcgatatagggcgacaggattggcccatgttttatcatgactttttcacgaatatcttgcaactcatccagagtccggtcacaacccccttgggactgattatgctcaaaaccacctcagaggagttagcgtgccccagggaggatctttcagtggcccgaaaagaggagctcaggaaacttcttctggatcaggtgcagacagtcctggggctgctgaccgggattctggaaactgtttgggataagcacagcgtgacggcagctacccctcctccatctcccaccagtggcgagtccggagacttgctgtcaaacttgctccagagtccttccagcgctaagctgctcaatcagcctataccaatattggacgtcgagtccgagtacatttgttcactagctctggagtgcttggctcatcttttctcctggattccattgagtgccagtatcaccccctcactgttgacaaccatctttcactttgccaggttcggctgcgatattcgggcacgaaaaatggcaagtgtaaacggatcatcccaaaattgtgtctccggccaagagagaggtaggctgggcgtgctagccatgtcctgtattaacgaactgatgtctaaaaattgcgtcccaatggaatttgaggagtacttgctgagaatgtttcagcagaccttctacctactgcagaaaatcacaaaggataacaacgcccatacggtgaaatcccgcctggaggagctagatgaatcctacatagaaaagttcaccgatttccttcggctatttgtgtccgtacaccttagacgcatcgaaagctattctcagtttccggtggtcgagtttctgactctgctgtttaagtacacattccaccagccgacacacgaaggctatttctcctgcctagatatctggacattgtttttggattacctgactagcaaaatcaaatccagactgggagataaagaggcagtgctaaatagatacgaggatgccctcgtgttgctcttgactgaggttttaaatcggatacagttccgatacaatcaggctcagttggaggagctggatgatgagacattggatgacgaccagcaaaccgaatggcagcgctatctgagacagagcctcgaagtggtggctaaagtcatggaacttctccctactcatgccttttccacccttttccctgtgctacaggacaacttggaggtctacctaggtctccagcagtttattgtcacatctggaagcggccaccgcctcaacatcacggccgagaacgactgccgtagattacactgcagcctgcgagacttgtcttcgctgctgcaagccgttggcaggctggcggaatattttatcggtgacgttttcgccgctcggttcaacgacgcactgacagtagtggaaaggctcgtcaaggttacattgtacggctcgcagattaagctgtacaacattgaaaccgcggtgccttccgttctcaagcccgatctaatcgatgtgcatgcgcagtcactggccgctctgcaggcatatagccattggttagcgcagtattgtagcgaagtccatcggcagaatacccagcagttcgtgactcttataagcaccacaatggacgccattacccccttgatatccacgaaagttcaggacaagctgctactgagtgcatgccacctgcttgtgagtcttgccactacggtgaggccagtgtttctcataagcattccagcagttcagaaggtcttcaatagaattacagatgccagcgctctcagactcgtcgataaagctcaggtgttagtgtgccgggctctgtccaatattctgctcctaccatggccaaatctgccagagaatgagcaacagtggccggtccgttccatcaaccacgcctcactgatttcagctttaagtagagattacaggaacttgaaacctagtgcggtggcccctcaacggaaaatgcctctggacgatactaagttgattatacaccagactctgagcgtgctggaggacatcgtggaaaatatctccggggagtctactaaaagcaggcaaatttgctaccaaagcctgcaggagagcgtgcaggttagccttgctttgtttccagcatttatccaccagtctgacgtaactgacgagatgctgtcattctttctgacactctttcggggtctgcgtgttcaaatgggcgtgcctttcactgaacaaatcatccagaccttcttgaatatgttcaccagagagcagctcgctgagtccattttacatgaaggctctaccggttgtcgggtcgtggagaagtttttgaagatccttcaggtggtggtccaagagcccggacaggtctttaaacccttcctcccctctataatagccctttgcatggagcaagtgtatccgataatagccgaacgaccatctcccgacgttaaggcagaactcttcgaacttcttttcaggaccctgcatcacaactggcgttactttttcaagtctaccgtgttagcaagtgttcagcgtggtatagccgaggaacagatggaaaatgaaccccagttctctgcaatcatgcaggctttcgggcagagctttcttcagcccgacattcatctgtttaaacagaatctgttctacctggaaactctcaatacaaaacagaagctataccataagaagattttcaggactgccatgttatttcagttcgttaacgtgctgctacaagtgttagtgcacaagagccacgacctcctccaagaggaaattgggattgccatctacaatatggcctcagtagattttgacggattcttcgccgcattccttccagagttcctaacttcatgtgacggggtagatgctaaccaaaagtcggtcctcggacgaaactttaaaatggatagagacttaccatcattcactcagaacgtacatcgcctggtaaacgaccttcgctactaccggttatgcaacgactcactccctcccggaacagtaaaactgtag

SEQ ID NO: 222659 - DNA, 3264 bp, Artificial Sequence
  Description of Artificial Sequence: Synthetic coding sequence
atggcggaccatgtgcaaagcttggctcaactcgaaaatctgtgcaaacagctgtacgagaccacagataccacaacacggcttcaggccgagaaggccctggtggagttcactaactcccccgattgcctctctaagtgtcagctgctattggagcggggaagttcaagctactcccaactactcgctgctacctgcctgaccaagctagtctcgcgaactaataaccctttacctcttgagcagcggatcgacatcaggaattacgtgctgaactacctggccacacgcccaaagctcgcaacgttcgtcactcaggcccttatccagctgtatgctcggatcacaaagctgggctggttcgattgccagaaggacgactatgtctttcggaacgcaatcacagatgtcacccgctttttgcaggacagcgtcgaatactgtatcattggcgtgactatactgtcccagttaaccaatgagatcaatcaggccgacacaacacacccactgacgaagcacaggaagatcgctagctcttttcgagactctagcctctttgatatttttaccctgtcctgtaacctgcttaagcaagcgtcagggaaaaatctgaacttgaacgacgaaagccagcacggcctgctgatgcagcttctgaaactgacccacaactgcctgaacttcgatttcatcgggacatccacagatgaatccagtgatgacctatgcaccgtccagattcctacaagttggaggagcgcttttttagatagtagcacactgcagctgttctttgacctgtaccactccattccgccaagcttttcacccttggtgctgtcatgtctggtgcaaatagcatccgttcgtagatcattgtttaataatgctgagcgcgctaagtttcttagccacctggtggacggtgtgaagcggattttggagaacccgcagtctctcagcgatcctaacaactaccatgaattttgccggttgttggctcggctaaagtctaactaccagctaggcgagctggtcaaggtggagaactaccccgaagtgattagactgattgccaacttcactgtgacctctctccagcattgggaattcgccccaaattcagtgcactatctactcagcctctggcaaagattggccgctagtgtcccatacgtaaaagctactgagcctcacatgcttgaaacatacactcccgaagtgactaaagcgtacataacctccagactggagagcgtccatatcatcctgcgcgatggcctggaagatccacttgaggatacgggtctcgtccagcaacagctggaccagctgtccaccattggtcgctgtgagtatgagaaaacctgcgctctcttagtgcagttatttgatcagtccgcccagtcatatcaggaactactgcagagcgccagcgccagtcctatggacatcgcagtgcaagagggaaggctgacatggctggtgtacataatcggcgctgtcatcggaggcagagttagcttcgcatccactgacgagcaggacgccatggacggagaactcgtatgccgtgtgcttcagctgatgaacctgacagactctcgccttgctcaagccggaaacgaaaagctcgaactggccatgttaagttttttcgagcagttcagaaagatctatatcggtgatcaagtccagaaaagcagtaagctgtaccggaggctttccgaagtactgggactgaacgatgagacgatggtcctgagcgtattcattggaaagatcatcaccaacttaaaatattggggcaggtgcgaaccaatcacatccaagactcttcagttgctgaacgatctcagcattgggtattccagcgtgcggaaactggtaaaactttcagctgtgcaatttatgctgaataatcataccagcgagcacttttccttcttgggcattaataatcaatccaatctgaccgatatgaggtgtcgtactacattctataccgcactggggagattgcttatggtagacctcggtgaggacgaggatcagtatgagcaattcatgctcccactgactgctgcttttgaggcggtggctcagatgttcagtacaaattcctttaatgagcaggaggcaaagcgaacattagtaggtcttgtgcgcgacctgcgcggaatcgccttcgcattcaacgccaagacctcattcatgatgctgttcgaatggatctacccatcttatatgccaatcctgcagcgggctattgagctgtggtaccacgatccagcctgcactacacccgtcctgaaattgatggctgagctcgtgcataatcgctcccaacgcttgcagtttgacgttagttcaccaaacggaatactcttattccgagagacctcgaagatgattaccatgtacggtaaccgaattctcacccttggggaagtgcctaaggatcaagtgtatgctctgaagctcaagggcataagtatctgctttagcatgttgaaagcagccctcagtggatcttatgtcaactttggagtgttccgtctgtacggcgacgacgctctggataacgcgcttcagacgtttatcaagcttctgttgagcattccccatagtgacctgttagattaccccaaattgagccagagttactattctctcctagaggtcctgacccaggaccacatgaattttatcgcaagtcttgaaccgcacgtgattatgtacatcttgagcagcataagcgagggcctgaccgccctggatactatggtctgcacagggtgctgttcttgccttgatcacattgttacatacctgtttaaacagttatcaagatccacgaagaagcggactacacccctcaatcaggagagcgacaggtttctgcacatcatgcaacagcacccagaaatgattcagcagatgttgagtaccgttctgaatatcatcatctttgaggattgtagaaaccagtggagtatgtcacgcccactgctgggtctaatccttctgaatgaaaaatattttagtgacttacggaattcgattgtaaatagccagccacctgagaaacaacaggctatgcatctgtgcttcgagaacctgatggaagggatcgaaagaaatctgttaacaaagaatcgcgacagatttactcagaacctcagcgcatttcgccgtgaggtgaatgatagcatgaagaacagtacctacggtgtcaattcgaacgatatgatgagttag

SEQ ID NO: 222660 - DNA, 3267 bp, Artificial Sequence
  Description of Artificial Sequence: Synthetic coding sequence
atgcgcgaccccggaagaaaaagtctagcacagctggaaaatttgtgtaaacaactgtacgaaaccacagatactaccacgaggttacaggccgagaaggctctcgtggagttcactaacagtccagactgcctgtctaagtgtcagctgctgctcgaaaggggtagttctagctactcacagctcctcgcagccacttgtttaacaaaactggtttctaggactaataacccacttccgctggaacagcggatcgacatacggaactacgtccttaattatctggccacccgtcctaagctggcaacatttgttacacaggcattgattcagctttatgccaggatcactaaactgggatggtttgactgtcaaaaagacgactatgtgttccggaatgccataacagatgttacaaggttccttcaggactccgtcgagtattgtatcataggggtcacaattctcagccagctcacaaacgaaatcaaccaggcagacacgacacacccactcaccaagcacagaaagatagctagctcattccgggacagcagtttgttcgatatcttcaccctgagctgtaacttgcttaaacaagcctccggcaagaatttgaatctcaatgacgaaagtcagcatggcctcctcatgcagctgctcaagctgacgcacaactgtctaaatttcgacttcatcggcacatcaaccgacgagtctagtgatgatctgtgcaccgtgcagatacctacaagctggcgcagtgcttttttggacagttccactttgcagctcttctttgatctttatcactccattccacctagcttttcacctctggtcctgagctgtctggtgcagattgcctcggtgcgtcggagcctcttcaacaacgccgagcgggctaagttcctgtctcatctggtggatggtgttaagcgcatcttggagaacccacagagccttagcgacccaaacaactaccacgagttctgtaggttactagcaaggctgaaaagtaactaccagctgggggagctggttaaggtggaaaattatcctgaagtgatcaggctcatcgctaatttcaccgtgactagtctgcagcactgggaatttgcacccaatagtgtgcattaccttctctccctgtggcagcgtttggccgcatcagtcccttacgtgaaagctacggagccacacatgctcgaaacatacacccccgaagttactaaggcctacatcactagccgcctcgaatccgtgcacatcatccttagagacggactcgaagatcccctcgaggataccgggctagtgcagcagcaactggaccagctgagcacgataggtcggtgtgagtatgaaaaaacgtgcgccctgctggtccagctgtttgaccagagcgcgcagtcttaccaggaattactacaatctgcatcagctagtcccatggacattgccgtccaagaaggtcgactcacctggttggtgtacataattggggctgtgatagggggaagggtgagcttcgccagcactgatgagcaggatgctatggatggggaactggtttgccgcgtgcttcagttgatgaacctgacagacagccgcctcgcccaagctggcaatgagaagctagagctggctatgctctcctttttcgagcagtttaggaaaatctatattggggatcaggtgcagaagtcctccaaactctacaggcggctgagtgaggtgctgggactgaacgatgagacaatggtgctgtctgtgttcattgggaagatcattacgaacctcaaatattggggaagatgcgagcccatcaccagcaagactctgcaactgctgaacgaccttagcattggttatagttccgtgaggaagctggttaagttatctgccgtgcaattcatgctgaacaaccacacttccgagcatttcagttttctagggatcaacaatcagagcaacctgactgacatgcgttgtcggacaaccttttacactgccttaggccgactgttaatggtagacttgggggaggatgaggatcagtacgagcaatttatgctcccactaaccgccgcttttgaagccgttgcccagatgttttcgacgaacagctttaatgaacaagaggcgaaacgcactttggtggggctggtcagggatcttagggggatagccttcgcctttaatgcgaaaacctctttcatgatgctcttcgagtggatatacccttcctacatgccaatcctgcaacgggcaatcgaactgtggtaccatgaccccgcttgtacaactccggtgctgaagctaatggctgaactcgtgcacaatcgctcccaaagactgcaattcgacgtaagttccccaaacggtatcttgctctttcgggagacttctaagatgattacgatgtacgggaataggatcctgacactaggagaggtgccgaaggatcaggtgtatgctctcaaactaaaaggaatttccatctgcttttccatgcttaaggccgctctgtccggatcttatgtcaattttggcgttttcagactctatggcgatgacgcactcgacaacgccctgcagacatttatcaagctgcttttatccatacctcacagcgacctgctggactaccccaagctctcacagagctattatagcttgctggaggtgctgactcaggaccatatgaactttattgcgtccttggaaccccacgtaattatgtacatcctcagtagtatttcagagggtttaaccgcactggacaccatggtgtgcacgggatgctgctcctgcttagaccatatagttacctacttgttcaaacaactttcaaggtctactaagaagcgcaccactcccttaaaccaagaaagcgaccggttcctgcacattatgcaacaacatcctgagatgatccagcagatgctctctaccgtgctgaacataataatctttgaagactgtcgaaatcagtggtcgatgagtagaccgttactcgggctcattctgttaaatgagaaatacttttccgacttgcggaattctattgtcaacagtcagcccccagaaaagcaacaggcaatgcacttgtgttttgaaaacctgatggagggaatcgagagaaatcttttaactaagaatagagatagatttacccagaacctgtctgcatttagacgcgaagtgaacgactctatgaagaacagtacctatggagtgaattctaacgacatgatgtcatag

SEQ ID NO: 222661 - DNA, 3291 bp, Artificial Sequence
  Description of Artificial Sequence: Synthetic coding sequence
atggcagaccatgtacaatcgcttgcacagcttgagaatctctgcaagcagctctacgagacgacagataccactactcggcttcaagcagagaaagccttagtcgagtttacgaattcacctgattgtctgtccaaatgccagcttttgttagaacggggatccagctcatactctcaattactggctgctacatgccttacaaaactggtgtcccgcaccaataacccgctgccccttgagcaaaggatagacattcgtaattacgtcttaaactatctggctactcggccaaagcttgctacattcgtaacacaggctctgattcagctgtacgctcgcattactaaactcggatggtttgattgccagaaagatgactacgtcttcaggaacgctatcacagacgtcacacgctttctacaagattcagtagagtactgtattattggtgtgacaatcctgtctcagctgactaatgaaatcaaccaggtgtctgctaccgctttcctgatcgaggccgatacaacacaccctctgactaaacacaggaaaatagccagctccttccgtgattcctctttatttgacatctttaccctctcttgtaatctgctaaaacaagcatcggggaagaatttgaatctgaatgatgaatcacagcacggtttactgatgcagttgctgaagctaacccataattgtctgaacttcgatttcattggaacctcgaccgatgagtcaagcgacgacctgtgcacagtgcagattcccacttcctggaggtccgctttcctggactcatcaaccctgcagctgttcttcgacttatatcattcaattcctccttcattctctcctctggtgctcagctgcctcgttcagattgccagtgtgagaagatccttgttcaacaacgctgagcgtgccaagtttctttcccatctggtggatggggtgaagcggatcttggagaatccacagtcgctttccgacccaaacaattaccacgagttctgtaggcttttggcaaggctgaaaagcaactaccaactcggcgagctggtcaaggtggaaaactaccctgaagtgatccgccttatcgctaacttcaccgtgacaagccttcaacattgggagtttgctccaaactctgtgcactaccttctatcactgtggcaacggttggcggcaagcgtcccttacgtcaaagctaccgagccacatatgctggaaacttataccccagaagtcactaaagcctatataacatcccgcctggagtcagtgcatataattctgcgagacggactcgaagacccactggaggacacgggcttggtgcagcagcaattggaccagttgagcaccatcggcagatgcgagtacgaaaaaacctgtgctcttctggtgcaacttttcgaccaaagtgctcagtcctatcaagagctactccaatccgcctcagcctcaccaatggatatagctgttcaggagggccgtctgacttggttagtgtacatcatcggcgcagtcatcgggggtagagtgtcctttgcatcaacggatgagcaggatgccatggacggcgaacttgtgtgtagggtgctgcagctgatgaatctgacggactctagactagcccaagcagggaacgagaagctggaattggccatgctcagcttctttgagcagtttagaaagatatatattggggatcaggtccagaagtcatccaagctatataggcgccttagcgaggtgttgggcttaaacgatgagacaatggtcctgtctgtattcataggcaagattatcacaaacctcaagtactggggcagatgtgagcctatcacatctaagaccttacaacttctaaacgatctctcgatcggctatagcagcgtgcgcaagcttgtcaagctttctgctgtccagttcatgttgaataaccatactagcgaacatttcagcttcctcgggataaataaccaaagtaatctgactgatatgcgctgcagaaccacattttatactgctctcgggaggctgttgatggtcgacttgggggaggatgaagatcaatatgagcagtttatgctgcctttgactgccgcattcgaagcagtggcacagatgttttccaccaactccttcaacgagcaagaagctaagcgtactctggtgggtttggtccgggatctgaggggcatcgcctttgcctttaacgctaagacctctttcatgatgctgtttgagtggatatacccctcctatatgcctattcttcagcgggcaattgagctatggtaccacgatcctgcctgtaccacccccgtgctgaagctcatggccgagcttgtccacaacagatcccagcgtttacagttcgacgtcagctcgcccaatgggatcctgctattccgggagacctcaaagatgatcacgatgtatggaaatcgcatacttaccctaggagaggttcccaaagaccaagtttatgccttaaaactgaaaggcatttctatttgtttctccatgttgaaagctgctttaagcggctcttatgtgaacttcggcgtgttcaggctgtatggcgacgacgcacttgataacgctctccaaacatttataaagctgcttctttccatcccgcactcggatcttctggactatccaaagctgagccaaagctactactcgctgctggaagtgttaacccaggatcacatgaactttatcgcttcccttgaaccccatgtgatcatgtacattctaagttctattagtgagggtctgacagccctggacactatggtttgtacaggatgctgcagttgcctggatcacattgtcacttacctgtttaagcagctgagcagatcaaccaaaaagcgtaccactcccttaaatcaggaaagtgatcgattcttacacatcatgcagcagcaccccgaaatgatccagcagatgctcagtaccgtgctgaatatcattatttttgaggattgtcggaatcaatggtcaatgtctcggccattacttggactgatcctgttgaatgagaaatacttctcagatctccgaaactctatcgtgaactctcagccccctgagaagcagcaagcaatgcacctatgtttcgaaaacctcatggagggaatagaacgcaatctcctgaccaagaaccgggacagattcactcagaacctgtctgccttccgccgtgaggttaacgactccatgaagaactctacttacggcgtgaactcaaacgatatgatgtcttag

SEQ ID NO: 222662 - DNA, 6363 bp, Artificial Sequence
  Description of Artificial Sequence: Synthetic coding sequence
atgcgctcatttaagagagttaactttggtactctgctgtccagtcaaaaggaggctgaggaactgctgcccgctctgaaagaatttctgagtaatccccctgccggtttccctagctctcggtccgacgctgaacggcgtcaagcctgcgacgcaatcctccgtgcttgtaatcagcagttgacagctaaacttgcctgccctagacacctcggttcactcctcgaactcgccgaactggcgtgcgacgggtatctggtgtctacccctcagagaccaccattgtacctggagcgcatcctgtttgtgcttctaagaaacgccgctgctcaaggctcacctgaggccacactgcgcctagcacagccactccatgcttgcttggtgcaatgttcaagggaagcagcaccgcaagactacgaagcagtcgctcggggaagcttttcattactttggaagggcgctgaagctctgttggagcggagagctgcattcgctgcgaggctgaaagcattgagtttcttagtattgctcgaggacgagagcacaccgtgcgaagtgcctcattttgcatctcccaccgcctgccgggctgtggctgctcatcagcttttcgatgcaagcggacacggactaaatgaggcggacgcagacttcctggatgaccttctctcccgccacgtcattcgcgcactcgtaggcgaacgtggtagttctagcgggctattaagcccccagcgcgcactgtgcctgctcgagttgacattggaacattgccggaggttctgctggtcaaggcaccacgacaaagccatctccgccgtggagaaggcacacagctatctcaggaataccaatctcgccccttcccttcagctttgtcagctgggtgtaaaactgctgcaggttggagaggagggaccgcaggctgtcgccaaactgcttattaaggcttccgcagtcctcagcaagtcaatggaggcccctagcccccctctgcgggctctgtatgaatcttgtcagttttttctgtccggtctggagagagggacaaagagacgatatcggctggatgccatcctgtctctcttcgcctttctaggtggttattgtagcctcctgcagcagttgagagatgacggcgtatacggcggaagtagcaagcagcagcagtcttttctgcaaatgtatttccaaggcctacacctgtacacagtagtggtctatgactttgcccagggctgccagatcgttgacctggctgacctgacacaactggtggatagttgcaaatcgactgtcgtttggatgctggaagcactggagggcctctctggccaggagctgaccgaccacatgggcatgacagctagttacacttcgaacttggcctactctttttactcccataagctgtatgccgaagcctgtgccattagcgagcctctttgtcagcatctcggactagtcaaacccggaacatatccagaagtgccaccggaaaagcttcatcgatgcttcaggctacaggtcgagtcactcaaaaagctgggcaaacaagctcagggttgcaagatggtaattttgtggcttgccgcacttcagccgtgcagcccagaacatatggctgagccggttactttctgggtcagagtcaagatggatgccgctagggctggagacaaagagctgcagttaaaaactttgcgcgacagcctgagcgggtgggacccggagaccttagctctgctattgagagaagagttacaagcctacaaagctgtgagggccgacacaggtcaggagaggtttaatattatttgtgatttattggagctgagccctgaggagacccccgcaggtgcttgggctagggccactcacctggtcgaactggcacaggtgctgtgttaccatgacttcacccagcagaccaactgctctgcattggatgcaattagagaggccctgcaactcctagattccgtaagaccagaagcgcaggctagggatcagttgctcgatgataaggcccaggcccttctgtggctgtacatttgcaccctggaagctaaaatgcaagaaggcatcgagcgggaccgccgagcacaagctcctggaaatctagaggagtttgaagtgaacgatctgaattacgaggataaactccaggaagacagattcctgtattctaatatcgcatttaacctggcagccgacgctgctcagagtaaatgcctggatcaggctcttgccttgtggaaggaactgttgacgaaaggtcaagcccctgccgttagatgtctgcagcaaactgctgcctcgcttcagatcctggccgcactgtatcagctggtggctaaacccatgcaggccctcgaggtattgttgttgctaagaatcgtaagcgagagactcaaggaccactcaaaggctgctggttcctcttgtcacattacacagttactgcttacactcggctgcccatcgtacgcacagcttcacctggaggaagctgcttcatccctgaaacacctggaccaaacaacagacacctacttgctgctgtccctgacatgcgacctgctccggtcccagctctattggacccaccagaaagtcactaaaggcgtgtctcttctgttaagtgtgctccgtgatccagcattgcagaagtcaagcaaagcatggtaccttctccgcgtccaggttctccaactggtcgctgcctacctgagcttgccctctaataacctgagtcactctctctgggagcaattgtgcgcgcagggatggcaaaccccggaaattgcactgatagatagtcataaactgctgcggagcataatcttgctgttgatgggctctgacattctatcaacacagaaggctgccgtggaaaccagtttcctagactacggagaaaacctggtacagaaatggcaggtcctcagcgaggtattatcctgctccgaaaagctcgtctgccatctgggacgcctgggcagcgtttccgaggccaaagccttttgtctggaggccctcaagcttacaacaaaactccagattccacgacaatgcgcgttgtttctggttctgaagggtgaactagagctagcgagaaacgatattgatctatgtcagagtgatctgcagcaagtgttgttccttcttgagagctgcactgagtttggcggagtgacccagcatctggacagcgtgaagaaagtacacctccagaaaggaaaacagcaagcacaggtgccttgccctccccagctgcccgaggaggagctcttcttgaggggccctgctttagagctcgtagccactgtggctaaagaacccggacccatagcacctagtaccaactctagccctgtcttgaaaactaaaccccagccaatcccaaattttttaagccactcgcctacttgtgactgttccctctgtgcatcaccggttttgactgcagtctgcctgagatgggtgctggtaaccgcgggagtgcggcttgccatggggcatcaggctcaggggctggatctgttgcaggtcgtgcttaaaggctgtccagaggctgctgaaagactgactcaggcgcttcaggcatcgctgaaccataaaacacctccatctttggtgccctcgttgctggacgagatcttggcccaggcttatacactgcttgcactggagggactgaatcagccaagcaatgaaagccttcagaaggtccttcagagtgggctgaagttcgttgccgcacgcattccacatctggaaccttggagggcctctctgctactgatctgggccctaaccaagcttggtggtctgtcctgctgcacaactcagcttttcgcctcatcatgggggtggcaacctcctttaatcaagtctgtgccaggttccgaaccatccaagacccagggacagaagcgctcagggagggggcgtcagaaactggcgtcagcaccactcagattgaacaataccagccagaaaggccttgagggcagaggcttgccgtgcacgcctaaaccacccgataggataagacaggccggacctcacgttcccttcaccgtgttcgaggaggtgtgccccactgagtccaagcctgaagtgcctcaggcgcctcgcgtgcagcagcgcgtgcagaccagactgaaagttaatttcagcgacgactccgatttagaggacccagtgtctgctgaagcgtggctcgccgaggaacccaagcgaaggggaaccgcctccagaggccgaggtagggccagaaaaggcttaagcctcaaaaccgacgccgttgtggctccagggagcgcaccaggcaatccagggctgaacggtagatctcggcgagcaaagaaggtagctagccgccattgtgaggaacgtcgccctcagcgggctagcgaccaggccaggccaggcccagagattatgcgcacaattccggaggaagagctgaccgataactggcgtaaaatgtcctttgaaattctgagaggctccgatggcgaagattctgccagtggtggaaaaaccccagcccctgggccagaagccgcttctggcgaatgggagttgcttaggctggatagtagcaagaagaaactcccttcgccttgtcccgacaaggaatccgacaaggatctggggccacggctcaggctcccctcagctcccgtcgcgactggactatctactctggactccatctgtgactccttgagtgtagcattccggggtatttcccactgtccaccgtcaggcctgtatgcgcatctgtgccgatttctggccttatgccttggtcatagggacccctacgccacagcttttcttgttaccgaatccgtgagcattacctgtagacaccagctcctcacacaccttcacagacagttatccaaagcccaaaagcatcgcggttccctcgagatcgctgatcaactgcagggattgtcgttgcaggaaatgccaggtgacgtaccactggccaggatccagcgattgttcagcttccgcgctcttgaatccggccactttccccagcccgaaaaggagtcattccaagagagactagcactgatcccctccggcgtgacagtgtgtgtgctagctttagcgaccctgcagcccggtaccgtgggcaataccctcttactcacgagactggagaaggactcgcctcccgtgtccgtgcagatccccaccggccaaaataagcttcacctgcgaagtgtactgaacgagtttgacgccattcagaaggcacagaaggagaactccagttgcaccgataagagagagtggtggactggacggcttgccctggatcatcggatggaagtcctcattgcatccctggaaaagtccgttttgggttgttggaaagggcttctgctaccatcatctgaggagcctggtccagcacaggaggctagcagattacaggagctgctccaggattgtggatggaagtatccagaccgcacactgctaaaaattatgctctctggagcgggtgcactcaccccgcaagatatacaggctctggcctatgggttgtgccccacacagccagagcgggctcaggaattgctcaatgaggctgttgggagactgcagggtctgaccgtgccatctaattcccacctcgtcctcgtgctagacaaggatctgcagaagctgccctgggagtctatgcccagtttgcaggccctgcctgttacaaggctccccagttttcggttcctgctgtcatacagcattattaaagaatacggcgcttccccagttttgtctcagggtgtcgatccacgctctacgttttacgtgctcaaccctcataataacctcagcagtaccgaagagcagttcagagcgaacttctccagtgaagcaggatggcgtggcgtggtgggggaagtgcctcggccagagcaagtacaggaagctttgacaaaacatgacctctatatttacgctggccacggcgctggcgctcgtttcctggatgggcaagctgtgctcaggctgagctgcagggcagtggccctcttatttggctgttctagtgctgcgctggccgtccgaggtaacctggaaggtgccggaatcgtgctcaagtatattatggctggatgtcctctgttcttggggaacttgtgggacgtaactgatagagatatcgaccggtataccgaagccctgctccaaggttggctgggggctggtccaggggcacccctgctgtactacgtgaatcaagctagacaggctcctaggctgaagtatcttatcggcgcagctcctattgcgtatggactgcccgtttcactgcgctaa

SEQ ID NO: 222663 - DNA, 6362 bp, Artificial Sequence
  Description of Artificial Sequence: Synthetic coding sequence
atgcggtctttcaagcgtgtgaacttcggcactcttctgagctcccaaaaggaggcggaggagctcctccccgcactgaaggagttcctgtccaatcctcctgccggtttcccttcgtcccgatccgacgctgagaggagacaagcgtgtgacgcaatcttgcgggcatgcaatcagcaattaacggcaaaactggcatgccctagacatttaggctcgctgctggagctcgccgaactggcatgtgatggataccttgtttccaccccacaacgacccccactgtatctggagagaattctgttcgtgctgctacggaatgctgctgctcaaggaagtcctgaagcgactttgaggctggcgcaacccctgcatgcttgtctcgtgcagtgctccagagaagcagccccacaggactacgaggccgtagccagaggctccttttctctcttgtggaaaggtgccgaagctctcctggaaagaagagccgcatttgcagctaggctgaaggcgctctcattcttagtgctcctggaagacgaatccaccccttgtgaagtcccccatttcgcctcgccgaccgcctgcagagcagtcgcagcacatcagctgtttgatgccagcgggcacggcctgaatgaagcagatgcagattttctggatgacctgctctctagacacgttattcgagcgctcgtaggcgagcggggaagtagctctggactactgtctccgcaacgcgctctgtgtctgctagaacttacccttgagcattgcagaaggttttgctggagccgacatcacgataaggcaataagtgctgtggagaaggctcactcttatttacggaacaccaatctagccccatccttgcagctgtgtcagctgggcgtgaagctccttcaggtgggggaagaaggacctcaggcagtcgctaagctcctgatcaaggcaagtgcggtgctatcgaaatctatggaggcaccttctccacccctgagggctctgtatgagtcgtgccagttttttctttcaggtctcgaacggggaacaaagcgtaggtacagactggatgcaatactgagcctattcgccttcctcggtgggtactgctctttgctgcaacagctgagggatgacggagtttatggcggaagctccaaacaacagcagtcattcctgcagatgtactttcagggtcttcatctgtacactgtagtggtgtatgattttgcgcagggatgtcaaatcgtcgacctcgcggacctgactcaactggtggactcatgtaaatcaaccgtcgtctggatgctggaagcactggagggcctgtctggccaggaactcaccgaccatatgggcatgacagctagttacacctccaatctggcctatagtttctattcacataaattatacgcagaggcttgtgctatctctgaacccttatgccagcatctgggccttgtcaaacctggcacatacccggaggtgcctccggagaaactccataggtgcttccggttacaagttgaatcactcaagaaactgggcaaacaggcacaggggtgcaagatggtaatactgtggctggctgcccttcaaccttgcagccctgagcatatggcggaacctgtgaccttttgggtccgagtgaaaatggacgccgcacgggctggtgacaaagagctgcaactaaaaactctgcgggacagtttatcagggtgggacccagagacactcgccctcttactgcgcgaagaactgcaggcatacaaggccgttcgcgctgataccggccaggaaaggtttaacattatatgtgacctcctcgagctgtctcccgaagagactccggctggggcttgggccagagctacacacttggttgaattggctcaggtgctgtgctatcacgacttcacccagcagacaaactgttctgcattggacgcaatcagggaagctctccagcttctggactcagtgaggccagaggcacaggctagggatcaactcctagatgataaagcacaggccctcttatggctctacatttgcactctggaggcaaagatgcaggaggggatcgagcgcgatcgcagagcccaggctcctgggaacttagaggagttcgaggtaaacgacctaaattacgaggataaattgcaggaggatcggttcttgtacagtaacattgcatttaacttagctgcagacgcagcccagtcaaagtgtttagatcaggcactcgcactgtggaaggagctgctcaccaaaggtcaggcccctgcggttaggtgtctgcaacagacagcggcatccctgcaaattctggcagcactgtatcagttagtagccaagcccatgcaggcgttggaagtgctgctcctgttacggatagtctctgagcgcctgaaagatcattcgaaggctgccggatcctcctgtcacatcacacaactcctattgaccctcggttgcccgtcatatgctcagctccatctcgaagaagctgcaagtagtctaaaacatctcgaccagacgaccgatacctacctcctgctttccctgacatgcgacctgcttaggtcacagttgtactggacacaccagaaagtcacaaagggtgtcagcttgctgttgagtgtcctgagagaccccgctctgcagaagagctccaaggcgtggtatctgttgagagtgcaggtgttacagctggttgccgcttatttgtccctgccctccaacaacctgtcacatagtctgtgggaacagctgtgcgcccagggctggcaaacacctgaaatcgctctgattgactctcacaaactgcttcggagcatcatattgctcctgatgggatctgatattctgtcaacccagaaggccgctgtcgagacatcatttcttgattacggcgagaaccttgttcagaaatggcaggtgctgtccgaagttctttcttgtagcgagaaactggtgtgtcatctcggcaggctcggcagcgtctctgaggcaaaggccttttgtctggaggccctcaagttgactacgaagctgcagattcctagacagtgcgctctgtttttagtcctgaaaggcgagctcgagcttgccagaaacgacatcgatttgtgccaatcggaccttcagcaagtgctttttctactcgagagttgcacagagtttgggggagtgacacagcacctcgactccgtgaagaaggtccatttgcagaagggtaagcaacaagcccaggtgccctgccccccacagctgcctgaagaagagctattcctacgcggtcccgcactggaactggtggccactgttgccaaggagcctggcccaatcgcgccatcgactaactcctcacccgtgctgaagacgaaaccccagccaatccccaactttctgagccattctccaacctgtgactgctctctctgcgcctcccccgttctgaccgccgtctgtctcagatgggtattagtcacggcaggcgtgaggctggccatggggcatcaggcccaaggactggacctgttgcaggtcgtccttaaagggtgtccagaagcagctgagaggcttacccaggccctacaggcaagtctgaaccacaaaacccctccaagccttgtcccaagtctgctggacgaaattctagcacaggcatataccttgctggcacttgaggggttgaatcagccctcaaatgagtcgctgcaaaaagtcttgcaaagcggcctgaagtttgtggcagctcgcatcccccatctcgagccctggagggcatcgttgctgctcatatgggcattgaccaagctgggcggattatcctgctgtaccacccaactatttgccagtagttggggatggcagcccccactgatcaagtctgtaccgggaagcgagccaagtaaaactcagggccagaagcgttcggggagagggagacaaaaactggccagtgcccctctgcgattgaataacacttcccaaaaggggctggaaggtcgtggcttgccatgcactccaaagccccctgaccgcatcagacaggccggacctcatgttcctttcacagtgttcgaggaggtttgcccaaccgaaagcaagcccgaagtgccccaagcccctagggtgcagcagagggtccagactaggctcaaagtgaacttctccgatgattcagatcttgaggacccagtctccgctgaggcctggcttgccgaggaacccaagagaagaggcactgctagtcggggtcgcggtcgtgccagaaaggggttgagtctgaaaaccgacgccgttgtggcccctggcagtgcaccaggtaaccctgggctgaatggcagaagtcggcgtgcaaaaaaggtcgcatcacgccattgcgaagaaagaaggccccagcgggcttcagatcaggcgagacctggacctgaaatcatgcgcactatcccagaggaagagcttacagacaattggcgtaaaatgtcatttgagatcctgagaggatccgatggagaggattccgcgagtggcggtaaaacccctgccccaggccctgaagctgcttccggtgaatgggaattgttgagattagacagttcaaagaagaagctgccttcaccctgtccagacaaagagagcgataaggatctcggacccaggctgagattacctagcgccccagtcgcgaccggactgtctactttagactctatctgcgatagcctatcagtggcattccggggtatttctcactgccctccttctggcctgtatgcccacctgtgcaggtttttagccttgtgcctggggcatcgcgatccctacgcgactgcctttttagtgaccgaatctgtgagcatcacctgccgacaccagctgcttacgcacctgcatcgccagctcagcaaagcccaaaagcaccggggtagcctggaaattgctgaccagttgcagggcctttccctccaggagatgccaggggatgtgcctctagcaagaatccagaggctatttagctttcgggcactcgagtccggacattttccccagcccgagaaggagtcgtttcaagaaagattggctctgattcccagcggtgtcaccgtgtgtgtcctggccttagctactctgcagcccggaacggtggggaacaccttgctgctaactagactggaaaaagattctccccctgtcagcgtgcagattcccactgggcagaataagctgcatttgaggtctgttctgaatgagttcgatgctatacagaaggctcagaaggagaactctagttgtactgataaaagggaatggtggactggccgattagcactggaccaccgaatggaagtgctcatcgcgtccctcgagaagtctgtgctgggatgctggaagggactgctgctgcctagcagcgaggaacctggacctgcccaagaagcctctcgcctgcaggaactgctccaggactgtggatggaagtacccggacagaaccttgttgaaaatcatgctcagcggcgctggagcactgactcctcaggacatccaggccctggcctacggactttgtcccacgcaacccgaaagggcacaggaactgctgaatgaggccgtcggtagactccagggacttacagtgcctagcaattcacatctagttctcgtgctggataaggacctgcagaaacttccatgggaaagcatgccctctctgcaagctctgccggttactcggttaccgagttttagatttctcttaagctacagtattataaaggagtatggagcctccccggtgctcagccagggagtcgaccctaggagcacattttatgtgctgaatccccacaacaatctgtcatctactgaagagcagtttcgggctaatttctcctctgaggctggctggcggggagttgtgggtgaggtgccgcgacctgagcaggtacaggaggccctcacaaagcatgatctgtatatttatgccggtcacggcgcaggcgcacggttcctagatggccaagccgtgctgcgtttgtcatgccgggctgtcgctctgttgttcggctgcagcagcgccgctctggccgtcagggggaacttggagggcgctggaatagtgctgaaatacattatggccggttgccccctgtttctaggcaatctatgggacgttacagatagagacattgatcggtatacagaggcattgcttcagggctggcttggagcagggccaggggctccactgctgtattatgtcaatcaagcacgacaagcacctaggctgaaatacctcattggggctgcacctatcgcttacggcctccccgtatccctgcggta

SEQ ID NO: 222664 - DNA, 5387 bp, Artificial Sequence
  Description of Artificial Sequence: Synthetic coding sequence
atggaagccccaagccctccactaagagccctgtatgagtcctgccagttctttctttcagggctggagcgtggcaccaagaggcgttacagattggacgcaatcctgagcctgttcgctttcctaggaggctactgcagtctgttacaacagctcagggacgatggagtctacggcggatcctcaaaacaacagcagtctttcctccagatgtatttccaggggctccacctctacactgtggtggtatacgactttgcccagggctgccagatcgtggacttggcagatctgacacagctcgttgatagctgcaagtccactgtagtttggatgctggaggctctggaaggactgtctgggcaggagctaaccgatcacatgggcatgaccgcatcatatacctctaatctggcctactctttctactcacataaactgtacgccgaagcatgcgccatctccgaaccattgtgccagcatctgggcttggtaaagcctggcacatatccggaagtccccccagagaaactgcaccgatgctttagactacaggtggaatcgctgaaaaaactggggaagcaagcgcaggggtgtaagatggtgatcctgtggcttgccgctcttcagccctgctctcccgaacacatggccgaacccgttacattttgggtccgggtgaagatggacgctgcaagggcaggcgataaggagctccagttgaaaacccttcgggacagccttagcggatgggatccagaaaccctggctctgctattgcgggaggagctgcaggcctacaaagccgtcagggctgacaccgggcaggagcgatttaatattatttgtgaccttctggagctttctcctgaagaaacccccgcaggagcctgggctagggcgacccacctggtggaactcgcacaagtgctgtgctatcacgactttacccagcaaacgaattgctcagcgctcgatgctattcgcgaggctttacagctgctggacagtgtacggccagaagctcaggccagggatcagttactggacgacaaggcgcaggctctgctctggctgtacatctgtaccctggaagccaaaatgcaggaaggaatagaacgcgaccgcagagctcaggccccaggaaacttggaagagtttgaggttaatgatttgaactacgaggataagctgcaagaagatcgctttctgtatagcaacatagcattcaatttggccgcagacgctgcacaatctaagtgtctagaccaggcgcttgcattgtggaaggagctgttaacgaagggacaggcacctgctgttcgatgtcttcagcagactgccgcttctctccagattctggctgccttataccaactggtggccaaaccaatgcaagcacttgaggtcctactgttgctcaggatcgtgtctgaaagacttaaggaccactcaaaagccgctggctcatcctgccacattacacagctgcttctgaccctgggctgccctagctacgctcagctgcatctggaagaggctgcgtcctctcttaagcatctagatcagacaacagacacatatctgttactctcattgacttgtgatctgctgcggtcacagttgtactggacacaccagaaagtcacaaaaggagtttctctgctgctatccgtcctgagggatcccgctttacaaaagtcctccaaggcctggtacctcttgagggtccaagttctgcagctggttgcagcctatctgtcactgccaagtaacaatttaagccactccctgtgggagcagctttgcgcccaaggttggcaaacccctgagattgcactgattgattcacacaagctgctgcgcagcatcattctcttgcttatgggaagcgacatcttgagcacccagaaggccgctgtggaaacttctttccttgactacggtgaaaacctcgttcagaaatggcaagtcctgtctgaggtgctgtcctgttccgagaaactggtatgccatctgggcaggctgggttcggtatccgaggctaaggctttctgccttgaggcccttaagttgaccactaaacttcaaatcccacgtcagtgtgccctgtttctcgtgctgaaaggagaactggaactggcccgaaacgatatcgacctttgccagtccgatctgcagcaggttttattccttttagagtcctgcactgagtttggtggcgtgactcaacacttggacagtgtgaaaaaagtccacctgcagaagggcaagcagcaggcacaggtcccatgccctcctcagctgcccgaggaggagttgtttctgagaggccctgcgctggaacttgtggccaccgtggccaaggaaccaggacctatcgcaccgtctactaactcatcacccgtgctgaaaaccaagcctcaacctatcccgaactttctatcacactcacctacctgtgactgttcactgtgtgctagcccagtgctcactgcagtgtgtctgaggtgggtgctcgtgaccgccggagtgaggctggctatgggccatcaggcccaggggctggacctgttgcaggttgtgctgaagggatgtcccgaagccgctgaaagactgactcaggcgcttcaggcctcactgaatcacaagacaccaccaagcctggtccctagcttgctcgacgagattctggctcaggcatatactcttctcgctctcgagggcttgaatcaaccttccaatgaaagcctgcagaaagtcctgcagtccggactgaaatttgtggcagccagaatcccacatctggagccctggagagctagtttgcttcttatttgggccttgacaaagctgggagggctgtcctgttgcacaacacagctttttgcttcgtcttggggttggcaaccaccgcttataaaaagcgtgccgggaagtgagccgagcaagacccaagggcagaaaagaagcggcagaggcaggcaaaaattggccagtgcccctttgaggctcaataacacatctcagaagggactcgagggacggggactaccatgcacacccaagccccctgatcgaatacggcaagctgggccacatgtgcccttcacagtgttcgaagaggtttgcccgacggaaagcaaaccagaagttcctcaggctcctagggtgcaacagagggtgcaaacaagactgaaggtgaactttagtgatgactctgacctggaggaccctgtgagcgctgaggcctggctggctgaagaacctaaaagacggggtacagcatctcgtggtcgagggagagccagaaaggggctctctctcaaaacagatgccgtggtcgccccagggtccgctccgggtaatccaggtttaaacggcaggagtcgcagggctaaaaaggttgcttcccgccactgcgaagaacgtaggccgcaaagagcttctgaccaggctagacccggacctgaaataatgcgtaccattccagaggaagagctgaccgataattggcgcaagatgtctttcgaaattctccggggaagcgacggcgaagactctgcctccggtggcaagactccagcccctggccctgaagccgcttccggggagtgggagctgctgagactcgattcaagcaaaaagaaactcccttcaccttgtccagacaaagagagcgataaagacttgggccctcggttgcggttgcctagcgcacccgtcgcaaccggtctgagtaccttagacagcatttgcgattctctcagtgttgcctttcggggtatttcacactgtcctcctagcggactctacgctcacctgtgtagatttttagctctgtgtcttgggcacagagacccctatgccaccgcctttctcgtcaccgagtcagtgtctattacctgccggcaccagctgctcacccatctccataggcagctctcaaaagcacagaagcacaggggatccctggagatcgctgatcagctgcaggggttgtcattacaggagatgccaggggatgtgccactggcaaggattcagaggttattcagcttccgtgcactggagtctggacactttcctcagcccgagaaagaatccttccaggagagactagcactgatccctagcggggtgactgtgtgcgtgttggcattagccacgcttcaacccggaacagtgggtaacacattgttactgactcgcctagaaaaggatagtcctccggtgtccgttcagattcctacaggccagaacaagttgcacttaaggtccgttctgaacgaattcgatgccattcaaaaggctcagaaagagaattcttcctgcacagataaaagagaatggtggaccggtcgcctggctctcgatcatagaatggaagtacttattgctagtttggaaaagagcgtcttaggatgctggaagggcttgctgctcccttcgtccgaggagccagggcctgcacaagaggctagccgactgcaggagcttttacaggattgcggctggaagtacccagaccgcacattgctgaagatcatgctttcaggtgcaggggctcttactccccaggacattcaggccctggcctacggactatgtccgacacagccagaaagagcacaggaactgctcaacgaggccgtgggacggcttcagggcctgaccgtgccaagtaacagccacctcgtgctggtgttggacaaagacctgcagaagctcccctgggagagcatgccaagtctgcaagctctacctgttacccgcctgccttcctttcggttcctcctgtcctactcaatcatcaaggagtacggagcctctcctgttctgagccagggggtagatcccaggtctactttttatgtccttaatccccataataacctgtccagcaccgaagagcagttccgggcaaacttttcctctgaggctgggtggcgcggtgtagtcggggaggtaccgcgtcctgagcaggtgcaggaagcccttaccaaacatgatctgtacatatacgccggacacggagcaggcgcacgcttcctggacggccaagcagtgttacgcctctcttgccgggcagtggctcttctgtttgggtgtagttcagctgctctggccgttcggggtaatctggagggtgcaggtattgttctcaaatatatcatggctggatgtccactcttcctagggaatctctgggatgtgacagacagggatatagatcgctacaccgaggctcttctccagggctggttaggagcaggcccaggcgcacccctcttgtactatgtgaaccaggcgagacaggctccaagattgaagtatctgattggcgctgccccaatagcatacggattaccagtaagtctgcgata

SEQ ID NO: 222665 - DNA, 1248 bp, Artificial Sequence
  Description of Artificial Sequence: Synthetic coding sequence
atgggcacgaccgccagagccgctctggtgcttacatatttagctgtggcttccgcggcaagcgagggcggattcacagccacaggccagaggcaattgcgccctgaacacttccaggaggttgggtacgctgcgccaccaagtccgcctctctctcgtagcttacccatggatcatcctgattcgtcgcagcacggcccaccgttcgaaggccagtcccaagtacagcccccacctagccaggaagccactcccctgcaacaagagaaactcctgcctgcccagctaccggcagagaaggaagtcggacctccactgcctcaggaagccgtgcccctgcaaaaagaactacctagtctgcagcaccccaacgaacaaaaagagggaaccccagctccttttggtgatcagtcccatccagagcctgaatcctggaatgccgcacaacactgtcagcaggaccgctctcagggcggatggggtcacaggctggatggttttcccccaggaagacctagtcctgataacctcaatcagatctgtctacccaatcggcagcacgttgtttacggtccatggaacctgcctcagtcctcatacagccacctcacccgccagggcgagacactgaattttctggagattgggtacagccggtgttgtcactgcaggagtcatacaaataggctggaatgtgctaaactggtgtgggaagacaccctggacaagtactgtgacagggagtatgcagttaagacccatcaccacctctgctgtcgtcacccaccatcacccacgagggacgagtgctttgcccgtcgagctccctaccccaactatgatcgagatatcctgactatagacataggacgagtgacacccaatttaatgggccacctatgtggtaatcagcgcgttttaactaagcacaaacacatccctggactgatacacaacatgaccgctagatgctgcgacctacctttcccagaacaggcctgctgcgccgaggaagaaaagctgacattcatcaatgacctgtgcggcccaagaagaaatatctggagggatcctgcgctgtgttgttacctgtctcctggcgatgaacaagttaattgttttaacatcaattacctgcggaatgtggcccttgtaagcggggatacagaaaacgccaagggccagggggaacaggggtctaccggtggaacaaatatatccagtacctcagagccaaaagaagagtag

SEQ ID NO: 222666 - DNA, 1623 bp, Artificial Sequence
  Description of Artificial Sequence: Synthetic coding sequence
atgggtacgactgcaagagccgcactcgtgctgacttatctggcagtcgcctccgcagcctctgaagggggatttaccgctactgggcagagacagttgagacccgaacattttcaggaggttggatatgccgctcccccatctccacctctgtcgagaagtttgccaatggatcaccctgatagctcccagcacgggccacccttcgagggccagagtcaggtgcaacctcctccttcccaagaggctaccccgctccagcaggagaagctcctgcccgctcagcttcctgctgagaaggaagtcggaccacccttacctcaagaagccgtccccctgcagaaggagctgccttctctccagcacccgaatgagcaaaaggagggtacaccggctcccttcggagatcagagtcatcctgaaccggagtcatggaatgctgcccaacattgtcaacaagaccggtcccagggtggttggggccaccggctagacggctttcctcctgggagaccgtctcctgacaacctgaaccagatttgtctgccaaaccgccaacatgtggtttatggaccctggaacctgccccagagctcttacagccacctgactagacagggagaaaccctgaattttcttgagattgggtatagcagatgttgtcattgccgttcacataccaatagactggaatgtgctaaactggtctgggaagaggctatgtctaggttctgtgaggccgagttttccgttaaaacccggccacactggtgttgtactcgccagggcgaggccaggttctcttgcttccaagaagaggctccccaaccacattatcaactgagggcttgcccttcccatcagccagatatttcttctggtctggaattaccatttccgccaggtgtgccgacgctggacaacattaagaatatctgccacttacggcgtttccggtccgtgccccgtaacctgccagccactgatccactgcagagagagcttctggcacttattcagctggagcgcgaattccagcgatgctgccgccaggggaacaatcacacgtgtacctggaaggcgtgggaagatactttggacaagtattgtgatcgcgagtatgcagtcaagacacaccatcacctctgctgcaggcacccgccttcaccgaccagggatgagtgttttgcacgtcgggctccctaccctaactacgacagagatattctgaccattgatatcggaagggtcacacctaatctgatgggccacctctgcggtaaccagcgggtactcaccaagcataagcacatacctggcctgatacataacatgacagcgaggtgctgcgatttgcccttccctgagcaagcttgttgtgctgaagaggaaaaattaacttttataaatgatctttgcggcccaaggaggaatatttggcgcgatccggcactgtgttgctatctcagccccggtgacgagcaggttaattgcttcaacatcaactacttacgtaacgttgccctcgtatcgggtgatactgagaacgctaaggggcaaggcgaacagggcagcacgggaggtaccaatatcagttccacttccgagcctaaagaggaatag

SEQ ID NO: 222667 - DNA, 1704 bp, Artificial Sequence
  Description of Artificial Sequence: Synthetic coding sequence
atgggtaccacggcccgtgccgctttggtgctaacttacttggcagtcgcctcggctgcaagcgaaggtggattcacagccaccggtcaaagacagttgcgcccagagcattttcaggaagtcggctatgccgcacctcctagcccacctctgagccgcagcctccccatggatcaccccgattcctcacaacatggccctcctttcgagggccagagcggtaaagagggacgcggacctaggccccatagtcagccatggctgggcgagcgcgtgggctgtagtcacattccccctagtatagtacaaccccctccttcccaggaagccaccccattgcagcaggagaagcttctcccggcacagcttccagcggagaaggaagtcggacctcccttaccgcaggaggcggtccccctccagaaagagctgcccagcctccaacacccaaacgaacagaaggaaggcaccccggctccttttggcgaccagtcacaccccgagcccgagagctggaatgcagcccagcactgtcagcaagacaggtcccaaggaggatggggccacagacttgatggcttcccgcctggcagaccctcccctgataatctaaaccagatttgcctccctaatagacagcacgtggtctacggtccctggaacctcccacagtcgagctacagccaccttactcgccaaggagagacactaaattttctagaaatcggttactcccgatgttgtcactgtcgtagccacacaaataggctggaatgtgctaaattggtatgggaggaggctatgtcgcgattctgtgaagctgagttctcagtcaagactcggcctcattggtgctgtaccaggcagggagaggcacgtttttcctgtttccaggaagaggccccacagccacattaccagctgagagcttgtccttcccaccagcccgatatttccagcggcctggaacttccgtttccacccggagtcccaacacttgataatataaagaacatttgtcacctccgcagattccgttccgtccccaggaacctgcccgctacagaccccttacagagagagcttttggcgctgattcaactggagcgggagtttcagcgctgttgcaggcaagggaataaccacacctgcacttggaaagcgtgggaggatacccttgacaaatactgcgaccgggagtacgctgttaagactcatcaccacctgtgctgtcggcatccacctagccccacccgcgacgagtgcttcgctaggcgggcaccttatcctaactacgatcgggacattttgaccatcgacatcggacgcgttacgcccaaccttatgggacatctttgtggcaatcaacgagtactaactaaacataagcatatacccggtctaatccataacatgacagcccgttgctgtgatctgcctttccctgagcaagcctgttgcgctgaagaggaaaagctcacgttcatcaacgacctctgcggacctagacgaaatatctggcgggaccctgccctttgttgttacctctcgcctggagatgaacaagtcaattgttttaacataaattatttacgtaatgtggccctggtgtcaggcgacaccgagaacgccaagggccagggcgagcagggaagtacaggcggaactaatatcagcagcacgagtgaacctaaagaagagtag

SEQ ID NO: 222668 - DNA, 2100 bp, Artificial Sequence
  Description of Artificial Sequence: Synthetic coding sequence
atgaagatcgctgtgttattctgttttttccttctaatcatttttcagaccgatttcggtaaaaacgaggaaatccccaggaagcaacgccgtaaaatttaccaccgtagactgagaaaaagttccacatctcacaaacataggtccaacaggcagttaggcatccagcagacaaccgtctttaccccagtggctaggttacccatcgttaacttcgactactcaatggaagagaagtttgagtccttcagctcatttccaggcgtggagagcagctacaacgtgcttccaggtaagaaaggccactgtttggtgaaaggaatcacaatgtacaataaggcagtctggtctccggaaccttgcacaacgtgcttgtgttctgatggacgcgtgctgtgtgatgagacgatgtgtcatccacagagatgtcctcagaccgtcattccagagggagaatgttgccctgtgtgtagtgccactgtctcttactccctgctgtctgggatcgccctgaacgatcgaaacgaatttagcggtgatagctccgagcaacgtgagccaaccaacctgctacacaagcaactgccaccccctcaggtgggcatggaccggatcgtgcgcaaggaggcactccaatctgaggaggacgaggaggttaaggaagaggatacagaacaaaagagagaaacgcctgagagccgcaaccagggacagctgtactccgagggcgactcccgagggggagatcgcaagcagcgcccaggtgaggagcggagactggcccatcagcagcaacgtcagggcagagaggaggaggaagatgaagaagaagaaggggaggagggcgaagaagacgaggaggatgaggaagacccggtacggggtgacatgttccgcatgccatcgcgttcccccctgcccgcaccccctcggggaactctcaggctgcccagcggatgttccctttcctacaggacaatatcctgcataaacgccatgctgacacagatccccccactgaccgcgcctcagatcacttcactggagcttactggaaactccatcgcttccataccagacgaggccttcaatggtctcccgaatctggaaaggctggacctctccaagaataatattacaagctcaggaattggtccaaaggcgttcaaactacttaagaagttgatgcgccttaacatggacggcaataaccttatccagataccctctcagctgccatctactctcgaggagctgaaggtgaatgaaaataatcttcaggccattgacgaggagtccctatcagatctgaatcaactagtgacactggagttagaggggaataatctatccgaagctaatgtgaatccactggctttcaagcccctgaagtcgctggcctacctgcgcctggggaagaataaatttcgtatcattcctcagggtctgcctggaagcatagaagagctgtatctcgagaataaccagatcgaagagatcactgagatctgtttcaaccatacgagaaagattaatgtgattgtgctacggtacaataagatagaagaaaatcgaattgcaccgctcgcatggataaatcaggaaaatcttgagagtatcgacctttcatataataagctgtaccatgtcccttcttacctcccgaaatccttattgcatctggtcctcttgggaaatcagatcgaacggatcccaggttatgtatttggccacatggagcctggactcgagtatctgtatctctccttcaataaattggccgatgatggcatggatagagtatcgttctatggtgcctatcacagtctccgcgagctgtttttagaccacaatgacctgaaaagcatcccccctggtatacaagaaatgaaggcattgcactttctgcgcttaaataataataagatcagaaacattcttcctgaggaaatctgtaatgccgaggaagatgacgatagcaacttagagcatctacacctcgagaataactatatcaaaatacgtgaaatccctagctatacctttagctgcatccggagctacagttcaattgtgctgaagccgcagaatatcaaatag

SEQ ID NO: 222669 - DNA, 495 bp, Artificial Sequence
  Description of Artificial Sequence: Synthetic coding sequence
atgaaaatcgccgttctattttgcttcttcctgttgatcatttttcagaccgatttcggcaaaaacgaggagataccgaggaagcagcggaggaaaatatatcatcgacgccttagaaagtctagcactagccataaacatcgtagtaacagacagctgggcatccagcagacgacagtatttactcctgttgctagactgcccattgtgaactttgactatagcatggaggagaagtttgagtcgtttagcagctttcccggagtggaaagtagctacaatgtgctccccggaaagaaaggccactgccttgttaaaggcataaccatgtacaacaaggcagtgtggagccccgagccctgcaccacatgcttatgctcagacgggagggtgctttgtgacgagaccatgtgccacccacagcggtgtccccagacagttatccccgaaggtgagtgctgccctgtgtgttctgccacaggtaccgagatctag

SEQ ID NO: 222670 - DNA, 483 bp, Artificial Sequence
  Description of Artificial Sequence: Synthetic coding sequence
atgaaaatcgctgtgctgttttgcttctttcttctaataatttttcagaccgatttcggaaagaatgaggaaatcccgaggaagcagcggaggaaaatataccaccgccgactgcgcaaaagctcaacctcacataagcaccgaagcaacaggcagctggggatccagcagacaacggttttcacacctgtagccagactacctatcgtgaatttcgattacagcatggaggagaagttcgaatcgttctcctctttcccgggtgtagaatccagttacaatgttcttcctgggaaaaaagggcactgtctcgtgaaaggcattactatgtacaataaggccgtgtggagccctgaaccctgtactacatgtctctgcagcgacggacgcgtgttatgtgacgaaaccatgtgtcatccccagcgctgcccccagacggtgatcccagaaggggaatgctgtcctgtgtgcagcgcaacctag

SEQ ID NO: 222671 - DNA, 1932 bp, Artificial Sequence
  Description of Artificial Sequence: Synthetic coding sequence
atgaagatcgcagtgttgttctgttttttcttgttaatcatcttccagacggatttcggcaaaaacgaagaaattccacggaagcaacgccgaaaaatttaccaccgtcgcctgaggaagtctagcacatctcacaagcatcggagtaaccggcagctcggtatccagcagaccaccgtgtttactccggtcgctcggcttcccatcgtgaattttgattattccatggaggagaaattcgagagcttttcctcttttcctggtgtagaaagttcttataacgtcttgccaggtaagaagggacattgcctggtgaagggaatcacaatgtacaataaagccgtttggagccccgagccctgcacaacgtgtctatgttctgacggcagagtgctgtgcgatgaaacgatgtgccatcctcagcgatgccctcagactgtgatccctgagggcgagtgttgcccagtgtgtagcgccactgagcagcgtgagccaacgaacctgctgcataaacagctgcccccaccacaggttgggatggatcggatcgtgagaaaggaggctctacagagtgaggaggacgaagaagtcaaggaagaggatactgaacagaaaagggagactccagagagtagaaatcagggtcagctgtatagcgagggcgatagtcgcggaggcgatagaaaacagcggcctggagaggaacgccgactcgcccatcaacagcaacgacaaggcagggaggaggaggaagatgaggaggaagagggcgaagagggggaagaagatgaggaggacgaagaggaccccgtgcggggagacatgtttcgcatgccctcccggtcaccccttcctgccccacctagagggacacttcggttgccctcggggtgttcactctcttacaggacgatctcttgcataaatgccatgcttacacagataccgcctctgacagctcctcaaattacttctctggaattaaccggtaattccatagcctccattccggatgaagcgttcaatggattacccaacctcgagcgtttggacctctctaagaacaacataacttcaagcggcattggacccaaggcgttcaagctcctgaaaaaactgatgcgcctcaatatggatggaaacaatttaatccaaatcccatctcagctgccaagtacactggaggagttaaaggtaaacgagaacaatcttcaagccatcgatgaagaaagcctgtcagacctgaaccagctggtgactttggagcttgaaggaaacaatctgtctgaggcaaacgtgaaccccctagcttttaagccgttgaaatcactagcgtaccttcgactcgggaagaacaagttcaggataatcccccagggcctaccgggttctatcgaagaattatatttggaaaataaccaaattgaagagatcaccgaaatatgctttaaccatacacggaaaattaacgtgattgtgctcagatataataaaatcgaagagaatcgcatcgcccctctggcatggatcaaccaggagaacttggaaagcatcgacttgtcttataataaattgtaccacgtgccgtcttacttgccaaagtctttattgcatcttgtgctgctcggaaatcagatcgaaagaatccccggttatgtatttggtcatatggagcccggtctggaatacctttatctctcttttaacaaattagccgacgacggcatggatcgggtgtcattctacggggcttatcactctctcagggagctgtttctggatcacaacgatttgaagtccataccaccgggtattcaagagatgaaagcactccactttctacgcctgaacaataataagatacgctgcgtatcagacgccgtcctagaaaccgtgaccaacaggtcggatgtggccttccccttgtggtag

SEQ ID NO: 222672 - DNA, 1779 bp, Artificial Sequence
  Description of Artificial Sequence: Synthetic coding sequence
atggagatgcaggaccttacatcaccgcactcacgccttagtggctcatcagagagcccaagtggcccaaaacttggcaattcccatatcaatagcaactccatgacccccaacggaacggaggtgaaaacagagccgatgtcttcctccgaaactgccagtaccactgcagacggatccctgaacaacttttcgggcagcgcaatagggtcctcctcgttttctcccagaccaacacaccagttctcgccgcctcaaatctatccatcaaacaggccatacccacacattctgcccacacccagctcacagactatggctgcttacggccagacccaattcaccacagggatgcagcaagcaacggcgtatgccacatatccccagcccggtcagccttatggtatatcctcctatggagcactgtgggctggaatcaagacggaggggggtctttctcaatctcagtctcctggacagactgggttcctcagctacgggacatctttctccaccccacaacctgggcaggcaccttacagctaccagatgcaggggagctcattcacaacaagcagcgggatttacactggcaacaatagtcttactaattccagcggcttcaactcgtcacagcaggattatccaagttacccatctttcggacagggacagtatgctcaatactacaacagctccccttaccccgctcactacatgacctccagcaacacatccccaactaccccaagcacaaacgctacataccagttgcaggagcccccatccgggatcacgtcccaagcggtgaccgaccccacagccgaatactcaaccatccactccccttccacccctattaaggatagcgatagtgatcgtctccgcaggggctctgacgggaaatcacgaggtcggggacggagaaacaataatccctcccctcctccggacagcgatctcgagcgggtctttatctgggacctggacgaaactatcatcgtttttcacagtctgctgactggctcttacgctaatcgatacggacgcgacccaccgacatctgtgagtctgggacttcgtatggaagaaatgatcttcaatcttgctgacacacacctcttctttaacgatcttgaagagtgcgaccaagtgcatatagacgacgtgagctccgacgataatggccaagacctgtctacatacaatttcgggacagatggctttcctgcggctgctacaagcgcaaatttatgccttgcaacaggagtgcgcggaggcgtagactggatgcgcaaactggcattccggtataggagagtgaaagagatctataatacatacaaaaacaatgtaggcggattactcggtcccgctaagcgggaggcgtggctgcagcttagggccgaaattgaggcgttgacagatagctggctaaccttggctctgaaagctctaagcctaattcactctcggacaaactgtgtcaatattctggtgaccacgactcagctgatccccgcactagcaaaggtgttgctgtacgggctggggatcgtgttccccattgagaatatatacagcgccacgaaaatcggcaaagaaagttgctttgaaaggatcattcagcgcttcggcaggaaagtagtatacgttgttataggggatggggtagaggaggagcaaggggctaagaagcatgcaatgccattttggcgcatctcaagccatagtgaccttatggccctgcatcatgcactggaacttgagtacttgtag

SEQ ID NO: 222673 - DNA, 1680 bp, Artificial Sequence
  Description of Artificial Sequence: Synthetic coding sequence
atgctgttgtttcctcaggtggccgttaagaccgagccgatgagtagctctgagaccgcatcaactaccgcagatgggtccctaaacaatttcagtgggtccgctatagggtcatcttcttttagtccacggcctacacatcaattctctcctccgcagatctatcctagcaacaggccatatccacatattctaccgacaccttctagtcagaccatggcggcttatggccagactcagttcactaccggcatgcagcaagctaccgcctatgctacttatccccagcccggtcaaccatacggaatcagtagctacggcgctctatgggcagggattaagacagagggagggttgtctcaaagtcagtcacctgggcagacgggttttttaagctacggaacatctttcagcaccccacagcccggtcaggctccatattcttaccagatgcagggctctagcttcactacctcctcaggcatttacacaggcaacaattccctcacgaatagttccgggtttaatagctcccagcaggactacccatcttatccatcctttggccagggccagtatgcccaatactacaattcctccccctacccagctcactatatgacttcatccaatacctctcccactactccatccactaatgctacttatcaactgcaggaaccaccttccggcatcacatcacaagcagttacagacccgaccgccgagtactctaccattcactctccctccacaccaatcaaagacagtgactccgatcgtttgcgcagagggtccgacggcaaaagccgaggccgtggcaggcggaacaacaacccctccccaccgccagacagcgacctggaacgcgtgttcatctgggacttagacgagacaattatcgtctttcactcccttctcacaggctcatacgccaatagatatggcagagacccaccgacatctgtttcattggggctccggatggaggaaatgatctttaaccttgccgatacacacctgtttttcaatgatcttgaagagtgtgaccaggtacacatcgatgatgtgtctagcgacgataatgggcaggatctgtcaacatataattttggcacggacggatttcctgcggcagctacgtccgctaacctctgtctcgccaccggcgtgcgtgggggagtagattggatgcggaagttagccttcaggtatagaagagtcaaggagatctataatacatataaaaacaacgtgggcggattactgggtccagccaagagagaagcatggctgcagctcagagctgaaatcgaagccctcacggatagttggctgaccctcgcgttgaaggcattgagcctgatacatagccgaactaattgcgtgaatatcttggtcacgaccactcagctgattcctgcgctggcgaaagtcctattgtacgggctgggcatcgtctttcctatagagaacatctattctgctacaaaaatcggaaaggaatcttgtttcgagcgcattatccagaggttcggaagaaaagtcgtttacgtggtgattggggatggagtcgaggaggaacagggtgcaaagaaacacgctatgcctttctggagaattagctcacactcagatttaatggcgctgcatcacgcactggaacttgaatatctctag

SEQ ID NO: 222674 - DNA, 1779 bp, Artificial Sequence
  Description of Artificial Sequence: Synthetic coding sequence
atggagatgcaggacttaacctcacctcactcccgtctctccggctctagcgagtcccccagcggtcccaagctgggaaattcccacatcaacagcaattcgatgacaccaaacggcacggaagtaaaaacggaacccatgtcatcttcagaaacagcttcaacaactgctgatgggagtctcaataacttctcggggagcgccattgggtccagcagcttctcgccaaggccgactcaccagttctcgcccccacagatctacccttccaatcgtccttacccacatatcctccccacccccagcagtcaaactatggccgcttacgggcagactcaatttacaacaggtatgcagcaggccacagcatacgcaacttatcctcaacccggacagccgtacggaatcagttcctacggtgctctgtgggcaggaattaagaccgaaggcggtttgagccagagccagagtccaggccagaccggcttcctgtcatatggcacttccttttcaaccccccagcctggacaggcgccttatagctaccagatgcaaggatcttcctttactaccagctcaggtatctatacagggaataatagcctcacaaatagctccgggttcaattcatcccagcaggattacccttcctatcccagtttcggacaggggcaatacgcacagtactacaactcatctccataccccgcacactatatgacctcttctaacacatcccctaccacacccagtacaaatgcaacctaccagctgcaggagcctcctagcggcatcaccagccaggcagtcacggacccgactgccgaatactcaacaatacactccccttctacaccgatcaaagacagtgacagcgaccgcctccgccgtggctctgatgggaaaagtaggggcaggggaaggagaaataataacccttccccaccgccagactccgatttggagagagtatttatctgggatcttgacgaaacaataatcgtgttccactctctgcttacaggctcatatgccaatagatatggtagggatcctcccactagtgtgtccttgggcctcagaatggaggagatgatatttaacctggccgacacgcatctcttctttaatgacctcgaagagtgcgaccaggtccatatcgatgatgttagtagcgacgataacggacaggatttaagcacatacaacttcggcacggatgggtttcctgctgctgccacctcggccaacctgtgcctggccaccggcgtccggggtggcgttgactggatgagaaagctagcctttcgttacaggcgcgtcaaggagatttacaatacttacaaaaacaatgtggggggtctcctcggcccagctaaaagggaggcctggttacaattgcgcgctgaaattgaggcgcttaccgacagctggttaaccctggctctcaaggctctgtcattgattcactcgagaaccaattgcgtgaacattcttgttactaccacccagctcattccagccctggcaaaagtattattatacggcctgggaatcgtgttccccatcgagaacatctatagcgcgacaaagatcggcaaggagagctgcttcgagcgtattattcagcgattcggccgtaaagtcgtctacgttgtcatcggggatggggtggaggaggagcaaggcgctaaaaagcatgcaatgccgttctggcgcatctcaagtcactcggatctgatggctctgcaccatgcacttgagctcgagtacctctag

SEQ ID NO: 222675 - DNA, 1683 bp, Artificial Sequence
  Description of Artificial Sequence: Synthetic coding sequence
atgcttatgatttatgttcagttagtggtcaagaccgagccaatgtcttcatccgaaactgcttccacaactgcagacggatccctgaacaatttcagtgggtccgcaatcggatcttcctccttctccccgagaccaacgcatcagttttctccccctcagatttacccttctaatagaccttatcctcatatcctgccaactccgtcctctcagacaatggcagcctacgggcagacccagttcaccactggcatgcagcaggctacagcctacgctacctatccacaaccgggacagccctacggcatctccagttacggagctttgtgggctggcataaaaacggagggcggtctctcccagtcacagagtcctggtcagacaggattcctgtcttacggcacgagtttttcaacaccccaacccggacaggccccatatagctaccaaatgcaggggtcctcgttcacaactagttccggcatttatacaggcaacaatagtctaacaaatagcagtggtttcaatagttcccaacaggattacccatcatacccttcatttggccaggggcagtatgctcagtactataattcgtccccttatcccgcacattatatgacctcctctaacacctctccgaccaccccgagcactaacgcaacatatcaacttcaggaaccaccatctggcatcacttctcaggctgtcacagatcccacagctgagtacagtacaattcattcgccttccaccccaatcaaagattcagactctgacagactccgcagggggtctgatgggaagtcacggggtaggggcagaaggaacaacaatccctctcctcctcctgactcggacctggaaagggtgtttatctgggacctggatgagactattatagtatttcacagtctgctgacagggtcttacgccaacaggtatggcagggatcctcctaccagcgtctctctggggctgcggatggaggaaatgattttcaacttagcggacacccatctcttcttcaatgatctcgaggaatgtgaccaggtgcatatcgatgacgtatctagtgatgataatggccaggacctcagcacatacaactttggtacggatggctttccagcagctgcaacctctgcaaatctgtgtctggcgaccggcgtacgcggaggagtggactggatgcggaagctcgctttcaggtatcgtcgggtgaaggaaatttataacacctacaaaaacaacgtgggagggttactcggaccggcaaagagggaagcatggctgcagttgagggccgagattgaggcgctcacagactcttggcttaccctcgctctcaaagctctgagcttgattcactcaagaaccaactgcgtgaatatcctggtcacaaccactcaactcatacccgctttggccaaggtgcttctgtatggactgggaattgtgttcccaattgagaatatctattcagctactaagattggtaaggagtcatgcttcgagcgcatcatccaacgcttcgggagaaaagtagtttacgtggttataggggatggtgtggaagaggaacagggagccaagaaacacgctatgccattctggcggatttcttcacattcagacctgatggccctacatcatgctctcgaactcgaatatctgtag

SEQ ID NO: 222676 - DNA, 1674 bp, Artificial Sequence
  Description of Artificial Sequence: Synthetic coding sequence
atggagatgcaagacctgacttcacctcattccaggctgtccgggtcttccgaatccccgtcagggcctaagctaggtaattctcacatcaattcaaactccatgactcctaacggcactgaggtgaagactgagcctatgtcttcttcagaaacagcgtccacgaccgccgacggcagcctgaataacttctctggatcagccattggctcctctagcttcagtccccgtcctacgcaccagttttccccccctcaaatctaccccagcaaccgtccctatccccacatactgcccacaccatcgtctcagacaatggcggcatatgggcaaactcagttcaccaccgggatgcaacaagctacagcctatgccacgtatcctcagccaggtcagccctatggaataagttcctacgggatcaaaaccgaaggaggactttcacagtctcaaagtcctggtcagacgggctttttgtcttatggaacatcttttagcacccctcagcccggacaagctccatactcgtatcagatgcagggaagctcctttaccacctctagtggaatctatacaggaaacaatagtctgactaactccagcggatttaatagcagccagcaggactatcccagctaccccagcttcggacagggccagtacgcgcaatattataactcttccccttatcccgcacattacatgacttcctccaatacaagtcccaccacaccttctaccaatgcaacttatcagttacaggagccacccagtggaattacctcccaggcggttacagacccaactgctgagtactctaccatacatagcccttccaccccaattaaagattctgactctgaccgactgagacggggttccgatgggaagtcccgcggaagagggagacgaaacaataatccttctcccccacccgactctgatctggagcgggtgtttatctgggacctagacgagactatcatcgtgttccattcactgctgaccggaagctacgccaatagatatggaagagagtgcgaccaggttcacatcgacgacgtgtcttccgatgacaacgggcaggacctcagcacatataacttcggcacagatggatttcctgcagccgcaacaagcgccaatttatgtctcgccacaggcgtccggggaggggtcgactggatgcgaaaattggcctttagatacaggagggtgaaagaaatatacaacacatacaaaaataatgtgggaggactactgggcccagccaaacgcgaagcttggctgcagctgcgtgcggagatcgaggccttaacagacagctggctgacacttgcactgaaggcactgtccctgatacactccagaaccaactgtgtgaacattcttgtcaccacaactcagctcatcccggctctagcaaaagtgctgctctacggactcgggatcgtgttccccatcgagaatatctattccgctacaaagatcggcaaagagtcctgttttgagcgaatcattcagcgctttgggcgtaaggttgtctacgtggtgattggggatggagtggaagaagaacagggggctaagaagcatgctatgccgttttggaggatatctagccacagtgacctcatggcgctccatcacgctttggagcttgagtacctgtag

SEQ ID NO: 222677 - DNA, 1527 bp, Artificial Sequence
  Description of Artificial Sequence: Synthetic coding sequence
atggttgagctggtcattagcccctctctgacagtgaactctgactgccttgacaagttaaagtttaaccgagcagatgcggctgtgtggacactctctgataggcagggaataacaaaaagcgctcctctgagagttagccagctttttagccgtagttgtcctcgtgttctgcctcggcaacccagtaccgccatggcagcctatgggcagacccaatatagcgccggaatccagcaggccaccccttacaccgcctaccccccacctgcgcaggcctatgggatccctagctactccatcaagactgaagacagcttgaatcactctccaggacagagcggcttcctgagctacggatccagcttctcaactagccctaccgggcaaagtccctacacataccagatgcatggaacaacagggttctatcaaggaggcaacggtctggggaacgcagccggttttggtagtgtccatcaagactacccctcctacccaggattcccgcagagccagtacccccagtactatggctcctcctataatccgccttatgtacccgcttccagcatatgtcctagccccctcagtacatcaacatacgtgcttcaggaggcctctcataatgtcccgaaccagtcctccgagagcctggcaggtgagtacaacacccataacggacctagcactcctgcaaaggagggagacactgaccggccacatagggctagcgatggaaagttgcgcggacggtcaaagcggagctctgacccaagtcctgcaggcgataatgagatcgagcgtgtcttcgtatgggatctcgacgaaaccatcatcattttccatagtcttttgaccggaacgttcgcttcgcggtatgggaaagactgcgatcagattcacgtagatgacgtgtccagcgatgacaatgggcaggacctatctacatataacttcagcgctgacggcttccactcttctgcaccaggtgctaacctgtgtctgggctccggcgtgcatggcggagtggattggatgcgtaaattagccttccgctatcgccgagtcaaggagatgtacaacacttataaaaataatgtcgggggactcatcggcactcctaaacgtgagacttggctgcaactgcgtgccgaacttgaggcccttactgacttgtggctcacacattctctgaaagctttgaacctgataaacagccggccaaactgcgtcaacgtccttgtgaccactacccaactgatccccgctcttgccaaggtcttgctttatggcctgggcagcgtgttccccatagaaaatatctatagtgcgaccaagaccggcaaggagtcttgtttcgagagaattatgcagcgtttcggccgtaaagccgtttacgtggtgataggagatggtgtggaggaagagcagggtgccaaaaaacacaatatgcctttttggcggatctcctgtcatgccgacctggaggccctgcgtcatgcactcgagctagagtacctctag

SEQ ID NO: 222678 - DNA, 1617 bp, Artificial Sequence
  Description of Artificial Sequence: Synthetic coding sequence
atggtcgaactggtcatttcacccagcttgaccgtgaactcagattgccttgataaactgaaattcaaccgagccgacgcagctgtatggacacttagtgaccggcaggggattactaaatccgcccctctccgcgtcagccaacttttcagtcgctcctgccctcgagtcctgccacggcagccctccactgccatggctgcgtatggccaaactcaatatagtgcaggtattcaacaggctaccccttatactgcctaccctccacccgcacaggcgtatgggattcccagctactccatcaaaactgaagacagtctgaatcacagtccaggacagtcgggcttcctgagctatggttctagcttttctacctctcccactgggcaatcaccgtatacctatcagatgcatggaacaaccggcttttaccagggcggaaacgggctgggaaatgcagcagggtttggctctgtacaccaggattacccttcgtaccccggatttccccaatctcagtacccacaatactacgggagtagctacaacccaccctacgtgcctgctagctccatatgtcctagccccctctccacctctacttacgtccttcaggaagctagccataacgtgcctaatcagagctctgaaagcttggctggcgagtataacacccacaacggcccttctacccctgcgaaggagggtgacaccgatagaccacatcgggcatctgacgggaagctccgtggtcgctccaagcggtcgtcagaccccagccctgctggcgacaacgaaatcgaacgcgtatttgtctgggatctcgacgaaaccatcattatattccatagcctattgaccggtacatttgcatccaggtacggaaaagacacgacgacttccgtgcgcatagggctcatgatggaggagatgattttcaacctggccgatacccatctcttcttcaacgacttggaagattgcgaccaaatccacgttgacgacgtgtcatctgacgacaatggacaggacttgtcgacttacaatttctcggctgacggctttcatagttcagcaccaggtgctaacctgtgcctgggcagtggggtccacggtggggtggactggatgagaaaacttgccttccgttaccgtagggttaaagaaatgtataacacatacaaaaacaatgtgggaggccttattggaacaccgaagagagagacatggctccagctgcgagccgaactcgaggctctaacggacctgtggctgacccactccctgaaagcactcaacctgatcaacagcagacctaactgcgttaatgtcctggtgacaaccacccaattgattcctgccttagccaaagtgcttttatacgggctggggagtgttttcccaatcgagaatatatactctgccaccaaaaccggaaaggaatcatgtttcgagaggattatgcagcggtttggtagaaaagcggtatacgttgtgatcggagatggcgtggaggaggaacagggagcgaaaaagcacaatatgccgttttggagaataagctgtcatgcagatcttgaagccctgagacatgcgctggaactggagtatctctag

SEQ ID NO: 222679 - DNA, 1380 bp, Artificial Sequence
  Description of Artificial Sequence: Synthetic coding sequence
atggtggagctggtaattagcccaagtctcaccgttaatagtgactgtctagataagctgaagtttaatcgcgcagatgcagcggtgtggacattgtccgatagacaggggataacgaagtcagccccactcagagtatcccagctcttttctcggtcctgcccccgtgtcctgcctcgacagcccagtacagcgatggcagcctacgggcaaacacagtatagcgccggaatacagcaggctactccatatacagcatatcctccacctgctcaggcttatggaattccctcctactcgattaagactgaagatagcctcaatcattcgcccggacaatccggctttctgagctacggctcctcattttcaaccagccctactgggcaatcaccctacacctaccagatgcatgggaccacgggcttttaccaagggggtaatggcctcggaaacgctgctggctttggtagtgtccatcaagactatcccagttatcccggattcccacagtcgcaatatccacagtactatggctcctcctacaacccgccatacgtcccagcctccagcatttgtccttccccgcttagcacttccacatacgttctgcaagaggcctctcataacgtacctaatcaaagttctgaatcgctggctggggagtacaacacccacaatgggccttccacccccgctaaggagggcgacaccgatagaccgcaccgtgcctccgacggaaagttgcggggtcggagtaagagatctagcgacccatctcctgctggtgacaacgagatagagcgcgtgttcgtttgggacctcgatgagactatcattatctttcacagtttactgacgggaacatttgcatccaggtacggcaaggacactactacatccgtccgcattggcctcatgatggaggaaatgatttttaatctagccgatacacacctgttcttcaatgacctggaggattgcgaccagatccatgtggacgacgtctcatctgatgacaacggtcaggacctctcaacttacaatttttccgctgacggtttccacagctctgctccaggggctaacttgtgtttaggatctggcgtgcatggtggcgtggactggatgcggaagttggcctttagatatagaagggtgaaggaaatgtataacacttacaaaaataacgtgggcggtaaggagagttgtttcgagcgtattatgcagcgattcggtaggaaagccgtctacgttgtcattggcgacggtgtggaggaggagcaaggcgcaaaaaaacacaatatgcctttttggaggatctcttgccacgccgacctcgaggcactcagacacgctcttgagcttgagtatttgtag

SEQ ID NO: 222680 - DNA, 1527 bp, Artificial Sequence
  Description of Artificial Sequence: Synthetic coding sequence
atggtggaattagtaattagcccctctctcacagtgaatagtgattgccttgacaaactgaaattcaaccgggctgatgccgctgtatggaccctatctgacaggcaaggcatcacaaaatcggcccctctgcgcgtgtctcagctgttttcacgaagctgtcccagggttctgccacggcagccttctacggcgatggccgcttacgggcaaactcagtattcagcgggtattcaacaggctacaccttacacagcatacccacccccagcccaggcgtacggtatcccttcttactctatcaaaactgaagactccctgaatcatagtcctggtcaatcaggatttcttagctatggtagctcattcagtaccagccctactggccaatctccatacacttaccagatgcatggtaccacagggttctatcaggggggaaatggactggggaacgcggcaggtttcggttcagtgcatcaggactatccttcctatccaggattcccccagtcccagtatcctcagtattacggtagcagctataaccctccctatgtgcctgctagctcaatctgcccaagtcctctgagtacgtctacatatgtgctccaagaggcctctcataatgtgcccaaccaaagctccgaaagtcttgcaggtgagtataacactcataatggcccttcaactcccgctaaggagggtgacaccgatcgacctcatagggcgtctgatggcaagctgcgtgggaggagcaaaagatccagcgatccaagtccggctggtgataacgaaattgagcgggtcttcgtttgggacctagatgagacaatcatcatattccactccttgttgaccgggaccttcgctagtcgatacggaaaggactgtgatcagatccatgtagatgacgtgtcatccgatgacaatggccaggatctgtccacctataatttttccgcggacggatttcactcctcagcgccaggtgccaatctgtgcctcggaagcggtgtgcacgggggtgtggactggatgagaaagttagccttccgttatcgaagggtgaaagagatgtataacacctataagaacaatgtgggaggccttatcggcacacctaaacgcgagacttggctgcagctgcgggcagaacttgaagccctgacagatctgtggttaacccatagcctgaaagccctcaatcttattaactctcggcagaattgtgtcaacgtgttagttactacaacgcagctgattcctgcgcttgctaaagtgttgctgtacgggctggggagcgtctttccgatcgagaatatatatagcgccacaaaaacaggaaaggaatcatgcttcgagcgcattatgcaacggttcggcagaaaggcagtctatgtagtcattggcgatggcgtggaagaggaacagggagccaagaaacacaacatgcccttttggcgaatcagctgccatgcggatcttgaggctttgcgccacgcccttgaactagaatacctgtag

SEQ ID NO: 222681 - DNA, 1611 bp, Artificial Sequence
  Description of Artificial Sequence: Synthetic coding sequence
atggaagaggagcaggatctgcccgaacagcctgttaagaaggccaagatgcaagagagcggtgagcagacaatatcacaggtctcaaatcctgacgttagcgatcagaaacccgaaacctcttctctagctagcaatctgcctatgtctgaggaaataatgacatgtacagactatatcccgcgatctagcaacgactacactagtcagatgtactcggctaagccttacgcacacatcctgtccgttcccgtttccgagaccgcctacccgggtcagactcagtaccaaaccctacagcagacgcagccgtacgcggtttatccacaggccacacagacatatggtcttcctccgttcgcctcatccactaacgcctccctgataagcaccagcagcaccattgctaacattcctgccgctgcggtagcctccatctctaatcaagattaccctacatacaccattttaggccaaaatcagtaccaggcgtgttaccccagttcctccttcggagttacaggtcagaccaactcggacgccgaaagtaccacgctagccgctaccacgtaccagagtgaaaagccctctgttatggccccagctcctgctgcccaaaggttgagttcaggagacccttccaccagccctagcctgagccaaactacccctagtaaggatacggacgaccagtctcggaaaaatatgacttctaagaacagaggcaagcgcaaggcagacgctacttcctctcaggacagtgagctggagagggtgttcctgtgggatctcgacgagacgattataatttttcactccctgttgactgggagttacgcacagaagtacggaaaggacccgaccgtcgttataggcagcgggctgaccatggaggagatgatttttgaagtcgctgatacccacctgttctttaatgatctcgaggaatgcgatcaggtgcatgtcgaagacgtggcatccgatgataacggtcaggacctcagcaattactcattttccactgacgggttttccggttcgggcggaagcggtagccatggctctagtgtgggcgtccagggtggtgtggattggatgagaaagctggcattccgttaccgcaaagtccgggaaatctacgacaaacacaagtctaatgtggggggtctgctaagtcctcagcgcaaggaggctcttcagcgtctgcgcgcagaaatcgaggtgctcactgattcctggcttggaactgccctgaagtcacttctccttattcagagccgcaaaaactgcgtgaatgtactcatcacgaccacccagctcgtgcccgctctcgccaaggtcctcctctacggattgggcgaaatctttccaatcgaaaacatttacagcgccaccaaaatcggaaaggagtcgtgttttgaaaggatcgttagccgcttcggcaagaaagtgacttacgtggtgataggcgatgggagagatgaggagatcgctgctaaacagcagctctattttctcgatatggaggccctagggtgccaactcgaacccacagcactaatcctgtttatacaactttctggaaacctgtccaattataataaactttag

SEQ ID NO: 222682 - DNA, 1251 bp, Artificial Sequence
  Description of Artificial Sequence: Synthetic coding sequence
atgatcattcctcataaatgcatcctgcagactagctctacaaatgccagtcttatctcaacctcctccaccatagcaaacattcctgccgcagcagtggcctcaattagcaatcaagactaccccacctacacaattttgggacaaaaccagtaccaggcctgctacccctcctcgagttttggagtgaccggccagacaaattcagacgcagagtccaccactctcgctgctacgacataccaaagtgaaaagccctccgtgatggcccctgctcctgcagcgcagaggctcagttcggacccatctacctctccctccctgtcccaaaccaccccgagcaaggataccgatgaccagagtcgcaagaatatgacatcgaagaaccgaggcaagcgaaaggcagacgctacatcttcccaggatagtgaacttgagcgcgtatttctgtgggatctggacgagacaataatcatcttccactccttactcaccgggagttatgctcaaaaatatgggaaagatccaacagtcgtgatcggatccgggttgaccatggaggagatgatttttgaggttgccgatacccacctgttctttaatgacctggaggaatgcgaccaggtgcacgtagaggacgtggccagtgacgataatggacaagatctgagtaattatagcttctctaccgacggtttttcagggtccggcggttccggctcacacggcagctccgtgggggtccaggggggtgttgactggatgcgcaagctcgcttttcggtaccgcaaggtgcgagagatttatgacaagcataagagtaatgttgggggtcttctgtctccacagcgaaaggaagccttgcagcgccttcgggctgagatcgaagttcttactgattcttggctgggaaccgctctgaagtctctgctactgatacagagccgtaaaaattgcgtgaacgtgctaataactacaacacaattggtgccggcactagctaaagtgctgctctacggcctgggagaaattttcccgattgaaaacatttactctgccaccaagatcgggaaagagtcttgctttgagcgcattgtctccaggttcgggaagaaggttacctatgtggttatcggagatgggagagatgaagagatagctgccaaacaacataatatgccgttttggagaattaccaatcatggagaccttgtgagtctgcaccaagcccttgagctggactttctgtag

SEQ ID NO: 222683 - DNA, 1722 bp, Artificial Sequence
  Description of Artificial Sequence: Synthetic coding sequence
atggaagaagaacaagatctgcctgaacaaccggtgaagaaggcgaagatgcaggaaagtggggagcagactataagccaggtttccaaccccgacgtgagcgaccagaaaccagagacctccagcttggcctctaatctgccaatgtcagaggaaatcatgacatgtactgattacatccccaggtcatctaacgattatacaagtcagatgtattcagccaagccatatgcccatattcttagcgttccagtctctgaaaccgcgtatccaggtcaaacacagtaccagacgttgcagcagacacaaccttacgccgtgtacccacaggctacccaaacatacggacttcccccattcggagctctgtggcctggaatgaagccagagagcggcttgattcaaacgccctcgccatctcagcactccgtgctgacatgcaccaccggcctcactacatctcagccttcccccgctcactactcttatcccattcaggcttcctctaccaatgcatctctaatctccacctcctcaacaattgcaaatatccccgcagctgcagttgcatctattagcaatcaggattatcccacatatacaatcttggggcagaatcagtaccaggcctgttacccctcgtcttccttcggagtgacaggccagaccaatagtgacgcagagtcaacaactctcgccgcaaccacctatcagtctgaaaagccatcagttatggctcctgccccagcagcacaacgtctttcctccggcgatccaagtacttccccttctctgtcccagaccacaccaagcaaggatacggatgatcagtcgcgaaagaatatgaccagtaagaatcggggaaaaaggaaggcagacgctacctctagccaggatagcgaacttgagcgcgtgtttctatgggatttggatgaaacaatcataatcttccacagcctgctcaccggctcttacgcccaaaaatatgggaaggacccaactgtggtgatcgggtctggcctcaccatggaagagatgatctttgaggttgcggacactcaccttttcttcaacgacttggaagagtgcgatcaggtacatgtcgaagacgtagcgtcagatgacaatggccaggacttgagcaactactctttcagcaccgacggtttttccggatcaggaggatcggggagccacgggtccagtgtgggtgttcagggcggagtggattggatgagaaaactcgcatttcgctacagaaaggtacgtgaaatctacgataagcacaagtccaatgttggtggattgctgtcgcctcagcgtaaggaggccctgcagcggcttcgcgcagagatagaagtcctgaccgacagctggcttgggaccgcactgaaaagcttgttacttattcagagccgtaaaaactgtgtgaacgtactgatcacaacaacacaacttgtccccgctttggctaaagtactactgtacgggctaggagagattttccccatcgagaacatttatagcgccaccaagatcggaaaagagtcttgcttcgagcgcatcgtctctaggtttgggaaaaaggtgacctacgtggtcattggagatggcagggacgaagagatcgccgcaaagcaacacaatatgcctttttggagaatcacgaaccacggcgacctggttagcttgcaccaggccctggagttggatttcctgtag

SEQ ID NO: 222684 - DNA, 1344 bp, Artificial Sequence
  Description of Artificial Sequence: Synthetic coding sequence
atgaaacccgaatctggtctgattcagactccctctccctcacagcacagcgtgctgacgtgcactactggtctgactacatcacagccttcacctgcacattatagttacccaatccaggcaagctccaccaatgcttccctcatcagcacgtctagcacaatcgctaatatacccgctgctgcggtggccagtatctccaaccaggattatccaacctacacaattttaggacagaatcagtatcaggcctgctaccctagttcatcctttggcgtaacaggtcaaaccaatagtgacgccgagtcaactacactcgccgctaccacttaccagagtgagaagccgtccgtcatggccccagcccctgccgctcaacgactgagtagcggcgacccaagcactagccctagtttgtcccaaaccactccttctaaggatactgacgatcagtctcgcaagaacatgacctctaaaaatagaggcaaaagaaaagccgatgcaacatcctcgcaggatagcgaactagaacgggtttttctctgggacctggacgaaactataatcatctttcactccctgctgacaggcagctatgctcaaaagtatggtaaggaccccacagtcgtgataggtagtgggctgacgatggaagagatgattttcgaggtcgccgacacccatctcttcttcaatgatctggaagagtgcgatcaggtccacgtcgaagacgtggccagtgacgataacggccaagatctctctaactacagctttagcaccgacggcttttcaggctcgggtgggagtggttcccacggaagctcggtgggcgtacaaggcggagtggattggatgagaaagctcgcctttcggtatcgaaaggtccgtgagatctatgataagcacaagtccaacgtgggagggctgctcagccctcaaagaaaagaggccttacaaaggctgagggccgaaatagaggtccttacagattcatggctcggaaccgccctgaagtctttactactgattcagtccagaaagaactgtgttaacgtgctcattacaacaacccagctggttcccgcacttgcaaaagtgctcttatacggacttggtgagatattccctattgagaatatttactccgccaccaagatcggaaaggagtcttgctttgaacggatcgtctccaggtttggcaagaaagtcacttacgtggtgatcggagatggtcgggatgaggagatagctgctaaacagcataacatgcctttctggagaattaccaaccatggggatttagtttctctgcatcaggctctggagctggactttctttag

SEQ ID NO: 222685 - DNA, 1584 bp, Artificial Sequence
  Description of Artificial Sequence: Synthetic coding sequence
atggaagaggagcaggacttgccggagcagccagttaagaaggctaagatgcaggagtctggcgagcagacgataagccaagtgtccaatccggacgtgtcggaccagaagcccgaaacctcttcacttgcttccaatttgccaatgtcagaagaaattatgacatgtactgactatatcccccgttcctcaaatgactacacctcacagatgtactccgccaagccatatgctcatattttaagcgtgcctgtgtctgagacagcgtatcctggccagacccagtaccagactcttcagcaaacacaaccgtacgcagtgtaccctcaggctacacagacttacggtctgccacccttcgcgagcagcacaaatgcctcactgattagtaccagcagtacaattgcaaacatcccggcagctgcggtagcaagtatatccaaccaagactaccccacctacactattctcggtcaaaaccagtaccaggcatgctaccctagctcttctttcggggttacaggccaaacaaactcagatgccgagtccacgactttagcggctacaacgtaccagagcgaaaaacctagcgtcatggcccctgctcctgccgcacaacggttgagctccggagacccgagcacaagtccctctctcagtcaaacaaccccgagcaaggacacggacgatcagtcacgaaagaatatgacgtcaaagaaccggggtaaacgtaaagctgacgccacatcgtctcaagacagcgagcttgaacgggttttcctttgggatctcgacgaaacgatcatcatctttcactctctcctgacgggttcatatgcacagaaatacggcaaggaccctaccgtggtgattggctccgggttgactatggaggaaatgatctttgaggtggctgacacccatctgttctttaatgatctcgaggaatgtgaccaagtgcacgtagaagacgtggcctcagacgataacggccaggatctgagtaactactcattttcaactgatggctttagtggaagcggcggtagcgggtcccacgggtcaagtgtgggagtgcagggcggtgtggactggatgcgcaaactagccttcaggtaccggaaagtcagagagatttatgataagcacaagagtaacgtcggcggactgctgagtccacaacgaaaagaagctttacagaggttgcgcgctgaaattgaagtgctgactgactcttggctcgggaccgctctcaagtccttgttgctcatccagtctcgcaaaaattgtgtgaacgttctaatcaccaccacccagctcgtcccggcactggctaaagtcctgctctatgggctcggcgagattttccctattgaaaatatctattccgctaccaaaatcggcaaggaatcatgttttgagcggatcgtatcacggttcggaaagaaagtgacatatgttgttattggagacgggcgagacgaggagattgccgctaagcaacacaatatgcctttctggagaatcacaaatcacggcgacttagtctctctgcaccaggccctggagctagacttcctctag

SEQ ID NO: 222686 - DNA, 1563 bp, Artificial Sequence
  Description of Artificial Sequence: Synthetic coding sequence
atgacttgcaccgattatattccccgttcttcaaatgattatacaagccagatgtactctgctaaaccctatgcccacatcctgtcggtacccgtcagtgagaccgcatatccagggcaaacgcaataccaaacattgcagcagacacagccctacgctgtttaccctcaggcaacccagacatatggcctgcctccatttggagcgctctggcctgggatgaagccggaatctggacttattcagacccctagtcccagtcagcattctgtactgacgtgtactaccggactgaccaccagccagccctcacccgctcactactcttacccaatccaggccagcagcacaaatgcttcactgattagcaccagcagtaccatcgctaacattcccgcagcggcagtagcatcaatttccaaccaggattatccgacctacaccatcctcggtcagaaccagtatcaggcgtgctatcctagcagttccttcggcgtgacaggtcagaccaacagcgatgcggagtcaaccaccctggctgcgactacataccagtccgaaaagccttcggtcatggctcccgcaccagctgctcagcgactaagcagcggcgacccgtcaacctcgccttctcttagtcagaccacaccctccaaggacactgacgaccagtctagaaagaatatgacctcgaagaatcgaggtaagaggaaggccgatgctacttcatcccaagactccgaactggaaagggttttcctgtgggacctggatgagacgattattatatttcacagcctactcaccggatcttatgcacaaaaatatggcaaagatccaacggtcgttattgggtctggtctgacaatggaggaaatgatatttgaggtcgccgacacccatctgttcttcaatgatctcgaggagtgcgatcaggtgcacgtggaggatgtcgctagcgatgacaatggacaagacctgagcaactactctttctcaaccgacgggttctccgggtccggaggatctgggtcacatggttcatccgtcggagtgcagggaggcgtagactggatgcgaaaactggcctttcgctacaggaaggtccgtgaaatctacgataagcacaaatccaatgttgggggactccttagtccccagcgcaaggaagcgctacagagactgagggctgagattgaagtactgacagattcttggctcgggacggccctcaaatctctcctattgatccaatcaagaaagaactgcgtcaacgtcctaatcacaaccacacagctcgtgcctgctctggccaaggtgctgttatacggcctgggggagatctttccaatcgaaaacatctacagtgccaccaaaatcggaaaggaatcatgttttgaaagaatcgtctctcgcttcggaaagaaggttacttatgtggtcatcggggatgggagagacgaagagattgcagccaaacagcacaatatgcccttttggaggatcaccaatcatggggacctggtgtcattgcatcaggctctcgaattggatttcctttag

SEQ ID NO: 222687 - DNA, 1920 bp, Artificial Sequence
  Description of Artificial Sequence: Synthetic coding sequence
atggaggattctcaggacctgaatgagcagagcgtaaaaaaaacatgtacagaatccgatgtgagccagtcccagaactctcgctctatggagatgcaagatctggcatccccccacacactggtggggggaggagatacccctggttcttcgaagcttgagaagtcaaatctgtcgtccacttccgtaaccacaaatggcacaggcggagaaaatatgacagtactgaacaccgccgactggcttctgtcttgcaacacaccaagttctgcaacaatgagtctgctagcagtcaaaaccgagccgctgaattctagtgaaactactgccacaaccggagacggtgccctggacacctttaccggttctgtgattacaagcagtgggtatagcccgagatcggctcaccagtattccccacagctctacccctccaaaccatatcctcatatcctgtcgactcctgcagcacagaccatgtccgcctatgccggacaaacccagtattctggaatgcagcagcccgctgtgtacacggcgtactcccagacagggcaaccctacagcctcccaacgtacgaccttggcgtgatgttgccagccatcaagaccgagtcgggcctcagtcaaacccagtcccctctgcagtccgggtgcttgagttacagcccagggttttccaccccccagcccggtcagacaccttactcctaccagatgcccggaagctccttcgccccttcaagtactatatacgccaacaatagtgtgtctaactccacaaacttctctggatctcagcaggactatccatcatacaccgcttttggccagaaccaatacgcccaatattacagcgcctcgacatatggagcgtatatgacttctaacaacaccgcggatgggacaccgtcgtccacctctacctaccagctccaggaaagcctcccaggtctcaccaatcagcccggagagttcgacaccatgcagtccccatcaacccctatcaaggacctcgatgagcgaacatgccggagcagtggtagcaaatcacgcggacgaggacggaagaataaccctagtccacctccggattccgacctggagagagtctttgtctgggatctggacgagaccattatcgtttttcacagcttgctgacaggcagctacgcacagaagtatgggaaggatcctcccatggcagtgacccttggtctccgcatggaagagatgattttcaacctggcagatactcatctgtttttcaatgatttagaggagtgtgaccaggtgcacatcgatgacgtgagctctgatgataatggccaggatctctccacgtattccttcgcaacggatggattccatgcagcagcatctagtgccaacctctgcctaccaacaggagtgcgcggaggcgtggattggatgagaaagttggccttcagataccggagggtgaaagagctatataacacttacaagaacaatgtcggaggactcctgggcccagctaagagggatgcctggctccagctgcgtgccgagatcgaaggtctgaccgacagctggctgacaaacgcactgaagtccctctccatcataagtacccgtagcaattgtatcaatgttctggttactactacccaattgattcccgcacttgcgaaagtgctgttgtactctttgggcggtgcttttcctatagagaacatttacagcgcaaccaagattggcaaggaatcatgctttgaacgaattgtcagtagatttggcactaacatcacctacgtcgtgattggggatgggagggatgaagaacacgctgccaatcagcataatatgcctttctggcgcatctccagtcatagcgacctgctggccctacaccaggctctagagttggagtatttatag

SEQ ID NO: 222688 - DNA, 1851 bp, Artificial Sequence
  Description of Artificial Sequence: Synthetic coding sequence
atggaagactcccaggacctgaatgaacagtctgtgaagaagacatgcacagagtcagatgtctcacagagccagaattcaaggagcatggagatgcaggacttggcatctccccatacgctggttggcggtggggatacacctggcagctctaaactcgaaaaaagcaacctgtcttccacttctgttactacaaatggaactggcgtctcactcctggcggtgaaaaccgagcctctgaatagcagcgaaacaaccgcgaccaccggcgatggcgcactggacacctttacaggatcagttattacttctagtgggtacagccctcgttcagctcatcaatactcaccacagctgtatcctagcaaaccctatcctcatatactctctacgcccgctgcacagactatgagcgcctacgcaggtcagacacagtacagtggcatgcaacaaccagctgtgtacaccgcatactcccagacgggccagccttactcgttgccgacgtatgatctcggcgtaatgctgcctgccattaaaaccgagagcggactgtcacaaacccagagcccacttcagtctggatgtttgtcttactcccctgggttctctactcctcagcccggacagaccccatattcgtaccaaatgcccggatcttccttcgccccatccagtactatctacgccaataacagtgtgagcaactccacaaacttctcaggctcccaacaggattacccatcctacactgcgtttgggcagaaccaatacgcccagtattactccgcttctacctacggagcctacatgacctctaataatactgccgatggaaccccttccagtacgtccacatatcagctgcaggagagtctgccaggattgaccaatcaacccggtgagtttgatacgatgcaatccccaagtacgcccatcaaagatttggatgagcgcacctgcaggtcatcaggctctaagtcccggggtcggggtaggaagaacaacccttcccccccacccgattccgatctcgagcgagtattcgtttgggatcttgatgagaccattatcgtgttccactctctgctgaccggatcatacgcccagaagtacggtaaggaccctcctatggcggtgacactggggttgaggatggaagaaatgatcttcaacctggccgatacgcatcttttcttcaacgatctcgaggagtgcgatcaagtgcacatcgacgatgtgagtagcgatgataatggacaggatttaagcacatacagttttgcaacagacggcttccatgcagcagcatcaagcgctaacctgtgcctccctaccggggtgcggggtggggtggactggatgcgaaagctggctttccggtaccgccgtgtcaaagaattgtacaacacttataaaaacaatgtaggcggacttctcggcccagccaagcgcgatgcctggctgcagctcagggcggaaatagaagggctgactgactcttggctcacaaatgctctgaagagcctgtcaatcatatccacccgaagcaattgcatcaatgttttggttactactacccagctgatccctgccttggcgaaagttctgttatattccttgggcggagcgttccctattgaaaatatatactcagctactaagattggtaaagagtcttgctttgagcgaattatgcagcggtttgggagaaaggtcgtgtacgtcgtaattggggatggtgtggaagaggagcaggctgccaagaagcataacatgcccttttggcgtatctcaagccatagcgacctgctggctttgcatcaggctctcgaactggaatacctctag

SEQ ID NO: 222689 - DNA, 1920 bp, Artificial Sequence
  Description of Artificial Sequence: Synthetic coding sequence
atggaggatagccaggaccttaacgagcagagtgtcaagaaaacgtgcaccgagagcgacgtgagccagtctcagaacagccggtcaatggaaatgcaggatttggcctcgccacacaccctcgtgggtggtggtgacacccctggatcttccaagctggaaaaatctaatcttagttccacatcagtaaccactaacggcacaggaggcgagaacatgaccgtcttaaacacagctgattggctgctgagctgcaatacacctagtagcgcgaccatgtccttgctggcagtgaagacagagcctctgaactctagtgagacaactgccaccactggggacggcgctctggatacgttcacagggtccgtaatcacaagcagcggctattcaccacgcagcgcgcaccagtactcccctcagttatacccatccaaaccttaccctcacattttgtcaacaccagctgcccagacaatgagcgcgtacgctggacagacccagtactcaggaatgcagcagccagctgtttacaccgcctattctcaaacaggccagccctacagtctccccacctacgaccttggcgtgatgttgccagccatcaagacagaatctggcctctcgcagacccaatcccctctgcaatctgggtgcctgagctactctcccggattcagcaccccacagcctgggcagactccttactcctatcagatgcccggtagctcctttgctccctcctccacaatttatgcaaacaatagtgtttcaaacagcactaatttctcaggctcacagcaggattatccgagctatactgcttttgggcagaaccagtacgcccagtactattcagcttcaacctatggagcttatatgacttcaaacaacaccgctgatggtaccccgtcgtccacctctacttaccagttacaggaaagcctcccgggtttgaccaaccagcctggcgagtttgacaccatgcagagtccctctactccaatcaaagaccttgacgagaggacctgtcgatctagtggctctaagagtcgcggtaggggcagaaagaataacccgagccctcctccagatagcgatttagagcgagtgtttgtttgggacttagacgagactataattgtgttccatagtcttcttacagggtcctatgcccagaagtatggcaaagatccacccatggctgttacactagggctcagaatggaggaaatgatctttaatcttgctgacacccatctcttctttaatgacctcgaagaatgtgaccaggtgcacatagatgatgtcagtagcgacgacaatggccaggacctctctacatacagctttgcaaccgatggctttcacgcagcggctagtagcgcaaacctctgtcttcccactggggtgcgtggtggtgtggattggatgcggaaactcgccttccggtaccggcgtgtcaaggagctgtacaatacttataagaacaacgttggaggtctgctggggcctgccaagagggatgcatggctccaactgagggccgagatcgagggactgacggactcatggctgacaaacgccctgaaatccctgtccatcataagcaccagaagtaactgtattaatgtcctggtgactactacgcaactcatcccggctctggccaaagtcctgctttactctctgggcggtgcgttccccattgagaacatttatagtgcaacaaaaattggaaaagagagctgttttgagaggatcatgcagcgtttcggtcgcaaggtggtgtacgtcgtaattggtgatggcgtggaagaggagcaggcagcaaaaaagcataacatgcccttttggcgcatcagtagccatagtgatctgctcgccctgcaccaggctctagaactggagtacctttag

SEQ ID NO: 222690 - DNA, 9497 bp, Artificial Sequence
  Description of Artificial Sequence: Synthetic coding sequence
atgactgataagtccattgtgatactgtccctcatggtgttccacagtagctttatcaatggtaaaacctgcaggaggcaacttgttgaggagtggcaccctcagcccagttcttacgtcgtcaactggacacttactgagaatatctgtttggacttctatagggactgctggtttctgggagttaacacgaaaattgatacgtcagggaaccaggccgtgccgcagatctgccctctgcagatccagctgggtgacatcctcgttattagtagcgaaccgtctctccagttccccgaaattaacctgatgaacgtctccgaaacatcatttgtagggtgtgttcagaacaccacaactgaggaccaactgctatttggctgccgactaaaggggatgcacaccgtcaacagtaaatggctaagcgtggggacgcactacttcatcactgtaatggcctcaggcccaagtccgtgcccgctgggcctcagactgaatgtgactgtgaagcagcagttttgtcaggagagcctctcttccgaattctgcagcggtcacggaaagtgtttgtccgaggcatggagcaaaacttacagctgccactgtcagcctccattttctggcaagtattgccaggaattagatgcatgcagcttcaagccttgcaaaaacaatggctcgtgtattaacaagcgggagaactgggacgagcaggcctacgaatgcgtttgccatccgccattcaccgggaaaaactgcagcgaaatcattggtcaatgccaacctcacgtgtgcttccacgggaattgctccaacatcacgagcaatagttttatttgcgagtgtgacgaacagttctccggaccattctgtgaggtatcagcgaagccatgcgtaagcttgttattctggaaacgcggtatttgcccaaatagctctagcgcgtatacatatgagtgccccaaggggtcaagcagccagaatggagagacagacgtctcagaattcagtctggtcccatgtcaaaacggaaccgattgtatcaaaatctccaatgacgtaatgtgtatttgttcccctatctttaccgacctgctgtgcaaaagcatccagacgtcctgcgaatcctttccccttcggaataacgccacatgcaagaaatgtgagaaagactatccatgtagttgtatctcaggctttacggagaagaattgcgagaaggccatcgaccactgtaaacttctgagcattaattgtctcaacgaagaatggtgctttaatattattggtcgcttcaagtacgtttgcatccccggttgtaccaagaatccttgttggtttctgaagaatgtgtatttaatacaccagcacctctgctactgcggcgtgaccttccacggaatctgtcaggataaggggcctgctcagttcgagtatgtctggcagttggggttcgctgggagcgaaggagagaaatgtcaaggtgtgattgacgcctactttttcctggctgcaaattgtactgaagacgccacctatgttaatgatcccgaagacaataactcatcttgttggttccctcacgaggggaccaaggaaatctgtgctaatggctgttcttgcctgagtgaagaggactcccaggagtacaggtatctgtgcttcctgcgatgggcgggaaacatgtacttagaaaatacaaccgacgaccaggagaacgaatgccagcatgaggcagtatgtaaagatgagatcaacagacctcggtgctcatgttcactgagttatattggcagactttgtgtggttaacgtcgactactgcctgggcaaccactcaatctcagtccacggtctgtgtttagcactgtcccataattgcaattgtagtggcctccagagatacgaacgaaatatatgcgagattgacaccgaggattgcaagtcagcctcttgtaaaaatggcaccacatctacccacctgcggggttattttttccgaaagtgcgttccaggatttaaaggcacgcagtgtgagatagacattgatgagtgtgctagccacccatgcaaaaacggcgcaacatgcatcgaccagcccggtaactacttctgtcagtgcgttccacccttcaaggtggtcgacggattctcatgcctgtgcaacccaggatatgtcggaattcgctgcgagcaggacatcgatgactgcatcctgaatgcatgtgaacacaacagcacctgtaaggacctccatttaagctaccagtgtgtgtgtttgagtgactgggaaggaaacttttgtgagcaggagagcaacgaatgcaaaatgaatccatgtaagaataatagtacctgcaccgatctctacaagtcctacagatgtgaatgtacctcgggctggaccgggcagaactgctctgaagaaattaatgaatgtgatagcgacccctgcatgaacgggggattgtgtcacgagagcacgattccgggtcagtttgtctgcctttgtccacctttatacaccgggcagttctgtcatcagcgttataacttgtgcgatctactgcacaatccctgtcggaacaattcgacctgtctggcacttgtcgatgccaaccagcactgcatctgtcgggaagaatttgagggcaagaattgtgagatcgatgtgaaggactgtttgtttctttcctgccaggattatggggattgcgaggacatggtgaacaacttccgctgtatttgcaggcctggcttcagtggaagtctgtgcgaaattgagatcaacgaatgcagctcagagccatgcaagaacaatgggacatgtgtcgatctaacaaaccggtttttctgcaattgtgagccagagtaccatggccctttctgcgaactcgatgtaaacaaatgcaaaatcagtccctgccttgatgaggaaaactgcgtttacaggactgacgggtataattgtctctgcgcgccaggctacaccggtatcaactgtgagataaacctcgacgagtgtctgtccgagccctgccttcatgacggcgtatgtatcgacggcataaatcattacacatgcgactgcaagtccggattttttggcacccactgcgagacgaacgccaacgattgtctgagcaatccatgtctgcatggacgctgtactgagctgatcaacgaatacccctgttcctgcgatgccgatggtacgtccacgcagtgcaagatcaagataaacgactgcacatccatcccctgtatgaatgagggcttctgccagaagagtgcacacggattcacgtgcatctgtccacgaggttatacaggagcgtattgcgaaaagtcgatcgacaattgcgccgaaccagagctgaactccgtgatttgtctaaatggagggatctgcgttgacggccctgggcacacatttgattgccgctgtctgcccggattcagtgggcagttttgcgaaatcaatatcaatgagtgctctagcagcccttgtctccatggcgctgactgtgaggatcatatcaacggctacgtctgtaagtgtcagccaggttggtctggtcaccactgtgagaacgagctggagtgtatcccaaacagttgtgtgcatgagctttgcatggaaaacgagcctggatcaacatgtctgtgtacccccggattcatgacctgtagtatcggtctgttgtgtggggacgaaatccgcaggataacgtgcttgactccaattttccaacggacagatcctatttcaactcaaacgtacaccattcccccatcagagactctggtgtcctcctttccttccattaaggccacacggattccggcaatcatggatacttatcccgttgaccagggtcccaaacagactggaatagtgaaacacgatatattgccaacaactggccttgcgacgctgcggatctccacccccctggaatcttaccttctccaagaattgatcgtgaccagagaacttagcgcaaagcactctctactgagctctgcagatgtgtcctcatcccggttcctgaatttcggaatcagggatccggcacagatcgtgcaggacaaaacctccgtttctcatatgcctatcagaacttctgctgcaactcttggcttctttttccccgatagaagggcgaggacaccatttattatgagttccctcatgagcgactttatcttccccacccagtctctgctgtttgagaattgtcagacagtggccctgtccgcgacacctacgaccagtgtgatcaggtccatccccggagccgacatagagctaaatagacagagcctgctctctagggggtttttattgatcgctgcctcgatctctgcaacccccgttgtgagcaggggggctcaggaagatatcgaggaatattctgcggacagtttaatcagcagacgagagcactggagactgctctcgccttccatgagccctatatttcccgcaaaggtaattatttccaagcaagtgaccattcttaattcttccgccctgcacagattttcgaccaaggcctttaacccatccgaatatcaagccatcacagaggcgtcgtccaaccagagattaaccaatatcaaatcccaagcagccgacagcctccgagaactgtcacaaacctgcgccacctgcagcatgacggagatcaagtccagccgcgaattcagtgaccaggtactacattcaaagcagtctcatttttatgagactttttggatgaattcggctattctggcgagttggtatgctctcatgggtgctcagaccatcactagtggtcactcattcagttctgcaacagaaattaccccatccgtagcatttactgaggtcccgtccctgtttccctctaagaaatccgccaagcggacaatcctgagttcctctctcgaagagagtatcaccctctcaagcaatctagatgtgaacttgtgcctcgacaaaacatgcctgtcgattgtcccaagccagaccatctcaagtgacctcatgaacagtgacctcacgagcaaaatgacgacagacgaactcagcgtttctgagaatattttgaagctattgaagataagacagtatggtatcacaatgggtcccaccgaggtgctgaaccaggagagcttgctcgacatggaaaagagcaaaggttcgcacacactattcaagctgcacccctctgattctagcctcgatttcgaactgaatctgcagatctaccctgacgtcaccctcaaaacctatagcgagattacgcacgcgaacgactttaagaataacttgccacctttaactgggtctgtgcccgacttctccgaggtcacgaccaacgtggctttttacaccgtatctgccacccccgctctttcaatacaaacctcctcctcaatgtccgtgattcgacctgactggccctacttcaccgattacatgacctcgctgaagaaagaggttaaaactagttccgagtggtccaagtgggagcttcagccgagcgtccagtaccaggaattcccaacggcctcaagacacttgccattcacgcggtcattaaccttgagcagcttggagtcaattttggcccctcagagactgatgataagcgacttttcctgcgtccgctattatggcgactcttaccttgaatttcagaatgtggccttgaacccacagaacaatatctctctagagtttcaaaccttctcaagctatggtctgctgctttatgtgaagcaggacagcaatcttgtggatggattcttcatccagttgttcattgagaacggaaccctgaagtaccatttctattgtcctggtgaagccaagtttaagtctatcaatacaaccgtgagggtggacaacgggcaaaaatataccctgctgattagacaggaactggatccgtgtaacgccgaactgaccatactaggtagaaatacacagatttgtgagtccattaaccacgtgctgggcaagcccctgcccaagtcaggctccgtctttattggcggattccccgatctccatggaaagattcagatgcccgttcccgtgaagaattttactggctgcatcgaagtgattgaaataaacaactggcggtctttcatcccttcaaaggctgtgaaaaattatcacattaacaactgcaggtcccagggattcatgctctccccgaccgcatcatttgtggatgcctccgacgtcacacagggtgtggacactatgtggacgagcgtgtctccctctgtggctgctccttctgtttgtcagcaagatgtgtgccataacggaggaacgtgccacgccatctttctgtcttccgggatcgttagtttccagtgcgactgcccactgcacttcactggtagattctgtgaaaaggatgcagggctgttttttcccagctttaatgggaactcttatctcgagctccctttcttgaagtttgtgctggagaaggaacacaacaggactgtgaccatatatctcactataaaaacgaacagccttaacggaaccatcctgtactctaatggtaacaattgcggaaagcagttcttacatttgtttttggtcgaaggccgaccatctgtgaagtatggctgcgggaactcgcagaacatactgactgtgagcgcaaactacagcatcaatacaaacgcctttacaccaatcactatccgttacactaccccagtcggcagcccaggagttgtatgcatgatagagatgaccgccgatggcaagcctccagtgcaaaaaaaagatactgaaatctcccatgccagtcaagcgtacttcgagtctatgtttctcggtcatatccctgcgaacgtgcagatccacaaaaaggctgggcctgtgtacggtttccgcggatgcatcctcgacctgcaggtcaacaataaagagtttttcatcattgacgaagcacggcatggtaaaaacatcgaaaattgtcatgttccctggtgtgctcatcatctatgtagaaacaatgggacctgtatttccgacaacgagaatctcttctgcgagtgccctcggctgtattcaggaaaattatgccagttcgcgtcgtgcgaaaacaacccttgtgggaatggtgcgacatgcgtccccaagtccgggaccgatatcgtttgcctctgcccttatgggagatctggccctctgtgcactgacgcgattaatatcacccaaccgaggtttagtggcactgatgccttcgggtatacaagcttccttgcgtatagcaggataagcgacataagcttccattatgagttccatctaaagtttcaacttgccaataaccattcagccctccagaataacctcatcttctttactggacaaaagggtcacggacttaacggagacgactttctcgcagttggcctgttgaatggcagtgtggtgtacagctacaatttgggctccggtatcgcctccatccggtctgagcctcttaatctgagcctcggcgtgcatacagtgcacttgggcaaattcttccaagaaggttggctgaaagtcgatgatcacaagaataagagtatcattgctccgggtagacttgtcggactaaatgtctttagccagttctatgtggggggttatagcgagtatactcccgatctgttacccaatggcgcagattttaagaatgggttccaggggtgtattttcaccttacaagtgaggacagagaaagacggacacttccggggtctaggaaaccccgaaggccacccaaacgctgggaggagcgtaggccagtgccatgcctcaccttgctctctgatgaagtgtggtaacgggggaacctgcatcgaatcaggaacaagcgtttactgtaattgtaccactggctggaaaggatccttctgcacagagactgtgtccacatgcgaccccgagcacgatcccccacaccactgctcacggggtgccacatgcatctccctgccccatggctatacttgcttctgtccactgggaacaaccgggatctattgtgaacaagcactgattctgatcgtgatactcgagaaacctaaaccagcggaacgaaaggtgaagaaggaagcactgtcaatcagcgacccaagctttcgatctaatgaactttcctggatgtcgtttgcttccttccacgtacgcaaaaaaacacatattcagctccaatttcagcctctcgctgctgacgggatcttgttctatgctgcccaacacttgaaggcgcagtcgggtgattttttgtgcatctccctcgtgaacagttctgtgcaattgagatacaatttaggggatcgcacaatcatccttgagacccttcagaaagtgacgattaacgggtccacttggcatattatcaaggctggaagagtgggagccgaggggtatctggacctggacgggattaacgtgaccgagaaggcgagtactaagatgagctccctagacacaaacacagacttttacataggaggagtgtccagcctgaatttagtaaacccaatggcaattgaaaacgagcccgtaggcttccaagggtgcattagacaggtcatcatcaacaaccaggagctccagctgactgagttcggtgctaaggggggatctaatgtgggagactgcgatggcacagcttgcggttataacacatgccgcaatggcggagaatgtaccgtaaacggaacgactttcagttgcagatgtctgcccgactgggccggtaacacatgcaaccagtcagtaagctgcctgaacaacctttgcctgcaccaatctctgtgcatcccggatcagtcattttcgtatagttgcctatgtactctcgggtgggttggacgctactgtgaaaacaaaacatctttcagtaccgccaaattcatgggtaatagttacattaagtacatagatccaaactacaggatgcggaacctgcaattcacaactatttcactaaacttcagtactaccaagactgagggcctcatcgtatggatgggaatcgcgcaaaacgaggaaaacgattttctggcgatcggtctccacaaccagactcttaagatcgccgtgaacctgggggaaaggatcagtgtgcctatgagctacaataacggcacattttgctgcaacaaatggcaccatgtcgtagttattcaaaaccagactttaattaaggcttatatcaataactccctaattctatctgaggatattgacccacacaagaacttcgtggccctcaactacgacggaatctgctacctgggcggattcgaatacggaaggaaggtgaacatcgtaactcaggaaatttttaagactaacttcgtcgggaagattaaagatgttgtcttcttccaggaacctaagaatatcgagctgatcaagttggagggctataacgtctatgacggcgacgagcagaatgaagtgactta

SEQ ID NO: 222691 - DNA, 1785 bp, Artificial Sequence
  Description of Artificial Sequence: Synthetic coding sequence
atgaccgataaaagtatcgtcattctcagtctgatggtgttccattctagcttcatcaacggtaaaacatgtcgaagacagctggttgaagaatggcacccccagccctcctcttacgtggtaaattggaccctgaccgaaaacatctgcctggacttttaccgggattgttggtttctaggagttaatactaaaatcgacaccagcggtaaccaagcggtcccacagatatgtcctctgcagattcaactgggggacatcctggtgatctcttctgaacctagcctccagtttcccgaaattaatctcatgaacgttagcgaaaccagttttgtgggttgtgtgcagaatactactactgaggatcagctcctgtttggctgtaggctgaaaggtatgcacactgtaaattccaagtggctctctgtgggaactcactactttattacagtgatggccagcggcccaagtccttgtcccttagggctccgcctgaacgtcactgtgaaacagcagttttgtcaggagagcttatcttccgaattctgttcgggacacggcaaatgcttgagcgaagcctggagcaagacttactcctgccattgtcagcctcctttttctggcaagtactgtcaggagctagacgcctgttcctttaagccatgcaaaaataacgggagttgtataaacaagagggaaaattgggacgagcaagcttacgagtgcgtgtgccaccccccattcaccggcaaaaattgttcagagatcattggtcagtgtcagccacatgtctgttttcacggaaactgttccaatatcacaagcaatagtttcatttgtgaatgcgatgagcagtttagtggtcccttttgcgaagtttccgccaaaccctgcgttagtcttctgttctggaaaaggggcatctgtccaaactcttccagtgcgtatacgtacgagtgtcccaaaggttctagttctcaaaacggagagactgatgtatccgagttttctctggtaccctgccagaatgggaccgattgtattaaaatctctaacgacgtaatgtgcatctgttcaccgatatttacagatcttctttgcaagtccatccagacatcatgtgaatcatttccactgagaaacaacgcgacttgcaagaagtgcgagaaggactacccatgcagctgcatttctggctttactgagaaaaactgtgagaaagctatagaccactgtaagttactgtccattaattgcctgaacgaagagtggtgcttcaatattatcggcagattcaagtacgtctgtattcccggatgtaccaaaaacccgtgctggttcctgaagaacgtttatctgatccaccagcacctgtgttattgtggcgtcaccttccacggcatctgtcaggataaaggccctgcccagttcgagtacgtatggcagctgggtttcgctggatccgagggggaaaagtgccaaggcgtgatagacgcctacttctttctggctgccaattgtactgaggacgccacctacgtcaatgatccagaagacaacaactcctcttgctggtttccacacgagggcacaaaggagatttgtgccaacggctgttcctgtctcagcgaggaggactcacaggaatacagatatttatgcttcctgaggtgggcagggaacatgtatctggaaaacacgacagacgaccaggaaaacgagtgtcaacacgaagccgtatgtaaggatgagataaatcgcccaaggtacctgtgtatcatttag

SEQ ID NO: 222692 - DNA, 9497 bp, Artificial Sequence
  Description of Artificial Sequence: Synthetic coding sequence
atgacagacaagtctatagttatcttgtctttgatggtatttcatagtagctttatcaacgggaaaacttgccgcagacagcttgtggaggaatggcatcctcaaccttcatcttacgtggtgaactggacactcacagaaaatatctgccttgacttctatagggattgctggttcttgggtgttaacactaaaatcgacaccagtgggaaccaggcggtcccccaaatatgtcccctgcagatacaactgggggatattctggtgatttcctctgaacccagcctgcagttccctgagattaacctgatgaatgtgtccgaaacaagcttcgtgggctgcgtacagaacaccactactgaggatcagctgttgtttggatgtcgcctaaaaggtatgcatacagtgaattctaagtggctatctgtcggcactcattacttcatcactgtgatggcgtctggcccaagcccctgccctctggggctcagactgaacgttaccgtaaaacagcaattctgtcaggaaagtttaagctcagagttttgcagcgggcatggcaaatgcttaagtgaagcttggtccaaaacgtactcatgtcactgtcaaccacctttctccggtaaatactgccaggagctcgacgcgtgtagttttaaaccctgtaagaacaacggctcctgcattaataagcgagagaattgggacgaacaggcatacgaatgcgtgtgccacccaccgttcacaggaaaaaattgttccgaaatcatcgggcagtgtcagccgcacgtgtgtttccatggaaactgctcaaatattacaagcaacagctttatttgtgaatgcgatgagcaattctcagggcctttctgtgaggtgtcggccaagccgtgcgtgagtctcttattctggaagaggggcatttgtcccaactcgtcttccgcatacacttacgagtgtcctaaggggagctcttcccagaacggggagacggacgtaagcgaattttctttggtgccatgtcagaacggcacagactgcattaagatctctaatgatgtaatgtgcatctgcagccccatctttaccgatcttctttgtaaatccattcaaacctcctgcgaatcttttccactgcggaacaatgcgacctgcaagaagtgtgagaaagactacccctgctcatgtatatccggctttacagaaaaaaattgcgaaaaggcaatagaccattgtaaacttctctctataaactgcctaaacgaagaatggtgcttcaacataattgggaggtttaaatatgtgtgcattccaggatgtactaagaacccatgctggttcctgaaaaatgtgtacctgatccaccaacatctttgttattgcggcgtaaccttccatggcatttgtcaagacaaaggacccgctcagttcgagtacgtgtggcaactgggtttcgcaggctctgagggtgagaagtgtcagggcgtaatcgacgcatacttctttctggccgcaaactgcaccgaagatgctacatatgtgaacgaccccgaggataacaactcctcttgttggtttccccatgagggcaccaaggaaatctgtgccaatggctgttcttgtcttagtgaagaagactcccaagaataccggtacctgtgcttcctcaggtgggcagggaatatgtacttggaaaataccaccgacgaccaagaaaacgaatgtcagcatgaggcagtgtgcaaagatgaaataaatcggccaaggtgctcctgcagtttgagttatataggaaggctgtgcgtagtcaacgtcgattactgtttgggcaaccatagtatcagcgttcacgggctgtgtctggccttaagtcacaactgcaactgctcaggactccaacggtatgagaggaatatctgcgagatagacaccgaggactgtaaaagcgcaagctgtaagaacgggacgacctcaacccatctcagggggtatttctttcgaaaatgtgttccaggattcaagggaacgcagtgtgagatcgacattgacgaatgtgcttcccacccatgcaagaacggcgctacgtgcatcgatcagcccggaaactacttttgtcagtgtgtccctcctttcaaggttgtcgatggcttctcctgtctatgtaatccgggatacgtgggaatcaggtgcgaacaggatattgacgactgtatacttaatgcctgtgaacacaatagcacctgcaaggacctgcatttgtcttatcagtgcgtgtgtctgtccgattgggaggggaacttctgcgaacaagaatctaacgagtgcaagatgaacccctgcaagaataacagtacctgtaccgatctttataaaagttatcggtgtgagtgtacctccgggtggaccggacagaactgttcagaagaaattaacgagtgtgatagcgatccgtgtatgaatggcggactttgccacgagtccactattcctggacagtttgtctgcctgtgtcccccattatacaccgggcagttctgtcaccaacggtacaacctctgtgatctcttgcacaacccgtgtcgaaataactccacatgtctggctttagttgatgctaatcagcactgcatatgccgcgaagagtttgaaggtaagaattgcgagattgacgtgaaagactgtctgttcctgtcttgccaagattatggcgattgcgaggatatggtgaacaatttcaggtgcatttgcagacccggatttagtggctctctctgcgagatcgagattaacgagtgttcgagtgagccctgtaagaataacggcacgtgtgtcgacctcacaaacagatttttctgcaattgtgaacctgagtatcacggtccattttgcgagttggatgtgaataaatgcaaaatatccccctgtctagacgaggagaactgcgtttacagaactgatgggtacaactgcctgtgtgccccaggatacaccgggattaattgtgagataaaccttgacgagtgcttgtccgagccttgtctgcatgacggagtgtgcatcgatggaatcaaccactatacctgcgactgtaagtccggctttttcggtactcattgtgagacaaacgctaatgactgtctatctaatccctgtttgcatggccgatgcaccgaactcatcaacgagtatccttgtagctgcgacgccgacggcacctccacacaatgtaagattaagatcaatgactgtaccagtataccctgcatgaatgaaggattctgtcagaaatccgctcacggctttacgtgtatttgtcccaggggttatacaggggcttactgcgagaaatctatcgacaactgcgccgagcccgaacttaactccgtcatttgtctgaacggtgggatctgtgttgatgggcctggtcacacatttgattgtcggtgcttgcccggtttctctggacagttctgcgaaattaatattaatgagtgctcctcaagcccatgtttgcacggcgctgattgcgaggatcatatcaacgggtatgtgtgcaagtgtcaaccaggatggagcgggcatcactgcgagaacgaactcgagtgcatcccaaactcttgcgttcatgaactgtgtatggaaaatgagccaggatctacatgtctttgcacacccggatttatgacttgtagcataggattgttatgtggcgacgagatccgaaggataacatgtttgacacctatcttccagagaacagatcctatctctacccagacctacaccattccgcctagtgagactcttgtatccagctttccatcaatcaaagctacacgaatacctgctatcatggacacttacccggttgaccaaggaccaaagcagacaggaatcgtgaagcacgacattctgccaacaacaggcctggctacattgagaatttccactcccctggaatcttacctgctacaggaactgattgtcactagagagctctcagcaaaacactcattgctgagctcagcggacgtctcctcaagtagatttctcaactttggtataagagatccagcccaaatagttcaggataagacttcggtaagccacatgcccatccgtaccagcgccgcaactttgggattcttcttccctgaccgtagagctagaacccctttcatcatgtcctccctgatgtctgacttcatattccctacccagtctctgctgttcgagaactgccagacagtagcactgtcagctacccctaccacatccgttatcagatctatcccaggggcagatatagagctgaatcggcagtcactcttgtcccgcggttttctcctgatagcagcctccatcagcgccaccccagtagtctctcgcggagcccaggaggatatcgaggagtactctgctgattctttgataagcaggagggaacattggcgcctgttgtctcctagtatgtctccgatcttccccgcaaaagttatcattagcaaacaggtaactatcctgaacagttccgccttgcacagattcagcacaaaggcctttaacccctctgagtaccaggcaataaccgaggcctcgagcaaccagagactcaccaatattaagagtcaagccgcagactccctgagggaattgagccagacctgcgcaacgtgctcgatgaccgagatcaagtccagccgcgagttttcggaccaggttctacactcaaaacaaagtcatttttatgagacattctggatgaactcagctatcctggcaagctggtatgcccttatgggggctcaaactataacttccggccacagcttctcctctgccacagaaatcacgccatcagtggccttcaccgaggtcccaagtttgtttccaagcaagaaaagcgctaagcgcaccatcctgagttcaagcttggaggagtccatcacactatcttccaatctcgacgtcaacctgtgcctcgacaagacttgcctgagcatagttccttcccagacaataagctctgacctaatgaatagtgatcttaccagtaagatgactaccgatgaactatccgtctcggaaaacatcctgaagctgctgaagattagacagtacggaataacgatgggaccgaccgaggtgctgaatcaggaaagtctcctggatatggaaaaatcaaaagggagccacaccctctttaagctacaccctagcgattcatcattggactttgagcttaatctccagatatatcctgatgtaactctcaaaacttattccgagataacccatgcgaatgattttaaaaacaatctgcccccactcacaggatcagtgcccgacttctcggaagtaactactaatgtggcattttacaccgtgtcggcaactccagcactctcaatccaaacttcgagctctatgagcgtgatacggccagactggccctattttaccgactacatgacatctctgaagaaggaggtcaaaacatcctctgagtggtcaaaatgggagttacagccttcagtgcagtaccaggagtttcctacagcatctcgccatctaccattcacccggtccctgacgttgagttcacttgagagcattctcgcaccccaacgtcttatgattagtgactttagttgcgtaaggtactatggggattcctatttagaattccaaaatgtggccttgaaccctcagaacaacatctctctggagtttcagaccttcagctcgtacgggttattgctgtatgtaaaacaggattccaatctggttgacggattctttattcagctgttcattgagaatggaacccttaaataccacttctactgtcccggagaggcgaagttcaagagcattaacacaaccgtccgagtggacaatggacagaaatatacactcttaatcagacaggagctagatccgtgcaacgctgagcttacaatcttgggcaggaatacacagatttgtgagagtattaaccacgtcctggggaagccgctgccgaagagtgggagtgtatttataggaggattcccagatcttcacgggaagattcagatgcccgttcctgtcaagaattttacaggctgcatagaggtgattgaaattaacaactggcgatctttcatcccctctaaagccgtgaagaactatcacatcaacaactgcagatctcagggctttatgctcagccccaccgcttcgtttgtcgatgcaagcgatgtaacacagggcgtggacacaatgtggacttctgtctctccatccgtggcagcccctagtgtctgccagcaggacgtgtgtcacaacggcggtacctgtcatgcaatatttcttagctctggcatagtgtcctttcagtgcgattgcccgcttcactttactggcaggttctgtgaaaaagacgccggtctgttctttccttcctttaacggcaactcttacctcgagctccccttcctgaagttcgtcctggagaaagaacacaatagaactgtgacaatctatcttacgatcaagacgaacagcttaaatggaactatcctgtattccaatggcaacaactgcggaaaacagttcctccatctttttctagttgaaggccgaccctccgttaagtacggatgcggaaacagtcagaatattcttacagtatcagcaaattatagcatcaacactaacgccttcactcccattacaatcagatatactacgcctgtcggcagcccaggagttgtttgtatgatcgaaatgacggccgacggaaagccacctgttcagaaaaaagacactgagatatcacatgcctctcaggcctattttgagtcaatgttcctagggcacattcccgctaatgtccagattcataagaaagccggtcctgtgtacggttttcgtgggtgtatattagacctccaggtcaataacaaagaatttttcatcatcgatgaggccaggcatgggaagaacatcgaaaattgccatgtcccctggtgcgcacaccacctgtgtagaaataatggcacatgcatcagcgataacgaaaacctgttctgcgaatgccccaggttatacagcggcaagctctgccagttcgcctcttgcgagaataacccttgcgggaacggcgctacatgtgtgcctaaatccggaaccgatatcgtgtgtctctgtccgtacggcaggtcagggcctctctgtacggacgcaataaatattactcaacctcggttttccggaaccgatgcatttggctacacctcattcctggcttattcacggattagcgatatttcttttcactatgaattccacttgaaattccagctggcaaataaccactctgctctgcagaacaatttgattttttttaccggccagaaaggacatggcctgaacggcgacgattttctggctgtgggcctactgaacgggagtgtagtgtattcttacaatcttgggtccggcattgcatccattcggtcagaacccctgaacctctccttgggcgtgcacacagtccacctcggaaaatttttccaggagggctggctgaaggtcgatgaccataagaacaaatccatcattgcccctggcaggctagttggtcttaatgttttttctcagttctatgtcggcggatatagcgagtacactccagacctgctgccgaatggcgctgattttaagaatggctttcaggggtgtattttcactctgcaggtaagaactgaaaaggacggtcactttaggggactcggaaacccggaagggcacccaaacgctggcagatcagttggccaatgccatgcgagtccctgcagccttatgaaatgcgggaatgggggaacctgcattgagagcggcacttcagtgtactgcaactgtaccacagggtggaaaggctccttctgcacagagaccgtgtcaacctgcgatccagagcacgaccctccacatcactgctcgcgcggtgccacctgtatttctctgccacatggttatacatgtttttgccctctgggtaccaccggaatctattgtgaacaggccttaattctgattgttatcctggaaaaaccgaagccggcagaaagaaaagttaaaaaggaggccctgagtatcagtgacccttcctttagaagtaatgagctgtcttggatgtcctttgccagcttccatgtgcggaagaagacgcatatccagctgcagttccagccgcttgctgcggatgggatcctcttttatgcagcccagcacctcaaggcccagtccggggactttctgtgtatctccctggtgaattcctccgtgcagctgcggtataatcttggggacaggacaataattctcgaaactctacaaaaagtaacaatcaacggatccacctggcatatcatcaaggccggacgggtcggagccgaaggatacctggatcttgatggcattaatgtaaccgagaaggctagtaccaagatgagtagtctggatactaatacagatttttatatcggcggtgtgagtagtctgaatctggtcaacccaatggctatcgagaatgaaccagtgggttttcagggctgtatcagacaggtcatcatcaataaccaggaacttcaactgaccgaattcggcgcaaagggcggttccaacgttggcgattgcgatggaacagcgtgtgggtataatacttgccgtaatggcggagagtgcaccgtgaacggcacaacgttttcctgcaggtgtttgccagattgggccggtaatacctgtaaccagagtgtgtcctgcctgaacaacctgtgcctccaccaaagtctttgtataccagatcagagtttcagctactcctgtctgtgcactcttggatgggttggcagatactgtgagaacaaaacctcttttagtactgctaagttcatgggcaacagctacataaaatacatcgatccgaactaccgtatgaggaatctgcaattcaccactattagtttaaacttcagcactactaaaaccgaaggattaattgtgtggatgggtatagctcaaaatgaagaaaacgatttcctggctatcggactccacaatcagaccttaaaaattgccgtgaatctcggtgaaaggatatctgttcctatgagctacaacaacgggacattttgctgtaacaaatggcaccatgtggttgttatccaaaaccagactcttattaaagcttacattaataacagtcttattctgagcgaggacatcgatccccacaagaatttcgtggctctaaactacgacgggatctgctacctcggcggtttcgagtacggtcgaaaggtgaacatagtaacacaggaaatcttcaaaacaaatttcgtgggaaagatcaaagacgtcgtgttctttcaggaaccaaagaatatagagctgataaagctcgaggggtataatgtttatgacggcgatgaacagaacgaggtcaccta

SEQ ID NO: 222693 - DNA, 9434 bp, Artificial Sequence
  Description of Artificial Sequence: Synthetic coding sequence
atgaccgataagtcaatcgtgatcttgtctctaatggtctttcacagtagttttatcaatggaaaaacatgccggcgtcaactcgtggaggagtggcacccccagccaagttcatatgtcgttaactggacattaaccgagaacatctgcctggacttttatagggattgttggtttctgggtgtgaacactaagatcgatactagcggtaaccaagctgtcccacaaatctgccccctccagatccaactgggagacattctggtgatctcctcagaaccctcactgcagtttcctgagattaacctgatgaacgttagtgagactagcttcgttggctgcgtgcagaatacgacaactgaagatcagctactgttcggctgtagactgaagggaatgcacaccgtaaacagcaagtggttgtccgttgggactcattacttcattacagttatggcctccggcccaagcccatgcccactcggattaaggttgaacgtgaccgttaaacaacagttctgtcaggagagcttgagctccgagttctgctctggacatggaaagtgtctatccgaagcttggtccaagacctattcttgccactgccagcctcctttctctggaaaatactgtcaggagttggatgcttgttcatttaaaccctgtaaaaataatggcagctgcataaataagcgggagaactgggatgagcaggcgtacgagtgcgtgtgccaccccccatttacaggcaaaaactgcagcgagatcatcggccagtgccagccacacgtgtgttttcacggaaactgctccaatattacttcgaattccttcatctgtgagtgtgacgagcagtttagcggacccttctgcgaggtcagcgctaaaccatgcgttagcctgctcttttggaaacggggtatttgccctaatagtagcagcgcttatacttatgaatgccctaaagggtcctcctcacagaacggggagaccgacgtaagtgagtttagtttggtgccctgccagaatggcaccgactgcattaagattagcaacgatgtgatgtgtatctgttctcccatatttacagatctgttgtgcaagagcattcagaccagttgcgagtcgttccctctgcgtaacaacgccacatgcaagaaatgtgagaaagattacccctgcagttgcatcagcggattcacagaaaagaactgcgagaaggcgatcgatcattgtaagctgctcagtataaattgtttgaacgaggagtggtgcttcaatataattggccgtttcaaatacgtctgtatcccgggatgcacaaaaaacccttgctggtttctcaagaatgtttatctaatccaccagcatctgtgctattgtggggtgacatttcacggcatctgccaagacaaaggacctgcccagtttgaatatgtgtggcagctgggctttgccggtagtgagggtgagaagtgtcagggcgtcatcgatgcatactttttcctggccgctaactgcacagaggacgctacatatgtgaacgatcctgaggataataacagttcgtgctggttcccccatgaagggaccaaggaaatctgtgcaaatgggtgcagctgtctctctgaggaagactcacaggagtaccggtatctgtgcttcctgaggtgggccggtaatatgtatctggagaacaccacagacgatcaagaaaatgagtgccagcacgaagccgtgtgcaaggacgagataaatcgccctcggtgctcatgttcgctgagctatataggacgattgtgtgtggtgaatgtcgattactgcttaggaaatcactcgatttccgtgcacggcctctgtctggccctctcccacaattgcaactgttcaggcctccagagatacgagcgcaacatctgtgagattgatacagaagactgcaagagcgctagctgcaagaacgggacaaccagcacacatctcaggggctacttcttccggaagtgcgtcccaggatttaaggggacacagtgcgaaatcgatatagatgagtgtgcctcgcatccctgcaaaaatggagccacatgcatcgaccagccaggaaactatttttgccaatgcgtgcccccatttaaggtcgtcgacggcttcagttgcctgtgtaacccgggatacgtcgggatccgatgtgagcaggatatcgacgactgtatactcaacgcatgcgagcacaactctacctgtaaagacctgcacctgagttatcagtgcgtctgtctcagcgattgggaggggaacttctgcgagcaggagtcaaacgaatgcaagatgaacccctgtaaaaataacagcacttgtaccgacctttacaaaagctaccgatgcgagtgtacctctggatggaccggccaaaactgtagtgaagaaatcaacgaatgcgatagtgatccctgcatgaatggaggcctgtgccacgagagcacaatcccgggtcagtttgtatgtttgtgcccacccctgtacactggacagttttgccaccagcgatataacctatgcgatttgctgcacaacccttgtcgtaacaattccacgtgcttggcattggtggatgctaaccagcattgtatctgcagggaggagtttgaagggaaaaactgcgagattgacgtcaaggattgtttattcctcagctgtcaggattacggcgactgcgaggacatggtaaacaacttccggtgtatctgtaggccaggcttctccggcagtttatgcgagattgaaatcaacgagtgctctagcgagccgtgcaagaacaatgggacttgcgtcgatctgacaaatcggtttttctgcaactgcgaacccgaatatcatggaccattctgcgaactcgacgtgaataaatgtaaaataagtccttgtttggacgaggaaaactgtgtataccggacggatggctacaattgtctttgtgcccctggttatactggaatcaactgcgagatcaacttggacgaatgtctgtctgagccgtgcttgcacgatggggtgtgcatagatggcatcaaccactatacatgtgattgcaagtctggcttcttcggaacccattgcgagacaaatgcgaatgactgcctttctaacccatgtctgcacggtaggtgcactgagcttatcaatgagtacccttgttcttgcgacgccgacggtacctccacacagtgcaaaattaaaattaacgactgcacttccataccgtgcatgaacgaaggcttttgtcagaagagcgctcatggtttcacctgcatctgccccagaggctacacaggagcttattgtgaaaaaagcatcgacaattgcgccgagcctgagctgaattctgtcatttgccttaatggagggatttgcgtcgatggaccagggcacacttttgactgtcggtgcctcccaggattcagcggccagttctgcgagattaatatcaatgaatgctccagctccccttgtcttcatggcgctgactgcgaagatcacatcaacggctatgtctgcaaatgtcaacctggttggagcggccatcattgtgagaatgaacttgagtgcatcccaaacagctgtgtccatgagctctgcatggagaatgagcccggatccacatgcctatgtacgcctgggttcatgacttgcagcattggactgctatgtggagatgaaatccggaggatcacatgtttaacaccaatctttcagaggacagacccaattagtacccagacctacaccatccctccatcggaaactctcgtttcttcattcccgagcataaaggcaactagaattcctgctataatggacacgtaccctgtggaccagggcccaaagcaaaccggaattgtcaaacacgatattctgcccacaacaggcttggctacccttagaatatctactcccctggagtcctacctcttgcaggagctgatcgtgactagggagctatcagcaaaacactctctgctctcctcagctgacgtgagctcatcacggttcctgaactttggaatcagggacccggcacaaattgtccaggataaaacaagtgtcagtcacatgccaattcgcacctcagccgcaaccttgggttttttcttcccagaccgcagagcaagaaccccctttattatgagctccctgatgtccgattttatatttccgacacagagcctcttgttcgagaactgccaaacagtcgccctgtctgcaaccccaactacaagtgtcataaggagcataccgggtgccgacattgagttaaatcggcaaagcttactcagtcggggattcctgttgatcgccgcttcaatctctgctacacctgtggttagcagaggggcacaggaggatatcgaggaatactctgccgatagtttaataagcaggcgagagcattggagactattgtccccctccatgtcccccatattcccagcgaaagtgataatcagcaagcaggtcaccatacttaacagtagtgctctgcatagattttccaccaaggcgttcaacccatccgagtatcaggcaatcacggaggccagtagcaatcagagattaacaaacataaagtcacaggccgctgatagcttgagagaattgtctcagacatgtgccacttgcagcatgacagagattaagtccagcagagaatttagcgaccaggtgttgcattccaaacaaagtcatttctacgagacattttggatgaactccgctattttggcgtcatggtacgccctgatgggagcacaaacgataacatccgggcattccttttcatccgcaacagaaataacgccctccgtggcctttacagaagtgccatcactgtttcctagcaagaagtccgcaaaacggactattctgtcgagctcattggaggagtcaattactctttctagtaatctggatgtcaacctttgcctggataaaacctgtctctcgatcgttcccagtcagacaatcagttcagatctcatgaattcagacttaactagcaaaatgaccactgatgagctgtctgtgtcagaaaatatccttaagttgcttaagatcaggcagtacggaattactatggggcctactgaggtgttgaatcaggagagcttactggacatggagaagtcaaagggttctcacacactgttcaaacttcacccatcggacagctcccttgactttgagctgaatctccagatttacccagatgtgacccttaagacatactctgaaattactcatgccaatgactttaaaaacaaccttccccctctcaccggatcagtacccgattttagcgaggttaccacaaacgtggccttctacacagtaagcgccacccccgctttatcaatccagacttctagtagcatgtcagtgattagaccggactggccgtactttacagattatatgacctccctaaaaaaagaggttaagactagttccgaatggtccaagtgggaactgcagcccagcgttcagtatcaggagttccctaccgcaagtaggcatctcccctttacacgaagtttgaccctgtcctctctcgagtccatcctcgccccacaacggctaatgatcagtgatttctcttgtgtccggtactacggggacagctacctggagtttcaaaatgtagctctgaatccacaaaacaatatttcactggagtttcagaccttctcctcctacgggctccttctttatgtcaaacaggactctaacctggtggacggtttttttattcagctgtttattgagaacggcactctcaagtatcatttttattgcccgggagaggctaagtttaaatccattaacacgacagtgagagtggacaatgggcaaaaatacacacttttaattcggcaagagcttgatccatgcaatgccgagctgaccatcctggggagaaatactcagatttgtgaatccattaaccatgtgctgggtaaacccttgcctaagtccgggagcgtattcatcggagggttcccagatctccatgggaagatacagatgccagtccctgtcaagaatttcactggctgcatcgaggttatcgagattaataattggagatctttcatcccatcaaaagctgtgaagaattaccacatcaacaactgccgttctcagggttttatgttgtccccaaccgctagctttgtggatgcgagcgacgtgacccagggagtcgacactatgtggacctccgtgagcccctccgtcgccgctccgtcggtatgccagcaggacgtatgccataacgggggtacatgccatgcaatctttctatcaagcgggatagtctcattccaatgcgattgtcccctgcactttactgggaggttctgtgaaaaggatgcagggctcttttttcctagtttcaacggaaattcatacctggaattacctttcttaaagtttgtgctcgaaaaggaacacaacaggactgtcactatctaccttaccatcaaaacaaattctttgaacggtacaatcctatatagtaacggcaacaattgcggcaagcagtttctgcacttgttcttggtggagggcagaccctcagtgaaatatgggtgcggcaactcccaaaacatactgacagtgagcgccaattactccatcaacacaaatgcttttacacctatcacgatccgttataccaccccggtggggtcgccaggggttgtttgcatgattgagatgaccgccgatgggaagccccctgtacagaagaaggatactgaaatttcacacgcctcccaggcctatttcgaatctatgttcctgggacacatccctgcaaatgtgcagattcataagaaagcaggtcctgtgtatgggtttcgtggttgtatcctcgatttgcaggtgaacaataaggagtttttcattattgacgaggctcggcatggaaaaaatatcgagaactgtcacgttccatggtgcgcccaccacttgtgcagaaacaatggcacatgcataagtgataacgagaacctgttttgcgagtgcccaagactgtatagcggcaaactgtgtcaattcgcttcctgcgaaaacaacccatgcggaaacggagcaacctgtgtgccaaagtctgggacagacatcgtgtgcttatgtccctacggccgaagtggcccactgtgtaccgacgctatcaatatcacccagccaagattctccggaaccgatgcttttggatatacttcctttctcgcctatagccggatcagcgatatctcttttcattatgagtttcaccttaagttccagttggctaataatcactcagcattacagaacaacctcatcttttttaccgggcagaagggccacggcttaaatggggatgattttctggcagttggacttctgaacggcagcgtggtgtactcttacaacctcggcagtggtatagcgtccattagatcagagccactgaatttgtccttgggcgtgcacacagtgcatctgggaaagttctttcaggagggctggctcaaggtggatgatcataagaataagtctatcattgcacccggtaggctggtgggtttgaatgtgttttctcagttttatgtgggagggtactccgaatatacaccagatttactgccgaatggagccgattttaagaatggattccagggttgcatctttacgcttcaagtgagaaccgagaaggatggtcactttcgcggactgggcaaccctgagggccatcctaatgcaggtaggagcgtcgggcagtgtcacgcatccccatgcagccttatgaagtgtggaaacgggggaacgtgcatcgagagcgggacaagtgtctactgcaactgcacaacgggttggaaaggatctttttgcacagagactgtgagcacatgtgatccagaacacgatccccctcatcactgtagccgaggcgcaacatgcatcagcctgccccatgggtacacatgtttctgcccgctgggcacgaccgggatttactgcgaacaggccctcagcattagcgacccttcttttaggtcaaacgagctcagctggatgtcttttgcaagtttccatgtccgaaagaaaacgcatatccagcttcagtttcaaccgctcgcagctgacggtatcttgttctatgcagcccagcatctgaaagctcaaagtggcgattttctctgtatctccttggtaaattctagcgttcagctgagatataacttaggcgatcgtaccatcattcttgagacacttcaaaaagtgacaataaacgggagtacttggcacattatcaaggctggacgcgtcggcgctgagggctacctggaccttgacggaattaatgtgacagaaaaggcatccaccaagatgtcaagtctggatacgaacaccgatttctacataggaggagtgagttctctgaaccttgtaaacccaatggctatcgagaacgaaccagtggggtttcaggggtgcattcgccaggtgattatcaacaaccaggagttacagctgaccgagtttggtgccaaggggggaagtaacgtgggtgattgcgatgggactgcgtgcgggtacaatacctgccgaaatggaggggagtgcacagtgaatggtaccactttctcttgccgttgtctacctgactgggccggaaacacttgcaaccagtcagttagttgcctgaacaatctatgtctgcaccagtctctgtgcatcccagaccaaagcttcagttacagctgtctgtgtactctgggctgggtggggagatactgtgagaacaaaacttctttttcaaccgctaagtttatgggtaatagctacatcaagtatatcgatcctaactaccgcatgcggaacctgcagtttacaactatcagtctgaatttctcgaccacgaagaccgaaggtctgattgtatggatgggaatagcacagaatgaggaaaatgactttctagcgatcggactccataaccaaaccctcaaaatcgctgtcaatctgggggagcgcatatctgtgcccatgtcatataacaacgggaccttttgttgcaataagtggcaccacgtagtggtgatccagaatcagactctgatcaaggcatacatcaacaacagcctgatactttccgaagacatagaccctcataaaaattttgtagccttaaactatgatgggatttgttatctgggtggctttgagtacggcagaaaggtgaatattgtgacacaagaaatcttcaagactaattttgtgggaaaaatcaaggacgtagtcttcttccaggagcccaagaacatcgagctgattaagctcgaaggatataatgtatatgatggggatgaacaaaacgaggtcacgta

SEQ ID NO: 222694 - DNA, 1785 bp, Artificial Sequence
  Description of Artificial Sequence: Synthetic coding sequence
atgactgataagtcgattgttatcctgtcactgatggtgtttcattcaagtttcataaacggcaagacttgccggagacagctggtggaggagtggcaccctcagccttctagttacgtggtcaattggactcttacagaaaatatatgccttgatttttatcgtgattgttggttcctgggggttaatacaaaaattgacacgtccgggaaccaggctgtgccccagatttgccctctgcagattcagctcggggacatactggtcattagctccgagccatcactacagttcccagaaattaacctgatgaatgtgtccgagacaagtttcgtggggtgtgtgcagaacactaccacagaggaccagctgctttttggttgcaggcttaaaggcatgcatactgtgaatagcaagtggctgagcgtcggtacccattacttcatcacggtaatggcatctggcccatctccctgtccgttgggtctaagacttaatgtgaccgtgaaacagcagttctgccaggagtcactatctagtgagttctgcagcgggcatggtaagtgccttagcgaggcctggtctaaaacctattcatgtcattgtcaaccacctttcagtggcaagtactgccaagaactggacgcatgctcattcaaaccctgcaagaataatgggtcctgtatcaacaaacgcgaaaactgggacgagcaagcatacgagtgtgtgtgccacccacctttcacggggaagaattgtagcgagataatcggacaatgccaacctcacgtatgcttccacggaaattgttcaaatataaccagtaactctttcatttgtgagtgcgatgagcagtttagcggtcctttctgcgaggtgagtgcaaaaccatgcgttagcttactgttttggaagcggggaatctgccccaactccagctccgcgtacacctacgagtgtccgaaaggctcttcttcacagaacggggagaccgacgtgagcgagttctctttagtgccatgccaaaatggcacagactgtatcaaaataagtaacgatgttatgtgcatctgttctcctatatttacggatctcctatgtaagtctattcaaacctcatgtgagtcgttccccttaaggaataatgcaacatgcaagaagtgtgagaaagactatccctgctcttgcatctcagggtttacggaaaagaactgtgaaaaggcgattgatcactgtaaacttctttccatcaattgccttaatgaggagtggtgtttcaatatcatcgggagattcaaatatgtgtgtatccctggatgcaccaaaaatccatgctggtttctcaagaacgtttatttgattcaccagcacctttgttattgtggagtaactttccatggaatatgccaagataagggcccagcccaattcgagtatgtctggcaattagggttcgccggttcggagggcgaaaagtgtcaaggtgttattgatgcatattttttcttggctgccaattgcactgaagatgcgacgtacgtcaatgatcctgaggataacaactcgagctgctggtttcctcatgagggcaccaaagagatatgtgccaatggctgttcctgcttaagcgaggaggactcccaggagtacaggtacctgtgcttcctgaggtgggccggaaacatgtaccttgagaacaccaccgacgatcaggaaaacgagtgtcaacatgaggccgtctgcaaggacgagatcaaccggccaaggtacctctgcataatttag

SEQ ID NO: 222695 - DNA, 1860 bp, Artificial Sequence
  Description of Artificial Sequence: Synthetic coding sequence
atgactgataaatctatagtgattctgagtctgatggtcttccattcttcctttatcaacggaaagacctgtcgacggcaattggtcgaggagtggcacccccagccctcaagctatgttgtgaattggactttaactgaaaatatctgtttggacttctatcgtgactgttggtttctgggggtgaatacgaaaattgatacttctggcaaccaggccgtccctcagatctgtccactccagatccagttaggggatatcctggtgatcagctcagaaccctcgcttcagtttcctgagatcaacttgatgaatgtgagcgagacatctttcgtgggttgcgtccagaataccacgactgaggaccagctcctgtttggctgtcggctgaagggtatgcacactgtgaacagcaagtggttatcagtggggacccactatttcataactgtcatggcttctggtccaagcccctgtccactgggtctaaggctcaacgtgacagtcaaacagcagttttgccaggagtcactgtccagcgagttttgttccggacacggaaagtgcctgtccgaggcctggtcgaagacttactcctgtcattgtcaaccacccttcagcgggaagtattgtcaggagctggatgcttgctcattcaagccttgtaagaacaatggaagttgcatcaataaaagagaaaactgggatgagcaggcctacgaatgtgtgtgccaccctcccttcactggcaagaactgcagcgagatcattgggcagtgtcagccacacgtgtgttttcatgggaattgcagtaatataacctccaacagctttatctgtgaatgtgacgaacagttttcagggccattctgcgaagtgagcgctaagccctgtgtaagcctcttattttggaagagaggtatctgtcccaacagcagcagtgcctacacatatgagtgccctaagggctctagctcacaaaacggggagacggatgtgtctgaatttagtctcgttccatgccaaaatggtactgactgtattaagatatcaaatgatgttatgtgcatttgcagccccatatttaccgatctgttatgcaagagtatacaaacatcctgtgaatcatttcccctccggaacaacgccacctgtaagaaatgcgaaaaagactatccctgtagctgtattagcggctttacagaaaaaaactgtgagaaagctattgaccactgtaagctcctctcaataaattgcctgaatgaggaatggtgctttaatatcattggtcgcttcaaatacgtttgtatccccggttgtactaagaatccgtgttggttccttaagaatgtctacctgattcatcagcatctttgttactgtggggtgacctttcacggaatatgccaggataaggggccagcacaatttgaatacgtctggcagctggggttcgccggaagtgaaggcgaaaagtgtcagggcgtgatagatgcatatttctttctggcagccaactgtaccgaagacgcaacctacgttaatgatcctgaggacaacaatagtagctgttggtttccacatgagggaacaaaggagatttgtgccaatgggtgttcgtgcttaagcgaagaggattctcaagagtatcgttatttgtgtttcctgcggtgggccggaaatatgtacctggaaaataccacggatgaccaggaaaacgaatgccagcatgaggccgtctgtaaggacgagatcaaccgcccacggcgaattctgaacaccgtgatcccccaccaaatccagcagcacatcgagcgctttattcagcacgaccaggtaggtttcatcgtcagaatttag

SEQ ID NO: 222696 - DNA, 1764 bp, Artificial Sequence
  Description of Artificial Sequence: Synthetic coding sequence
atgggctgggacctaggcaccaggctgttccagagacaggagcaaagatccagattgagcagaatatggctggagaagactagggtttttctagagggcagcacacgcacacccgctctcccacactgcctgttttggttactccaggtgccatccacccaagacccgctctttcctggctacggccctcagtgtcctgtcgatctggccggacccccttgtctcagaccactgtttggcggacttgggggatactggcgcgctttgcagagggggagggaggggcgaacaatgacgtcccgggcaagtgagctatctcccggaagatcggttacagccggtattattatcgtgggcgatgagatcctgaagggccatacacaggatactaacacgttcttcctctgtcggactcttagaagcttgggcgttcaggtatgccgcgtgagcgtggtgcctgatgaggtcgccacgatcgccgctgaggttaccagtttctctaaccggttcacccacgtgcttacagcaggcggtatcggacccactcatgacgatgtcactttcgaggccgtcgctcaggcgtttggcgacgagctgaagcctcaccccaaattagaagctgcaacgaaagctttaggcggagagggatgggagaaactatctttagtcccgagctcagccagactgcactacggcaccgacccttgtactggccagcctttccgattccccttggtcagtgtgcggaatgtctacctcttccctggaatccccgagctgcttaggagagtccttgaagggatgaagggcctctttcagaatcctgccgttcagttccactcaaaggagctatacgtggcagcagacgaagccagtattgccccaatattagctgaagcacaagcacacttcgggcgtcgactgggtctgggatcttacccagactggggctctaactactaccaggttaagttgacgcttgactcagaggaagaaggtcctctcgaagagtgtttggcgtacctgacagcacgactccctcaggggagtctggtgccatacatgccgaacgccgtggagcaggcctccgaagcagtgtataagctcgctgagtctgggtcctccctcggaaaaaaggtagccggagcacttcagacgatcgaaacatcgctggctcagtattctttgactcaactgtgtgtggggtttaatgggggtaaggactgtacagcgctactgcatctgtttcatgctgcggtgcaacgaaagctgcccgatgtccctaacccactgcagattctgtacattcgtagtatatctccttttccggagctcgagcaatttctgcaagacactatcaaaagatacaatcttcagatgctcgaagctgagggtagcatgaagcaggccctgggtgaactgcaggcgaggcaccctcagcttgaggctgtcctgatgggcacccggaggaccgacccatactcatgctctctgtgtcctttttccccaaccgaccctggatggcccgcattcatgaggataaatcccctgctggattggacgtatagagatatctgggatttcctgcggcagctgttcgtgccctattgcatcctgtatgacaggggctataccagcttgggatctcgggaaaacaccgtgaggaaccccgcacttaaatgtttatcccccggagggcatccaacttatcggccagcatatttactggagaatgaagaagaggagcggaacagcagaacttag

SEQ ID NO: 222697 - DNA, 513 bp, Artificial Sequence
  Description of Artificial Sequence: Synthetic coding sequence
atgaagggactgtttcagaatccagccgtgcagttccactcgaaggaactctacgtggccgctgatgaggctagcatcgcccctattctggccgaggctcaggctcactttgggagacgcctcggattagggagttatccggattggggctctaactattatcaagtgaaactgacactggacagtgaagaagaaggcccacttgaggaatgtttggcttatctgacagcccgactaccccaggggtccctggtgccttacatgccgaacgccgtcgaacaagcgtctgaggcggtgtacaaacttgccgaatccgggaattacttaatgttccaaacaccttcccggtcctgtattagtgccgcatctcccttgtctctgtcttggaattccttctacagaacattgagtagagagcaggccattccagagaatcagatcgccagccctccatcagaggcaaagggcgcagaggaaccctggatgggaccgtttcctggccagcaagggtag

SEQ ID NO: 222698 - DNA, 1473 bp, Artificial Sequence
  Description of Artificial Sequence: Synthetic coding sequence
atgaccagtcgcgcatctgagctatctcccggacgtagtgttacagcaggaattatcattgtgggagatgaaatcttaaagggtcatacccaggatacaaacaccttcttcctctgtaggaccctgagatcattgggggtgcaggtgtgccgcgtgagcgttgttcctgacgaagtggcaacgattgccgcagaagtcacatccttttccaaccgcttcacacatgttctgacagccggaggtatcggacctacgcacgatgatgttaccttcgaggccgttgcccaggccttcggcgatgagctcaagccgcatccaaaactggaagcagcaactaaggctctcgggggagaggggtgggaaaaactgtccctggttcccagctctgcacgactacattacggtacggacccttgcacaggacaaccgttcaggttccccctggtgagcgtcagaaacgtttacctgtttccaggtattcccgagctcctacgcagagttctcgagggaatgaagggtctctttcagaatcccgcagtgcagttccatagtaaagagctctatgttgcggctgacgaagcctctattgcacctattctggcagaggctcaggcgcacttcggaaggcggcttggtctaggctcatatccagattggggcagcaattattatcaggtgaaactcacgctggactccgaagaggagggacccttggaggagtgtctggcctatttaacagctcggcttcctcagggcagcctggtgccttatatgcctaacgccgtggaacaagccagcgaggctgtgtataagctggctgagagcggcagttcgcttggtaagaaagtcgcgggagcactgcagacaattgaaacctccctggcacagtattcgcttacacaactttgtgtcggattcaatggcggaaaagactgcactgccctactccacttgttccacgccgctgtgcagcgcaagcttccggatgttcctaatccacttcagatcttatatattcgttccatctcaccttttcctgagctagagcaattcctgcaggacaccattaaaagatataacctacagatgctggaagcagaggggtctatgaaacaggccctgggtgagcttcaggctcgacacccccaattagaggccgtgctgatgggcacacggaggacggatccatactcttgctctctttgccctttcagcccgaccgatccaggatggcccgcatttatgcggatcaatcccctgctggattggacgtatcgcgacatctgggactttctgaggcagttgttcgtgccatattgtatcctgtatgaccgtggctacacctccttgggatcacgggaaaatacggtcaggaatccagcactgaaatgcttatccccgggaggccacccaacctaccggcctgcttatcttctggaaaatgaggaggaggaacgcaattcaaggacatag

SEQ ID NO: 222699 - DNA, 387 bp, Artificial Sequence
  Description of Artificial Sequence: Synthetic coding sequence
atgcttgaagccgaagggtctatgaagcaagctttgggcgaattacaggccaggcatcctcagttagaggccgtcctcatgggtacacgcagaaccgacccttattcatgtagcctatgtccgtttagccccactgaccctggctggcccgcattcatgcgcatcaatccactgttggattggacctaccgcgatatctgggattttcttagacagctgttcgtgccttattgtattctgtacgatcggggttataccagcttgggtagccgcgagaacaccgtacgcaatcctgcgctcaaatgcctgagccctggcggacatcccacctacagacccgcatacttgttggagaatgaggaagaggaaagaaactcacgcacctag

SEQ ID NO: 222700 - DNA, 885 bp, Artificial Sequence
  Description of Artificial Sequence: Synthetic coding sequence
atgcagccctcatcctccacaccccctctccacccatactccactgacggccttatcttccctttcaatcctcagggacacacgcaggacactaacacctttttcctgtgcagaacactgcggtcccttggagtgcaggtctgtcgcgtgagcgtggtgccggacgaggtggctaccattgccgctgaagtcacttccttctccaatagattcactcacgtccttactgctggaggaatcggaccaacacacgacgacgtgacttttgaagccgtcgcccaggcgtttggtgatgaactgaagccccatcctaaactcgaggctgccacaaaggcgttagggggagaagggtgggagaaactctccctggtgccctcaagcgcaaggcttcactatggtaccgatccatgcacaggccagccatttaggtttccccttgtgagcgtgagaaacgtgtatctctttcctggcatacccgagctcctacgacgggtcctcgagggcatgaagggtctcttccagaatccagccgttcaattccattctaaggaattgtacgtggcggcagacgaggccagcattgccccaatcctggcagaagcccaggcccactttggacgcaggcttgggctaggcagttatcctgattggggaagtaactattaccaagtcaagctgacactggacagcgaggaagaaggtccactggaggaatgtttggcctacctgacagcacgacttcctcagggatcattagttccttatatgccaaatgctgtagagcaggcttctgaggctgtatataaattggcggagtccggcagagacctgatggaagagggccattacgcccagtcacattggtggcaccctcgaagccagtag

SEQ ID NO: 222701 - DNA, 1341 bp, Artificial Sequence
  Description of Artificial Sequence: Synthetic coding sequence
atgacatctagagcctccgagctgtcccccggtaggagcgtgaccgctggcataattatagttggtgatgagatcctgaaaggccacactcaggacacaaacactttcttcctttgcagaacgcttcgcagtttaggcgtccaagtgtgtcgtgtttcagtggtcccagatgaagtggccacgatcgctgcggaagtcacctcattctctaatcgcttcacacatgtgctgacagccggtgggattggaccaactcacgatgatgtgaccttcgaggcggtggcccaggcattcggcgacgagctgaagccgcaccccaaactcgaggccgctacaaaagcgctcggcggtgagggatgggaaaaactgtcgctggtgccgagctccgcacggctgcattatggaaccgacccgtgtacaggacaacccttccggtttccgttagtaagcgttcgaaacgtctacctgttccctgggatccccgaacttctccggagggtcctcgaaggtatgaagggactttttcaaaacccagccgtccagttccattctaaggagctgtacgtggcagctgacgaagcttcaatcgccccaatcctggccgaggcccaggcgcactttggcagacgtctcggtctggggtcttaccctgactggggcagtaattactaccaggttaagctgactctcgatagcgaagaagagggaccactggaggagtgtttggcctatctgaccgccagactccctcaggggagccttgtgccctatatgcctaatgctgtggaacaagccagcgaagcagtatacaaactggccgagagtggcagtagcctcggcaaaaaagttgcaggggcactccaaacgattgagaccagtttggcccaatactcccttacccaactctgtgttggattcaacggtgggaaggactgtacagcactcttgcacctgttccatgctgcagtgcagcgcaaacttccagacgtcccaaaccctctgcagatcctgtatatcaggtctattagtcctttccctgagctcgagcagtttctccaagatactataaaaagatacaacctgcagatgttggaagctgagggttctatgaagcaagccttaggggagcttcaggctcggcaccctcagctggaggccgtcctcatggggactcgccgaacggatccgtacagctgttcactttgtccattctcccctacagaccccggatggccagcgttcatgcgaatcaacccactcctagactggacttatagagacatttgggactttctgaggcagcttttcgtaccttactgtattctgtatgatagggggtag

SEQ ID NO: 222702 - DNA, 1371 bp, Artificial Sequence
  Description of Artificial Sequence: Synthetic coding sequence
atggggtgggatctcggtacaaggttgttccagagacaggagcagagaagccgactttctcgaatctggctggaaaagacacgggtcttcctggagggaagcacccgcactcctgccctcccccactgccttttttggcttctccaggtcccctcgacacaagatcctctatttcctggctatggtccccagtgtccagtggatcttgccggtccaccgtgtctgagacctctgttcggaggcctgggaggatactggcgagctttgcagagagggagggaagggcgaactatgacttccagggcgtcagagctctcccctggccgaagcgtgaccgcaggcattattattgtcggagatgagattctgaagggtcatactcaagacaccaataccttcttcctgtgcagaactttacgtagtctgggcgtgcaggtttgtagagtttctgtggtgcctgatgaggtggcgaccatcgcggctgaagtcacctctttttccaatcggttcacccatgtcctgaccgctgggggtattgggccaactcacgacgacgtgacatttgaggccgttgcccaagccttcggggacgaacttaaaccacatccaaagttggaggccgctacaaaagcgttaggaggcgaaggatgggagaaactctcgttagtgccatcatctgcacgcttgcactatggaacagatccttgcacggggcagcccttcagattcccactggtgtctgtcagaaacgtgtatctgttccctgggattcccgaactgcttaggagagtgcttgagggcatgaagggactctttcagaacccagctgttcagtttcattctaaggaactttacgtggctgccgacgaagccagtattgcaccgattctggcagaggcccaggcacacttcggtagacgattgggactggggtcgtatcccgattggggaagcaactactatcaggtaaaactcacattagacagcgaagaagagggtccactggaggaatgtcttgcatacctgacagcgagactccctcagggttctctggtgccctatatgcctaacgccgtggaacaggccagtgaggcagtgtataagctggcggaatcgggctcgtcattagggaagaaagtggctggcgctctgcagactattgagacctctctggcgcaatattcactcacccagttgtgcgtaggctttaatggtggaaaggattgcactgcactgctgcaccttttccacgctgcggtccaacgcaagctccctgacgtgcctaatcccctgcagattctttacattcggtctatctcaccatttccagagctcgagcaatttctccaggacacaatcaaacgctattag

SEQ ID NO: 222703 - DNA, 1017 bp, Artificial Sequence
  Description of Artificial Sequence: Synthetic coding sequence
atgcagccctccagcagtacccccccactgcatccttattctaccgacgggcttatatttcctttcaatccgcagggacacactcaggatacaaataccttctttctgtgccgaaccctgagatcgttgggcgtacaggtgtgccgggtgagtgtggtaccggatgaggtggcaacaatcgcggcagaggtcacctcctttagtaatagattcactcatgtcttgactgccggtggcatcggaccgacccatgatgacgtgaccttcgaggccgtcgcccaagctttcggtgatgaactgaagccacatcccaaacttgaagccgctaccaaggcgctcggcggagagggttgggagaaactctccctggtaccaagctccgcaagactccattacggtaccgatccatgtaccggccagccattccgtttcccactggtcagtgtgaggaacgtgtacttattcccaggcatacctgaactcctgcgtagggtactggaggggatgaaaggactgtttcagaatccagcagtacagtttcattctaaggagctgtatgttgctgcggatgaagcgtcaatcgctccaatactcgcagaggcacaggcgcacttcggacgacgcttagggctgggcagttatcccgactggggtagcaattactaccaggttaagctgacgctggattcggaggaggagggcccactagaagaatgtctcgcttacctcacagctaggttgccccaaggcagtctggtcccgtacatgcccaacgcagtggaacaggcatccgaggcagtatataagctcgctgagtctggaaattacctaatgtttcagacaccgagcaggtcctgcattagtgccgcatcaccactgagcctgtcctggaattctttttaccggacactctctagagagcaagccatcccggagaatcagattgcctcacctccatctgaagccaagggtgccgaagaaccctggatgggtcccttccccggtcaacagggatag

SEQ ID NO: 222704 - DNA, 1461 bp, Artificial Sequence
  Description of Artificial Sequence: Synthetic coding sequence
atgatccgccgagtcttgccgcatggcatgggacgcggacttctgactcggcgtccaggcacccgtagagggggattctcactagactgggacggaaaagtttccgagatcaagaagaagatcaaatccattctgcccggtcgctcgtgtgacctgttgcaggatacttcgcacctcccaccggagcactccgacgtggtcatagtggggggaggcgttctggggctttccgtggcttactggcttaagaagctcgaatctagaaggggagctattagggtcctggtggtggaacgagaccatacctattcccaagcctccaccggactgtccgtcggtgggatctgtcagcagttctccctgccagagaatatccaattgtcactgttttcggccagtttcttacggaatattaacgagtatctcgccgtcgtggatgcccctccactagatctgcgcttcaatccgtcgggctaccttctgttagcatctgaaaaggacgcagctgctatggagagcaatgtcaaagtgcagcggcaagaaggtgccaaagtgtcattaatgtcccctgaccagttgcggaataagtttccctggattaacaccgagggtgtggccctcgcttcatatggcatggaagatgagggatggttcgacccatggtgtctcttgcagggcctgcggaggaaggtacagtccctcggcgtactgttctgtcagggagaggtgactcgcttcgtgtcttcctcgcagcgtatgctgactaccgacgataaggccgtcgtgctcaagcgcatccacgaagtgcacgtcaagatggacaggagtctggaataccagcccgtggaatgtgcaatagttataaacgccgctggggcttggtccgctcagatcgctgcgctagctggagtcggcgagggccctcccggtactctgcaggggaccaaactcccagtagagcctcggaagcggtacgtgtacgtatggcactgtccacagggtcctggtctggagactcctctcgtggctgatacaagcggtgcttattttcggagggagggtctaggctctaactaccttgggggtagaagccctactgagcaagaggagcccgaccctgcaaaccttgaagtagaccatgacttctttcaggacaaagtgtggccacatctcgccctgcgtgtgccagctttcgaaactctgaaggtgcagagcgcatgggctgggtattatgactacaataccttcgatcaaaacggcgtcgttggccctcaccccttagtagtcaacatgtacttcgccactgggttctcaggacatggactgcagcaggccccaggaataggcagggccgttgccgagatggtgctcaagggacgctttcagaccattgacctaagcccattcctgttcactcgcttttatctgggcgaaaagattcaggaaaacaacatcatttag

SEQ ID NO: 222705 - DNA, 951 bp, Artificial Sequence
  Description of Artificial Sequence: Synthetic coding sequence
atggagagcaatgtcaaggtccagcgccaggaaggggctaaggtgtcgttaatgtcccctgatcagctgagaaacaagttcccatggattaacaccgaaggcgtggccctggcatcttatggtatggaggatgaaggttggttcgatccatggtgtctgctgcagggactccgacgaaaggtacaaagcctgggggttctcttttgccagggtgaggtgacacgatttgtgtcaagcagtcagaggatgcttacaaccgacgataaagctgtcgtgctgaagcgcattcatgaggttcatgtcaagatggacaggtccctcgaatatcagccagtagagtgtgctatcgtgatcaacgccgctggggcttggagcgcacagatcgccgctctcgctggcgtcggtgaagggcctcccggtaccctgcagggaaccaaactcccagtggagcccaggaagaggtatgtgtacgtttggcactgtccacagggacctgggctggaaaccccactggttgcagatacaagcggcgcttacttccggagggagggactgggcagtaattatttaggtgggcgatcccctaccgagcaggaggagcccgacccagccaacctcgaagttgaccatgatttctttcaggacaaagtctggccacatctcgctttgcgcgtgcctgcttttgaaactctgaaagtgcagagtgcctgggcaggctattatgattacaacaccttcgatcaaaatggggtggtcggtcctcacccccttgtggtcaatatgtactttgcaaccggattctcagggcatggccttcagcaggcgcctggtattgggagggccgtggccgagatggtcctgaaaggacgtttccagactatcgatctgtccccgtttttgtttacaaggttctatctgggagaaaagattcaggagaacaatatcatctag

SEQ ID NO: 222706 - DNA, 1419 bp, Artificial Sequence
  Description of Artificial Sequence: Synthetic coding sequence
atggcccacaccgggcgaacagtcgggagactgggcgagggtgattgggatggtaaagtctcagagatcaagaagaaaatcaaaagcatactgccagggcgaagctgcgacctcctccaggatactagccatctgcctcctgaacactccgatgtcgtgattgttggtggtggcgttcttggtcttagtgtggcttactggctaaagaagctggagagtcggaggggcgctatccgggtactggtcgttgagcgcgaccatacttattcccaggcatccactggcctgagcgtggggggtatatgccagcagttcagcttgccagaaaacatccagctttccctgttcagcgctagtttcttgcgcaacattaatgagtacctggcagtggtggacgctccccctctggatctgaggttcaatccgtctggctacctgttgcttgcctccgagaaggatgcagccgcaatggagagcaatgttaaggtgcagagacaggaaggagcgaaggtgagcctgatgagccctgaccaactgcggaacaaatttccttggattaacacggaaggagttgcgctggcctcatacggcatggaggacgagggctggtttgacccttggtgtctactccagggtctgcgtaggaaagtgcagtctttgggcgtactgttttgccagggggaagtcacgcgcttcgtttcttcgagccagcgcatgctgacaactgacgacaaggcagtagtgctgaagaggatacatgaagtgcacgtcaaaatggacagatccctagagtaccagcccgtagaatgcgctatcgtgattaacgccgctggagcttggagcgcccagatcgcagcactggccggtgtaggggagggaccgcctgggaccctccagggcacgaagctgcctgtggagccccgaaaaagatatgtttacgtatggcactgtccacagggacccggactcgagacacctcttgtcgccgatacaagcggggcttacttcagacgcgaaggattagggtctaattacctgggcggacggtccccaactgagcaggaagagcctgaccccgctaatctcgaggtggatcatgactttttccaggacaaagtgtggccacatctagcgctaagggttcccgcattcgagactttaaaggtgcagtcagcctgggctggctattatgactataatacctttgaccaaaacggagtggtgggcccacacccactcgttgtgaacatgtacttcgccacggggtttagcggccacggtcttcagcaggcgcctggtattggccgagccgttgctgaaatggtcctcaagggccgattccaaaccattgacctctcaccctttctgtttacacgcttctacctcggagagaaaatccaagaaaacaatatcatctag

SEQ ID NO: 222707 - DNA, 501 bp, Artificial Sequence
  Description of Artificial Sequence: Synthetic coding sequence
atggcccagaggctgctgctaaggaggttcctagcaagcgtcatctctcgaaagccgtcacaagggcagtggcctcccctgacttcgcgggctctgcagacaccccagtgcagtcctgggggtctgaccgtcactcctaacccagctcggactatttataccactcggatatccctgactacatttaatattcaggacggacctgatttccaggatcgggtggtgaattccgagactcccgtggttgttgattttcacgctcagtggtgcggtccctgcaaaattctgggaccccgactggagaagatggtcgcaaaacaacacggtaaggttgtaatggccaaagttgatatcgacgaccacacggatttagcaatcgaatatgaagtgtctgctgtgccaacagtcttggcaatgaaaaacggtgacgtggtcgacaagttcgttgggattaaggacgaggaccagctggaggcttttttgaagaagctcatcggttag

SEQ ID NO: 222708 - DNA, 2055 bp, Artificial Sequence
  Description of Artificial Sequence: Synthetic coding sequence
atgggactctcagctgccgctcccctttggggacccccaggcttgctgctggctattgctctgcatccagccctgtccgtccctcctcgcagagattactgtgttctgggggcaggccctgctggactgcagatggcatactttttgcagcgagcgggaagagactacgctgtgtttgagcgagcccctaggcctggaagtttttttaccagataccctagacatagaaagcttatctccatcaataagcgatatactggtaaggcaaacgcagaatttaatctgcggcacgattggaactcattattgagccatgatccgagactcctgtttcggcactactcccgagcctatttccctgacgcgagagacatggtgagatatctgggggattttgccgacaccctgggactccgagtgcaatataacactactattgctcacgtcactcttgacaaggaccggcaggcctggaacgggcattactttatcctcaccgaccaaaaaggtcaggtccaccagtgtagtgttttattcgtggcaaccggactgtccgtgcccaaccaggttgacttccctggatctgagtatgcagagggctatgagtccgtgtcggtggatcccgaagattttgtgggacagaacgtgctcatcctggggagaggtaattcggcctttgaaactgccgaaaacattctaggcgtaaccaattttatccatatgctctcacggagtagggtcagactctcttgggcaacacactatgtcggggacctgcgtgctatcaataacgggctgctggacacctaccagctcaagagtttggacggcttactggagagtgatctgaccgaccttgccatcctcaaggactccaaaggtaaatttcatgtcactcctaaattttttttggaggaggcaaataccaatcaatcagccgactccataacactgccacaggacgataacgacaattttgccatgcgagttccctacgaccgcgtaattcggtgcttgggctggaatttcgacttcagcatatttaataaaagccttcgtcttaacagcggtaacgcctttgggaaaaagtaccctctaattcgcgctagttacgagagcaaaggctcacggggactatttatcctggggacagcatctcatagcgttgactataggaagtccgcagggggatttattcacggctttcgctacactgtgcgggcagtacatcgactcctggaacatcggcatcattccgtaacctggccagctactgagctgcctatcactcaactcacctcctctatcgtgcggagagtgaatgaagccagcggtctatatcagatgttcggagttctggctgacgtaatcctgctcaaagaaaattcgaccgccttcgaatatctggaagagttccctattcagatgctcgcccagctagagacgctcacgggccgaaaggccaagcatggtttgtttgtcataaatatggagtatggacgcaattttagtggccctgacaaagatgtgtttttcgacgatcgttcagtaggccatactgaagatgcttggcagtccaattttctgcaccctgtgatctactattaccggtacttaccaacagaacaggaagtgaggtttcggccagctcactggcccctgcctcgacccacagctatccatcatattgtggaggactttctgacagactggacagctcccatcggacacattcttcctctccggagattcctcgagaattgcttggatacagacctgaggtctttctacgctgaaagttgcttcctcttcgccctgaccagacaaaagctccctcccttctgtcagcagggctacctgagaatgcaggggctggtgtctacggagagcctgtggcaacaccgggttgagtcacgtttgttgcgagactatgctcccaccggcaggagactggaggacagcagtcagcagctcggggatcaggagcctctaggatcacctctggcgccaggacctttggcccagtcagtggactccaacaaggaggaattgtag

SEQ ID NO: 222709 - DNA, 2055 bp, Artificial Sequence
  Description of Artificial Sequence: Synthetic coding sequence
atggggctgagcgcggctgctcccctgtggggacctccaggcctcctgctggcgatagctcttcatcctgccctgtctgtaccccctcgtcgcgattactgtgtgctcggcgctggtcctgcagggctgcagatggcctacttcctccaacgggcagggagggactatgctgtgtttgagagggctccacggccaggatccttttttactaggtatccgcgtcaccgaaagctgatctcgatcaataagcgctacaccggcaaagccaatgccgaatttaatttaaggcacgattggaactctctgctatctcacgatccgagattgctgttccgacactactctcgcgcttacttccctgacgccagagacatggtaaggtatctcggcgactttgcagatactctgggcttgagagtgcagtataacacaacaatcgcccacgtcaccctcgacaaggaccggcaagcttggaatggacactactttatcctgactgaccagaaagggcaggtgcatcagtgcagtgtcctgttcgtggctaccggactgagcgtccccaaccaggtggacttcccgggatccgaatacgctgagggctacgaaagtgtatcagtcgacccggaggattttgttggtcaaaacgtacttatcttaggcaggggtaatagcgccttcgagactgccgaaaacatcctgggtgtgaccaatttcatccacatgttgagcaggtctcgcgttagactgtcctgggcaacccactacgtcggagatctcagagcaataaacaatggtctgctcgacacctaccagttaaagtctctcgatggactattggagtcggatctgacagaccttgccatcctgaaagattcgaagggaaaattccatgtgactcccaagttcttcctcgaggaggctaacacgaaccagagtgccgattccatcacactcccacaggacgataacgacaatttcgctatgcgtgttccatatgaccgagtcatcagatgtctaggatggaactttgattttagtatctttaataaatcattacgacttaattcagggaacgccttcgggaagaaatatcccctgatcagagcttcttacgagtcaaaaggtagcaggggcctgtttatcctcgggaccgcctctcacagcgtggattaccggaaatccgcgggaggtttcatccacggttttcgctacacagttcgggcagtgcaccgactgcttgagcacagacaccactccgtaacgtggcctgcgactgaactgccaattacccagctgacctcaagtatcgtgcgaagggtcaacgaggctagcggtctgtatcagatgttcggcgtgctggctgatgttattctgttgaaggaaaatagtaccgccttcgaatatctcgaggagtttcccatccaaatgctggctcagctcgaaactttgacaggccgtaaggccaaacatggactgttcgtcatcaacatggagtatgggaggaatttctcaggccctgataaagacgtgttttttgatgaccgatccgtaggtcacacagaagacgcttggcagagcaactttctgcatccagttatttactactaccgttacctgcccacagagcaagaagtacgctttcgaccggctcattggcccctccctagacccactgccattcatcatatcgtggaagactttctcactgactggactgcccctatcggacacatcctaccactgagacgattcctggagaactgccttgatacagatctccggagtttctatgccgaatcttgtttcctgttcgcattaacgcgccagaaactgcccccattttgtcagcagggatacctccgcatgcagggactcgtcagcaccgagtcgctgtggcagcatcgcgtcgagtcaagactgctaagggattacgcaccaaccgggagacgcttggaagacagttctcagcagctgggagatcaggagcccctaggcagtccactcgcccctggaccgttggcccagtcagtggactcaaataaggaagagctgtag

SEQ ID NO: 222710 - DNA, 261 bp, Artificial Sequence
  Description of Artificial Sequence: Synthetic coding sequence
atgggcctatcagccgctgccccactgtggggaccaccaggcctactactcgcaatagctttacacccagctctcagcgttcctcctcgtagagactattgcgtgctgggagccggtcccgctggactgcagatggcctattttctccagcgggctgggagggattacgctgtgtttgagcgcgctcctcgcccaggctccttcttcaccagatatcccaggcacaggaagttaatctcaattaataagcgatacacttag

SEQ ID NO: 222711 - DNA, 729 bp, Artificial Sequence
  Description of Artificial Sequence: Synthetic coding sequence
atgtttctgctaagcggagacccttgctttaagaccccccctagtacagcaaaatccatctctatccccggtcaggattctagcttgcaactgacctgcaaggggggaggcactagctcgggcggaagctcaacaaattcgctaaccggttcccgccctccaaaagccagacctacgatactctcctcgggtctgccagaagagcccgatcaaaacctctcttcgcctgaggaggtttttcactctggacactcacgtaactctagctacgcctctcagcagtccaagatatccggatactctaccgagcactcaagaagtagtagtttgtcagacctgacacacagaagaaacaccagcacttccagcagcgcatcaggcggactgggtatgactgtggaaggccctgaaggaagtgagagagagcaccgtccacctgaaaagccgccaaggcctccacgtcctctacacctgtctgaccgctcgtttcggagaaaaaaagattctgtggaatcccatcctacatgggtggacgacactcgaatcgatgctgatgccattgtggaaaagattgtccagtcacaagactttaccgatggctcaaataccgaggatagcaatctccggctgtttgtcagccgggatggctccgcaacactcagtggcatacaactcgctaccagggtctcttctggcgtttacgaacccgtggtcatcgaatctcactag

SEQ ID NO: 222712 - DNA, 1155 bp, Artificial Sequence
  Description of Artificial Sequence: Synthetic coding sequence
atggcatttctgatgaaaaagaagaagttcaaattccagaccacgttcactctggaagaactaaccgccgttcctttcgtgaacggagtcttgttttgcaaagtgagactacttgacggcggtgattttgtgtctctttcatcccgggaagaggtccaggagaattgcgtccgctggaggaaacgcttcacatttgtgtgtaagatgagtgctaacccagccaccggccttttggatccatgtgtatttcgtgtatctgttaggaaagagttgaagggcggtaaggcatactcaaagctcggatttgcagacttgaacttggccgagttcgccggatcaggaagtacagtgcgatgctgtctcctggaaggctacgacacgaaaaacacaagacaggacaattctatccttaaagttaccatcggcatgttcctgctctccggagatccttgcttcaaaacccctccctcaaccgctaagtcgatcagtataccgggacaggactcctcactgcagctgacctgtaaaggcggtggtacaagctcaggaggcagctctactaatagcctgactggtagccgtccaccaaaagcgaggcctacaatcctgtccagtgggctccctgaggagccggaccagaatttgtccagcccggaggaggtttttcactctggtcacagcagaaactcctcttacgcctctcaacaatctaagatctccggttacagtacggaacattcacgctcctcgagcctgtcggacctaactcacaggcggaatacttccacgtcctcatcagcttccgggggtctggggatgacagtggagggaccagagggcagtgagcgcgaacatagacctccagaaaagcctcccagaccgccacggcctctgcacttgtcggacagatccttccgtcggaagaaggactccgtcgagtcacacccaacatgggtcgatgataccagaattgatgccgacgccattgtcgagaagatcgtgcagagccaggatttcactgacggaagtaacacagaagattcaaatctaaggctgtttgtgtccagggacggatcagccactttatcgggcatccagttggccacacgagttagtagcggagtgtacgagcctgtcgtcatagagagtcactag

SEQ ID NO: 222713 - DNA, 435 bp, Artificial Sequence
  Description of Artificial Sequence: Synthetic coding sequence
atgtattctgaaattcagagagagagagccgatatcggcggacttatggcaagaccagaataccgggaatggaaccccgagctcataaagccaaaaaaactcctgaacccagtgaaggcatccagatcacaccaagaactgcatcgagaactgctgatgaaccacaggcgaggactcggcgtcgattctaagccggaactgcaaagggtgctggaacacagacgcaggaatcagctcattaaaaagaagaaagaagaactggaagcaaaaaggcttcagtgcccattcgaacaggaactgctaaggaggcagcaacgcctgaaccagcttgaaaagccacctgagaaggaagaggatcatgcccctgagttcattaaggtgcgtgagaatttacgcagaattgcgaccctcacaagcgaggaacgcgaactctag

SEQ ID NO: 222714 - DNA, 435 bp, Artificial Sequence
  Description of Artificial Sequence: Synthetic coding sequence
atgtattccgaaatacagagagaaagggctgacatcggaggactgatggcacggccagaataccgcgagtggaatcccgaactgattaagcccaagaaactgctcaatccagtcaaagcatcacgctcccaccaggagctgcatcgagaacttctgatgaaccatcgcagaggactaggcgtcgactctaagcccgaactgcagagggtgcttgagcacagaagaaggaaccagctgatcaagaagaagaaggaagagcttgaagctaagcgactccagtgcccctttgaacaggagctcctgcggaggcagcagcggttgaatcagcttgaaaagccaccggaaaaggaggaagaccatgcgcctgaattcattaaagtgcgcgagaaccttcgccgaatagccacattgactagcgaggagcgggagctgtag

SEQ ID NO: 222715 - DNA, 519 bp, Artificial Sequence
  Description of Artificial Sequence: Synthetic coding sequence
atggcccagcggctgggagagtgggcacgaggcccttcagatgccactgggctctatcgcgctgtgctcctccggtcagcagccatgtacagcgagattcagagagagagggctgacatcggagggctcatggcaagacccgagtacagggagtggaaccccgagctcattaaacctaagaagttactaaatccagtcaaggcttcccgatcacaccaggaactccatagagaattactcatgaatcacaggaggggtttaggagtggactctaagcctgaactgcagagggtgcttgaacacagacggagaaaccaactaattaaaaagaaaaaagaggaacttgaggcaaagcgcttgcaatgtcctttcgaacaagagcttctccggagacagcaaagattaaaccagttagagaagccgccagagaaggaagaagatcacgcacccgaatttatcaaagttcgcgagaacctgcgaagaatcgcaaccctgactagcgaggaaagggaactttag

SEQ ID NO: 222716 - DNA, 408 bp, Artificial Sequence
  Description of Artificial Sequence: Synthetic coding sequence
atgtacagcgagatccagagggagagagccgacatcggaggcctgatggcgagaccagagtaccgagagtggaatccggaactaatcaagcccaaaaagttgctcaaccccgtgaaggcatcgaggagtcaccaggaacttcatcgagagttgttaatgaatcatcgcaggggattaggcgtggattcgaaaccggagctgcaacgtgtcctggaacatcggaggagaaaccagcttattaagaagaagaaagaagagctcgaagcaaagcggctgcagtgcccctttgagcaggagttgctgagacggcagcagcgtttgaaccaggtcggggatgggcaccctgccggtaccacacacccaccaggactgtcctcaagagaggaactttgctgcggccattcatag

SEQ ID NO: 222717 - DNA, 318 bp, Artificial Sequence
  Description of Artificial Sequence: Synthetic coding sequence
atgtactctgagatccagcgggaacgggcagacatagggggactcatggccagaccggagtaccgcgagtggaacccagaactgattaagccaaaaaagttactaaatcccgtgaaagcctcccgctcccaccaggaactgcatcgggagttgctcatgaatcacaggaggggactgggcgttgatagcaagcccgaactccagcgtgtccttgagcaccgccgtcggaaccagttgatcaaaaaaaaaaaagaggagctggaagcaaagcgtctccagtgtccattcgaacaggaactgcttcggcgacagcagtag

SEQ ID NO: 222718 - DNA, 528 bp, Artificial Sequence
  Description of Artificial Sequence: Synthetic coding sequence
atgggggcagcccaggggaaaaagaaaacatattctccccaggcccgtttccactcagaaaatgaaaagcagcgcagaaatggatccgccgctatgtatagtgaaatacagagggaaagagctgacataggtgggcttatggcaagacccgaatatcgtgagtggaatcccgagctcatcaaaccaaagaagttgcttaatccagttaaagcctcccgctcgcaccaggagctgcacagggaacttttgatgaatcacagacgcggtttgggggtggactccaaacctgaattacaacgggttttggaacatcggagacgcaatcaattaattaagaaaaaaaaagaggagctggaggcaaaaaggctgcagtgcccatttgagcaggagctactcaggagacagcagcggctgaatcaactcgaaaaacccccagaaaaggaagaagatcacgcaccagaattcatcaaggtgagggaaaatcttaggcgcatcgcgacactgactagcgaagagagagaactctag

SEQ ID NO: 222719 - DNA, 789 bp, Artificial Sequence
  Description of Artificial Sequence: Synthetic coding sequence
atggcgcctggttcacctccaggccctgccatcgctactatgaagttaaatgaacggtccctggctttttacgctacatgtgatgcccctgttgataacgcgggatttttgtataagaagggcggtcggcacgccgcttaccatcggagatggttcgttctccggggtaacatgctgttttatttcgaggacgcggcttcccgcgaaccggtgggtgtgatcattttagaagggtgcactgtggagctggtggaggctgccgaggagtttgcctttgcagtgaggttcgccggaacacgcgcaagaacttatgtgttggcagccgagtcccaggacgcaatggaggggtgggtgaaggctctaagccgcgctagttttgactaccttagactcgtggtacgggagctggagcagcagcttgcggctgtgagaggcggtggtggcatggctctcccgcagccccagccccagtcactcccactccccccaagtctgccatccgctttggcgcctgtcccatcgctgcctagcgctccagcccctgtccctgccttacccctgccaaggcgtccttctgcactgccacctaaggaaaacggctgtgccgtgtggagtacagaagccactttccgacctggacctgagcctccccctcctccaccccgaagaagagcttctgctccccacggtcccctggatatggccccatttgcgagactgcatgaatgctacgggcaggaaatccgcgctttgcgcggacaatggctgtcctccagagtgcaaccctag

SEQ ID NO: 222720 - DNA, 750 bp, Artificial Sequence
  Description of Artificial Sequence: Synthetic coding sequence
atgaaacttaacgagcgaagtctcgctttctacgctacctgtgacgctcctgtggataacgctgggttcctgtacaagaaagggggaagacacgccgcataccacagaagatggttcgtcctgcgtggcaatatgttattctacttcgaagacgccgcatctcgcgaacctgtgggcgtaattatcctcgaaggctgtaccgttgaattggtggaagccgctgaggagttcgcctttgctgtgagattcgcaggcaccagagcaagaacgtatgtcctggcagcagagtctcaggacgccatggagggttgggttaaagcattgtctagggcctccttcgactacttaaggttggtcgtcagggagctcgaacagcagttagctgcggtgcggggtggcggagggatggctttgccccaaccccagcctcagagtttgccactgccaccctccttgccgtccgcactcgcccctgtgccatcactgccctccgcgccagcgcctgttcctgccctgcccctacctagaaggcctagcgcccttccccctaaggagaacggatgtgccgtatggtccactgaagcgacattcagacccggtcctgagccccctcctccacctcccaggaggagagcttctgccccacacggccctttagacatggcaccgttcgctcgactgcacgaatgctacggccaggagatccgggctctgcgcggacagtggctgagctcacgagtccagccttag

SEQ ID NO: 222721 - DNA, 267 bp, Artificial Sequence
  Description of Artificial Sequence: Synthetic coding sequence
atgaaactcaacgagcgttccctcgctttctatgcgacttgcgatgctcccgtcgataacgccggttttctgtataagaaaggcggaaggcatgctgcctaccacagacggtggtttgtgctcagaggtaacatgctgttttattttgaggacgcagcatctagggagcctgtgggtgttatcattttggtggctgtcgccttgtggccgagagccctaagcgtgtccccatggtggcttagtcagggttctccagacacaccttag

SEQ ID NO: 222722 - DNA, 849 bp, Artificial Sequence
  Description of Artificial Sequence: Synthetic coding sequence
atgcaagctagctgcacccgacgagtgggcggaacaaggcctaccacaggagccggatcatgctgtgctgggacttgcagctccacgagccgaactttgcccgctgtttccccgtgggccagcagttcgtggcgtgccgctctctggtcctggtggcggcctccacgtagctctccctctctgtgcgcccttagaggtcccggtagagctccgacttgctggccccttcgtgtgaggatgccttggagggccggaagcaggccctgccgagtgcctgcaagtaccacttgtgggtggtggtgtgcatcatggtctagctcctggagactctacgtggcaggtgtggcctggccttgccctagcccatcaccttctccatgcccatgtcctaggccatgtccactcccctggccccagagccacccgtgtctcctgccccaacccagatcacagccttgtccctgccctgctggccctgttccatcaaggccaagaagaatggccgcattaagcggagccttgagacctccatctggcctcgatccctcacccctgcaccataggttggcagccggtcctagacaccctaccggaccttggacctggccgccttcccctggttgcactagcgccatggccaggcgaagtggcccttgtgtcgcctccggatccgcggctggatcaagtcctgaggcaacccgcgctcccgtcttaggaggccacaaactgtatgcactgtgggataggccaggacctggagagaccggtggcgcagatcccgaaggtaatcacggccaggggtggccgcctggcccagagtggcctggttttggaggctgcagactctag

SEQ ID NO: 222723 - DNA, 354 bp, Artificial Sequence
  Description of Artificial Sequence: Synthetic coding sequence
atgaagttaaacgagaggtctcttgccttttatgcgacttgcgacgccccagttgacaacgccggttttctgtataagaaggggggaaggcatgccgcttatcacagaagatggttcgttctcagaggcaacatgctgttttacttcgaggacgccgcatcccgagaacccgtgggcgtgattattctggaagggtgcactgtggagctcgtcgaggccgctgaagagtttgcctttgctgtccgcttcgctgggactcgcgctcggacgtacgtattggctgccgagtcccaagatgccatggaggggtgggtaaaagccctgtcacgcgcttccttcgactacctccggtag

SEQ ID NO: 222724 - DNA, 750 bp, Artificial Sequence
  Description of Artificial Sequence: Synthetic coding sequence
atgaagcttaatgagcggtcactcgccttttacgcaacctgcgacgcccctgtagacaatgctggcttcctgtacaagaaaggcggaagacatgcggcataccatcgcagatggtttgttctgagaggaaacatgctgttctactttgaagacgctgctagccgggagcctgtaggcgtgattatcctcgaaggctgtacagtcgaacttgttgaggctgctgaggaattcgcatttgctgtccgttttgccggtaccagagccagaacctatgttctcgccgcagagagccaagacgcaatggagggttgggtgaaagcgttgtcccgtgcgagctttgattatctccgactcgtggtgagggagctcgagcagcagctcgccgcagtaaggggcggtggaggcatggcgctgccccagccacagccacagagtctccccctcccgccatcgttaccttccgcccttgcacctgtaccaagccttccctccgctccagcccctgtccccgcacttcctctgccaagacgaccctccgccctgcctccaaaagaaaacggctgcgctgtgtggagcacggaagccacttttcgccctgggcctgagccccctccaccacccccaaggcgacgtgcttctgcgccacacggccctctggatatggccccatttgctagattgcacgagtgctacggccaggagatccgggcactcagaggccagtggctctctagccgcgtccagccttag

SEQ ID NO: 222725 - DNA, 750 bp, Artificial Sequence
  Description of Artificial Sequence: Synthetic coding sequence
atgaagctgaacgagagatcattggccttctacgccacctgcgacgcccctgttgacaacgccggtttcctgtataagaaggggggtaggcatgctgcataccacaggaggtggtttgttctgcggggaaatatgctgttttacttcgaagacgcagcctctcgtgaacccgtaggcgtcattattttggagggctgtactgtggagctggttgaagcagccgaagaatttgctttcgcggtgcggttcgctggaacccgcgcaagaacatacgttttggcagctgagtcccaggacgctatggagggctgggtaaaggccctgtcccgagcctcctttgattacttaagattggtcgttagagagctagagcaacagctagccgctgtcagaggcggaggaggcatggccctcccacagccccagccacagtccctgccacttcctcctagtttgccatctgccctggccccagttccgagccttccttccgctcccgcaccagtcccagctctgccattaccaaggcggccaagtgcacttccccctaaagagaacggttgtgcagtgtggtctaccgaagcgacatttcggcctggcccagaacctccaccaccaccgccaaggcggagggccagtgcccctcacggaccacttgatatggctccgtttgctagattacacgaatgttatgggcaggagattcgtgcactcaggggccaatggctcagctctcgggttcagccatag

SEQ ID NO: 222726 - DNA, 225 bp, Artificial Sequence
  Description of Artificial Sequence: Synthetic coding sequence
atgaaactgaatgaaagaagtctcgctttctatgctacctgtgacgctccagtcgataatgccggattcctctacaagaaagggggacgccacgctgcttatcatcggaggtggtttgttctgagagggaacatgctgttctacttcgaggatgccgctagccgcgagcctgtgggagtgataatcctggagggatgcaccgtggagcttgtcgaggccgcatag

SEQ ID NO: 222727 - DNA, 243 bp, Artificial Sequence
  Description of Artificial Sequence: Synthetic coding sequence
atgaagctcaacgagagatccttggcattctacgctacttgcgatgctcctgtggacaacgcagggtttttgtacaagaaggggggtagacacgccgcataccaccgcagatggttcgtgctaagagggaatatgctgttttattttgaggacgctgcctcaagggagcccgttggcgtgattatcttagaagggtgtactgtagagttggtggaggccgctgaggagtttgctttcgcctag

SEQ ID NO: 222728 - DNA, 780 bp, Artificial Sequence
  Description of Artificial Sequence: Synthetic coding sequence
atgaaacttaatgaacgctctgtggcacactatgcgctttccgactcaccggcagaccatatgggtttcctgcgaacgtggggaggtcccggtacacctccaaccccgagtggaacaggcaggagatgttggttcgtacttaagggcaatcttctgtttagctttgagtcccgggaggggcgagccccactgtctttagtggtccttgagggctgtactgtggaacttgccgaggccccagtgcctgaagagttcgcctttgccatctgtttcgacgcgccaggggtaagaccgcatttgttagctgccgaagggccagctgctcaggaggcatgggtgaaagtccttagtcgagcctccttcggctacatgagactcgtggtgagagaattagaaagtcagctccaagacgcaagacagtccctcgctctccagaggagatcgagttggaaaagtgtcgcaagtcggtgtaagccacaggcccctaaccatcgggcagcgggtctcgaaaacggtcattgtctgtctaaggactcctcaccggtcggtctagttgaggaagccggaagccggagcgctggttggggtctggctgaatgggaactgcagggccctgccagcctgctcctgggcaaaggtcagtcccccgtatcccctgagaccagttgcttttccacgctgcacgactggtatgggcaggaaattgtggagctgcgacaatgttggcagaagcgcgctcagggtagccacagcaagtgtgaggagcaggaccgcccttag

SEQ ID NO: 222729 - DNA, 327 bp, Artificial Sequence
  Description of Artificial Sequence: Synthetic coding sequence
atgaaactcaatgaaagatctgtcgcacactacgcgctcagtgacagccccgcagaccacatgggcttcctacgaacctgggggggacccggaacaccccctacgccaagcggaacaggtaggcggtgttggtttgtgctgaagggcaacctgttgttttcattcgaatctcgggaaggccgagcccctttgtctttggttgtcctggaaggctgcaccgtcgagctggcggaggcgccagtcccggaggaatttgctttcgcaatctgtttcgatgcacctggggtcagaccccacttgctggcagccgagggcccagcagcttag

SEQ ID NO: 222730 - DNA, 729 bp, Artificial Sequence
  Description of Artificial Sequence: Synthetic coding sequence
atgaccattcccggaggaaccccatcactaaagatcctctggcttaatcaggaaccggaaattcaagttaggagactcgacacactgctcgcatgttttaacctgtcgagtagtcgcgaagagcttcaggctgtggaaagtcccttccaagctctgtgctgcctattgatttacttattcgtgcaagtggatactctgtgtttggaggacctccacgcctttatcgcccaggcactctgtcttcagggcaagagcacctctcaactggtcaacctgcagccagactatatcaatcccagggccgtgcagctgggttctctgctcgtgaggggcctgaccacactcgtcctggtcaattccgcgtgtggattcccatggaagaccagtgatttcatgccttggaatgtcttcgacgggaagctgtttcatcagaaataccttcagtcagagaaaggatacgccgttgaggtgctgctggagcaaaaccgtagcagactcactaagttccataatttgaaagccgtcgtatgcaaggcctgcatgaaggaaaatagaaggatcacggggagagcccactggggatctcaccacgcaggacgctggggtaggcaggggtccagctaccaccgaaccggctctggctacagtcggtccagccagggccagccctggcgcgatcagggccctggatcccggcagtacgagcacgatcagtggaggagatactag

SEQ ID NO: 222731 - DNA, 2733 bp, Artificial Sequence
  Description of Artificial Sequence: Synthetic coding sequence
atgggtgtacgcggactgcagggattcgttgggagcacatgcccacatatatgcacagttgtgaattttaaggaactcgctgaacatcatagatccaagtaccccggttgcacccctaccatcgtggtggacgcaatgtgttgccttagatattggtacacccctgagtcgtggatatgtggtggccagtggagagagtatttcagtgcactcagagattttgtgaagaccttcacggccgcaggaatcaagttaatcttctttttcgacggtatggtggagcaggacaaaagagatgaatgggtgaagagaaggctcaaaaacaaccgggaaatatcccgcattttccactacattaaatctcacaaagagcaacctggcagaaatatgttcttcattccaagcggcctggctgtgtttacaaggttcgccttgaaaaccctgggacaggagacgctgtgcagtctgcaggaggctgattatgaggtagctagctatggcctacagcacaattgcctgggaatactgggcgaggacaccgactatctgatctacgatacgtgtccctacttttcaattagcgaactctgtctggagagcctggatactgttatgctttgccgcgagaagttgtgcgagtcattgggcttgtgtgtggctgacctacccctgctagcctgtcttttgggaaacgacatcatccccgaagggatgttcgagagctttcgctataagtgcctgtccagctacacctctgtgaaagagaattttgacaagaagggcaatatcatcctggccgtgtccgatcatatcagtaaggtgctttatttataccagggcgaaaagaaactggaagaaatcttgcccctcggtccaaacaaggccctattctacaaaggaatggcaagctacttacttcccggtcagaagagcccctggttctttcaaaagccgaaaggagtcatcactctggacaagcaggttatttcaacatcgagtgacgctgagagccgggaggaggtcccaatgtgcagcgacgctgaaagtagacaggaagtgccaatgtgcaccgggccagagagcagacgagaggtcccggtttacacggattcagagcctcgtcaagaagtgccaatgtgcagcgaccccgaacccaggcaggaggtaccgacctgcactggcccagaatcccggagagaagtccccatgtgctccgatcccgaaccgcgacaggaagtaccaatgtgcaccgggccagaggccaggcaagaagtgccaatgtacaccgacagcgaacctcgtcaagaggtcccaatgtacaccgactcggagccccgtcaggaagtgcctatgtacaccggaagcgaaccgcgtcaagaagtccccatgtacaccggcccagagtcccggcaggaagttcctatgtataccggtcctgaatctcgtcaggaagtgctaattagaactgaccctgagtccagacaagagattatgtgcactgggcacgagtcaaaacaggaggtccccatctgcacagatccaatctccaagcaggaagactcaatgtgcacccacgcagagataaaccaaaagctgcctgtcgcgaccgactttgaattcaaactagaagccctgatgtgtaccaatccagagattaaacaggaggaccctaccaacgttggccctgaggtgaaacaacaggtgactatggtttccgacactgagatcctcaaagtagcacgaacccaccatgtgcaggccgagtcttacctggtctataacattatgagcagcggggagatcgagtgttcaaataccctcgaagacgagttggatcaggcacttccatcacaggctttcatctatagaccaatccggcagagggtgtattcactgctattggaagactgccaagatgtgactagcacatgcctagcagtcaaggagtggttcgtgtaccccggtaatccattgcgccaccccgacctggtcagacctcttcaaatgacaattccaggcggaacgccgtccctcaagatcctgtggctgaaccaagaaccagagatccaggtgcgtcgtctggacaccttgctggcatgtttcaatttgagctccagccgggaggagttacaggccgtcgagagtccattccaggccttgtgttgcctgctcatctatctttttgtgcaggttgacacgctctgcctcgaggacctccatgcttttatcgctcaggccttatgtctgcagggaaagtccacaagccaacttgtcaacttacaaccagactacattaaccccagggcagtccaactgggctccttactggtcagaggcctgacaaccctggtccttgttaattccgcctgcggttttccttggaaaacgtccgactttatgccatggaatgtattcgatggcaagctctttcaccagaaatacttgcagagtgaaaagggctatgccgtggaggtgctgctggaacagaacaggtctagacttacgaagtttcataacctgaaagctgtggtatgtaaggcctgtatgaaagagaaccgacgcatcactggcagggcccactggggctctcaccacgccggacggtggggccgacagggtagctcctatcacagaacgggaagtggctactctagaagctctcagggtcaaccttggcgggatcagggacccggaagccgacagtacgagcacgatcagtggagacggtattag

SEQ ID NO: 222732 - DNA, 2802 bp, Artificial Sequence
  Description of Artificial Sequence: Synthetic coding sequence
atgtttggacccagaggcagtacttctgcaggtgcagggcgtaaagagattctgagtcgatcctctgtcatgggcgttaggggtctgcagggctttgtggggagcacctgcccccacatatgtaccgtggtgaatttcaaagagcttgcggagcaccacagaagcaagtacccaggctgtacaccaacaattgttgtggatgcgatgtgctgcttgcggtactggtacacacccgaatcatggatttgcggtggacagtggcgggagtactttagtgccctgcgggattttgtgaagactttcaccgccgctggcattaagctcatttttttttttgatggaatggtggagcaagacaagagagatgagtgggttaaacgaagactgaaaaacaatcgtgaaatctcccgaatctttcattacattaagagtcacaaggaacagcccggtcggaatatgttcttcattccatctggtctcgcagtgtttacacgcttcgccctgaaaacacttggccaggagaccctgtgctctctgcaggaagctgactatgaagtcgcttcctatggcctgcaacataactgcttggggatcctgggggaagacaccgactacctgatctacgatacatgtccatattttagtatctcagaattgtgcctagagtctctagacactgtgatgctgtgtcgggagaaattgtgcgagtctttgggtttgtgcgtcgccgacctcccactccttgcatgtcttttagggaatgacataatacccgaagggatgtttgagtcattccgttacaagtgtctgtcaagctacacctcggtgaaagaaaatttcgataaaaaaggtaatattattttggccgtcagcgaccacatctcgaaagtgctgtacctgtatcagggtgagaagaagctcgaagagatcctcccactgggacccaacaaggccctgttctataaagggatggcctcatacttgctccccggtcagaaatccccttggttctttcagaagcctaagggggtgattacgttggacaagcaggtaatctccaccagctcggacgccgaatctagagaagaggttcctatgtgttccgacgctgagtcacgccaggaggtgccaatgtgtactggcccagaaagccgcagagaagtaccagtatacaccgactcagagcctcgccaggaggtgcctatgtgcagtgatcctgagcctaggcaggaagtgcctacatgcactgggccagagtctcgtcgggaggtacctatgtgctccgaccctgaacccaggcaggaggtccccatgtgtacagggcctgaggcaaggcaagaggtgcctatgtatacagattctgaaccgaggcaggaggttccaatgtacaccgactccgaacctcgccaggaagttcccatgtatactggcagtgagcctcgtcaggaagtgccgatgtacactggacccgaaagtcggcaggaggtgccaatgtacaccggtcccgaaagtcgccaggaagtgctcatccggacggaccccgaatctaggcaggagatcatgtgcaccgggcatgaaagtaaacaggaggtgccaatttgcacagaccccatcagtaaacaagaggactctatgtgcactcatgcggaaatcaatcagaagctgccagtggcaacagatttcgagttcaaactggaagctctcatgtgcaccaatcctgagatcaaacaggaagatcctactaatgtgggcccagaagttaagcagcaggttacgatggtgagcgacactgagattctgaaggtagccaggacccaccacgtgcaggcagaatcctacctggtttacaacattatgtccagcggagagattgagtgcagcaatacgcttgaagatgagctagatcaggcactaccttcccaggcgttcatatacaggcctatccgccaaagagtgtattccctgctcctggaagactgtcaggacgttacctcaacctgcttggccgttaaggagtggtttgtgtacccagggaatcctctgagacacccagacctcgtacgaccactacaaatgacaatcccaggcggtacaccgagtctaaagatcctctggctaaaccaagaacctgagatccaggttaggagactggacaccctgctggcttgcttcaatctgagttcgtccagagaggaacttcaggccgtggagtctcctttccaagccctctgttgcctccttatctacctctttgtgcaagtggacacattatgcctggaggaccttcatgctttcatcgctcaggctctgtgcctgcagggaaaatccacttctcagctcgtgaatctgcagcccgattacatcaacccacgggctgtgcaattgggcagtttgttggttcgagggttgaccaccctcgtgcttgtgaactccgcctgcggttttccatggaagacctcagatttcatgccgtggaacgtctttgatggcaaactatttcatcagaaataccttcaaagcgaaaaggggtacgccgttgaagtcctactagagcagaatcgcagcagactgaccaaattccataaccttaaggccgtggtgtgcaaggcctgcatgaaggagaaccggcgaataacaggtcgagcacactgggggagtcaccatgcgggacgctggggccgtcagggctcctcgtaccacagaacaggcagtgggtattctaggtcatcccagggccaaccttggcgagaccagggacccggatcacgacagtatgagcacgatcaatggagaaggtattag

SEQ ID NO: 222733 - DNA, 2769 bp, Artificial Sequence
  Description of Artificial Sequence: Synthetic coding sequence
atggacaggcagatgatcctgtctagaagcagcgttatgggggttcgcggactccaagggtttgtgggctccacctgcccacatatctgtacggtggtgaacttcaaggaactcgctgaacaccatcggtcaaagtatccgggatgcactccgaccatcgtggtggatgcaatgtgttgtctgcgttactggtacacacctgagtcctggatctgcgggggtcagtggagagagtatttctccgctctgagagattttgtaaaaaccttcactgccgcagggattaaactcatattctttttcgatggaatggtggaacaggacaagcgtgatgagtgggttaaacgacgactgaaaaacaacagggaaatctcacgtatcttccactacattaagtcccacaaggagcagccgggtagaaatatgtttttcatcccctcaggactggctgtgttcactcggttcgccctgaagaccctgggacaagagacactttgtagcctgcaggaggccgactatgaggtggcatcgtacggtctgcagcacaactgcctggggatcctgggagaagatacagactacctcatctatgatacctgcccatacttcagcattagcgaactttgcctggaatctctggatacagtgatgctctgcagagagaagctctgcgagtctctgggcttgtgtgtggccgacttgccgctacttgcttgtcttttagggaatgatataataccagaaggcatgttcgagtcctttcgatacaagtgtctgagcagctataccagtgtcaaggagaatttcgacaagaaggggaatattattttggctgtatccgatcatataagcaaagtgctgtacctgtatcagggagagaagaaactcgaggagattctgcccctggggccaaataaagccctattctacaagggtatggctagctatctgttgcccggacaaaaatcaccatggttcttccagaaacccaagggggtgataaccctcgacaagcaggttatctccacttcttcggacgccgagtctagggaggaagtgcctatgtgtagcgacgcagagagtcggcaggaagtacctatgtgcaccgggccagagtcacggagggaggtgccagtttacaccgactccgaacctcgccaagaggtgcctatgtgtagtgatcccgaacccagacaagaggtgcccacctgcactggtccagagagtcggcgagaggtgccaatgtgttcagatcccgagcccaggcaagaggtacccatgtgtacgggaccggaagctagacaggaagtacctatgtatacagacagcgaaccacgacaggaggttcctatgtatacagactcagagccccgtcaggaggtacccatgtacacagggtcggaaccaagacaggaggtccccatgtacacagggcctgaaagcagacaggaggtccctatgtataccggccctgagtctcggcaagaggtgctgattagaactgatcctgaaagccggcaggaaatcatgtgcaccggtcatgaatccaaacaagaagtgcccatctgcaccgaccccatttctaagcaggaagatagcatgtgcacacacgccgagatcaatcaaaagttacccgtggccaccgactttgaattcaagttggaggcgctgatgtgcactaatcccgagattaaacaagaagaccctacgaatgttgggccagaagtcaaacagcaggtgaccatggtcagcgacaccgaaattctgaaggtcgcacgcacacatcatgtgcaagcagagagctatctggtctataatatcatgtcgtccggagagatcgaatgttctaatacgctggaagatgaactcgaccaagcactaccctcacaggcctttatttaccgtcctatcaggcagcgagtgtatagcctcctcctcgaggattgccaggacgtcaccagcacatgtctcgccgtgaaagagtggttcgtctaccccggaaatcccttaagacatcccgaccttgtgaggcccctgcagatgacaattcccggtggtaccccatcacttaagattctgtggctgaaccaggaacctgagatccaggtgcgcagactcgataccctgctggcctgctttaacctttcaagttcccgcgaagagctccaggcggtcgagtcaccatttcaagctctgtgttgtttactgatttatctgttcgtccaggtcgataccttgtgcctggaggacctgcacgcatttatcgcccaggcgctctgtctgcaggggaagtccacctctcagctcgttaacctccagcctgattatatcaatcctagagctgttcaactcggctctctgttagtacggggacttaccaccctcgtactggtaaactccgcctgcggcttcccctggaaaactagtgactttatgccgtggaacgtgttcgacggcaagctgttccaccagaagtacctccaaagcgagaaaggctatgccgtggaagtgctattggaacagaatagatcccggctgacaaagttccataacctgaaggctgtcgtgtgcaaagcttgcatgaaggagaataggcggatcaccggcagggctcattggggatctcatcacgcaggacggtggggacgacaggggtctagttatcatcggaccggcagcggttactcccgctccagtcagggccagccgtggcgggatcagggaccaggctctcggcagtacgaacacgaccagtggcggcgttactag

SEQ ID NO: 222734 - DNA, 3291 bp, Artificial Sequence
  Description of Artificial Sequence: Synthetic coding sequence
atgggagttcagggttttcaggagttcttggaaaaacggtgccctggcgctgtggtccctgtcgacttgctgaagctggctcggaccgtgagccggcagcagcagcagcagcatctgcaccggcagctgccacccaccgccgctctcgcgcctggggctcccagggccgcaagagggagcgtgcccctccagccccctcttcctcctgctgccctcggtgcctactctggtggcgcaggtcctatcaggcaccaccatcctgcacatcattttcatcatcacggtcaagcccaacctggcctgcatcctcctctgccaccaccccctccccctcagctgccgggagccagggtgctggtcgacgctggcagcgcccttcctcgtctctacggaggataccaaactgactgggtttgcggtgggcagtggaacgccatgttagggtacctaagcgcactgtgtcaagcttgcgcgtatcctggaggggacggactggagctggtcgttatgttccctggcggtctcggcaaagacagattggcggaatgggggaggcgttgccaggccgaacggcagaccgctcagctcatcgtggggcacgttggaaacaaagggaccccacctcccagagcctggtttctcccaccagcttgtctgagccactgtgtcagactggctcttatcagattccgcgtcaaggtctttcagtcactggaggatcaccatttagaagtggtagccttcttccgcgagaatggatttcacggcctgttggcacacgacagtgaatacgctttgtacaatattcctagctactattctagtcatgccttaaagctgtcttggaatggcaagaatctgaccacaaaccagtttctcatgcaggaggtagctaaacaattagggctgaagcgaatgaacttcccgatcttcgccgctctccttggcaaccacatcctgcctgacgaagacctggccgcttttcactggtcactgctgggccctgaacaccctctcgcctctctgaaggttagagcccatcaattagtgctacccccatgcgacgtggttatcaaggccgtgtcagagtacgtgagctccatcaaggatccttcaaacctggatgtggtgggtaaggacgtgttcaagcagagccaaagcaggacagaagacaaaatcgaaagattcaagaaggccgtggaatattattccgtgacgactaaactgagtagtcttccagtcgggccaagcttccttggattccggaacaaccgattgggcaaccccccactccctcggaatcaggtggggactattagcgcaggcaaaccaatgttttcacaccaggtgcctcagaaagtaaaataccccccaccatttcccgtcggaccaaatagcagtctgttattctcgagtcacgccttgggcgagtcccacgccttttctgaagaccccatgttgcagaattctcctttcgccaactgggcggttagctacgattccagtgccagtcagttccccaattacctcccaagtaaagcttcaccccctttaggccctgacagtagccacagttcctccagcgacggcgatgagcccaatggtgccagcagcgatcatattacggaggcttttcatcaccagcctgagtggggtaacccaaacagggatcgtgggagttgggctcagcctgtggataccggggtgagtgaggcctcactgggcgacggggaacctcacatccctagcctgctgtccatgtcgacccggaatcatatggatattaccattcctccactccccccagtggccccagaggttctaagagtcgctgagcatagacatagacggggtttgatgtatccttacatctatcatgtcttgacaaaaggagagatcaagattccggtctgcattgaggatgagtgcaacatggagctgccgccagccgcactcctcttcaggagcgcaagacagtacgtctacggggtgctctttagcttagctgagacccaacggaaaatggaaagactggcaatgagacgcagactgccagtggaggttccctctgtaatcctgaaggaatggagcgcctacaagggcaagtcaccacagacccccgagctagtgtccgcattaactttcagggagtggacttgccctaacctgaaaaagctatggttaggaaaagctgtggaggacaaaaatcgcaggatgagggcctttctggcctgtatgaagtcagacacccctagcatgctgaacccggcaaatgtgccaacacacctcctgctgatgtgttgtgtgttaagatacatggtccaatggcctggtggtcgtattctgcaccggcacgagttagacacttttctggcccaagctgtctcgacacaactgtatgagccagacaggctccaggaattgaaaatagagaagctggacgctcggggaattcagctagccgcactgttcatgtccggggtcgacactgcattgttcgccaacgacgcctgcggtcagcctgtcccttgggagcattgttgtccctggatttacttcgacggcaagctgtttcagtctaaactcattaaggccggtcgagagagggtgtctctggtggagctttgtgatggccaggccgacctggccactaaagtcgaaaaaatgcggcagtccatactagagggcgtgaacatgaaccatccaccaccaagcgcactgctgccgagcccaacattcgtcccccctatggtgccctctctgtaccccgtcagtctctatagccgcgctatgggttccatgcctctcccaccgcaaggacgatctaggggattcgcgggtctgcaccctatcccaccccagggcggaaaactggaaatcgctggcatggtggtgggtcagtgggctggctcccggagttcgcggggaaggggctccttcggcatgcaggtggtttcagtcgggggacccggaaaaggccacggcaaagaacagactggtaggggcagcaagggacacaagaagggaaataaacagggctcttcggatggcgtgtcgaaatctcttgaactccaccaggggaggagccgaagtcaggtcaatggcaactcaggtgctctcatcaaggaggaaaagtctgaccacaggctccccgctccaagtcaatgtgccctgtcccgggacagcaacgagtgcaacaatgggaatagatatttgcccatgaacaaccgagagaagaatcacttgcaagaacagaaactcgaaactgtggctcaaaggaaagaggactag

SEQ ID NO: 222735 - DNA, 717 bp, Artificial Sequence
  Description of Artificial Sequence: Synthetic coding sequence
atgggcgtgcaagggttccaggaatttctcgagaagcggtgtccaggagctgtcgtgcctgttgacctgctgaagctggcccgaactgttagtcgccagcaacaacaacaacatttacaccggcagttgccccctacggctgctttagcaccgggagcacccagagccgcacggggatcggttcctttgcagccccctctgccccctgctgccctcggtgcctacagtggcggagctgggccaatcaggcatcaccacccagcgcatcactttcaccatcacggacaggcgcagccgggactgcaccccccactgcctccaccccctcctccccagctccctggtgctagagttttggtggatgccggatcagccttgcctcgtctgtacgggggttatcagacagactgggtatgtggcggacaatggaacgctatgcttggttacctcagtgcactatgccaggcctgcgcctacccgggaggagatggactcgagctcgttgtgatgttccccggagggctaggtaaggaccggctggccgaatggggcagacgctgtcaggcagagaggcagaccgctcagttgattgtgggacacgtgggcaataagggcactccccctccaagagcctggtttctgcctcctgcctgtctgagccattgtgtcaggctggccttgatcagatttcgcgttaaacaggcagccatgttgtag

SEQ ID NO: 222736 - DNA, 3408 bp, Artificial Sequence
  Description of Artificial Sequence: Synthetic coding sequence
atggagacccaaaaggacgaggccgctcaggccaaaggcgcagctgcatctgggagtacccgcgagcagaccgcagaaaagggtgccaaaaataaggctgcggaagccaccgaaggaccgacaagcgaaccttcctcaagtggtcccggaagactgaagaaaacagccatgaaactgtttggaggcaagaaaggcatctgtacacttccttctttcttcggcggtggacgcagcaagggctcaggtaagggttctagcaagaaaggactaagcaaatccaagacccacgatggtctgtctgaagcagctcacgggccagaggacgttgtatctgagggaaccgggttctccctacccctgcccgaattaccttgtcagtttcctagcagccagagcgcccacggcgcactcgagactggctctaggtgtaagacttctgtcgctggggctaccgagaaggcggtggcagagaagttcccctctatgccaaaacctaagaagggattaaaaggcttcttctcaagcattcggagacatcgtaagagcaaggtgacgggcgctgagcagagcgaacccggagccaaggggccagagcgtgtgcgggctaggccacatgagcatgtgtcgagtgctccacaggtcccatgctttgaggagactttccaggcccctagaaaagagaacgccaatccccaggatgccccaggccctaaagtgtcccctacaccagaacccagccctcctgctaccgaaaaaatggcatgcaaagaccctgagaagcctatggaagcttgcgccagcgctcacgtgcagccaaagcctgcgccagaagccagtagtcttgaggagcctcactctcctgagaccggggagaaggtggttgctggagaagtgaaccctcccaacgggcctgttggcgaccctctgagtctcctctttggcgacgtcactagcttaaaatccttcgacagtctcacggggtgcggcgacatcatcgccgaacaggatatggactctatgacggactctatggcctccggtggccaaagggcaaaccgtgacgggacgaagaggtccagctgcctagttacttaccaggggggaggggaggagatggccctgcctgacgacgacgacgaagaggaggaggaagaagaagaggttgaacttgaggaggaggaagaagaggtaaaagaggaggaggaagacgatgatctcgaatacctgtgggaaacagcacagatgtatcccaggcccaatatgaatctgggctatcatcccaccacttcccctggacatcacgggtatatgttgttggatcccgtgcgctcgtaccctgggctcgctcctggagagttactaacgccgcagagtgaccagcaagagtccgccccaaacagcgatgagggctactacgattcaactacgcccggatttgaggatgacagcggagaggctctcgggctcgtccggagggattgcctcccgcgagattcgtacagtggggatgctctgtatgaattctacgagcctgatgactccctggaaaattctcccccaggggacgactgcctctatgaccttcatggtcggtccagcgagatgttcgatccgttccttaactttgagccttttctgtcctcccgacctccgggagccatggagacggaggaagagagattggtgaccattcagaagcaactgttgtactgggagctgcggagggagcagcttgaagctcaggaggccagggcccgtgaagcccacgccagagaggcccacgctagagaagcatacactcgcgaggcttacggcagagaagcctacgctcgggaagcccacacttgggaagcccacggcagggaggcgaggactcgagaggcccaggccagagaagtccgatgtagggagacacaggtccgagaaacccaggctaggcaagaaaaacccgtcctggaataccaaatgcggcctttggggccatccgtaatggggctcgcagctggcgtgtcgggcacgagccagatcagtcatagaggcatcacatctgccttcccaactacagcatcctcagaacctgactggagagatttccggcctttggagaaaagatatgagggaacctgttccaagaaagaccaatccacttgcctcatgcaattgtttcaatccgacgccatgttcgagccagatatgcaggaagctaattttggcggtagccccagaagagcctacccaacatactcacctccagaagacccagaagaggaggaagtcgaaaaagagggcaacgctacagtcagctttagccaggccctagtagagttcacttccaatgggaatctcttcagcagtatgtcgtgttcaagcgatagtgacagctcatttactcaaaacctccctgaactcccccctatggtcacgttcgacattgccgatgttgagagagacggggaaggaaaatgtgaagagaatcctgagttccataatgacgaggacctagctgccagtctggaagccttcgaactaggatactatcacaagcacgcttttaacaactaccactccaggttttatcagggcctgccctggggcgtttcctctctgccacgttaccttgggctgcccggactgcaccccaggccaccgcctgctgcaatggccctgaaccgacggtcacgcagcctggacacagcagagaccctggaaatggaactctcgaatagtcatctggtgcagggctacttggaatcagacgaattacaggcgcagcaggaagactcggatgaggaggacgaggaagaggaagaaggagagtggtccagagattcacctctgtcactgtacacggagcctcctggagcctatgactggcccgcatgggcaccttgtcccctccccgtcggtccaggcccagcctggatcagtcccaaccagttggataggccgtcttcacagtccccctatcgacaggctacctgttgtatacctccaatgacaatgagcatcagtctgagcgttccagagtctcgcgctcctggcgagagcggcccacagctggcacgcccttcccacttgcatctgcccatgggcccttgttacaacctgcagccccaagcctcgcagtccatgagggcacgccctcgcgacgtcctgttgcccgtcgatgagccaagctgttctagttcatccgggggattctctccgagccccctgcctcaggcaaagccagtgggcataacacacggcattccccagcttcccagagtgcggccagagcacccgcaaccacagcctacacactacggaccttcttcactggacctatcgaaagagagagctgaacagggcgcttccctggcaacctcatactcgagcacggccatgaacggtaaccttgcaaagtag

SEQ ID NO: 222737 - DNA, 2415 bp, Artificial Sequence
  Description of Artificial Sequence: Synthetic coding sequence
atggagacacagaaggatgaggccgcacaggccaagggcgcagccgcatccggttccacaagagagcaaacagcagagaaaggagctaaaaataaagccgcagaagctaccgaaggccctacttctgagccgagctcttcaggccctggcagacttaaaaaaacagccatgaaacttttcggaggtaaaaaaggcatatgtacattaccctctttcttcggagggggacgctccaagggcagtggcaaggggagtagcaaaaaagggttgtctaagagcaaaacacacgatggcttatcagaagctgctcacggccctgaggatgtggtctccgagggtacgggatttagcctccccctccccgaactgccgtgtcaatttcccagttcacaatcggcacacggggcactggagactggttccaggtgtaagactagcgtggcaggggcaaccgaaaaagctgtggccgaaaagttccccagtatgccaaaacctaaaaaaggattgaaagggttctttagttcaatccgccgtcatagaaaatccaaagttaccggagcggagcagtcagaacccggagccaaggggccagaaagagttcgggcacggcctcacgagcatgtgagctccgcacctcaggtgccttgttttgaagagactttccaagcaccacggaaagaaaatgccaacccccaggatgctcctggcccaaaagtgagccctacccctgaaccttccccacccgcaacagagaagatggcgtgcaaagacccagagaagccgatggaggcttgtgcctccgcgcacgttcaaccaaaacccgctcctgaagcgagtagtctggaggagccccattctccagagacaggcgaaaaggtcgtggctggcgaggtcaaccccccaaacggaccagtgggagatcctttgtcactgttatttggcgatgtgacttcactgaagagcttcgacagtcttactgggtgcggagacataatcgccgagcaagatatggatagcatgactgactcaatggcgagcggcggtcagcgtgcaaacagagatggcactaagagatcatcctgtctggtgacctatcaggggggaggggaggaaatggctttgcccgacgacgacgatgaggaagaggaagaagaggaggaagtggagttggaggaggaggaggaggaggtaaaggaggaggaggaagatgacgatctagaatacctgtgggaaaccgctcagatgtacccaaggcctaacatgaatctagggtatcaccccacgacttccccgggtcatcatgggtatatgctccttgaccctgttcggtcctacccaggcctcgcccctggcgaactgctgaccccgcaatcagaccaacaggagagcgccccaaactcagacgagggctattatgactcgaccacccctggcttcgaggatgacagcggcgaggcccttggtctggtgcggagagattgcttacctagggacagctattccggcgacgctctgtacgaattttacgagcccgatgactctctcgaaaattctccaccgggagacgactgcctttatgacctccatggccgtagtagtgagatgttcgatccatttttgaattttgaaccttttctcagctcccgtcctccaggggcaatggagacagaggaagagcggctggtgacgatccaaaaacagttgctttattgggaactgaggcgagaacagctagaagcccaggaggctcgggctcgggaggcccacgccagggaggcccatgccagagaggcctatacacgagaggcttacggcagggaggcctacgcgagagaagcgcacacgtgggaagctcacggacgagaggcacggactcgcgaagctcaggcacgagaggtgcgatgtagagagacgcaggttagagagacgcaggcacgacaagagaagcccgtcctagagtatcaaatgaggcccctcggcccttccgtgatgggactcgctgctggggtcagcggcacctcccaaatctcacaccgagggattaccagtgcttttcccaccactgcaagttccgagcccgactggcgcgactttagacccctggagaaacggtatgaaggcacgtgcagcaaaaaagaccaatcaacctgcctcatgcagttgtttcagagcgatgctatgttcgaaccagacatgcaagaagccaactttgggggttcccccagacgggcatatccgacgtacagtcccccagaggaccctgaggaagaggaagtggagaaggaaggcaatgccactgtatctttcagccaagccctagtggaatttaccagcaacggcaacctctttagttctatacgatgccccggtaccgaagacaaacgccaagtgacacaagcatgtgggacatggtag

SEQ ID NO: 222738 - DNA, 1566 bp, Artificial Sequence
  Description of Artificial Sequence: Synthetic coding sequence
atgtttaccagcgagaaaggcgtggtggaggaatggctgagcgagttcaagacgttgcccgagacttcactgcctaactacgcaactaatctcaaagataagagctcattggtttcttccttatacaaagtgatccaggaacctcagagcgaactgttggagcctgtgtgccatcagctcttcgaattctatcgctccggcgaggagcaactcctgcagttcactctgcaatttctgcccgaacttatatggtgctacctggctgtgtccgcttccagaaacgtgcacagctccggttgtatcgaagcactgcttctcggagtgtacaatctcgaaatcgtagacaaacagggccataccaaggtgctgagctttaccatcccttctctgtccaagccgtcagtgtatcacgaacctagttcaattggaagcatggcgctgacagagtccgcgctgtctcagcatggtctatcgaaggttgtgtattcaggtccacacccccaacgggaaatgctcactgcacagaatcggttcgaggtgctgacgttcctcctgctgtgttataacgctgccttgacatacatgcccagcgtttctctacaatccctttgtcagatctgcagccgcatttgtgtttgcggttatcctcgccagcatgttaggaaatataagggcatttcttcccggattcccgtctcatccggctttatggtgcagatgctgactgggatctatttcgcgttttacaacggagaatgggatctcgcacagaaggcgctcgatgatattatttaccgtgcacaactggagctctacccagagccattgctggtggccaacgctatcaaagcctccttgcctcacggacccatgaaaagcaacaaggaaggtacacgctgcatccaggttgaaattacccccaccagctctcgcataagtagaaatgccgtcacttctatgagcattcggggacaccggtggaagcgacatgggaacaccgagttgaccggccaggaggagctgatggaaattagcgaagtggacgaaggtttctattctcgggctgcgtccagtacttcccagtcaggcctgagcaatagtagtcataactgctccaataagccttcgatcggcaagaatcacaggcgctctggcggtagcaagacaggaggcaaggagaaggagaccacaggagagtcatgcaaggaccatttcgctaggaaacaaactcagagagcacagtcagagaacttagagctgttgagtctcaaacgcctgaccctgactactagccagagtttgccaaagccgtcctctcacggcctggctaaaaccgccgctactgttttctccaaaagttttgaacaggtgtctggcgtgactgttccacataacccaagcagtgcagttggctgcggcgctggaacggatgcgaaccggttcagtgcgtgctctctgcaggaggagaagctaatatacgtgtctgaacgcacagaattaccgatgaagcaccaatcgggccagcagcggccacccagcatctctatcacgctgtctacagactag

SEQ ID NO: 222739 - DNA, 342 bp, Artificial Sequence
  Description of Artificial Sequence: Synthetic coding sequence
atggacggcagggtgcagctgattaaagcacttctcgctctgcccataagacctgccacacggagatggagaaaccctatcccctttccagaaaccttcgacggcgatacagacagactgccagaattcatcgtgcaaactggctcctacatgttcgtggacgagaatacctttagcagcgacgctctgaaggtgacattcctcataactagactgaccgggcctgccctgcagtgggtgatcccgtatattaagaaagaatctccactgctcaatgactatcgtggctttttagcagaaatgaagagagtcttcggttgggaagaagacgaggacttctag

SEQ ID NO: 222740 - DNA, 2241 bp, Artificial Sequence
  Description of Artificial Sequence: Synthetic coding sequence
atgggcgacgtgctgtccacacacctggacgatgctcggaggcagcacatcgcagagaagactggcaaaatccttaccgagtttctacagttttatgaagatcagtacggcgtggccttgttcaacagcatgagacatgagattgaagggacaggactaccccaggcccaattgctgtggagaaaggtgcctcttgatgagagaatcgtattctccggtaatctgtttcagcatcaggaagattctaagaaatggagaaacagattcagcctggtcccccataattatgggttagtcctgtatgagaacaaagcagcctacgaacgccaggtcccacccagggcagttatcaacagtgctggttataagatcctaacatctgtggatcagtacctggagttgattgggaacagcttacccggaaccacggccaaaagtgggtcggctcctatactcaagtgcccgacccagtttcctctcattctgtggcatccctacgctcgacattactacttttgcatgatgaccgaagctgagcaggacaagtggcaagccgtgttgcaagattgtatcaggcattgcaataacggcatccctgaagactcgaaggtcgaaggaccggcatttacagacgcaatacgcatgtatagacagagcaaagaactctacggaacatgggagatgctgtgtggaaatgaggtgcagattctgtccaacctggtgatggaagagttgggaccagagctgaaggccgagctcggaccacgcctgaaggggaaaccacaggagcgtcagagacagtggatccaaatcagcgacgccgtgtatcacatggtgtatgagcaagccaaggccaggttcgaggaggtcttaagcaaggtgcaacaggtgcagccagctatgcaagccgtgattcggacagatatggaccagattatcaccagcaaagaacatctggctagcaagattcgggcatttattctgccaaaggcggaggtgtgtgtacggaaccatgtccaaccttatatcccctccattcttgaggcactcatggtccccacgagccagggcttcacggaagtcagggacgtctttttcaaagaggtgaccgatatgaacctgaatgtgattaatgagggaggcattgacaagctcggcgaatatatggagaagctgtcccgtctggcataccatcccctgaagatgcagtcctgttatgaaaagatggaaagcctccgactcgacggattacagcagaggttcgatgtgtcctctacttccgtatttaagcagagagcccagattcacatgcgcgaacagatggacaacgctgtgtatacgttcgagacattacttcaccaggagctgggcaaaggacctacaaaagaagagctctgcaaatccatacagcgagtactggaacgggtcctcaagaaatatgattatgactcgtcaagcgttcggaagcgtttctttagggaggccctgttacagatctccatcccatttctgttgaagaaactggcgccaacgtgtaagtctgagctccctcggtttcaggaattaatatttgaagactttgcccgattcatcttggtggaaaatacttatgaggaggtcgtcctgcagactgtcatgaaggatattcttcaggcggtgaaagaagcagcagttcagcggaaacataacctgtatcgggattcaatggtgatgcataattccgatcctaacctccacctgctagcagaaggggctccaatcgactggggagaagaatactccaattcaggcggaggaggatccccttcaccatcgaccccggagtctgccactctaagcgagaagaggcgccgagccaaacaggtcgtatccgtggtccaggatgaggaagtggggttgccctttgaggctagcccagagtcacctcccccagccagccctgatggcgtgactgagattaggggattgctggcgcaaggcctccgcccagagtctccccctccagcaggaccattgctaaacggagcgcctgccggagagtctccgcagccaaaggctgctcccgaagcctccagtccgccagcctccccgctgcagcacctgctccctgggaaagccgttgatctcgggcctcccaaaccatcagatcaagaaacgggcgaacaagtcagctccccgtctagccaccccgcactccataccaccacagaagattcagctggagtgcaaactgaattttag

SEQ ID NO: 222741 - DNA, 2202 bp, Artificial Sequence
  Description of Artificial Sequence: Synthetic coding sequence
atgggatggatgggagagaagactggcaagatcctgacagaattcctgcagttctacgaggaccaatatggagtggcactcttcaatagcatgcgccacgagatagaaggaaccggcctcccccaggctcagctgctgtggcggaaagtgccccttgacgagcgcatcgtgtttagcggtaatctctttcagcaccaagaggactctaagaagtggaggaacaggttttctctggtgccccataactacggcttggtcctatacgagaacaaggccgcatacgaaagacaggtccctccccgtgctgtgattaatagtgctggatataagatcctgacctccgttgatcagtatcttgaactgatcggtaattcacttcccggaacaacagcaaagtccggcagcgctccaattttgaaatgcccaacccagttcccactgatcttatggcatccttacgccagacattactatttctgcatgatgacggaggcggaacaggataagtggcaagctgtcttacaggattgcatcagacactgtaataacggcatcccagaagactctaaggttgagggtccagcttttaccgacgccatacgaatgtatcgacaaagtaaagaattgtatggcacatgggaaatgctgtgcggtaacgaggttcagatcctctccaacctcgttatggaggagctagggccagagctgaaagctgaactcggccctcgcctaaaggggaaaccccaggagcggcaaagacagtggatccagatcagcgacgcagtctatcatatggtctatgagcaggctaaagcaagattcgaagaggtgctttctaaggttcagcaggtacagccggctatgcaagcagttatcagaaccgatatggaccagatcatcaccagcaaggaacacctggcatccaagattagagccttcattttgccaaaggccgaagtctgcgttcggaaccacgtgcagccatacatccccagcattctggaggccctcatggttccgacaagtcaaggctttaccgaagtgagagacgtgttcttcaaggaggttacggacatgaacctgaatgttattaatgagggcggaatcgataaattaggcgaatacatggaaaaattgagccggctggcttaccacccactcaagatgcaaagttgctatgaaaagatggaatctctccggctcgatggcctgcaacagagatttgacgtgagcagtaccagtgtgtttaaacagcgggctcagatacacatgagagagcagatggacaatgccgtgtacaccttcgaaactcttcttcaccaagaattgggtaagggtccaacaaaagaggagttgtgtaaatctattcagcgtgtactagaacgcgtgctgaaaaagtatgactacgattcctcaagcgttagaaagcgtttttttagggaagcgctcttgcagatatcaataccattcctcctgaagaagctggctccgacgtgcaagagcgaactgcctcggttccaggaactgatttttgaggattttgcccgttttatattggtcgagaacacatatgaggaagtggtgcttcaaaccgttatgaaggatatcctccaggcggtgaaggaggccgctgtgcagcggaagcataatctctaccgggattcgatggtcatgcacaattcagatccaaaccttcacctgctagccgagggtgccccaatcgattggggcgaagagtacagcaactcaggcggtggaggtagcccatcccctagcactcccgagtcagctacgctaagtgaaaagcggaggagggccaagcaggtagtaagtgtcgtccaggacgaagaggtcggtctgccctttgaagcatcaccagaatccccaccgcctgcgagcccggatggggttacggagatcagaggcctcttagcccagggtctgcgccctgagtctcctccacccgcaggccctctgctcaacggcgctcccgctggagagtctccgcaaccaaaagcagccccagaggcatcttctccacctgcgagccccctgcagcacttgctgcctgggaaagccgtcgatctaggcccaccaaaacctagcgaccaggagactggggagcaggtaagctcgccctcctcacaccccgcactccacactaccactgaagactccgccggtgtccagaccgaattctag

SEQ ID NO: 222742 - DNA, 1191 bp, Artificial Sequence
  Description of Artificial Sequence: Synthetic coding sequence
atggtacctacctctcagggttttacagaggtgagggatgtgtttttcaaagaagttaccgatatgaacctgaatgtcattaatgaaggaggaatcgacaaactcggggagtatatggagaagctgtcccgacttgcctatcaccctttaaagatgcagtcctgctacgagaaaatggaatccctgagacttgatggcctccagcaaagatttgacgtgtccagtaccagcgtgttcaaacaacgggcacagattcacatgcgcgaacaaatggacaacgctgtgtacaccttcgaaactctgttgcaccaggagctgggcaagggtccaacaaaggaagaactgtgtaagtcaatacaaagagtcctagaacgcgtgctcaagaagtatgactatgactcctcaagcgtcagaaaacgatttttccgcgaagctctgctgcagatctcaattcccttcctgcttaaaaaactcgccccaacgtgtaagagtgaactgccaaggtttcaggagctgatcttcgaagacttcgccagatttatattagtggaaaatacctatgaggaagttgtgctgcaaactgtgatgaaggacatcttgcaagctgtgaaagaggcagctgttcagcggaaacacaatctgtacagggattccatggtgatgcataactccgatcccaacctacacctgttagccgagggagctccaattgactggggggaagagtattcgaattccgggggaggcggttctccatcaccatcaacaccagagtccgccaccctctctgaaaaaagacgcagagccaagcaggtggtatctgtcgtgcaggacgaagaagttgggttaccctttgaggcgagccccgaaagcccaccccctgctagcccagacggcgtaactgagattagaggcctgttggcccaaggtctgcgacctgagtctccgcctcccgctgggccactccttaatggcgcaccagcaggggaatctccccagcccaaggcggctccggaagcctcatctcccccagcctctcctctgcagcacttacttccaggcaaagctgtggacctgggccctccaaagcctagtgaccaggagacaggagagcaggtaagttccccatcaagccaccctgcactgcatacaacgaccgaagattccgctggggtacagactgagttttag

SEQ ID NO: 222743 - DNA, 3072 bp, Artificial Sequence
  Description of Artificial Sequence: Synthetic coding sequence
atgggggcaggagccctcgccatctgtcagtctaaagcagcggtgcgactgaaggaagatatgaagaaaattgtggcggtgccactgaacgagcagaaagacttcacctatcagaaactgtttggagtctctttgcaagagcttgaacggcagggactcacggaaaacggaattcctgccgtcgtttggaacatcgtagaatatctgacacaacacggtcttacacaagaagggctgtttcgcgtaaatgggaatgtgaaagtcgttgaacaactgagactgaagtttgagtcaggagtacctgtggagctcggcaaagatggggacgtgtgtagcgctgctagcctcttaaagctcttcctgcgcgagttgccagatagccttattactagcgccctgcaaccgcgttttatccaattattccaggatgggagaaatgatgtgcaggagtcctccttgcgcgatctcataaaagagcttcccgacacccattattgtctgctgaagtacctgtgccagttcctcacgaaagtcgccaagcaccatgtgcagaatcggatgaatgttcacaacctggccacagtgtttggcccaaattgcttccacgttcctcccggattagaagggatgaaggagcaagacctctgcaataaaatcatggcaaagattctggaaaattataacactctttttgaagtcgaatacacagaaaacgatcacctgagatgtgagaatctcgcacggctgatcatcgtcaaagaggtgtactacaagaattcattaccaattttattgaccaggggactagaaagagatatgcctaagccacccccaaaaactaagatcccaaagagcagatcagagggatccattcaagcccaccgcgtgctccagcctgagttaagcgacgggatcccccagctctccctgaggctgagttatagaaaggcttgcctggaggatatgaattcagccgagggcgcaatttcagccaagctcgtcccgtcatcacaagaggacgagcgcccacttagcccgttctacctgtcagcccatgtgcctcaggtgtcaaatgtatcagccaccggcgagctcctcgagagaacgatccggagcgctgtagagcagcatctttttgacgtaaataacagcggcggtcagtctagcgaagactcagagtccggcaccctctctgcttcttcagcgactagtgccaggcaaagacgcaggcagtccaaggaacaagatgaggtgagacatgggcgagataaaggactcattaataaggagaatacgcccagtggattcaaccaccttgatgactgtattctgaacacacaagaggtcgaaaaagtccacaaaaacacattcggttgcgccggtgagagaagcaagcctaagcgtcagaaatcctctacaaaactgtcagaactgcacgacaatcaggatgggttggttaacatggagtcgctcaactctaccagaagccacgaaagaaccggccctgacgacttcgaatggatgtctgatgaacggaaaggaaatgagaaggacggcggacatacccaacacttcgagtctcccaccatgaagatacaagaacatcccagtttatccgacaccaagcagcagcgcaatcaggatgctggcgaccaggaggagtcctttgtctccgaggttccccaaagtgaccttaccgcactgtgcgacgaaaaaaactgggaggagcctattccagcattcagcagttggcaaagagagaattccgatagcgatgaggcccacctcagccctcaggccggaaggctgatcagacagcttctcgacgaggatagtgatccgatgctttcgcccaggttctacgcttacggacagagtcggcagtaccttgacgacactgaggtcccaccttctccacccaactctcactcatttatgagaaggcgcagtagcagtttgggttcctacgatgatgagcaagaggacctcacccctgcacagctcacccgaaggattcagtcactgaagaaaaagataaggaagttcgaagatcgcttcgaagaagaaaagaaatataggccatctcacagcgataaagccgctaaccccgaggttctcaagtggactaatgatcttgccaagttccgcagacagctgaaagagagtaagctgaaaatttcagaggaggaccttacaccaagaatgagacagagatccaatacccttccaaagagcttcggttcccagctggaaaaagaagatgaaaagaagcaggaactcgtcgataaagccatcaagccttcagttgaggccacccttgagtccatccagagaaagctccaggagaagagagccgagagtagtcgacccgaagacatcaaagatatgacaaaggatcaaattgctaatgaaaaggtagctctgcagaaagctttattgtactatgagtcgattcacggcaggcctgttacaaaaaacgagagacaagtcatgaagcccttatacgacagatacaggttagtgaagcagatcttgagcagggcgaatacgattccaattattgggtctccaagtagcaaaaggcggtctcctttgttgcaaccgattatcgaaggcgagacagcgagtttcttcaaggaaatcaaagaagaagaagaaggttcagaagatgatagcaatgtgaagcctgatttcatggtgacgctcaagaccgacttctccgctagatgtttcttagatcagttcgaggacgatgccgatggtttcattagcccaatggatgataaaattccttctaagtgttctcaggatactgggttgagtaatcttcatgccgctagtatccccgagctcttagagcacctccaagagatgagagaagagaagaagcgcattcgaaagaagcttcgggacttcgaagacaacttttttagacagaatgggaggaacgttcagaaggaggataggacccccatggctgaggaatattccgagtacaagcacatcaaagctaagttgcgcctgcttgaagtcctcatctcaaagcgagacaccgacagtaaatcaatgtag

SEQ ID NO: 222744 - DNA, 2010 bp, Artificial Sequence
  Description of Artificial Sequence: Synthetic coding sequence
atggcttgtgaaataatgcctttgcaaagctcgcaggaggatgagcgccctctgtccccattctacctctccgcacatgtcccgcaggtcagcaatgtctcagctaccggagagctattggaacgcaccattcgaagtgccgttgaacaacatctcttcgacgtgaacaatagcgggggtcagagcagtgaagactccgaatcaggaacattatctgcctccagtgccacctccgccaggcagagaaggaggcagtcaaaggagcaggatgaggttcgccacggtcgggataaggggctcatcaataaggaaaataccccttctggttttaatcaccttgatgactgcattctaaatacccaggaagtggagaaagtgcataagaataccttcggatgtgcaggtgaaagatcaaaaccaaagaggcagaagtcctctacaaaactttcagaactgcatgacaatcaagacgggctagttaacatggaatctttaaacagcactcgatcacacgagaggacagggcctgatgatttcgaatggatgtccgatgaaagaaagggcaatgaaaaagacggagggcacacgcagcacttcgaatcccctaccatgaagatacaagagcatccgtctctgagcgataccaaacaacagcggaaccaggacgccggagatcaggaagagtccttcgtttcggaggtgcctcaaagtgaccttaccgccttatgtgacgagaagaactgggaggagccgatcccagccttctcttcctggcagcgcgagaactccgatagcgatgaggcacacctctctccccaagccggacgactcattcgtcaactgctggatgaagactccgaccccatgctctcgccgaggttttatgcttacggacagagccggcagtatttggatgacaccgaagttcccccttccccaccaaactcacactcattcatgaggcgtagaagtagcagtctcggctcctacgatgacgagcaagaagacttgacaccggctcagctgactcgcagaattcagagtctgaaaaagaagattcgcaagtttgaggatcgatttgaagaggagaaaaagtatcggccaagccacagtgataaggccgctaacccggaggtcctgaaatggacaaatgacctcgctaaattccgtagacagttgaaagaaagcaagctcaagatcagcgaggaggatttgaccccacgcatgagacagagatctaataccctccccaagtccttcggatcccagctggaaaaggaagacgaaaagaagcaggaactggtggacaaggccataaagccctcggttgaggcgacactggagagtatccaacgtaagcttcaagagaagagggcagaatcctcccggcctgaggacattaaggacatgaccaaggaccagatcgcgaacgagaaagttgctctgcagaaagccctactgtactacgaatcaatacacggccgtcccgtgaccaagaacgaacgacaagtaatgaaacctctatatgatcggtatcgtctggtgaagcaaatcctgtctagagccaacacgattccaataatagaagaagaggaaggttcagaggacgatagcaacgtcaagcctgactttatggtaacgttgaaaacagacttcagtgccaggtgtttcctcgatcagttcgaggacgatgcagatggatttattagccccatggacgacaagattccatctaaatgttcccaggatactggcctgtctaaccttcatgcagctagcatccccgagctgttggaacatcttcaggaaatgcgtgaagaaaaaaagaggatacgtaaaaagctgagagactttgaggataacttctttcggcagaacggtagaaacgtgcagaaggaagaccgaactccaatggccgaagaatacagtgaatacaagcacataaaggccaaacttcggctgctcgaagtgctgatatcaaagagggatacggatagcaaatcgatgtag

SEQ ID NO: 222745 - DNA, 2094 bp, Artificial Sequence
  Description of Artificial Sequence: Synthetic coding sequence
atggcttgcgaaatcatgcccctgcaatcttcacaagaagatgaaagacccctgagccctttttacctctctgctcacgtccctcaggtgagcaacgtctccgctaccggcgagttgttggaacgaaccatccgcagcgccgtggagcagcacctctttgatgtgaataatagtgggggacagtcttccgaggacagcgagtctgggacattatcagcctccagcgctacgagcgcacggcaaagacgacgccagtccaaagagcaagatgaggtacgccatgggcgtgacaagggacttatcaataaggagaatactccgagtggattcaaccacttggacgattgtatcttgaatactcaggaggtggaaaaagtccacaaaaacacgttcggatgtgccggagagagatccaaacctaaacgccagaagagctccaccaaactatccgaactgcacgacaatcaggatggcctcgtcaatatggagtcccttaacagtaccaggagccacgaacggactggaccagatgatttcgaatggatgagcgacgaaaggaaaggaaacgagaaagatggagggcatacccaacactttgagtctcccacaatgaagatccaggaacatcccagtttatctgacacgaagcaacaacgcaaccaggacgcaggtgaccaggaagaatcatttgttagcgaagtgcctcagagcgatttgacagctctgtgcgatgaaaagaattgggaggagcccattcctgccttttcgagctggcaacgcgagaattctgacagtgatgaggcccacctgtcccctcaggcaggccgacttatccgccagctgctcgatgaagactcggacccaatgttgtccccccgtttttacgcctatggccaatcccggcaatatttagacgacaccgaggtgcctccttctcctcccaacagtcatagctttatgcggcgaaggtcgtcttcactggggagctacgacgatgagcaggaggatctgacccctgcccagttgacgaggagaatccagtcattaaagaaaaaaatccgcaagtttgaggaccggttcgaggaagaaaagaagtacagaccatcacatagcgacaaagcggctaatccagaggttctgaaatggaccaacgacctggctaaatttcgccgtcagctgaaagaatccaaacttaaaatttccgaagaggatctgacccctcgcatgaggcagagaagcaacacccttcctaagtctttcggctcccagttggagaaagaagacgagaagaagcaagaattagtcgataaggccattaagccttcagttgaggcaacattggagtcaatacagcgaaaactccaggagaaaagggccgagtccagccggcctgaggatatcaaggacatgacaaaagaccagattgccaacgaaaaggtagccttgcagaaggcactcctgtattacgagtccatacacggccgacccgtgactaagaacgagcgccaggtcatgaaaccactgtacgaccggtatagacttgtgaaacagatcctgtcccgggcaaacaccattcccattatcgggagccccagctcgaaacggcgatcacctttattgcagccgataatagaaggcgaaacagccagcttcttcaaggagatcaaggaagaggaggaaggctccgaggacgactccaacgtaaagcccgactttatggtgaccctgaagactgatttttccgcaagatgctttctggaccaattcgaagatgacgccgacggctttatctccccgatggacgataagatcccatctaaatgctcacaggacaccggactcagtaacctgcacgcagcttccatccctgagctgcttgagcacctacaggagatgcgagaggagaaaaaaagaattagaaaaaagttgagagattttgaggacaactttttccgccagaacggcagaaacgtccagaaggaggatcgcacgcccatggccgaagagtatagcgagtataaacacataaaagccaagctgcgcttactggaggtactgatctcgaagagagacaccgattctaagtcaatgtag

SEQ ID NO: 222746 - DNA, 609 bp, Artificial Sequence
  Description of Artificial Sequence: Synthetic coding sequence
atgggtgccggtgctttagccatttgccagtctaaagctgctgtgcgcctgaaagaggatatgaagaagatcgtggcagtgccgcttaacgagcagaaagactttacctaccagaagctgtttggggtgagcttacaagaattagaacggcagggtctcacggagaatggtataccagctgttgtttggaatatcgtggaatatctgacccagcacgggctgactcaggagggcctattccgtgtcaacggcaacgtgaaagtcgttgaacaacttcggctcaagtttgagtcgggcgttccagtggagcttggcaaggacggcgacgtgtgctctgccgcatcgctcttaaagttatttcttcgggaactgcctgatagcttgatcacatcggctttgcagcctaggtttattcaactgtttcaggatggtaggaatgatgttcaggagtcgtctttgagggacttgatcaaagagctcccagacacacattactgtctcctgaagtatttgtgtcagtttttaaccaaggttgcgaaacaccacgtgcaaaaccgtatgaacgtccacaatttggcaaccgtttttgggcctaattgcttccagtag

SEQ ID NO: 222747 - DNA, 1494 bp, Artificial Sequence
  Description of Artificial Sequence: Synthetic coding sequence
atggcatcgccggcacctccagagcatgccgaagaaggatgccccgcacccgctgccgaggaacaggcccctccatcccccccacctccccaggcctctcccgctgagcgccagcaacaggaggaggaagcacaggaggccggtgccgctgagggtgcaggactgcaagtagaagaggcagcaggtcgcgctgctgccgcagttacatggctgctaggggagcctgtgttgtggctgggttgtcgagctgatgagctgttatcctggaagcggccactgaggtctctgttgggttttgtggcagccaacttgcttttttggttcttggcattgacaccttggagggtgtaccaccttatcagcgtgatgattttgggcagagtcattatgcagattattaaagacatggtgctatctaggacaagaggcgcacaactctggagaagtctgagtgaatcgtgggaagtgataaacagtaagcctgatgaacgaccaaggctttcacactgtatcgctgagtcctggatgaatttttccatttttctacaagaaatgtccttatttaagcagcagagcccgggtaagttttgtcttttggtctgttcggtttgtacttttttcaccattctcggctcctacattcccggagttattttgagttacctgttactcttgtgtgctttcctgtgcccgctatttaagtgtaacgacatcgggcagaagatctattctaaaattaaaagcgtcctcctgaaactcgacttcggaattggggagtacatcaaccagaagaaacgggagcggagcgaggccgacaaggagaagtcacacaaggacgacagcgagttagatttttccgcactgtgcccaaaaatttccctcaccgtcgctgccaaggaactcagtgtgtctgacacagatgtcagcgaagtatcatggactgacaacggcacttttaacctctctgagggctatacaccgcagactgacactagcgatgacttagaccgaccgtccgaagaggttttcagccgcgaccttagtgatttccctagcctggagaatggaatgggaacgaatgacgaggacgaactctctctcggcttaccaacagagctcaaaaggaaaaaggaacaactagattccggccacaggccatctaaagagactcaatcggccgcaggattgaccttacctttaaatagcgatcaaacctttcatctcatgtccaacctagcgggagacgtgatcacagctgcagttaccgccgcaatcaaggaccagctggagggtgtgcagcaagctctctcacaggctgcccctatcccggaggaggatacagacactgaggagggggacgattttgaactgttggaccaaagtgagctggaccagattgagtccgaactgggcctaactcaggaccaggaagcagaagctcagcagaacaaaaagagctccgggttcctgtctaatctcctagggggtcattag

SEQ ID NO: 222748 - DNA, 1071 bp, Artificial Sequence
  Description of Artificial Sequence: Synthetic coding sequence
atgccagaaggagaagactttggccctggcaaaagctgggaggtgatcaactccaaacccgacgaacgtccaaggctgtctcattgcattgctgagagttggatgaattttagtatctttctccaggaaatgtcactttttaagcagcaatcaccaggcaagttttgcttactggtgtgctccgtttgcacatttttcaccatcctcgggagctatatccccggagttattctgagctatctcctgctcctttgcgcattcctttgtccacttttcaaatgcaatgacattggacagaagatctattcaaagatcaaatcagtcctcctgaagctggattttggcatcggggagtacattaatcaaaagaaacgcgagcggtcggaggctgacaaggaaaaatcacacaaggacgatagtgagctggatttcagtgctttgtgccctaaaatttcactgactgtcgcagccaaagagctttccgtgagcgacactgatgtgtcagaggtgagctggactgacaacggaacatttaatttgtccgaggggtatacccctcaaaccgatacgtcggacgatctcgacagaccatccgaggaagtgttttctagagatttatccgactttccctctctcgaaaacggcatgggcactaacgacgaggacgaactttctcttggattgccgacggagctgaagagaaagaaagagcaactggactccggtcaccgtcccagcaaagagacccagagtgccgcaggtctgactctgccgttgaacagcgaccagactttccatctgatgagcaacctggcaggtgacgtgatcacagcagccgtgactgccgctatcaaggatcagctggagggtgtgcaacaggctcttagtcaggctgcgcctatcccagaagaggacacagacactgaggagggagatgattttgagttgctcgaccaatccgaattggatcagattgagtcagaattgggtctaacacaagatcaggaagccgaggcacaacagaataaaaagtcctccgggtttttatcgaacctactgggtggacattag

SEQ ID NO: 222749 - DNA, 2151 bp, Artificial Sequence
  Description of Artificial Sequence: Synthetic coding sequence
atggcaacaagccaccgggtcgccaagctcgtcgccagcagcctgcagacacccgtaaacccgataacaggcgctcgggtggctcaatacgaaagggaagatccgttgaaggccctagcagcagcagaagctatactggaggatgaggaagaggagaaagtggctcagcccgctggcgcttcagccgacctcaatactagcttcagcggcgtggatgaacatgcaccaatttcttatgaagactttgttaattttcccgacatccaccacagtaatgaggaatattttaaaaaagtggaggaacttaaagccgcacacatcgaaaccatggcaaagctggaaaagatgtatcaggacaagttgcatctaaaggaggtacagcctgtggtcatccgcgaagatagcctgagtgactcatccaggtctgtttcagagaaaaacagttaccaccccgtgtctctcatgaccagtttcagtgagccagaccttggccagagtagttccttatacgtaagtagcagtgaggaagaactgcctaatctggagaaggagtatccaaggaagaatcgtatgatgacatacgccaaggaattgataaataatatgtggactgatttctgcgtggaagattacatcagatgcaaggataccggctttcacgctgccgagaaaagaaggaaaaagcgcaaagaatgggttccaacaattaccgtgcccgagccctttcagatgatgattagagagcagaagaagaaagaagagtccatgaaaagcaagtccgacattgaaatggtccacaaggccctgaagaaacaagaggaggaccctgagtataaaaaaaaatttagagcaaacccggtgcccgcaagtgtgttcttgccattgtaccacgacctggtcaagcagaaggaggaaagaagacggtccctgaaagaaaaatcaaaagaggctcttttagccagccaaaaaccgtttaaattcatagcgagggaggagcagaaaagggccgcacgggagaagcagctgcgggactttcttaaatacaaaaagaaaacaaatcgtttcaaagctcggccaataccacgtagtacgtatggaagtaccactaatgacaaattaaaagaggaggagctataccgcaacctgcgtacccagctaagagcacaggagcatctgcagaatagctcgcccctgccgtgccgaagtgcctgcggttgtagaaatccacgatgtcccgagcaagctgtcaagcttaaatgtaagcacaaagtccgatgtccaactcccgacttcgaagatctaccagagcggtaccaaaagcatctgagcgaacataaatctccaaagttgctaacggtctgtaaaccctttgatctgcacgcatctccccacgcctccattaaacgggagaaaatcctggcagatattgaggcggatgaagaaaacctgaaagaaactcggtggccttatctctctccgaggaggaaatctcctgtcaggtgcgcaggcgtcaaccctgtaccatgtaattgcaacccacctgtgcccaccgtctcctctagggggcgagagcaggctgtgcggcgatctcttgaagaaaagaaaatgctggaagaggaaaggaatcgcattctcaccaaacagaagcagcgaatgaaggagctgcaaaagttgttgaccacacgagcaaaagcctacgatagtcaccaatcccttgcccagatcagcaagagtagagttaagtgtctgcgcaaatcagagaaagagcggatgagggagtatcaacgagaattggaggaaagggaagagaagctcaaaaaaaggcctcttcttttcgaacgcgttgcccagaagaatgctaggatggctgcagagaagcactactcgaataccctgaaagcactaggcatctccgatgaatttgtatcaaaaaaaggccagtctggaaaggttttagaatatttcaataaccaggaaacaaagtccgtgactgaggataaagagtccttcaatgaggaggagaaaattgaagagagagaaaacggcgaggagaattattttatcgatactaatagccaagactcctacaaagagaaggacgaggctaacgaagagagtgaagaagagaaatccgtggaagagtcacactag

SEQ ID NO: 222750 - DNA, 1983 bp, Artificial Sequence
  Description of Artificial Sequence: Synthetic coding sequence
atggctaccagccacagagtggctaagctagtggccagttcacttcagactcccgtcaatcctatcaccggcgcaagagtggctcagtatgagagggaagaccctctcaaggccctcgctgctgctgaggcgatattggaagatgaggaagaggagaaggtggctcaaccagctggcgcatctgccgatctcaatacctcattcagtggcgtcgatgaacacgcaccaatctcttacgaggatttcgtcaatttcccagacattcaccatagtaacgaggagtacttcaaaaaggtggaggagcttaaagccgctcacattgaaaccatggccaagctggaaaagatgtatcaagataagcttcatttgaaggaggtccagcccgtggtcataagagaagattccctctccgattcttcacgatctgtgtcagagaaaaactcctatcatcctgtctcactcatgaccagcttcagcgagccagacctcggacagagttcaagcttgtacgtcagctcctctgaggaggagctgcccaatctcgaaaaagaatatcctcgaaagaacaggatgatgacatacgccaaggaactgatcaataacatgtggacagatttttgtgtggaggattacattcgatgtaaggacacaggattccacgcggcagaaaagcggcgtaagaagagaaaagagtgggttccaactatcacagtgcccgagccttttcagatgatgatccgtgagcaaaaaaaaaaggaggaatccatgaaaagtaagtcagatatagagatggtgcacaaagcccttaagaaacaggaagaggaccctgaatataagaagaagttccgggctaacccagttcccgcaagcgtgtttctgcccttgtatcacgacctcgtcaaacagaaggaggagcggaggcggagcttaaaggaaaagtccaaagaagctttactggcatcccagaaacctttcaaattcatagctcgcgaagagcagaaacgagctgcgagagaaaaacagcttcgagacttcttaaagtacaaaaaaaagacgaataggtttaaggcccgaccgatacccagatcaacctacgggagcaccaccaatgacaagctgaaagaggaagaactgtaccggaacctccgcacacagttaagggcacaggagcatctgcagaatagttctccactaccttgccggtcagcttgcgggtgtaggaaccctcgctgccccgagcaggccgttaagctcaagtgcaaacacaaagtgaggtgcccaacccccgactttgaagatttgccagagcgctaccagaagcatcttagcgaacataagtctcctaaactactgacagtctgcaagccatttgacttgcatgcctctccccatgcctctatcaaaagggaaaagattctggctgacatagaggccgacgaggagaacttgaaggaaactcgatggccatatttatccccccgacgaaagtccccagtgagatgtgcaggcgtgaacccagtgccttgcaactgcaaccctcccgtgcccactgtgtcatcaagaggacgtgaacaggctgtccgcaagtcagagaaggaacggatgagggagtaccagagagagctagaggaaagagaagagaaattgaagaaacggccactcctcttcgagcgcgttgcccagaagaacgcacgtatggcagcagagaaacattatagcaacaccctgaaagccctcggaataagtgacgaatttgtctccaagaagggacagagcggtaaggttctggagtattttaataaccaagaaaccaaatctgtcacagaggacaaagaaagtttcaatgaagaggagaaaattgaagagcgggagaacggcgaggaaaattatttcatcgacaccaactcacaggacagctataaggagaaggacgaagccaatgaggaatccgaggaggaaaagagtgtggaggaatctcattag

SEQ ID NO: 222751 - DNA, 645 bp, Artificial Sequence
  Description of Artificial Sequence: Synthetic coding sequence
atgagcgtgccacagatacatgtggaagaagtgggcgcagaagagggggctggcgctgctgctccaccagacgatcatttaaggtcattgaaagccttgaccgagaaactgcgcttagagactcgtaggccctcttacctcgaatggcaggccaggttggaggagcacacttggccgttcccgagaccagcagccgagcctcaggccagccttgaggagggcgagaggggagggcaagagcccttgctccctctgcgtgaggctggacaacacccgcctagtgctcgatcagcttcacagggcgcaaggcctctgagcacaggaaagctggagggctttcaaagtatcgatgaagccatagcttggctgagaaaggagttaactgagatgcgcctgcaggatcagcagcttgcccgtcagctcatgcggctgagaggtgatattaataagctgaaaatcgagcacacctgtcgcctacaccgccgaatgctgaacgacgctacgtatgaactggaggaacgggacgaacttgctgacctattttgcgacagcccattggcgtcttccttcagcctatctacaccactgaaattaatcggggttactaagatgaacatcaattctcgacgtttcagcctttgctag

SEQ ID NO: 222752 - DNA, 1248 bp, Artificial Sequence
  Description of Artificial Sequence: Synthetic coding sequence
atggccgctagtataagcggctacacgtttagcgccgtgtgcttccacagcgcaaacagcaatgctgatcatgaaggtttcctgttgggggaggtccgtcaagaggaaacattttcaattagcgactctcagattagtaataccgagttcttacaggtgatcgaaatccacaatcaccaaccctgtagtaagctcttttcattctatgattacgcctccaaagtaaatgaggagtctctggaccgcatcttaaaagaccgacgaaaaaaggtgatcggatggtatcgatttagaaggaacacccaacagcaaatgtcgtatcgcgaacaggtcctgcacaagcaactgacccgcatccttggagtgcccgatctagtattccttcttttcagcttcatttccaccgccaacaactcaacccatgctctggagtacgtcctgttccggccaaataggcggtataaccagagaatctcccttgctatccctaatttggggaatacatcacagcaagagtacaaagttagttccgtgcctaacaccagccagtcatatgctaaggtgattaaggagcacggcactgacttcttcgataaggacggagtgatgaaagacatccgagccatttaccaggtgtataacgctttacaggaaaaggttcaggcggtgtgcgcagatgtggaaaagtctgagagggtggtggaatcctgccaggcggaggtgaacaagctgcgcaggcagattacccaaaggaagaatgaaaaggaacaggaaaggagactgcagcaggctgtgctcagtcggcagatgccctccgaaagtctagatcctgccttttctccccgtatgcctagctccggattcgcagctgaagggagatccaccttgggagacgcagaagcatcggatcctccaccaccgtattcagattttcatccaaataaccaggagtcaactctgagccattctcgcatggaacggtccgtctttatgcccaggcctcaggccgtcggaagttcaaattatgcgagtacaagcgcgggtctgaaataccccggatcgggggcagacctgcctccgcctcaaagggcagctggggatagcggggaagatagtgacgactcagactatgaaaatctgatagacccaactgaacccagcaattccgagtatagtcacagcaaggatagcaggccaatggctcaccccgacgaagaccctcggaacacacagacaagtcagatctag

SEQ ID NO: 222753 - DNA, 3522 bp, Artificial Sequence
  Description of Artificial Sequence: Synthetic coding sequence
atgaccagacggtgtatgccagcccgtcccggttttccatcatcccctgcacctggctcttccccaccccgatgccacttacgaccgggatccacggcccatgccgcagccggaaagcgcacagaaagtccgggagaccgcaaacaaagcattatcgatttcttcaaaccagccagcaaacaagataggcacatgcttgattcaccccagaaatccaacattaaatacggtggatcccggctgagtattactggcacggagcagttcgagaggaaactgtcttccccaaaagagagtaagccgaaacgcgttcctcccgagaaaagccctataattgaggcgttcatgaagggcgtgaaggagcaccacgaagaccacgggattcatgaatctaggcggccttgtctgtctctagcctctaagtacttagctaagggcactaatatttacgtgccttcatcgtaccatctcccaaaggaaatgaaaagcttgaagaagaagcaccggagccccgagagaaggaagtccctgttcatccatgagaataacgagaaaaacgatagggatagaggaaagaccaacgcagacagcaagaagcagaccacggtggccgaggcagatatatttaacaatagctcacggtcacttagcagccgttcatccctctcccgacaccaccctgaggaatctcccctgggcgctaaatttcagctaagcttggcttcatactgtcgcgaacgtgagctgaaacgactgagaaaggagcaaatggaacaacgtatcaactccgagaatagcttctcggaggccagctcgctgtcactgaagtcctctattgagcgtaagtacaaacccaggcaagagcaacgaaagcagaatgacataattcccggtaagaacaacctctccaacgttgaaaatggccacctgtccagaaagaggtcttcatcagactcatgggaaccgacttcagctgggtctaaacagaacaaattccctgagaagagaaagaggaattccgttgatagcgatctcaagtcaactagggagagcatgattcccaaagctagggaatcttttttagaaaagaggcccgatgggcctcaccaaaaggagaaatttattaaacatattgcattgaagaccccaggagacgtgcttagactcgaggacatcagcaaggagccatcagatgagacggacggatcatcagccggactggcaccctctaacagcggcaatagtggccatcattccaccagaaatagcgatcagatccaggtggctggtaccaaagagaccaagatgcagaagccgcacctgcctttgtcccaagagaaatccgccatcaagaaggctagtaacctacagaagaacaaaactgcctccagtacaaccaaagaaaaagaaaccaaattgcccctcctctctagagtgccatctgccggaagcagtctggttcctttaaacgctaaaaactgcgctctccccgtctcaaagaaagataaggagagatcttcatccaaagagtgttctggccacagcactgaatcgacaaagcataaggagcataaggctaagactaacaaggctgacagcaacgtgagctcgggtaaaatatccgggggaccactgcggtctgaatacggtacgccaacaaagtccccacctgctgctctggaggtcgtcccctgcatcccaagccctgctgctccctcagacaaggcacctagcgagggagagagttctgggaactccaacgctggatccagcgccctcaaaagaaagttaaggggcgacttcgactctgacgaggaatctctcggatataatctggattccgatgaagaggaagaaacactaaaatctttggaagagatcatggcccttaattttaatcagaccccagccgcaacaggtaaaccccctgcgctgagcaaaggcttacgtagccaatcaagcgactatactgggcatgtgcaccccggtacttatactaatacgcttgagagactagtcaaagaaatggaagacacacagaggttggatgagctacagaaacaacttcaggaggatatcaggcagggcaggggaatcaagtcgccaatcagaatcggcgaagaggactcaacagacgatgaggatggattgctcgaagagcacaaggaattcttgaaaaagttctccgttaccattgatgccattcccgaccatcatcctggtgaggaaatcttcaattttctcaatagcgggaaaattttcaatcaatacacactggacctacgggactcgggtttcatcggccagtccgcagtcgagaaactaattttaaagagcggaaagaccgaccagatctttctgactacccaggggtttcttacctcagcttaccattacgtacagtgtccagtgcctgtcctaaagtggttgttccggatgatgtccgtccataccgattgcatcgtgtcagtgcagattttgagtacactgatggagataacaattaggaacgatacatttagcgattctccggtgtggccctggattccgtccctctcagacgtcgccgctgtgttctttaacatgggcatcgacttccgcagcttattcccgctggaaaacctccagccggacttcaatgaagattatctggtgtctgaaacccagaccacctcccggggaaaagagagcgaagattcatcctacaagcctatctttagcactctgccagaaaccaacattctcaacgttgttaagttcttggggctctgcactagcatccatccggaggggtaccaggatcgcgagatcatgctcctgatcttaatgctattcaaaatgtctctggagaaacagttgaaacaaattccccttgttgacttccaatccctgttaattaaccttatgaagaatattcgcgactggaacactaaagtccctgaattgtgcctagggataaatgaactctcaagccaccctcacaacctgctttggcttgtccagctcgtgcctaattggacatccagggggaggcagcttcgccagtgcctatcactggtgataatctcaaaattactggacgaaaaacatgaggacgttccaaatgcaagcaacctccaagtgtctgtccttcatcgctatctagtgcagatgaaaccctcggacctgctgaaaaagatggtcctgaaaaaaaaggctgaacagccagacggaattatcgatgattctttgcatttggagttggaaaaacaggcttattacctcacatacatccttctgcacctagttggcgaggtaagttgcagccattccttcagcagcggccagagaaagcactttgtgctgttatgtggggcactcgaaaaacacgtcaaatgtgacattagggaagatgcccgtctattttacaggaccaaggtaaaggacctggtcgccagaatacacggcaagtggcaagaaattatccagaactgccggcctacacaggggcaactgcacgacttctgggtcccagatagttag

SEQ ID NO: 222754 - DNA, 3561 bp, Artificial Sequence
  Description of Artificial Sequence: Synthetic coding sequence
atgactcgtcgatgcatgccggcacggcctggattccccagtagccccgctccgggatcaagcccacctcgctgtcatttacggccaggaagtacggcccatgccgctgcgggtaagcgcaccgaaagtcctggagatagaaagcagtccattattgatttttttaagccagcctccaaacaagatagacacatgttggacagcccgcaaaagtcaaacattaagtatggcggtagcaggctttctattaccggcacagagcagttcgagcgtaaattatcatcccccaaagaatctaagccaaaacgcgttccaccagaaaagtcacccatcatcgaggcatttatgaaaggggtgaaagaacatcatgaagatcacgggatacatgagagccgcagaccatgcttgtcactcgcgtccaagtatctggcaaagggaacaaatatctatgtgccgagtagctatcacctgcctaaagagatgaagagtcttaagaagaaacacaggagccccgagagacgcaaatcgctgtttatccatgagaacaacgagaaaaacgatcgggaccgcggtaagaccaatgccgacagtaagaagcagaccactgttgccgaggcagacatctttaacaattctagtaggagcctcagtagcagaagctccctgtccaggcatcatcccgaagagagccccctgggggcaaaatttcaactgagtcttgcaagttactgccgcgagcgcgagctaaagagactcagaaaggagcaaatggaacagaggatcaattctgagaactctttttccgaagcatcctctcttagtctcaagagtagtattgagcgaaagtataagccacggcaggaacagagaaagcaaaacgatataattcctggcaagaataacctgagcaacgtcgagaacggacacttgtcaagaaaaagaagctcaagcgattcatgggagccgacttctgccggttccaaacaaaacaaatttcccgaaaaacgaaagcggaactccgtggactcggatctgaaatccacccgcgaatccatgatccccaaagccagggaaagttttctggagaagaggcctgacggacctcaccaaaaggagaaattcatcaaacatattgcactcaaaacaccgggagatgtgctgaggctcgaggatatttctaaggagccttcagatgagaccgatgggagctccgcagggctcgcaccgagtaactcaggaaattccgggcaccactcgaccagaaatagcgatcaaattcaagtggcaggaactaaagaaacaaagatgcaaaagcctcacctgcctctgtctcaggaaaagtctgccattaaaaaggcatcgaatctgcagaagaataagactgcctcttcaaccacaaaggagaaggaaacaaagctgcccctcctcagtcgagttccaagcgccggatcgagccttgtgcctttgaatgcgaagaactgcgctctacctgtgtctaaaaaggataaagaacgaagcagttctaaggagtgcagcggccactcaaccgagtccaccaagcacaaggagcataaagctaagacaaataaggccgactccaatgtgtcctctggaaaaatatctggaggccctctccgctccgaatatggtactcccacgaagtctcctccagccgctctggaagtcgtaccctgcattccaagccccgcagctccctccgataaagcaccctctgagggggagtcaagcggcaactccaacgctggaagttctgcactcaagcgcaagcttcggggagattttgattccgatgaagagtcactggggtacaacctggattccgatgaggaggaggaaactttaaagtcgcttgaagaaattatggctttgaactttaatcaaaccccagccgcaacggggaaaccacctgcactcagtaagggactccggagccaatccagtgattatacaggtcacgtgcaccccggaacctacacaaacacattagagcgactggtgaaagaaatggaggatacacagcggctagacgagctccaaaagcaattgcaggaagacatccgacagggcagaggaataaagtctccaataagaatcggagaggaagattcgacagatgatgaggacggactcctggaggaacataaggaattcctaaaaaaatttagcgttacaattgatgcaatcccagatcatcatcctggagaagagatcttcaacttcctgaatagcggcaagattttcaatcagtatacccttgacctacgggacagtggatttattggacagagtgccgtggagaagttgatactcaaaagcggcaagaccgatcagatctttttgacaacccaagggtttctgacatccgcctatcattacgttcagtgtcctgtgccagtccttaaatggctgtttcgtatgatgtcagtccacactgattgtatcgtcagcgtgcaaattttatctacccttatggagatcactataaggaacgatacattctctgatagcccagtatggccttggatccccagcttatccgacgttgcagccgtatttttcaacatggggatcgacttccgatctctctttccactcgagaatctgcagcctgactttaatgaagattatctggtctcagaaacccagacgaccagccgtgggaaggaaagcgaggacagtagctataagcctatcttctctaccctacccgaaaccaatatactgaatgtagtcaagttccttggcctttgcaccagcattcaccctgagggttaccaggaccgcgagattatgctgcttatccttatgttattcaagatgtccttggagaaacagttgaagcagattccactcgtcgattttcaaagcctgctgatcaaccttatgaaaaacattagagattggaacaccaaggtacctgagctgtgcctgggaatcaatgaactgtcctctcacccccataatctgctctggctggtgcagctggtgccgaactggacctcccgtggcagacagcttcgtcagtgcctgagtctggtaattatttctaaactgttggacgaaaaacacgaggacgtgccaaacgccagtaacttgcaggtttctgtgctgcacaggtacctcgtccagatgaaaccctcagacctcctgaagaagatggttctcaagaagaaggcagagcaacctgacggaattatcgacgacagtctgcacctagaacttgagaagcaagcatactacctgacatatatcctcctgcatctcgtgggagaggtttcctgttcccacagttttagtagcgggcagcgtaagcattttgtgttactttgcggtgcacttgaaaagcatgtgaaatgtgatatcagggaagacgctagactattctaccggacaaaggtcaaggacctggtggccagaattcacggcaaatggcaggagatcattcagaactgcaggccaacacaggttagcttttgctacactattagttgcatcctgaacagcttcgcagaatggcacagcagctattgtctcaaatag

SEQ ID NO: 222755 - DNA, 2277 bp, Artificial Sequence
  Description of Artificial Sequence: Synthetic coding sequence
atgacgcgcaggtgcatgcccgctcggccaggcttcccaagctcacccgcacccggatcttctcccccacggtgccacctcagacccggttctacggctcatgccgctgctggaaagcgtacagaaagccccggtgatagaaaacagtccattatcgatttttttaaaccggcttctaaacaagacagacatatgttggactcccctcagaaatctaacatcaaatatggcggaagccgtttgagcatcactggcacagaacagttcgagcgtaagttatcctcacctaaggagtctaaacccaaaagagttccccctgaaaagtcacccatcatcgaagcattcatgaaaggtgtgaaggagcatcacgaggaccacggtatccatgagtccaggcgtccttgcttaagcttggcctcaaagtacctggcaaaggggaccaatatttacgtacctagcagttaccaccttcctaaggaaatgaagtctctgaagaaaaagcataggagccccgagagaagaaagagtctcttcatacatgagaacaacgaaaaaaacgacagagatcgaggaaagaccaatgctgacagcaaaaaacaaactaccgtcgccgaagcagatatttttaacaacagcagccgatctctgagctccagaagcagcctgtctagacaccatccggaggagtctcccctgggggctaagtttcagctgtccctagcttcatattgccgcgaaagagagctcaagcggctgaggaaagaacaaatggagcaacggattaactctgaaaatagctttagtgaagcctcttctctatccctgaaaagtagcattgaaagaaagtacaagcccaggcaagagcaaagaaagcagaacgatattattcctgggaagaataatctgagcaacgtggagaatggacatctttcaaggaaaagatcaagttcggatagctgggagcctaccagtgctggcagtaagcagaacaaatttcccgaaaagaggaagaggaacagcgtcgactccgacttgaagtccacgagggagagcatgattcctaaggctcgtgaaagctttctggagaagcggcctgacgggcctcaccagaaagagaagtttataaaacacatcgctctgaagaccccaggcgatgttctacgcttagaagatatcagtaaggagccgagcgatgagactgacggctcatccgctgggcttgccccatctaatagcggcaactcaggtcaccactccactaggaactccgatcagattcaagtcgccggaacaaaggaaaccaaaatgcagaaacctcatttgcctctgagccaggaaaaaagcgccattaagaaggcctcaaatctgcagaagaacaagacagctagctcaacaactaaggagaaggaaacaaagctgccacttctgagccgcgtgccttccgccggatcttcactcgttccgcttaacgctaagaactgcgccctgcccgtaagtaagaaagataaggagcgtagcagcagcaaggaatgttccgggcacagtactgagtctacaaaacacaaggagcacaaagctaaaacaaataaggctgactccaacgtgtcctccgggaagataagcggagggccacttcgttccgagtacgggacgcctacaaaatcccctcccgctgcactggaggtcgtgccctgcatcccctcccctgccgctccctctgacaaggccccaagtgagggagaaagctctgggaattctaacgccggatccagtgcacttaagagaaagctgagaggcgacttcgactcagatgaagagtccctaggctacaatttggactctgacgaggaagaagagacgctgaagtctctggaggagattatggccctgaatttcaaccagacccccgctgccactgggaagcccccagcgctctccaagggtctgcgctcacagagctcggattataccggtcacgttcacccaggcacctatacaaatactcttgagaggcttgtcaaggagatggaagacacccagcgattcgttagtatcaagatcaatctccttaatctcaccttctgtctgtttgtctggctaacctttaatttgccctttctgaaaaatcacgaaaaactggcctgcattttggatagtgtagtcaattgcgtccggatcaggtatgttggacggacccagtggctcatgcccgtcatcacgaccctctgggagactcaggctaggctgctcgagcctaggagcagccgcctcaggtag

SEQ ID NO: 222756 - DNA, 675 bp, Artificial Sequence
  Description of Artificial Sequence: Synthetic coding sequence
atgactcgcatcaccgagctgtggtcttcaccgcagtggaaagtaggcgcagaggtttgcggaaggcagatgcgggaacaaagaactgcagagcaatctgaaacgcagcgaacatggctctccatggcagctacattgcaatttttagtctgcttggtcgttgccatttgcctcttgtcaggagtgaccaccacccagccccatgccggacagccaatggattctacgagcgtgggaggtggccttcaggagcccgaagcgccagaggtgatgtttgagctcctgtgggcaggattggagttggacgtaatggggcagctgcacattcaagacgaagagctggcgtctacccaccctgggagacggctgcggttgctattacagcatcatgttccgagcgatttagagggcacggagcagtggctgcagcagttgcaggacctccgcaagggacctcccctaagcacatgggattttgagcacctgctgcttactggcttaagctgtgtataccgactgcacgccgctagtgaggccgaggagcgaggcaggtgggctcaggtgtttgcactactcgcccaggaaaccctgtgggacttgtgtaaggggttttgcccacaggacaggccaccctctctgggctcctgggcaagtatactggatcccttcccctag

SEQ ID NO: 222757 - DNA, 606 bp, Artificial Sequence
  Description of Artificial Sequence: Synthetic coding sequence
atgcgcgaacaacgaacggcagaacagtctgagacacagcgcacttggctgtctatggccgctacactgcagttcttggtgtgcctagttgtggccatctgtttactcagcggagtcaccaccacccagccccacgccggacagcctatggatagcacgagcgtaggcggtggtctgcaggagcctgaagctcctgaagtcatgttcgagttgctctgggccggactggaactcgatgtcatgggacaactgcacatccaggacgaagagttggccagcacccatccaggccgtcgcttgcggctgctgctgcaacatcacgtccccagcgacctggagggcactgagcaatggctccagcagttgcaggatctgcggaagggcccaccgctttcgacttgggactttgagcatttactgcttactgggcttagctgtgtgtaccggctgcacgccgcttctgaggccgaggaaagaggcagatgggcacaagtgttcgctctgctcgcccaggagaccttgtgggatctctgtaagggcttttgcccccaggatagaccaccttctctgggaagttgggcctctattctagacccattcccctag

SEQ ID NO: 222758 - DNA, 1626 bp, Artificial Sequence
  Description of Artificial Sequence: Synthetic coding sequence
atgcctgggctcagacgagacagactcctgacgctgttgctcctgggggcactgctcagcgcagacctttatttccacctgtggcctcaggtgcagcggcaactccgacctagggaacgtcccagaggttgcccctgtacagggagggcatcttcactggccagggactcggcagcggctgcatcagatcctggtacaatagtgcataattttagccgcaccgagcctcgaactgaaccagcaggaggcagtcactcaggtagctcttctaagctgcaggccttattcgcccatcctctctacaacgtccccgaggagcccccactcttaggcgcagaggactcgctactggcatcccaggaagctctgaggtactacagacgtaaggtggctaggtggaaccggcgacataaaatgtatagagagcagatgaacctcacttcactggacccccctctccagctcagattggaagcctcgtgggtgcagttccacctgggtatcaatagacacggattatacagcagatcctcaccagtggtgagcaagctgttacaggatatgaggcacttccccacaatctccgccgactattcccaagatgagaaagccctcctcggggcttgtgactgcacacagattgttaaacctagcggggtccacctcaagttagtgctacgcttttcagatttcggcaaggccatgttcaagccgatgcggcagcaacgtgacgaggaaacgcccgtggattttttttatttcattgatttccagcgacacaacgcggagatcgccgcatttcatctggaccgcattctggacttccgtcgggtgccccctactgttggtcggatagtcaacgtgaccaaggagatcctcgaagtcactaagaacgaaatcttacagtcagtgttcttcgtgagtcccgcaagcaatgtgtgcttctttgcaaagtgtccgtatatgtgcaagaccgagtacgccgtgtgcggcaatccacatctgctggaaggctcactttccgcctttctaccttctctcaacctagcgcctcgattaagcgtgcctaatccctggatccgtagttacaccctagcagggaaagaggaatgggaggtcaatcccctatactgcgatactgttaagcagatctatccatacaataactcacagaggttgttgaatgtaatcgatatggctatcttcgatttcctgatcggaaacatggatcgacatcattatgagatgtttaccaagttcggggatgacgggtttctcattcatctcgacaatgctaggggctttgggcgacatagccatgacgaaattagtattctgagccctttgtcacagtgttgcatgatcaagaaaaaaacactattgcacctccagttgctcgctcaggccgactataggttgtccgacgttatgagggagtcacttcttgaggaccaactatctccagtgctcactgagccccatctgcttgctctagataggcgcttgcagacaatacttcgcaccgtggagggctgcatagtggcacacggtcagcaatctgtgatcgttgacggaccagttgagcaactggccccagattccggccaggccaatctgacaagctag

SEQ ID NO: 222759 - DNA, 1023 bp, Artificial Sequence
  Description of Artificial Sequence: Synthetic coding sequence
atgggaccgcctcacagcggaccaggtggtgtgcgcgtgggtgccttactgctcctcggcgtactcggcctcgtgtccggtctgagtctggaaccggtgtactggaacagcgccaacaagcgctttcaggctgagggaggttatgttctgtacccgcagattggcgacagactcgatttgctgtgtcctagagcgagacctcccggacctcatagctcccctaactatgaattctacaaattgtacctggtcggcggagcacagggccgtagatgcgaggccccaccagcaccaaacctgttgctaacgtgtgaccgaccagaccttgaccttcggtttaccattaagtttcaagaatactctccaaatctatggggccacgagttccggtctcatcatgattactatatcatcgctacgtcagacgggaccagagagggcctggaatccctgcagggcggagtgtgtctgacaagaggcatgaaagtgctccttagagtggggcagagtccacgcggaggcgcagttccaaggaagcccgtgtctgagatgcccatggaaagagaccgaggagctgctcacagcctagaacccggaaaagaaaacctgcccggtgaccccacaagtaacgcgacatctcggggagccgaggggcctctgccccctccttcgatgcccgctgtggcaggggctgccggtggcctggccctgctcttattgggcgtggccggtgcgggtggggcaatgtgttggagacgacgacgagcaaaaccctcagagtcgcgccaccccggaccgggatcctttggtagaggagggagtctgggacttggtggaggcggtgggatgggccctagagaagctgagcctggcgagttgggaattgccttgagagggggaggtgccgcagatccaccgttctgtcctcactatgagaaggtgagcggagattatggtcaccctgtttatatagttcaagatgggccaccacagtcaccacccaacatctattataaggtttag

SEQ ID NO: 222760 - DNA, 438 bp, Artificial Sequence
  Description of Artificial Sequence: Synthetic coding sequence
atgttcacctcccccagtgagggtaaaccagggaatatggataggcatcactacgagatgttcacaaagttcggtgatgatggctttttgatacacctcgataatgcacgcggttttgggcgtcattcccacgacgagatctccatcctgtcgcccttgagccaatgttgtatgatcaaaaagaagactctgctgcatctgcaactgcttgctcaagctgattacaggttgtccgacgtcatgcgggaatccctgctcgaagatcagctatcccccgtgctgacagagccccatttgctagccctggaccggagattgcagacaatcctccggacagtcgaagggtgcatcgtcgcccacggccaacagtctgtgatcgtcgacggccctgttgagcagttagctcctgattctggccaagccaatctgactagttag

SEQ ID NO: 222761 - DNA, 1230 bp, Artificial Sequence
  Description of Artificial Sequence: Synthetic coding sequence
atgaagcttaagcagagggtggttctgctggccatcctgttggttattttcatttttacaaaggtgttccttatagataacttagatacttctgctgctaacagggaggaccagcgggcttttcacagaatgatgacggggttacgcgtcgagttggcgcctaagttggatcacacactgcagagcccatgggagattgccgctcagtgggtcgtgcctcgcgaggtgtatccagaagaaacacctgagttgggggctgttatgcacgcaatggctactaagaaaatcatcaaagctgacgtgggatataaaggtacccagttaaaggccctgctgatcctggagggaggacagaaggtggtatttaagcccaaaagatattctagggaccacgtcgtggaaggggagccctacgcaggatacgatagacataacgcagaggttgcggcattccatctggatcgcatcctagggttccacagagctcccctcgtggtggggagatttgtcaatctgcggaccgagatcaaacccgtggcaactgagcaattgctctcaacttttctcacggtgggcaacaacacctgcttttacggaaagtgctattattgcagagagacagaacccgcttgcgccgatggcgacataatggagggatctgtcactctgtggctgccagatgtctggccgctgcagaagcaccgtcacccctggggcaggacgtatcgggaggggaaactggcgaggtgggagtacgatgagagttactgcgatgctgttaaaaagactagcccttatgactcggggcctaggctcctggatataattgataccgccgtctttgattacctgattgggaatgccgaccgacaccactatgaatcttttcaggacgatgagggagccagcatgttaattctgctggacaatgccaagagttttgggaacccgagtctggacgagcggtcaatattggccccactgtatcagtgctgcatcatccgagtttcgacctggaacaggcttaactacctcaaaaatggggtgttgaaatcggccctgaaaagcgccatggctcacgaccctatctcacccgtgctgtctgacccccatttggatgcggtggaccaacgcctattgtccgtgctggcgaccgttaaacaatgcactgatcaattcggcatggataccgtccttgttgaagaccgcatgcctctgtctcacttatag

SEQ ID NO: 222762 - DNA, 417 bp, Artificial Sequence
  Description of Artificial Sequence: Synthetic coding sequence
atgaagctgaagcagcgcgtcgtactgttagccattctgttggtaatcttcatcttcaccaaggtatttctaatcgacaacttagacacgtccgctgcaaacagagaggatcagagggccttccacagaatgatgacagggcttcgagtggagttagcacctaagctggatcatactctgcagagtccatgggaaattgcggctcagtgggttgttccgagggaagtctacccagaggagactcctgaacttggggctgtgatgcatgcgatggctactaagaagatcattaaagctgacgtgggatacaaagggacccagctcaaagcgttattaattctggaaggcggtcagaaggtggtttttaagccgaaacggtattcaagggatcatgttgttgagggggaaccttattag

SEQ ID NO: 222763 - DNA, 1755 bp, Artificial Sequence
  Description of Artificial Sequence: Synthetic coding sequence
atgaagatgatgctcgtgcgacggttcagagtgctaatccttatggtgtttttggtcgcttgtgcactccacatcgcattggatctcctccctcgcctggagcgacgaggcgcacggccatctggggagcctgggtgtagctgtgctcaaccggcagccgaggtcgccgcaccgggatgggctcaggtcagagggagaccgggagagccacctgcagcctctagcgctgctggagatgccggatggccaaataaacatactctaagaatcctgcaagacttttcatcagacccaagttctaacttgagcagtcactccctcgaaaaactgccccctgctgcggagccggcagagagggctctgcgcggaagagatcccggagccctaagaccccacgatcccgctcaccgcccactgcttcgtgaccctggccctaggcggtctgaaagccccccaggtcctggcggagacgcctctttactggccaggctctttgagcatcccctttaccgcgtggccgtcccccctctgactgaggaagatgttctcttcaatgtcaattccgatacacgtctctcacccaaggctgcagaaaatcccgactggccgcacgctggcgctgagggtgccgaattccttagtcccggtgaagcggcagtggatagttatccaaactggttaaagtttcatatcgggataaatcgctacgagctgtattccagacacaatcctgccatcgaggctctgctccatgatctcagtagccagcgcattacctcagtggctatgaagtctgggggaacccagctcaagttgatcatgactttccagaactacgggcaagcactgtttaaaccaatgaaacagacgcgggagcaggaaacccctcccgattttttttattttagcgactacgagcggcataacgcggagatcgctgcatttcacctcgataggatcttggactttagacgcgttcccccagtggctgggaggatggtcaatatgaccaaggaaattcgcgatgtgacaagagacaagaagctctggcgcactttcttcatcagcccggcaaataacatctgtttttacggtgagtgctcatactattgctccaccgagcacgccctgtgtggaaaacccgatcagattgaagggtccctggctgcgtttctgcctgacttgagcttggcaaaacggaaaacttggcgcaacccctggcggaggtcataccacaagagaaaaaaagccgaatgggaagtagacccggactactgtgaagaggtgaaacaaaccccaccttacgactcaagccaccggatcctggatgtaatggacatgaccatcttcgattttctgatgggcaatatggacagacaccactatgaaaccttcgagaaattcgggaatgaaactttcatcatccatctggacaatgggcgaggtttcgggaagtacagtcacgacgaactctctatcctagtcccgttgcagcaatgctgcagaattagaaagtccacataccttcgattgcagttactggcaaaagaagagtacaaactgtccttgttgatggcagagagtctgagaggcgaccaagttgctccagtgctgtatcagcctcatctggaagcgctggacaggcggctgcgcgtagtgctcaaggcggttcgtgactgcgtggaaagaaatggattacacagcgtcgtggatgacgatctggacaccgaacatcgcgcagcctcggccagatag

SEQ ID NO: 222764 - DNA, 3957 bp, Artificial Sequence
  Description of Artificial Sequence: Synthetic coding sequence
atgatgaaccgaacaacaccggaccaagagcttgtgccagcctccgaacctgtgtgggaaaggccttggagcgtcgaggaaattcggaggagctctcaatcctggtcactcgcagctgacgccggactcctgcagttccttcaggaatttagccagcagactatttcacggacccacgaaattaaaaaacaggtggacggcctgattcgcgagaccaaggccacagactgtcggctccacaacgtctttaatgatttcctgatgctctctaacacacaatttatagagaatagagtatatgacgaagaagtggaggagccagtgctgaaggccgaggcagaaaaaacggaacaggagaagacaagggaacaaaaagaagtggatctgattccaaaggtccaggaggccgtgaactatggtctgcaagtgctagatagcgcattcgagcagctcgacattaaagctggaaactctgactctgaggaagatgatgccaatggacgtgtcgaactgatcctggagccaaaggacttgtacattgacagacctctcccatacctcattggctccaaactgtttatggagcaggaggatgtgggactgggcgagctgagtagcgaagagggtagcgtcggaagtgatcgcggatcaatagttgacacagaagaggagaaggaggaagaggagtcagatgaagactttgcacatcactctgacaacgagcagaatcagcatacgacgcaaatgtctgatgaggaggaggacgatgatggatgtgacctcttcgcagactccgagaaagaggaggaggacatagaagatatagaggagaatacgaggcctaagcgcagtagaccaacttctttcgcagacgagctggccgctagaataaagggcgatgcaatggggagagttgacgaagaacccactacactgcctagtggcgaggcgaaacctaggaagactctgaaggaaaagaaggaaagacgcaccccctccgacgatgaggaagataatctcttcgcccctcctaaactcactgatgaggatttctcaccattcgggtcaggtgggggtctattcagcggcggtaaggggctgtttgacgacgaggatgaggaatctgacctattcaccgaagcctcacaagatcgacaggcaggcgcaagcgttaaagaagaaagttcatcctctaagcctggaaagaaaatacccgctggtgccgtttctgtgttcctaggcgatacagatgtgtttggggcagctagcgtacctagtctgaaggaaccgcagaaacctgagcagcccacccctagaaaatctccctacggcccacccccaacaggtctgtttgacgacgatgatggggatgacgacgacgacttcttttccgcccctcactcgaaacccagcaagaccagaaaggtacagtccaccgcggacattttcggtgacgaagagggggacctttttaaagagaaggctgttgcctcccctgaggcaaccgtgagtcagaccgacgaaaataaagccagggccgagaaaaaggtgaccctttcatatagcaaaaatctgaagccgtcttcggaaaccaagacccagaagggcctcttctctgacgaagaagacagtgaggatctgtttagttcacaaagcgcctcaaatttgaaaggcgctagcctgctccccggaaaactgccaacttctgtaagcctgtttgacgacgaagatgaagaggataacctctttggaggcacagccgcaaaaaagcagactctatctctccaggcccaacgggaggagaaggctaaagccagtgaactcagtaagaaaaaggcttctgccttactgttctcgagcgatgaagagtggaatatcccagcctctcagacacacctggctagcgattcaagaagtaagggggaacccagggattccggcactctgcagtcccaggaggctaaagccgttaaaaaaacaagcctgtttgaggaagacaaagaggatgatttattcgccatagccaaagattctcaaaagaaaactcagcgcgtctctctgctgttcgaagatgacgtggactctggaggctctttattcggatcccctccaaccagcgtgccacctgccactaagaagaaggagacagtgagtgaagctcccccactcctgttctccgacgaagaggagaaggaagcacagcttggcgtgaagtcagtggataagaaggtagagtcagcgaaggagtcgctgaagttcggtcggacagacgtggctgagagcgaaaaggagggattactgactcggtccgcccaggagacggtgaaacacagcgatttgtttagttctagcagtccttgggacaaaggcaccaagccacggacaaagaccgtcctgtcgctattcgacgaggaagaggacaagatggaggaccagaacatcatacaagctcctcagaaagaggtgggaaagggatgcgatcctgatgctcatccgaagtcgaccggagttttccaagatgaggaactcttgtttagtcataaactgcagaaggacaatgatccagacgtcgatctttttgccggtaccaagaaaaccaagctgctcgaaccgtccgttgggtccctgtttggggatgacgaggatgacgacctgttttctagtgccaagtctcagcccctggtacaagagaagaagcgtgttgttaagaaggaccactctgtgaactcctttaaaaatcagaagcaccctgaatcgattcaagggtccaaggaaaaagggatctggaagcccgagactccccaggctaatcttgctatcaatccagcagctctgttgcctaccgctgcctcccagatttctgaggtgaagcccgttctacctgaacttgccttcccttcttccgaacaccggaggtctcatggccttgagagcgttccagtgctccccggatctggggaggctggagtttcctttgatctgccagcccaggcggatacactgcacagtgcaaacaaatctagggtgaagatgaggggtaagaggaggccgcagaccagagccgcaaggcggttggccgcacaggagagctctgaagccgaggatatgtctgtcccgcgaggacccatcgctcagtgggctgacggcgctatctccccaaacggacataggccccaacttagagcagcttctggcgaagacagtaccgaggaggccttggccgcagccgctgctccctgggaggggggtcccgttcccggagtagacacatcaccatttgccaaatccttgggccactctagaggtgaggcagacttgttcgatagtggcgacatctttagtacgggaaccgggagccaatccgtggaacgcaccaaacccaaagccaaaatcgctgagaatcctgctaatcctccagtgggaggcaaggccaagtcacccatgtttccagcgctgggcgaggcctcctccgacgatgacctgtttcagtcagccaagcctaagcctgctaagaagactaatccctttcccctcctggaggatgaggatgatctatttacggaccagaaggtgaagaaaaatgaaacaaagagttcatcccaacaggacgttatcctgaccactcaggatatttttgaggacgacatcttcgcaaccgaggccatcaagccctcacagaagacacgcgaaaaggaaaagacactcgaatcgaacctgtttgatgacaatatcgacatatttgcagatctgaccgttaaacccaaggagaagtccaagaagaaagtggaggcaaagtctatcttcgatgacgacatggacgacatattttctactggaattcaggcaaagaccactaaacctaagtccagatccgcccaagctgcccctgagccacgattcgagcacaaggtttccaatatcttcgacgaccctctgaacgcattcggcggtcaatag

SEQ ID NO: 222765 - DNA, 3789 bp, Artificial Sequence
  Description of Artificial Sequence: Synthetic coding sequence
atgaaccgcactaccccggaccaggagttggtgccagctagcgagcctgtttgggaacgcccatggtctgtcgaggagataaggaggtcgagccaatcatggtctctggcagctgatgcaggaagggtttacgatgaagaggtggaagagcccgtcctgaaggccgaagccgagaagacagagcaggaaaagacaagagagcagaaggaggttgatcttattcctaaagtgcaggaggctgtaaactatggactccaggtgctggacagcgcatttgagcagttggatatcaaggctggcaatagcgactcagaagaagatgacgccaatggtcgggtcgagctgatcctcgaacctaaggacctgtatatcgatcgcccactcccttacttgataggttcaaagctttttatggaacaagaggatgtcggtttgggcgagctgtcctccgaggagggtagcgtcggttcggaccggggatccatagtagacacggaagaagagaaagaggaggaagagtcagacgaggacttcgcacaccactccgataatgagcagaaccaacacaccacgcagatgagtgatgaggaggaggatgatgatggctgtgacttatttgcggattctgaaaaagaagaagaagacatcgaggacattgaggaaaacacaagacctaaaaggtcgaggccaactagctttgccgacgagttagccgcacggatcaagggagacgcgatgggtagagtcgatgaagagcctaccacgctgccatctggagaagctaagcccagaaaaaccctgaaggagaagaaggagagacgcacaccttccgacgacgaagaggataatctctttgccccacctaagctgacggatgaggacttcagtccttttggctcagggggaggcttgttcagtgggggaaaagggctctttgacgacgaagatgaggagtccgatctgtttaccgaagcctctcaggaccggcaggcgggtgccagtgtgaaagaagaatcgtcctcatctaaaccgggaaagaaaatcccagcaggcgctgtgagcgtgtttctcggggacaccgacgtgtttggtgccgcaagtgttccttcactgaaagagccacagaaacctgagcagccaactccaaggaaatcgccctacggcccacctcctaccggattgtttgacgacgatgacggtgacgacgacgacgattttttttccgccccacacagtaagccctcaaagacacgaaaagtccagagtacagctgacatattcggcgatgaagagggagacctctttaaggaaaaggctgtagcaagccctgaagctacagtatctcaaaccgacgaaaacaaggctagagcagagaagaaggtcacactgtcatacagcaagaacctgaagcctagctccgaaacgaagactcagaagggcctgttttccgacgaggaggactccgaggacttgttttccagccaaagcgccagcaatctcaaaggtgcctctctgcttcctggaaaattgccaaccagcgtttcgttgttcgatgatgaggacgaagaggacaacctgttcggcggaacagcggctaagaagcaaacattgagccttcaggcacagcgagaggaaaaggctaaggccagcgaactctctaaaaagaaggcatccgccttgttgttttcctcagatgaggagtggaacattcccgcaagtcagactcacttggcatccgatagcagatccaagggcgaacctcgggatagcggcaccctgcagagtcaggaagcgaaagccgttaagaaaacctccctgtttgaggaggataaagaggacgatctgttcgcaatagcaaaagatagccaaaaaaagactcagcgcgtatccttgctgtttgaagatgacgtggacagcggaggctccctgttcggcagtccccctacttctgtgccgccagcaacaaagaaaaaggaaacagtcagtgaggctcctcctctcctttttagcgatgaagaggaaaaggaagcacagctcggggtgaaatctgtggacaagaaggtggaaagcgcgaaggagtctctaaaattcggacgtacggacgtggccgaaagcgagaaagaaggcctgctcacgagaagcgctcaggagacagtgaaacacagcgatttgttttctagctcaagcccctgggacaaaggcacaaagcctagaacaaagacggtgctgtcactgtttgatgaagaagaggacaaaatggaggatcagaatataatccaggctcctcagaaggaggtgggaaaaggatgcgacccagatgcccatcctaagtccaccggggttttccaagacgaagagctattgttcagccataagttacaaaaggataacgaccctgacgtggatctgtttgccggaaccaagaaaactaagctgctggaaccctctgtcgggtctctgttcggggatgatgaggacgacgaccttttcagtagtgccaagtcccaacccctcgtacaggaaaagaagagggtcgttaaaaaagatcactctgtgaattcatttaaaaatcaaaagcacccagaatcgatccagggatctaaagaaaaaggaatctggaagccggaaacccctcaggccaatctcgccattaatcccgctgccctcctccctacagccgcatcccagatcagcgaggtgaagcctgtgcttccagagctggccttcccctctagcgaacaccggaggtctcacggacttgagtccgtaccagtactaccaggctctggcgaggctggggtgagctttgacctgcccgcacaagcagatactctccattctgcaaataagagtcgcgtgaagatgcgcggaaagcgacgtcctcagactcgggctgctcgacggcttgccgctcaggaatccagcgaagcagaggatatgagtgtccctcggggaccaattgctcagtgggccgacggggctatttcaccaaatggacatcgtccccagttgcgcgctgctagcggggaggactccaccgaagaggctcttgccgctgccgcagccccatgggagggaggccctgtccccggtgtcgatactagccccttcgctaagagcttgggccacagccgcggagaggctgatttatttgacagtggcgacattttcagtactggcaccggatcccagagcgtagagcgtacaaagcctaaggccaagattgccgaaaacccagccaatcctccagtggggggaaaagccaaaagtcccatgtttcctgctctgggcgaagcgagttcagatgacgatttatttcaatcagccaagcccaaacctgcaaaaaaaaccaatccctttcctttgcttgaagacgaagatgacttgtttactgatcagaaagtgaagaaaaatgaaacaaagtcatcttctcagcaagacgtgatactcacaacacaagatatttttgaggatgacatcttcgcaacagaggctattaaaccatcacagaagactcgagagaaggaaaagaccctggaaagcaacctgttcgacgataacatcgacatattcgctgacttgacagtaaagcctaaagagaagtccaagaagaaggtcgaggctaaatctattttcgatgacgacatggacgacatatttagcaccggaatccaggccaaaaccactaaaccaaagtcccgctccgcacaggcagcccctgaacctaggtttgagcacaaagtttccaatatctttgacgacccactgaacgctttcgggggacagtag

SEQ ID NO: 222766 - DNA, 399 bp, Artificial Sequence
  Description of Artificial Sequence: Synthetic coding sequence
atggaggatcaaaacattatccaggccccacagaaagaggttggcaagggctgtgatcctgacgcacatccaaaatccaccggtgtctttcaggatgaagaactgttgtttagtcacaagttgcagaaggacaacgacccagacgtagatttattcgccggaactaaaaaaaccaagcttctggaaccctctgttgggagcctgttcggggatgacgaggacgatgaccttttcagtagtgccaaaagtcagcccctggtgcaggagaagaaacgcgtggtcaagaaagatcacagtgtgaattcctttaagaaccaaaagcacccggagtcgatacagggaagcaaggaaaaggggatctggaaaccggagactccgcaagtccggaaccccttatag

SEQ ID NO: 222767 - DNA, 3963 bp, Artificial Sequence
  Description of Artificial Sequence: Synthetic coding sequence
atgatgaatcgcaccacacccgaccaggagcttgtccccgcttcagagcctgtgtgggagaggccctggtcagttgaagagattagacggtcttctcaatcatggagcctggccgcagacgcaggcctcttgcaattcctgcaggaattttcacagcagaccatcagccgcactcatgagataaaaaagcaggtggacgggttgatccgcgagaccaaagctaccgactgccgcctgcataacgtgtttaatgacttcttgatgctgagcaatactcagtttattgagaatcgcgtgtacgacgaggaagtcgaagaaccagtactgaaagccgaagccgaaaaaacagagcaggagaaaacgagagagcaaaaagaggtggacctgatcccaaaagtgcaagaggccgtgaactacggtttgcaagtgttggactctgccttcgaacaattggacattaaggctggaaactcggactccgaggaggatgacgccaacggacgtgtggagctgatcctggagcctaaagacttgtatattgaccgacccctgccgtatttgattggaagtaaactcttcatggagcaggaagacgttggcttaggagagctctcttcagaggagggtagcgtcgggtctgatagaggctcaatcgtcgataccgaagaagaaaaggaagaggaagagtctgacgaggacttcgctcatcattcggataacgagcagaatcagcatacaactcagatgtctgatgaagaggaggacgatgacggctgtgacctgtttgctgattccgaaaaagaggaggaggacatcgaagacatagaagagaatacacgacctaaaagaagccgcccaacaagcttcgccgacgaactggcggcacggataaagggcgacgctatgggaagggttgatgaggaacccactactctcccaagcggtgaggcaaagcctaggaagaccctgaaggagaaaaaagagagacggacaccctcagatgacgaagaagacaatctttttgcacccccaaagctgaccgacgaagacttctctccatttggctcaggaggtggcctgtttagcggcggtaagggcctgtttgacgatgaagacgaggagtccgatctctttactgaggcctctcaagaccggcaagcaggggctagtgttaaagaggaaagctcctcgagtaaacctggtaaaaagatccccgcaggagcggtatccgtgtttctcggagacacagatgtgtttggcgctgcttctgtcccgagtctgaaagaaccacaaaagccggaacagcctactccacgcaaatccccgtatgggccacctccaaccggacttttcgatgacgacgacggcgatgatgatgacgacttctttagtgcgcctcacagtaaaccaagtaaaacgcggaaggtgcagtcaacagcagacattttcggtgacgaggagggcgatctattcaaggagaaggcagtcgcaagccccgaggctactgtatctcagactgatgaaaataaggcacgagccgagaaaaaggttacactgtcttactctaaaaacttaaaaccaagcagtgagacaaaaacccaaaaaggcctcttctctgatgaagaagatagtgaggacttattttcttcccagtccgctagtaatcttaagggtgctagtctccttcccggtaaacttcccactagtgtctctttattcgatgatgaggacgaggaagataatctgtttgggggtaccgccgctaaaaaacagacgctgtcactacaagcccagcgcgaggagaaggcaaaagcaagtgagctgagcaagaaaaaagcctcggcactgttgttcagcagcgacgaggaagaccagtggaatattcctgcttcccaaacgcatttggcatctgactctaggagtaaaggcgaaccccgagattctggaaccttacagtcccaggaggcaaaggcggtaaagaagacttccctgtttgaggaggacaaagaggacgatctgtttgcgatcgccaaggactcacagaagaagacgcagcgggtgagccttctgttcgaggatgacgtggacagcggaggatcactgttcgggtcgccacccacaagtgtgcctcctgccacaaaaaaaaaggaaaccgtatctgaggcgccacccctgcttttctctgacgaagaagaaaaggaggcgcagttaggggtcaaatctgtggataagaaggtggagtcggcaaaagagtctctgaagtttgggagaacagacgtggccgaaagcgaaaaagagggactgctgactcgtagcgcccaagagaccgttaaacatagcgatcttttctcctcttcttctccttgggataaaggcacaaaaccaagaaccaagacggtgctgagcctgttcgacgaggaggaagataagatggaagaccagaacatcatccaagcaccccaaaaagaggttgggaaagggtgtgaccccgatgcccatcctaagtcaaccggcgtctttcaggacgaagagttgttgttctctcacaaattacagaaagataacgatcccgacgtggacctcttcgctggtacaaagaagaccaagttattagaaccatccgtaggcagtctgttcggtgacgatgaggatgatgatctcttttcgagcgccaaatcccagccacttgtccaagagaaaaagcgagttgttaagaaggatcacagtgtgaattcctttaaaaaccaaaaacacccagaatcaatacaaggcagcaaggagaagggcatctggaaaccagagactccccaagccaatcttgccattaatccagctgccttgttgcctactgctgcatcacagatctcagaggttaagcccgtgctccccgaattagcgttcccatcaagtgagcacagaagaagtcacgggctcgagagtgtgcccgtcttgcctggcagcggcgaggctggtgtcagcttcgatcttcctgcgcaagctgacacgctgcacagtgccaataaatcacgcgtaaagatgcggggaaaacgtagaccccagacccgtgcagcacgcaggctcgctgcccaggagtcgtccgaggcagaggacatgagcgtgccacgcggaccgattgcccagtgggctgacggagccatcagtccaaacggtcacagaccccagctacgtgccgcttccggcgaggacagcaccgaggaggctctggcagctgctgctgcaccatgggagggcggacccgtgcccggtgtggatacctctcctttcgcgaagtcactcggacatagccgcggtgaggccgacctgtttgactccggcgacatattctctaccggcacaggcagccaaagcgtggagagaaccaagcccaaggcaaagatagccgaaaatcccgctaacccccctgtcgggggtaaagccaagtcccccatgtttccagctctgggggaggcttcttctgatgacgatctattccaatccgcgaaacccaagcccgcaaaaaagaccaacccattcccattacttgaagatgaggatgacctgtttactgatcagaaggtcaagaagaacgaaaccaaaagcagtagtcagcaggacgtgattctgacgacccaggacattttcgaggatgatatttttgccaccgaggcaatcaagccctctcagaaaacacgcgagaaagaaaagaccctggagagcaatctgtttgacgataacattgacatttttgccgatttgaccgttaagcctaaagaaaaatccaaaaagaaggtggaggcaaaatcaatctttgatgacgatatggatgatatcttcagcaccggtattcaggccaagaccaccaaacccaagtccaggtctgcacaggcggcacctgaaccaaggttcgagcacaaagtttcgaatatattcgatgatcccttgaatgcctttggtggccagtag

SEQ ID NO: 222768 - DNA, 4026 bp, Artificial Sequence
  Description of Artificial Sequence: Synthetic coding sequence
atgatgaacagaacaactccagatcaagagctggtccctgccagcgaacccgtgtgggaaaggccctggagcgtggaagaaatcagaagatcgagccaatcatggagtctggccgcagatgccggtctgttacaatttctccaggaattctctcagcaaaccatctcgcggacacacgaaatcaaaaaacaggtggacggtctgatccgcgaaaccaaagcaacagactgccgcctccacaacgtgttcaacgattttctgatgctttccaatactcagtttatcgagaatcgggtctacgatgaggaagtagaagagccagtgttaaaggctgaagccgaaaaaacagagcaggagaagacacgggaacagaaggaggtggacctgatccctaaagtccaggaggcggtgaattatggactacaggtgctggattctgctttcgaacagctggacattaaagcaggcaactccgactcagaggaggacgacgcaaacggcagagtggagctgattcttgagcccaaagacttgtatatcgatagaccactgccttacttgattgggagtaagctgtttatggaacaagaggatgttggcctgggggagctgtcctctgaggagggcagtgtgggctcagaccggggatctatcgttgatacagaagaagaaaaggaagaggaagaatctgacgaagattttgcacaccactccgataacgaacaaaaccagcacactacccagatgagtgatgaagaagaagatgacgacggctgtgacctatttgccgacagcgaaaaagaagaagaggatatcgaggatatagaagagaatacgcggccaaagcggtccagacctaccagcttcgcggacgaactcgctgctagaatcaagggcgatgcaatggggagagttgacgaggaacccaccacgctccccagtggggaggcaaagccccgaaagaccctgaaggagaagaaggagagaagaactccatctgatgatgaagaggacaatcttttcgcccctcctaagttgactgatgaagatttttcaccatttggaagtggcggaggcctgtttagcggtggtaaaggcctcttcgatgatgaggacgaggagagtgacctgttcaccgaggccagccaagatcggcaggcaggagcttcggtaaaggaggaatcaagttcttccaagccgggaaagaagatacctgccggtgctgtcagcgtctttctaggtgacaccgacgttttcggagcagcgtccgttcccagcttgaaggagccccagaagcctgagcagcccacccctcgaaagtctccgtatggaccaccacccacgggacttttcgatgacgacgatggggatgacgatgacgacttcttttccgccccacactcaaagccatcaaaaacaggtaaagtgcagtcgaccgctgatatcttcggagacgaagagggtgatctgtttaaggagaaggccgtggcctcgcccgaagcaactgttagccagacggacgaaaataaagcccgagcagagaagaaagtgacccttagttactcgaagaacctgaaaccatcatctgagaccaaaacacaaaaaggtctgttctccgacgaggaggactccgaagatctgtttagtagccagtctgcgagtaatctgaaaggagcatccctgctgcctggcaagctccccaccagcgtctcactttttgatgacgaggacgaggaagataacctgttcggagggacagcggcaaaaaagcaaactttatccctgcaggctcagagagaagaaaaggccaaagcatcagaactctccaaaaagaaagccagtgcactgttgtttagctctgatgaggaagatcagtggaatatccccgcttcacagactcacttggcaagcgactcacgttctaagggggagccacgcgatagcggcaccttgcagagtcaggaagccaaagccgtgaagaaaaccagtctcttcgaagaggacaaagaagacgacttgttcgctattgccaaggatagtcagaaaaagactcagcgcgtctcgctgttattcgaagatgacgttgacagtggaggcagcctgttcgggtctccgccaacgtccgtgcctccagcaacgaagaaaaaggagacagtatcagaagccccacctctgctattttctgatgaggaggaaaaagaggcccaactgggtgttaagtccgtcgacaagaaagtggagtccgctaaggaaagcctgaagtttggtaggaccgacgtggcggagagcgagaaagaaggactgctcaccagatccgcccaagaaacagttaaacacagtgacctgttctcctcttcaagcccttgggacaaggggaccaagcctcgaacaaagacagtattgtcactttttgatgaagaagaagacaagatggaagatcagaatattatccaagctccacagaaagaagtgggcaaagggtgtgaccccgacgcccaccctaagtccaccggtgtgtttcaggacgaggagctgctgttctctcataaactccagaaggataacgatccggacgtggatttgttcgctggaacgaaaaagacaaaattgcttgaaccatccgtgggctcactgttcggtgacgacgaggatgatgatctgttttcttcagcaaaaagtcagccattggtccaggagaaaaaacgggtggttaagaaggatcatagcgtgaattcatttaaaaaccagaagcatcccgagtctattcagggctccaaagaaaaagggatatggaaaccggaaacaccacaagattcaagtggcctggccccatttaagacaaaggagccctccacacgcattggtaagatccaggccaatttggcaattaaccctgctgccttacttcctaccgccgctagccagattagcgaggtgaagcccgtgctgcctgaactcgcttttcccagctcggaacatcgacggtcccacggtttagaatccgtgccagtgctccctgggagcggagaagcaggagtgtctttcgatctgcccgcacaggctgataccttgcattccgcaaataaatctcgcgtcaagatgagaggcaagcgaagacctcagacccgtgccgctcgccgtttggcggcacaagagtcgtcagaggctgaggacatgtccgtgcctcggggtcctatcgcgcagtgggccgacggtgctatctctcccaatggccaccgcccacagctcagagcagcctctggtgaggattccaccgaggaggcgttggctgccgcagccgcaccttgggagggcggtcccgtgcccggtgtggatactagcccttttgcaaagtccctgggacacagcagaggagaagcagacctattcgattcgggcgacatcttttctactgggaccgggtcccagtccgtggaacgcaccaaacccaaagccaagattgccgaaaatcctgcaaatccgccagtagggggaaaggccaaatcacccatgttcccagctctgggagaagctagcagcgatgatgatcttttccaaagcgccaagccgaagcccgctaaaaaaacgaacccttttcccctgctggaggacgaggacgacctgttcactgatcagaaggtgaagaaaaatgaaacgaagtcttcctctcagcaggatgtgattctgaccacccaagatattttcgaagatgacatattcgccacagaagcaattaaaccctcacaaaaaaccagggagaaggaaaagaccctcgaaagtaacttgttcgacgacaacattgacatattcgccgatcttaccgtgaaaccgaaagagaagagcaaaaaaaaagtcgaagcaaagagcatatttgatgacgatatggatgacatcttctcaactggaatccaggccaaaactacaaaaccaaagagcagatccgctcaagcagctcccgaaccgcgtttcgagcacaaggtgagtaatatattcgacgatcccctcaacgcatttggaggacaatag

SEQ ID NO: 222769 - DNA, 840 bp, Artificial Sequence
  Description of Artificial Sequence: Synthetic coding sequence
atgatgaacaggaccacgccggaccaggaactggtgccagcttctgagcccgtttgggagcggccttggtcggtggaagaaattcgcaggtcttctcagtcttggtctttggctgctgacgcaggcagagtatacgatgaagaagtagaggagcccgtcctgaaggcagaagcagagaagaccgagcaggagaagaccagagaacaaaaggaggttgacctcatccctaaagtgcaagaggctgtaaactacggacttcaggttctcgattccgcctttgaacagcttgacataaaggcgggtaattctgacagtgaggaggacgatgccaatgggcgtgtggagttgattctcgagcctaaagatctatacatagaccggccattgccctacctgatcggttcaaagttattcatggaacaggaggacgtgggactgggagagctttcctcagaagaggggagtgtggggtcagaccgcggtagtatagtggacacagaggaggaaaaggaagaggaggagagcgatgaggactttgctcatcactccgataacgagcagaaccagcatacaactcagatgtccgatgaagaagaggacgacgacggctgcgatctgttcgccgattcagagaaagaggaagaagatatagaagacatagaggagaacaccagacccaaacgaagtcgtccaacatcgttcgcagatgagcttgctgccagaatcaagggagatgctatgggtagggtggacgaagaaccaacaactttgccttccggtgaagctaaaccacgcaagaccctgaaggagaaaaaagaaaggcgtacgccttccgactag

SEQ ID NO: 222770 - DNA, 3762 bp, Artificial Sequence
  Description of Artificial Sequence: Synthetic coding sequence
atgcccaggctgtccggtaaatctgtgagagtttacgacgaggaagttgaagaacccgtcctcaaagcagaggcggagaagaccgagcaggagaagacacgggagcaaaaggaggtcgacctgatacccaaggttcaggaggctgtgaattatgggctgcaggtccttgattctgcctttgagcaattggacatcaaggcgggaaacagtgactctgaggaggatgatgccaatgggcgagtggaactgatactagaaccaaaggacctatatatcgaccggcctttgccttaccttatcggtagtaagttgttcatggagcaagaagacgttggacttggcgagctctctagcgaggaaggttccgtagggagtgatagagggtcaatagtcgataccgaggaggaaaaggaggaagaagaatcagacgaggattttgctcaccacagcgataatgagcagaatcagcataccacacagatgagcgatgaagaagaggatgatgatggttgtgacctgttcgccgactcagaaaaagaggaggaggacatagaggacatcgaggagaacacccggccaaagagaagcaggccgaccagctttgccgacgagttagccgcacgcatcaagggcgatgctatggggagggtcgacgaggaacccacaacgttacctagcggcgaggcaaagccaaggaaaactttaaaggaaaaaaaggagaggagaaccccctctgacgatgaggaggataatcttttcgctccacccaaactgaccgacgaagacttttcccctttcggatccgggggtggcttgttttccggaggcaaagggctgttcgacgatgaagatgaggagagcgatttattcacagaggcctcccaggacagacaagctggggcttccgttaaagaggagtcctcatcctccaagcccggaaagaaaatcccggcaggcgctgtatccgttttcctcggagacaccgatgtgtttggcgcagcatctgtgccaagtcttaaggaaccccaaaagcctgaacagcctactccccgaaaatccccttatggtccccctcccactggcttatttgatgacgacgatggcgatgatgacgacgactttttctcggcgcctcattctaagcccagcaagactggtaaggtgcagtcaaccgcagacatttttggggacgaagagggggaccttttcaaagagaaagccgtagccagtccagaggccaccgtatctcaaactgacgagaataaggctcgtgccgaaaagaaggttactctttcttactcaaagaacctcaaaccttcatccgagactaagacccagaaaggcctgttcagcgatgaggaagactctgaggacctttttagctcccagagtgcaagcaacctaaagggtgcctcactcctgcctggaaaactccccacctcagtttctttgtttgacgatgaggacgaggaagacaacctatttgggggaactgccgcaaagaaacaaacccttagtcttcaggcccagcgggaagaaaaagccaaagcatccgaactgtctaagaaaaaagctagtgcgttgctgttctcaagcgacgaagaggatcaatggaacatcccagcgtcacagactcatctggccagtgatagcaggagcaaaggagaaccaagagacagtggcacacttcagtctcaggaggcaaaggcagttaaaaagacctctctgtttgaggaggacaaggaggatgatttgtttgctatcgccaaagatagccagaaaaaaacgcagagagtatccctgctcttcgaggacgacgttgattccgggggaagtctgttcgggtcaccgccaacttcagtgccccctgccactaagaagaaggaaacggtgtctgaggcaccacctctgctgttcagtgacgaggaagagaaggaggcccaattgggcgtaaaatcagtggacaagaaggtcgagtccgcaaaagagtccctgaaattcggtagaacggatgtcgcagaaagcgaaaaggaggggctgctcaccagatctgcacaagagaccgtgaaacactccgacctgttcagttcgagtagcccttgggataaaggcacgaaacccagaacaaagacagtgctgtccttgttcgatgaagaggaggataagatggaagaccagaatatcatccaggccccacaaaaggaggtgggtaaggggtgtgatcccgatgctcacccaaagtctacaggggtgtttcaggacgaagagctgctgttcagccacaagctgcagaaggacaacgatcctgatgtagatctgtttgccggtacgaagaagaccaagctcctcgaacccagtgttgggagtctgttcggggacgacgaggatgatgatctcttctcctctgccaagagccagccactggtacaagagaagaagagagtggtgaagaaagatcattctgttaactcatttaaaaaccagaaacacccagagagtattcagggttcaaaggaaaagggtatctggaagccagagactccccaggacagttccggcctcgcgccatttaaaacaaaagagccgagcacaaggatcggtaagatccaggcaaacctcgccatcaaccccgcagctctgcttccgacagccgcttctcagataagtgaagtgaagccagtactgcctgagcttgcattcccctcctccgaacacagacggtcgcacggcctcgagagcgtcccagttcttccaggatctggcgaagccggtgtgtcattcgatctgccggctcaggctgacaccttgcacagtgcaaataagagtcgtgtgaagatgcgcggtaaaagacgtcctcagacccgtgccgcacgaaggctggccgcacaagaatcttctgaagctgaggatatgagcgtgcctcgtggccctatcgcccagtgggccgatggcgctatttctccaaacggtcatcgccctcagctaagggccgcttctggcgaggactctactgaagaggctttggcagccgcagccgcaccatgggaaggcggaccagtacctggagtggacacatccccttttgccaaatcactaggacattctagaggtgaggctgatttattcgactcaggcgacatattctctacaggaaccgggagccagtcagtagaaaggacaaagccaaaagcaaaaatcgcggagaatcccgctaatccgcctgtcggagggaaagccaagagccccatgtttcctgccctaggagaagcctccagtgacgatgatctgttccagtccgctaaacctaagccagctaagaagaccaatcctttcccactgctggaggacgaggatgatctttttaccgaccagaaggtcaagaagaacgagacgaagtcaagttcgcaacaggatgtgattctcaccacccaggatatctttgaagacgatatcttcgctactgaagccatcaaaccttctcagaaaacgcgggaaaaggaaaagacactggagagcaaccttttcgacgataacattgacatcttcgcagacctgacggtcaaacctaaggagaagtctaagaagaaagtggaagcaaaatccatctttgacgacgacatggatgatatcttttccaccggcattcaggccaagacaactaagcctaaaagccggtcagcccaggccgcaccagaaccaagatttgagcacaaggtgtccaatattttcgacgacccgttgaacgctttcggcggacaatag

SEQ ID NO: 222771 - DNA, 3738 bp, Artificial Sequence
  Description of Artificial Sequence: Synthetic coding sequence
atgatgaatcggaccacccccgatcaggagctcgtgcccgctagcgagcccgtatgggaaagaccctggagcgtggaagaaattcgacgctcatctcaaagctggtctttggcagcggacgcaggcctgctgcagttcctgcaggagttttcccaacagaccatttcccggacacatgaaatcaaaaagcaggtggatggtctcattcgtgaaacaaaggcaacggactgtaggctgcacaatgtattcaacgacttcttgatgctgtctaacacacagttcatcgagaaccgggtttacgacgaggaggtggaggagccagtcctgaaagccgaagcagagaagacagagcaggaaaaaactagagagcaaaaggaagtcgacctaatcccaaaagtgcaggaggcagtcaattatggtctgcaagtcttggattccgccttcgaacagctggacataaaggccggtaactcagacagcgaggaggatgacgcaaatgggagagtggagctgatcctggagccaaaagatctatacatcgacagaccgcttccctatctcatcggctccaagcttttcatggagcaggaagatgttggcctgggagagttgtcatcagaagagggatctgtgggctcagacagaggatcgatcgtcgataccgaggaggaaaaggaagaggaggagtccgacgaagatttcgcacaccacagcgataatgaacaaaatcaacatactacccagatgtctgacgaagaggaagacgatgacggatgcgatctgttcgccgatagtgaaaaagaagaggaggatatcgaagacattgaagaaaatacacgcccaaaacggtcccgccctacatccttcgcagatgagctggctgcccgaatcaaaggcgatgctatgggcagagtcgacgaggagccaaccaatgaagaggataacttgttcgcccctccaaagctaacagatgaagacttctcaccattcggtagcgggggtggcctgttcagtggaggaaaaggcttgttcgatgatgaggacgaagagagcgatctctttacggaggcctctcaggacagacaggccggtgcatcggtaaaggaggagagcagtagttctaaaccgggaaagaaaattcctgccggtgccgtatctgtattcctcggggacacggatgtcttcggtgctgcttctgtgcctagcctgaaggagccacagaaacccgagcagcctactccaaggaagtccccttacggacctccacccactggcctgttcgatgacgacgatggggatgacgacgatgatttctttagtgcgccacacagcaagcccagtaaaacccgaaaggttcagagtactgcagatatcttcggagatgaggagggagaccttttcaaggaaaaagccgtcgcctcaccagaggcgaccgtgagtcaaaccgacgaaaataaagcccgagccgagaaaaaggttacactgagttatagcaaaaacctcaagccttcctcagagacaaaaacacagaaaggcctgttcagcgacgaagaagactccgaggacttattttctagccagtcagcttccaatctcaagggagcttctctattgcccggtaagctgccaacctcagtttcactgttcgatgacgaggacgaggaagataacctttttggaggaacggccgctaaaaagcagactctgtccttgcaagctcagagagaggagaaagcaaaggctagcgagctgagcaagaagaaggccagcgctttgctgttctcaagcgacgaggaagaccagtggaacatccctgcctcccagactcatctcgctagtgactccagaagtaaaggagagccaagagattccggcaccttgcagagtcaagaggcaaaggcggtgaagaagacttctctgttcgaggaggacaaagaggacgacctgtttgcgattgctaaggactcccagaagaaaactcagagggtttccctcttatttgaggatgatgtggatagtggtggatctctgtttgggagcccgccaacctcagtcccaccagccacaaaagagggcctactcacaagaagcgcccaagaaaccgtgaagcactcggatcttttttcctcatcctcgccttgggataaggggaccaagccccgaacgaaaacagtcttgagcctttttgacgaggaggaggacaagatggaagaccaaaacatcatccaggctccacagaaggaggtgggaaaaggatgtgatcccgacgcgcatcccaagtcaaccggggtgttccaggatgaagagctgctgtttagtcacaagttgcagaaagacaacgaccctgatgtggacctgttcgccggtacgaagaaaaccaaactgctggaacctagcgttgggtccctatttggggatgatgaagacgacgatttgtttagtagtgccaaaagccaacccttagtacaagagaagaaacgcgtagtgaagaaagatcactcagtcaactcttttaagaaccagaaacaccctgagtccatacagggcagcaaagagaagggcatttggaaacccgaaacaccccaggccaatctggcgatcaatcctgccgctctccttcctacagctgcgtcccagattagcgaggtaaaacctgttttgcctgagctggcctttccgtcttccgaacaccgaagatcacatggcctcgaatccgtcccagtgctccccggttcaggcgaagctggcgtgagttttgacttacccgctcaagctgatactctccattcagctaacaagagccgggtgaagatgaggggaaagagaagacctcagacccgcgctgcacggagactggccgcacaggagagtagcgaagccgaagatatgagcgtgccacgcggaccaattgcacagtgggctgatggcgcaatctctcccaacggtcaccgccctcagcttcgggctgcgtccggggaggattccactgaggaggctctagcggcagcagcagccccatgggagggcggtcccgtgccaggtgtcgacacctctcccttcgcaaaatcactggggcatagccgcggagaggcagacctgtttgactcaggcgacatctttagcacaggcactggctctcagtctgtggagcgtaccaaacctaaagcaaaaatcgctgaaaatcctgccaacccacctgtgggtgggaaagccaaatcacccatgtttcccgcactgggagaagcctccagtgatgatgatctgttccagtccgctaagcccaaaccagctaaaaagacaaacccatttcctctgctcgaggacgaagatgatctcttcaccgatcagaaagtgaagaagaatgaaaccaagtcatctagccagcaggacgtgattctcaccactcaggatatcttcgaggacgatattttcgctactgaggccatcaaaccttcccaaaaaacacgggaaaaggagaagacgctggaatccaacttgtttgacgataacatagatatttttgctgacctcaccgttaagcctaaggagaagagcaagaaaaaagtggaagccaaaagcatctttgacgacgacatggatgacattttttccaccggaattcaggcaaagacgactaagccgaaatccaggtcggctcaagctgctccagagccaaggtttgagcacaaggtgtcaaatatttttgacgaccctttaaatgcctttggagggcagtag

SEQ ID NO: 222772 - DNA, 3840 bp, Artificial Sequence
  Description of Artificial Sequence: Synthetic coding sequence
atgatgaatcgtaccacacctgaccaggagttagttccggcttcagaacccgtttgggagcgcccatggagtgttgaggagattagacggagctcacagtcctggtcgttggccgcagacgctggactgcttcagtttctgcaggagttctcacagcagactatatctcgcactcacgaaattaaaaaacaggttgatgggctgatccgtgaaaccaaggcaacagactgcagactgcataatgtcttcaatgactttttgatgctatccaatacccaatttattgagaatcgagtgtatgatgaggaggtggaggagccagttttaaaagccgaggctgagaaaacggaacaggagaaaacacgggagcagaaggaggttgatctgatccccaaggtgcaggaagccgtgaactatggcctgcaggtgctagactctgccttcgagcagcttgatatcaaagcagggaactctgactctgaggaggatgacgcgaatggtagagttgagctcattttggagccaaaagacttgtacatcgatcggccacttccatatctgatcgggtcaaaactattcatggagcaagaggatgtgggactgggggaactttcttcagaagaggggagcgtgggatcagatagaggatccattgtggacacagaggaggagaaggaggaagaagagtccgatgaggacttcgcacatcacagtgataacgagcaaaaccagcatactacccagatgagcgacgaagaggaagacgacgacggctgcgatctcttcgctgattcagaaaaagaggaggaagacatcgaagatatcgaggagaacacacgtccgaagcgctcaaggccaacatcgttcgcagacgagctggcagcgagaatcaagggggatgccatgggcagggtggatgaagagcctaccaccctcccatcaggcgaagctaagccgaggaagaccctgaaggagaaaaaagaaaggagaacgccctctgacgatgaggaggacaatttatttgctccacccaagctgaccgatgaggacttcagcccgtttggctctggaggtggactgttcagcgggggaaaaggtctttttgatgatgaggatgaagagtccgacctctttactgaagcatcccaagatcgccaggcaggggcatctgtcaaggaagaaagttctagtagtaaaccgggaaagaagattcctgccggagccgtgagcgtttttttgggggacacagatgtcttcggggctgccagcgtgccctctctgaaggaaccacagaaaccagagcagccaaccccacgaaagagcccctatggacctcctccaaccgggctctttgacgatgatgacggcgatgatgacgacgacttcttctccgctccacatagcaaaccttctaaaaccaggaaggtccaaagtacagccgacatttttggggatgaagagggagacctgttcaaggagaaggcagtggctagtccagaggctaccgtgagccagacagacgaaaacaaggctcgcgcagagaagaaagtaacattatcttactctaaaaatctgaagccttcctcagagacaaaaacccagaaagggttgtttagcgacgaggaagattcagaggatctattcagcagtcagtctgccagtaacctcaagggagcgtctctcctgcctggcaagttgccgacctctgtgagtctgttcgacgacgaagatgaggaagataacctctttgggggaactgctgcgaaaaagcagactctctccctgcaggcccagcgcgaagaaaaggctaaggctagcgaactgtccaaaaagaaagcttccgctctcctttttagcagtgatgaggaggatcagtggaacattcccgcaagtcaaacccacctagcctctgactcgagatctaaaggcgagccaagagattctgggacgctgcaaagtcaggaggccaaggccgtcaagaagacaagcctgtttgaggaggataaggaggatgatttgttcgccatcgccaaagatagccagaaaaaaacccagcgcgtctcactgctgtttgaggacgacgtcgattccggaggtagcctgttcggatcccccccaacctccgtgccccctgccaccaaaaagaaagagactgtctccgaggcaccaccactgctgttttccgatgaagaagagaaagaggcacagcttggtgtgaaaagcgtcgataaaaaggtggagtctgccaaggagtcattgaagttcggaaggaccgatgtagcagagtctgagaaggagggtttgctaacacggtccgctcaggagacagttaaacacagtgaccttttctcaagctcctcaccctgggataaagggaccaagcctaggaccaagaccgtgctttccctctttgatgaagaagaggacaagatggaggaccagaacattatccaagccccacaaaaggaagtgggtaaaggttgcgaccctgatgcccatcctaaaagcaccggtgttttccaggatgaagaattgctattctcccataagctacagaaggacaacgatcctgacgtcgacctgttcgctggcaccaagaaaactaagttacttgagccgtctgttggaagcttgtttggggacgatgaagacgacgaccttttttcttctgcgaaatcacagcccctggctaaccttgccattaacccggctgccctgctacctacagctgctagtcagatctcagaggtgaaacctgtcctgccggagcttgcttttcccagctctgagcatagacgctcacacgggttggagagcgttcctgtacttcccggaagtggcgaagccggagtctcctttgacctccccgctcaggcggatacactgcactccgcgaacaaaagcagggtaaagatgaggggcaagaggcgtcctcaaacccgggctgccaggcggcttgctgctcaggagtcctcggaggccgaggatatgtctgtccccagaggtcccattgcccaatgggccgatggtgctatttcacctaatggacacaggccacagctcagagcagccagcggagaggacagtactgaggaggctctggcagcagcagcagctccttgggaaggagggcctgttcccggagttgatacgtccccttttgccaaatctctggggcattcaagaggagaggcagatctcttcgacagcggagacattttttctactggcactgggtcccagtcggtggagaggaccaaacctaaagccaagattgctgaaaaccctgcgaatcctccagtaggagggaaagctaagtcgccaatgtttcccgctctcggggaagcgagttcagacgatgacctgttccaaagcgccaagcctaagcccgcaaagaagactaaccccttccccctgttggaggatgaggatgacttatttaccgaccagaaagttaagaagaacgagaccaaatcctccagccagcaggacgtaatcctgacgacccaagatatcttcgaggatgatatctttgctactgaggctatcaagccctcgcagaagactcgcgagaaggaaaaaacgttggagtccaatctgttcgatgataatatcgatatttttgccgatctaaccgttaagcctaaggaaaagtctaaaaaaaaagtggaggccaagagtattttcgatgatgatatggatgatattttttcgacaggtatccaggccaagacaaccaaaccaaagagcagaagcgcccaagccgctcccgaacccagatttgagcacaaggttagtaatatctttgacgaccccctcaatgcctttgggggtcagtag

SEQ ID NO: 222773 - DNA, 1329 bp, Artificial Sequence
  Description of Artificial Sequence: Synthetic coding sequence
atggccgagggggaaggttacttcgccatgtccgaagacgagctggcttgctccccttatatacctttagggggagattttggcggaggagacttcggcggaggcgatttcggcggaggagacttcggtggtggtgggtctttcggagggcactgcctcgattattgtgagtcacccacggcacactgcaacgtgctgaactgggagcaggttcagagactggatggtatcctatccgagacaatacctatccacggcaggggaaactttcctacactcgaactccaaccgagcctaatcgttaaggtggtcagacgcagattggcagagaaacgtataggagtccgcgacgtgcgcctgaacggttcagccgctagccatgtgctgcaccaggatagcggcctcggttacaaggatttggatttgatcttttgtgctgacttaaggggcgaaggggagttccagacagtgaaagacgtagtgctggattgtctcctggattttctgcccgagggggtaaataaggagaagatcactcccctaacactgaaagaggcttacgtgcagaagatggttaaagtttgtaatgactcagatcgttggagtctcatttcactgagtaacaactccggtaagaatgtcgagcttaaatttgtggacagcctcagaagacagtttgaatttagcgttgattcatttcaaattaaattagactctctgctccttttttatgaatgctccgagaatccaatgaccgagaccttccacccaacaattattggagaatccgtttatggagatttccaggaagcgtttgaccacctttgtaacaagataatagcaacgaggaatcctgaggaaatcaggggcggaggcctgcttaaatactgcaatctattggtgcgtggctttcggcctgcatcagacgaaatcaaaacactgcagaggtatatgtgctccaggttctttattgacttttccgatattggcgaacaacaaagaaagcttgaaagttacttacagaatcactttgtgggtctcgaggataggaaatacgaatacctgatgacgttgcacggcgtggtcaacgagtccacggtttgtctaatgggacacgaacgcaggcagactctcaacctgatcactatgctggccatacgcgtcctcgcagatcagaacgtgatccctaacgttgcaaatgtaacctgttactaccagcccgctccctacgtcgccgatgcaaatttcagtaactactatatagcacaggtgcagcctgtgtttacatgccagcagcagacatactccacgtggctgccttgtaattag

SEQ ID NO: 222774 - DNA, 1176 bp, Artificial Sequence
  Description of Artificial Sequence: Synthetic coding sequence
atggcagaggagtctagttgcactcgggactgcatgagcttttcagtgctaaattgggaccaggtctcgcgcctacacgaggtcctcaccgaggttgtaccgattcacggtcggggaaattttccaactctggagattaccttaaaagatatagtccagaccgtgagaagccggctcgaggaggctggaatcaaggtccacgacgtgaggctcaatgggtccgccgctggacacgtgctcgtcaaagacaatggcctggggtgtaaggatctcgaccttattttccacgttgccctcccaaccgaggcagagtttcagcttgtgagggacgtcgtgctgtgttcacttttgaacttcctgccggagggggtcaataagctcaagatatctcctgtgacgctgaaggaggcctacgtccagaagctggtgaaggtgtgcacggacaccgaccggtggtccttgatcagcttatcaaataaaaacggaaagaatgtggagctgaagtttgttgactcgattcgcaggcaattcgagtttagtgtggactccttccaaatcatcctggactctctgcttttcttttatgattgctcaaataaccctataagtgagcattttcatccaaccgtgattggggagtccatgtacggagattttgaggaggccttcgaccacctgcagaatcgccttattgctaccaaaaatccggaagaaatccggggtggagggcttctcaagtatagcaatctacttgtccgagatttccgacctacagaccaggaggagatcaagacactcgaacggtatatgtgttccagattctttattgattttcccgatattcttgaacagcagcggaagttggaaacttatcttcagaatcatttcgccgaagaggaacgctccaagtacgattatctaatgatcctcagacgggtcgtgaatgagtcgaccgtctgtctgatgggccacgagagaagacaaaccctcaatctgatttctctcctggctctgcgagtgctggccgagcagaatattatcccttcagcgacaaacgtcacttgctattatcagccagccccttatgtctccgatggcaatttctccaactactatgtcgcgcaccccccagtgacttattcccaaccatatcccacctggttgccatgtaattag

SEQ ID NO: 222775 - DNA, 2340 bp, Artificial Sequence
  Description of Artificial Sequence: Synthetic coding sequence
atgcagcaggctctcgagctagccctggaccgtgcagaatacgtcatagagtcagctaggcagagacccccaaagcgaaaatacctcagttccggtagaaagagtgtgttccagaagttgtacgacctatacatcgaagaatgtgagaaggagcctgaggtcaaaaaactgaggagaaacgtcaatcttcttgaaaaacttgtgatgcaggagacactttcttgcctagtcgtaaacctctatccaggaaatgagggctatagccttatgctgcgcggtaaaaatggatctgatagcgagacgattagactgccttacgaggaaggagagctgctcgaatacctcgacgctgaagaactacctcccatcctcgtggacttgttagagaagagtcaggtgaacatctttcactgtggctgtgtgattgccgaaattcgtgattaccgccaatccagcaatatgaagagccctggctatcaaagccggcatatccttttgaggccaactatgcagactctgatatgcgacgtgcactctatcacaagcgataatcataagtggacacaggaggacaagctgttgctcgagagccaactcattctggccactgcggagcccctctgtttagaccccagtatcgccgtgacatgtaccgccaatagattgctatacaacaaacaaaaaatgaatacacgacctatgaaacggtgtttcaagagatactcccgctcctctctgaacagacaacaggacctgagtcattgccctccccctccgcaactgagattgttagactttctgcaaaaaagaaaggaacggaaagcagggcaacactacgacctgaaaatcagtaaggcagggaactgcgtggatatgtggaagagatccccctgcaatcttgccataccctccgaagtggatgtggagaaatatgctaaggttgagaagtctatcaaatcagatgacagccagcctacagtgtggccagcacacgatgtcaaggatgactatgtgtttgaatgtgaggcaggcacccagtaccagaagaccaagctgacaatcctgcagagcctaggggaccccctgtactacggtaagatccagccctgtaaggctgacgaggaatcggatagccagatgagcccttctcactcgagtacggacgaccacagcaattggttcattatcggttcgaagaccgatgcagagagagtggtcaatcagtatcaagaactggtgcagaacgaggccaaatgccctgtcaagatgtcacactcttctagtgggagcgcatctctttcacaggtgtctccaggtaaagaaactgaccagacagagacagtgtccgtccagtcttcagtgttaggaaagggtgttaagcatagaccaccaccaataaagctgcctagctcatccggtaacagttcttccgggaactactttactccccagcagacctcctctttcctaaagagccctacccctccaccaagtagcaaaccaagtagcatacctagaaagtcgagtgtggatctgaaccaagttagtatgctcagcccagctgccctgtctcccgcatcatccagccagcgaacaacagcaactcaggtgatggctaatagcgccggactgaacttcatcaatgtcgtcggctctgtatgcggcgctcaggcccttatgagcggaagtaacccaatgctaggatgcaacaccggagctatcaccccagccggtatcaatctctcaggactcctgcctagtggtggactcttgccaaacgccctgcccagtgccatgcaggcggctagccaggcaggggtcccattcggcttgaagaatacttctagcctgcgacctctgaatttgctgcagttgccaggtgggtccctgatctttaacactttgcaacaacagcagcagcagttgtctcagtttaccccccaacagccacagcaaccgacaacttgttcacctcaacagccaggtgaacagggctcggagcaaggaagcacttcccaggaacaggctttgagcgctcagcaggccgctgtgatcaacctgacaggagtagggagtttcatgcaaagccaggcggcagtcctgagccagctcggctccgccgaaaacaggccagagcaatcgctcccacagcaaaggtttcaactgtcctccgccttccagcagcagcaacagcagatacagcagctgcgcttccttcagcaccagatggccatggcagctgccgctgcccagaccgcccaactgcaccaccaccgtcacactggaagccagagcaaaagtaagatgaagcgcggaacgcccacaaccccaaaattttag

SEQ ID NO: 222776 - DNA, 2202 bp, Artificial Sequence
  Description of Artificial Sequence: Synthetic coding sequence
atgcaacaggcgctggaattagcgctggaccgggcagagtatgtcatcgagtcagctcgccagcgccctccaaagcgaaagtacctttcatctgggcgtaaatcagtctttcaaaagctatatgacctgtacatcgaggaatgcgagaaggaaccagaggtcaagcagaagctgcgtcgcaatgtgaaccttctagagaagctggtgatgcaggagacactgagttgcctcgtggtgaacctgtatcctggcaatgagggctactccctaatgctgcgtgggaaaaacggaagtgattcagaaacaattcgcctgccatacgaggaaggtgagctgctggagtaccttgacgcagaagagctccccccaatcctggttgacctgctggaaaagagtcaagtgaacatattccattgtggctgtgtgatcgctgagattagggactaccggcagtcctccaatatgaagagcccaggttatcaaagccgccatatcttactgcggccaaccatgcagacgctgatctgtgacgtgcactcaattacgtctgacaaccataaatggacccaggaagacaagctcctattggagtcacagctgatccttgctacggctgagccactatgcctggacccaagcatcgccgtgacttgtacagcaaataggctcttgtataacaaacagaaaatgaataccaggcccatgaagcgctgttttaagagatattctaggagctccctgaatagacagcaagaccttagccactgtcctcctcccccacagctgcggctgctcgacttcctgcagaagagaaaggaacggaaggcaggacagcactacgatcttaaaataagcaaagccggaaattgtgtcgatatgtggaagagatctccatgtaatcttgccatacccagtgaagtcgacgtagaaaagtatgcgaaggttgaaaagtcgataaagagcgatgactctcagccaacagtgtggcccgctcacgatgtgaaagatgattacgtgttcgagtgtgaggccggtacccagtatcaaaaaacgaagctgaccatcctgcagtctctgggcgaccctctttactacggaaaaatacagccctgtaaagccgacgaggagagtgattctcagatgagtccaagccattctagtaccgatgaccactcaaactggtttattatcgggtcgaaaaccgacgcagagcgcgtcgtgaatcagtatcaggagcttgtgcagaatgaggccaaatgtccagtcaagatgagtcattcttcttccggaagtgctagtttaagtcaggtgtctcctggtaaggaaacagaccaaacagagaccgtctccgtgcagtcgtccgtgctcggcaagggtgttaaacatagaccccctccaataaaactcccttcttcctcaggaaacagcagcagcggaaactacttcaccccccagcagacctcctccttcttgaagagtccaacgcctccgcctagttcaaagccgtcaagcatccctcggaagtcatcagtcgatttgaaccaggtgagcatgctgtccccggctgcccttagcccagcaagctctagtcagagaaccactgccactcaggtgatggcgaactctgccggattgaatttcattaacgtagtcggaagtgtatgtggcgctcaggcattaatgtcagggagcaatccaatgctcgggtgtaatacaggggctattacccccgctgggatcaacctcagtgggctgcttcctagcgggggtctgctgccgaacgctcttccaagtgccatgcaggccgcatctcaggccggtgtaccattcggcttgaagaataccagtagtctgaggcccctaaacctccttcagttaccaggaggcagcctcattttcaatactctgcagcaacagcagcaacagctgagccagtttactccacaacagccccaacagcctaccacatgttcacctcagcagcctggggagcagggatccgagcagggctcaaccagtcaggaacaggccctaagtgcccaacaggcagctgtcataaatcttacaggcgtgggaagtttcatgcagtctcaggccgctgccgtggccatcctggcagcctctaatggttacggttcaagcagcagcacgaacagctccgctacatccagtagtgcatatagacagcctgtcaagaaatag

SEQ ID NO: 222777 - DNA, 2202 bp, Artificial Sequence
  Description of Artificial Sequence: Synthetic coding sequence
atgcagcaggctctggaattagccctcgatagagcagaatatgtaattgaatccgctcggcagaggccacccaaacgtaagtatctcagcagcgggcgtaagagcgtgttccagaagttgtacgatctatacattgaggagtgtgaaaaggaacctgaggttaagcagaagctacggcgaaacgtgaatctgcttgaaaaactcgtcatgcaagaaaccctgtcctgcttggtcgtgaacctgtatccaggtaacgagggatactcactcatgctaagaggcaagaatggttccgacagcgaaactatcagactgccctacgaggaaggagaactgctcgagtatcttgatgccgaggagctgcctccaattctcgttgacctacttgagaagagccaggttaacatttttcattgtggatgtgttattgccgaaatcagagattataggcagtcgtctaacatgaagtcccctggctatcagtcccggcacatcctgttgagaccgactatgcaaacacttatttgtgacgtgcactccattacatccgataatcataagtggacccaggaagataagctgctcctggagagccagctaatcctcgcgacagcggagcccctttgtttggacccatccatagccgttacatgcacagccaatcggctgctctataataaacagaagatgaacacacggccaatgaagaggtgtttcaaacgttattctagatcatcactcaatcggcagcaggacttgagccactgccccccaccccctcagctgaggctactggatttcctccaaaagcgtaaggagaggaaagctggccagcactatgacctcaagataagcaaggccggtaactgcgttgatatgtggaagcgatccccctgcaatctggctattccaagtgaagtggatgttgagaaatatgccaaagttgagaagagtatcaagtccgacgactcccagccgacagtctggccagcacatgatgtgaaagatgattatgttttcgagtgtgaggccggaacgcagtaccagaaaacaaagctcaccatcctgcagtcgctgggagatccattatactatggcaaaatccagccatgtaaagccgacgaggagagtgatagccagatgtccccttcgcattcaagcaccgatgatcattctaattggttcatcattggttcaaagacggatgcagaacgggtcgtaaatcagtatcaggaattggtgcaaaatgaagccaagtgtcctgtcaagatgtcgcacagttcttccggttcagcctccctctctcaggtgtcgccgggaaaggagaccgatcagaccgagaccgtgtcagtacaaagttctgtgttgggaaagggtgttaagcatcgccctccacctattaaactgccttcaagcagtgggaactccagttctgggaattactttactccacagcagacttcgtcgttcctgaaatcgcccaccccaccgcctagtagtaaaccatccagcatcccacgcaagtccagtgtcgacttaaaccaggtctctatgctttcccctgccgctctgtccccagcatcatcttctcagaggaccactgcaacccaggtgatggcaaactctgcaggattaaactttatcaatgtggtcggcagcgtatgcggcgcacaggctctgatgagtggtagcaatccaatgctagggtgtaatacgggcgctataacccctgcgggtatcaacctgtcgggtctgctgccttccggaggcttacttcccaatgcccttcccagtgccatgcaagccgcatcccaggctggggtgccctttggactgaaaaacacatcatcactaagacctttgaatttgctgcagcttcctggtggaagtctgatctttaatacactccagcaacagcagcagcagctttcccagttcactccgcagcaacctcagcaacctacaacttgtagccctcagcagcccggagaacagggcagcgagcaggggtccactagccaggaacaggccctatcagcacagcaggctgccgtgataaatcttaccggggtgggctcttttatgcagagccaggcagctgcagtggcaatcctggctgcatcgaatggctacggatcatcttcgtcaactaatagctccgctacatcctcctccgcttatcggcagcccgtgaaaaagtag

SEQ ID NO: 222778 - DNA, 2202 bp, Artificial Sequence
  Description of Artificial Sequence: Synthetic coding sequence
atgcaacaagctttagagttagctttggatagggctgagtatgttattgagtccgcgaggcagcggcctccgaaacgcaagtatctttctagcggaaggaaaagcgtattccagaagttgtatgatttatacattgaggagtgcgagaaggaacctgaagtgaaacagaaactgcgcagaaacgtgaatctgctggagaaactggtgatgcaggagaccctctcctgtcttgttgtaaatctttacccaggcaatgaaggctacagcctcatgctgagggggaaaaacggaagcgatagtgaaacaattagactcccatatgaggaaggtgaattactcgagtatctggacgcagaggaactaccccctattctggtggacttgctggaaaagtctcaggtcaacatttttcactgtggatgcgttatagcggagattcgcgactacagacagagctctaacatgaagtcccccggatatcaatcacgacatatcttgctgagacctacaatgcagaccctcatctgcgatgtgcactccatcacgagtgacaaccacaagtggactcaggaggataaactgttgcttgagagtcaactaattttagcgaccgctgagccgctgtgcctcgacccttctattgctgtaacatgcactgctaaccgcttgctgtacaacaaacaaaagatgaacacccgacccatgaaaagatgttttaaacgctactctagatctagtttgaacagacaacaggatttgtcccactgcccgcctccgcctcagctgcggctgctagatttcctgcagaagcgcaaggaacgcaaagcgggacagcactacgacttgaagatttccaaggctggcaactgcgttgatatgtggaaaagatcaccctgtaacctggccatccctagtgaggtggatgtcgaaaaatatgccaaagtagaaaagagtatcaaaagcgacgatagtcagccaacagtgtggcccgctcatgatgttaaggatgactatgtgttcgagtgtgaggccggaactcagtatcaaaagaccaagctcacaatcctgcaatccttgggagacccactttattacgggaaaatccagccgtgcaaggctgacgaagagtcagattctcagatgagcccgagccacagctccacagatgatcactccaattggttcatcatagggagtaagaccgatgcagaacgggtcgtgaatcaatatcaagaattggtgcagaacgaggctaaatgcccagtcaagatgagtcattcttcatctggctcagcctctctgagccaggtaagtccagggaaggagacagatcagacggaaacagtcagcgtccaaagctcagtgctcggtaaaggcgtgaaacaccgcccaccacccattaaactcccttcctcctcgggcaacagcagctctggaaattatttcacccctcagcagacctcttcgttcctcaagtcacctaccccgccaccatcctccaaaccgagttccatacccagaaagtccagtgttgacttgaaccaagtctcaatgctatcccccgctgcgctttcaccggcaagcagcagtcagcgaactaccgccacccaggtgatggccaatagcgccggactgaatttcatcaacgtcgtggggagcgtttgcggggcacaggctctaatgagcggtagtaatcccatgctaggctgcaacactggggctatcacaccagcgggaattaacctgtccggtttattaccctctgggggactcctcccgaacgcccttccatcagctatgcaggccgcttctcaggcaggcgtccctttcggccttaagaacacctctagcctccgtcctttaaatctgctgcagctgcctggaggatcactcatttttaacaccctgcagcaacaacaacagcagttgtctcagtttaccccccagcagccccaacaaccaactacctgcagtccccagcagccaggcgagcagggttcagagcagggatctacgagccaagaacaggctttaagcgctcagcaagcagccgtcatcaacctgactggagtcggctcttttatgcagtcgcaggcagcagctgtcgctatcttggcggcatccaatgggtatggttcctcatcctccacaaattcgagtgcaaccagctcttctgcgtaccgccaacctgtcaaaaagtag

SEQ ID NO: 222779 - DNA, 2217 bp, Artificial Sequence
  Description of Artificial Sequence: Synthetic coding sequence
atgcaacaggcgctggagttggcccttgatagagctgagtacgtgatcgagtctgctcggcagcgcccaccaaagcgcaaatacctgtctagcggccgtaagtccgtctttcagaaactgtacgatctctacatcgaagagtgcgaaaaagagccagaggtgaagaagctgaggcgaaatgttaacttactggagaagttagttatgcaagaaactctctcctgtctggtggttaatctctaccctgggaacgagggttactcacttatgctgcgaggaaagaatggcagcgactccgaaacaatacgcctgccatatgaggagggggagctcctcgaatatctagacgcggaagaacttccacctatcttggttgacctgctggagaaatcccaggtaaacatatttcattgcggctgtgtcatagccgaaatcagagactacaggcagtccagcaacatgaaaagtcctggctatcagtcgcgccatatcctccttagacccaccatgcagactctcatctgcgacgtacactcaattactagtgataatcacaaatggacccaagaagacaaattgctcctggaaagccagctgatcctggccactgcggaacctttgtgcttggacccaagcattgccgttacatgtacagccaacagactactgtacaataaacagaagatgaatacccgccctatgaaacgctgctttaaaaggtactccagatctagcctgaataggcagcaggacttgtcccattgccccccacctccccaactccgcttactggacttccttcagaaaagaaaggaacgaaaagccggacagcattacgacttgaagatcagcaaggccggaaactgcgtcgatatgtggaaacggtcaccgtgcaatctcgcaatccctagtgaagtggacgtagagaagtacgccaaggtggagaagtccataaagtcggacgatagtcagcctaccgtctggccggctcatgatgtgaaggacgactacgtgttcgaatgtgaagccggtacccaatatcagaaaacgaagctgaccattttacagagtttaggcgaccctctctattatggcaaaatccagccatgtaaagccgatgaggagtctgactcccagatgagcccgtcgcattcatctacagatgaccattcaaattggtttatcatcgggagcaaaaccgacgccgagcgagtcgttaatcaataccaagagctcgtccaaaatgaagctaaatgtcctgtgaagatgtcccattcgtccagcggaagcgcaagtttgtcacaggtgagccccggtaaggaaactgatcaaaccgagacagtatccgtgcaaagctctgttcttggaaagggcgtcaaacatcgacccccacctatcaaattaccttccagttcagggaacagttcatcgggtaattatttcacccctcagcagacttcaagcttcctaaagagtccaacccccccacctagcagcaaaccatcttctattccccgtaagagcagcgtcgacctgaaccaggtctccatgttatcccctgcggcactatctccagcaagtagttcccagcgcacgactgcaacccaggtaatggccaattcagctggcctgaacttcattaacgtagtgggctccgtgtgcggcgctcaggccctcatgtccggatccaacccaatgctcggctgcaatacaggcgcaataacgccagcgggtatcaatctctcgggtctgcttccctccggtggtctgcttccaaatgctttgccatcagctatgcaagctgccagccaggctggcgttccctttggcctgaaaaatactagttcccttcgccctcttaatctgctgcaacttccgggagggagtctaattttcaacactctgcaacaacaacagcagcagctgagccagtttacacctcagcagccacagcagccaaccacttgcagtccccaacaacccggagagcagggttcagaacaggggagcacctcacaggagcaggcccttagcgcacagcaggctgcagtgataaatctgacgggggtcgggagtttcatgcagagccaggctgcagccgtcgcaatcttagctgcctctaatgggtatgggagctcctccagcaccaacagctccgcgactagttcctccgcctacagacaacccgatacgcgcgctctaaatcaaaagaactag

SEQ ID NO: 222780 - DNA, 1497 bp, Artificial Sequence
  Description of Artificial Sequence: Synthetic coding sequence
atgtatgtgatcgaaagtgcgcgacagcgaccccctaaacgcaaatacctaagcagtgggcgaaagtccgtttttcagaaattgtacgacctgtatatcgaggagtgcgaaaaggagcccgaggtgaaaaaactgcggagaaacgttaatttactggaaaagctggttatgcaggaaaccttatcttgtctagtggtgaacctttacccaggcaacgaggggtactctctgatgctccggggaaaaaacggatctgactcggaaaccatacgcctcccctacgaagaaggagagctcctggagtacttagatgccgaggaacttcctcccattctcgtggacctgctggagaaaagccaggttaacatcttccactgcggctgcgtcattgccgaaataagagactacagacagtctagcaatatgaagtcacctgggtatcaatccaggcatatattgctgcgtcctacaatgcagaccctgatctgcgatgtgcattcaataacaagtgataaccataagtggacccaagaggataagctgcttttggaatcccagctaattctagccacagcggagccactatgcctggacccctccattgccgtgacatgcaccgcaaacaggttactttacaataaacagaagatgaatacaaggcctatgaagagatgtttcaaaaggtatagtaggtcttcactgaatcggcagcaggacctgtcccactgccctcctccgcctcagctgcggctcctggatttcctccagaagcgaaaggagcggaaggccggacaacactatgatcttaagatctcaaaggcaggaaattgcgtggatatgtggaagaggtcgccatgcaacctcgctatcccctcagaagtagacgacgtgaaagatgattacgtgttcgaatgcgaagccggaacgcagtatcagaaaacgaagcttaccattctgcagtccctcggtgaccctttgtattacgggaaaatccagccgtgcaaggcagacgaggagtctgactctcagatgagcccttctcacagctctaccgatgaccattcaaattggttcatcattggctcaaaaacagacgctgagcgagtggtcaatcagtaccaagagcttgtgcaaaatgaggcaaaatgtccagtgaagatgagccactcttcatctggctccgcgtcactttcccaggttagccccggaaaggaaaccgaccaaaccgagacagtttccgtccagagctccgtgcttgggaagggggtgaaacacaggcctccacccataaaactgccttcatcttcagggaattctagtagcggaaattatttcaccccacagcagacttccagctttttgaagagtcctactccacctccttcatctaaaccttcttctattccccgaaaaagttctgttgatctcaatcaggtgagtatgttgtctccagcagcactgtcccccgcatcttcatcccagaggcacgagtcatag

SEQ ID NO: 222781 - DNA, 678 bp, Artificial Sequence
  Description of Artificial Sequence: Synthetic coding sequence
atgctgctgacgctggctggcggtgccctgttttttcctggactgttcgctctctgcacctgggcgctgaggaggtcccagcccggttggtcccgcacagactgtgtgatgatcagtactcggctggtttctagcgtgcacgctgtattggcaaccgggtccggtattgtgataatccggtcgtgcgacgacgtaattaccgggcgacattggcttgctcgagagtatgtatggttcctgattccatacatgatctatgactcttacgcgatgtatttgtgtgagtggtgtcgtaccagggatcagaatagagctccctcgttgacgttgaggaatttcctgtctagaaatagactgatgataactcaccacgccgtgattctgttcgtcctggtcccagtcgctcagctgaaacagcagcacaccctcctgtacaaggtcaatggtatcctgaccctggccaccttcctgagctgtcgcattctgttgttccccttcatgtattggtcgtacggtcgccaacagggactctccctccttcaagtccctttctccatccctttttactgtaacgtggctaatgcgttcctggtcgcgcctcagatctattggttctgcctgctatgcagaaaggccgtgcggctttttgacactccacaggcaaaaaaggacggctag

SEQ ID NO: 222782 - DNA, 774 bp, Artificial Sequence
  Description of Artificial Sequence: Synthetic coding sequence
atgctgctcaccctggccggtggcgcactcttttttcccggattattcgccctgtgcacgtgggctctgcgaagaagccagcctggatggagccgaactgattgtgttatgatctctacacgcctggtcagttccgtacacgctgttttagccaccggctccggaattgtaattattcgctcatgcgatgacgttatcactggacgccactggttggctagagagtatgtgtggtttctgattccttacatgatctacgactcatacgcaatgtatctctgcgaatggtgcaggacacgagaccagaatagagctccgagcctcacacttaggaactttctgtctagaaataggctgatgataactcatcatgctgtgattctgtttgtgctcgtacccgttgcgcagaggctgaggggggacctgggggatttttttgtcgggtgcatttttacagcggagctgtcaacaccatttgtgagcctgggtagagtgctgatccaattgaaacagcaacatacgctgctgtacaaagtcaacggcatcctgacattagcaactttcctgagttgcaggatcttactgtttccatttatgtattggagttacggtcgtcagcagggccttagcttgctgcaggtacctttcagcatccccttctactgcaacgttgccaacgcctttctggtcgcaccccagatctactggttttgtctgctatgccggaaggcagtgaggttgtttgataccccccaggcaaaaaaagatggctag

SEQ ID NO: 222783 - DNA, 993 bp, Artificial Sequence
  Description of Artificial Sequence: Synthetic coding sequence
atgattagtacccgataccgccgtagacgagatgcaccgaggggcccaggcagatgcccaccacaccccacacgaccacgaggccctggacggaaaagaggagctgccggatctcccggtgctgcccctagcgcctcacgacgcccagaattcccaaagccgctgcgcgtgctaccgtggagggagaggggcagaggaggaagggagtggcccatgtcactgcgatctccactccccacatctgcctgcggttggggtgagtcaggtaggagacccggtcgcgctccctgcgggcctcggaccgggctgagcgctagagcagttctgtccgccagagccaggcttgtgagctctgttcatgccgtattagccacgggctccggaattgtgatcatccggtcttgcgacgatgtgattacgggcaggcattggcttgccagggagtacgtttggttcctgataccttacatgatttatgactcctatgccatgtacctgtgtgagtggtgccgcactcgggatcagaatagggccccatctctgacccttaggaatttcttgtcccgaaatcgcctgatgatcacgcaccacgctgtcatactgttcgtgctggtgccagtcgcacagagactccggggagatctcggagacttcttcgttggctgtatctttacagcagaactttccactcccttcgtctcgctggggagggtgctaatccagctaaaacagcagcacactctgttatacaaagtgaacggaatactaacactcgctacttttctatcatgccgaattctgcttttccctttcatgtactggtcatacggccgacagcaaggcttaagcctgcttcaggtgccgttctccatcccgttctactgcaacgtggcaaatgcatttcttgttgcccctcaaatctattggttttgtttactatgtcgcaaggccgtcaggcttttcgacacccctcaggctaaaaaggatggctag

SEQ ID NO: 222784 - DNA, 741 bp, Artificial Sequence
  Description of Artificial Sequence: Synthetic coding sequence
atggaggctccagaagcagctgaggggggactgcagagaggagcacggagagccgcaggggctagaagccagggtgcgctcccctctggagaagtgcatcacggcggagtgaagctcgggatgagaagcataccaatagccacagcgtgtacgatttaccataaattcttttgcgaaaccaatcttgacgcatatgacccatatctgatcgccatgtcatcaatttacttggctgggaaggttgaagagcaacaccttagaactcgtgatattatcaacgtgtctaatcggtacttcaatccaagcggggagcctctggagctagactcgaggttttgggagcttcgcgacagtatagtacagtgcgaacttctcatgctgcgagtgctgcggttccaagtgagcttccaacatcctcacaaatatctgctgcactacctcgtgagcctgcagaattggctcaacagacactcttggcagagaacaccagtcgccgttacggcgtgggcactgttgcgcgatagttatcacggagcactgtgccttaggttccaggcccagcatatagccgtggcagttctgtatctggccctacaggtgtacggagttgaggtccccgcagaggttgaggcggaaaaaccctggtggcaggtgttcaacgacgacctgacaaagcctataatagataacatcgtgtcagacctgattcagatttacacaatggacacggaaattccatag

SEQ ID NO: 222785 - DNA, 585 bp, Artificial Sequence
  Description of Artificial Sequence: Synthetic coding sequence
atggaagccggtgtgaaactcgggatgaggtctatacctatcgccactgcttgtactatctaccacaagttcttctgcgagacaaatctggacgcctatgatccatacctgatcgcaatgtctagcatatacctggcaggtaaggtagaagaacagcacttaagaaccagggatattatcaatgtttcgaacaggtactttaatccaagcggtgaacccctagaactagacagccgcttctgggaacttagggacagcatagttcaatgcgagcttctcatgctgagagtgctgaggtttcaggtttcgttccagcaccctcacaagtacctgctgcattacctggtttcactgcagaactggctgaaccgccactcgtggcaacggactccagtggctgtcaccgcctgggccctgctccgcgattcttaccatggagccttatgcctcagattccaagcccaacatatcgctgtcgctgtgctgtatctggcactgcaggtatatggagttgaggtgcctgccgaggtggaggcagaaaagccttggtggcagatttatacaatggatacagaaatcccctag

SEQ ID NO: 222786 - DNA, 681 bp, Artificial Sequence
  Description of Artificial Sequence: Synthetic coding sequence
atggaagctccggaggctgcggagggtggactgcagcgcggagctagacgcgctgccggagcccgatcccaaggcgcacttccatcaggtgaggtgcatcatggaggggtaaagcttggtatgagatctataccaattgctactgcctgcacaatctaccataagttcttctgtgagacaaacctcgacgcttatgacccttacctcattgccatgagctccatttatctggccggtaaggtcgaggaacagcacctccggacccgtgacatcattaacgtgagcaacagatactttaatccaagtggggagccactggagctggactctagattttgggaactccgggattctatagtgcagtgcgagctcttgatgctcagagtgctcaggtttcaagttagttttcagcatcctcataagtatctgcttcactatctggtctctttgcagaactggctgaataggcactcttggcagcgtacacctgtggccgtgacagcctgggctcttctccgcgactcctatcacggggctctgtgtctgcgttttcaggcccaacacatcgccgtggcagttctgtacttggctctgcaggtctatggcgtcgaagtcccagctgaagttgaagccgagaagccctggtggcagatatacaccatggatacagaaataccttag

SEQ ID NO: 222787 - DNA, 645 bp, Artificial Sequence
  Description of Artificial Sequence: Synthetic coding sequence
atggaggctggtgtgaagttgggaatgagaagcatcccgatagctacggcatgtacaatctaccataaattcttctgtgaaaccaatctggatgcttacgacccctacctcatcgcaatgagctctatttaccttgcgggtaaggttgaggaacagcacctgcggacgcgggatattattaacgtgtcaaacaggtacttcaatccttccggtgagcccctggaactggacagtcgattttgggaactcagagattcgatcgtgcagtgcgaattgctgatgctaagagtgttgcgtttccaggtgagtttccagcaccctcacaaatatttgttacattacctcgtgtcactccaaaactggcttaaccggcactcgtggcagagaactcccgtggccgtgactgcttgggctcttcttcgtgacagctatcacggcgctctgtgcttgagatttcaggctcagcatatcgctgtcgccgttctgtatctggcactccaagtatacggcgtggaggtgcctgctgaagtagaggcagagaagccctggtggcaggtcttcaatgatgacttgactaagccgataatcgataacatcgttagcgatctgattcagatctacacaatggacaccgaaatcccctag

SEQ ID NO: 222788 - DNA, 741 bp, Artificial Sequence
  Description of Artificial Sequence: Synthetic coding sequence
atggaagcccctgaaggaggaggaggtcccgctgctagagggcctgaaggtcctgcccctgaagctcgggtccattttagggttgcacgttttatcatggaggcgggagtgaagctgggtatgcggtccattcccatcgcaacggcttgcaccatataccacaagttcttttgcgagacgaacctggatgcctatgacccttatctgatcgccatgtcctccatctacttggccggaaaggtggaagagcaacacctgagaactagggacatcattaacgtcagcaaccggtattttaatccctctggtgagccgttggaattagactcacgattctgggagctccgggatagtatcgtccagtgcgagcttctgatgcttagagtactgcgcttccaggtgtccttccagcacccccacaagtacctactgcactatctggtttcattacagaactggcttaaccggcactcctggcagcgaacgcccgttgccgtgaccgcttgggcacttctgagggatagctatcatggcgcactctgcctgagatttcaggctcagcacatcgcggtggcggttctctatctcgcattgcaggtatatggagtagaagtaccagccgaagtggaagccgaaaaaccatggtggcaggttttcaatgatgacctaactaagccgataatcgataacatagtgtccgacctgattcagatctacactatggacaccgagatcccgtag

SEQ ID NO: 222789 - DNA, 429 bp, Artificial Sequence
  Description of Artificial Sequence: Synthetic coding sequence
atggaagccggagttaagctgggaatgagatctatacccattgccacggcatgcacaatctaccataaatttttctgcgaaacaaacttagacgcgtacgatccctacctcatcgcaatgtcgtccatctacttggccggtaaagtggaggaacagcacctccggacaagggatataataaacgtcagtaaccgcttcatcccttggactcaacgctctcccaaggtgctagcccaggcctgccctaaacggtcacccggttggtccgctgcttggggccactgtcaccacgttgcaatgacggcagggccacataggacctcttgggaggactggctgtgttgctggcgacgggctggtgagggcaatggtatgttgcccttgtgtcagtcgttggaggtggccgtccaggtgatggtcggagcctag

SEQ ID NO: 222790 - DNA, 285 bp, Artificial Sequence
  Description of Artificial Sequence: Synthetic coding sequence
tgagccggaaaagtagaagagcagcacctgcgaactagagatattattaatgtcagcaaccggtactttaatccctccggcgaacctctcgagctcgactcccgattctgggagctgcgcgatagtatcgtgcagtgtgagctactcatgctgcgggtgctgcgatttcaggttagctttcagcaccctcataaagtctttaatgatgacttgactaagccaatcatcgacaatatcgtgtcagacctgatacagatctataccatggacacagagattccttag

SEQ ID NO: 222791 - DNA, 366 bp, Artificial Sequence
  Description of Artificial Sequence: Synthetic coding sequence
tgacggtactttaatccatctggcgagccactcgaactcgattcacgcttctgggagctgcgtgacagcattgtgcagtgcgagctcctgatgctcagagtgttgcgctttcaggtgtcctttcagcaccctcacaaaaattggctgaaccgccattcctggcagcggactccagtggctgtaactgcatgggctttgttaagggactcataccacggtgctctttgcctccggttccaggcacagcatatagccgtagccgtgctttatctggccctccaagtgtatggagtggaagtaccggctgaagtcgaagcagagaaaccctggtggcagatctacaccatggatacagagataccctag

SEQ ID NO: 222792 - DNA, 3207 bp, Artificial Sequence
  Description of Artificial Sequence: Synthetic coding sequence
atgttagtcggctcacagagctttagccccggtgggccaaacggtattatcaggtctcagagtttcgcaggtttttcagggcttcaggaacggcgtagcagatgtaactcatttatcgagaactcaagtgcactcaagaaaccgcaggctaagctgaagaagatgcacaacttgggtcataaaaacaataatcctcccaaggagccccagcccaagcgtgtggaggaagtgtatagagccctgaagaatggtctagacgagtatctggaagtgcatcagactgaattagataagctcactgcccagctcaaggatatgaaaaggaattccagactgggggtgctgtacgacctggacaaacagatcaaaacgatagagcggtacatgcgtcgactcgagttccacatctccaaggttgacgagctgtacgaggcatactgcattcagcgcagactccaggacggtgcctcaaaaatgaagcaggcatttgcgacctctcctgcctctaaggccgcacgtgaatctctaactgagatcaatagatccttcaaggagtacaccgaaaacatgtgcaccatcgaagtcgagctcgagaacctactaggggaattctcgatcaagatgaaagggctggctggatttgcccgtctgtgtccgggagatcagtatgagattttcatgaagtatggtcggcagaggtggaaactcaaggggaagatagaggtgaacggcaagcagtcatgggacggcgaggaaactgtgttccttccccttatcgtgggattcatttcaattaaagtgaccgaactaaaaggcctcgcaactcacatcctcgtaggcagcgttacctgtgagaccaaagagttgttcgccgcaagaccgcaagttgttgccgttgacatcaacgacctcggtacaattaaacttaacttggagattacatggtatccctttgatgtggaagatatgacagcctcgagcggcgcaggaaacaaggccgctgcccttcagcggagaatgtctatgtacagccaggggacaccggaaactccaacatttaaggatcactccttctttcgctggctgcacccttctcccgataagccgagaagactgtccgtgctcagcgcacttcaagatacattctttgcgaaactgcatcggtctcgctccttcagtgacctgccttccctacgtccatcgcccaaggcggtacttgaactgtactccaatctaccagacgatattttcgagaatggaaaggcagccgaagagaaaatgcctctcagcctgtcattttcagacctccccaacggggactgtgccctcaccagccattccacaggaagtccttcaaacagcacaaatcctgagatcactatcacacctgcggaattcaatctgtcatccttagctagccagaatgagggaatggacgataccagttctgcctcttccaggaatagtctgggggaggggcaggaaccgaaaagtcatctgaaggaggaggaccccgaagaaccaagaaagccagccagcgcaccaagcgaagcttgccgaagacaaagttcaggcgctggcgcagagcacctgttccttgaaaacgatgtcgccgaagcccttctccaggagtctgaggaggcatctgagctcaagcccgtggagcttgacacgtcagagggcaatatcactaaacagctcgtaaagagactgaccagcgccgaagtgccaatggcaacagatcgtctcttgagcgagggctctgtgggaggggaatctgagggatgccggtcctttctcgacggctccctggaggatgcttttaacggactgctgcttgctctagaaccccacaaggagcaatacaaagagtttcaggatctgaaccaagaggtgatgaacctggacgacattctgaagtgtaagcccgcagtttccaggtcacgatccagctcactgagcttgactgtggagagcgccttggagtcatttgattttttgaacaccagtgatttcgatgaagaagaagatggggacgaggtctgtaatgtgggaggcggtgcagacagcgtgttttctgatacagaaaccgagaagcattcttaccgcagcgtgcatcctgaggcacggggacatctttccgaagcattgacggaggataccggagtaggaacgagcgttgccggatccccgctgcccctcaccactggaaacgagtcgctggatataacaattgtgagacacctgcagtattgtacccagttggtacagcaaatagtattctcctccaagactccctttgtggccagaagccttttggaaaaacttagtcggcagattcaagtgatggagaagctggctgctgtgagtgatgagaatatcgggaatatcagctctgtcgtcgaggccatacctgagtttcacaagaagctgagtctgcttagcttctggaccaaatgttgtagtcccgtgggagtatatcacagccccgcagatagggtgatgaagcagttggaagctagctttgccagaactgtaaacaaggagtatcccggtcttgcagatccggtgttccgcacactagtctctcagattttagatcgcgctgaacccctgttgtccagcagcctgtcttccgaggtggtaacggttttccaatattactcatactttacatcacacggtgtgagcgatctcgagtcctatttgagtcagcttgccaggcaggtgtccatggtgcagacccttcaatctctgcgcgacgaaaaactcctccagactatgtctgacctcgccccttccaacttactagcgcagcaggaagttcttagaacactagctctgttattgacacgcgaggacaacgaagtgagtgaggcggttaccctatatctggctgctgccagcaagaaccagcactttcgagagaaagccctcctctactactgcgaggccctgaccaagacaaatctgcagttacagaaagccgcatgcctcgctctgaaaattttagaggccacagagagtatcaagatgctcgtcaccctatgtcagagcgatactgaagagatcaggaacgtagccagcgagaccctgctgtctctcggtgaagacggccgactagcttatgagcagctggacaagttccccagggactgtgttaaagttggcggacggcatggaaccgaagtcgccacagccttctag

SEQ ID NO: 222793 - DNA, 1776 bp, Artificial Sequence
  Description of Artificial Sequence: Synthetic coding sequence
atgctggtgggaagccagtctttctccccagggggacctaacggaattattcggagtcagagttttgccggattctcaggcctgcaggagcgaagatctcgctgtaattctttcatcgagaattcatcagccctcaagaaacctcaggctaaattgaagaagatgcacaacctcggccataaaaacaataatccacccaaggagccccagcccaaaagagtggaggaggtctaccgggcactaaagaatggcctggacgaatacttggaggtacaccagacagaactggacaagctgacagcccagctgaaggatatgaaaaggaactcccgcctgggtgttctgtatgacctcgataaacagataaaaactatagagcgctatatgaggagactggaatttcacatcagcaaggtggatgagctgtacgaagcctactgtattcagcgaagattgcaagatggggcttccaagatgaagcaggctttcgcaaccagcccagctagcaaggccgctcgcgagagcctgacagaaatcaatcgctcttttaaggaatacaccgaaaacatgtgcactatcgaggtggagctggagaacttattgggagagttctccatcaaaatgaaaggcctggctggcttcgccaggctttgccccggagaccagtacgaaatcttcatgaaatacggacgccagcgttggaaactcaaagggaaaattgaagtcaacggtaaacagtcatgggacggcgaggaaactgtgttccttcccctcattgtgggttttataagtatcaaagtgaccgaactcaaaggactggctactcatattttggttgggtctgttacgtgcgaaaccaaagagctgttcgctgcccgaccccaggtggttgctgttgatattaatgatctcgggactatcaaactgaacctggagattacctggtacccattcgatgtagaggatatgacagcctcctccggcgctgggaataaagccgctgcgctgcagaggcgcatgtcgatgtattctcagggcacgcctgaaactcccacattcaaagaccattctttcttctcaaatctgcctgacgacatcttcgaaaacggtaaggctgcagaggagaagatgccactgtccctcagcttctctgacctgcccaacggggactgcgccctgacatcccacagcacgggctcacctagtaactctactaatcctgagatcactatcaccccagccgaatttaacctgtcatccctcgcgtcccagaatgaaggaatggatgacacctcatcagccagcagtcggaattcactgggagaaggacaggagcctaagagtcatttgaaagaggaggaccctgaagagccaaggaaacccgcaagcgcaccttcagaggcatgtagaagacagagctccggagccggtgccgagcacctgttcctggagaatgatgtcgctgaagccctcctgcaagagagcgaagaagcaagcgaacttaaaccggtggagctagacacatccgaggggaatattacgaagcagctagtcaagagattaactagcgccgaggttcccatggctacagaccgcctgctgtctgagggttcagtaggcggagagtcagagggatgtcggagtttcctggacggtagcctggaagatgcattcaacggcttgctgttggccctagagccgcataaggaacagtataaagaattccaggacctcaatcaagaggtcatgaatctggatgatatactgaaaaagtag

SEQ ID NO: 222794 - DNA, 1944 bp, Artificial Sequence
  Description of Artificial Sequence: Synthetic coding sequence
atggtgttaccctcacggcttcattggattaggaatcgtccttggagagataggataagacgcagacagcttaacagactgccaactagattacctgagattatgctagtgggaagccaatccttcagtcctggtggcccaaacggcatcattcgaagccagtccttcgcgggattcagcggcctccaggaacggagaagccggtgtaattctttcatagaaaattcctccgctctcaaaaaaccgcaagccaagttgaagaagatgcacaacctgggacacaaaaataacaaccccccaaaagaaccgcagcccaagagagtggaagaggtgtatagagccttgaagaacggtctcgacgagtatctcgaggttcaccaaactgagctcgacaaactgacagcccagctgaaggacatgaaaaggaatagtagattaggggtgctgtacgacctggataaacagatcaaaaccatcgaacgctatatgaggcggttagagttccatatatctaaggtagacgagctgtatgaagcatactgcatacagcgtagactgcaagatggtgcctctaaaatgaaacaggcctttgctacaagtcctgcctccaaggcagcacgggaaagcctcacggagatcaatcgttcttttaaggagtacacagagaatatgtgcacaatcgaggttgagctggagaatctcttgggagaattttcaatcaaaatgaagggtttggcaggattcgcgcgtctttgcccaggcgatcagtacgaaatttttatgaagtatggccgacagagatggaagctgaaaggcaaaatcgaagtgaacggtaagcagagctgggacggtgaggagacggttttcctgccactgattgtagggtttatttctattaaggtcactgagctgaaggggctggccactcatatccttgtgggcagtgttacatgcgaaaccaaggaattattcgcagcacgaccccaggttgtcgcagtggatattaacgaccttggcacgattaagctgaatttagaaatcacttggtatcctttcgatgtggaggacatgaccgccagcagtggtgcaggcaacaaagccgctgcccttcagaggaggatgagcatgtactcacagggcacaccagagacccccactttcaaggatcactctttcttcagtaacttacctgatgacattttcgagaatgggaaggcggctgaagaaaagatgcctctttcgctctcattcagcgatctaccaaacggcgattgcgctctgacaagccacagtaccgggtctccaagtaatagtaccaacccggagatcaccattaccccagctgaattcaatttgtcttcactcgctagtcagaatgaaggaatggacgacacctctagcgcttcaagccgcaacagtttgggagaggggcaagagcctaaatcacacctgaaggaagaagaccctgaagagccgagaaaaccagctagcgccccttcagaagcctgcaggcgccagtcctctggggctggcgcagagcacttgtttctggaaaatgacgtcgctgaggctctgctccaggagagtgaagaggcctccgagctaaaacccgtggagttggacacatctgaaggcaacatcacgaaacaactggtgaaacgacttacctccgcagaagtgcccatggctacagacaggctcctgagtgaaggctccgtaggcggagaatccgaggggtgccgctctttcctagacgggagcctagaggacgcttttaacggattgttactggctctcgagccccacaaggagcagtataaggagttccaggaccttaatcaggaggtgatgaacttggacgatatcctgaaagacgctaaacatttggatgatcagaagctgaatggagcggcatcttggactgagatcaccgaaggagaatag

SEQ ID NO: 222795 - DNA, 3144 bp, Artificial Sequence
  Description of Artificial Sequence: Synthetic coding sequence
atgcagttcttcgacgccgaggagctgctggtggatgaagaagatgacgttttcggagagggattgccaacgagactgcctgagatcatgctcgtcgggtcccagtctttctcccccggtggcccaaacggaattatacggagtcagtcgttcgccggattctctggcctccaggaacgccgttcacgatgtaactcgtttattgaaaattccagcgctctgaaaaagcctcaggccaaactgaaaaaaatgcacaacctgggccacaagaacaacaaccccccaaaagagccgcagccaaaaagggtggaagaagtctatagggccctaaagaatggtctggacgaatacctcgaggtgcaccaaaccgaactggacaaattaacagcccagcttaaagacatgaagcggaacagtaggcttggtgtgttgtatgatctcgataaacaaatcaaaaccattgagaggtatatgcggcgactcgagtttcatatatcaaaagtggatgaactgtacgaagcttactgcattcagcgtagactgcaggacggggcttccaagatgaagcaggcgtttgcgaccagccccgctagcaaagctgctcgggagtccttaaccgagataaatcgcagcttcaaggaatataccgaaaacatgtgtacgattgaggtcgaactggagaacctgctgggagagttttctattaagatgaaggggttggccggttttgctcggctttgccccggagatcaatatgaaatctttatgaagtacggtcgtcagcgatggaagctgaagggcaagatcgaggttaatggaaagcagtcatgggacggcgaggaaactgtattccttcctctaatagtgggatttatcagtatcaaagtgaccgaactgaagggcctcgccacccacatcctggtcgggtctgtcacatgcgaaaccaaggaactctttgccgctagacctcaagtagttgccgttgatatcaatgaccttggcactatcaagctcaacctggaaattacatggtacccatttgatgtggaagacatgacagcttctagcggcgcaggcaacaaagccgctgctctgcagcgccgtatgtctatgtacagtcagggcacgccagagacacccacatttaaagatcactcatttttctctaacctccctgacgacatcttcgagaatggaaaagccgcagaggaaaaaatgcctctgtccctcagtttctcagatctcccgaacggagattgcgccctgacaagccattccactggctcaccaagtaacagcacaaatcccgaaattacgattacacccgctgagtttaatttaagttctctggctagccagaatgagggcatggacgatacctcatccgcctccagtcggaacagcctcggcgagggccaggaaccaaagagtcacctgaaagaggaagatcctgaggaaccaaggaaacccgcttcagcacccagtgaggcgtgtcgccgtcagagctctggcgcaggggcagaacacctcttcctggaaaatgacgtcgccgaagccttgctccaggagagtgaagaggcaagcgaactgaagccagtggagctggatacttcggagggaaacatcaccaagcaactcgtgaagcgccttacaagcgcagaggttcccatggctaccgatagattgctgtcggaaggctctgtcggaggcgaatctgagggctgtcgtagttttctcgatggctccctggaagacgcctttaacggattgctgctggcgctggagccccataaggagcagtataaagagtttcaagacctcaaccaagaggtgatgaatctggacgacatcctgaaatgcaagcccgcagtgtcccggtctcggtcgagtagcctaagccttaccgtggaatccgccctggagtctttcgactttttgaacactagcgacttcgacgaggaagaggatggggacgaggtctgcaatgtgggcggaggagccgatagcgtcttttcggatacagaaactgaaaaacattcataccgcagcgtacacccagaggcaagaggccatctgagcgaggcattgaccgaagacacaggggtcgggactagcgtcgctggaagtccactacccctgaccacaggcaacgagtccctagacattaccatagtccggcatctccagtactgcacacagttggtgcaacagatcgtgttctccagcaagacaccctttgtagctcgcagcctcctcgaaaagctgtcgaggcagatccaggtaatggagaaattagctgcggtgagcgacgagaatatcggcaacataagctctgtggtggaagcaatcccagagttccacaagaagcttagtctgctgtcgttttggacaaaatgctgctcgcccgttggcgtttaccacagccctgcagaccgagtgatgaaacaactcgaagcttcattcgccaggactgtgaataaggagtacccgggactggcagatcccgtcttccgaaccctggtgagccagatccttgatagggccgaaccattactgagctcctccttatcgtccgaagtggttaccgtgttccagtactattcttacttcaccagccatggggtgtctgacctggagtcctatctgtcccagctggccaggcaggtcagcatggtgcagaccctccagtccctaagagatgagaaacttctgcagacaatgtccgatctggcgccatcaaacctcctggcccagcaggaagtgctgaggacactggccctgctcctaacaagggaagacaatgaagtatccgaagccgtaaccctgtacctggccgcagcctctaagaaccagcatttccgggaaaaagcgctcctgtattattgtgaggcactgacaaagacaaacctgcaattgcagaaggcggcttgcctggcactgaagatcctggaggcaactgagtctattaagatgctcgtcaccctgtgccaatccgacactgaggagatcagaaacgtggcatctgaaaccctgctctctctgggcgaggatggacggctagcttatgagcagctggataaattcccacgggattgtgtgaaggttggaggccgacacggtacggaagttgccactgcgttctag

SEQ ID NO: 222796 - DNA, 1842 bp, Artificial Sequence
  Description of Artificial Sequence: Synthetic coding sequence
atgttggtaggctcccagtcattctcacccggaggacctaacggcatcattagatctcagtctttcgccggattcagtggcctgcaggaaagaagatcaagatgcaactctttcatagaaaatagctcagccctgaagaaaccccaggcaaaactgaagaagatgcacaatctaggtcacaaaaacaacaatcctcccaaagaaccccagcccaagcgggtcgaggaagtgtacagggccttgaaaaatggtttggatgagtacctggaggtacaccagactgaactcgataaactgaccgctcagctcaaagatatgaaaagaaattccaggctgggagtcctctatgatctcgataagcagattaaaaccatagagcgttatatgcggaggttagagtttcacatttcaaaggtggatgagctctacgaggcttattgcatccagaggagactgcaagatggtgccagcaaaatgaaacaggcgtttgcgacctctcccgctagtaaggcagccagagaatcactaaccgagattaaccggtcgtttaaagagtataccgagaacatgtgcaccatcgaggtcgagttggagaatctgcttggcgaattcagcatcaagatgaagggcctggccggattcgcgagattatgtcccggagaccaatacgagatttttatgaaatacgggaggcaaagatggaagctgaagggcaagatcgaggtgaacgggaagcagtcctgggacggagaagagaccgtcttcctgccgctcattgtgggtttcatttctatcaaagtcaccgaactcaaagggctggcaactcacatcttagtgggatccgttacctgtgaaactaaagagctgttcgcagccaggccccaggtcgtggccgtagatatcaatgacctggggacaataaagctgaacctggagatcacatggtatccattcgatgtggaggacatgacagcgagcagtggagccggtaacaaggccgcagcactgcagagaaggatgagtatgtacagccagggcacacccgagacacctacgtttaaagaccatagcttcttctcaaacctccccgatgacatcttcgagaatggaaaagcggcagaagagaagatgccacttagtctctccttcagcgacctcccaaatggggactgcgccctgaccagccactccacaggcagcccatctaactctaccaatcctgagattaccatcacacccgctgagttcaacctgtcttctctggccagccagaacgagggaatggatgatacaagctcagcttctagcaggaatagtttgggggaggggcaggaacctaaatcacacctcaaggaagaagatccagaagaaccgcgtaagcctgcctccgccccttccgaggcatgcaggcggcagtcatccggtgccggagcagagcacttattccttgaaaacgatgtcgcggaggcactgctgcaggaaagtgaagaggccagcgaactgaagccagttgaactggatacaagtgagggcaacataacaaagcaacttgtcaaaagacttacctccgcagaagtgcccatggcgacagatcgcctgttgtctgagggatcagtgggcggagagtcagagggttgtaggagctttttggatggtagtctcgaggacgcattcaacggattactgctagccctcgagccgcacaaggagcaatacaaggagtttcaggatttaaatcaggaggtgatgaatctggacgacattctaaaggacgccaagcacctggacgaccagaagctaaatggagctgcttcctggacagagatcacggagggagaatag

SEQ ID NO: 222797 - DNA, 2673 bp, Artificial Sequence
  Description of Artificial Sequence: Synthetic coding sequence
atgtccgcaaataactcacccccttcagcccagaagagtgtgctcccaacagccatacccgcagtgctcccagcggcttccccctgctccagtccaaaaacaggactgagcgcccgactttctaacggatccttctctgcacccagtctgactaattcaagagggagtgtccacactgtatctttcctgcttcagatcgggctcacacgagagagtgtcaccatcgaggcccaagagctgtctctttcggctgtgaaggacctcgtctgcagcattgtgtatcagaaatttcccgagtgcggtttcttcggaatgtacgacaagattttgctatttcgccatgacatgaacagtgaaaacatcctgcaactgataacctctgctgatgaaatccacgaaggagacctcgttgaggtggtgctttcagccctggctaccgtagaagactttcaaatccggccacataccctgtacgtccacagctataaagcacccacattttgcgattattgcggggagatgttgtggggtctagtacgacagggactgaaatgcgaagggtgcggccttaattaccataaacggtgtgcattcaaaattccaaataactgcagcggcgtacgcaaacgtcgcctttccaacgtgtccctgcccggacccggtctttcagtccccaggccattgcagcctgaatacgtggccttaccaagcgaagagtctcacgtacaccaggaacccagcaaaaggatcccttcgtggagcgggcgacccatttggatggaaaaaatggtgatgtgccgcgttaaggtccctcataccttcgccgtgcacagctacacacggcctacgatctgccagtactgtaagagactcctcaagggactcttccggcaggggatgcaatgcaaagactgtaagtttaattgtcataagcgttgcgcttctaaggttccccgtgactgcctcggagaagtcactttcaacggcgagccctctagcctggggactgacacagatatcccgatggacatagataacaacgatataaacagtgacagctcacgtggccttgacgataccgaggaacccagcccccctgaagataagatgttctttctggacccctccgatctggacgttgagcgcgacgaggaggctgtaaaaacgatcagtccttccacctctaacaatattcctttgatgagagtggtgcagtctataaagcacacaaaacgaaagtcttccacaatggtgaaagagggctggatggtgcattacacatcgcgggataatctcaggaaacggcactattggcggttggacagcaagtgtttgaccctcttccaaaatgagagcggcagcaaatattacaaggagatccccttgagcgagatactgcggatctcctcccctagagatttcacgaacatttctcaagggtcaaacccccattgtttcgagatcataactgacactatggtgtatttcgtcggggagaataatggcgactcgtcgcataatcccgtccttgcagccaccggggtcggcctggacgtggctcaatcttgggagaaggctatccgtcaggccctcatgccagtaacgcctcaggccagcgtctgcacaagtccgggtcagggaaaagatcacaaggacctcagcacgtctatatcagttagcaactgccaaatccaggaaaatgtcgatatttccactgtatatcagatcttcgccgatgaggtactcggaagcggccaatttggcatcgtctatggcggtaagcaccggaagactggtagagacgtggctatcaaagttatcgacaaaatgagattccccacaaaacaggagtcacagctcagaaacgaagtggctattttacagaatttgcatcaccccggaatcgtgaatcttgaatgtatgtttgagacgcccgagcgcgtctttgtggttatggagaaactacatggagatatgttggaaatgatcttaagctctgaaaagagcagactgcctgagcgtatcaccaaatttatggtgactcaaattttggtggctctcagaaacttgcacttcaaaaatatagttcattgtgatttgaagcctgaaaatgtgcttctggccagcgccgagccgtttccccaggtgaaactctgcgattttggctttgctagaataatcggagaaaaatcattcaggagatctgtcgttggtactcccgcttacctggcacccgaggttctgcgttctaaggggtataatagatctctcgacatgtggagtgtcggcgtgataatctacgtatctctcagtgggacattcccgttcaacgaggatgaggatatcaatgaccagattcagaatgccgctttcatgtacccgcctaacccatggagggaaatctcaggagaagctattgacctcatcaacaatctgcttcaggtgaagatgaggaagaggtactccgtggacaagtcgctatcccatccctggctccaggactatcaaacctggctggatctgcgcgaattcgaaacgagaataggtgagaggtatatcacgcatgagtctgacgatgctaggtgggagatccacgcttacactcataacctggtttatcccaaacacttcattatggcccctaaccctgacgatatggaggaggatccttag

SEQ ID NO: 222798 - DNA, 1233 bp, Artificial Sequence
  Description of Artificial Sequence: Synthetic coding sequence
atgccgtatagcacaaacaaggagttaattctcggcataatggtgggaacagcgggtatttccctgctgctgctatggtatcacaaggttaggaagcccggtatcgcgatgaagcttccggagttcctgagcttagggaatacctttaattccataacactgcaggacgagattcacgacgaccagggcacaacagtcatctttcaggagagacagctgcagatactggaaaagttaaacgagctgctgacaaacatggaagagctgaaggaagagatcaggttcctgaaggaggccattccaaaactggaagaatacattcaggatgaactgggaggtaaaattacagttcacaaaattagtcctcaacaccgagccaggaagcgtcgactgcccaccattcagtcctcggctacctctaattcttctgaagaggctgagagcgagggcggttacatcaccgctaacaccgataccgaagagcagagctttcccgtgccgaaagcttttaacactcgcgtagaggaactcaacctggatgtcctcctgcaaaaagtggaccatcttagaatgtctgaaagcgggaaaagcgagagcttcgagttgctgagagaccacaaggagaaattccgcgacgagatagagttcatgtggaggttcgccagagcatacggcgacatgtacgagctctctacgaacactcaagagaaaaagcactatgccaacatcggcaaaacgctgagtgaacgcgctattaatagagcacctatgaatggacactgtcatctgtggtatgctgtgttgtgtggatacgtgagtgagttcgaaggacttcagaacaaaattaactacggacacctgttcaaagagcatctcgacattgctattaaacttttgcctgaggagcccttcttatactatctcaaaggaaggtactgctacactgtgagtaaattgagttggatcgagaagaaaatggccgcaacactgttcggcaagattcctagctcaaccgtgcaggaggcgctgcacaactttctgaaggcagaagaactttgcccagggtactctaatcccaactatatgtatctggctaaatgctataccgacttagaggagaaccagaatgctctgaaattctgcaatctggccctgctcctgcctactgtgacaaaagaggacaaagaggcgcaaaaggagatgcagaagatcatgacatctctcaagagatag

SEQ ID NO: 222799 - DNA, 1233 bp, Artificial Sequence
  Description of Artificial Sequence: Synthetic coding sequence
atgccatactccacgaataaagaactaattctcggaattatggtagggacggccggaatctcactgcttttactctggtatcacaaggtgaggaaacctgggatcgcgatgaagctgccagaatttctgagcctgggcaatactttcaatagtataacccttcaggacgagatccacgatgaccagggcacaacagtcattttccaagaacgtcagctgcagatactcgagaaactcaatgaattgcttacaaacatggaagagctcaaagaagaaatccggttcctcaaggaggccatcccaaaattagaagagtatattcaggatgagctgggagggaaaatcacagtgcataaaatttcacctcagcatagagccagaaaaagaagactccccactatacagagcagcgcaacctcaaatagtagtgaagaagctgagtccgaaggaggctatatcactgcaaataccgacaccgaggagcagagcttccctgtgcctaaagccttcaacacgagagtggaggagttgaatctggatgtgctgctgcagaaagtggaccatcttagaatgagtgaaagcgggaagagcgagtcctttgaacttttaagagaccataaggaaaaatttagggatgagatcgaattcatgtggcgatttgcacgcgcttacggcgacatgtatgaattaagtactaatacccaggaaaaaaaacactacgcaaacataggcaaaacactgtctgaacgagctatcaatagggcccctatgaatgggcactgccacttgtggtatgccgtcctatgtggctacgtatctgaattcgagggactccaaaataaaatcaactacgggcacctattcaaggaacatctggacatagctataaagctgctccctgaagagccttttctctactacctcaagggtaggtactgctataccgtatccaagctctcgtggatcgagaaaaagatggcagcaacgctatttggtaagatccctagtagcacagtgcaagaggctctccacaacttcctgaaagccgaggaattatgccccggatacagtaacccaaattacatgtacctggccaaatgctatactgacctggaggaaaatcagaacgcactcaagttttgcaacttggccctgctccttcccactgtcacgaaagaggataaggaggcccaaaaggaaatgcagaaaatcatgacatccctgaaacggtag

SEQ ID NO: 222800 - DNA, 528 bp, Artificial Sequence
  Description of Artificial Sequence: Synthetic coding sequence
atgccctacagcactaacaaagagcttatccttgggattatggtggggactgccggaatatctttgctgctgctgtggtatcacaaggtgaggaaacccggaatcgctatgaaactccctgagttcctttccctagggaatacttttaactctataactctacaagatgagatccacgacgaccagggaaccactgttatcttccaggagaggcaactccaaatactcgagaaactcaacgaactgttgacaaatatggaggaattgaaagaagagatcagatttctcaaagaagctattcctaaactggaagaatatattcaagacgaactggggggtaaaataacagtgcacaaaatctcaccacagcatagggccaggaagcgacgactgcctactatacaatccagcgctacttccaattcatctgaggaggccgagagcgagggtggctatatcacagcaaacacagatactgaggaacagagcttccccgtgccaaaagcttttaacacaagggtcgagtag

SEQ ID NO: 222801 - DNA, 798 bp, Artificial Sequence
  Description of Artificial Sequence: Synthetic coding sequence
atgggcaaatgtcttcgctatatcaccgctaacaccgatactgaggaacagagctttcctgtgccaaaggccttcaacacccgggtagaagaactgaacttagatgtcctgcttcagaaagtggatcatctgagaatgtctgagagtggtaagagcgaatcgtttgaactattacgagatcataaggaaaagttcagagatgagattgagttcatgtggcgctttgccagagcttacggcgatatgtatgaactcagcaccaatacacaagagaaaaagcattatgctaacataggaaagaccctgagcgagcgggcaatcaaccgtgcacctatgaatgggcactgccatttatggtacgctgttctttgcggatacgtttctgaatttgagggactccagaataagataaactatggtcacctttttaaggaacacttagatatcgcaattaaactgctgcctgaggaacccttcctgtattatcttaagggcagatactgctatacagttagcaagctgagttggatcgaaaagaaaatggctgctaccttgtttggtaagattcctagttcaacagttcaggaggcactgcacaactttctgaaagcagaagaactctgccccggatattctaatcccaactatatgtatctggcgaagtgttacacagaccttgaggaaaatcagaacgctttgaaattttgcaatctggccctcctgctgccgaccgtgacaaaggaggataaggaagcccagaaagaaatgcagaaaatcatgactagcctgaagaggtag

SEQ ID NO: 222802 - DNA, 453 bp, Artificial Sequence
  Description of Artificial Sequence: Synthetic coding sequence
tgagtgctgtgcgggtacgtgtctgagtttgagggtctgcagaacaagatcaactatgggcacctcttcaaggagcatttggatatcgctatcaaactgctgccagaggaacccttcctctactatttgaaagggagatattgctacactgtcagtaaattgtcatggatcgaaaagaaaatggcagcaacgctcttcgggaaaattccaagctcgacggtgcaggaagccttacacaactttcttaaagcagaagaactgtgcccgggatattctaacccaaactatatgtatctggcaaaatgttacaccgacttggaagagaatcaaaacgccttgaagttctgcaacctggccctccttttgcccaccgtgaccaaagaggataaggaagcccagaaggagatgcagaaaatcatgacttcgctgaaacgcctaagaaaaacaaagtag

SEQ ID NO: 222803 - DNA, 717 bp, Artificial Sequence
  Description of Artificial Sequence: Synthetic coding sequence
atgggtaagtgcttgcgatacatcactgcaaacacggacacagaggagcaatcctttcctgtgccgaaggccttcaacacacgcgtagaggagctgaatctggacgtgttgttgcagaaggtcgaccacttaaggatgtctgaaagcggtaagagcgagagtttcgagttgcttagggatcataaagagaagttcagagacgagatcgaatttatgtggagatttgctcgggcatacggcgatatgtatgagttgagcacgaacacacaggagaagaaacactatgctaacatcggcaaaacattaagtgaacgagcgatcaaccgagccccaatgaatggacactgtcacttatggtatgctgttctgtgtggctacgtctccgagttcgagggacttcagaataaaattaactacggtcacctgtttaaggagcatttggatatcgctataaaacttctgcccgaagagccattcctgtattaccttaagggtagatactgctacacagtctccaagctgtcatggatcgaaaagaaaatggcagcaaccttgttcgggaagattccgtcttccactgttcaggaagctctgcacaacttcctgaaagccgaggaactctgtccaggctacagcaatccaaattacatgtacctggcgaaatgctataccgatcttgaagagaatcaaaacgccctcaaattctgtaacttatag

SEQ ID NO: 222804 - DNA, 1413 bp, Artificial Sequence
  Description of Artificial Sequence: Synthetic coding sequence
atgtcaagacttggggcattgggtggcgcaagagccggactgggcctgctccttggcacggctgccggactgggttttctgtgcctcctgtacagccaacgttggaagaggacgcagcgccacggtcggtctcagagtctccctaacagtctggattacacccagacctccgacccaggccgtcacgtgatgttgttgcgagcggtgcctggtggtgctggcgatgcaagcgtactgcctagtctgccgagggagggtcaggagaaagttttagatcggctggatttcgtgctcacctcactggtggcattgcgaagggaggtggaggagctgcgcagcagcctgaggggactggcgggagaaatcgtcggcgaagtgcggtgccacatggaagaaaatcagagggtcgccaggcggaggaggttcccatttgtccgcgaaagatcagatagtacagggtcctctagcgtgtattttaccgcgtcctcaggggcaacctttactgacgccgagtctgaaggcggatacaccacggctaatgcagaaagcgacaacgagagggactctgacaaagagagcgaagacggcgaagacgaggtgtcctgcgagacggtaaaaatgggtaggaaggactcgttggacctggaggaagaggcagcttccggcgcttcatctgcccttgaggccggtggcagctcaggcctcgaagacgtcttaccactcctgcagcaggcggatgagctccaccggggagatgaacagggaaaacgcgagggatttcagttactgttgaacaacaagttggtctacggttcgagacaggatttcctctggcgcctcgcaagggcttactcagatatgtgcgagctgacagaggaggtgtccgagaaaaagagctacgccctggatggcaaggaggaagccgaggccgcactggagaaaggtgacgagagtgccgattgtcacctatggtatgcagtgttgtgtgggcagcttgctgagcacgagagtatccagagacgcattcagtcgggtttctcgtttaaagagcacgtcgacaaggctatcgccttgcaaccagaaaatccaatggctcactttcttttgggtcgctggtgttatcaggtatcacatctttcttggctagagaaaaagaccgctaccgctcttctcgagagtccgcttagcgccacggtcgaggatgccttacagtcattccttaaagctgaagagcttcagcccggattcagtaaagctggcagggtttacattagtaagtgctatcgagagctgggaaaaaatagcgaggccaggtggtggatgaaattggcacttgagctacccgatgttaccaaagaagacttggctatacagaaagacttggaagagttagaagtgattcttagggattag

SEQ ID NO: 222805 - DNA, 1413 bp, Artificial Sequence
  Description of Artificial Sequence: Synthetic coding sequence
atgtcacgcctaggtgcactgggtggcgcaagggcaggtctggggctgctgcttggtacagccgctggactgggcttcctgtgtcttctctatagccaacggtggaagaggacccaacgccatgggaggagtcagtctctacctaatagcctggactatacccagaccagcgaccccggaagacacgtcatgttgctgcgtgctgtgccaggcggtgccggagatgcctctgtgcttccgtcacttcctcgcgaaggccaggagaaagtcctcgatcgtctggatttcgttctcacatctctggtcgcgctccggcgtgaagttgaagagctgagatcctccctacgcggacttgccggagagattgtgggagaggtgcggtgccatatggaagagaaccagcgcgtcgccaggaggcgcaggttcccatttgtgcgagagaggtctgacagtacagggagctcctcggtgtactttacggcaagcagcggtgcgacctttacggacgccgaaagcgagggcggatacacaaccgccaacgctgagtccgataacgagagggactctgacaaggaatccgaggacggcgaggacgaggtgagctgtgagactgtgaaaatggggaggaaagactcccttgaccttgaggaggaagccgcaagtggggcttcatccgcactggaggcgggaggctcatcaggactggaggatgtattgccactgctgcagcaggcagatgagctgcaccggggagacgagcagggcaaacgtgaggggtttcagctgctgctcaataacaagctggtgtatggctccaggcaggacttcctttggaggttggcaagggcttactccgatatgtgtgagttgacggaagaggtctccgaaaagaagagttacgccctcgatggtaaggaagaggctgaggctgctttggagaagggcgacgagagcgccgattgtcacctttggtatgcagttctgtgcggacagctggccgagcacgagtccatccagcgacgcattcaaagcggattctcgttcaaggagcacgtagataaggccattgcccttcagcccgaaaatcctatggcccactttctccttggtcgatggtgttaccaggtaagccatctaagctggctggaaaaaaaaactgcaaccgccctactggaaagcccattgtcagcgacagtggaggatgcgctgcaatcattcctgaaggccgaagaactgcagcctggtttttcgaaagcaggaagggtgtatataagcaagtgctaccgagaactcggtaagaactcagaggcccgttggtggatgaaactcgcgctggaactgcccgacgtcactaaggaggacttagcaatccagaaggacctcgaggaactcgaggttatcctgagggactag

SEQ ID NO: 222806 - DNA, 1224 bp, Artificial Sequence
  Description of Artificial Sequence: Synthetic coding sequence
atgttgctccgcgctgttcctgggggtgctggcgatgcctcggtgcttcccagcctgcctcgggaaggtcaggagaaggttctggatagactcgatttcgtactgaccagtctggttgctcttcggagagaggtggaagagctaaggtccagcctccggggactcgctggtgaaatcgttggagaggtgcggtgccatatggaggagaatcagcgggtggctagaaggcggaggtttccgtttgtgcgtgagaggagcgattctactggatcatcaagcgtatatttcacagcctcatctggtgcaacctttaccgatgccgaaagcgagggtggctataccacggctaatgctgaatccgacaacgaacgggactctgacaaggagagcgaggacggggaagacgaggtgtcatgtgagacagttaaaatgggcaggaaagactctttggacttagaggaggaggccgctagtggcgcttcaagcgcactcgaagctggtggctcttctggcctggaggacgtgctgccactgttgcagcaagccgatgaacttcaccgcggtgatgaacagggtaaaagggaaggcttccagcttctactcaacaataagctggtgtatgggagtaggcaagatttcctgtggcgcttggcgagagcgtacagcgacatgtgtgagctcacagaggaggtgtccgaaaaaaagtcgtacgctctggacggtaaggaagaggcggaagccgcactcgagaaaggtgatgaatccgccgactgtcacctttggtatgctgtgctgtgtggccaacttgctgagcatgagagcatccagagacggattcagagtggtttcagttttaaagagcacgtcgacaaagccattgccttgcaaccggagaatcctatggctcatttcctactagggcgatggtgctaccaggtctcacacttgtcttggttggagaagaaaaccgcaaccgctctcttggagagtccgttgagtgctactgtcgaggacgccctgcagagcttcttgaaggccgaagagctgcagcctgggtttagtaaagctggccgtgtatacatcagcaagtgctacagggaacttggcaaaaacagcgaagcgaggtggtggatgaagctggcacttgagctgccggacgtgacaaaggaagacctggccattcagaaagacctggaagagctggaagtcatcctccgagactag

SEQ ID NO: 222807 - DNA, 864 bp, Artificial Sequence
  Description of Artificial Sequence: Synthetic coding sequence
atgagtaggctgggcgctttaggcggagcccgagctggcctggggctgcttctgggcactgctgctgggctgggctttctgtgcctcttatattcccagaggtggaaaaggactcaacgacacggacgatcccagtccctccccaactcactcgactacacacaaacatctgatcctgggagacatgtcatgctgttaagggcggtccccggaggtgctggtgacgcaagtgtgttgccctctctacccagggaagggcaggagaaagtgctggaccggctggacttcgtgctaaccagcttagtcgctctgagacgtgaggtggaggagctgaggtctagcctgagagggctcgctggggaaatcgtcggcgaggtacgctgccacatggaggagaaccagagggtcgcccgtcgcaggcgcttccccttcgtgcgcgagcggtctgattccacaggctcttcatcagtgtacttcaccgcatcctccggggcaacgttcaccgacgctgagtctgagggcggttacacaacagccaatgccgagtcagataacgaaagagatagtgataaagagtcagaggacggcgaggatgaggtatcatgtgagacggtcaaaatgggtcggaaggattccctcgatctggaagaggaggcagcctccggagcatcaagcgcattagaagctggaggaagttctggcttagaagatgtgctgcccctgcttcagcaagccgatgagttacatcgaggagatgagcaagggaaacgcgaagggttccagctgctgctgaataacaagcttgtttatggctcccggcaggactttctgtggcgattggcacgggcttatagtgatatgtag

SEQ ID NO: 222808 - DNA, 945 bp, Artificial Sequence
  Description of Artificial Sequence: Synthetic coding sequence
atggcactggccgcaaggctctggcgcttactacccttccgtcgaggagcagcccctggctcaagattgcccgctggcactagcgggagcaggggccattgcggcccttgtagattcaggggttttgaggtcatgggcaaccccggaactttcaagcgcggactgctgctctcggcactgagctatctcggctttgagacctaccaggtgatctcccaagccgcagtggtgcatgcaacagcaaaagtggaagagatcctggaacaggctgattatctgtacgaatcgggagagaccgagaagctgtaccagctgctgacccagtataaggaaagtgaggacgctgaattactctggcggctcgccagagcttctagggatgtcgctcagctcagccgaacgtcagaggaggagaagaagctcttggtctacgaagccttagagtacgccaagagggctctagagaaaaacgaatctagctttgcttcgcacaagtggtacgccatttgcctgagtgatgtgggagactacgaagggataaaggccaagatagcaaacgcctacattatcaaggagcacttcgagaaagcgatagagctcaaccccaaagacgcaactagcattcatctcatggggatctggtgctacacattcgctgaaatgccatggtaccagcgaagaatcgccaaaatgttattcgccacccccccttcatccacctatgagaaggcactggggtattttcaccgggctgagcaggtcgacccaaacttttatagtaagaatctgctcttgttgggaaaaacatatcttaaactgcataataaaaaactagcagcattctggctgatgaaagctaaagattaccctgcccacaccgaggaagataagcaaattcaaacggaggccgcacaactcctaacttcttttagtgaaaaaaattag

SEQ ID NO: 222809 - DNA, 855 bp, Artificial Sequence
  Description of Artificial Sequence: Synthetic coding sequence
atggctctcgccgcaagactgtggcgtctgctgccttttaggcgcggagccgctcctggcagcaggctgccagcgggaacatctggctcacgcggacattgcggcccttgcaggtttcggggattcgaagtgatgggcaatcctggtactttcaaacgcggactcctgttatccgctctgagttacctgggctttgaaacataccaggtgatcagccaagcagctgtggtccatgcaacagccaaagtggaggagattctggagcaggcagattacctgtatgagtcaggcgagacagagaagctctaccagctgctcactcagtacaaagaatccgaggatgccgaacttctgtggagattggcgagggctagtcgggacgtggcccaactatctagaaccagcgaagaggaaaagaaactcttggtatacgaggctcttgaatacgcaaaacgggctctggagaagaatgaaagcagcttcgcaagccataagaaggccatagaactgaacccaaaggatgctacatctatccacttaatggggatctggtgttacaccttcgcggaaatgccctggtaccagcgtcgtatcgctaaaatgctgttcgccacgcccccaagctccacttatgagaaggccctgggttatttccatcgggctgagcaggttgaccctaacttctacagcaaaaacctcttactgctcggaaaaacttaccttaagctgcataataagaaattggccgctttctggctgatgaaggctaaagactaccctgcacacactgaggaggataagcagatccagacagaggctgctcagctgctcacatctttcagcgagaaaaactag

SEQ ID NO: 222810 - DNA, 3540 bp, Artificial Sequence
  Description of Artificial Sequence: Synthetic coding sequence
atggcgagaaggagccagtccagttcccagggagacaatccccttgcacccggttacttgcctccgcactacaaggaatattatcgcctggctgtcgacgcactggctgaagggggtagtgaagcgtactcacggtttttggcgacggagggagcgcctgacttcctatgccctgaggagttagagcatgtttctcggcacctgagaccaccgcagtatgtgactagggagccccctgaaggctctctgctggacgttgacatggacgggtcctccggaacttactggccggtcaattcagatcaggcggttccagagctggacctggggtggccattaacctttggattccaggggaccgaagtgacaacacttgtgcagccgcctccacccgacagtccaagtatcaaagatgaggcacggcgtatgatcagatccgctcagcaggtggtggctgtagtcatggatatgtttaccgacgtggacctgctgagcgaggtcttggaggcggcagctcggagggtgcctgtctatatactcctcgatgagatgaatgcacagcatttcctggacatggccgacaagtgcagagtgaatctgcagcacgtggacttcctgagagtgagaacggtagccggacccacttactattgcaggacgggaaagtcatttaagggccacgtcaaggaaaagtttctgctagtggattgcgcggtcgtcatgagcggatcttatagttttatgtggagtttcgaaaagattcatagatctctcgctcatgtcttccaaggggagctggtcagcagcttcgacgaagaattccgcattctcttcgcccagtcagagcctctggtccccagcgccgcagcactagccagaatggacgcatacgctctggccccatacgcgggagcgggtcccctggttggtgtaccaggggtgggcgctcctacacctttttcattccccaaaagggctcatcttctgttccccccacctcgcgaggaaggactcgggttccctagctttcttgaccctgatagacatttcctctctgccttcagaagggaagagcccccacgcatgccgggaggagccttggaaccccacgccggtctgcggcctctttctcgcagactggaggccgaggcaggtcccgcaggagagctggccggtgcccgtgggttttttcaggctcgccatttggagatggacgcattcaagcggcatagcttcgcaacagagggggcaggcgctgtggagaactttgctgccgcaaggcaggtgtcccggcagaccttcctgtcccacggcgacgatttcagattccagaccagccattttcacagggaccaactttatcagcagcagtaccagtgggatccgcagctgaccccagccagaccccagggacttttcgagaagctccgcggagggagagccggttttgccgatccggacgacttcacgctaggcgctggcccacgctttccggaactgggcccagatggacaccagaggctagactacgtcccatcgtccgcctcccgggaggtgagacacggttctgacccagcctttgcccctggacctcggggactggagccatcaggagccccacgcccaaatctgactcagcgatttccatgccaagccgctgccagacctggccctgaccccgctcccgaagcagagcctgagcgcagagggggacctgagggaagagcaggactgagacgctggcggctcgcctcatacttgagcggatgccatggtgaggatggcggtgatgatggcctgccagcacccatggaggcggaagcatatgaagatgatgtcctggcacccggtggcagggccccagctggtgatcttctcccttccgcctttcgagtcccagcggcatttccaacaaaggtccctgttcctggcccagggtcaggcggaaatggccctgagcgggaaggacctgaagagcctggtctcgctaagcaagacagctttaggagtagattaaaccccctagtacagcgctcctcccggctgaggtcgtccctcatttttagcacaagccaagctgaaggggctgccggagcggctgccgcaacagagaaggtgcagctgctccataaagaacagactgtgtcagaaaccctggggccaggcggagaagccgtgcgatccgccgcttctacgaaagtcgctgagctccttgagaagtacaagggcccagcacgagaccctggtggcggagctggggctatcactgtggcaagccacagcaaggcagtggtgtcacaagcttggcgagaggaggtcgccgcacctggtgccgtgggaggagaacgacgcagtttggagtcttgcctgctggatctgcgagacagtttcgcccagcaactacaccaagaagcagaaaggcaacctggggcagcctctctcaccgcggctcaactcctggataccttgggtcgcagcgggtcggatcgacttcccagtagatttctctccgcacagtctcattcaacgagccctcagggtctcgatagtccactgcctctggaaggatctggcgcacatcaggttctccataatgagagtaagggcagccccacgagtgcctatcctgagagaaaaggtagtcctactccagggtttagcactcgcagaggctcccccactaccggcttcatagagcagaaaggcagtccaacctcggcctatcccgaaagacgtggttctccggtgccccctgtccccgagcgcagaagctcccctgtcccacctgttcccgagagacggggatccctcaccttaactatctccggggagagtcccaaagcaggtcctgccgaggagggaccatccgggccaatggaagtgcttcgaaaaggtagtctccgcctgcggcagctcctgagtcctaagggggaacgcagaatggaggacgaaggtggatttcccgtgccgcaggagaatgggcagcccgaatctccaagacgtctgtctttgggacagggagactccacagaggctgcgaccgaggaacggggtccacgtgcacggttgtcttctgctaccgccaatgctctgtactcttcaaacctgagagatgacactaaggccattcttgagcaaattagtgctcatggccagaagcatcgggctgttcccgcaccctctcccggacccacacacaacagtcccgagctggggagaccaccagccgctggggtgctggccccagacatgtccgataaggataaatgcagtgccatcttcagaagtgatagtttagggactcagggaagactcagcaggacgctgcctgcaagcgccgaggagcgcgaccgcctgcttcgtcgcatggagtctatgcgaaaagaaaagagagtttattctcgcttcgaagtgttttgtaagaaggaggaggccagtagtcctggcgctggcgaggggccagctgaagaaggaactcgggacagtaaggtggggaaattcgtccccaaaattttgggaaccttcaaaagcaagaagtag

SEQ ID NO: 222811 - DNA, 933 bp, Artificial Sequence
  Description of Artificial Sequence: Synthetic coding sequence
atggggaaccaggtcgagaagctgacacatctgagttacaaggaggtacccacagccgatcctaccggagtggacagagacgacgggccaaggatcggcgtatcctacatttttagcaacgatgacgaagatgtggagccccagcctccccctcagggcccagatggtgggggactgcccgacggtggagacggcccacctccgcctcagcctcagccttacgatcctcggttacacgaggttgaatgctctgtattttaccgggacgaatgtatttaccagaagtcattcgccccagggtccgccgctctgtctacttacacccccgaaaatctcctgaacaaatgcaagcctggcgatctggtggaatttgtcagccaggctcaataccctcactgggcagtgtacgtgggcaactttcaggttgtgcatcttcatcgactggaggtgatcaactctttccttacggacgcttctcaggggcgtagaggccgagttgtgaacgatctatatagatacaaaccgttgagctcgtctgctgtggttcgcaacgcattggctcacgtcggcgcaaaggaaagggaattgtcctggcgaaactctgaatccttcgctgcttggtgccgctacggtaaaagagagttcaaaataggaggagagttaaggatcggtaaacagccatatcgtctgcagattcaactgtctgctcagaggagccacactctggaattccaatctctggaagatcttattatggagaagcggcgaaatgatcagataggccgagccgcagtcctacaggaacttgcaacccatctccaccctgccgagcccgaggaaggcgacagtaacgtggccagaactacaccacccccaggccgtccccctgcacccagctctgaagaggaggacggcgaggccgtggcccactag

SEQ ID NO: 222812 - DNA, 999 bp, Artificial Sequence
  Description of Artificial Sequence: Synthetic coding sequence
atggaacctgtgggccgaaagcgcagtcgtaaggctgctaaagcgcaactcgaggctcaggtaactgccgctcagggggctaccaaggagggatctggaatcgcctcaaacttccctgggcagcccactatggagcctgttggccgaaaacgtagccggaaggccgctaaagcccaattggaagctcaggtgagggctgctcctgccaagaagcataccggaaaggacccagtgcgggatgagtgcgaagaacgcaatcccttcactgagactcgcgaggaagatgttactgatgagcacggagagagagaaccattcgccgagaaggacgagcacactggtatccacactatgaaactggagcatattgctgctgacatcaagaaaggtctcgctgcaaagagagaaatgataaagatcgacaaagcggcttataggaagaccaaaaacacaatcgagagggcccttaagaaaaaacaactgaaaagacagaagagggactaccgccatactagaaagttattaaacgttctgaaagaatacatcgctgagaaacagaaagacgatgaggccgaggaagctgaagctgccgctgctgccgcagaggctgctgctgcagccgaagctgcagctgccgctgctgaggtcatagttgtggaggacgaagaagaggaggagaaggaggaggaggaagaaaaggaagaggaagaagaggagggagaagaagaaggagggggtgaggagggagaggagggtggcggaggtggagagggagaggaaaccgaggaggaagaggaagaggaagaagaagaagaagaggaggagcagataaaggcatttcaggagaaacagaaaagatggcagcagcccacaggagtgcggtcctggagattgcgggaaatgaaacccttgttggaacagttgctcaaagccgctaaagacaccaaagacaactattgcatcatctcttctagcgaggaatcagaattggacaattag

SEQ ID NO: 222813 - DNA, 999 bp, Artificial Sequence
  Description of Artificial Sequence: Synthetic coding sequence
atggaaccggtcggacggaagcggagtcggaaagcagctaaggcgcagctggaagcccaggtgaccgctgcccagggggctaccaaagaggggagtggcatcgcctccaattttcctggccaacctactatggagccagtaggaagaaagaggagccggaaagccgctaaagctcaactcgaagcccaggtgagggccgctcccgctaaaaaacatactgggaaagaccccgttagagacgagtgtgaggagcggaaccccttcaccgaaactagagaggaggatgtaacggatgaacacggagagcgcgaacctttcgcagagaaggacgagcacaccggcatccatactatgaagctggagcatatcgcggctgatatcaaaaaggggctggctgccaagagggagatgatcaagattgataaagcagcatatcgtaagacaaaaaatacgattgaacgcgctctaaagaaaaaacagctgaaacgacaaaagcgtgactatcgccatacacggaagcttctgaacgttttgaaggaatacattgcagagaagcagaaagatgacgaggccgaagaagctgaagccgctgccgcagcagctgaggctgcagccgcagcagaagcggcagcggctgccgcagaagtgattgtggtagaggatgaagaagaagaggagaaggaggaggaggaggaaaaggaggaggaagaggaggagggcgaagaagagggcggaggtgaagagggtgaagaaggagggggaggcggagagggcgaggaaactgaagaggaggaggaagaggaggaagaagaggaggaggaggagcagatcaaggcattccaagagaagcagaagcgttggcagcagcccacaggggtccgttcttggcggctgcgcgagatgaagccactgctagagcaactgctcaaagcagccaaagacacaaaagataactattgcattatctcttcctctgaggaaagcgagttggataactag

SEQ ID NO: 222814 - DNA, 561 bp, Artificial Sequence
  Description of Artificial Sequence: Synthetic coding sequence
atggcagcttggggcaagaaacacgctgggaaggaccctgtaagggatgagtgcgaggaacggaacagattcacggagacccgcgaagaagatgtaaccgatgagcacggcgaacgggaaccctttgcagaaactgacgagcatacaggtgctaatactaagaagcctgaagacacagctgaggacctcaccgcaaagcggaagcggatgaagatggacaagacttgctcaaagactaagaacaagagtaagcacgctctgcgcaagaagcaactgaagcggcaaaaacgggactatatacatagcctgaagctcctaaacgtgctagaggagtacatcaccgacgagcagaaagaggaggaagaggaggaaggggaggaagaggaactgattagaatttttcaggaacagcagaagaaatggcagcagtaccgatcagtacgacgtgagaggctgaaggaaatgaaattattgcgggatcaatttgtaaaggcgctggaggattttgaagacctctgtgaccgggtgttttctgatgaggacagcgaactggacaactag

SEQ ID NO: 222815 - DNA, 681 bp, Artificial Sequence
  Description of Artificial Sequence: Synthetic coding sequence
atgccgggtttcctcagtttcctgtcagtctctctccgatcccccggatccggaatagccagtagctttcccggtcaacctgctaccgatccggttggtcgccgagcggctaaagcacagctggaggcgcagtttatggccgcatggggaaaaaaacacgccggtaaagatcctgtgagagatgaatgtgaggagcgcaaccgcttcaccgagactcgggaggaggatgtgactgacgagcacggtgagagggagcctttcgctgagaccgatgagcacaccggggctaacaccaagaaacccgaggatacagctgtgggggctaacaatttcaagaattaccccgtacacatcggggtgagttccgagcagcatatcctgctggactgttctctttcacggcagaaacgcgattacatccattctctgaaactcctgaatgtcctcgaggagtacattactgatgagcagaaggaggaggaggaggaggagggcgaggaggaggagttgatcaggatattccaggaacaacagaagaaatggcagcagtaccgctccgtgagaagagagcggctgaaggaaatgaagttactgcgagatcagtttgtgaaggcactggaggatttcgaggatctctgtgatagagttttttccgatgaagatagtgaactcgacaattag

SEQ ID NO: 222816 - DNA, 561 bp, Artificial Sequence
  Description of Artificial Sequence: Synthetic coding sequence
atggccgcatggggcaagaagcacgccggaaaagatccagtcagagacgagtgcgaggagcgcaatagatttaccgaaacaagggaggaggacgtcacggatgagcacggcgagcgggaacccttcgccgaaacagatgaacacaccggagccaacactaagaaaccagaagacacggctgaggacttgaccgccaaacgaaagcggatgaaaatggacaaaacctgttctaagacaaagaacaagtcgaagcatgccttgagaaaaaagcagctgaagaggcaaaagcgcgattatatacatagcctgaaactgcttaacgtcctggaggagtacattacagacgaacaaaaagaagaagaggaggaggagggggaagaagaagagctgatcagaatcttccaggagcagcaaaaaaagtggcagcagtatcgctccgttcgaagggaacggctgaaagagatgaaattactgcgggatcagttcgttaaagctttagaagattttgaagatctgtgcgaccgggtttttagcgacgaagacagtgagctggataactag

SEQ ID NO: 222817 - DNA, 501 bp, Artificial Sequence
  Description of Artificial Sequence: Synthetic coding sequence
atggcagcaaaggaccagctggaggtacaagttatggccgctcaagagatggagcttgcaggcaaagaccctgtgagtcacgagcacgaggagcgtaagcccgtgactgaaaccaaggagggagacgtgacagacgagcatggcgaacggggttcctttgctgagaccgacgaacacacaggcgtcgacaccaaagaactcgaggatatcgcagctgacataaaggagcacctggccgctaagagaaaaaggattgaaaagatagccaaggcctgctccgagataaaaaaccgcataaagaacgttctcaggaccacacagcttaagcgccagaaacgggactatcggataagcctaaagctcccaaacgttctcgaagagttcatcactgatgaacagaaggacgaagagggggacggcgagaaggaggaacagatcaagattttccaggaacagcagaaacgctggcagcaagatggaaaaggtactgaaagggattag

SEQ ID NO: 222818 - DNA, 501 bp, Artificial Sequence
  Description of Artificial Sequence: Synthetic coding sequence
atggccgctaaagatcagctggaagtacaagtcatggctgcccaggagatggaactggcaggaaaggaccccgtctctcacgagcatgaggagcgtaagccagtcaccgagacaaaggaaggtgatgtgacggatgagcacggagaaagaggaagttttgccgagaccgacgaacacaccggcgtggacacaaaggaactggaagatatcgctgccgacatcaaagaacatctcgccgcaaagcgtaaaaggattgaaaaaattgctaaggcatgctctgagattaaaaaccgtatcaagaacgtgctgcggaccacccagctcaaacggcaaaaaagggactatcggatatctcttaagctccccaatgtgctggaagagttcataacagatgaacagaaagatgaggaaggcgacggagaaaaggaagagcaaataaaaatttttcaggaacaacagaaacggtggcagcaggatggaaaaggcaccgagcgcgactag

SEQ ID NO: 222819 - DNA, 381 bp, Artificial Sequence
  Description of Artificial Sequence: Synthetic coding sequence
taggacgtcaccgacgaacacggggaacgcggtagtttcgctgagacggacgagcacacaggggtggatacaaaggaattagaggatatcgccgctgatataaaggagcatttggctgccaaacgcaagagaattgagaagatcgccaaagcttgcagcgaaataaaaaaccgcattaagaacgtgcttcgaacaacacagctgaaacggcagaagagggattaccggatttcacttaagttaccaaacgtgttggaggaattcattaccgacgaacagaaggatgaggagggcgacggcgaaaaggaggagcaaatcaaaattttccaagagcagcagaaacgatggcagcaagacggcaaaggcactgagcgcgactag

SEQ ID NO: 222820 - DNA, 387 bp, Artificial Sequence
  Description of Artificial Sequence: Synthetic coding sequence
atggcggcaaaagaccagcttgaagttcaagtcatggcagctcaggagatggaactggctggcaaggaccccgtgtcacacgagcatgaggagcggaagcccgtcactgaaacgaaggagggcgacgtcaccgatgagcatggcgagcgcggaagctttgctgaaactgatgagcacaccggggttgacacaaaggagttggaggacatagctggaatgttctacgagttgttcgtggtgtatgagaactgctttcaaccatacaacccttactccaggttgtacgaactggtcgacgacaaaacagtccttaacgccttctttagctatatagcatttaacgtgatttgtcttattatctttctgacctatttcttcaattgctag

SEQ ID NO: 222821 - DNA, 1395 bp, Artificial Sequence
  Description of Artificial Sequence: Synthetic coding sequence
atgatggcacggagagacccaaagccaggggctaagcgcttggtccgagcccagacgctccaaaagcaaaggagggctccggtgggccctcgagccccacctcccgatgaggaggatccacggctcaaatgcaagaactgcgaggcctttggccataccgctcgcagtacacgctgccccatgaaatgttggaaagcagccctggttcccccaaacttcggtgagaaagaaggcaaggagaacctcaagccctggaagccacaggttgaagccaacccgggacccttaaacaaagataagggggagaaagaagaaagaccacggcctcaggacccacagaggaaggccctgctccacatattttcgcgaaagcctccagagaagccactgcccaaccagaagggttccactgagagttctgactacttacgtgtcgcttcagggcctatgcctgtgcacaccacctccaagcgtccccgagtcgacccggttctgtccgaccggagtgctacagagatgagcgaccgcggttctgtgctggcatctctgtccccgctgcgcaaggcttccttgagttcatctagtagcctcggacctaaagagaggcagaccggggctgcagctgatatcccacagaccgctgtgaggcaccagggccctgaaccgctgttggtggtaaagcccacacacagctccccagctggaggctgtcgtgaagtcccacaggcggcaagtaagacccatgggctcctgcaggctgtcagtccacaagcacaggacaagaggccagcagtcacatcgcagccatgcccccctgctgccacccatagtctgggcctgggcagtaatctctcttttggccctggagctaagcggtcagctccagcacctatacaggcgtgccttaattttccaaaaaagcctaggttgggacccttccagataccagagtctgcaattcagggcggagaacttggcgctcccgaaaacctgcagccacctcctgccgcaactgagctggggccaaggacctcgccccagacaggcactcggacccccgctcaagtgcttagtggtgatcggcagccgccacattccagaccttgtctgcccaccgcgcaggcttgcacgatgtcgcaccatcccgcagcatcccacgacggggcacagccactccgagtgctgttcagaagattagaaaacggccgatggtccagcagtcttcttactgccccaagctttcacagtcccgagaaacctggagcttttctggcacagtccccccacgtgtccgagaaaagtgagggtccttgcgtcagggtcccccctagtgttctttatgaggatctgcaggttccatcaagttctgaagatagtgattcagacttggaatag

SEQ ID NO: 222822 - DNA, 45 bp, Artificial Sequence
  Description of Artificial Sequence: Synthetic coding sequence
atgatggcgagaagagatccgaagccaggcgctaagagactttag

SEQ ID NO: 222823 - DNA, 1395 bp, Artificial Sequence
  Description of Artificial Sequence: Synthetic coding sequence
atgatggcaaggagggatcctaagcccggagctaagaggctagtgcgcgctcaaacactacagaaacagcggcgagcgcctgtcgggcctcgggctcctccaccggatgaggaagatcctagactgaaatgtaagaactgcgaagcctttggccacacagctcggagtacccgatgccccatgaaatgctggaaagctgccttggtccctcccaactttggcgagaaagaggggaaggagaacttaaaaccctggaagccgcaagtggaggcgaatccaggcccactgaataaggataaaggagaaaaagaggaacgacccaggccacaggacccccaaaggaaggccctgctccatattttttcacggaagccaccggagaagcctctgcccaatcagaagggcagcacggagagcagtgactatttacgcgttgctagtgggcctatgccagtccatacgaccagtaagcggccaagggtggatccagtactgagcgacaggagtgcaactgagatgagcgatagaggaagcgtgttagcaagtctgtcccctctgaggaaggcctctctctccagtagctcaagcttaggtcctaaggagcggcagactggcgctgccgctgatattccccagaccgccgtgaggcatcaggggcctgagccgctgctagtcgttaaaccaacacactccagcccagcaggaggatgcagggaagtgccacaggccgcttcaaagacacatggccttctgcaggctgtcagcccgcaggcacaagacaagcggccagcggtgacatcccagccatgtcctcctgctgcaactcacagcctcggtctgggatccaacctatcatttggccctggggcaaaacgctcagcgccagcccctatccaggcctgcctgaattttcccaagaagccccgactggggccatttcagattcccgagtctgctatacagggtggagagctgggggcacctgagaatctgcagccccctcctgcagcgacagaattggggccacgtaccagcccgcagaccggtacgcggactccagcccaagtgctgtctggagaccgccagccaccccacagtcgtccctgcctgcctacagcgcaggcctgcacaatgtctcatcacccagccgcatcgcatgacggtgcacaacctctcagggtgctgtttcggcgattagagaacgggagatggtccagcagcctacttacggccccaagcttccattccccagagaagcctggggcttttctggcccagtccccacatgtctctgaaaagtccgaaggtccgtgtgtacgcgtccccccttctgtgctgtacgaggacctgcaggttcccagctcctccgaagattctgactccgacctggaatag

SEQ ID NO: 222824 - DNA, 1143 bp, Artificial Sequence
  Description of Artificial Sequence: Synthetic coding sequence
atggctgtaactgaggccagcttacttagacagtgccctttgttgttgccacaaaatagatcaaagaccgtctatgagggttttatctccgcccagggccgtgactttcatctcaggatcgtccttccagaggatttgcagctcaaaaacgccaggctcctctgctcttggcagttgcggacaatcctctctgggtaccacagaatagtgcaacagcggatgcagcacagccctgatttaatgtctttcatgatggagcttaagatgctgttggaggtagccctcaaaaataggcaggaattgtatgcccttcccccaccgccacagttttattcatccctcatcgaggagatcggaaccctgggatgggacaagctggtgtatgcagatacatgtttcagcacaatcaagttaaaggccgaagacgcaagtggcagagagcacctgattactctcaagcttaaggctaagtatcccgctgaatcccctgattatttcgtagactttcctgtacctttctgtgcctcctggacaccccaagtgaattcacctcagtcatctctcattagtatttactcccaattcttggctgcgattgagagtctcaaggcattctgggatgtgatggatgagattgatgagaaaacttgggtgctagagccggaaaagcctcctcgcagtgccactgcccgaagaattgcactgggcaataatgtatctatcaatattgaggtcgatccgaggcatcctactatgctgccagaatgcttctttctcggggctgatcacgtggtgaagccattagggatcaagttatccagaaatatccacctttgggatcccgaaaattctgtgctgcaaaacctgaaagacgtactagaaattgatttccctgccagggctattctggagaaaagcgatttcaccatggactgcggaatttgttatgcatatcagctcgatggcaccatacccgaccaggtgtgtgacaattctcagtgtggccagccgtttcatcaaatctgcctgtacgaatggctcagagggctgttaacctctagacagtcgtttaatatcatcttcggagaatgtccctattgttcaaagcctattactctgaaaatgtcagggagaaagcattag

SEQ ID NO: 222825 - DNA, 2580 bp, Artificial Sequence
  Description of Artificial Sequence: Synthetic coding sequence
atgacgagcaagcaggcaatgtcttccaacgaacaagagcgtctgttatgctacaatggggaggtactcgtcttccagctgtccaagggaaacttcgccgataaagaaccaaccaaaacccctatccttcatgttaggaggatggtgtttgacaggggcaccaaggttttcgtccaaaagagcacagggttttttacaatcaaagaagaaaacagtcatttgaaaatcatgtgttgcaattgtgtgtccgacttccgtactggtattaatttgccttacatcgttattgaaaagaataagaaaaataatgtatttgaatactttctgctcattctccacagcacgaataagtttgagatgcggctcagtttcaagctcggctacgagatgaaggatggtcttcgagtgttaaacggacctttaattctttggcgacacgttaaagccttcttctttattagctcccaaacaggaaaagttgttagtgtcagtgggaacttcagctctatccaatgggctggagagattgagaatttggggatggtgctactggggctaaaggaatgctgcctgtctgaggaggagtgcactcaggaaccaagtaaatccgattacgcaatctggaacacgaagttttgtgtgtattcactggagtctcaggaagtgctgagcgatatctatataattcctcccgcatactcttctgtagtaacctacgtacacatctgtgcaaccgagataatcaagaaccaactgagaatttcactgattgccctgaccagaaagaaccagctcatttctttccaaaacgggacgcctaagaatgtctgtcaactcccctttggagatccatgcgcagtgcagcttatggatagtggcggtggaaatttgttttttgttgtcagtttcattagcaataatgcatgcgcggtgtggaaagaatccttccaggtcgcagctaaatgggagaagttgtccctggtgctcattgacgacttcatcggctctggcactgagcaggtcttactgctgtttaaggatagcctgaattctgactgcctgaccagttttaaaattactgatcttggcaaaatcaactatagttccgaaccttctgactgcaacgaggatgacctcttcgaggacaagcaggaaaacaggtatttagtagttccgcctctcgagaccgggctcaaggtatgcttcagttccttcagagaactaagacagcacctactcctcaaggagaaaattattagcaaatcttataaggctctgatcaacctggtgcagggtaaggatgataacacttcgtcagctgaggaaaaggagtgtctggtgccgttgtgtggcgaagaggaaaatagcgtccatatcctggacgaaaaactttccgataactttcaagatagtgagcaactggtggagaagatttggtatcgcgtgatagatgattctctggtcgtgggagtgaaaactacttcgtcactcaagctcagcctgaacgatgtgaccttatccctgttaatggatcaggctcatgactccaggtttagactgctgaaatgtcagaaccgtgtgataaagctctccactaacccttttcccgcaccttacctcatgccttgcgagattggtttggaggccaagagagtcacacttaccccagattctaaaaaagaggagtcctttgtgtgtgagcatccgagcaagaaagagtgcgtccagattatcactgcggtgacaagcctgtcccctttgttaaccttttccaaattttgctgcactgtgttactgcaaatcatggagagggagtccggcaattgtccgaaagaccgctacgtcgtgtgtggcagagtctttctgtccctggaagacttatctactggcaaatacctgttgacgtttcccaaaaagaagccaatcgagcacatggaagaccttttcgctctgctcgcagctttccacaaaagttgtttccagattacaagcccagggtatgctctgaacagcatgaaggtctggctacttgagcacatgaagtgcgagatcatcaaagaattccccgaggtatatttctgtgaacggccaggctccttttacgggacactgtttacctggaaacaacgaactccctttgaaggaatcctcatcatctactctcggaaccagacagttatgttccaatgcctgcataacttaatacggattctgcccatcaactgtttccttaaaaatctcaaatctgggagtgaaaacttccttattgataacatggctttcacacttgaaaaggagctggtcacgctctccagtcttagcagtgccatagctaaacacgaaagcaatttcatgcagcggtgtgaggtgagtaagggaaagtccagcgtggtcgctgcagctctcagtgatcggcgtgaaaatatccatccatacaggaaggaattacagcgggaaaaaaaaaagatgctgcagaccaatttgaaagttagtggcgcactgtatagagagattactctgaaggtggccgaggtgcagcttaagtccgactttgccgcacagaagctgagcaacctgtag

SEQ ID NO: 222826 - DNA, 2580 bp, Artificial Sequence
  Description of Artificial Sequence: Synthetic coding sequence
atgacaagcaagcaggccatgtcgagcaatgagcaggaaagactgctgtgctataacggtgaggtcctggtattccagctctctaagggaaacttcgccgacaaggagcctacgaaaacccccatattgcacgttagaagaatggtgtttgatcgtggtaccaaggtgtttgtccagaagtccacgggtttcttcactatcaaagaggagaattctcacctcaaaatcatgtgttgcaattgcgtgtcggactttaggactggaattaacttgccctacatcgtgatagaaaagaacaagaagaacaacgtttttgagtactttctcctgattctccattcaactaataagtttgaaatgagactcagttttaagctgggatatgagatgaaggatggtctgcgagtgctgaacgggcctctgatactgtggcgccacgtgaaggcgttctttttcatcagcagccagaccggtaaagttgtttcggtgtccggcaatttcagtagcatccagtgggccggagagattgagaacttgggcatggtgcttttaggcttgaaggaatgctgtctctccgaggaggagtgcacccaggaaccgagcaagtcagattacgccatctggaatactaagttctgtgtgtactcactcgaatcacaggaagtactcagtgatatctatataattccgcctgcatatagttcagttgtgacatacgtacatatctgcgctaccgaaatcattaagaatcagctacgcatcagcctgatagctctgactcgaaagaaccagcttataagtttccagaacggaaccccaaaaaacgtgtgtcagctgcctttcggcgacccctgtgccgtgcagctcatggattcagggggagggaatctgttctttgtggtcagctttattagtaacaatgcttgcgcagtgtggaaggagagctttcaggtcgccgcaaagtgggaaaagctgagcttggtcctcatcgacgatttcatcggatcagggacagaacaggtgttgttactgtttaaagatagtctgaactcagactgtttaaccagttttaaaattaccgacctgggcaaaatcaattacagctccgagccatcagattgcaacgaagacgacctttttgaggacaagcaggagaatcgatacctggttgtgccgccacttgaaacaggcctcaaggtttgcttctctagctttagggagcttaggcaacatctgttattaaaggagaaaataatctctaagagctacaaggctctgatcaatctggtccagggcaaggacgacaatacttcatccgcagaagaaaaagagtgccttgttcccctgtgcggggaggaagagaattctgtgcatattctagatgaaaagttgtccgataactttcaggatagtgagcaactcgtcgaaaaaatctggtatagagtgattgacgactccctggtcgtgggggtcaagaccacatctagcctaaaacttagcttgaacgacgttacactatctttgctgatggaccaggcccacgacagccggttccgcttgctgaagtgccaaaatcgcgtgattaagctaagtaccaacccattccctgctccatatctgatgccttgcgagataggcctagaggccaaacgagttacactcactcccgattctaagaaggaagaatcatttgtttgcgagcatccttctaagaaagagtgcgtgcagattattaccgctgtgacatccctctccccactgttgactttctcaaagttctgctgtaccgtgctattgcagattatggagcgggaaagcgggaactgccccaaggataggtatgtggtatgtggcagggtgttcttgtcactggaggatctgagcaccggaaagtacctacttaccttcccaaagaagaaaccaatcgagcatatggaagacctgttcgctcttctcgccgctttccacaagagttgctttcagatcacatctcccggatatgcactcaacagcatgaaagtctggctcttagaacacatgaaatgcgaaatcattaaggaattcccagaggtctatttctgtgaaaggcccggtagcttctacggcaccctgttcacctggaagcagagaaccccctttgaaggcatccttattatttactctagaaaccaaacagtaatgttccagtgccttcataacctgatcagaatcctccccataaactgctttctgaagaatctgaaaagcggctctgagaacttcctgattgacaatatggcctttaccctcgagaaggagctcgttacactttcttcattgtccagtgcaatagcaaaacacgagtcaaacttcatgcaaagatgcgaagtctccaaggggaaaagcagcgtggtggccgctgctttgagcgaccggcgagaaaacatccatccgtatcgaaaagagctgcagagagagaagaaaaaaatgcttcaaaccaatctcaaagtcagcggggcattataccgcgaaatcactcttaaagttgcagaggtccagctcaagtctgatttcgctgcgcaaaaattgagcaatctgtag

SEQ ID NO: 222827 - DNA, 2457 bp, Artificial Sequence
  Description of Artificial Sequence: Synthetic coding sequence
atgacttctaagcaggctatgagttctaatgaacaggaacgtctgctgtgttacaacggcgaagtcttagtgttccagctttcaaagggcaactttgctgataaagagcctaccaaaactcctatcctgcatgtccggcgaatggtcttcgaccgcggaactaaagtgtttgtgcagaaaagcacaggattctttacaataaaagaagagaactctcatctcaaaatcatgtgctgcaattgcgtctccgacttccgaaccgggattaatctgccttacatagttatcgagaagaataagaagaacaatgtctttgaatacttcttactcatcctccacagtactaataagttcgagatgcgcctcagcttcaagctggggtacgaaatgaaggatggccttcgggtcctgaacggcccactcattctctggaggcacgtaaaagccttcttttttatcagcagccagactggtaaggtcgtatcggtgagcggtaacttttcatcaattcagtgggccggagagatcgaaaacctcggcatggtgctcctaggtttgaaggaatgttgcttgtcagaagaggagtgcacccaggagccatctaagagcgactacgcaatatggaacaccaagttctgcgtctactcacttgagtctcaagaagtgctgagcgacatatatatcatcccaccggcatactctagtgtggtcacttacgtgcatatctgcgcaaccgaaatcataaaaaatcaacttaggatcagcctcatcgctctaacgagaaagaaccaacttatcagctttcagaatggtacgccaaagaacgtatgtcaactgcccttcggagacccatgtgctgtgcaactgatggattcggggggtgggaatctattctttgtggtttcctttatcagtaataatgcctgcgctgtgtggaaggagtcgttccaagtggctgcaaaatgggagaagctctccctagtcttgatagacgacttcatcggatccgggacagagcaggttctcttactttttaaggattcacttaattccgactgtcttacgtcatttaaaatcactgaccttgggaagattaactacagcagtgagccatccgattgcaatgaagacgacctcttcgaggacaagcaggagaacagatatctcgtggtgccacctcttgagactggacttaaggtctgctttagctccttccgcgaattgagacaacatttactgctgaaagaaaaaattatctccaaaagctacaaggctctcatcaacctcgtgcaggggaaggatgacaatacgtcctccgctgaagagaaggaatgcttagtgccgctttgtggggaagaggaaaattctgttcatatcctcgacgagaaactttccgataacttccaggactcagagcaactggtggagaagatctggtatcgcgttattgacgacagtctggtggttggagttaaaacaactagctcgctgaaattgagcctgaatgatgtcaccctctccttactcatggaccaggcccatgatagtcgcttccgcctcctgaagtgccagaaccgggtcatcaagctgtccaccaacccgtttcctgcgccatacctcatgccatgtgagatcggattggaagcaaaacgcgtgacacttactcctgattccaagaaggaagagagctttgtgtgtgagcacccaagtaaaaaggaatgtgtgcagataatcacagctgttacgtctctcagtcctctgttgaccttttccaagttttgctgcacagtgttactgcagataatggaaagagagagcggaaattgccctaaagaccgctacgtggtgtgcgggcgtgtctttctgtctttggaggacctgtccacaggtaagtacctcctgacattccccaagaaaaaacccatcgagcatatggaggatcttttcgccctgctggccgctttccataagtcctgtttccagatcacatcgcctggttacgctctgaattccatgaaagtgtggctccttgagcacatgaaatgcgaaattattaaggagtttccagaagtgtacttctgtgagcgtcctgggagtttctatggaacgctgttcacatggaaacaaagaaccccctttgagggtatactgataatttactcaaggaaccaaaccgtgatgtttcagtgcttacacaacctgatacgaatattacccatcaactgctttctgaaaaacttgaagtctgggtccgaaaatttcctgattgacaacatggcgttcactctggaaaaagagttagtcactctctcctctttaagctctgcaattgcaaagcatgaaagtaatttcatgcaaagatgcgaagtcagcaagggtaaaagctctgttgtggctgctgctctgtctgacagacgcgagaacatccatccttatcgaaaggagctgcagagatag

SEQ ID NO: 222828 - DNA, 1677 bp, Artificial Sequence
  Description of Artificial Sequence: Synthetic coding sequence
atggcccaagattccgtggatctgtcctgcgactaccagttctggatgcagaagctgagcgtgtgggatcaggcgagcaccctggaaactcagcaggacacctgcctgcatgttgcgcaattccaggagttcttgcgaaaaatgtatgaggccttaaaagaaatggattcgaacaccgtgatcgagcggttcccgactataggccagctcctggcaaaggcttgttggaaccctttcattctggcctatgatgaaagccagaagattctgatctggtgcctctgctgtctgatcaacaaggaaccccagaattcaggccagtccaaactaaacagctggatccaaggcgttcttagtcacatcttgagcgcattaagatttgacaaagaagtagcattatttacacaagggttaggatacgcacctattgactattatccaggccttcttaagaacatggttctctctctggcatccgagttgagagagaaccacctaaacgggtttaatacccaaaggcgtatggcgcctgagcgagtggcctccttgagtcgcgtttgcgtgcccttaataacccttacagatgtcgacccactagtagaagccttgctcatctgccacggacgcgaaccgcaagagatcctacagcccgaattcttcgaagccgtcaacgaagccatcctgctgaagaaaatcagcctccctatgtctgctgtcgtgtgtctctggcttcgccatctgccctcactggagaaggcaatgttgcacctgtttgagaagctcatatcatctgagcgcaattgtctgcgcaggatcgagtgtttcattaaggatagctcccttccccaggcagcatgccatcctgcaatttttagagtggttgatgagatgttccgatgcgcgctcctggagaccgacggagccttggaaattattgctaccatccaggtgtttacacagtgttttgtagaagctctggagaaagcttccaagcagctgagatttgccctgaagacttactttccctatacatctccttccctcgctatggtactcctgcaggacccgcaggacatcccacgagggcactggctccagaccctgaagcacatcagtgaactccttcgcgaagctgttgaggatcagacacatggctcttgcggtggacccttcgagagttggttcctctttatccactttggcggatgggccgagatggttgcagaacagctcctgatgtcagctgccgaacctcctacagccttgctttggctccttgctttttactacgggcctagagacggcaggcagcaacgggctcaaactatggtgcaggttaaagccgttctgggacacttgctagccatgagcaggagttcatcactatccgcccaggatctgcagacagtcgctgggcagggcaccgacacagatctcagggctccagctcagcaacttatacggcacctcctcctcaacttcctactctgggccccaggagggcataccattgcctgggatgtcattacacttatggcccatactgcagagatcacgcacgagatcatcgggttcctcgaccaaacactgtatcggtggaataggttaggcatcgagagtcccaggagcgaaaaactggcacgagagctgttgaaggaactgcgtacccaggtgtag

SEQ ID NO: 222829 - DNA, 1677 bp, Artificial Sequence
  Description of Artificial Sequence: Synthetic coding sequence
atggctcaggacagcgtcgatctttcctgcgactaccagttttggatgcagaagctgtctgtatgggatcaagcctcaaccctggaaacacagcaagatacatgtctccatgtggcccagttccaggagttcctgcgcaagatgtatgaagcgctaaaggaaatggactccaacacagttatagagagattccccaccattggacagttgttagcgaaagcttgttggaaccctttcatattggcttacgatgagtcccagaaaatcttaatttggtgcctctgttgtctcatcaataaagaacctcagaatagcggccagagcaagctgaattcctggatccagggagtgctgagccatatcctatccgccctgcgcttcgataaggaggtggccctgttcacccagggtttgggttacgctccaattgattactaccccggtctattgaagaatatggtgctatctctcgcttctgaactcagagagaaccaccttaacggattcaacactcagcgcagaatggccccagagcgagttgcatccctttccagggtgtgcgtacctttgatcactctcaccgacgtagatccactggtggaggctttgctgatttgccatggacgagagcctcaagagattctgcagcccgagttcttcgaggccgtcaacgaggccatcctgctgaagaaaatcagcttacccatgtctgccgttgtctgtctctggctcaggcatttaccaagtctggagaaagccatgctacatctatttgagaagctgatctcctctgaaaggaattgccttagacgcatcgagtgcttcattaaagattcaagtcttccgcaggctgcctgtcatcccgcaatattccgggtggtggatgagatgttcaggtgtgctctactcgagacagacggcgcactggaaattatagcaacaatccaggtgttcacccagtgtttcgtggaggccttggaaaaggcaagcaagcaactaagattcgctttaaaaacttactttccctacacttccccttcacttgcaatggttctgttacaagacccccaagatatccctcgcggacactggctacagaccctgaaacatatctctgagctgttacgggaggccgttgaggaccagacccacggtagctgtggcggaccctttgaaagttggttcctgttcattcattttggaggctgggcagaaatggtagccgaacagctcctgatgagtgcagcagagcctcccaccgcactgctttggcttttggcattttactacggccctcgagacggaagacagcaaagggcccaaacaatggtgcaagtgaaggcggtcctggggcacctgcttgcgatgagtagatcctctagcttatccgcacaggatttgcagactgtggcgggacaggggactgacaccgatctgcgggcacccgctcagcagcttatccgtcacctgttgttgaactttcttctctgggcgccagggggtcatacaattgcctgggacgtgatcacactgatggctcataccgccgagatcacgcacgaaataattggattccttgaccagacattgtataggtggaaccggctcggtatcgagtctccaaggtcggaaaagttggcccgagagctgctcaaagaactacggacccaggtgtag

SEQ ID NO: 222830 - DNA, 453 bp, Artificial Sequence
  Description of Artificial Sequence: Synthetic coding sequence
atggcccaagatagtgttgacctgtcgtgtgattaccagttctggatgcaaaaactgtcagtgtgggatcaggcctctaccctggaaacacagcaggatacgtgtctccatgttgcccagtttcaggagttcttacggaagatgtacgaggccctcaaggaaatggattccaacacagtaatagagcgctttcccaccattggtcagctcttggcaaaagcctgctggaacccctttattctggcttatgacgaatcacagaaaatcctgatatggtgtctgtgttgcctgataaataaagaaccgcagaacagtggtcagagcaaactgaacagctggattcagggtgtgctgtcccacattctgtcagcccttcgcttcgataaggaagtggcgctgttcacccagggcttgggctacgcgccaatcgactactaccccggacttttatag

SEQ ID NO: 222831 - DNA, 4416 bp, Artificial Sequence
  Description of Artificial Sequence: Synthetic coding sequence
atggtcagcaagcgaaggctgagtaaatcagaggataaggagagcctgacagaggatgccagcaagacgcgaaagcagcccctgagcaagaaaaccaagaaaagtcatatcgctaacgaggtggaggaaaacgattccatttttgtcaaactgctcaaaatctctggtataatcctgaagactggggaatcccaaaaccagttagccgtggatcagatcgcattccagaagaaactgttccagacacttagaaggcacccatcctaccctaagattattgaggagtttgtttccgggttggagtcctacattgaggacgaggattcattcagaaattgtctgctgagttgcgagcgattgcaagacgaagaggcatctatgggggcaagctactcaaagtctctcattaaactcctgctggggattgatattctccaacctgccatcatcaagaccctctttgaaaagctcccagagtacttctttgaaaacaagaactccgacgagattaacattccacgcctgattgtgtctcagctcaagtggctcgatagagtggtggatgggaaagacctcaccacaaaaatcatgcagttgatatcgatcgctccggaaaacctacagcatgatatcataacaagcctgcctgagatactcggagactctcagcatgccgacgtgggtaaagagttgagtgacttgctcatagaaaacaccagtctgactgtgcccattctggatgtcttgtccagcctgcgtttggatccaaacttcttgttaaaagttcgacagctcgttatggacaagctctcatcgataagactcgaagacctgcctgtcatcattaaatttattcttcactccgtcactgcgatggacacccttgaggttattagtgaattgagagagaagctggacttgcaacattgtgtgctcccatctaggctgcaggcctcacaggtaaaattgaagtcaaagggacgggcaagcagctccgggaatcaggagagcagtggccagtcctgcattatcctgctctttgacgtcattaagagtgccattaggtacgagaaaactataagtgaggcatggataaaggctattgagaacaccgctagtgtgagcgagcataaagtgttcgatctggttatgttattcatcatttatagtaccaacacgcaaactaaaaaatacatcgatcgagtgctccgcaacaagatacgtagcgggtgtatacaggaacagctactgcagagtacgttctctgttcactacctagttctcaaagatatgtgtagcagcatcctcagcctggctcaaagcctgctgcattctcttgaccaatctatcatctcattcggcagtctcctgtacaagtatgcttttaagtttttcgatacttattgccagcaggaggtggtgggagctctggtcacccatatttgctctggcaacgaagccgaagtcgacaccgctttagatgtgcttctcgaactggtggtcctgaacccatccgccatgatgatgaatgcagtctttgtaaaagggatccttgattaccttgataacatcagcccacagcagattcgcaaattgttttatgtcctctctacattagccttcagtaagcagaatgaggctagttctcacatccaggatgatatgcatctcgttattaggaagcaactgtcttccacagtgttcaagtacaagctgatagggattattggtgccgtgacaatggccggaattatggccgcagaccgcagcgaatcgccctcccttacacaggaacgagccaacttgtccgatgagcagtgtacacaagtcaccagccttttgcagctggtacactcctgttcggaacagtcccctcaggcatctgcgttatattacgacgaattcgccaatctgatacagcacgagaagctcgacccaaaggccctcgagtgggtggggcataccatctgtaacgactttcaagatgcttttgtggtggactcttgtgttgtcccggaaggtgatttccctttccccgtgaaagccctctacgggctggaggagtacgacacccaagatggcatcgccataaacctgcttccgctgctgtttagtcaggacttcgcaaaagacggagggccagtgacatcacaggaatctgggcagaagctggtgtccccactctgtctagcaccatactttagactgcttaggctttgcgtagagagacaacataatgggaacctcgaagaaattgatggactactggattgcccgatttttctgactgacctggaaccaggcgaaaaactagaatccatgtctgccaaagagcgttctttcatgtgcagcttgatatttctgacacttaactggtttcgcgagatcgtgaacgctttctgtcaggaaacttctccagaaatgaagggtaaggtcctgaccaggttgaagcatattgtcgaactgcagatcattctggagaaatacctagctgtcacccccgattacgtgcctcctttggggaactttgatgttgaaacactggatatcacgccacacactgtgacagccatcagtgccaagatccgaaagaaaggaaagatcgagcggaagcagaagaccgatggatccaaaacatctagttcggacacgctaagtgaagaaaagaactccgaatgtgatcctactcctagccatcggggacaattgaacaaggagtttactggtaaggaggagaaaacgtccctgctccttcataactctcatgcattttttagggaattagatattgaagttttcagcatcctacactgcgggctcgtcaccaaatttatcctggacactgagatgcatacggaagcaaccgaggtggtccaactgggccctcccgaactgctgtttctgctggaggatctgtctcagaaactcgagagcatgctaacaccgcctatcgcacgacgggttccatttctgaaaaataagggcagtaggaacataggatttagccacctgcagcagcgttctgctcaggagattgtgcactgtgtgttccagctcctgaccccaatgtgcaaccatctggagaacattcacaattatttccagtgtctggcggcagagaatcatggggtggtggatggccctggagttaaggtgcaggaataccacattatgtcttcctgctaccagagattgctgcagatttttcatggcctatttgcttggtccgggttttcgcagcctgagaatcagaacttactgtattctgctctacacgttttatcttctcgccttaaacagggggaacactctcagcccttggaagaactgttgagtcagagcgtccattacttgcaaaatttccaccagtccattcccagcttccagtgtgccctgtatctgattcggttgctgatggtgattctagaaaaatccacagcctcagcacagaataaagaaaaaattgcgtccctcgctcgtcagtttctatgtcgagtatggcccagtggcgacaaagaaaaatccaacatctcaaacgaccaactacatgctcttttatgtatatatctggaacatactgagtctatactgaaggcaatagaagagatagccggtgtgggcgtgcccgagctgataaattccccaaaagacgcgtcctcctcaactttccccacacttacaaggcatacattcgtggtgttttttcgtgtgatgatggctgagttggaaaagactgttaagaagattgagcccggtactgccgcagatagtcagcagattcacgaggaaaaattactttattggaacatggctgtgagggatttcagtattctaataaacctgattaaggtgttcgacagtcacccagtcctgcatgtgtgcttgaaatacgggaggctgttcgtggaggcgttcctgaaacagtgtatgcccctgctggatttttcctttcggaagcacagagaagacgtattgagtctgttagaaacttttcagttagatacccggctgctacaccatctgtgcggacattctaagattcaccaggacacccgcctgacacagcacgtgcccctgctcaagaaaacactggagttgctggtctgccgggtcaaagctatgctgactctgaataactgtagggaggctttctggctcggcaacctgaagaatcgtgatctgcagggtgaagagatcaaaagtcagaacagccaggaaagcacagcagatgagtctgaggacgacatgagctcccaggcttctaagtccaaggccaccgaggtttccctccagaaccctccagagtcaggaacggacggctgtatcctcctcatcgttctgtcttggtggagccgcaccttaccgacatacgtgtactgtcaaatgctcctttgcccgtttccgttccccccatag

SEQ ID NO: 222832 - DNA, 3750 bp, Artificial Sequence
  Description of Artificial Sequence: Synthetic coding sequence
atggtgtctaagcgaaggctgtccaagagtgaggacaaggaaagtctgacagaagatgcttccaaaactaggaaacagccactgagtaaaaagactaagaaatcccatatcgccaacgaggttgaagaaaatgacagcattttcgtgaagttacttaagatatctgggattatccttaaaactggcgagagccagaaccagttagcggtagatcaaatcgcattccagaagaagctgttccagacacttcgtcgccacccatcatacccaaagatcatcgaggaatttgtctcgggtctggagtcttacatcgaggatgaagattcttttagaaactgcctcctgagctgtgagcgtttgcaggatgaggaagcctcaatgggtgcatcctattccaaatctctgatcaaactgctactggggatcgatatactccagcccgctataatcaagaccctgtttgagaaattgcccgaatacttcttcgagaacaagaactccgacgaaattaatataccaaggttaatcgtatctcagttgaaatggctggatcgcgtcgtagacggcaaagacctaaccaccaaaatcatgcagctgatcagcatagcgccagaaaacctccaacatgacattatcacttcgctgccagaaattctcggcgattctcagcacgccgatgttggcaaagaactctccgacttgctgatcgagaacacttccctgactgttcctattctggatgtgctgtctagcctcaggcttgacccaaatttcctcctcaaagtgcgccagctcgtgatggataaactttcctccatccgactggaggatctcccggtaataatcaagtttatactccatagcgtgactgccatggacactcttgaagtgatcagcgagctgcgggagaagttggacctgcagcactgcgtgttacccagcagactgcaagcgtcacaggtcaaattgaagagtaagggccgagcaagctctagcggaaaccaggaaagctcaggacagtcgtgcataatattgctcttcgacgttataaagtccgccattaggtatgaaaaaactatttcagaggcttggattaaggcaattgaaaacacggcaagcgtgagtgagcacaaggtcttcgacctggtgatgctgtttatcatatactcaacgaatactcagacaaaaaaatatatcgaccgagtgttaagaaacaaaatccgaagtgggtgcatacaagagcagttgttgcaatcaacattctcagtccattatctggtgctgaaggacatgtgttcaagcatcctaagtctggcccagagccttctgcattcgctcgaccagagcatcatttctttcggttcactgctatataaatacgcttttaagttttttgacacatattgccaacaggaagttgtgggagcgctggtgacccatatatgctctggtaacgaggccgaggtagataccgctctggacgttttgcttgaattggtggtgctgaatccaagcgctatgatgatgaacgcagtgttcgtgaaggggattctggattacctggataacatatccccccagcagattcgcaaactgttttatgtgctgagtacattagcattttctaaacaaaacgaagcgtcctctcacatccaggacgatatgcacctggtaattaggaaacagctgagtagcaccgtttttaagtataaacttatcggtataatcggagctgtcaccatggcgggaatcatggcggcagacaggagtgaatctccaagtttaacacaggagcgcgcaaacctgagcgacgagcagtgcacgcaggtcaccagtctactgcaattggtccacagctgttcagagcagagcccccaagcttctgccctgtactatgatgagttcgcaaacctaatccagcatgaaaagctggatccaaaggcactcgaatgggtgggccacaccatctgcaatgactttcaggacgccttcgtggtcgactcctgcgtggtgccagaaggcgatttcccatttcctgtcaaagcgttatatgggttggaggagtatgacacccaggatggtatagctatcaatctgttacctcttctgttctcgcaggacttcgctaaggacgggggtcctgtcacatcacaggagagtggccagaagttggtgagccctctgtgtcttgccccatacttcaggttgttgcgtctgtgcgtggagcggcagcacaacggtaatctagaggaaatagatgggctcctggactgtcccatctttctgacagacttagagcccggagagaagttagaaagcatgtccgctaaggagcgttccttcatgtgctctctgatttttctcaccttgaactggttccgggagatcgtgaacgcgttttgtcaggagaccagtcccgaaatgaaaggaaaagttctcacccgattgaagcacattgtcgaactgcagataattctcgagaagtacctcgccgtgactccagattatgttccccctctcggtaacttcgacgtggagactctggatattactccccataccgtgacggccattagcgctaagattaggaagaagggtaagatcgaacgtaaacagaagactgacgggagcaagacctcctcatccgacacactgtccgaggagaagaattcggaatgtgacccaacaccttcacatcgcggtcagctgaacaaggagtttacaggcaaggaagagaagacaagtctcctgctgcacaattcccacgctttcttcagagagctcgacatagaagtgttctccatcctgcattgtggattggtaactaagtttatactcgatacagagatgcacacagaggccacggaagtagtgcagctggggcctcctgaattgctttttttgctcgaggacctttcccagaaacttgagagcatgttgacaccaccgatcgcgcgacgagtcccatttcttaagaacaagggttctcgcaacatcgggtttagccacctccagcagcgcagcgcccaagaaatcgtccactgcgtgttccagctgctaaccccgatgtgtaaccatctggagaacatccacaattattttcagtgcctggctgctgaaaaccacggagtggtggatggcccaggggtaaaggttcaggaataccacattatgtcaagctgttaccagagactactgcagatctttcacggcttattcgcctggagcggattctcccagccagagaatcagaatctcctctactccgctttgcatgtgctgtccagtcggctgaaacagggagagcacagccagcccttggaggagctattaagtcagagtgtgcattatctgcagaactttcatcagagcataccctcattccaatgtgccttgtatctgattaggttattaatggtgattttagagaagtcgacagccagcgcccagaacaaagaaaagattgccagccttgctagacagttcctatgtcgcgtttggccctccggggataaagagaaatccaacatttccaatgaccaactgcatgccttgttgtgcatttatctggagcacactgagagcatcctgaaagccattgaggaaattgctggtgtgggcgtgcctgaactcatcaatagccccaaggatgcatcctcaagtacattccctacactgactagatttatgaagcgtaactcaagtacagggacctggctgttcgagacatccgtgtccagcagtacatag

SEQ ID NO: 222833 - DNA, 4356 bp, Artificial Sequence
  Description of Artificial Sequence: Synthetic coding sequence
atggtgtctaagcggcgtctgagtaagagtgaagacaaagaaagcctaacagaagacgccagcaagacacggaagcaacccctctctaaaaagactaagaagtcgcatattgctaacgaggtcgaggagaatgactccattttcgtgaagctgttaaaaatttcagggatcattttgaagaccggggagagtcagaatcagttggctgtggatcaaatcgctttccagaaaaaactgtttcagacactgagacgtcatccgagttatcccaagatcattgaggagttcgtgtcaggactggagtcgtacatcgaagatgaagattctttcagaaactgtctgctaagctgcgagcgcctgcaggatgaagaggcatctatgggcgctagctactccaagagtctgattaagctcctgctgggtattgacattctgcagccagcgattatcaagaccctgttcgaaaaactgcccgaatactttttcgagaacaagaattccgacgaaattaatatcccccgtttgatagtgagtcagctgaagtggcttgaccgagtggtcgatggaaaagacctcactacaaagatcatgcagctgatttcaatcgcgcctgagaaccttcaacacgatataattacctccctcccagaaattttaggcgactctcagcatgcagatgtggggaaagagctgtctgatctactcattgagaacacttccctaaccgtgcctatcctggatgtgctctccagcctgcgactggaccctaattttctccttaaggtacgacagctggtgatggataaactcagctccatccgcctggaggatctgccggtcatcatcaaattcatcttacattctgttaccgcaatggacaccttggaagttatctctgagcttagggagaagttggacctgcagcactgtgttttgcccagtcggctccaggcgtcccaagttaaactcaaaagtaaagggagagcgtcatcttcaggtaaccaggagtcaagcgggcaaagctgcatcatactgctcttcgatgttatcaaaagcgctatccgctatgaaaaaaccatctcagaagcctggataaaggccattgaaaacacagcctccgtctctgagcacaaggtgttcgacttggttatgctgttcatcatttatagcaccaatacgcagacaaaaaagtatatcgacagggtgctgagaaacaagatccggtccggctgtattcaggagcagctccttcagagtactttctctgtccactacctggtcctgaaagacatgtgtagctctatcctgtctttggctcagtcactcctccacagcttggatcagtctatcatttcgttcgggtcactgctgtacaagtacgcgtttaaatttttcgacacatattgccaacaggaagtggtgggagcactggttacacacatctgttcagggaacgaagcggaggttgatactgctctggatgtgctcttggaattggtggtgcttaacccaagcgccatgatgatgaatgccgtctttgtgaagggaatcttagattacttggacaatatcagcccacagcaaattcgcaagttgttttatgtcctgtcaactttggccttctccaagcaaaacgaagctagctcacatatccaagacgacatgcacctggtgatacgcaagcagctgtcttcgacagtgtttaaatacaagctgattggtatcattggggcagtcacaatggcaggaatcatggctgctgatcgctccgaatctcctagcctaacacaagaacgagctaacctgtcagatgaacagtgcactcaggtcacctcactgcttcagttggtacacagctgttctgaacagtcgccacaggccagtgccttatattatgatgagttcgcaaatctgattcaacacgaaaagctggatcccaaagctctcgaatgggtcggccacacaatctgcaatgacttccaggacgctttcgtggtggactcttgtgtcgtacccgaaggggatttcccttttcccgtgaaggccctctacggcctagaagagtatgacactcaggatgggattgctatcaacttacttcccctgctgttttctcaggatttcgctaaggacgggggacccgttacctctcaggagtccggtcagaagctagtgtcacctctgtgtcttgccccatactttcgccttctgaggttgtgcgttgagaggcagcacaacggcaatctcgaggagatcgatggcctgctcgactgcccgatttttctcaccgacctggaaccaggcgagaagctggagagtatgtcagcgaaggaacggtcgttcatgtgctctttaattttccttactctgaactggtttagggagatcgtgaatgccttctgccaggaaacatcccccgagatgaagggtaaagtgttgactagattaaagcatatcgtggaactgcagattattctggaaaagtacctggctgtgacaccagattacgtcccccctctggggaacttcgatgtcgagacactcgatataacccctcacaccgtgacagccatctcagccaaaattcggaaaaagggcaagattgaaagaaaacagaagactgatggttccaagacatcctcttcagacacactcagcgaggagaaaaattctgaatgcgatccaaccccttctcaccgaggacagctgaataaagagtttacgggcaaagaggaaaaaacttccctgctgctgcacaatagccacgccttcttcagagaactggatatcgaggtgtttagcattctccactgtggactggtgaccaaatttattctcgataccgagatgcatactgaagctaccgaggttgtgcaactcggacccccagaactactgttcctcctcgaagatctgagccagaagttggagagtatgcttacccccccaatcgcgaggcgggtgccgttcctgaagaacaaggggagcaggaatatcgggttttctcatctccagcagcgctccgcacaagagattgttcactgcgtgttccaacttcttacccccatgtgcaaccacctggagaacatccacaactacttccagtgtctggcagcagagaatcacggggtcgttgatggccctggcgtcaaggtgcaggagtatcacattatgagctcctgctatcagaggctcctgcagattttccacggcttgtttgcctggtctgggttctcccaacccgagaatcagaacctgctgtattccgccctgcatgtcctgtcaagcaggctgaagcagggggaacattcacaacccctcgaagagctactctcacagtccgtgcactatctgcaaaatttccatcagtcaatccccagctttcaatgtgccctgtacctgatccgccttctgatggtgatcttggaaaagagtacagcatccgcgcagaataaagaaaagatcgctagccttgctagacagttcctgtgccgcgtctggccatcaggggataaggaaaaatcgaatatatcgaatgaccaactacacgccctgctgtgtatctatcttgagcacaccgaaagcatcctgaaggcgattgaggaaattgcaggagtcggcgtccctgagctcatcaatagccccaaagatgcaagctccagtactttccccacgctgactaggcacacattcgttgtctttttcagagtgatgatggctgagttagagaagaccgtgaagaagatcgagcctggcactgcggctgatagtcaacagattcatgaggagaagctgctttattggaacatggctgtgcgtgatttcagtatcctaatcaatctgattaaagtctttgactctcacccagtgctacacgtgtgcttgaagtacggtcgcctgttcgtcgaggcctttctgaaacagtgtatgcccttattggatttcagctttagaaagcatcgggaggacgtactgtcactgcttgaaacattccagctggacacaaggctccttcaccacttgtgtggacacagtaaaattcaccaggatacaaggctgacacagcacgtgcctctgttgaagaagacgttggagctgctcgtgtgcagagtcaaggcaatgctgactttgaacaactgccgggaagctttctggttaggaaacctgaagaacagggatctccagggagaggagataaagtcccagaactctcaggagagcacggcagatgagagtgaggacgatatgtcttctcaagctagtaagtccaaagcaaccgaagacggtgaagaggacgaagtgtccgccggagagaaagaacaggactcggatgagtcatacgatgactccgattag

SEQ ID NO: 222834 - DNA, 4356 bp, Artificial Sequence
  Description of Artificial Sequence: Synthetic coding sequence
atggtatctaagaggaggctctctaagtcggaggataaggaatctctgaccgaagacgcgtcaaaaactaggaagcagcctctcagcaaaaagacaaagaaatcacacatcgccaacgaagtcgaggaaaatgacagtatatttgttaaactcctgaaaatatctggtattattctgaaaacaggagagtcccaaaaccagctagcggtagatcagatcgcttttcaaaagaagctatttcaaaccctgagacggcacccatcttacccaaagatcattgaggaattcgtttcaggtctggagagctacattgaagacgaggactcctttaggaattgtctgctgagctgtgagagactgcaggacgaggaggcatctatgggcgcatcctactcgaaaagcctgattaagctattactcggtatagatatcctccaaccagccattataaagactctgttcgagaagctccccgagtacttcttcgagaacaagaattcagatgagattaatattcccagacttattgtctcccagctgaagtggctcgatagggtggtggatgggaaagacttgactactaaaatcatgcagctaatcagtatagcgccagaaaacttgcaacacgatattatcacttccctgccagagatactgggcgactcccagcacgctgatgtggggaaggagctatccgacctcctgattgagaacacatccctgaccgttcccattctggatgtactgtcatccctgaggctggaccccaactttctgcttaaggttagacaattagtgatggacaagcttagctccattcgactggaagatctccctgtgatcataaagttcatcttgcactccgtcactgcgatggatactttggaggtgattagcgaactacgcgagaagttggacctccagcactgcgtgttaccttctagactccaggcatcccaggtcaaacttaagtccaaagggagagcctcaagctctgggaaccaagagtcctccggccagtcctgcataatattgctgtttgatgtgatcaaatcagcaatccggtacgagaaaacaatatccgaggcgtggatcaaggccattgagaataccgcctctgtgagcgagcataaggtctttgacctcgtcatgctcttcatcatctacagtacgaatacgcagacgaaaaaatacattgaccgcgtgctgcggaataaaattcggagcggttgtatccaggagcagctcttgcagtccaccttttccgtgcactacttggtcctgaaagacatgtgctcaagtatcctatccctggcccagagcctgctgcactcactcgatcagtcaatcatctcatttggctctctgctgtacaaatatgcattcaagttctttgatacatattgtcaacaggaagtggtcggcgcacttgtgacacatatctgcagtggaaatgaggcagaagtcgacaccgcgctcgacgtgctgttggagctagtggtgttaaacccaagtgcaatgatgatgaacgcggtgtttgttaagggcatcctagactatctggacaatatctctcctcagcagatccggaagctgttctacgtgttaagtacactcgccttctctaaacagaacgaagcttcaagccatattcaagatgacatgcacctggtgattagaaaacagttatcttcaaccgtgtttaaatataaattaattggaattatcggagctgttactatggccggtatcatggccgcagaccgcagcgaatcaccctccttgacccaggaacgggcaaacctgtcagacgaacagtgtacccaggtcaccagcctgctacagctagtgcattcttgttctgagcagtccccacaggcaagtgccttatactacgatgagttcgcaaaccttattcagcatgagaagctcgaccccaaggctttggaatgggtcgggcataccatttgtaatgatttccaagacgctttcgtcgttgatagctgtgtggtgcctgagggagacttcccattcccagtgaaggccctgtacgggctggaggaatacgacacccaggatggaattgccattaacttactcccccttctattttcccaagattttgctaaggatgggggacccgtgactagtcaggagtccgggcagaagctcgttagcccgttgtgcttggccccatacttcagacttctacgcttgtgcgttgaaagacagcataacggcaatctcgaagagatcgacgggctgctggattgtccgatcttcctgaccgacctcgagcccggagaaaaattggagtccatgtccgccaaggagaggtcctttatgtgtagtctcatcttcctgacgttgaattggttccgcgaaatcgtgaacgctttttgtcaggagacatcacccgagatgaagggaaaagtgttaaccagactgaaacatatcgtggaactgcagattatactcgaaaagtacctcgctgtgacacctgactacgtcccccctctgggtaacttcgatgtggagacattggacatcacaccgcatactgttacagctatcagcgctaaaatacgaaagaagggcaagattgaaaggaaacagaagactgatggttcaaaaacctctagcagcgacaccctaagcgaggagaagaactcagagtgcgaccccacaccgtctcatagaggacagcttaataaggaatttactggaaaagaggaaaagacatctctgctcctgcacaactcccacgcatttttccgggagctggatatcgaagtgttcagcatactgcattgcgggctcgtgacgaagtttattcttgacacagaaatgcacactgaggctaccgaagtggtgcagctaggacccccagagctgctttttctgctggaggacctgagccagaagcttgaaagtatgttgacccctcctattgccagacgcgtgccatttctcaaaaataagggcagcagaaacatcggcttttcccacctccaacaacgctccgcccaggaaattgtccactgcgttttccagctgctaacccccatgtgcaatcatctggagaatattcataattatttccaatgcctggctgccgagaaccatggcgttgtagacggcccaggggtcaaggtgcaagaataccacattatgtctagttgttaccagcgtttactgcagattttccacggcctatttgcctggagcggatttagccagccagaaaatcagaatctgctctacagcgcactgcatgtgctgtcgtcaagactcaaacagggtgaacatagtcagccactggaagagctgctttcacagagcgttcactatctgcaaaacttccaccaatctattccatcctttcagtgcgctctgtacctaatccggctgctcatggtgatattggagaagtccaccgccagtgctcagaacaaggagaaaatcgccagcttagctagacagtttctgtgtcgtgtgtggccgagtggcgacaaagagaagtccaacatatcaaacgatcagctacatgctctactgtgtatctacttagaacacacagagtccatactgaaagccattgaagaaattgctggtgtcggtgtgccggaactgattaatagtccaaaggatgccagttccagtacttttcccaccctcacgcgtcacacttttgtcgtattctttcgtgtgatgatggcagaactggagaagaccgtgaagaagatcgagccagggacagccgctgactcacagcaaattcacgaggagaagctcctgtactggaacatggccgtccgtgacttttccatacttattaatctgataaaagtcttcgacagtcaccctgtgttacatgtatgtctgaaatacggccgtctatttgttgaagcgtttctcaaacagtgtatgccgctactggatttcagttttagaaagcatagggaggatgtcctatcactgttggagacatttcagctggatacacggctcttgcaccacctctgtgggcattcaaagattcaccaagatactcgcctgactcagcatgtgccactattaaaaaagaccctggagttgctggtgtgtcgggtgaaagccatgctgacccttaacaattgccgggaggctttttggctaggaaacttgaagaatcgcgacctacaaggcgaagagatcaaatcccaaaactctcaggaaagcactgccgatgagtccgaggatgacatgtcatcccaagcatctaagtctaaagcaacagaggacggtgaggaggacgaagtttccgccggagaaaaggagcaggacagtgacgaaagttacgatgatagtgattag

SEQ ID NO: 222835 - DNA, 1341 bp, Artificial Sequence
  Description of Artificial Sequence: Synthetic coding sequence
atggatagttctgccgctccaaccaacgcaagcaattgtacagacgccctggcgtattcctcctgcagtcctgctccaagtccaggaagttgggtcaacctgtcccatcttgatggcaacctgtcagacccttgtggcccaaaccgaactgatctggggggacgagattcactctgccccccaacgggcagcccctctatgatcactgccattactatcatggctctatacagcatcgtatgtgtggtagggttgttcggcaatttcctggtgatgtatgtgatagttcggtacaccaagatgaagaccgcgaccaatatctacatctttaatcttgctctggcggatgccctcgccactagcacgctcccattccagtctgtcaactatctgatgggtacctggcctttcgggacaattttgtgtaaaatcgtaataagcattgactattacaatatgtttacctcgatcttcaccctctgcaccatgagcgtggaccggtacattgccgtgtgtcatccagtgaaggctctggatttcaggacaccacgcaatgcaaaaatcatcaacgtctgtaactggattctcagtagcgccatcggcctacctgtgatgttcatggctactacgaagtatcgtcagggaagcatcgattgcacgctaacgtttagccatccaacatggtattgggagaacttgctgaaaatctgcgtgtttatttttgcctttatcatgcccgttctaatcatcacagtgtgctacggactaatgatactgcgcctgaaaagtgtgagaatgttgtcaggaagtaaagagaaagacagaaatttacgacgcatcactcggatggttctggtagttgttgccgtatttattgtctgctggaccccgattcatatttatgtgatcatcaaagcactagtgacaatacctgagacaacctttcaaaccgtgtcatggcacttttgtattgccttaggttataccaatagctgtttgaatccggtgctttatgcgttcctggacgagaactttaagaggtgcttccgcgagttttgtatacccacctcctctaatattgagcaacagaacagcacccgcatccgccagaacacgcgagaccatccatcaactgccaataccgtggacaggaccaaccaccaatgccttcccatcccaagtctatcatgttgggcgctggagcaaggatgtttagtggtgtatccaggaccactacagggaccactcgtgaggtacgacctgcctgccatattgcacagttcttgcttacgaggtaacactgcccctagcccgagtggtggcgcttttttgctgtcatag

SEQ ID NO: 222836 - DNA, 1125 bp, Artificial Sequence
  Description of Artificial Sequence: Synthetic coding sequence
atggaaagccttctacagcacctcgaccgcttcagtgagttgttggccgtaagcagcaccacatacgtgtcgacttgggaccctgccactgtgagacgagccctgcaatgggctcgctacttaagacatatccacagacgctttggcaggcacggacctatccgcactgcgctggaaaggcgtctgcataaccaatggagacaggagggtggcttcggacgcggaccagtcccaggcctagcaaatttccaggcactggggcactgtgacgtgctgctgagcctccggttactcgagaatagagcactaggagacgctgctaggtatcacttggtgcagcagctatttccgggacccggagtacgggacgcagacgaagagaccctgcaggaatcacttgcacgccttgctcgcaggcggagcgcggtgcatatgcttagattcaatggctatcgagaaaaccctaatctgcaagaggactctctcatgaaaacccaggccgagctcctgctggagagactacaagaagtgggtaaggcggaggccgaaagaccggcacgctttctgtcctccctgtgggaacgactgccacagaacaatttcctgaaagtgatcgccgtagcgctgttacaaccccctctgtccaggcggccacaggaggagttggaacccggtattcataagagtcctggagagggatcccaggtgcttgtccattggctgctgggcaattccgaggtcttcgccgctttctgcagggctctgccggcaggattgctgacactggttacatcaagacacccagccctgagccccgtgtacttgggactgcttactgactggggacaacgcctccattacgatctccaaaagggaatttgggtcggaaccgaaagccaggatgtaccatgggaagagctgcataataggtttcagtctctgtgtcaggcaccaccccctcttaaagataaggtactaacggcactggagacatgcaaggctcaggatggggacttcgaggtgccaggactgagcatctggaccgacctgctcctcgcattacgcagtggcgctttcaggaagaggcaggtgctgggcctgagcgccggactgtcttccgtttag

SEQ ID NO: 222837 - DNA, 3807 bp, Artificial Sequence
  Description of Artificial Sequence: Synthetic coding sequence
atggatcaaaagatattatccttggctgcggagaaaacggccgacaagcttcaggaattcctgcaaactctccgggagggggacctgacaaatttactgcagaaccaggccgtgaaggggaaagttgccggtgctctcctgcgcgcaatcttcaagggctccccctgcagtgaggaggcagggactctacgtaggagaaaaatctacacctgttgcatccaactggtcgagtccggggatctccagaaggagattgcaagcgagatcattggcctgctcatgctggaggcacatcacttcccaggtccactactggttgaactggctaacgagttcatcagcgccgtcagagaaggctcgttagtgaatgggaaaagcctagaacttttgcccataattctgacggccctggcaacaaagaaggaaaatttggcgtacggaaagggagttctctctggtgaagagtgtaaaaagcaactcatcaacacactgtgctccggacgatgggaccagcagtatgttatccagctaacatctatgttcaaagatgtacctctgaccgccgaagaagtggagttcgtggtagaaaaagctctttccatgttttcaaagatgaatctgcaggagattcctcctctggtataccagctgctggtgttatcgtcgaagggttcacgcaaaagcgtgctggagggaattatcgcctttttctccgctttagataaacaacataatgaggagcagtccggggatgagcttttggacgtagttacagttccaagcggcgaactacggcacgtggagggcaccattatactccacatcgttttcgcgatcaagctcgactacgaattagggagagagctcgttaagcatctgaaagtgggccagcagggcgacagcaataataacttatcccccttcagcatcgccctcctcctgtcggtaacgaggattcagagattccaggatcaggtacttgatttattaaaaacctctgtagtgaagtcattcaaagatctgcagttactgcaggggtccaaatttctccagaatctggtgccccaccgttcctacgtgagcacaatgattctcgaggttgtaaaaaatagtgtacactcctgggaccatgtgacacagggactagtggagctcggatttatactgatggactcctacggccctaagaaagtcctggacggcaagaccatcgagaccagtccatccctgtcacgcatgcccaaccagcacgcgtgtaagctgggcgctaatatcctgctggaaacatttaagattcacgaaatgatccggcaagagatcctggagcaggtgctgaatagagtcgtcactcgagcatcttctcctatcagccatttcttagatttgctcagcaacattgttatgtatgcgcctctggtcctgcaaagctgcagcagcaaggtcacagaggccttcgactacctttcttttctccctctgcaaaccgtccaaaggctcctgaaggcggtccagccattgctcaaagtatccatgtcaatgcgtgactgcctcatcctagtcttaagaaaggccatgtttgctaatcagctggatgccagaaagtccgccgttgcgggattcctgctacttctgaagaatttcaaggttctcgggagccttagcagctcccagtgctcccagagcctgtccgtgtctcaagtccatgtggacgtgcactctcactacaatagtgtcgctaacgaaaccttttgcctggaaatcatggattctcttagacgctgtctcagccagcaggccgacgtgcggctgatgctgtatgaaggcttttatgatgtgctgcggagaaacagccaactcgctaatagcgtgatgcagactctacttagccagcttaaacagttctacgaacctaaacctgatctcctgcctcctctgaaattggaagcatgcattctcacccagggggacaaaattagcctccaggaacccctcgactacttgctatgctgcattcagcattgtctggcctggtataagaacaccgtgattccactgcagcaaggtgaggaggaggaagaagaggaggaggctttctacgaagatctagacgatatcctggaatcaatcacaaatcgtatgatcaaatccgagctggaagattttgagcttgacaagtcggctgacttcagccagtccacttccataggcatcaaaaataatatttgcgcgttcttagtcatgggggtctgcgaggttcttatagaatacaatttctccatctctagcttcagtaaaaacaggtttgaagacattttaagtctctttatgtgctataaaaaactttccgacatcttgaatgagaaggcgggaaaggccaaaaccaagatggccaacaaaacatcagatagtctgttgtccatgaagttcgtgagctcgttgctgactgcattgttccgcgtcttgctgtggaggtacacttcgatacccactagcgtggaagaaagcggaaaaaaggaaaagggcaagtccatctcattactgtgcctggagggcctccaaaagatattctctgccgtgcagcagttctaccagccgaagatacagcagttcctgagggcccttgacgtcacagacaaggaaggtgaagagcgggaggatgcagatgtgtccgtgacccagcgtaccgcatttcagataaggcagttccaaaggtctctgctgaatctcttgagctcacaagaggaggacttcaattctaaggaggctctgttactcgttacagtacttacgtctctcagcaagttactggaaccctccagccctcagttcgtccagatgttatcatggacatcgaaaatctgtaaggaaaactctcgcgaagatgccctattctgtaagagcctgatgaatctgttgtttagcctccacgtgtcctataaatcccccgttatccttctcagggacctttcacaggacatccacggtcaccttggcgatattgaccaggacgttgaggtggagaaaactaaccactttgccattgtcaatcttcggacagccgcacccaccgtgtgcttacttgttctgtcgcaggcagaaaaggtgttggaagaagtggattggttgattaccaagttgaagggccaggtgtcccaagagaccctgtccgaggaggcttcatcacaagctacccttccgaatcagcccgtggagaaggccattattatgcagctgggcacgttactaaccttttttcatgagctggttcagacggccctgccttccggaagctgcgttgacaccctgctcaaagacctatgcaaaatgtatacaacactcaccgctctggtaagatattacctgcaagtgtgccaaagtagcgggggtatccctaaaaatatggaaaagctggtcaagctgagcgggagtcatctcacaccgttatgttacagctttattagctacgtgcagaacaagtccaagtctctgaattacaccggggaaaaaaaagagaaacctgccgcagttgccaccgccatggcacgggtgttgagagagaccaagccgatacccaacttaatctttgcaatagaacagtacgagaaatttctgatccacctttccaaaaagagtaaagtcaacctcatgcaacatatgaaactgagcacaagtagagactttaagatcaagggtaatattttagatatggtgttaagagaagatggtgaggatgaaaacgaagagggcactgcttctgagcacgggggacagaacaaggagcccgctaaaaaaaagagaaagaagtag

SEQ ID NO: 222838 - DNA, 3987 bp, Artificial Sequence
  Description of Artificial Sequence: Synthetic coding sequence
atggatcagaagatcttgtcactggctgcagagaagactgccgataaactgcaggagttcctgcaaacgctgagagagggcgatctgaccaatcttctgcagaatcaggccgtgaaaggaaaggttgctggcgctctgctgagggccatttttaaggggtcaccgtgctcagaagaagctggcacattacgaaggcgcaaaatttacacatgttgtattcagttggtggagtctggtgatctgcaaaaagagatcgctagcgagattatcggcctcctgatgttagaagcacaccacttccccggacctcttttagtggaactggccaatgaattcatttctgccgttagggagggcagcctagtcaacgggaaatctctagagctgctgcctatcattctcacggccctcgccactaagaaggagaacctagcctatgggaaaggcgtgctgagcggggaagaatgcaaaaagcaactgatcaacaccctctgttccgggagatgggatcagcagtacgtcattcagctcacctccatgttcaaggacgtgcctctgaccgcagaggaggtcgagttcgtggttgaaaaagcgctgtcaatgttttccaaaatgaatttgcaggaaatcccccctctcgtgtaccaattgcttgttctgtcatcaaaaggcagcaggaagagtgtgttggaaggaatcatcgccttcttcagtgcgttggataagcagcataacgaggagcagtctggagatgagcttctggatgtggtaactgtgccctcaggagaactcagacatgtggaagggaccattattctacacattgtgttcgccataaagctggactatgagctgggcagggaattggttaagcacttaaaagtagggcagcagggagattcaaataataatctgagtcccttctctatagccctccttctgtctgtgacaaggatccagaggtttcaggaccaagtgctcgacctcctaaagacgagcgtagtgaagtcgtttaaggatcttcaactcttacaagggagtaagtttctgcagaacctggtacctcaccgcagttacgtaagtacgatgattcttgaggtggtgaaaaatagtgtgcactcttgggatcacgttacgcagggcctggtggaactaggatttatcctcatggattcctacggcccaaaaaaggtgctcgacgggaaaacaattgagacttccccctcactgtctagaatgccaaatcagcatgcctgcaaactcggcgcaaatatcctacttgagacattcaagatccatgagatgatccggcaggagatcctggagcaagtgctgaaccgggtcgtgacaagggcaagctccccaatctcccatttcctggatctcctgagtaacatcgtgatgtatgctccattggtcctccagagctgctcatcgaaggtgactgaggcttttgattatctttcctttttgccattgcagaccgtgcagcggctgctcaaagctgtgcagcctcttttgaaggtgtcaatgagcatgagggattgcctgatactggttctgaggaaggccatgtttgccaatcagcttgacgctaggaagtccgccgtggctggatttctccttttgttgaagaatttcaaggtgttgggcagcctttcctcaagccaatgttcccagtctcttagcgtgagtcaagtacacgtcgacgttcacagccattataattccgttgccaatgagacgttctgcttggaaatcatggactctctaagacggtgcctgtcccagcaagctgatgttagattgatgctttatgagggattttatgatgtgctacgaagaaatagtcagctcgccaactcggtcatgcagacactcctctcccagctgaaacagttctacgaaccaaaacctgatctgttgcctcccctcaagctggaggcctgcatcttgacacaaggggataagattagtctgcaagagcctctcgattatctgctgtgctgcattcaacattgtctcgcttggtataaaaacacagttatcccgctgcaacaaggggaggaagaagaggaagaggaagaagccttttatgaagacctggatgatatcttggaaagcattaccaacaggatgatcaaaagtgagctagaagactttgagttagataaaagcgcggatttctcccagtccacctccattggcattaaaaataacatttgcgccttcctcgtgatgggcgtatgcgaggtcctgatcgaatacaatttttctatcagttcgttctccaaaaataggtttgaagatattcttagcttgttcatgtgctacaagaagctgtcagatatcctgaacgaaaaagccggaaaggccaaaactaagatggctaacaagaccagcgactccctgctgagcatgaagtttgtgagctccttattaaccgcactatttcgtgatagcatccagagccatcaggagtccctctccgtcttacgaagctctaatgagttcatgcggtatgcggtgaacgtggctcttcagaaggtgcagcagctcaaagagactggacatgtgtcaggtcccgacggccagaatccagaaaaaatttttcagaatctgtgcgacatcacgcgggtccttctctggcgatacacaagtatccccacatcagtggaggagagcggaaaaaaagaaaagggcaagtcgatcagtctactgtgcctagagggccttcagaaaatatttagcgcagttcaacagttctatcagccgaagatccagcagtttctgagggcactggatgtcaccgacaaagaaggtgaggagagagaggacgcagacgtgtctgtgacacagaggactgctttccagatccgacagtttcagagatcacttctcaatctgttgagttcacaagaggaagactttaactcgaaggaggcccttctcttagtgaccgtgctgacaagcctttccaagctgctcgaaccttcttcaccccagttcgtccagatgctaagttggacttctaaaatttgcaaggagaacagccgcgaggatgccctgttttgcaaaagccttatgaacctgctattttccctccatgttagttacaaatcaccagtgatcttgctgagggacttatcacaggacatccatggtcacttaggggatattgaccaggacgtggaagtggagaagaccaatcatttcgcaatcgtaaatttgcgcactgcggcaccaaccgtttgtctgctggtgctgagtcaagccgaaaaggtgctcgaagaagttgattggttaatcacaaaactgaaaggccaagtgtcgcaggagactttgagcgaagaagcttccagccaggccacactgcctaaccagcccgttgagaaggccattatcatgcagctggggacccttctcacattctttcatgagctggtccagacggcattgccgagcgggtcgtgcgttgacaccctgcttaaggatctgtgcaaaatgtatactaccttaacagccctggtgagatactatctccaggtgtgtcaatcttctgggggaatccccaagaacatggagaagctggtcaagttgagcggatcccacctcacacctctgtgctactcatttatctcatacgtccagaacaagtccaagagccttaactacaccggcgaaaagaaggagaagcccgctgccgttgcgacggcaatggcacgagtgctgagggagaccaaacccatacccaaccttatcttcgccatagaacagtatgagaagtttctgattcacctaagcaagaaatccaaggttaacctcatgcagcacatgaaactgagcacttccagagacttcaagataaaagggaacatcctggatatggtgcttagggaggacggtgaggatgaaaacgaggagggaacggcctccgagcacggtggtcagaacaaagagcctgcgaagaagaagaggaaaaaatag

SEQ ID NO: 222839 - DNA, 3288 bp, Artificial Sequence
  Description of Artificial Sequence: Synthetic coding sequence
atggaccagaagatattgagcttagcagccgagaagactgcagataagctccaagaattcttacagacccttagggagggcgacctgaccaacctgctgcaaaaccaggcagtcaagggaaaagtcgctggggcactgttgagagctatctttaaggggtccccctgctctgaggaggctggtacactgaggcggcgaaaaatttacacctgttgcatccagctcgttgaaagcggggacctgcagaaggaaatcgcatccgaaatcattggtctcctaatgttggaagctcatcacttcccaggcccactcctggttgagctggcaaacgagttcatttccgcagttagggagggatccttagtaaatggaaagagcctggaactgcttccgatcatcttaacagctttggctacaaaaaaagagaatctggcatacggaaagggcgtcctctcgggagaggaatgtaaaaagcaactgattaacactctgtgcagcggacgatgggatcaacaatatgtcattcagctaacttccatgtttaaggacgtcccgctgactgccgaggaagtcgaattcgtcgtcgagaaagctctgtccatgttctctaagatgaatctgcaggaaatcccacctctcgtttaccagctcctggtgctgtccagtaaagggtctaggaagagtgtgcttgaagggattatcgcctttttctctgccttagacaaacagcacaacgaagagcagtctggggatgagctgcttgacgttgttacagtaccatctggagaactgcggcacgtcgaaggtaccattatattgcatatcgtgtttgccatcaaattggactacgagttgggtagagagctggtgaagcacttgaaggtgggacagcagggggactcgaataacaacctgagcccttttagcattgcattgctcctcagcgtgactcgcatccagagatttcaggaccaggtactcgacctgctcaagacaagcgtggtaaagtctttcaaggatctgcagttactgcagggttccaaattcctgcagaatctggtgcctcaccggtcctacgtttcaacaatgatcttggaggtggttaaaaacagcgtgcactcctgggaccacgtcacgcagggccttgtagaattggggttcatattaatggattcatacggcccaaaaaaagtcctcgatggtaaaacaattgagacaagtccttccctcagccggatgcctaatcaacatgcgtgtaaacttggcgcaaacattctactcgagacatttaaaatccatgaaatgattcgccaggaaatcctggagcaggtgctgaaccgagttgtgacccgggcatcttccccaatatcacacttccttgatctcctctcaaatatagttatgtacgccccattggttctgcagtcctgtagctccaaagtgacagaagctttcgactacttgtcctttctccctctccagaccgtgcagcgcctcctcaaggccgttcagcccctgcttaaagtatccatgtccatgagggactgcctgatactggttctgcgaaaggccatgttcgctaatcagctggacgccagaaagagcgctgtagccggattccttctcctgttgaagaatttcaaggtcctcggcagcctgtcctccagccagtgcagccagtccttgtctgtgagtcaggttcatgttgacgttcactcacactataacagcgttgccaatgagactttttgcctggaaataatggattctcttcgcagatgcctctcccagcaggctgatgtaaggttgatgttgtacgaaggcttctacgacgttctacgcagaaactcccagctcgcaaattctgtcatgcaaactttattaagccaactaaagcaattttacgagccgaagcctgacttactgccgcctctgaagttggaagcatgtatcctgacgcagggagacaaaatctcactgcaggagcctctggattatctgctttgttgtattcaacattgcctagcttggtataagaacactgtgatccccctccagcaaggcgaggaagaggaagaagaagaagaagccttctacgaggatttggatgacatcctggagagtatcacgaaccgaatgattaagtctgagttggaagactttgaacttgacaagagtgctgacttcagtcagagcacctctattggcattaagaacaatatttgtgcatttttggtaatgggggtctgcgaggtgctgattgagtataacttttctattagctcattcagtaagaaccgctttgaggacatcctcagtctgttcatgtgttataaaaaactgagcgacatactgaacgaaaaggctggtaaggcaaaaacaaaaatggctaataagacctccgattcactgttgtcgatgaaatttgtgagcagcctgttaaccgctctgtttcgcgttctactatggcggtatacgtccatccctacctccgtcgaggagtcggggaagaaggagaagggcaagtccatcagcttactgtgcctggagggactgcagaaaatcttctccgccgtgcagcagttctaccagccgaagatccagcaatttctgcgcgctttggatgtgacggacaaagagggagaggaacgtgaggatgccgatgtgagcgtcacacaaagaaccgcctttcaaatcaggcaatttcagcgatccctgctgaatttactttccagccaggaagaagactttaattctaaggaggcactattgctcgtcactgtgctgacatcactgtccaagttgctggaacccagctcaccacagttcgtgcagatgttgagttggacctctaagatctgtaaagagaactcaagagaggatgccctgttttgcaagagtctgatgaacctcctctttagtcttcatgtgtcctataaatcccctgttatcttattaagagatctctctcaggacatccacggccacctcggggatatagaccaggatgttgaggtcgaaaaaacaaaccatttcgcgatcgttaatctgcgcactgctgcccctaccgtgtgtctactagtcctaagtcaggccgagaaggtcctcgaagaggtggattggcttattactaaactcaaaggacaggtgtcacaagagactctgtcagtgtctcccggtgtgtccgaactgcgcagaaactcgaagaagtatgggaaggctggagaagcagtgtggttcagctccgatccccctgtgctgttcttccacttccttcgtactgaatag

SEQ ID NO: 222840 - DNA, 222 bp, Artificial Sequence
  Description of Artificial Sequence: Synthetic coding sequence
atgtttaaggatgttccgctgaccgcagaagaggtggagtttgtggtcgagaaagccttgtcaatgttctctaagatgaatcttcaggaaatccccccactggtatatcagctgttagtgctgagttctaaaggctcccgcaagtcagtgctagaggggatcatcgcattctttagcgccttggacaagcagcacaacgaagaacagtctggcgacgagtag

SEQ ID NO: 222841 - DNA, 501 bp, Artificial Sequence
  Description of Artificial Sequence: Synthetic coding sequence
atggcccaaacttcttcttatttcatgctaataagttgcctgatgttcctgtctcagtcgcagggacaggaagctcagactgaactgccccaggcacggatcagctgccctgaggggacgaatgcctacagatcctattgctattacttcaatgaagatcgtgagacatgggtggatgctgatctttactgccaaaatatgaactcagggaatctcgtgtctgtgctgacacaggcggaaggtgcatttgtcgcctccctgattaaagagtccggtactgacgactttaatgtctggatcgggctgcatgaccctaagaagaaccggaggtggcactggagcagtggatcactggtgtcttacaagtcctggggaatcggcgcacctagttccgtgaatcctggttattgtgtttcgctgacgagcagcactggcttccagaagtggaaagacgtgccatgtgaagataagttctccttcgtctgtaagttcaagaactag

SEQ ID NO: 222842 - DNA, 384 bp, Artificial Sequence
  Description of Artificial Sequence: Synthetic coding sequence
atggcggtaacagaggctagcctattaaggcagtgccctctgctgctaccacagaaccgcagcaagaccgtgtacgaggggttcatctcagcacagggcagagacttccacctgaggatcgtactccctgaggatcttcagctgaaaaacgcccgactcctatgcagttggcagctccggacaatcctgtcagggtaccatcggatcgtccaacagcgcatgcagcactcccctgatctgatgagctttatgatggaactcaagatgttgttagaggtggcactgaaaaatagacaggagctatacgcacttccccctccccctcagttctactcctccctaattgaggaaatcggtacactcggctgggacaaggcaccctag

SEQ ID NO: 222843 - DNA, 6146 bp, Artificial Sequence
  Description of Artificial Sequence: Synthetic coding sequence
atgtctggtcgacagcgaacactctttcaaacttggggaagttcaatcagcagatcttcggggacacctggctgtagtagcggcaccgagagaccccaatccccaggtagttcaaaagccccactgccggcagccgctgaggcacaactcgaaagtgacgacgatgtcttgctggttgcagcttatgaggccgaacgccagctgtgtttagaaaacgggggattctgcaccagcgctggagcattgtggatctacccaaccaattgtcctgtgagggattatcaattacatatatcccgcgcagcgctgttctgtaacacattggtgtgcttgcccaccggcctaggcaagacctttatagccgcagtggtaatgtacaatttttatcggtggttccccagcggaaaggtcgtcttcatggctccgactaaacccctggttacccagcaaatcgaggcatgctaccaagtcatgggtattccccagagccatatggctgagatgacagggagcacccaggcgtcgacgagaaaagagatttggtgcagcaagagagtcctgttcctgacaccccaggtcatggtgaatgacctttccagaggggcatgccctgctgccgagattaaatgtttagtgattgacgaggcgcataaggctcttggcaattatgcttactgccaggtggtgagagagttagtcaaatacactaatcacttccgtatacttgccctctcagccacacctgggagcgatattaaggccgtgcagcaggtcatcaccaatttgcttatcggacaaatagaactgagaagcgaggactcacctgacattctcacgtactctcatgagcgtaaggtggagaaactgatcgtgccactaggcgaggaactcgcagctatccagaagacctacatccagattctagagtctttcgcacgctccctgatccaacggaacgtccttatgcggcgagatattccaaacctcacaaaatatcaaatcattctggcccgagaccagtttagaaaaaatccttcacctaacatcgtgggcatccagcaagggatcatcgagggggaattcgcaatttgcatctcgctgtaccatgggtacgagctgctgcagcaaatggggatgcggtctctctactttttcctatgcgggatcatggatggaacgaagggcatgacacgctcaaagaacgagttaggccgaaatgaggattttatgaaactgtataatcacctggaatgtatgttcgccagaacgcggagtaccagcgccaacggtatttctgccatccagcagggtgacaagaacaaaaaatttgtgtactctcaccccaagctgaaaaagttagaagaggtggtcattgagcatttcaaaagttggaacgcggagaataccacagagaaaaagcgcgacgaaacaagggtgatgattttttcctcatttcgcgatagcgtccaggaaatcgcagaaatgctgtctcagcatcagccaattattagagtaatgacgttcgtgggtcacgccagtgggaagtcaacaaagggttttacacagaaagaacagctcgaggtggtcaaacaatttagagatggcggatataacaccttggtctcaacttgtgtgggtgaagagggcctagacattggcgaagtcgatctgattatttgttttgattctcagaagagcccaattcgcctggtgcaacgcatgggtcggactgggcgaaagagacaaggacgcattgtcattattctgagtgagggacgtgaggagcgaatttacaatcagagccagagtaataaacggagcatctacaaggcaatttccagtaatagacaggtgctccacttctatcagcgctccccacgcatggtgcccgacggcataaatcccaaattgcacaaaatgtttataacccatggcgtttatgagcctgagaagccgagcagaaaccttcagcgtaaatcaagcatcttctcttatcgggacgggatgcgtcagtcaagtcttaagaaggactggtttttgagcgaggaggaatttaagctttggaataggctgtatcggttaagagactccgatgagatcaaggaaattaccctgccacaggtgcagttttctagcctccaaaatgaggaaaataaacccgctcaggaaagtacgactggtatccaccagctgtccctgtccgaatggagactgtggcaggaccatcccctccccactcaccaggtagatcactccgacagatgtcgccactttattgggctgatgcagatgattgagggaatgcgccacgaggaaggagagtgctcttacgagctcgaggtggagtcttatctgcagatggaggacgtgacatcaacattcatcgccccaagaaacgaaagtaacaacctggcttccgacacttttattacccataagaagagcagtttcatcaaaaacattaaccagggctcatcgtcctcggtaatcgaatctgatgaggagtgcgcagaaatcgtgaaacaaacacacattaagcctaccaagattgtcagcttaaaaaagaaggtcagcaaagagatcaagaaagaccaactcaagaaggagaacaatcatggcatcattgatagcgtggataacgaccggaactccacagtggagaatatttttcaggaggacctacctaacgacaaacgaacttccgatactgacgaaatagccgcaacttgtaccattaatgaaaatgtgattaaggagccttgtgtattactgaccgaatgccagttcaccaataaatccacatccagcttggccggtaatgtgcttgactccggctacaacagctttaacgacgagaaatcagtgtcatctaatctctttcttcctttcgaggaggaactctatattgtaagaaccgacgatcagttttacaactgtcactctctgaccaaggaagtgttggctaatgtggagagattcttatcttactcccctccaccacttagcggactttcggatctggagtatgagattgcgaagggcactgcgcttgaaaacttactttttctcccctgcgctgagcatctcagatccgacaagtgtacctgtctattgtcccactcggccgtcaattcccagcaaaatctggaattgaattccttgaaatgtataaattatccgagcgagaaatcgtgtttgtacgacattccaaatgacaacattagcgacgagccctcactctgtgactgcgacgttcataagcacaatcagaatgaaaacctagttcctaacaaccgggtacagatccaccgatcccctgcgcagaacctggtgggcgaaaacaatcacgacgttgataactctgacctccctgtcctgtccactgaccaggacgaaagcctactgctgtttgaagacgtcaacactgaatttgacgatgtttccctttctccattgaactcaaaatccgaaagtctgccggtgagcgataagacagcaatcagtgaaactcccctggtgtcacagttcctcattagtgatgaactgctcttagataacaacagcgagctgcaggatcaaataacaagggacgctaattcctttaaatcaagagaccagcggggagttcaagaggaaaaggtaaagaaccatgaagacattttcgactgctctcgcgacctgttttccgtgactttcgacctggggttctgtagcccagacagtgatgatgaaattctggagcatacaagcgatagcaaccggcctttggatgacctgtacggaagatacctggaaattaaggaaatttctgacgcaaactacgtgtccaaccaggctttgatcccacgcgaccactctaagaatttcacctcgggcaccgtgatcatcccttccaatgaagatatgcagaatcccaattacgtccacctgcccctaagcgctgctaagaatgaagagctgctcagtccagggtactcccagttctccttacccgtgcagaaaaaggtcatgagcacccccttgtcaaagtccaatactttgaatagtttcagtaagatcagaaaggaaatcctcaaaacccccgatagctccaaggaaaaagtcaacttgcagagattcaaggaagccctcaacagcaccttcgactattccgaattcagcctggaaaagtcaaaatcttccggcccaatgtacttacacaagtcttgtcattcagtagaagacggccaactgctcaccagtaacgaaagtgaagacgacgaaatattcaggcgcaaggtgaaaagagctaagggcaacgtgctgaacagccccgaggaccaaaaaaattccgaagtcgattccccactgcatgccgtgaaaaagcgacggtttcccataaataggagtgagctgagcagcagcgacgagtctgagaatttcccgaaaccatgcagccagctggaggattttaaggtgtgtaacggtaacgcccgacgtggaatcaaggtccctaaacgccaaagtcatctcaagcacgtggcaaggaaatttttggatgatgaggccgaactgtcagaggaagacgccgaatatgttagttcagacgaaaacgacgaatcagagaatgagcaagatagttcgctgctggacttcctcaacgatgaaacacaactctctcaggccattaacgattccgagatgagagcaatttatatgaagtctctccggagtcccatgatgaataacaaatacaagatgatccataaaacccataagaacattaacatcttttcccagattcccgagcaagacgagacctacctggaagacagtttctgtgtggatgaggaagaatcctgcaagggtcagtcctctgaggaggaggtttgcgttgacttcaatcttattacagacgactgctttgccaattctaagaagtataagacccgccgtgccgtcatgttaaaggagatgatggaacaaaattgtgcacactcaaaaaagaagttgtcacgcataatactgccggacgattcctctgaagaggagaacaatgtgaatgataaaagagaaagcaatatcgccgtgaacccttcgaccgttaagaagaataagcagcaggatcattgtcttaacagtgtcccctctgggtcttccgcacagtccaaggttcgctcaacccccagagttaacccacttgcaaagcagagcaaacagacctccctgaacctcaaagacacaatttctgaagtctctgattttaagcctcaaaatcataatgaagtacagtctacgaccccgcctttcaccacagttgactctcagaaggattgcagaaagttccccgttccccaaaaggatggatccgcactggaggattcctccacgtcaggcgcaagctgcagcaagtccaggccacacctggctggaactcatacttccttgagactacctcaagagggaaagggcacctgcatcctggtcgggggacacgagatcacgtctggactggaagtgataagctctctcagggctatacatggactgcaggttgaagtctgccccctgaatggctgtgactatattgtttctaatcgaatggttgtggagagacggagccaaagcgaaatgctgaacagcgtgaacaagaataaattcatcgagcagattcagcatctgcagtccatgtttgagcgcatctgcgtgatcgtagaaaaagaccgggaaaagactggagacacgagcaggatgttccgcaggaccaaaagctacgattcacttctgaccaccttaatcggtgcaggaatcaggatcctgttcagcagctgccaggaggaaacagcagacttgttgaaggagctgagcctcgtcgagcagcgtaaaaacgtggggatacatgtacctactgtggtaaattcaaacaagagtgaggctctacaattctatctctccatccctaatatatcttacatcactgctctcaatatgtgccaccagtttagttccgtcaagaggatggccaattcgagcctccaggaaatttctatgtacgcccaggttacgcatcagaaagctgaagagatctacaggtatattcactatgtctttgatatccagatgctccctaatgacctgaaccaggaccgtttgaaaagcgacatata

SEQ ID NO: 222844 - DNA, 2010 bp, Artificial Sequence
  Description of Artificial Sequence: Synthetic coding sequence
atgtcaggacgtcaacgaacactctttcagacctggggttcatcaatttcccggagctccgggacaccaggctgctccagtggcaccgagcgcccacagagcccagggtcgtcaaaggccccactgcctgctgccgcagaggcacagctcgagagcgacgatgatgtactccttgtcgcagcttacgaagctgaaagacaactctgtttagaaaatggaggcttttgcacaagcgccggagccctgtggatttacccaactaattgccccgtgcgagattaccagctgcacatctcccgggcagcgctgttctgcaataccctggtgtgtctccccactggtctcggcaagacattcattgccgcagttgtgatgtataacttctatagatggttcccatctgggaaagtggttttcatggccccaactaagcccctcgtcacgcagcaaatcgaggcttgctaccaggtgatgggcatcccacagagccacatggctgagatgacaggctccacacaggcttctacaaggaaggagatttggtgcagtaagagggtcctgttcctcaccccgcaagtgatggtgaacgacttgtcgaggggtgcctgccccgctgcagagatcaaatgcctggtcattgatgaggcacacaaggcactggggaactacgcttattgccaggtggtccgggaactggtcaagtacacaaaccactttagaatcctggcactcagcgccaccccaggcagcgatataaaggccgtacagcaggttattacaaacctgctgattggccagattgagctgagaagcgaagactcccctgatatcttaacctacagccacgagcgaaaggtggaaaagctgattgtgccactcggagaagagctggcggctatccaaaaaacctatatccagatcttggagtcttttgcccgtagccttattcagcggaacgtgctaatgcgccgagatattcccaacctgaccaagtaccaaattattctggcccgtgaccagttccggaaaaatccttcccccaacatcgtgggaatccagcagggcatcatagagggggaatttgccatctgcatttccctgtatcacggctacgaactccttcagcagatgggaatgcggtcgctgtatttcttcttgtgtggcatcatggatgggacaaagggcatgactaggtcgaagaatgagctgggtcgaaacgaggactttatgaagctgtataatcacttagagtgcatgttcgctagaactagatccacgtcagccaatggtattagtgctattcagcaaggtgacaaaaacaaaaaattcgtctacagccaccccaagctaaagaaacttgaagaagtggtcattgaacatttcaagagctggaatgcagaaaatacaacagagaaaaaacgtgatgaaactagagtgatgattttctcttcatttagagacagcgtgcaggagattgccgagatgctcagccagcaccaacccattattagagtgatgacattcgtgggccatgcttcaggtaagtctacgaaggggtttactcagaaggagcaactcgaggtggttaagcaattccgcgatggcggatataacactttggtaagtacctgtgtcggcgaagaaggcctagatattggtgaggtggaccttatcatttgctttgactcccaaaaatcccctatacggttggtgcagagaatgggtagaacaggtcgcaaacgacagggacgcatcgtaataatcttatccgagggcagagaggagcgcatctacaaccagagccagagcaacaagagatcgatctataaggccatcagtagcaaccgccaagtcctccatttttatcagagatctcctaggatggtgcccgatgggatcaatcctaaactacacaagatgttcatcacccacggggtgtacgaacccgaaaaaccgagtcgcaatctgcagcggaagtcttcgattttctcctaccgggatggcaagtag

SEQ ID NO: 222845 - DNA, 1968 bp, Artificial Sequence
  Description of Artificial Sequence: Synthetic coding sequence
atggccgactacagcactgtccccccacctagcagtggatctgctggaggcggtggagggggtggaggaggcggtggagtgaacgacgcctttaaagatgccttgcagagggctagacagatcgccgcaaaaattggtggagacgccggtacaagcctcaactccaatgactacggatacggcggtcaaaagcgtcctctcgaagatggtgatcaacccgacgctaagaaggtagcgccacagaacgacagctttggcacacaattgccaccaatgcaccaacagcagtcacgctccgttatgacggaggaatacaaggtgccggacgggatggtaggatttattatcggcaggggcggagagcagatttcaagaattcagcaggaatctgggtgcaagattcagatagcacctgattctggtggcctgcccgaacggtcctgtatgttgacaggcactcccgagtctgttcagtccgccaagcggctcctggatcagatcgtggaaaagggtcgacctgccccaggcttccaccatggagacggtcccggaaacgctgtgcaggaaattatgatacctgcttccaaggcaggattggtcattggcaaaggtggagaaactatcaagcagcttcaggaaagagctggggtcaaaatggttatgatacaggatggacctcagaatactggcgctgataagcccttgaggatcaccggagatccatacaaggtacagcaggccaaggagatggttctggagctgattagagatcagggcggatttagagaggtaaggaacgagtatggtagcaggatcggcggtaatgaaggcatcgacgtacccatcccaagatttgctgttggtatagtgattggacggaatggggaaatgatcaaaaagattcaaaacgacgccggagtccgcattcaattcaaacctgatgatggaaccacccctgaacgcatcgctcagatcactggcccacccgacagatgtcaacatgcagccgagatcattacagatctgctccgctccgttcaggctggcaaccccggaggaccaggcccaggaggcagaggcagagggagagggcagggtaattggaacatgggcccacccggaggcctgcaggaattcaattttattgtgccaaccggcaagaccggacttatcatcgggaagggcggagaaactatcaagtcaattagccagcagagcggagccagaattgaactccagcgtaatccccctccgaatgccgatcctaatatgaagcttttcaccatccggggtactccccagcagatcgactacgcacggcaactgattgaagaaaaaatagggggtcctgtgaaccccttgggccctccggtgcctcatgggcctcacggagtgccaggccctcatggacctcccggaccaccgggaccaggtactcctatgggcccatacaaccccgctccatacaatcctggaccaccagggcctgctccacacgggcctcctgcgccttatgcccctcagggttggggcaacgcatatcctcattggcagcagcaggcccctccggatcccgctaaggctggcaccgatccaaattccgctgcctgggccgcttactatgcccactactatcagcagcaggcccagccaccccctgccgctccagctggtgctcctaccacgacccagacaaacgggcagggcgaccagcaaaatcccgcacccgctggccaggtagactacacaaaggcctgggaagaatactataagaaaatgggtcaggcggttccagcaccaaccggggcacccccaggtggacagcccgattactcagctgcttgggcagaatactatcgccagcaagccgcatattacgctcagacatcgccccagggcatgccccaacacccccctgctccccaaggctttgcaaaccatgctcgctcccaccatcatttgtactag

SEQ ID NO: 222846 - DNA, 1935 bp, Artificial Sequence
  Description of Artificial Sequence: Synthetic coding sequence
atggcggactatagtactgtgccacccccaagctcaggatcagcgggtgggggtggcggaggaggcggagggggtggcgtgaatgatgcattcaaggacgctctgcagcgggcacgtcagattgctgccaagattggcggagacgctggaacttcactcaactcaaacgattacgggtacggcggacaaaaacgcccactcgaagacggcgatcagcccgacgctaaaaaggtcgctccgcaaaatgactcatttgggactcagttgccaccgatgcaccagcaacagtccaggagtgtcatgaccgaggaatacaaagtacccgatggaatggtaggcttcattatcggccgtggtggggagcagattagtagaattcagcaggagtctggctgtaagattcagatagcccctgacagcggagggctgcctgagagatcatgcatgttaacagggactcccgaatctgtgcaaagcgcaaaaagactgctcgaccagatcgttgaaaagggtcgccctgcccctggctttcatcacggggacggcccagggaatgccgttcaagaaataatgattccagccagcaaagcagggctggtgattggtaaaggcggtgagactatcaaacagctgcaagagcgggctggggttaagatggtcatgatccaggacggtccccaaaacactggggcagacaaacctctgcgcattactggcgacccttataaagtacagcaagctaaggaaatggttctagagttgatacgcgatcaagggggattccgtgaggtccggaatgagtatggctcacggataggcggaaacgaaggaatcgacgtgcctatcccccgtttcgctgtaggtatcgtaatcggtcggaatggggagatgattaaaaagatccagaatgatgccggtgttcgcatccagttcaagcccgacgacggcactacacccgagcggatcgcgcaaattactgggcctcctgacaggtgccagcatgctgccgagattataaccgatctccttaggtcagtccaggccggaaacccaggaggtccaggcccaggaggccgaggcagaggcagggggcaggggaactggaatatgggaccacctggtggactacaggagttcaacttcatagtgcccaccggtaagacaggcctgattatcggaaagggcggtgagaccatcaagtcgattagccagcagtccggagcccgaatcgagcttcagaggaaccctcctcctaacgctgatcccaacatgaagctttttactattcgagggactccacaacagatcgactatgcgaggcaactgattgaggagaaaatcggcggtccagtgaacccgcttggtcctcctgtgccgcacggccctcacggtgtacctggcccacatggaccacccggaccccctgggcctggcacccccatgggaccctacaaccccgctccctacaacccaggccctcctggccctgcccctcacgggcctcctgccccatacgctccacaaggttggggaaatgcgtacccgcactggcaacaacaggcaccacctgaccccgcaaaagcgggaacagacccaaactcagccgcatgggcggcttattatgcccactactatcagcagcaagcacagccccctcccgcagcaccggcaggggctccaacaaccacccagacaaacgggcagggggaccagcagaaccccgctcctgcaggccaggtcgactacacaaaggcatgggaggaatattacaaaaagatgggccaggctgtccccgcacccaccggagccccacctggaggtcagcccgactatagtgccgcatgggccgagtattatcggcagcaggcggcttactacgcacagaccagcccccagggaatgccgcaacacccccctgcgcctcagggtcaatag

SEQ ID NO: 222847 - DNA, 1965 bp, Artificial Sequence
  Description of Artificial Sequence: Synthetic coding sequence
atggctgactacagcaccgtgccaccaccttcctcaggcagtgcaggcggagggggaggcggtggcggaggaggtggggtaaacgacgccttcaaagacgcactacagcgggctagacagattgcggctaaaataggtggggacgcaggaaccagccttaatagcaacgattatgggtatggcggacagaaaagaccgctggaggacggcgaccagcccgatgcaaagaaagtggcccctcagaatgacagcttcggtactcagttaccccctatgcatcagcaacaaagatccgttatgacggaggaatataaggtgcccgacggcatggtgggtttcattatcggcagaggaggagagcaaatatccaggattcagcaggagagcggttgtaaaattcagatcgcccctgattctggaggcctaccggagaggtcctgcatgctcactggaacgcccgaatcggtacagtccgctaaacggctgttagaccagattgttgaaaagggacgccctgcacctggatttcatcacggcgacgggccagggaacgccgtccaggagatcatgattccggcatcaaaagccggtctcgtgatagggaagggcggtgaaacaattaaacagctgcaagaacgggcaggggttaaaatggtgatgatccaagatgggccacagaacacaggtgccgacaaaccgctgcggatcaccggtgatccctataaagttcaacaggctaaggaaatggtgttagaattgatcagggatcagggagggttccgcgaggtgcgaaatgaatatggcagtcgaatcggaggaaatgaaggaattgacgtgcccatcccgcgatttgcagtgggaatcgtcattggccgtaatggagagatgatcaaaaagattcagaatgacgctggcgtgcgtatccagttcaaacctgacgacgggaccacccctgagagaatagcccagataaccggacctccggaccgatgtcaacacgcggctgaaataattaccgatttactgagatccgttcaggctggtaacccagggggtcccggtcctggcggacgcggaagaggacgtgggcagggaaattggaatatgggtcccccaggcggactccaagaattcaatttcattgttccgaccggaaaaaccggcctaatcattggtaagggcggagaaaccatcaaatcaatctcccagcagtctggagccaggattgagctccagagaaatccaccccctaacgcagaccccaacatgaaactgtttacaattcgtggcacaccacaacaaattgattacgctcgccaactgattgaggagaagatcgggggaccggtgaacccactgggtccccctgtcccccacggaccccacggggtccctggccctcacggtcccccaggaccgccagggccaggaaccccaatgggaccctataacccagccccttacaaccctggacccccaggcccagcccctcacggtccgcctgctccctatgcacctcaaggttggggtaacgcctatcctcattggcaacagcaagcacccccagaccctgccaaagctggaacagaccctaactctgccgcatgggctgcatactacgcccattattatcagcagcaagcgcagccgcctccagctgctccagcaggggctcccacaacgacccagacgaacgggcaagaaggcgaccagcagaatcccgcacctgctggacaagtcgactatactaaggcttgggaggagtactacaagaagatggggcaggctgtgccagctcccacgggtgctccaccgggagggcagcctgactactccgctgcctgggcagagtactatagacagcaggccgcatactatgcacagacgagcccccagggaatgccacaacaccctcccgcaccccagtgccgtttcgaccccgcttccatagagctggcgctgtag

SEQ ID NO: 222848 - DNA, 1890 bp, Artificial Sequence
  Description of Artificial Sequence: Synthetic coding sequence
atggccgattacagcaccgttccccctccatcctccgggtccgccggagggggaggcggaggcggtggaggaggtggcgtcaatgacgcgttcaaggacgctctgcagagggccagacagattgcggctaagataggcggagacgcaggaacttccctgaatagtaacgactatgggtacggaggtcagaagagacctctcgaggatggcgaccagcctgacgctaagaaagtggcccctcaaaacgactctttcggtacccagctcccaccaatgcatcaacagcagcggtcggttatgaccgaagaatacaaagtgcctgacggcatggtcggctttataatcgggagaggaggagagcaaattagcaggattcagcaggaaagcggatgtaagatacagatcgccccagactccggaggtttgccagagaggtcatgtatgttaacgggcaccccagagtctgtacagagtgccaagagattgctggaccaaatcgtagagaaaggcagacctgctcccggatttcaccacggtgatgggcctgggaacgccgtccaggaaatcatgataccggcatccaaagcgggtctggtgattggcaaagggggagagactattaagcagctacaggagagggcaggtgtgaagatggtaatgatccaggacggcccacagaatacgggcgctgataaacctctccgtattaccggggacccctataaagtccagcaggccaaggagatggtcctggagctgattcgtgatcagggtggattcagagaggttagaaacgagtatgggagccgcattggcggtaacgagggaattgacgtcccgatacctcgctttgccgtaggtatcgtgatcgggaggaatggcgagatgattaagaaaattcagaatgacgctggggtgagaatacagtttaaacctgatgatgggaccaccccagaacgcattgcccagatcaccggacctccggaccgttgccagcacgctgcagagattataactgacctgctgcgctccgtgcaggccggtaacccaggcggaccaggcccaggcggaaggggacgtggcagggggcaggggaactggaacatggggccacctggcggattacaggagttcaactttattgtgccaactggaaagacaggcctgatcattggcaaaggcggtgaaactataaagtccatttcacagcagtctggggctcgaattgaacttcaaaggaacccgccacccaatgccgacccaaacatgaaattgtttaccattcggggaacacctcagcagattgactacgccagacagctgattgaagagaagattggtggaccagtgaatccgcttggtccacctgttccacatggcccaccaggcactccgatgggcccatataatcccgctccctataacccagggcctccgggtccagccccacatgggcctcccgctccatatgctccacagggctggggcaatgcttacccacactggcaacagcaagctcctcccgaccccgctaaggctggcacagacccaaattctgctgcatgggcggcatattatgcccattactaccagcagcaagcccaaccccctcctgctgctcccgctggcgcaccaactacaacacagaccaacggacagggtgaccagcagaatcccgctcccgctgggcaggtcgactacactaaagcttgggaggaatattataagaaaatgggccaggcggtcccagcacctaccggcgcaccacctggtgggcaaccggactactcagcagcctgggcagagtattatagacagcaagcagcttactacgcccaaaccagtccacagggcatgccacagcacccaccggcaccacagggacaatag

SEQ ID NO: 222849 - DNA, 699 bp, Artificial Sequence
  Description of Artificial Sequence: Synthetic coding sequence
atggcagattatagtacagtccccccacctagcagtgggtccgcaggaggcggaggcggaggaggtggtggaggtggtgtaaacgatgcatttaaggatgccttacagcgggcaagacaaattgcagccaagatagggggagatgctggaacgagcctcaattccaatgattacggttatggtggccagaaacgaccattagaagatggcgacggcagctggacgagccccagtagcactactcactgggaaggcatgccatccccattcaaagatcagcctgatgccaaaaaagtggccccacaaaacgacagctttggaacacagctccccccaatgcaccagcagcagaggagtgtgatgaccgaagaatacaaggtgcccgatggaatggtaggattcattatcggacggggtggggagcagatcagccgcatccaacaggagagtggatgtaaaatccagattgcacctgacagcggaggcctgcccgaacgctcttgcatgctgacgggaaccccagagtctgtgcagtccgcaaaacgcctgttggaccaaatcgtcgaaaagggtagaccagctcctgggtttcaccatggagatggccctggcaacgcggtgcaagagatcatgattccagccagcaaagcaggcctggtgattggtaaggggggtgagaccatcaaacagctacagtag

SEQ ID NO: 222850 - DNA, 1998 bp, Artificial Sequence
  Description of Artificial Sequence: Synthetic coding sequence
atggctgactacagcacagtgcctccccctagctctggatctgcgggaggagggggaggaggcggtgggggtggtggcgtgaatgacgcttttaaggacgctcttcagcgggctaggcagattgctgccaaaatcggtggtgatgccggtacgagtttgaactcaaacgattacggctatggaggtcagaaaagacccttggaggatggtgatggatcttggacgagcccctcctccactacccactgggagggcatgccgtcaccttttaaggatcagccagatgcaaagaaggtcgcacctcagaatgactccttcgggacacagctgcccccaatgcatcaacagcagtccagatctgtgatgactgaggaatataaagtgccggatggaatggttggctttatcatcggaagaggcggagagcagatctcccggatccagcaagagagtggctgcaagattcaaattgccccagatagtggtggcctacctgagcggagctgcatgctcaccgggactcccgagtcagtgcagtcggcaaagcggctgcttgatcagatcgtggaaaaagggcgtccggctccgggttttcatcacggcgacgggccaggaaatgccgtgcaggagatcatgattcccgctagcaaggccggtcttgtcattgggaaaggaggcgaaaccatcaaacagctgcaagagagagccggagtgaaaatggtgatgatccaggacggccctcagaatactggagccgacaagccactgaggataacgggcgatccgtacaaggtccagcaggccaaggagatggtgttagagctgatacgcgatcaggggggatttcgcgaggtcagaaacgagtatggcagccggattggagggaacgaaggcattgatgtgcccattcctagattcgcagtgggaattgtgatcggtagaaacggagaaatgatcaaaaaaatccaaaacgacgcaggcgttaggatccagtttaagccagacgatggtacaacacctgagcgaatcgcccagatcaccggaccacctgatcgatgtcagcatgcggcagagatcatcactgaccttctccgatccgtgcaggctggcaaccccggaggtcccggacctggcggaagggggagaggcaggggtcagggcaactggaacatgggcccaccaggaggactgcaggagtttaactttatcgtgcccacaggaaagacgggcttaattataggaaaggggggtgagactatcaagtccatttcccagcaatctggcgcacgtatcgaactgcagagaaacccacccccaaatgcagacccaaacatgaagttattcacaatccggggtactcctcagcagattgattacgcccgacagctgatagaggagaagatagggggacctgtgaaccccctggggcctcccgtaccgcacggaccccacggtgtgcccggaccccacggccctccgggaccgcctggaccaggcacaccaatgggaccatacaacccagccccttacaatccaggacctccaggaccggctccccatggaccgccagccccatatgcaccccaggggtggggcaatgcctatccccattggcagcagcaggctcctccagatccagccaaagctggaaccgaccccaatagcgccgcatgggctgcttattacgcgcactactaccagcagcaggcccaaccacctccagccgcacccgcaggagctcctacaactacacagaccaacggacagggcgaccagcagaatcccgcacccgcagggcaggttgattacactaaagcttgggaagagtattacaaaaaaatgggtcaggccgtgcccgctcccacgggcgcacccccaggaggacagccggactactccgccgcttgggctgagtactatcgtcagcaagccgcttactacgcgcagacctccccacagggcatgccacagcacccaccagcaccccagggccagtag

SEQ ID NO: 222851 - DNA, 1260 bp, Artificial Sequence
  Description of Artificial Sequence: Synthetic coding sequence
atgcctttgtctagatggcttagatcagttggagtattcctgctgcctgcgccttactgggctccgagagagaggtggctgggcagtctgcgaaggcccagtctagtccacggctatccggtgctggcatggcactccgccaggtgttggtgtcaggcctggacagaggagcctcgcgctctctgcagttctctgcggatgaacggagatcagaatagcgatgtctacgcccaggaaaaacaggacttcgtccaacacttcagtcagatagttcgagtgctgaccgaagacgaaatgggccatccagagataggagacgctatagcaagactgaaggaagtactggaatacaacgccattgggggtaagtataatagggggctgaccgtagtcgtcgctttcagagagctagtagagcccagaaagcaggacgccgactccttgcagcgggcttggaccgtgggttggtgcgtggagctgcttcaggctttttttttggttgccgatgatatcatggattcctcactgaccaggaggggtcagatctgttggtatcagaagcccggagtggggcttgatgctatcaacgatgctaacctgctggaagcctgcatctatcggctgctgaagctctattgtcgcgagcagccttactacctgaatctcatcgaattatttctgcagagttcttaccagacagagattggccagacgctcgacttgctaacagccccacagggcaacgtggacctggtgcggttcactgagaagcgctataaatctatagtgaagtacaaaacagctttctacagtttttatttacctattgccgcagcgatgtacatggcgggtattgacggggagaaggagcatgccaatgcaaaaaaaatactgctggagatgggtgagttcttccaaatccaggatgattaccttgacctgtttggcgatccttctgtgaccggcaagatagggactgacattcaggacaataaatgcagttggctggtcgttcagtgtcttcagcgagccaccccggagcagtaccagatcctaaaggagaactacgggcagaaggaggccgagaaggtggctagagtaaaggccctgtatgaggagttggatctgccagccgtttttctgcagtacgaagaagatagttattctcacatcatggcattaattgagcagtatgcggctcccctgcctcccgcagttttcctcggactggcgagaaagatctataaaaggcggaagtag

SEQ ID NO: 222852 - DNA, 1260 bp, Artificial Sequence
  Description of Artificial Sequence: Synthetic coding sequence
atgcctttgagtagatggctccgatcggtaggggtgttcttgttacccgcaccatactgggcacccagagaacgatggttggggtctctaagacgcccatcactggttcatggctatcccgttcttgcttggcattctgcgaggtgttggtgccaagcatggactgaggaaccgagagcactgtgctcctcgctgcgtatgaatggggatcagaattctgatgtgtatgcccaggaaaagcaggatttcgttcagcatttcagtcagattgtgagagtattgacggaggatgaaatggggcaccccgaaatcggtgatgcgatcgccagacttaaagaagttctagaatacaatgctatcgggggaaagtacaaccggggactgaccgttgtcgtagcattccgcgaactggtggaacctcgtaaacaggacgccgactctctgcagcgtgcatggacagtgggttggtgcgtagaactgctgcaagcctttttcttagtcgccgatgacattatggatagttccttaactaggcgcggacagatctgttggtatcagaagcctggcgtcggcctcgacgccattaacgacgctaatctcctggaggcctgcatttatcgtctgctgaagctctactgtcgagagcagccttactatctcaacttgattgaattatttttgcagtcttcttatcaaaccgaaattggacagacactggacctgttgactgccccacaggggaacgtggacctcgtccgctttacagaaaaacggtataaaagtattgtgaagtataagactgccttctatagcttctacctacctatagcagctgccatgtacatggctggaatcgatggcgagaaggaacatgcaaacgctaagaaaatcctcttagagatgggggagtttttccagatccaggacgactacttggacctgttcggtgacccctcggtgaccgggaagattgggacagatatccaggataacaaatgtagctggctcgtagtgcagtgtctgcagagagctacacctgaacagtaccagattctcaaagaaaactacggccaaaaggaggctgagaaggtggcacgcgtaaaggctctctatgaagagctagatctcccagccgtgtttttacagtatgaagaggactcctacagtcacattatggcactcatcgagcaatatgccgctccacttccccctgcagtgttcctcggcctggcccgtaagatctataagagaagaaagtag

SEQ ID NO: 222853 - DNA, 1062 bp, Artificial Sequence
  Description of Artificial Sequence: Synthetic coding sequence
atgaacggtgaccagaattccgacgtatatgcacaggaaaagcaggactttgtgcaacactttagtcaaatcgtgagagtgctcactgaagacgagatggggcacccggagattggcgacgcaatcgccagactcaaagaggttctggaatacaatgcgataggtgggaagtacaatcgcggattaaccgtcgtcgttgcattcagggaactagtcgagcctcggaagcaagatgccgacagcctgcagagagcttggaccgtggggtggtgtgtggagctgctgcaggcctttttcctcgttgccgacgacatcatggactctagtctcacccggagggggcagatctgctggtatcagaagcctggggttggccttgacgcaataaacgacgctaacctgctcgaagcttgcatctatcggcttctcaagttatattgtagagaacagccatactacctgaacctgatcgaactgttcttacaaagcagttatcagaccgaaattggtcaaactcttgatctcttaaccgctccccaaggaaatgttgatctggtgcggtttaccgagaagcgatataagtcaatcgtcaaatataagacggcattttactccttctatctgccaattgctgccgcaatgtatatggcgggaatagatggcgagaaagaacacgctaatgccaaaaagatcttactggagatgggagagttctttcagattcaggacgattacctggatctgttcggtgacccatcagtgacaggcaagatcggcacagacatccaggacaataagtgcagctggctcgtcgtgcaatgtctgcagcgcgctacaccagagcaatatcaaatcctcaaggagaactatggacaaaaagaggccgagaaggtggccagggtcaaagctctctatgaagagctagatctacccgctgtctttttgcaatatgaggaagattcatactcacatatcatggctctgatcgagcagtatgcggcacccctgccacccgctgtatttctcggcctggctagaaagatttataagagaagaaaatag

SEQ ID NO: 222854 - DNA, 2760 bp, Artificial Sequence
  Description of Artificial Sequence: Synthetic coding sequence
atgactggatacacaatgctgcggaacggcggagctgggaacgggggacaaacttgcatgctgagatggtctaataggatccgattaacctggttgagcttcactttgtttgttattttggtgtttttccccctgatcgcgcactactacctcaccaccctcgacgaagccgatgaggccggaaagaggatttttggtcctagagtgggcaacgaattatgtgaagtgaagcacgtgctggacctttgccgtattcgggagtcagtgagcgaggaacttctccagctagaagcaaaaaggcaagaactcaacagcgaaattgcgaagctgaacctcaagatagaggcctgcaaaaagtctatcgagaatgccaagcaggaccttctgcaactgaagaacgtcatttctcagacagaacattcttataaagaactgatggcacaaaaccagccgaagcttagccttcctatcagacttctccctgagaaggatgacgccggactgccccctccaaaggcaactaggggttgtagactgcataattgtttcgactactctcgctgcccactgacatctggcttcccggtgtacgtttacgatagtgaccagttcgtattcggttcctacctggatcctttggtgaagcaggcttttcaagccacagccagagccaatgtttacgtgacagagaacgctgatatcgcctgcttgtacgtcatccttgttggtgagatgcaagaaccagttgtactgaggccagcggaactggaaaaacagctgtatagtctgccacattggagaactgatggtcacaaccacgtgattatcaacttgagtcggaagagcgatactcagaatcttctctataatgtgagcaccgggagagcaatggtggcccagagtaccttttacacagtgcagtataggccaggcttcgacttagtcgtttcaccacttgtgcatgctatgtccgagccgaatttcatggaaattcctccacaggtgccagtgaagcgaaaatatctctttacattccaaggcgagaaaatcgagtctctccgaagcagtttgcaggaggctagatctttcgaggaggagatggaaggcgaccccccagcggattacgatgaccggattatcgctaccctcaaggccgttcaagactcaaagctggaccaggtgctcgtcgaattcacctgtaagaaccagcctaagccttctttgccgaccgaatgggcactgtgtggggagcgcgaggaccggcttgaattactgaagctgagcacatttgcgctgatcattactccgggtgatccaaggcttgttatctcaagtggctgtgctaccaggctcttcgaggctctggaagtgggagccgtcccagtggtgttaggcgagcaggtgcagctaccttatcaggatatgctgcagtggaacgaggcggcactggttgtgccaaagccacgggtgaccgaggtgcattttttgctgcgatccctatctgacagtgatctgctcgctatgcggaggcaaggccgttttctctgggaaacatattttagtacagctgactccatatttaacactgtgctggccatgattaggacgagaatccaaatccctgccgcacccatacgggaagaggccgcagccgaaataccccatcgttcaggtaaggccgcagggacagatcctaatatggcggataacggggatctggacctcgggcctgtcgagaccgagcccccttatgcaagtcctcgctacctgcggaactttactctaacagttacagacttctataggagttggaactgcgcgccaggccctttccatttgtttccgcacacaccttttgatcccgtcctccctagtgaagctaaattcctaggcagtgggacaggttttagacctattggaggaggcgcaggcggatccggcaaagaattccaggcggcactggggggtaatgtgccccgtgagcagtttactgtggtgatgttgacctatgaaagagaggaggtcttgatgaactctctggaaaggctcaacgggctgccatacctgaacaaagtggtggtggtctggaatagcccgaaactgccctcagaagatctgctgtggcccgatatcggagtgccaatcatggtcgttaggaccgagaaaaacagcctgaacaaccgattcctgccctggaatgagattgagactgaagccatcctctccatcgatgacgatgcccacttacgccatgacgaaattatgtttggatttcgcgtatggcgtgaagcccgtgacaggatcgtggggttcccaggtagataccatgcatgggatatcccacaccagtcgtggctctacaattccaactattcatgtgaactatccatggtacttactggcgctgcctttttccacaagtattacgcatatctgtactcctacgttatgccgcaggcaatccgggacatggtcgacgagtacatcaactgtgaggatatcgccatgaacttcctcgtgagtcatatcacccggaagccccctatcaaagtcacaagcaggtggacattccgatgtcccggttgcccgcaggccctgtcccatgacgactcccacttccacgaaaggcataaatgcatcaattttttcgtaaaagtgtatggctatatgcctctcctttacactcagtttcgagttgatagtgtgctgtttaagaccagactacctcatgacaaaacaaaatgtttcaagttcatctag

SEQ ID NO: 222855 - DNA, 1125 bp, Artificial Sequence
  Description of Artificial Sequence: Synthetic coding sequence
atggagttcgtgaaatgtctgggccaccctgaggaattctacaacctcgtacggttcaggattggaggaaagcgtaaggtgatgccaaagatggatcaggacagccttagttcatcactgaagacgtgctataagtatctcaaccaaacctcgaggagcttcgctgcggtgatccaggcattggacggcgagatgaggaatgcggtgtgcatcttctacctggtgctcagggcactcgacacactcgaagatgacatgaccatcagcgttgagaagaaagtgccactccttcacaactttcattcattcctctatcagccagattggcgcttcatggagtcaaaggagaaagaccgccaagtgctggaggacttccccacatattgtcactatgtggcaggcttagttgggatcggcctgagccgtctgtttagtgccagcgaattcgaagaccccctcgtaggcgaggatactgaacgagccaattcaatgggactttttctgcaaaaaactaacattattcgagactatctggaggaccagcagggtggtcgagaattctggccgcaagaagtctggtcacgttatgtgaaaaaactgggtgacttcgcgaagcccgagaatatcgatctggctgtacagtgcctaaacgaactgattacgaacgccttgcatcacattcccgacgttatcacctatcttagcaggttacgcaatcagtcggtgtttaatttctgcgcgattcctcaggttatggccattgccaccttagccgcttgttataacaatcagcaggtgttcaaaggcgctgtgaagatacgaaaagggcaggctgtgaccttgatgatggacgccaccaacatgcccgcagtcaaagctatcatctaccagtatatggaagaaatttaccatcggattcctgacagtgatccaagctctagtaaaactcggcagattatctccaccatccgtactcagaaccttcctaactgtcaactcatctctaggagccactattcaccaatctacctctcttttgtcatgctgctcgcagcgctgagctggcagtatctgactactcttagccaggtgactgaagattacgtgcagaccggtgagcactag

SEQ ID NO: 222856 - DNA, 999 bp, Artificial Sequence
  Description of Artificial Sequence: Synthetic coding sequence
atgaccatatcggtcgagaagaaggtccctctgttgcacaacttccattcatttctataccaacccgattggcgatttatggaatctaaggagaaagaccgccaagtcctggaggactttccgacaataagcttggagttcaggaatttggcagaaaaataccagaccgtcatcgccgatatctgtcgtcgaatgggaatcgggatggctgagtttttggacaagcatgtcacatctgaacaggaatgggacaagtattgtcattacgtggccggactggtgggaattggtctgtcgcggctattcagtgcaagcgagtttgaagaccccctggttggagaagatacggagagagcaaattcaatgggactgttcctccagaagaccaatatcattagggactacctcgaagatcagcaggggggtagggagttttggccacaagaggtctggtcccgttacgtcaagaaactgggtgatttcgccaaacctgaaaacatagacctcgccgtgcagtgccttaacgagcttatcacgaacgccttgcatcatattcccgatgtaatcacctacctgtctaggttgaggaaccagagcgtttttaacttttgcgcaatccctcaagtgatggcaatagcaacactagctgcctgctacaataaccaacaggttttcaagggcgcagtgaaaattaggaaagggcaggcagttaccctgatgatggatgctacaaatatgcccgcagttaaagccataatttatcagtacatggaagagatctaccaccgcattcccgactctgatccctccagttccaagactcgacagataattagcacaattcggacacagaatctccccaactgtcaactcatttctagaagccattactcgccaatctacctgtcctttgtaatgttgcttgccgctctgagctggcaatacttaaccaccctgtcacaggttacggaggactatgtgcaaactggcgagcattag

SEQ ID NO: 222857 - DNA, 1233 bp, Artificial Sequence
  Description of Artificial Sequence: Synthetic coding sequence
atggaattcgtgaaatgcctcggacaccctgaagagttctataacttagtacgattccggataggcggtaaacgcaaagacagcttgtcttcctcgcttaagacctgttataagtatctgaaccagaccagtcgctcattcgccgcagtaattcaggccctcgacggagaaatgcggaacgcagtgtgcatattttacttggtccttcgcgcactcgatactctggaggacgacatgacaattagcgtggaaaaaaaggtcccactcttgcataattttcactcgtttctgtatcagccagattggcggttcatggagtccaaagagaaggacagacaggtcctggaggacttcccgacaatttctttggaattcaggaacctagctgaaaaataccagaccgtgattgctgacatctgcagacgtatggggatcgggatggccgagtttctggacaagcatgtaacctcggagcaggaatgggacaagtactgccactacgtagccggtttagtcgggatcggcctctctcggttgttttcagccagtgagtttgaggaccccctggtcggtgaggataccgagcgggcaaactccatgggtctcttcctgcagaagacaaacatcatccgcgactatttggaggaccaacagggtgggagagagttttggccacaggaggtgtggtcaagatatgtgaagaagctgggagatttcgcaaagccggagaacattgacctcgccgttcagtgtttgaatgaattgataactaacgctctgcaccacatacctgacgtgatcacatacctgagtcgtctcaggaatcaatccgtcttcaatttttgtgccataccgcaagtcatggctatagctacactggccgcatgctataataaccaacaagtattcaaaggcgctgtaaaaattaggaagggccaagccgtgaccttgatgatggacgcaaccaatatgcctgctgtcaaggctatcatataccaatacatggaagaaatttatcaccgaataccggacagtgacccctcaagttctaaaacaaggcagatcatctccactattaggacccagaacctgcccaactgtcagttgatcagccgttcccactactcaccaatttacttatcctttgtcatgctgctcgcggcattgagctggcagtacctgacaaccctgtcccaggtaactgaagactatgtgcaaactggagagcactag

SEQ ID NO: 222858 - DNA, 999 bp, Artificial Sequence
  Description of Artificial Sequence: Synthetic coding sequence
atgaccatcagtgtggagaagaaagtgcctttgctgcacaatttccactcttttttgtatcaaccagattggcgcttcatggaaagcaaagaaaaggacaggcaggtcctggaagattttccgaccatttccttggagtttcgaaacttggccgagaaatatcagactgtgatagcagatatttgcagaagaatgggtattgggatggcggaattcctggacaagcacgtcacctctgagcaagagtgggacaagtactgccattacgtcgccggtctggtggggataggtctctccaggctcttcagtgcatctgagtttgaggaccccttggtcggggaagatacagagagagctaactccatgggcctattcctacagaaaaccaatattattcgcgattacctggaagaccagcagggcggtagagagttctggccacaggaggtctggagtaggtacgtcaagaagctgggtgatttcgccaagcccgagaatatagatctcgccgtacaatgtttaaatgagctcataacaaatgcgctgcatcacatcccagacgtgatcacctacctgtccaggctgcggaatcagtccgttttcaacttttgtgctattccacaggtgatggccattgctacacttgccgcatgttataataatcagcaagtattcaagggcgctgtgaagatccgaaaagggcaggctgttacgcttatgatggacgcgactaacatgcctgcagtcaaagccataatctaccagtacatggaggaaatataccaccgtattccagacagcgatccatctagcagtaaaacgcggcagattattagcactattaggactcaaaacctcccaaactgccagctgatcagccgttcccattacagccccatctatctttcattcgtgatgctgctggccgctttgtcctggcaatatctcacaacactctctcaagtgacagaggattacgtgcagacaggcgaacactag

SEQ ID NO: 222859 - DNA, 1062 bp, Artificial Sequence
  Description of Artificial Sequence: Synthetic coding sequence
atgagaaacgccgtgtgcattttctacctggtgctcagggccctggataccctcgaggacgatatgaccatatccgttgagaagaaggtgcccttgcttcacaatttccattctttcctttaccagcccgattggcgctttatggagagcaaagagaaagaccgacaggtgctagaagacttccctacaatctcgctcgagttcagaaatctcgccgaaaaataccagactgtgattgccgatatctgtcgccgtatgggcatagggatggccgagttcctggataagcatgtaacttctgaacaggaatgggataagtactgtcattacgtggccggactggtgggcattggcctgtcacgcctcttctccgctagcgaattcgaagatcctctggtgggagaagatactgagcgagctaattctatgggcctgttcttacaaaagaccaatatcatacgcgactatctggaggaccagcaaggcggtagagagttctggcctcaggaagtgtggtccaggtacgtgaagaaacttggagactttgccaaacccgagaacatcgacctggccgtccagtgcctgaatgagcttatcacaaacgcactgcaccatataccagatgtgatcacttacctgtcgaggttaaggaatcagtcggtgtttaacttttgcgccatcccacaggtaatggcaattgcaacattggcagcctgttataataaccagcaggtgttcaaaggcgctgtgaaaattaggaagggacaggctgtaacgctcatgatggatgccacaaacatgcctgccgtgaaggcaatcatctatcaatacatggaagagatctaccaccgaattcccgactctgacccctcatcatctaagacaaggcagatcatcagtaccataaggactcagaatctccctaactgtcagctgatctctcggtcacactacagccctatttatcttagtttcgtgatgctgcttgctgcactgtcctggcaatacctaactaccctctcgcaggtcactgaggactacgtgcagaccggggagcactag

SEQ ID NO: 222860 - DNA, 1062 bp, Artificial Sequence
  Description of Artificial Sequence: Synthetic coding sequence
atgcgcaacgctgtgtgcatcttttacctggtgttgcgggcattagatacgctcgaggacgatatgactatttcggtcgagaaaaaggtacccctcctacacaactttcattctttcctctatcaaccggactggcggttcatggagtctaaggagaaggatagacaggtccttgaagattttcctaccatttctttggaattccgcaatctcgccgaaaaatatcagaccgtgattgcagacatctgccgcagaatggggattggtatggctgaatttctggacaagcacgtgactagcgagcaagagtgggataaatactgtcattacgtggcgggacttgtgggcataggcctgagccggctcttctccgctagcgaattcgaagaccctctcgtgggtgaggatacggagagagctaattcaatgggcctattcctacagaagactaacataattcgggattatttagaagaccagcagggtggtcgagaattttggccccaggaggtttggtcccgctacgtgaagaaactgggggacttcgcaaagccagagaatattgatctggctgttcaatgccttaacgagttgatcacaaacgccctgcaccatataccagacgtgattacctacctgagtaggcttagaaatcagtcagtgttcaacttctgtgccatcccgcaggtaatggcaattgccaccctggctgcatgttacaataaccagcaggtgttcaagggagcagtcaaaatcaggaagggccaggctgtaacacttatgatggacgccactaacatgccagcggtaaaagctatcatctaccagtacatggaagagatatatcatcgaattcctgactcagatccctcatcttcgaagacacgccagatcatcagtacaattcgtactcaaaaccttcctaactgtcagctgattagccgctcccattacagccctatttatctgtcttttgtgatgctgctcgctgcgctgtcctggcaatatctgacaactctcagtcaggtgacagaggattacgtgcaaacaggtgagcattag

SEQ ID NO: 222861 - DNA, 921 bp, Artificial Sequence
  Description of Artificial Sequence: Synthetic coding sequence
atggaatctaaggaaaaagacaggcaagtgctggaggatttccccaccatctctctggaatttcgcaatctggccgagaagtatcagacagttatcgcagatatctgcaggcgaatgggcataggcatggcagagttcctggacaagcacgtaacatctgaacaggagtgggataagtactgtcactatgtggccggactggttggtatcgggttaagccgtctttttagtgcttccgagttcgaggaccctcttgtcggagaagataccgagagagccaactcaatgggcctcttcctgcagaaaactaacatcatccgggattatctggaggaccagcagggcggaagagaattttggccgcaggaggtctggagccgttacgtcaaaaagctgggcgacttcgctaagccagagaatattgacttggctgtgcagtgtttgaatgagctgatcaccaacgcgctccaccatatacctgacgtgatcacctacctgagtcgcctgcggaaccagtccgtctttaatttctgcgctattcctcaggttatggccatcgctacactagcagcctgttacaacaaccagcaggtttttaaaggtgctgtaaaaatcagaaagggacaagcggtcacattgatgatggacgccactaatatgccagcagtgaaagccataatttaccaatatatggaagaaatttaccatcgcatccctgattctgatcccagttcgtctaagacaaggcaaatcataagcaccatccggacacagaacctgcctaactgccaactaatcagtaggtcgcactattctcccatttacctcagttttgtcatgctgctggctgctcttagttggcagtaccttaccaccctctctcaagtgaccgaagactacgtccagactggtgaacattag

SEQ ID NO: 222862 - DNA, 1140 bp, Artificial Sequence
  Description of Artificial Sequence: Synthetic coding sequence
atggcagcaaccgaaggcgtgggcgaagcagcccagggcggagagccaggacaaccagctcagccccctccacaaccacaccctcctcctccccaacagcagcataaagaagaaatggccgcagaggctggagaggccgtggcttcaccaatggacgatggttttgtttccctcgactctcctagctatgtcctatatcgggacagagccgagtgggcggacatagatcctgtaccacagaatgatggccctaatcccgtggtgcaaattatttacagcgataaatttcgggatgtttatgattacttccgggcagtcctccagagagacgaaaggtccgagagagcctttaaactgaccagggacgccatcgagctcaacgcagccaattacaccgtttggcactttcggcgtgtgctactgaagtccctccagaaggacctgcacgaagaaatgaattacatcacagctatcattgaagagcaaccaaagaactaccaggtgtggcatcaccggagagtgctcgtcgagtggctgagggacccctctcaagagttggagttcattgcggacatcttaaaccaggatgcaaagaattaccatgcatggcaacaccgtcagtgggtgattcaagagttcaaactgtgggacaacgaactacagtacgtcgatcaattactgaaggaggacgtccggaataacagtgtttggaatcagcgttatttcgtgatatcaaacacaaccggttacaacgaccgtgccgtgctggagcgggaagtacaatatacgctggagatgatcaaattagtcccgcacaacgagagcgcatggaattatctgaagggaatcttacaggataggggcctgagcaaatatcccaacctcctgaatcagttattggacttgcagccatcccactctagcccttacctcatcgcatttctcgtggacatctatgaggacatgctggagaaccaatgcgacaacaaggaggacattctcaacaaggctctcgaactctgcgaaatcttggccaaagagaaggacaccatccggaaggagtattggcggtacataggtcgttccctgcagagcaaacattccacagagaacgactcccctaccaatgttcagcaatag

SEQ ID NO: 222863 - DNA, 939 bp, Artificial Sequence
  Description of Artificial Sequence: Synthetic coding sequence
atggcagctacagaaggggtgggcgaagccgcacaaggcggagagcctgggcagccagcccagccccctccacaaccccatcctcctccgcctcaacagcagcataaagaagagatggcagccgaagccggtgaagcagttgccagccctatggatgacggatttgtgtccctcgatagcccatcatatgttctctaccgccactttcgtagggtgctcctcaagtcgctccagaaagacctgcacgaggagatgaattacattacggccatcatcgaagagcaacccaaaaactatcaggtttggcaccatagaagagtgctggtggagtggctgcgagatccttcacaggaactcgagtttattgctgacattcttaaccaggacgctaaaaactaccatgcttggcaacaccggcaatgggtgatccaggagttcaaactatgggataacgagctacagtacgtggatcaactgcttaaagaagatgtccgcaataacagcgtatggaaccagcgctactttgtcattagcaacacgaccggatataatgatcgagcagtcctggaaagagaggtacagtatactttagagatgattaagttggttcctcacaacgagtctgcttggaattacttgaaggggatactccaagatagaggcttgagtaagtaccccaatctcctgaaccaactactggacctgcagcctagtcactcttcaccctatctcattgctttcctggtggatatctatgaagatatgttagaaaaccagtgtgacaacaaagaagatatcctcaataaggcacttgaactatgtgagatcttggcgaaggaaaaggacactatacgaaaagaatactggaggtatatcgggcgtagtctgcagtcaaagcacagcacggaaaatgatagtccgacgaacgtgcaacagtag

SEQ ID NO: 222864 - DNA, 1314 bp, Artificial Sequence
  Description of Artificial Sequence: Synthetic coding sequence
atggcttcaccctcctctttcacttactattgcccgccttcatcatcccctgtatggagtgaacccctgtactctctcagacccgaacatgcacgcgagagactgcaggacgacagcgttgaaacagtgacgtccatcgaacaggcaaaggtcgaggagaaaattcaggaagtcttttcgagctataaattcaatcacctggttcctcgtctggtactacagagagagaagcatttccattatctgaagaggggcttgagacagctgactgatgcttacgaatgtcttgatgcttctcgtccctggttgtgttactggatccttcactcgctcgagttactggacgagcccataccccaaattgtcgcaaccgacgtgtgccagtttctggaactctgccagtctccggaaggcggtttcggtggcggaccagggcagtaccctcacctcgctcctacctatgccgctgtgaacgccttgtgcatcatcggcacggaggaggcatatgacattatcaaccgcgagaaactgctccagtacttgtattctctgaaacagccagacgggagctttctgatgcacgtgggcggtgaggtggacgtgagatccgcttattgcgcagcaagtgttgccagtcttacaaacatcattacccctgatctcttcgagggcactgcggagtggattgctagatgccagaactgggaggggggaatcgggggagtccctggcatggaggcccatggaggatatacgttttgtggcttagctgccctggttattctcaagagggaaaggtctctcaacctcaaatctctcctgcagtgggtgaccagtaggcagatgagatttgaaggcggtttccagggacgctgtaataaactggtggacgggtgctactccttctggcaggctggactattacctctgctgcaccgcgctctgcacgcccagggtgatccagccctgtccatgagccattggatgtttcaccagcaggccctgcaggagtatattctgatgtgttgccagtgccccgcaggtggactcctggacaagcctggcaaaagccgggacttttatcacacatgttactgtctatcagggctgagcatcgcccagcacttcggctccggagctatgcttcatgatgtagtactgggtgtccccgagaacgcgcttcaaccaacgcaccctgtgtacaacattggccctgataaggtaattcaggccaccacctatttcttacagaagccagtgcctggatttgaggagctgaaagacgagacttctgctgaacccgctaccgattag

SEQ ID NO: 222865 - DNA, 1953 bp, Artificial Sequence
  Description of Artificial Sequence: Synthetic coding sequence
atggcatctaatatggaccgggaaatgatcctggccgactttcaggcatgcacaggtattgagaacatcgacgaggcaatcaccctcttagaacagaacaattgggatttggtcgcagctattaatggggtgatcccccaggaaaacggaatcctgcagagtgagtatgggggtgaaactatacctgggccagcatttaatcccgctagccaccccgcaagcgctcccacctccagttctagtagcgcattcagaccagttatgcctagtcgccaaatcgtagagaggcagccccgtatgcttgactttagagtggagtacagagaccggaatgtggatgtcgttctcgaagacacttgcactgtcggtgaaattaaacaaatcctggagaatgaactgcagattcctgtgtccaagatgctgcttaaggggtggaagactggcgacgtggaagatagcacagtgctaaaatccctacatctgccaaagaacaactccttatacgtccttactcccgacttaccccctccatccagcagctcccacgctggagcactgcaagagtctctgaatcaaaactttatgctgattatcacgcaccgcgaagtgcagcgagagtacaatctcaacttctctggcagtagcaccatacaggaggtaaagcggaatgtgtatgatctcacttctatcccagtgcgccaccagctgtgggagggttggcctacttccgccaccgatgattcaatgtgcctggcagagagcggattgtcttatccatgtcaccggctgaccgtgggtagacgctccagccccgcacaaacacgcgagcagagtgaggagcagatcaccgatgtgcacatggtaagcgacagtgacggagacgattttgaggatgcgaccgagttcggcgttgacgatggggaagtcttcggtatggcctctagtgcactgcggaaaagcccaatgatgcccgaaaatgctgagaacgagggcgacgcgctcctgcagtttactgctgagttttcaagccgatatggagattgccatcctgtgttctttatcggctcccttgaagccgcattccaggaggccttttacgtgaaagcaagagatagaaagcttctggcaatatatctccatcatgatgagagcgtacttaccaacgtgttttgctcccagatgctctgtgcggaatctatagtatcatacctaagtcagaatttcatcacgtgggcctgggacctgactaaggattccaatagagcccgattcctgacaatgtgcaacaggcactttggctcagtggtggctcagaccattagaactcagaagaccgatcaattccctctcttcctgatcataatgggtaagcgttcaagtaatgaggtgctcaacgtcattcaggggaacacaaccgtcgacgagctgatgatgaggcttatggccgcaatggagatctttaccgcccagcagcaggaggatatcaaggacgaggatgagagagaagcacgagaaaacgtcaagagagaacaggatgaagcatatcggctctccttagaggcagaccgggcaaaacgcgaggcccacgagagagagatggctgagcagttcagattggaacagattagaaaggagcaggaagaggaacgcgaggccatacgtttatcgcttgagcaggcactccccccagagccaaaggaagagaatgccgagccggtatccaagcttcgaatccgcacaccgtctggcgaattcctggaacgtcggttcctcgcatctaataagctgcagatcgtatttgactttgtggccagtaaaggattcccctgggatgaatacaaattactctcgacatttcctcggagggacgtgacccagctggatcctaataaaagtctgctggaggtcaagttgttcccacaagaaaccctgttcttggaagctaaggagtag

SEQ ID NO: 222866 - DNA, 1473 bp, Artificial Sequence
  Description of Artificial Sequence: Synthetic coding sequence
atgatcctggctgacttccaggcgtgcaccgggatcgaaaacatagacgaggccatcacactgctggaacagaacaattgggatcttgttgccgctatcaatggggtgatcccacaggaaaatggtattctgcagtccgagtatggtggtgaaaccatcccagggcctgcttttaaccccgcaagtcacccggcttcggcacctacatcgtcatcgagctccgctttccggcctgtcatgccctcccggcagattgtagagcggcagccccgaatgttagactttagagttgaatacagggatagaaacgtagatgtggtcctggaggacacgtgtaccgtcggcgaaataaaacagattcttgagaatgagctccagatccctgtttcgaagatgttactcaaggggtggaaaactggtgacgtcgaagacagcaccgtgctgaagtccctgcatttacccaagaataattctctttacgtgctaactcccgacctgccaccgcctagcagttccagtcatgctggggcactgcaagaattcagtagcagatatggggattgtcaccccgtattttttatcggttctctcgaagctgcctttcaggaggccttttatgttaaagctagagaccgcaaactgctggcaatctatcttcaccatgacgaatccgtgctgaccaatgtcttttgctcccagatgctgtgcgcggagtctatcgtgagttacttgagccaaaatttcattacttgggcttgggaccttacaaaagactccaaccgagccaggtttctcacaatgtgcaatcgacactttggctccgtcgtggctcaaacaatcagaacacaaaagacggaccagtttccactgtttctcatcatcatgggtaagcgatcatccaacgaagtccttaacgtgattcaggggaatacgacagtggatgagctgatgatgcgtctcatggcggctatggagattttcaccgcccaacagcaagaagacattaaagatgaggatgagagagaggcccgagaaaacgttaaacgagagcaggatgaggcctaccgcctgagtcttgaagccgacagggccaaacgggaggcacacgagagagaaatggcagagcagtttaggcttgagcagattcgaaaagagcaagaagaggagagagaggccatccgactgtccctggagcaagccctgccacccgagcccaaggaggagaatgccgagccagtatcgaaacttcgcattaggactccgagcggcgaatttctggagaggaggtttctagcctccaataagctgcagatcgttttcgactttgtagcctcaaagggcttcccatgggacgagtataaacttctgtctacttttcctcggcgagatgtgacccagctggacccgaataaaagcctcctggaagtcaagctctttcctcaggagacgctcttcctcgaggctaaagaatag

SEQ ID NO: 222867 - DNA, 1953 bp, Artificial Sequence
  Description of Artificial Sequence: Synthetic coding sequence
atggcctcaaacatggatagagaaatgattttagccgactttcaggcctgtaccggaatcgaaaacatcgacgaggcaatcaccctcctggaacagaacaactgggatctggttgccgcaattaacggcgtgattcctcaagaaaatggcattctgcagtccgaatacggcggagagactatccccggaccggcttttaaccccgcttcacaccctgcatccgcccctacaagctcctcttcttcagcctttcggcctgtgatgccgagtagacagatcgtggaaaggcagccaaggatgcttgacttcagagtggaatacagagaccgcaatgtcgatgttgtgcttgaagacacatgcacagtaggagagattaagcaaattttagagaatgagttacagattcctgtgagtaaaatgctgctcaaaggctggaagactggcgacgtagaggattccaccgttctcaagtctctccacttacctaagaataattctctatacgtgctaaccccagatctacccccaccctcctcctctagccacgctggggcactgcaggagagcctgaatcaaaatttcatgctcattatcactcaccgcgaagtgcagagagagtataacctcaacttctctggcagtagcacgattcaggaggttaagaggaacgtatacgaccttacatctatcccagtgagacaccagctctgggagggctggccaacatccgcaactgacgacagcatgtgcttagcggaatccggcctctcatacccctgccacaggctgacagtcggtagaaggtcaagtcctgcacagacgagagagcagtccgaggaacagatcactgatgttcatatggtgagcgattctgatggtgatgactttgaggacgcaaccgaatttggggtggacgacggagaagtgtttggaatggcctcctccgcactgcgcaagagccctatgatgcctgagaatgcagaaaacgagggtgacgccctgctgcagtttacagcggagttttcaagccgctatggtgattgtcatcccgttttcttcatcgggagcctggaggccgctttccaggaggctttctatgtaaaggcccgagaccgtaaactgcttgctatatatctgcaccacgacgagagcgtgctgactaacgtgttttgttcacaaatgctctgcgctgagtcgatcgtgagctacttgagccaaaacttcatcacatgggcgtgggacctgacgaaggacagcaatagagccaggtttttaaccatgtgcaatagacatttcggaagcgtcgttgcccaaacaattagaacccaaaaaactgaccaatttccgctatttttaatcataatgggtaagcggtcatctaacgaagtcttaaacgtaattcagggcaacactactgtcgacgagttgatgatgcgactgatggccgctatggagatttttaccgcccagcaacaagaggatattaaggacgaggacgaaagggaagctagggaaaacgtcaaacgtgagcaggacgaagcctatcggctgagtctggaggccgaccgagcgaaacgcgaggcccatgagagagagatggccgaacaattcaggctggaacaaataaggaaagaacaggaagaggagagggaggcaataaggctgagcctcgaacaggccctgccgcctgagcctaaggaggagaatgcagagcccgtcagcaagctgcggatcaggactccatccggagaattcctcgaaaggaggttcctggcctctaataaactgcagatcgtgttcgattttgtcgcctccaaggggtttccatgggatgagtataaactgttgtctacgttcccccgaagagatgtgactcagttagatcctaacaaatctcttctggaggtgaaactcttccctcaggaaacgctctttcttgaggcgaaggaatag

SEQ ID NO: 222868 - DNA, 1497 bp, Artificial Sequence
  Description of Artificial Sequence: Synthetic coding sequence
atggccagcaatatggatcgggaaatgattttagcagacttccaagcctgcacaggtattgagaacatagatgaagctattaccctccttgagcaaaataattgggacctggtggccgctatcaatggggtgattcctcaagagaacggcatcctgcagagcgagtatggtggagagaccatacctgggccagcctttaaccctgcgtcccaccctgcgagtgcacccacgagttccagctcatcagcattccgaccggttatgccctcacgacaaatcgtagagcgccaaccccgtatgctggacttccgcgtggaataccgagatcgaaacgttgatgtcgtgctggaggatacttgtaccgtaggtgagattaagcaaatcctcgagaatgaattacagataccggtgtctaaaatgttgcttaaaggttggaagaccggggacgtagaggactccactgtgcttaaatcccttcacctgccaaagaataattccttgtacgttctcactcctgacctgccgcctcctagcagttcctcgcacgctggcactcttcagcagttcagttatcggtacggagattgccacccagtcttttttattggttctctggaggccgcatttcaggaagccttctacgtgaaagccagagatcggaagctgctcgccatttacctgcatcacgatgagtctgtgcttacgaacgttttctgctctcaaatgctatgcgcagaaagtattgtcagttacttgagtcagaacttcataacctgggcatgggacctgaccaaggatagtaatcgcgcaagattcctgacaatgtgcaataggcacttcggcagcgtagtggctcagactatccgcactcaaaagacagatcagttccccctcttcctaatcataatgggaaagcgatcctcgaatgaggtcctgaacgttattcagggcaatacaacagtagacgagctgatgatgcgcctgatggccgctatggagatatttaccgcacaacaacaagaagatatcaaggatgaggacgagcgagaggcgcgtgagaacgtgaagagggaacaggatgaggcttacagactgtccctggaggctgaccgagcaaaaagggaagctcatgagcgggaaatggctgagcagttccgcctggagcagatccgcaaggaacaggaagaggaacgggaagccatccggctgtcccttgaacaggccctgcccccagaacctaaagaggagaacgcagagccggtatcaaaactcaggatccgtaccccgtccggggagtttctcgaaagacgtttcttagcgtctaacaaactgcaaatcgtatttgactttgtggcgagtaaaggtttcccgtgggacgagtacaaattattatctacttttcccaggcgcgacgtaacgcagctggaccccaacaagtctcttctggaagtgaagttgttccctcaagaaactctgttcttagaggctaaagaatag

SEQ ID NO: 222869 - DNA, 1227 bp, Artificial Sequence
  Description of Artificial Sequence: Synthetic coding sequence
atgagaaatctgttggagatgtgcctggcagaatcaggcctgagctacccttgtcaccgactgactgtaggccgacgatcctcacccgctcagacaagagagcaatctgaggagcaaatcacagacgtgcacatggtcagcgatagtgacggcgatgactttgaagatgccactgaattcggcgtggacgacggcgaggtattcggaatggcctctagcgccttgagaaaatcccccatgatgccggagaacgctgagaatgagggcgatgctctcctgcaattcaccgccgagttcagcagtagatacggtgattgccacccagtgttcttcattggctccctagaagccgcattccaggaagcgttttatgttaaagcgcgagaccggaaacttctggccatttatttgcatcatgatgagagcgtgttaaccaatgtgttctgttctcaaatgttgtgcgcggaatctattgtctcatacctgagccagaacttcatcacatgggcctgggatttaacgaaggacagtaatcgagccagatttttgactatgtgcaaccgccattttggctcagtcgtcgcacagacgatccgaacccagaagacagaccaattcccattgtttctcattattatgggaaagcggtcttcaaatgaggtgctcaacgtcatccagggaaacactactgtcgatgaactgatgatgcggctgatggccgctatggaaatcttcacagctcagcagcaggaggatatcaaggacgaggacgaaagagaagctagggaaaacgtgaagagagaacaggacgaagcttatcgtctgtctctcgaagctgatcgggcaaaacgcgaggctcatgagagggagatggccgagcaatttagactcgaacagattcgaaaagagcaggaggaggagcgcgaggccatccgactctcactggagcaggccctgcctcccgaacccaaagaagagaacgctgaacctgtgagtaagctgcggattcggactccttccggagagtttctggaacgtagattcctagcgtctaataagctgcagatagtgttcgattttgtcgcgagtaaaggctttccatgggacgaatacaaactcctgtcaaccttccccaggcgagatgtgacacagctggaccccaacaagagtctgctggaggtcaagctgttccctcaggaaacactgttcttagaagctaaagaatag

SEQ ID NO: 222870 - DNA, 951 bp, Artificial Sequence
  Description of Artificial Sequence: Synthetic coding sequence
atgactcagggaaagctgtctgttgctaacaaagcccctggcaccgagggccaacagcaggttcacggggaaaaaaaggaggcgcctgcagtccctagcgcacccccatcatatgaagaggccacttccggtgaaggcatgaaagccggagcgtttccacccgctcccactgcagttcccctgcatccaagctgggcctacgtggatccttcctcatcctcttcctacgacaatggattcccgaccggggatcacgagctcttcaccacgttttcctgggacgatcaaaaggtacggagggttttcgtgagaaaagtgtacacaatccttctgatacagttgctggtgacactggcggtagttgcattgttcaccttttgtgaccccgtcaaagattacgtgcaggctaatccagggtggtattgggcttcttacgctgtgttctttgctacatatctcactctggcttgttgttcagggccacgacgacactttccatggaatctcattctgctaactgtcttcaccctttcaatggcgtatttaactgggatgctctcctcttattataacaccacgtccgtgttgctgtgccttggcatcaccgctttggtgtgcctttccgttacagtgttttcgtttcaaacaaaattcgattttacttcctgccaaggcgtcttatttgtgttactgatgacactttttttctccgggctgatcctcgccattcttttgccgttccagtatgtcccttggctgcacgctgtgtatgcggctttgggagccggagtcttcacactattcttggctttagacactcagctgttgatgggcaatagaagacactccctttccccggaggagtacatctttggcgctcttaatatctacctcgatattatctatatttttaccttctttttgcagctgttcgggacgaaccgtgagtag

SEQ ID NO: 222871 - DNA, 951 bp, Artificial Sequence
  Description of Artificial Sequence: Synthetic coding sequence
atgacccagggcaaactctcagtggctaacaaagccccaggcaccgagggccagcagcaggtgcatggagagaagaaggaggctccagccgtgccctcagctcctccatcttatgaagaagctacttcgggcgaaggtatgaaggccggtgcgtttcccccagctcctacggccgtgcccctacacccctcctgggcctacgtagacccaagctccagctccagttacgacaacggtttccctaccggcgaccacgagctcttcaccacattttcctgggatgatcagaaagtaaggcgcgtgttcgtgagaaaggtctacacaatactactgattcaactcctcgtgacattggcagttgtcgccctgttcactttttgcgatcccgtcaaggattacgtccaagccaaccctggctggtactgggcttcttacgctgtcttctttgcgacatacttgaccctggcctgctgcagtggcccaagacggcactttccgtggaatcttattctgctaaccgtgtttacgctgtccatggcctaccttaccggtatgcttagcagctattacaataccacatccgtgctcctgtgcttggggatcacagctttagtctgcctgtcagtaaccgtcttctcttttcagactaagttcgatttcacctcctgtcagggagtgctgtttgtgctactgatgactctgttttttagcgggttaatactagctattcttctcccttttcagtacgtgccctggttacacgccgtgtacgccgctctgggtgctggcgtctttaccctgtttctggccttagatacccagctgctcatggggaaccgtaggcactccttatcgcccgaggagtatatctttggggcactgaacatctatctggatataatctacatcttcactttctttctacagctctttggcacaaaccgagagtag

SEQ ID NO: 222872 - DNA, 813 bp, Artificial Sequence
  Description of Artificial Sequence: Synthetic coding sequence
atgaaagccggtgcatttccgcctgcgcctactgctgttcctttgcacccatcttgggcctacgtcgatccaagctcttcttcgtcctacgacaacgggtttcccactggagaccacgagcttttcaccacgttctcttgggatgatcagaaagtgcggagggtgtttgttcgaaaagtgtacactatcctcctgatacagcttctcgtgacgctggcggtcgtcgcattattcaccttctgcgaccctgtgaaagactatgtgcaggctaatcccggttggtactgggcctcatatgccgttttctttgctacatatctgacactggcatgttgtagcgggccacgcagacattttccctggaatctaatacttctaactgtcttcaccctttcgatggcctacctgactggcatgctcagcagctattataataccaccagcgtcctcctttgtctgggaattactgccctggtctgtctctctgtcaccgtttttagcttccagacaaagtttgatttcacctcttgtcagggcgtgctgtttgtgctgctgatgaccctttttttcagtgggcttatccttgccattctgctgccatttcaatacgttccctggcttcatgccgtctatgccgctcttggagcgggtgtgtttacgctatttttggcccttgatacacagctcctaatggggaaccgcagacacagtctgtcacccgaggagtatatcttcggcgctctgaatatttatctggatattatttatatttttaccttttttctccagctgttcggtacaaaccgcgagtag

SEQ ID NO: 222873 - DNA, 1173 bp, Artificial Sequence
  Description of Artificial Sequence: Synthetic coding sequence
atggacttctggttgtggcctctatacttcctgcccgtgagcggagcgctcaggattctgccggaggttaaagtggaaggcgagctggggggtagcgttactattaagtgtcccctgcctgagatgcatgtgagaatctacctctgccgtgagatggctgggagtggcacatgtgggactgtggttagcacaacaaattttatcaaagcagagtacaaagggagggtaaccttgaagcagtacccgcgaaagaatttgtttctggtggaggtcacccaactgacggaaagcgacagcggggtctatgcatgcggggcagggatgaacacagacagaggtaagacacagaaggtcacactgaacgtccacagcgaatacgaaccctcctgggaggaacagccgatgccggaaacgccgaaatggttccatctcccttacctgttccaaatgcctgcgtacgcctcttcatcaaaatttgtaacccgcgtcactactcctgctcagagaggaaaagtaccccctgtgcatcattctagcccaaccactcagataactcacaggccccgagtaagccgcgcttctagcgtggctggcgataagccgaggacattcctcccctccacaaccgcgtccaaaatatcagcgcttgagggtttactcaaaccccagactcccagctataaccaccacactaggcttcacagacagagagcacttgattacggaagccagagcggccgtgagggccaaggatttcatattctaatcccgaccatactcgggttatttctcctcgcactgttgggcttggttgtcaaacgcgcagtggaacgccgtaaagctctgtcacggagggccagacggctggccgtaaggatgcgtgccctggaaagcagtcagcgacccaggggcagccccaggccaagatcgcaaaataacatctatagtgcgtgcccacggcgagccaggggcgcagacgccgcagggaccggggaggcgcctgtgcctgggccaggagcccctcttccacctgccccactacaagtctcagagtctccctggctccatgcaccttcccttaaaacgtcatgtgaatacgtcagcttataccaccaaccagcagctatgatggaagactccgactctgatgactatatcaacgtgcccgcatag

SEQ ID NO: 222874 - DNA, 921 bp, Artificial Sequence
  Description of Artificial Sequence: Synthetic coding sequence
atggatttttggctgtggcccctttattttctgcccgtgtctggtgctctcaggatcctccccgaggttaaggtcgaaggagagctagggggaagtgttaccatcaagtgcccactgcccgagatgcacgtacggatctatctttgtagagaaatggccggttcgggcacctgtgggaccgtcgtgagcactaccaactttatcaaggccgagtacaagggtagagtcaccctgaagcaatatcctaggaaaaacctctttcttgtggaggtgacacaactgacggagtctgactctggtgtgtatgcatgcggagcaggtatgaatacagataggggtaagactcagaaagtcaccctgaacgtgcactctgaatatgagccatcttgggaagaacaaccaatgccagagacaccaaagtggttccatttaccatatttgtttcagatgcccgcttacgccagcagcagcaagttcgtgaccagggtgaccaccccagctcaaaggggaaaagtgcccccagtccatcactcgagccctactactcagattacgcatcgccctagggtcagcagagcaagttcagtagccggagacaaacctcgaacattcctcccaagcacaactgcaagcaaaatctcagccctcgaaggccttttaaagccccagaccccatcctacaatcaccatacacggttacaccggcagtctccacttcaggccggaccccctaccggcagagaagatgctaggcctggcgaactacccgaggctccaagagtcgccgctaccgcacttccgaaacagcatcttcagagactccctgcggcacggagttggtccggtcgttgtcggcacaggggcggtccccgaagcaggcccaggagcgcagttgctccgagacccgcagcaggtgtttag

SEQ ID NO: 222875 - DNA, 837 bp, Artificial Sequence
  Description of Artificial Sequence: Synthetic coding sequence
atggacttctggttgtggccactatactttctccccgagtacgagccgagctgggaggaacagcctatgcccgagacgcctaaatggtttcacttgccctatttgtttcagatgccagcctacgcctcctcttcaaagtttgtgacgcgggtgacaacgccagctcagcggggtaaggtcccacctgtacatcactcttcacccacaacccaaatcacccatcggcctcgcgtaagccgggcaagttccgtcgcgggtgataagcccaggacatttctgccgtcaaccacagccagtaagattagtgcactcgaaggactgttgaagcctcaaactccgtcatacaaccatcacactagactccatcggcaacgggcattggactacgggtcgcagtctggtcgcgaaggacaggggtttcacatcctgatccctactattctggggctgttcctgttggccctactggggcttgtggtgaagagagcagtggagcgtaggaaggctctttcccgtagagctcggaggttggcggtgaggatgcgcgcattggagtctagtcaaaggcccagagggtcccctcggccaaggtcacagaataacatttactctgcctgcccaaggagggccaggggagcggacgccgcaggcacaggggaagctcctgtcccaggccctggcgcacctttacccccagcccctctgcaagtctctgagagcccctggttgcacgcgccaagtttaaaaaccagttgcgagtacgtctctttgtaccaccaacctgccgcaatgatggaagattcggattccgacgactacatcaatgtgcctgcgtag

SEQ ID NO: 222876 - DNA, 456 bp, Artificial Sequence
  Description of Artificial Sequence: Synthetic coding sequence
atggacttctggctgtggcctctgtacttcctgcccgtgagcggtgcactgagaatccttcctgaggtcaaagttgagggcgagctcgggggatccgtaacaattaagtgcccgctcccagagatgcacgttcggatatacctgtgtcgggagatggccggttcaggaacatgcggaacagttgtgtcaaccactaattttattaaggcagagtacaagggaagggtaaccctgaagcaatacccacgaaagaatctgttcctggtggaagtgactcagctgactgaatctgattctggagtttacgcctgtggtgcaggaatgaatacagacagaggaaagacgcagaaggtgacccttaacgtgcactcagagtacgagccttcttgggaagaacagcctatgcctgagacaccgaagtggttccatctcccatacctgttccaaatgccctag

SEQ ID NO: 222877 - DNA, 444 bp, Artificial Sequence
  Description of Artificial Sequence: Synthetic coding sequence
atggacttctggctgtggccattgtattttcttccggtgagcggagccctgagaatcctaccagaggttaaggtagagggagaactaggaggctcagtgacaatcaaatgcccattgccggaaatgcacgtgcgaatatacctgtgccgagagatggcaggttcagggacctgcggcactgtggtgagcacaactaatttcataaaggctgagtacaagggcagagtaaccctgaagcagtacccgaggaagaatttgttcctggtagaggtgactcagctgacggagtctgattcaggagtgtacgcttgcggagccggaatgaatacggaccgtggcaagacgcagaaggtgacactgaatgtgcacagtgagtacgagccgtcctgggaggagcagcccatgcccgagacaccaaaatggttccacctgccctacttgtag

SEQ ID NO: 222878 - DNA, 426 bp, Artificial Sequence
  Description of Artificial Sequence: Synthetic coding sequence
atggacttttggctgtggcccttatatttcctgccggaaatggaaagttgttgtgtggcccaagacggcctggagctggttgccctctctgacccacctggcagcgccagccagtccgcagggatcactgtgagtggcgctctgcgaatacttcctgaggtgaaggttgaaggggaactgggcggatccgtgaccatcaagtgccccctcccagagatgcacgtaaggatttacttatgtagggagatggctgggtctggaacttgtgggaccgttgtgtccaccaccaactttatcaaagccgaatataaaggccgagtgacacttaaacagtatcctaggaaaaatctgtttctggtagaggttacacaactgacggagagtgattcaggagtttatgcctgtggagcgggtatgaatacatag

SEQ ID NO: 222879 - DNA, 1398 bp, Artificial Sequence
  Description of Artificial Sequence: Synthetic coding sequence
atgaggaggcctcgcggtgagcctgggcctagggcacccagaccaaccgagggagccacctgcgctggtccaggggaatcgtggagcccttcgcctaacagcatgctcagagtactactgtcagcccagaccagcccagctcgtctgtccggactcttactcattccaccagttcaaccttgctgtctgggccctagtaagtggggggaccggcctgttgggggtggcccttcagcgggtcccgtgcaaggtctgcagaggctgttggagcaagctaagtcaccgggtgagctgctccgatggctggggcagaacccaagcaaggtgagggcacaccactacagcgttgctctgcggaggctgggccaattactgggaagtcgcccacggccaccacctgtggagcaagtcaccctgcaggatctcagccagctgattattcggaactgcccctcctttgacatccacaccattcatgtgtgcctccatttggcagtcctgctcggctttccgagtgacggtcctcttgtgtgcgccttggaacaggagcgaagactgaggctgccacccaaaccccctccccctctgcaaccactgctccgtgggggacagggcctagaagctgctctgtcatgtccgaggttcctgagatacccacgccagcatcttatctcttcactggcggaagcaaggccagaagagttgacaccccacgtgatggtcttactcgcacagcacctcgcacgacacaggttgcgggagcctcagctgctggaggcaatcgctcacttcctggtggtgcaggagacacagctcagctccaaggtggtccagaaactcgttttaccgtttggcagactgaactacctgcctctcgagcaacaattcatgccctgccttgagcgcatcctcgcacgagaggcaggagtcgcccctttggccaccgtgaacattctcatgagtctgtgtcagctgaggtgccttcccttccgggctctccactttgtattctctcccggatttatcaactacatttcgggtacaccacacgcacttattgtgcggcgttatctgtcactgctggatacagctgtcgagttggagctgcccggatataggggtccgcgtcttcccaggcggcagcaggtaccaatatttcctcagcccttgatcacagacagagcccgatgcaaatactcacataaggatattgtcgcagaggggctgaggcagcttttgggagaggagaagtacaggcaggacctcactgtcccgccaggttattgtaccgactttctattgtgcgcgagttcgtctggagccgtgttgcctgttcgaactcaagaccccttcctgccatacccgccaagagcatgcccaagttcgagggctacctag

SEQ ID NO: 222880 - DNA, 1650 bp, Artificial Sequence
  Description of Artificial Sequence: Synthetic coding sequence
atgcgtcgacccaggggtgagcccggtccccgtgctccaaggccaacagaaggagccacatgcgctggaccaggggaatcatggagcccttcccctaactctatgttgagggtgcttctttctgcgcagactagtccagctaggctgtccggccttttgctgatcccgcctgtgcagccttgctgcctcggacccagcaagtggggagacaggccagtgggagggggtccaagcgccggtcctgtccaaggcctccagcggctgttagagcaggccaagtccccaggagagctgttgcgatggttgggtcagaatcccagtaaggtgcgggctcaccactacagcgtggcccttcggagactgggacaactgcttgggtcccgaccccgacctccgcctgtggaacaagtgactctacaagatttgagccaactcattattagaaactgccccagtttcgatatccacactattcatgtgtgtctgcatctggctgtgctcctggggttcccgagcgacggtcctttagtatgtgcgctcgaacaagagcgcagactgaggcttccccctaagccgcctccgccacttcaaccactacttcggggaggccagggcctggaggccgctctgtcctgtccccgattcctgcggtatccaagacagcacttgatctccagcctggccgaggctcgcccagaagagctgactcctcatgttatggtcctgcttgctcagcaccttgctcggcatcggctgagagagcctcagttgctggaggccatagctcacttccttgtggtgcaggaaactcagcttagcagtaaagtcgttcagaagctcgtgctgccatttggacgcctcaattatctgcccttagaacagcagtttatgccatgtctcgagcgcatcctggctcgggaggccggtgtggcacccctggctaccgttaatattctgatgagtctatgtcagttgcgttgtcttccttttagggccttgcacttcgtattcagtcctggcttcattaactacatctccggcacaccacacgcactcattgttcggcgttatctctctctgctcgataccgctgtcgagctggagctcccgggataccgaggcccacgactaccacggaggcagcaggtgccaatttttccccagcctctgattacggaccgagccaggtgcaagtactctcataaggatatcgtcgcggaagggttgcgacaactgttgggagaagagaagtaccgacaggacctgaccgtccccccaggatattgcacggattttctgttgtgtgctagttcctctggagctgtgctgcccgtcagaacgcaagatccctttctcccctatcctcctagaagttgcccccagggccaagccgcaagcagcgcaaccactagagaccccgctcagcgcgtcgtgctcgtgctgcgggaacgctggcacttttgccgcgacggacgcgtactcctggggtctcgtgccctgcgagagcggcacctcggcctgatgggctatcagctgctgcctctgccttttgaagagcttgaatcccagagggggctgcctcaacttaagagctatcttcggcagaagctgcaggccttgggcctccggtggggtcccgaggggggttag

SEQ ID NO: 222881 - DNA, 1227 bp, Artificial Sequence
  Description of Artificial Sequence: Synthetic coding sequence
atgcgaaggccccgtggagaacctggacccagagccccacgaccaactgaaggcgcaacatgtgcgggacccggtgagtcctgtttcccaagcgatggtcccctggtctgcgccctcgaacaggaacggcgactccgactgccccctaagccccctcccccactgcaacctcttctgaggggaggccaggggcttgaggctgcattgtcctgcccccgatttctgcggtatcccaggcaacatctcatctcatcccttgccgaagcgcgtcctgaagaacttactccacacgtgatggtcctgcttgcccaacacttagcaagacacagactgagagagcctcagctgctggaagccatcgcccactttcttgtggtccaggaaacccaactgagctccaaggtggtccaaaagctcgtccttccctttggtcggctaaactacctgcctcttgagcagcagtttatgccctgcctcgagcgaatcctggctcgcgaggcaggtgtggccccactcgcaactgtgaacatccttatgagtctctgccagttgagatgtcttcctttcagggcgttacactttgtgttctcacccggtttcattaactatataagcggcacgccgcatgctttaatcgtgcgacgctatctgtccctactcgataccgctgttgagctggaactacccggatacagaggtcctagattaccccgacgccagcaggtgcccatcttcccacaacctttgattacagacagagccagatgtaagtactcacacaaggatatcgtggcagaaggcctgaggcagctgttgggagaagagaagtatcggcaggacctgacggtgcctccgggatactgtaccgatttcctcctctgtgcgtcgtccagcggggctgtgctaccagtgaggacccaagatccctttttgccatacccacccaggtcgtgcccccagggccaggcggcaagcagtgccaccaccagggacccagcacagagagtagtgctggtgcttcgggaacggtggcatttttgtagagatgggagggtgcttctgggcagccgtgccctccgcgagcggcatctgggcctgatggggtatcagctgctgcctctgccattcgaagagctcgaaagccagagagggctgccacaactgaaatcctacttgcggcagaagctgcaggctctgggactgaggtgggggccagaaggaggttag

SEQ ID NO: 222882 - DNA, 480 bp, Artificial Sequence
  Description of Artificial Sequence: Synthetic coding sequence
atgctgagggtgctgctcagcgcacagacaagtcctgcgagactctccggtttattgctgattccgcctgtgcagccctgctgtttggggcctagcaaatggggcgaccgtcctgtggggggagggccaagcgcagggcctgtacagggcctgcagaggctcctggaacaagccaaaagccccggagaactgcttaggtggctcggacagaacccgtccaaggtgagagcccaccactactcagtcgcacttagacgcctgggacagctgctcggatcaaggcctcgcccaccaccagtcgagcaggtgactcttcaggacttatcccagctgataattcgcaactgtccgagtttcgacatccatacaattcatgtctgcctgcacctcgccgtactgcttggtgggacagaagtgggtcccgcactttgggcaaccgagctgcccgcacccggtactgctgtgtacgcactgccttag

SEQ ID NO: 222883 - DNA, 1569 bp, Artificial Sequence
  Description of Artificial Sequence: Synthetic coding sequence
atgaggcggcctaggggcgagcccggacctcgggctccgcgtcccaccgaaggagctacatgcgcgggacccggagagagctggagccctagccccaactccatgctgagggtgctgttgagtgcccagacctcgcctgcaagactcagtggactgctgcttattccgcctgtccaaccatgctgtctgggccctagcaaatggggagataggcctgttgggggagggcctagcgccggtcccgtgcaaggacttcagaggcttctggagcaagcaaaatcacccggagagttgttgagatggcttgggcagaatccttcaaaagttcgtgcacaccactattcagtggccttgcggaggctgggccagctgctgggctctcgtcccaggcctcctcccgtggagcaggtaacccttcaggatctatcccagctgatcatccggaattgtcccagttttgatatccatacaatccacgtgtgcctgcatctggctgtcttgctgggctttccttccgatggtcctttggtttgtgccctcgagcaggagagaaggctgcggctgcctccaaagccaccacccccattgcagcctctgctcagagaagcccgaccagaggagctgaccccgcacgtaatggtcctgcttgctcagcaccttgcccgtcaccggctgagggaaccacagctgctggaagccatcgcacactttcttgtcgttcaggagactcagctgtcttcaaaagtcgtgcagaagctggttctcccattcggcagactcaactacttgccacttgagcagcagttcatgccctgcctggaaaggatcctggccagagaggcaggcgtggccccactagccactgtcaatatcctgatgtctctgtgtcagctgcggtgcttgccgtttcgcgctctacatttcgtgttctctcccggattcatcaactatatttctggtactccacacgcactgattgtccgacgatacctgagcctcctggacacagctgtcgagttggagctcccaggctacagaggtcctagacttccacggaggcagcaggttcctatcttcccccagccacttatcacagacagggccagatgtaaatacagccacaaagatatcgtggctgagggtctccggcagttgttaggagaagagaaatatcgtcaggatctaactgtgccacccggatactgtactgatttcctactatgcgctagctccagcggcgctgtcctgcctgtgaggacacaagatccatttttaccctatcccccaagatcatgcccacagggccaggctgcgtcatctgccaccaccagggacccagcccaacgagtggtgctggtgctgagagaaagatggcacttctgtagagacggacgtgtattattaggttcaagagcactccgcgagaggcacctgggtcttatgggctaccagcttctcccattacctttcgaggagctcgagagccagagggggctcccacagttaaaatcgtaccttagacagaaattacaagcattgggtttgcggtggggcccagagggcggatag

SEQ ID NO: 222884 - DNA, 1179 bp, Artificial Sequence
  Description of Artificial Sequence: Synthetic coding sequence
atggaagcccctctcgtgagcctggatgaagaattcgaggatctgaggccatcatgctcagaagatcccgaggaaaaaccacaatgcttctacggaagtagtccccaccacttggaggatccgtcactgtcggaattggaaaatttcagcagcgagattatatcatttaaatctatggaggatctggtgaatgaattcgatgagaagttaaatgtttgtttccgaaactataacgccaaaacggagaacctggccccagtgaaaaatcagctgcagatccaggaggaggaggaaactctgcaggacgaagaagtgtgggatgctctgaccgacaactacatcccttctctgtcagaggactggagggacccgaacatcgaggccctgaatggcaactgtagcgataccgaaatccatgagaaggaggaggaggaattcaatgagaaaagcgaaaacgattctgggataaacgaagagcctctgttaacagctgaccaggtgatagaagagatagaagaaatgatgcagaactccccagatcccgaggaggaagaagaggtactcgaggaggaagatggaggcgaaacaagtagccaagcggatagtgtgctcttgcaagaaatgcaggccctgactcaaaccttcaacaacaattggtcctatgagggccttcggcatatgagcggtagcgagctgactgaattgctcgaccaagttgaaggcgctatcagagattttagcgaagagctagttcagcaactcgcgaggagagatgagctggagtttgaaaaggaggttaagaacagctttatcaccgttttgatcgaggtgcagaacaagcagaaggagcagcgggaactgatgaaaaagcggcgaaaagaaaaaggcctctctctccaaagcagccggatcgagaaaggaaatcagatgcctttgaaaaggttttccatggagggcatcagcaatattcttcaaagcggcataaggcagaccttcggctcttctggaacagataagcaatacctcaataccgttattccatatgagaagaaggcttcccccccttctgtagaggatcttcagatgttaaccaacattcttttcgccatgaaggaggacaacgaaaaggtgccaactcttctgacagattacatcctgaaagtcctgtgccctacgtag

SEQ ID NO: 222885 - DNA, 315 bp, Artificial Sequence
  Description of Artificial Sequence: Synthetic coding sequence
atggaggcgcctttggtgtcactcgatgaagagtttgaggatctgcgtccgagctgtagcgaagaccccgaagaaaaaccccagtgcttttatgggtcttccccccaccacctggaggacccaagtctgtcagaattggagaacttttcatctgaaattatcagctttaaatcaatggaggatctagtcaatgagtttgatgaaaagcttaacgtctgctttcgcaactacaatgctaaaaccgaaaatctggcccctgtgaagaaccagcttcagatccaggaagaagaggagaccctccaggacgaagagtag

SEQ ID NO: 222886 - DNA, 315 bp, Artificial Sequence
  Description of Artificial Sequence: Synthetic coding sequence
atggaggcgccactcgtcagcttagatgaggaatttgaggatctgaggcccagctgctctgaggatccagaggagaagccgcaatgtttttatggctcatcgccacaccacctggaagacccctcactgagcgaattagagaatttctcctcagaaattatatcatttaagagtatggaagatcttgtgaacgagtttgacgaaaaactgaacgtgtgtttccgcaattacaatgctaaaacagagaatctggcacccgtcaagaaccagctgcagatccaggaagaggaggaaacattgcaggatgaggagtag

SEQ ID NO: 222887 - DNA, 1419 bp, Artificial Sequence
  Description of Artificial Sequence: Synthetic coding sequence
atgacagcgaacggcactgccgaagcagttcaaatccaatttggactgattaattgtggcaataagtatctcaccgccgaagcgttcggctttaaagtgaacgcaagtgcctcctccctgaagaagaatcatttaggaagatacctggccgcagacaaagatggcaatgttacttgcgagcgggaagttcctggacccgactgcagattcctcatcgtggctcatgacgatggtagatggtccctacagagtgaggcccaccggagatatttcggcggaacagaagacaggctgtcgtgtttcgcccagactgtgagcccagcagaaaagtggtcggtccacatcgcaatgcatcctcaggtcaacatctattccgtgacacgcaaaaggtacgcccatcttagtgcaagacccgcagatgagatcgcagtcgaccgtgacgtgccatggggtgttgattcgttaatcacccttgcattccaagaccagcgctacagtgtgcagactgcagatcaccgattcttgcggcatgatggtcgcttggtggcacgaccagaacctgccacagggtatacactagaatttcgttccggcaaggtggcatttcgcgattgtgaggggcgttatctggcaccatccggacccagtgggaccctaaaagccggaaaagcgacaaaggttggtaaagatgagctgttcgccttagaacagtcgtgtgcacaggttgtgctacaggctgctaatgagcgcaacgtgtcaacgcgtcaagggatggatctaagcgccaatcaggacgaggagacagatcaagagacattccagctcgaaatcgatcgcgacacaaaaaaatgtgccttcagaactcacaccgggaaatattggactttgaccgctaccggaggggtccaatccaccgcatccagcaagaacgcttcatgttactttgacattgaatggagagatcgaagaatcacgcttagggccagcaacggaaaattcgtgacgtctaagaagaacggtcagctggctgcctccgtcgaaacggccggtgactcggagctgtttcttatgaagctcatcaaccgtcccattatcgttttccgcggtgaacacggatttataggatgcaggaaggtcactggcaccctggacgcaaaccggtccagctatgatgtatttcagttggagttcaatgatggggcttataacatcaaagattccacaggcaaatattggacggttggttctgactccgctgttacgagcagtggggatacaccagttgacttcttttttgaattctgcgactacaataaggtcgcaattaaggtgggcggaaggtatctcaaaggtgaccacgctggcgtcctcaaagcatctgctgagacagtcgatcccgcttctctgtgggagtactag

SEQ ID NO: 222888 - DNA, 1482 bp, Artificial Sequence
  Description of Artificial Sequence: Synthetic coding sequence
atgactgccaatggtacagcggaggccgtacaaattcagttcggactcatcaattgtgggaacaagtacctgactgctgaggcattcgggttcaaagtgaatgcctccgcaagtagcctgaaaaagaagcagatatggacgttagagcagccgcctgacgaagctggcagcgcagccgtctgcttaagatcgcatctcggcaggtatttggctgccgataaggatggtaacgtcacatgtgaacgcgaggtgccgggtcccgattgtaggttcctaatcgtggcccatgatgatggaagatggagcttgcaatccgaagcccaccggcgttacttcggcggaactgaggatagactgtcctgttttgcacagactgtgtcccctgccgagaagtggtccgtccatattgctatgcaccctcaggtcaacatttacagtgttactcggaagcgctatgcccacctgtctgctcggccagcagatgagatcgccgttgatagggacgttccctggggcgtggactctctaataacgttggccttccaagaccagaggtacagcgttcagacagctgaccatcggttcctgcgccatgacggcaggcttgtcgcacgccctgaacccgcaactggatacaccctagagttcaggagcggaaaagttgccttcagagattgtgaggggaggtacctggctccttctggccctagtggaacactcaaagctgggaaagccactaaggtcggaaaggacgaactcttcgcacttgagcagagctgtgctcaggtcgtgctccaagcagctaacgagcggaatgtgagtacccggcagggtatggatctgtcggctaaccaagacgaggaaacagatcaagagacctttcaattggagatcgatagggacaccaagaagtgcgccttccggacacacaccggaaaatactggaccctgaccgccacgggcggagtgcagtcaaccgcttcttcaaagaatgcatcctgctatttcgacattgaatggcgggaccggcgaatcaccctgagggccagcaacgggaagttcgtgacttctaaaaagaacggacaattggcagcaagtgtagagactgctggggattctgaactgtttctgatgaaattgattaacagacccattatcgtattccgaggagagcacggcttcatagggtgtagaaaggttaccggcactctcgacgccaacagaagctcttatgatgtgtttcagctggagtttaacgacggggcttacaatataaaggactccacgggcaagtactggactgtaggatcagattcagcagtaacaagtagcggcgacacacctgtggatttcttctttgaattctgcgattacaacaaagtggctatcaaggtaggcggaagatatctcaaaggagatcacgcgggagtgctcaaggccagcgctgaaacagtggatccggctagcctgtgggaatattag

SEQ ID NO: 222889 - DNA, 648 bp, Artificial Sequence
  Description of Artificial Sequence: Synthetic coding sequence
atggacttgagcgcaaatcaggatgaagagaccgaccaagaaacctttcagctagaaattgatagagacaccaaaaaatgtgccttccgcacacatacaggcaagtactggaccctcacggcaactgggggagttcagtcaacggccagctctaaaaacgcctcctgttactttgacatcgagtggagagatcgacggatcacactaagggcttctaacgggaaattcgtgacatcgaaaaaaaacggtcagcttgccgcttccgtggaaactgccggagacagcgagctctttctgatgaaactgattaatcggccaatcattgtgttccggggagaacatggattcattggatgtaggaaggtcaccgggacactggatgctaaccgctcctcttacgacgtatttcagttagagtttaacgatggcgcatataacataaaggacagtactggaaaatattggaccgttggttctgatagtgccgttacaagctctggggacacacctgtagacttcttctttgagttttgtgattacaacaaagtcgccatcaaggttggaggcagatatctaaagggtgatcacgctggcgttttaaaggcttccgctgaaaccgtggaccccgcaagtctctgggaatactag

SEQ ID NO: 222890 - DNA, 1551 bp, Artificial Sequence
  Description of Artificial Sequence: Synthetic coding sequence
atgcccactaatggccttcaccaggttctgaaaatacagttcggtctggtgaacgatacggatagatacctgacagcagaatcgttcgggtttaaggtcaacgcttccgccccatccctgaagcgaaaacagacttgggtcttagaaccggatcctggccagggcaccgcagtacttttgcggagtagtcatctgggtaggtacctatcggcggaggaggacggacgagtcgcgtgcgaggcggaacagccaggtagagattgcagatttctggtcttgccccagccggacgggcgttgggtattaagatccgagccacatgggcgattcttcggcggtaccgaggatcagttgtcatgcttcgcaacagccgtcagtccagctgaattatggacagtgcatctcgcaatacacccacaagctcatctcctcagcgtctctcgcagacgctacgtacacctctgtcccagggaggacgagatggccgctgacggagataaaccatggggggtggatgcattgctgaccctgatcttccggagccgccgatattgcttaaaaagttgcgatagcaggtacctccgatctgacgggcgactcgtatgggaacccgaaccaagagcctgttacaccctggagtttaaggctggcaaattagctttcaaagactgcgacggccattacctggctcctgtgggcccagcaggtaccctgaaagccggtaggaacactagacccggtaaggacgaactcttcgatctggaagagagccacccacaggtagtgttggtcgctgcaaaccatagatatgtcagcgtgcggcagggcgtgaatgtgagtgcgaaccaagatgacgagctcgaccatgagacttttcttatgcaaatcgatcaggagactaagaagtgcaccttctatagcagcactggcggttactggactctggtaactcacggcggaattcacgcaaccgccacacaggtgagcgccaacaccatgttcgaaatggaatggagaggtcgaagagtcgctctaaaggctagcaatggcaggtacgtatgcatgaaaaagaatgggcagttggctgccatctctgacttcgtgggccctccccctcgcccagcgtggacaggaaaggttgccggtggcgctgcccagcagactctctccccaccagggaaggacgaggagtttacactgaagctgatcaacagaccgattttggttctccgcggactagacggatttgtctgtcaccaccggggaagcaatcagctggatacgaaccgttcagtgtacgacgtctttcacttatccttctctgacggcgcatacaggatccggggtagggatgggggtttttggtacaccggctcgcacggctccgtttgtagtgacggagaaagagccgaggacttcgtcttcgagtttcgggagaggggcagactagcgatccgcgctcggagcggaaagtatctcaggggaggcgcttccggcctgctcagagccgatgcggacgccccagcaggtacagccctatgggaatattag

SEQ ID NO: 222891 - DNA, 1479 bp, Artificial Sequence
  Description of Artificial Sequence: Synthetic coding sequence
atgcctaccaatgggctccaccaggtactaaagattcaatttgggctggtcaatgataccgacaggtacctgaccgccgagtcgttcgggtttaaggtgaatgcaagtgccccttcactcaaacggaagcagacatgggttctcgaacccgatcccggacagggaacagccgtgctgctcaggtcaagccaccttggaagatacctgtctgcagaagaggatgggagagtggcatgcgaagccgaacagccgggtcgagattgcagatttttggtattgcctcagcccgatggacggtgggtccttcgtagtgagccgcacggcagatttttcgggggtaccgaagatcaactgtcttgcttcgctactgccgtgtcccccgctgaactgtggaccgtgcatctggctattcatccacaggctcacctgctgtctgtgtcacggagaagatatgtgcacctgtgtcccagagaggacgaaatggcagccgacggggataagccatggggagttgacgctttattaaccttgatcttccggtccaggcggtactgcctaaaaagttgtgattcccgatatttaaggtctgatggccgattagtctgggaacctgagcctagggcctgctacactcttgaatttaaggctggaaagctggcattcaaagactgtgacgggcactacctggcaccagtgggacctgccggaacactcaaagcagggaggaacacgcggccaggtaaagatgagctctttgacctcgaggagtctcacccacaagtggtgctagtggctgccaatcaccggtacgtgtcggtgcgccagggtgtaaacgtgagtgccaaccaggatgacgagctggatcacgagacctttctgatgcaaatcgaccaggagactaaaaaatgtactttttatagctccacagggggatactggacccttgttacccacggcggtatccacgctaccgccactcaggtaagcgccaacaccatgtttgagatggaatggcggggtcgaagagtggccctgaaggctagcaatggacggtatgtgtgcatgaagaagaatggccagctggcggcaatcagcgatttcgttggaaaagacgaggagttcacattaaaactcattaacaggcctatcctggtactccgcggtctggacgggtttgtctgtcatcataggggttccaatcaactggacacaaatagatcagtgtatgacgtgttccacctgtcctttagcgacggcgcataccgcattaggggacgagatggaggattctggtataccggcagccacggaagcgtatgctccgacggcgaaagagcagaggacttcgtttttgagttccgagagagaggacggcttgccattagagctaggtctggcaaatatctgagagggggagcgagcggtttgttgcgggctgatgccgacgcccctgccggtactgcactgtgggaatattag

SEQ ID NO: 222892 - DNA, 2133 bp, Artificial Sequence
  Description of Artificial Sequence: Synthetic coding sequence
atgttaacaacgctgaaaccgtttggatccgtctctgtggagtccaagatgaacaacaaagccggtagtttcttctggaacttgagacaatttagcacactggtgtccacaagcagaaccatgaggctgtgctgtctggggctttgcaaaccgaaaatcgtgcactcaaattggaatatcctgaacaatttccataacaggatgcagtctacagacattataagatacctgttccaggacgcatttatttttaaatccgacgtcggctttcagaccaaagggatctctacccttaccgccctgagaatcgagaggttgctgtatgcaaagcgtctatttttcgactccaaacaatcactggttcctgtcgacaagagcgatgacgagctgaaaaaggtcaacctgaatcacgaggtgagcaacgaggatgttctcaccaaggagacgaaaccgaaccgaatctccagcagaaagctgagtgaggagtgcaattcactgtccgacgtgcttgatgcctttagcaaagccccaacattccctagctccaactacttcaccgcaatgtggactatcgcaaagagactatccgatgatcaaaagcgctttgagaagagactgatgttcagtcatcccgcttttaatcagctgtgtgagcacatgatgagggaggccaagatcatgcagtacaaatacctcctgtttagtctccacgcgatcgtcaagcttggcatcccccagaataccattcttgttcaaaccttactgagagtaacacaggagcgtatcaacgaatgtgacgagatctgcctatctgtcttgtcaaccgtgctggaagcaatggaaccttgtaagaatgtccatgtgctgagaaccggatttcgcatcctcgtggatcagcaggtttggaagattgaggatgtgttcaccctccaggtcgttatgaagtgcataggtaaagacgcacccattgcactgaagcggaagttggagatgaaggctttgcgtgagctcgacagatttagcgtgctgaacagccagcacatgtttgaagtgctcgcagccatgaatcatagaagcctaatcttactggatgaatgtagcaaggtagtacttgataatatccatgggtgtcccctgcggattatgattaatatcctacagagctgcaaggaccttcagtaccataaccttgaccttttcaaaggtcttgcagattatgtcgccgcaacttttgatatttggaagtttagaaaggtgctgttcatcctgattttgttcgagaacctcggctttcggcctgtgggattgatggacttatttatgaaaaggatcgtggaagatcccgagagcctaaacatgaaaaacattctctccatcctacatacatattcatccctgaatcacgtgtacaagtgccagaacaaggaacaatttgtggaggttatggcatctgcattaaccggctatttacataccatctcttctgaaaatctgcttgacgccgtgtattctttttgcctgatgaattattttcctctggcaccattcaaccagttacttcagaaggacatcatcagcgagctgctgacgagcgatgacatgaaaaacgcctacaaattgcatacgctggatacgtgtctgaagctggatgatactgtttacttaagggatattgccctgagtttaccacaattacctcgagagctcccatcaagccacacaaacgccaaggtggctgaagtgctgtccagcctactgggtggtgagggacacttctccaaggatgttcatctcccacacaattatcatattgacttcgagatcagaatggatactaataggaatcaggtgttacccctttctgacgtggatacaaccagtgctaccgatatccaaagggtggctgtgctttgtgtgtcccgctcagcatactgcttggggtcctcacacccgagaggtttcctggcgatgaaaatgcgccacctcaatgcgatgggatttcacgtgatattagtgaataattgggagatggacaagctggaaatggaagacgcggtcacttttctaaagacaaaaatctactctgttgaagcactgccagtcgcggcagtgaacgtccagtctacgcagtag

SEQ ID NO: 222893 - DNA, 2133 bp, Artificial Sequence
  Description of Artificial Sequence: Synthetic coding sequence
atgctgaccaccctgaaaccctttggctcggtgtcagtagaatccaaaatgaacaacaaggccggttcatttttctggaacctccgccaattcagtacactcgtctccacgagccgcacaatgcgcctgtgctgtctgggtctgtgtaagcctaaaatagtccactctaattggaacatattgaacaactttcataaccggatgcaatccacggacatcattcgatatctctttcaagatgccttcatcttcaaatccgatgtggggttccagactaagggaatttcaacactgaccgcgcttcggattgagcgacttctgtatgcaaagagactgttttttgactcaaagcagtctttggtccccgtcgacaaatcagacgacgagcttaaaaaagtcaatctaaatcacgaggtctctaacgaagatgtgcttactaaggagactaaaccgaaccgcattagttcacgtaagctgtccgaagaatgtaattcgctgtccgacgtgctggacgcctttagcaaggctccaacgtttcctagcagtaattattttacagcgatgtggaccatcgctaagcgactgtcagacgaccagaaaagatttgagaaaagattaatgttctcacacccagctttcaaccagctgtgcgagcacatgatgcgtgaggctaagattatgcaatacaagtatctgttgttcagtctgcacgcgatagtgaagttgggtataccccagaacaccatcctcgtgcagacccttttgagggttacacaggagcgcatcaacgaatgtgatgagatatgcctgtctgtgctgtccactgtgctcgaagcaatggaaccctgcaagaacgtgcatgttctcagaacgggattccgcatactggtagatcagcaagtctggaaaatagaggatgtgtttaccctgcaggttgtgatgaaatgtattgggaaggatgcgccaatcgccctgaaacggaagctggaaatgaaagcccttagagagctggaccggttttcggtgctcaattcccagcatatgttcgaagttctggccgctatgaatcaccggagtctgattttgctggatgagtgcagtaaagtggtgcttgataatattcacggctgtcctctacgtatcatgatcaacattctgcagagctgtaaggatttacagtatcacaacctcgatctgttcaaaggccttgctgactatgtggccgcaactttcgatatatggaaatttagaaaggtgttatttattcttattctcttcgagaacctaggatttagaccggttggtctgatggacctgtttatgaagcgcattgtggaagatccagagtcactcaatatgaaaaacatactgtctatcctgcatacctactcctccttaaatcatgtgtacaagtgtcagaacaaggagcaattcgtcgaagtcatggcctcagctctcacaggatatctgcacacgatctcctcggagaacctgcttgacgccgtctattctttctgtttgatgaactactttcccctcgctcccttcaatcagttgctccagaaggatatcatctcagagctcctaacatctgatgacatgaaaaatgcctataaacttcatacacttgacacatgtctgaagctggatgatacggtttacctgagggatatcgctctctccctgccacagctccctcgggaattgccttcttctcatactaacgccaaggtggcggaggtgctgtcttccctgcttgggggtgaagggcactttagcaaggacgtacacttaccccacaattaccacatcgacttcgagattcggatggacaccaataggaaccaagttctgccccttagcgatgtcgatactaccagcgcgaccgacatccagagggtcgctgtgctatgcgtcagccgctcagcttactgtttagggagttcacacccaaggggatttcttgccatgaagatgcgtcacctgaatgccatgggctttcatgtgatcctggtgaacaactgggagatggataaactggagatggaagacgctgtgaccttcctgaaaactaagatttactctgtggaagccctgccagtagcggctgttaacgtgcagtcaacccagtag

SEQ ID NO: 222894 - DNA, 2133 bp, Artificial Sequence
  Description of Artificial Sequence: Synthetic coding sequence
atgctcacaaccctgaaaccctttgggtcagtttccgtggagtccaaaatgaacaataaggccggttccttcttttggaacctgcggcagttctccacgctggtgtcaacctcccggacgatgcggctctgttgcttgggcttgtgcaagccaaagatcgtgcatagtaactggaatatccttaataacttccacaaccgcatgcagtcaaccgacatcatcagatacctgttccaggacgcgttcatttttaaaagtgatgtcggattccagactaagggcatatccacgcttacagctctgcggatagaacgcctgttatatgcaaaacgcctcttttttgactccaaacaatcccttgtgccagttgacaagtcagacgatgaattgaagaaagttaatctcaatcatgaagtttcaaatgaggatgtactcacgaaagagacaaaacccaatcgaatatcaagcagaaaacttagtgaggaatgcaattcgctgagcgatgtactcgatgccttttcaaaagcacccacatttccttcctctaactacttcaccgctatgtggacgatcgctaaacggctttcagacgatcagaaaaggttcgagaaacgccttatgttctcacacccagcatttaaccagctgtgcgagcatatgatgcgggaggctaagatcatgcagtataagtacctcttattttctctacacgcgatagtgaagctgggcatcccccaaaataccatcctggtccagactctgctgcgggttactcaggaaaggattaatgagtgtgatgagatatgcctaagcgtactgtccactgtactggaagcaatggagccctgcaagaacgttcacgtccttcggaccggcttccggattctggtagatcagcaggtgtggaaaattgaagacgtgttcactctccaggtggtgatgaaatgcatcggcaaggatgccccaatagccctcaaacgcaaactggagatgaaagcactacgggaactggaccgcttttcagtactgaactctcagcacatgttcgaggttctggctgcgatgaatcatcgatctctgatcctcctggacgaatgctccaaagtcgtcctggataacatacacgggtgcccacttaggataatgatcaacatcttgcagtcgtgcaaagacctgcaatatcataacctggacttattcaagggtctggctgactatgtcgctgctacttttgatatctggaagttccggaaagtgctatttattttgatcttgttcgagaatctcgggtttaggccagtaggccttatggacctcttcatgaagcgaatcgtcgaggaccctgagtctctgaacatgaagaacatcctgtctattcttcacacgtattcgtcactcaatcacgtgtacaagtgtcaaaacaaagagcagttcgtggaggtgatggcttccgctctgactgggtatttgcacactatttctagtgaaaacttattagatgctgtttacagcttctgcctgatgaattacttccccctcgcacctttcaaccagttgctgcaaaaggacatcatcagcgaactgctgacatccgacgatatgaagaacgcatacaagctgcataccttagatacgtgcctgaaactggacgacaccgtttatctgcgtgatatcgccctaagtctgccccagctgcccagagaactcccctcttctcacacgaacgcaaaagtggcggaggtgctcagttctttgttaggaggggaaggccatttttccaaggacgttcacttgccccataactatcacattgatttcgagatcaggatggacacgaaccggaaccaggtgctcccactgtcagacgttgatacgacaagtgctacagacatacagcgcgtcgcagtgctttgtgtaagccgcagcgcctactgcctgggcagctcccatcctcgaggtttcctcgctatgaagatgcgccatcttaacgccatgggcttccacgttattttggtcaataactgggagatggacaagctagaaatggaagacgcagttactttcctcaaaaccaaaatttattccgtggaggccctgccggtggcagccgtcaatgtgcagtcaactcagtag

SEQ ID NO: 222895 - DNA, 375 bp, Artificial Sequence
  Description of Artificial Sequence: Synthetic coding sequence
atgctcaccacactgaagccattcggaagcgtgtccgtggaatctaaaatgaataataaagcagggtctttcttctggaatctgcgtcagttctccacgttggtctccactagccggaccatgcggctgtgttgtctaggattgtgcaagcccaaaatcgttcattcgaactggaacatccttaataatttccacaaccgcatgcagtctacagacatcatccggtacctgttccaggatgcgtttatcttcaaatccgatgtcggatttcaaacaaaaggaatatcaactcttaccgccttgcggatcgagagattgctctacgcgaaacggttattcttcgattctaaacagagcttagtgccggtggactag

SEQ ID NO: 222896 - DNA, 2295 bp, Artificial Sequence
  Description of Artificial Sequence: Synthetic coding sequence
atggcggcaacactgaaatctctcaagttggtcagataccgggcattctgttctccctccgccttcggggctgttcgctccgtttcttactggaatgtttcatccacccaacacggcggacaggaccccccagagcacatatcactctgtcattcagccaagaaggtgaagaatatttgttccaccttttccagccgccgaatactgaccacaagttccgcacatcctggtttggagttttcaaaaacttctagctctaaggcttctaccctccagttgggcagccctagggccactggagtggacgaagaagacgttgaagtctttgatagctttgagaacatgcgtgtcttcctgcagctgagacctgaataccgggtgcactcttacaacgcctcggaaacatctcaactattaagtgtgagcgaaggagagttgatcttacacaaagtcagggtgaaccaaaacaaccttcaggcgcaggtcatcgttgattatctgtgtaaattatctagtctgccagcggagcagcatcccgtgctgttaggatctacctcatttgctctcctgtgtcaactttctgtcaagaagatccagctcttcgacacccaggatctgataaacgtcctgaaagccttcgtgatccttggcattccccactctcacagcatgttggacgtgtatgaaactaagtgctgtcatcaggtttgggagatgaacatggaccagctgttattggttgcagacctgtggcggtacctcgggagaaaggtgcctagatttctcaatatcttctcctcttatttaaatcttcattggaaagatttatctctctctcagttggtgcacctgatatacgtgattggcgaaaaccgccaggtgagccaagacctgatgcaaaaactggaatccttaatacttaaatacattgacctgattaacttggaggaagtgggaactatctgcctgggttttttcaaaagttctactaacctgagcgaattcgtgatgaggaagatcggcgatcttgcctgtgcaaacatccaacacctgtcatctcgaagtctggtgaatattgtgaagatgttcagatttacacacgtcgatcacatcaactttatgaagcaaattggcgaaatcgctccacaacggatcccaagcctcggagtccagggtgtgatgcatctaaccttgtactgctctgcacttcgcttcctgaacgaaggagtcatgaatgctgtagccgcttctctgccccctcgtgtggcgcattgccgaagcaaagacgtcgctaaaatcctttggagctttgggactcttaactacaaaccgcctaatgccgaggagttctacagctccctgatttcggaaatccacagaaagatgcctgagtttaaccagtatccagagcacctccccacatgcttgttaggattggctttcctggaatactttccagttgagctgatagatttcgcgttgtctcccggtttcgtgcggctggcccaggagcgtaccaagttcgacctgctgaaggaactgtacacactcgacgggaccgtcgggatagagtgcccagactaccgcggaaacagactctctacccacctgcaacaggagggctccgagttgttatggtacctggctgagaaagacatgaactccaagccagaatttctggaaactgtttttctgctagaaacaatgctgggcggtcctcagtatgtgaagcaccacatgattctccctcacaccaggtcctcggacctggaggtacaactcgacgtcaacttgaagccactacccttcaaccgggaggctaccccagccgaaaacgtggctaagctgcgtctcgaacacgtgggtgtgtcgctcactgacgacctgatgaataagttgctgaagggaaaggccagggggcattttcagggaaagacagagtcagagcccggacagcagccgatggaactggagaacaaggccgctgtccccttagggggatttctgtgcaatgtggctgataagtcaggggctatggaaatggctggtctctgcccagccgcttgcatgcagacacctagaatgaaactggctgtgcagttcaccaaccggaatcagtattgttacgggtcccgggaccttttgggacttcacaatatgaaacgaagacagctggccaggctggggtaccgcgtggtggagctcagctactgggagtggcttccactgctcaaacgcacaaggctggagaagctggcattcttgcatgagaaagttttcaccagtgctctctag

SEQ ID NO: 222897 - DNA, 183 bp, Artificial Sequence
  Description of Artificial Sequence: Synthetic coding sequence
atggcctgccaaggccgtgaggaatgctggtgccagtctcgaattgcaagaactcttcccgcagatcagaagccagaatgtcgcccttattgggaaaaggacgacgcatctatgcctctgccctttgaccttaccgacatagtttcggagcttcgcggacagctgctggaggccaagccctag

SEQ ID NO: 222898 - DNA, 630 bp, Artificial Sequence
  Description of Artificial Sequence: Synthetic coding sequence
atgctagacgacttgaatgctacccaccaacactgtgtcctggcaggctcgcaaccacgctttagttctacccacagggtagcagagtgttcgacgggcaccctggattatattttgcaacgctgtcaattggccttacagaacgtttgcgatgatgtcgacaacgatgacgtctccctgaagtcgtttgagccagcggtgctgaagcagggcgaggagatccacaacgaggttgagtttgagtggctgaggcagttttggttccagggcaaccgctatcgaaagtgtactgactggtggtgtcaaccaatggctcagctggaggccctgtggaaaaaaatggaaggagtgacgaacgccgtccttcacgaggtgaaaagagaagggctccccgttgaacagcggaacgagatcctgaccgccatattagcctcgctcaccgcccgtcagaacctacggagagagtggcacgcccgatgtcagagtaggattgcgaggacactgcccgctgatcaaaagcccgagtgtcggccttattgggaaaaagatgacgccagtatgcccctgccttttgacttgactgacatcgtgagcgagcttcgtgggcaacttctcgaggccaagccatag

SEQ ID NO: 222899 - DNA, 321 bp, Artificial Sequence
  Description of Artificial Sequence: Synthetic coding sequence
atggctcagttagaggcactctggaagaaaatggagggggtcacaaatgcagtcctgcacgaggtcaaacgagaaggactgcccgtcgaacaaaggaacgaaatccttaccgcgatcctagctagcctcactgcacgacagaacctgcgcagagagtggcatgctcgatgtcagtctagaattgctcgcactctcccagcggatcagaagcctgagtgcaggccttattgggagaaagacgacgcctctatgcctctgccctttgacctgaccgacatcgtaagtgaactgcgcggacagctgctggaagccaagccatag

SEQ ID NO: 222900 - DNA, 321 bp, Artificial Sequence
  Description of Artificial Sequence: Synthetic coding sequence
atggcccagctggaagcgctatggaagaaaatggagggtgttactaacgcagtgttacacgaggtgaaacgggaggggttgccagtggaacaacgcaacgagatcctgaccgctattctggcctcccttacagcccgacagaatctcaggcgggagtggcacgccagatgccaatcacgcatcgcacggacgttacctgccgaccagaaaccagaatgcaggccttactgggagaaggatgacgcctccatgccactccctttcgatctgacagacattgtgtccgagttgcgtggtcagctgctggaagcaaaaccttag

SEQ ID NO: 222901 - DNA, 384 bp, Artificial Sequence
  Description of Artificial Sequence: Synthetic coding sequence
atggaatggcgaaaagtttccgaatgtaacagcgtcgaaccatgcagggaggtgaagaagtggccctacaggtgcatccaccatgggaagaacttctcacgaatgacaaacgccgtgctgcacgaagtaaagcgcgagggccttcctgtcgagcagaggaatgagatcctaaccgccattctcgcctctctgactgcacgccaaaatttgcgccgtgaatggcatgccagatgccagtcccggatcgcaagaacattgccagccgatcaaaagcccgaatgtcgtccttattgggaaaaggacgacgcctctatgcctctgccgtttgatttgaccgatattgtctcagaattgcggggacagttactcgaggccaagccttag

SEQ ID NO: 222902 - DNA, 1518 bp, Artificial Sequence
  Description of Artificial Sequence: Synthetic coding sequence
atgaagagaacacccacagcggaggagcgtgagagagaggcgaaaaagctgagactgttagaggagttggaagatacctggctcccttatttgaccccaaaagatgatgagttttatcaacagtggcagctcaaataccctaaactgattctgcgggaagcttcgtccgtgtctgaagagctacataaagaggtgcaagaggcatttttaacactgcataaacatggttgcctgttccgagatctcgtgcgcatccaaggaaaggatctactcactcctgtgtctagaatcctgataggcaatcccggttgcacgtataaatatctgaatacccgcctatttacggtcccctggcccgtgaagggatccaatatcaaacacacagaggccgagatagccgcagcatgcgaaacttttctcaaactcaacgattacctacagattgaaacaatccaggctttagaagaactagctgcaaaggaaaaagctaacgaagatgccgtgcccttgtgcatgtccgccgacttcccaagagtcggaatgggcagctcttataatggtcaggatgaggtggacattaaatctcgcgctgcctacaacgttacccttctgaactttatggatccgcagaagatgccttacttaaaggaagaaccctacttcgggatgggcaaaatggctgtaagctggcatcatgacgagaatctcgttgatcgatctgccgtggctgtgtatagctacagctgcgaagggccagaggaagaaagcgaggatgattcccacctcgaagggagagaccccgatatttggcacgtgggttttaaaatctcatgggatatcgagacacctggactggctatcccgctccaccagggtgattgctacttcatgctggacgatctgaatgcaactcatcagcattgtgtcctcgccggaagccagccaagattttcatctacccaccgagtcgcagagtgttcaacgggcacactggattatattttgcaaaggtgtcagctggcactgcagaatgtgtgcgacgatgtggataatgatgacgtgtcgttaaaatccttcgagcctgctgtgctgaaacagggggaggaaatccacaatgaagtagaatttgagtggcttcggcagttctggttccaaggtaacagatacaggaaatgtactgactggtggtgccaacctatggcccagcttgaggccctgtggaagaagatggagggagtaactaacgcggtgcttcatgaggtaaagcgcgaagggttgcccgtagaacagcgtaacgagattctgactgcgattctagccagcctgaccgcccgacagaaccttcggagagagtggcacgccaggtgccagtctagaatagcgcgaacactgcctgccgaccagaagcccgagtgccggccttattgggagaaagacgatgcctccatgcctttgccatttgacttgactgatatagtgtctgagctccgtgggcagctgctggaggcaaagccttag

SEQ ID NO: 222903 - DNA, 321 bp, Artificial Sequence
  Description of Artificial Sequence: Synthetic coding sequence
atggcacagttggaggccctgtggaaaaaaatggaaggcgtcactaacgccgttctacatgaggtcaaaagggagggactgcccgtagagcagcgaaatgaaattttgacagcaatccttgcctccctgacagcaaggcagaacctgcggcgagagtggcacgccaggtgtcaatccagaatcgctcgcacactccccgctgaccagaagccagagtgccgaccttattgggaaaaagatgacgcaagcatgccactgccttttgatctcacagacattgtgtccgaattaagaggccagctgctggaggccaaaccctag

SEQ ID NO: 222904 - DNA, 13050 bp, Artificial Sequence
  Description of Artificial Sequence: Synthetic coding sequence
atgacaatcgctctactgggttttgctatttttctgctgcactgtgcgacctgtgaaaaacccctggaaggcatcttgagcagctctgcatggcacttcacacatagccactacaacgcaacaatctatgagaactcttcccccaaaacatatgtggagagctttgagaagatgggaatttacctcgccgagccacagtgggcggtgcgttaccgtatcatttccggagatgtggcaaacgtctttaagaccgaggagtatgtagtaggtaatttctgtttccttagaatccggacgaaatcatccaacacagcgctgctgaatcgcgaggtacgcgattcttacactctcatcatccaggccactgagaaaactctcgagttggaagcactgactcgagtcgtcgtgcatatcttagatcaaaatgacttgaagccactcttcagtcctccctcataccgggtgacaattagcgaagacatgcctctgaaatcgccgatttgtaaagtcaccgccacagacgccgacctcggccagaacgccgagttctactacgcatttaatacgagatccgaaatgttcgccatccatcctacctcgggcgtcgtcacagttgcaggcaaactgaacgtcacatggaggggtaagcacgagcttcaggtacttgccgtggacaggatgcggaagatatccgagggcaatgggtttggcagtctagccgctctggtcgtccacgtcgagcccgcactccgaaaacctcctgcaattgcgtctgtggttgtgaccccacccgattctaacgacggcaccacctatgccactgtcctcgtggacgcgaactcgtctggtgcagaggtggagtcggttgaagtcgtcggcggagaccctggaaaacacttcaaggccattaagtcctatgccagatccaacgaattttctctggtatctgtcaaagatatcaattggatggaatacctccatgggtttaacttgagcctgcaggcgaggagcgggtcagggccttacttctacagccagattagaggattccatctcccaccgtctaagttgagcagcctgaaattcgagaaagctgtatacagagttcagctcagtgagttcagcccacccggatctcgcgtagtgatggtgcgtgtgactccagcctttccaaacttacaatacgtactcaagcctagttcggaaaacgttggattcaagctcaacgcgagaaccggtcttattactactaccaagctcatggatttccacgacagagcccattaccagcttcatattaggacctctccaggacaggctagcacggtggtcgtgattgacatcgtggattgcaacaaccatgctcccctgtttaatcggtctagctacgatgggactctcgacgagaacatcccgccagggacatcagtgttggctgtgaccgccactgatcgagaccatggggagaacggctatgttacatactcaattgcgggacccaaggccctgcctttcagcatcgatccatacctggggatcatttctactagtaaacccatggactacgaactgatgaagcgaatatatacatttagagtgagagcaagcgattgggggtcaccattccgtcgagaaaaagaggtatcaatcttcttacagttgaggaatctgaatgataatcagccgatgttcgaagaggtgaactgcacaggttcaattagacaggattggcccgttggaaaatcaattatgacaatgtccgccatcgacgttgacgagctccagaacctaaagtacgaaattgtctcagggaacgaactggagtattttgatttgaaccacttctctggcgttatctctctgaagagacccttcatcaatctgaccgcaggtcaacctacgtcgtactctctcaagattaccgcttcagatgggaagaactacgcttccccaaccacgctgaatattacagtggtgaaagacccccatttcgaagtgccggtaacctgcgataagactggcgtattgactcagttcacaaaaaccatcttgcattttatcgggttacaaaatcaggaatccagcgacgaagaatttacttccctttctacctaccagatcaaccactacactccccagttcgaagaccacttcccccaatctatagatgtgctcgagtctgtgccaatcaacactccgttagcccgactggccgcaaccgatccagacgctggctttaacggcaagctggtgtacgtgatcgctgacggtaatgaagaggggtgtttcgacatcgagctggagactggcctcctgaccgtggccgcacctctggattatgaagcaactaatttttatatcctgaatgtgacggtgtacgatttgggaaccccacagaaaagttcctggaagcttctcaccgtaaatgtaaaagattggaatgacaacgcccctcgcttcccccctggtggctaccaactcaccatcagcgaggacaccgaagtgggcactaccatagctgaactgactactaaggacgccgatagcgaagacaatgggagggtcagatatacgttgctcagccccaccgagaaattctcccttcatcccctgacgggagaactcgtggtgacggggcatctcgaccgagaatccgagccccgttacatcctgaaagtcgaggctcgcgaccaaccaagtaaaggccaccaactgttcagtgtcaccgatctgattattacactggaagatgtcaacgataacagcccacagtgtatcacggagcataatagattaaaagtccccgaggatctgccccctgggactgttcttaccttcttggatgcatcagatccagacttgggaccagcgggagaggtgaggtatgttttaatggatggggctcatgggacctttcgcgttgatctgatgactggcgctctcatcctggaaagggaactcgattttgaacgacgggctggatataacctgtcactttgggcaagtgacggtggcaggcccctcgcgaggcgaaccctgtgccacgtagaggtgatcgtcctggacgtgaatgaaaacctccaccccccacattttgcctccttcgttcatcagggccaggtccaggagaatagcccctctggaacccaggtaatagttgtggcagcacaggatgatgactcggggcttgatggcgaattgcagtacttcctacgggcagggactggtctggccgctttctcaatcaatcaagatacagggatgattcaaaccctagcgccactcgatagagaatttgcgtcctattactggcttaccgtgttggctgtagataggggtagtgtaccgctttctagtgtcaccgaagtctatatcgaggttactgacgccaatgataatccacctcagatgtctcaggctgtgttctaccccagcatccaagaagatgccccagtaggtactagcgtcctgcagttggacgcatgggacccggatagcagctccaaaggcaagttgacttttaacatcaccagcggtaactacatgggcttctttatgattcatcccgtcacgggactcttgtccactgctcagcaactggatagggaaaataaagacgaacatatactggaagttaccgtgctggacaatggcgaacctagtctgaagagtacttctcgtgtcgtggtgggcattctggacgtcaatgataatccccctattttctctcataagttgtttaatgttcgactacccgaacgtctctccccggtgagcccaggcccagtgtatagactggtcgcatctgatctggacgagggccttaacggtagggtgacatactccatcgaggattctgacgaagaagcgttcagcatcgatttggtgactggggtcgttagctcaagtagcacctttactgcgggagaatacaatatccttaccatcaaggccactgactccggacagcccccattgagtgctagcgttagattacacatagagtggataccctggcctcgccctagcagtataccgctggccttcgacgaaacttactactctttcacagtcatggaaacggatcctgtcaaccacatggtgggcgtaatctcagtagaaggtcgccctgggttgttctggttcaatatatcaggcggtgacaaagatatggatttcgatatcgagaagaccaccggaagtatagtcatcgccagacctctggatactaggcgcagatccaattacaatcttactgtggaagtaacggacgggtccaggactatcgccacccaagtgcacatttttatgattgccaatataaatcaccatcgacctcagtttcttgaaacgagatatgaggtacgcgtgcctcaggataccgtaccgggagtagaactcttaagagtgcaggctatcgatcaggacaaaggcaaatctctgatctatacgattcatggctctcaagatcctggcagcgcgtccttgtttcagctggacccgtctagcggagtccttgttacagtcggcaagttggatctcgggagtggcccatcccagcacactctgactgttatggtgcgggaccaagaaattcctattaaacgaaattttgtgtgggtgactatccacgtcgaagacggcaacctgcatccccctcggttcacccagctacactatgaggcctccgtgcccgatactatagcacccggtaccgaattgctgcaggtcagagcgatggatgccgacagaggcgtgaatgccgaagttcattatagcctgttgaagggtaactcagagggctttttcaatataaatgcgcttctcgggattatcactttggctcagaagttagaccaggcaaaccacgccccacatacattgaccgtcaaggccgaggatcagggctcaccgcaatggcatgatctggcaactgttattattcacgtctacccctccgatcgctcagctcctatcttctccaagtcagaatattttgtcgagattcccgaatccattccggtcggctcaccaattttgctggtgagcgcgatgagcccctctgaagtaacatacgagcttcgggagggaaacaaagacggcgtcttttctatgaattcatacagcggcctaatttcaactcagaagaaactggatcacgagaagataagttcctatcagcttaagattcggggaagcaacatggctggagccttcacagatgttatggtcgttgtcgatatcatcgacgagaacgataatgcgcctatgttcttgaagtcaacttttgttggccagatctccgaagctgcaccactctacagtatgataatggataaaaacaataatcctttcgtcatccatgcttctgactcagacaaggaggccaattcgttactggtgtacaaaattcttgagcctgaagcactcaaattttttaaaattgaccctagtatgggtaccctgacaattgtcagcgaaatggattatgagtcaatgccctcttttcagttctgtgtatacgttcacgatcagggatcacctgtgctgtttgcaccgcgaccggcacaggtgatcatccatgtacgagacgtcaatgactcccccccacgtttcagcgagcagatttacgaggtggccattgtcgggcctattcaccccggaatggaactgctcatggtgagggcctccgacgaggactccgaggtgaactattctatcaagacaggcaatgcggacgaagccgtgactattcatccagtcacaggctccattagtgtacttaacccggcttttctcggcctctcgcgcaaactgaccatccgcgcaagcgacggactctatcaggacactgctctggtgaagatatcactgactcaggttttagataagtctctccagttcgaccaggatgtttactgggcagctgtgaaggagaacctgcaggataggaaagccctagtaatcctgggcgcacagggaaaccatctgaatgacacactgtcttacttccttcttaatgggactgacatgttccacatggtacagagtgctggagtgctccagaccagaggagtggcctttgacagagagcagcaagacacccatgaactggcagttgaagtgcgggacaatcgcactccgcagcgggtcgcccagggcctggtgagagtaagcatcgaggacgtaaacgacaacccacctaaattcaaacatctcccatactacactattattcaagatggtaccgagcctggtgatgtattattccaggttagcgcgactgacgaagacttgggcaccaacggtgccgtcacttacgaattcgcagaagattacacctactttaggatcgacccttacctgggagacatatccctgaagaagcccttcgattaccaggccctgaataagtaccacttgaaagtcattgcacgcgatggagggaccccgtcccttcagagtgaggaagaggtcctggtgacagtgcggaacaaaagcaatcctctgttccagtccccttattacaaagtacgagtgccagaaaacattacactgtacaccccaatactacatactcaggcgagatctcctgagggtttgcgtttgatttacaatatcgtggaagaagaacccctcatgctgttcacgaccgacttcaagaccggcgtgctaaccgtgactggtccgctggactacgagtccaagacgaaacacgtgttcactgtacgcgcaactgataccgctctgggcagcttcagcgaagccacggtggaagttttagtcgaggacgttaatgacaaccctcccaccttctctcagctggtttacaccacctccatcagtgagggtctacccgctcagacacctgtgattcaacttctagccagcgatcaggattcggggcgaaaccgcgacgtgagctaccagatcgttgaagatggcagcgatgtctctaaattctttcagattaacggctcaacgggcgaaatgagcaccgttcaagagctagactatgaagcccaacagcactttcatgtgaaagtcagggccatggataagggagacccccctttaaccggcgaaactctagtagtggttaacgtctcggacatcaatgataaccctcctgagttcaggcagcctcaatacgaggcgaacgtgagtgagttggctacatgcgggcacctggtactgaaggtgcaggccatcgatccagattccagagataccagccgcctggaatatctgatcctttccggcaaccaagataggcacttttttatcaacagcagcagtggaattatcagcatgttcaatctgtgcaaaaagcacctagactcttcatacaatctccgagtcggggcttccgacggggtgttcagagccaccgtccctgtctacatcaatactactaacgcaaacaagtacagccccgaatttcagcaacatctttacgaagcggagttggcggagaacgcgatggtagggaccaaagtgatagacctactcgccattgacaaggactctggcccatatggaacaatagactatacgatcatcaataaacttgcttccgagaagttttccatcaatccaaatggccagatagctactctccaaaaactagaccgcgagaacagtaccgagcgtgtgattgccattaaagtcatggcccgagacggcggtgggcgtgtggcattctgtacggtcaagattatcctgactgacgaaaacgacaatccaccccagtttaaagcctcagaatatacagtatccatacagtccaacgtcagcaaggattcacccgttatccaggtactggcctatgatgccgacgagggacagaatgctgatgtcacatacagcgtgaatcctgaggacctcgtgaaagacgtcattgaaatcaatccagtaaccggagttgtgaaagtgaaggactctctggtcggcctggaaaatcagaccttggactttttcatcaaagcccaggacgggggaccgcctcactggaactcactggtccccgtgcggctgcaggttgttcccaaaaaagtctctctgcccaagttcagcgaacctctctataccttctcagctccagaagatctccccgagggatccgagattggtattgtgaaagctgtcgcagcccaggaccctgtgatatactctctggtgcggggtacaaccccagagagcaataaggatggggtcttttctttggatccagataccggcgtgataaaggtgcggaagcccatggatcacgaatctaccaaactctaccagatagatgtgatggcccactgtctgcagaatactgatgtcgtgtctctcgtgagtgtgaatatccaagttggcgacgtgaatgataatagacccgtcttcgaggctgacccctataaagccgtcttaaccgagaatatgcctgttgggacctccgtgatccaggttactgccattgataaggacaccggtagggatggccaggtgtcctatcgccttagcgccgacccagggtccaacgtgcatgaattatttgctatcgatagtgaatccgggtggatcacaaccctgcaggagttggattgtgagacctgccagacataccatttccacgtagttgcatacgatcatggtcagaccatacagctttcttcacaggctcttgttcaggtgtccattaccgacgagaacgacaatgctcccaggtttgctagcgaagagtatcgagggagtgtggtagagaattccgaaccaggggaactggtcgccaccctcaaaacactcgacgcagatatttccgaacaaaatcggcaggtgacatgctatataaccgaaggcgacccacttggtcagttcggtatatctcaggtcggggatgagtggcgcatctcttcccgaaagacattggacagagaacacactgcaaagtacctgttgcgagtgacagcttccgacggaaaatttcaggcaagcgtgacagtagaaattttcgttctggacgtgaacgacaactctccccagtgtagccagctcctctacaccggtaaggtccacgaagacgtttttcctgggcattttattctcaaagtctctgcaacagaccttgacactgataccaacgctcagatcacatactcgctgcacggtcccggagcgcatgaattcaagctcgatccgcacacaggggagctcactacattgaccgcgctggatagggagcggaaggatgtgtttaatcttgtggctaaggccacggacgggggagggcgatcttgccaagcagacatcaccctccatgtcgaagatgtgaatgataatgcccctaggttcttcccttctcattgtgccgtcgccgtttttgataatacaaccgtgaagacgcctgtggcagtagtgttcgcaagagacccggatcagggagccaatgcacaggttgtgtactccctccccgatagcgccgagggacactttagtatcgacgccaccaccggcgtcatccgcctcgagaagcctttgcaggtgcgaccacaggccccactagagctcacagtgcgggcttctgacctcggcaccccaattcccctctcaaccttgggcacagtcactgtgtccgtagttggattagaagactacttacctgtgtttcttaatacagaacattccgtgcaggtccccgaggacgcacccccagggaccgaggtcttacagcttgccactcttaccaggcccggtgccgagaagacagggtaccgcgtggtgagcggcaatgaacaaggcagattccgacttgatgcccgaactggcatcctctatgtcaacgcctccctcgatttcgagaccagccccaaatatttcctgtcaattgagtgttcacgcaaatctagttccagcctctccgatgtgactacagtgatggttaacatcacggacgtcaatgagcacagaccacagttcccccaagacccatatagcactcgtgttttagaaaacgctctggtgggtgatgtgattctgactgtgagcgcaacggatgaggacggacccctcaattccgacatcacctacagcttgattggaggtaatcaactcggtcacttcacaatccaccctaagaaaggagagcttcaggtcgctaaggcgctggacagagagcaggcaagcagctacagcctgaagttgagagccacggatagcggccagcccccactgcacgaagataccgacattgccattcaggtggccgatgtcaatgataatccacctcggtttttccagttaaactacagcaccacagtccaggagaattccccaatcggaagcaaggtgcttcagcttatactctctgaccccgattccccggaaaacggacctccctactcctttcgaattacaaaagggaacaacggttctgcttttcgggtaacccctgacgggtggctggtgacagccgaaggcctgtctcggagggcacaagagtggtaccagctacagatccaggccagcgacagcggaatccctccactcagctcattaactagcgtgcgcgtacatgtcaccgagcagagtcactatgccccaagtgctctgcccttggaaatattcattacagtaggggaagatgagttccaaggcggaatggtcggaaagatccatgcaaccgaccgagaccctcaagatacgctgacctatagcttagctgaggaagagactctcggacgccatttctctgttggcgctcccgacggcaaaataatcgccgctcagggcctgcctcgcggacactattcatttaatgtgaccgtgagcgatgggaccttcacgacaaccgcaggcgtgcacgtctacgtttggcatgtgggccaggaggccctgcagcaggccatgtggatgggattctaccagctaacgcctgaagaactggtttcagatcattggaggaacctgcagcgctttttatctcacaagttagacattaaacgcgctaacatccacctcgcgagtctgcagccagccgaagccgtggccggagttgatgtcctgcttgtatttgaaggtcactccgggactttctatgagttccaagagcttgcttcaattattacacattcagccaaggagatggaacacagtgtgggggtgcagatgcggtctgccatgccgatggtcccttgtcagggacctacatgccaggggcaaatatgccacaacactgtgcatttagaccctaaagttggaccaacctacagtactgcacgcctcagcatcctgacacctaggcaccacctgcaaaggtcatgctcctgtaacgggaccgctaccagattctccggccagtcttatgtgaggtatcgggctcccgctgccaggaattggcacattcacttttacctgaagaccttgcagccacaagctatcctcttgttcaccaatgagaccgcctctgtttcgctgaagctagcctccggggtgcctcagctcgaatatcactgcctcggcggattttatgggaatttatcctcccagaggcatgtaaacgatcacgagtggcacagcatcctggtcgaagagatggacgctagcattcggcttatggtagatagcatgggaaacacgagtttggtcgttcctgagaattgtaggggcctgcgaccggaaaggcacctgctgctgggaggactgattctgctgcacagttccagcaatgtgagccagggctttgaaggctgtttagatgcagttgtagtgaatgaggaagctttggacctgctagcaccgggtaaaacagttgccggactgttggagacacaagctttaactcaatgctgtctccatagtgactactgcagccagaacacctgtctcaatgggggaaaatgttcctggacgcacggcgctgggtacgtatgtaaatgcccccctcagttttcaggcaagcactgtgagcagggacgtgaaaactgcaccttcgcaccctgcttagagggcggaacctgcattctgtctcccaagggcgcttcctgcaactgtccccacccatacaccggagacagatgcgaaatggaggccaggggatgctccgaggggcactgcctggttaccccagaaatccaacgcggagactgggggcagcaagaattgttaataataaccgtggccgtggccttcataatcataagcactgtcggactcttattctattgccgccgatgtaagagccataagcccgttgcgatggaggatccagacctcctggctcgatctgtcggcgtcgacacccaggcaatgcccgctatcgaactcaacccgctgtccgcctcttcgtgcaacaatctcaatcagccagagcctagtaaggctagcgtacctaacgagctagtcacatttggtcctaattccaaacaaaggccagtcgtgtgttccgtgcctccacgactaccaccagccgcagtcccttctcatagtgataatgaacctgtcataaaaaggacctggagctccgaggaaatggtgtacccgggaggagctatggtctggccacctacctacagtcgcaatgaacgctgggaatatcctcacagcgaggtcacacaaggccctttaccaccatcagctcatcgccatagcacgcctgtcgtgatgcccgagccaaacggcctctacgggggattccctttccccctagagatggagaataagagggctcctctgcccccaagatacagcaaccagaacctcgaggacctcatgccctcacggccaccttctccacgtgagcgtttagtggccccatgtctcaatgagtatacagcaatttcctattaccattctcagttccgccagggaggaggaggcccatgtcttgccgacggcggatacaagggggtaggcatgagactgtccagagcaggccctagttacgcggtttgcgaggtggaaggcgctccactcgccggtcagggacagcccagggtgccacccaactatgaggggagtgacatggttgaaagcgactacggatcttgcgaggaagtgatgttctaa

SEQ ID NO: 222905 - DNA, 13770 bp, Artificial Sequence
  Description of Artificial Sequence: Synthetic coding sequence
atggatatcatcatgggccactgtgtgggcactcgacccccagcctgttgtttaatccttctgctatttaagctgctggctaccgttagccagggcctcccaggcactgggcctctggggttccactttactcactccatttacaacgcaacagtgtacgaaaattcagctgcacgcacttatgtcaactctcagagtcgcatgggcatcaccttaattgatctatcctgggacattaaatacagaattgtttcaggagatgaagaggggttcttcaaagccgaggaagtgattatagccgacttttgtttcctgcgcatccgaacaaaggggggaaattcagccatcttgaacagagaaatccaggataactacctgctgatcgttaaggggtctgtaagaggcgaggacctcgaggcatggaccaaggttaacatccaggtgcttgacatgaatgaccttcgccctctgttctcaccaacaacctacagcgtgaccatcgccgagtctaccccactgagaacctccgtcgctcaagtgacagccactgacgcggatattggatccaacggagagttctattactatttcaaaaacaaggtggacctcttctccgtacatccgaccagcggtgtgatctctctgtctggtaggctgaactatgacgagaagaacaggtacgacctggaaatactggccgtcgatagggggatgaaactgtatgggaacaacggagtctcctcaacagcaaagctgtatgtgcacattgagcggattaacgagcacgctcctacaatacatgtggttacacatgttccttttagcctcgagaaggagcccacctacgcagtagtcactgtggatgacctcgacgacggagctaacggcgagattgaatcggtgtcaattgtggcaggagaccccctggaccagttctttctggctaaagaaggaaagtggctcaacgagtataagattaaggagagaaagcagatcgattgggaatcgtttccctatggttacaatctaacactacaagcgaaggacaagggctcacctcaaaaatgttctgccctgaaagcagtgtacattggcaatccgaccagagacaccgtgcctatccggtttgagaaggaggtctacgacgtgagcattagtgaattttcgcccccaggtgtagtcgtagctatcgtcaaactaagtccagaaccaatcgacgtagagtacaagctaagtcccggagaggacgcagtatatttcaagattaacccaagaagtggactcatcgtcacggcacggccactgaataccgtcaagaaagaagtgtacaaactagaggttaccaataaggaaggcgatctcaaggcgcaagttaccatctcaatcgaggatgccaacgaccacacacctgaattccagcagccattatatgacgcctatgtcaatgaatcagtacctgttggcacaagtgtgttgacggtaagtgcttcggacaaagacaagggtgaaaacggctatatcacttacagtattgcaagtcttaacttacttccattcgtaattaaccagtttaccggtgttatctcaactaccgaagaattggacttcgaatcctcacccgagatttaccgctttattgtgagggcctccgactggggaagcccataccgacatgagtctgaggtgaacgtcaccatccgaattggaaacgtgaacgataactcacctttgttcgagaaagttgcttgccaaggtgtgatctcatacgatttccccgtgggaggccacatcacggccgtctccgccatcgacatcgacgaactggagctggtgaagtacaagattatttccggcaacgaattagggttcttttacttaaatccggacagtggcgttctgcagctaaagaagtcgctaacgaatagcggcatcaagaacggaaactttgcgctgaggatcactgcaactgatggtgaaaacctggccgacccaatgagtattaacatcagtgtgcttcacggcaaagtgagcagcaagtccttttcctgcagggaaacccgggtggcacagaagctggctgaaaaacttctgatcaaggccaaagctaatggcaaactgaacctggaggacggcttcctggatttctattctatcaataggcaaggcccatactttgataaaagtttcccgtcagacgtggccgtgaaggaggacctcccagttggggcaaacattctgaaaataaaagcctacgacgcagacagcggctttaatggcaaagtgcttttcaccatttccgatgggaacacagatagctgctttaatatagacatggaaacagggcaactgaaggtcctcatgcccatggaccgagagcacacagacctatatctcctcaatattaccatctacgatctggggaacccacagaagagtagctggagactgctcaccatcaatgtggaagatgccaatgacaactcaccggtgttcatccaagattcctactcagtcaatatactggaaagtagcgggatcggcaccgagattattcaggttgaggccagagataaagacctaggctccaacggtgaggtcacatactcagttctaaccgatacccagcaatttgccattaatagtagcactggaatcgtctatgtggccgatcagctggaccgtgaatcaaaggctaattatagtctgaagatcgaagccagagataaagccgagtccggccagcagctgtttagtgttgtcacgctgaaggtgtttctcgacgacgtgaatgattgtagcccagccttcattccttctagctacagcgtgaaagtcctggaggacttacccgtcggcactgtgattgcatggctcgaaacacacgaccccgacctgggattaggcggacaggtgagatactccctcgttaatgattacaatgggcgattcgaaatcgacaaagcttctggagcaattcggctctcaaaggagctggactacgaaaagcagcagttttataacttgaccgtacgtgccaaagacaaggggcgtccagtgtccttgtctagcgtctccttcgtggaggtcgaggtggtcgacgtcaacgagaacctgcacaccccttactttccggattttgccgttgtgggcagtgtgaaagagaactctcgtatagggacctcagtccttcaagtgacagctagggatgaggactccggcagggatggtgagatccagtatagtattcgcgatgggagtggtctgggtcgtttttccatcgacgatgagagtggggtcatcacggccgcagacattcttgatcgggagacaatggggtcctattggctgaccgtttatgcgaccgatagaggagtagtgccgctttacagcaccatagaagtgtacatcgaggtcgaggatgtcaacgataacgcccctttgactagcgagcccatctactatccagtagtcatggagaactcccccaaggatgttagtgtgatccagatccaagctgaggatcccgattcctctagcaacgagaagctgacataccgaatcacatcaggcaatccgcagaatttcttcgcgatcaacatcaagaccggtctgatcaccacaacctcaaggaaacttgatcgggagcagcaggccgagcatttcttagaggtaactgtgacagatggagggccatcccccaagcagtcgacaatatgggtggtcgtccaggtactggacgagaatgacaataagccccaatttccggaaaaagtatatcaaataaagcttcctgagagagaccggaaaaagcgaggagaacccatctacagagcttttgctttcgaccgcgatgaaggcccaaacgccgagatctcctacagcattgtggacggcaatgacgatggtaagttcttcatcgaccccaaaacgggtatggtctcatcaaggaagcagtttactgctggctcttacgatatcctgaccatcaaggccgtggacaacggcaggccacagaagtcatctacggcccgattgcacatcgaatggatcaaaaagcctcctcctagccctataccgcttaccttcgatgagcctttctataattttactgtcatggaatctgatcgcgttaccgagatagtcggcgtggtgtccgtccagcccgcaaatactcccctgtggttcgacatagtcggcggaaattttgatagcgctttcgatgccgaaaagggggtggggacaattgtgatcgctaaaccactcgatgcggagcagagaagtatttataacatgagtgttgaagtgacagacggtaccaacgtggccgtcactcaggtgtttattaaggtcctcgataacaacgacaacgggcctgagtttagccagccgaactatgacgtcaccatctccgaggatgtgttacccgatacagaaattctacagatagaggccactgaccgggatgagaagcataagttatcatacacagtacattcctccatagatagtatctcaatgcgaaaattccgaatcgacccaagcaccggggtactgtataccgctgaacgactggaccacgaggctcaggacaaacacatccttaacatcatggttagggatcaagagttcccatatcggcgaaatctggcgcgtgtgattgtaaacgtggaagacgctaacgatcattcaccctacttcacaaatccgctatacgaggcctccgtgtttgagagcgccgctctcggctccgcagtcttacaggtcaccgccttagataaggataagggcgaaaacgctgaattgatatataccatcgaggcaggcaatactgggaacatgtttaaaatcgaacctgtcctggggattatcactatctgtaaagaacccgacatgacaactatgggacaatttgttctgtccatcaaagtcacagaccagggatcaccccctatgtctgccacagcgatcgtgagaatctctgttacgatgtctgataattcacaccctaagttcatccacaaggattaccaagctgaagtgaatgagaatgtcgacattggaacgagcgtgatattgatcagcgccatcagtcagtcgaccctgatctacgaagtaaaagatggcgacatcaacggaatttttacgataaacccatactcaggggttattacaacacagaaggccctggactacgaacgcacttcttcttatcagctgattattcaagccacaaatatggcaggaatggcatccaacgctactgtgaacatccagatcgtcgatgaaaatgacaatgccccagtctttctctttagccagtactccggttctctgagcgaggccgctccaatcaactcaatcgtcagatctctggataactccccactggtcatccgcgcaaccgacgcagactccaataggaacgctttgttagtgtaccaaattgtggagtctacagccaagaagttcttcactgtggattcctctactggcgcaatacggaccattgcaaacctggatcatgagacaattgcccactttcatttccacgttcatgtacgggacagcggcagtccacaactgactgctgagagccctgtagaggtgaatatcgaagtcacagatgtcaatgataaccctccagtgtttactcaggcagtgttcgagaccattcttcttttaccgacatatgttggagttgaggttctgaaagtaagtgcgactgacccggatagcgaagtacctcctgagttgacctattcattgatggaaggatctctggaccactttctgatcgactcaaattcaggcgtcctaactatcaaaaacaataacctttctaaagaccattacatgctgatcgtgaaggtcagtgatggaaagttctacagtaccagcatggttacaatcatggtcaaggaggctatggactccggactccactttacacagtctttttactccacctcgatttccgagaataatactaacatcactaaggtggccatcgtgaacgctgtgggcaatcggctgaatgagccgctgaaatattctatcctcaatccaggcaacaaatttaaaatcaaaagcacttcaggagtcatccaaaccactggagttcccttcgatagggaggagcaagaactatatgaacttgtggtggaagctagcagggagctggaccacctgcgtgtcgcacgtgttgtggtgcgagtgaacattgaagatataaacgacaactcccccgtctttgtgggcctgccttactatgctgcagtgcaggttgatgccgaacccggaacgttaatctaccaggtgacggcgatagacaaggataaggggccaaatggtgaagtaacatatgtcttgcaagatgactacggacactttgaaattaatcccaactccggcaatgtcatcctgaaggaggcttttaacagcgatttgagtaatatagagtatggggtgaccattcttgctaaggatggaggcaagccttctttaagcacgagcgtggagctgccaatcacgatcgtgaataaggccatgcctgtgttcgacaaaccattctacactgcatccgttaatgaggacattcgaatgaacaccccaatcctgtccatcaacgctactagccccgagggacaggggataatttatataatcatcgatggtgaccctttcaagcagttcaacatcgatttcgacacaggagtgctgaaggtagtgtctcccttggactatgaagtaacaagtgcgtataagcttactattcgtgccagtgacgccctgacaggcgcacgtgcggaggtgaccgtggacctgttggtcaatgatgtgaatgacaatccgcctattttcgaccagccaacgtataataccaccctctctgaggcaagcctaatcgggactccagtgctgcaagttgtgtctatcgacgccgatagcgaaaacaataagatggtgcattatcaaatcgtccaggacacctacaattctacagattacttccacatcgattcctcttcgggcctcatcttaacagccagaatgctcgatcacgagttagtgcagcactgcacactgaaggtgagaagcatcgattctgggttcccctccctgagcagtgaggtcctcgtccacatttatatttctgatgtgaatgacaatcccccagttttcaatcagctgatctatgagtcgtacgtaagtgagctcgctcctaggggccatttcgttacctgcgtgcaggcttctgacgctgatagctccgactttgaccggctggagtacagcatactgagcggaaacgaccggacttctttcttgatggactcaaaatcgggcgtcatcacactaagcaatcacaggaaacagcggatggaaccgctgtatagcttaaatgttagcgtctccgacggcctctttactagtaccgctcaggttcacatccgagtcctaggcgctaatttgtacagtcctgcattttctcagtcaacatatgttgcagaggtaagggagaacgtggcagctggtacaaaagttatacacgtacgcgctaccgacggcgatcccggaacatacggtcagatcagctacgctattatcaacgacttcgccaaggaccgatttcttatcgactccaacggacaagttatcactacagagaggctcgatagggaaaacccactggagggggatgtgtcaatatttgtgagagctctggatggcggtgggaggactaccttttgcaccgtcagggtgatcgtagttgatgaaaatgataatgcccctcagtttatgacagtggagtaccgggcttcagtccgcgctgacgttgggcgtggccatctggtcacccaggtgcaagccatcgaccccgatgacggcgctaactcacgcattacatactctctttattctgaggcctcggtcagcgtcgcggatctgctcgaaattgatccggataatgggtggatggtcactaaggggaacttcaatcagctcaaaaacactgtcctgtccttcttcgtgaaagccgtcgatggaggcatccctgtgaagcattctctcatccctgtctacatacatgtacttcccccagagaccttcttaccgagctttactcagtcacagtactcttttacaatcgcggaagataccgccattggcagtacagttgatactctaagaattttaccttcccagaacgtgtggttttcgaccgttaacggggagcgccctgagaataacaagggcggaatcttcgtcattgagcaggaaactgggacgataaaactggataaacgcctggaccgtgagacctccccagccttccatttcaaggttgctgcgacaatccctctcgataaggtggatattgtttttacggtggatgttgacataaaggtgctcgacctgaatgataacaaaccggtgtttgaaactagctcttatgataccatcatcatggaaggcatgcccgtcggtacaaagctgacccaagtccgcgcaatagacatggactggggggctaatggccaggtcacctattcgctccattcagattcacagcccgaaaaggttatggaggcttttaacatcgattccaacaccgggtggatttccactttgaaggacctggaccacgagacagatccaaccttcacgttttctgtagttgcctctgacttaggcgaggcattttctctcagcagtaccgccctcgtgagcgtcagagtgactgatataaatgataatgccccagtttttgcacaggaggtctatcgcggaaacgtcaaggagagcgaccctcctggagaggtggtcgcagtgctctcaacctgggaccgagacacgtctgacgtaaaccggcaagtctcctatcatattactggtggtaatccgagaggcaggtttgcgcttgggctggtgcagagcgaatggaaggtctacgttaagaggccgttggatcgtgaggaacaggacatatacttcctgaatattaccgcaacagatggtttatttgttacgcaggccatggtagaagtgagcgtctccgatgtgaacgacaattctcccgtctgtgatcaggtggcatacacggctcttttacctgaagacattccctccaacaagatcattctcaaggtgagtgcaaaggatgcagacattggttcaaacggctatatccgctattccctgtacgggagcggcaactcggaattttttctagatccagagtcaggggagctaaaaactcttgctctgctggacagagaacgaatccccgtctactctttgatggcaaaggcaacagatggcggaggacgattctgccagagcaatatccacctaatcctggaggatgtaaatgacaaccctcccgtcttctcatctgatcattacaacacatgcgtgtatgaaaataccgcgaccaaagcgctactcactagggtccaggcagtcgaccctgatatcggtattaatcggaaggtagtctatagcctcgccgactcggcaggtggtgtattttcaatcgacagcagctccggtatcattattcttgagcagccgctcgacagggagcaacagagcagttacaatatctccgtgagggccactgaccagagtccgggacagagcctgtcttccctaacaactgtgacaattacagttttagacattaacgacaatccccctgtatttgagcgaagggactatctcgtgaccgtccctgaggacacatcaccagggacacaggtgctcgctgtctttgccacctcaaaggacatcggcacaaatgccgaaattacatacctcatccgatccgggaatgaacaaggaaaatttaaaatcaaccccaaaacggggggtatcagcgtctccgaggtcttagattatgagttgtgtaaaagattttacttggtcgttgaggcaaaggatggaggcacacccgctctttctgcagtagctaccgtgaatatcaatcttaccgacgttaacgataatcctccaaagtttagtcaggatgtatattctgcagtaatcagcgaggacgcactcgtgggcgatagcgtgattctgttaatagccgaagatgttgacagtcaacctaacggacagatccacttctccattgtgaatggtgatcgagacaacgaatttactgtcgacccggtgctgggcctcgtgaaggtcaagaagaagctggatcgcgaacgtgtcagcggctattctctcctggttcaggccgtcgattccgggatccccgctatgtcatcaacagctaccgtgaatatagatatatccgacgtgaacgacaattccccagtgttcactccggctaattacaccgccgtgattcaagagaacaaaccagtgggaacaagcatcctacagctcgtggtgacagatcgtgattcgttccataatggaccaccgtttagcttcagtattctctctggtaacgaggaagaggagtttgtcttggatccacacggtatcttgaggagtgcggtggtctttcagcacacagagagcttagaatatgtactgtgcgttcaagccaaggactctggaaaaccacaacaggtgtctcatacatacatcagagtgcgagtgatcgaagaatcaactcataagccaactgccatccctcttgagatcttcattgtcaccatggaagacgatttccccggtggtgtgattggaaaaattcatgctacagaccaggatatgtacgacgtgcttacattcgctttgaagagtgaacagaagagcctgtttaaagtcaactcacatgacgggaaaatcattgcgctcggcggactggactcaggcaagtatgtcctgaacgtaagcgtgtccgatggtcgctttcaggttccgattgatgtggtggtgcacgtggagcagctggtccacgagatgctgcaaaatacggtcaccatcagattcgaaaacgtcagtccagaggactttgtgggactacacatgcacggttttagacgaactttgagaaacgctgtgttgactcaaaaacaggactccctacgaatcatttcgatccagccagtcgcagggacgaatcagctcgacatgttgtttgccgtggagatgcattcctccgaattttataaaccagcctatcttatccagaagctttccaatgctcgcaggcacttggagaacataatgcgcatatccgctatactcgaaaagaactgctccggcctggattgccaggaacaacattgtgagcaaggactgtctctggactctcatgcactgatgacatactcaaccgctcgaatctctttcgtctgtcctcgattctataggaatgttcgctgcacctgcaacggaggactgtgtcccggatcaaatgacccatgtgtggagaaaccatgtccaggcgatatgcaatgcgtttcttatgaagcaagtcggagaccattcctatgccagtgtccccctggtaagctgggtgaatgctctggtcacactagcctgagcttcgccggtaattcctacatcaaatatcggctttcagagaacagcaaagaagaggattttaaactggccctgcggctgaggaccttgcagtcaaatggcattatcatgtacacacgggcaaatccctgcatcatcctgaagattgtggacgggaagctttggttccagctcgattgcggttcgggccctggaattcttggaatcagcggtcgagctgtgaacgacggctcctggcatagcgtgttcttggaattaaataggaacttcacaagtttgagtcttgacgactcatatgttgaacgacgcagagcccctttgtatttccagaccctttcgacagagtcttccatatatttcggcgctttggtccaggcggacaatatccgcagtctgacagatactcgcgtcacccaggtgctatccggatttcagggatgtctggacagtgtgatacttaataataatgagttgccactgcagaataaaagaagcagtttcgctgaagtggtggggctgactgagttgaaactagggtgcgtgttgtacccagatgcatgtaaacgctctccttgccagcatggtggctcatgtactgggctcccatccggaggttaccagtgcacttgcctatcccagtttaccggaagaaattgcgagagtgagattactgcctgctttcccaacccctgccgaaacgggggaagttgtgatccaattggtaatacttttatctgcaactgcaaagccggtctcactggagtgacctgcgaagaagacatcaacgagtgtgagcgggaggaatgtgaaaacggcggaagttgtgtcaacgtgtttggatccttcctctgtaattgtacacccggatacgtgggccagtattgtggcttgcgcccagtagtggtccctaatatccaagctgggcatagctatgtagggaaggaggagttaatagggatagccgtggtgttattcgtgatttttatcctggtggtcctcttcattgtgttcaggaagaaagtgtttagaaagaattactctcgcaataacatcactcttgttcaggatccagccacagctgctctcttgaacaaaagcaatggcatccccttccgtaacctcagagggtcgggcgatggacgaaatgtttatcaagaggtcggcccaccccaggttcctgttagacccatggcttatactccctgtttccaatccgactctagaagcaacttagacaaaatcgtggacggattagggggagagcatcaggaaatgaccaccttccatcccgagtcaccgaggatcctaaccgctcggaggggggttgtcgtctgctccgttgcccctaatcttcccgcagtgagtccttgccgctccgactgcgatagtatacggaagaacgggtgggacgccggaactgaaaacaaaggggtcgatgacccaggggaagttacctgctttgccggatctaacaagggtagcaattcagaggtgcaaagcctcagcagcttccagtcggatagcggagatgataatgcatccattgttaccgtcatacagctggtgaataatgtggtggatacaattgagaacgaagttagcgtgatggatcaggggcagaactacaatagggcctaccattgggacaccagtgactggatgccgggtgcccgactctctgacatcgaggaggtgcctaactacgaaaaccaggatggtggctctgcccatcagggcagtactcgggaactagaaagtgactattatcttggcggatacgatatcgactctgagtacccaccaccgcatgaggaggagttcctatcacaggaccagttaccgcctccattgcctgaggacttccccgaccagtacgaggcgctgcccccttcccaaccagtcagcttggcttcgactctaagcccggattgtcggaggcggcctcaattccatccttcccagtacctcccgcctcacccatttcccaacgagacggaccttgtcggaccaccggcttcctgtgagttctccacatttgctgtgtctatgaatcaaggtacagagccgacaggcccagcagactctgtttccctgagtttgcacaattctcggggaaccagctccagcgacgtgagtgcaaactgcgggttcgacgactctgaagtggctatgagcgattacgagtcagtgggcgagctgagcctcgcttctttgcacattccctttgtcgagactcaacaccagactcaggtctat

SEQ ID NO: 222906 - DNA, 13674 bp, Artificial Sequence
  Description of Artificial Sequence: Synthetic coding sequence
atggatattataatggggcactgcgttggcactagaccacccgcatgttgcctgatcttgctgcttttcaagctgctcgcaactgtgtcccagggactccctggtactggtcccttgggattccactttacacactctatatataacgcaaccgtgtacgaaaactccgcagccaggacctacgttaattcacaatcacgaatgggcattacattaatcgacctcagctgggatatcaaatataggattgtgtccggggacgaagaagggtttttcaaagccgaggaagtgataatcgccgacttctgcttcttgcggatccgcacaaaaggtggaaatagcgctattttgaatcgggagattcaagacaattacctgcttatcgtcaaaggctccgtgaggggcgaagatttggaggcttggactaaggtcaatatccaagtgctcgatatgaatgacctccgacctctattcagccctacgacttattcagtgacaatcgcagagtccaccccgttgcgcacctcagttgcccaggtgacagctaccgacgctgacatcgggagcaacggggagttctattactacttcaagaacaaggtggatttattttcagttcaccctaccagcggtgtgatatcactgtccggtcggttaaattacgatgagaagaaccggtacgatctagagattttggccgtagaccggggaatgaagctatatggaaacaacggcgtatcaagcaccgccaagctctacgtgcacatcgaacggataaatgagcacgcacctacaatccatgtggtgacccatgtgcctttctccctggagaaggaaccaacctacgccgttgtgaccgtggacgatttagacgacggagccaatggggaaatcgaatcagtgtctattgtggctggagaccccctagaccaattctttctcgctaaggaaggcaagtggcttaatgaatataaaatcaaagaacgtaaacagatcgactgggaatcttttccctacgggtataacctcactctgcaggctaaggacaaagggtccccccagaaatgcagtgctctgaaagctgtttacattggcaatcctacacgagacaccgtaccaatccgttttgagaaggaagtatacgatgtgagtatctctgagttcagtccgccaggagtggtggtggcaatcgtgaaattgtctcccgaacctatcgatgttgaatacaagctaagtcctggagaagacgctgtgtattttaagatcaaccctcgaagtggcctgattgtgaccgccaggcctctcaacacggtcaaaaaggaggtttataagctggaagtcacgaataaggaaggcgatctgaaagcacaggttactatttccatcgaggatgcaaatgaccatacacccgagtttcaacaaccgctgtatgatgcctacgtgaacgaatctgtgccagttggcacctcagtgctgactgtgagcgcgtctgataaggataagggggagaacggctacatcacctattctatagcttcccttaatctgctgccttttgtcattaaccaatttaccggcgtcatttctaccactgaagaacttgattttgaatcctcgcccgagatttaccgtttcatcgtccgggctagcgattggggctctccataccgccatgaatccgaggtgaacgtaaccatacgtattgggaacgtcaacgacaactccccgctgttcgagaaagtcgcatgtcagggtgtgatatcgtacgatttccctgtgggagggcatataacggccgtctctgccatcgacatcgatgaacttgagctcgtgaagtataaaatcatttcaggtaacgaactcggatttttttacttgaacccagatagtggcgtcttacagctcaaaaagagcctcaccaactccggcatcaagaacgggaatttcgccctgcggatcacagctaccgacggggaaaacctggctgatccgatgtctattaacatcagcgtgcttcatggaaaggtttcctctaagtccttctcatgtcgagaaacaagagttgcgcagaaactggctgaaaagctcctgatcaaagcaaaggctaacggaaagctgaatctcgaagacgggttcttggacttctattcgatcaatcggcaaggcccatacttcgataagtcgtttccttctgacgtcgcagtaaaggaggacctgccagtcggggctaacatcctgaaaatcaaagcctacgacgccgattctggctttaacgggaaggttctgtttaccatttctgacgggaataccgattcctgcttcaacattgacatggagaccggccagttgaaagtgcttatgcctatggatagggaacacaccgacctgtacctgctgaatattaccatttacgatctgggaaacccccagaagagttcatggcgcctgttgacgatcaatgtagaggacgccaatgacaattcaccagtgttcatccaagactcttactccgtaaatattttagaatcatctggcattggaacggagattattcaggtagaagctcgagataaggacctcggcagcaatggcgaggtgacgtactcagtacttaccgacacccagcagtttgccattaacagcagcaccgggattgtgtacgtggctgaccagctggacagggagagcaaagctaactatagcttaaagattgaggctagagataaagctgagagtggacagcagttattcagtgtggtgactctgaaggtgttcctggacgacgtgaacgattgcagcccagcattcattccttcctcttattctgtgaaggtgcttgaggatctcccggtgggaacggtgatcgcatggctcgaaactcacgacccagacctggggcttggtggacaggtgcggtactctctggtcaatgactacaacggaaggttcgagatcgacaaggcctccggagctatccgtctgtctaaagagctggactatgaaaagcagcagttctataacctcactgtgcgggctaaggacaaaggcagaccagtctccctttcgtctgtgtcattcgtggaggtggaagtggtagacgtcaacgaaaatctacataccccttactttccagattttgccgtagtcggctcggtgaaggagaattccaggatagggacctcggtcctacaggtaaccgctagggatgaagatagtggaagggacggggagatccagtattcgatacgggacggatccggcctcggacgcttttcaattgatgacgaaagtggtgtgattacggcagcagatatcttggatagggagaccatggggtcatactggctgaccgtatatgctacggaccgtggggttgtgcctttatattctaccatcgaggtatatatcgaagtagaggacgttaacgataatgccccattaacgtctgaaccgatttattacccagtcgtaatggaaaattcccccaaggatgtgtccgttatccagattcaagcagaggatccagacagctccagcaatgaaaaacttacttatcgcatcacctctggaaacccacagaacttctttgctattaacataaagacgggcctaatcacaaccacaagtcggaaactcgatcgggaacagcaggccgagcacttcctcgaggtgaccgtgacggacggcggtcccagccccaagcagagtacaatatgggtggtagtacaagtactggatgagaatgataataaacctcagtttcctgagaaggtctatcagatcaaattaccggaacgcgaccggaaaaaacgcggtgagcctatttaccgcgctttcgcatttgatcgggatgaggggccaaatgctgaaatctcctatagcattgtggacggcaacgacgacgggaaattcttcattgaccccaaaactggcatggtcagttcccggaaacagttcaccgcaggctcctacgacatcctaacaattaaggctgtcgacaatgggcgtccacagaagtcttctactgctcgtctccatatagaatggatcaaaaagccccctcctagccctattcccctgaccttcgatgagccattctataattttaccgtgatggaatccgaccgcgttacggaaatagtgggagtagtgtctgtccagcctgccaacactcccctgtggttcgatatagtggggggtaactttgactcagccttcgacgcagagaagggagtaggcactattgttatcgccaaaccacttgacgctgagcagagaagcatttataatatgagcgtagaggtaactgatggaacaaacgttgccgtgacgcaggtcttcataaaggttttagataataacgacaatggaccggagttttctcaaccaaattacgacgtgacaatttctgaggacgttctgcccgataccgaaatccttcaaattgaggctaccgacagagatgagaagcataaactcagctacaccgttcattcctcgatcgactcaatctctatgagaaaattcagaattgacccctctacgggcgtactttacacagcagagcgactcgaccacgaggcccaggataaacacatcttgaacattatggtcagagaccaggagttcccgtacagacggaacttggccagggtcatcgtgaatgtagaagacgccaatgatcatagcccctattttactaatcccctttacgaggcatctgtttttgaaagcgctgcacttggaagtgccgtgctgcaggttacggctctggataaggataaaggagaaaatgccgaacttatctacaccatcgaggccggaaacacgggcaacatgtttaaaatcgagccagtgctgggcatcattaccatctgtaaggagccagacatgactacaatgggtcaattcgtcctctctatcaaagtcacggatcagggatctccccctatgtcagctaccgcaattgttcgtatttccgtaacaatgtccgacaactcccacccaaagtttatccataaagactaccaggccgaggtaaacgaaaacgtagatattggcacctcagtcatccttatctctgccatttcccagtccaccctaatttacgaggttaaagatggcgacataaatggcattttcactattaatccctatagcggagttattaccacccagaaagctctagactatgagcgaactagctcatatcagctgattatacaagctacgaacatggccggaatggcatctaatgccacggtgaatattcagattgtggatgagaatgacaatgctcccgtttttcttttctcccagtactcgggaagtctaagtgaagcagccccaataaactcaatcgtcaggagcctggataattctccactggtcattagagccactgacgccgattcaaatagaaacgccctgttagtgtatcagatcgtggagagtacagcaaaaaagttctttaccgtggattccagcaccggtgcgatccgtaccattgccaaccttgaccacgaaacgatcgctcattttcatttccacgttcatgtcagggacagcgggtcaccacagctgacggccgaatcccctgtggaggtgaatatcgaggttacggatgtgaacgataatcccccagtgttcacccaggctgtgttcgaaaccattcttctgctgcccacttacgtgggggtagaggtactgaaagtctccgctacagatccagactcagaagtgccccctgagctgacctactccttgatggaagggtctctggatcactttctcatcgatagcaattcaggcgtcctgacaataaagaacaataacctgtcgaaggaccactatatgctgattgtgaaggtctccgacggcaaattttactcgaccagcatggtgactattatggtgaaggaggccatggactccggactgcattttacacagtctttctactcaacgtcaatcagcgagaataatactaatattaccaaagtagccatcgttaacgcagtggggaaccggcttaacgagcctctaaagtacagcatcctgaaccctgggaataaatttaaaattaagtcaacatcaggagtcattcagacaaccggtgtcccattcgaccgcgaggagcaagaactgtatgagttagtggtcgaggcctcccgcgagctggaccacctgcgcgtcgccagagtggtggtgagagtaaacatagaggacattaatgataacagtccagtcttcgtcggtctcccatattacgctgccgttcaggtagacgctgagccaggcactttgatctaccaggtgaccgctattgacaaagacaaggggccaaatggagaagtgacgtatgttttacaggatgattatggccattttgagatcaatcctaactccggcaacgtgatcctcaaagaagctttcaatagcgacttatccaacattgaatacggggtgaccatactggccaaggacgggggaaagccctctctctccactagtgtcgagcttcccattacaattgtcaataaggcaatgcccgtgttcgacaaaccgttctacactgcgtctgttaatgaggatatcagaatgaatacccccattttgtcaatcaatgcgacatctccggaggggcaaggaatcatctacattatcatcgacggagaccccttcaaacagtttaacattgacttcgataccggggtcctgaaagtggtgtcaccactcgactatgaagtgacgagtgcgtataagctgaccatccgagcttcagatgcattaaccggggcacgcgcagaagttacagtggatctccttgtaaatgatgtgaacgataacccccctatttttgatcagcccacttacaacactaccctttccgaggcctctttgatcggcactccagtgttacaggtggtgtctattgacgcagacagtgaaaacaataagatggtccattaccaaattgtacaggacacctacaattccaccgattattttcatatagactcaagcagtggcctgattctcactgcaaggatgctcgaccacgaactggtacagcactgcaccctgaaagtaaggtctattgatagtggtttcccttccttgtccagcgaagttctagtccacatctatatcagcgatgtgaacgacaatcctcctgtcttcaatcaactaatctatgagagctacgtgagcgaactggccccaaggggccactttgttacctgcgtgcaggcttctgacgctgatagctccgactttgatcgcctggaatactccattctgagcggaaatgaccggacaagttttcttatggacagcaagtcaggcgtgattaccctgtccaaccacaggaagcagcggatggagcccttgtattccttaaatgtgtccgtgtctgacgggttattcacctctacagctcaggttcacattcgggtccttggtgctaacctgtattcccctgcctttagccagtccacatacgttgctgaggtgcgggagaacgtggccgctggcacgaaagtgatccacgtgagggcaacggacggcgaccccggtacttacggacagattagctacgcgataattaatgactttgccaaggatcgttttcttatagacagcaacgggcaggtgataactaccgagcgcctcgatcgcgaaaacccactggagggagacgtgagcattttcgtaagggcattggatggcggaggcaggaccaccttctgcaccgtgagagtgatcgttgtggatgagaatgacaatgctcctcagtttatgacagtggaatatcgagctagcgtgcgggctgacgtaggtcggggacacttggtgactcaggtgcaggctatcgacccagatgatggagcaaactcaaggattacttatagcctatattccgaggcgtctgtgagtgttgccgacctcctggagatagatccggacaatggatggatggtcaccaaagggaatttcaaccagttaaagaatacagtcctgtccttctttgtcaaggcagtggatggtgggataccagtcaagcacagtctgatccccgtgtatattcacgtacttccccctgagactttcctgccgtcgtttacacagagtcagtactcattcactattgccgaagacacagccatcggtagcaccgtagacacgctcaggatactcccatcccaaaatgtgtggttttcgaccgtgaacggcgaaaggcctgagaacaacaaaggcggtatctttgtgatcgaacaagaaacaggcacaatcaagctggataagcgactggacagggagacctcgccagcctttcacttcaaagtggcagcaaccatcccacttgataaggttgacattgtcttcaccgtagatgtggatatcaaagtgctagacctcaatgataataagccagtgtttgagacctcctcttatgataccattattatggaagggatgcctgtgggcactaagttgactcaagtccgggcaattgatatggactggggggctaatggccaggtgacctactctctccactccgactcccagcccgagaaagttatggaagcctttaacatcgattctaatactggctggattagcactctcaaggacctggaccacgagacagacccgacgttcaccttctccgtcgtagctagcgacctaggcgaagcattttctcttagctctacagctttggttagcgttcgggtcaccgacataaatgacaacgcccctgtattcgcacaggaggtatacaggggtaatgtgaaagagtcagatcctcctggggaggtggttgcagtactgagtacctgggaccgagatacgtccgacgtcaacagacaggtgtcttatcacatcaccggcggaaatcctagagggcgtttcgcccttgggctggttcagtccgaatggaaagtgtacgtgaagcgaccgctagatcgtgaagagcaggatatctacttcttgaacataacagcaacagacggactgtttgtaacccaggctatggttgaggtctctgtgtccgacgttaatgataattcccccgtgtgtgaccaggtcgcttacacagccttgctgcctgaggatatacctagcaataagataattcttaaggttagcgccaaggacgcagatatcggcagtaatgggtatattcgttactctctgtatgggagcggtaactccgaattttttttagacccggagagcggagagctgaaaacactagcacttctggatagagagagaattcctgtttatagcctgatggccaaagccactgacggcggaggtagattttgccagagcaatatccaccttattctcgaggatgtgaatgacaaccccccagtgttctcctcagaccactacaatacatgcgtttatgagaatactgccaccaaggcactcctgacaagggttcaagctgtcgacccagatattggcattaatcgaaaagtggtgtacagcctggcggacagtgcgggtggcgtattttccattgactcctctagcggcataatcatccttgagcagcctttggatcgagaacagcagtccagctacaacatttcagtccgcgctaccgatcagagccccggacagtcacttagttcactgacaactgtgacaattacagttttggacataaacgacaacccaccagtgttcgagcgcagagattacctagtgactgtgcctgaggacacgagcccagggacccaagttctcgctgtctttgcaacttctaaggatatagggacgaatgctgaaattacctatctaatccggtctggtaacgagcaggggaaatttaaaattaaccctaaaacagggggaatctccgtgtccgaggttctggattatgagctttgtaaaaggttctacctagtggtagaggctaaggacgggggaacgcctgccctaagtgccgtcgctactgtgaatatcaatttgacggatgttaacgataaccctcccaagttctcccaggatgtctattcggccgtcattagcgaagatgcccttgtcggagacagtgtaatcttgctaattgccgaggacgtagattcccagcccaatgggcagatacacttcagcatagtgaacggggaccgggataatgagttcacggtggaccctgtgcttggactggtgaaagtgaaaaaaaagctcgatcgggaaagagtttctggttacagcctcctggtacaggccgtggacagcgggatccccgcaatgagtagcaccgcgacggtaaacatagatatctcggatgtgaacgacaattcccccgtgtttacgcccgcaaactacacagctgttattcaggagaataaaccagtgggaaccagcattctccaacttgtggtgactgacagagactctttccataatggcccacccttctccttctctatcctgtccggcaacgaagaggaagagttcgtactggatcctcacggtatcctgaggtcagcggtggtgtttcagcataccgagagccttgagtatgttctctgtgtgcaggccaaggacagtggcaaacctcagcaggtgtcccacacatacattcgggtgagagttattgaggaatccacccataagccaacagccatacccctcgaaatcttcattgttacaatggaggacgatttccccggaggtgtgatcggaaagattcacgccacagaccaggatatgtatgatgtgcttaccttcgctttaaagagcgaacagaagtccctgtttaaggttaacagtcacgatggaaaaattatagccttgggcggtctggatagcgggaagtacgtgctcaacgttagcgtttctgacgggaggttccaggttcccattgacgtggttgtccacgtggagcagctggttcacgaaatgctccagaataccgttacaatcagatttgagaatgtctcacccgaagatttcgtcggactgcatatgcatgggtttcggagaacgctgcggaatgccgtcctgacccagaaacaagacagcctgaggatcatcagtattcagcccgtggccggtaccaaccagttggatatgcttttcgccgtcgagatgcacagtagcgagttctataagcccgcatacctgatccagaagctgtccaatgcaagaagacatctcgaaaacattatgcgtattagcgccattctggaaaagaactgttccggtctagactgccaggaacagcactgcgaacaaggacttagtctcgattcccacgcgctgatgacctattctacagcgaggatcagcttcgtttgcccacggttttaccggaacgtgagatgcacatgtaacggaggcctctgtcctggatctaatgatccatgtgtagagaaaccatgcccaggtgacatgcagtgtgtgagttacgaagctagcaggcggcctttcctgtgtcagtgtccacccggaaagctgggagagtgtagcggtcatacgtccctcagttttgccggtaactcttacatcaagtacaggctgtcagagaactccaaggaggaagacttcaagttggccctccgacttcgcacactgcagagtaacggaataataatgtacacccgagctaacccgtgcatcattttaaagattgtagatggcaagctttggttccaattggactgtggcagtggtccaggcatattgggcataagtggccgtgcagtgaacgacggtagctggcattcagtcttcctagaactgaatcgtaatttcacctccctgtccttggacgactcctacgttgaacgcagacgtgctccgctgtactttcagacactgtccacggagagctccatatactttggcgctctggtccaggctgacaatatcaggtcactaactgatactcgggtgacccaggtcctgtctggctttcagggttgcctcgattcagtaattctcaacaacaacgagcttccactgcagaataagcggagcagttttgctgaggtagtgggccttaccgagctgaaactcgggtgtgtcttgtaccctgacgcttgtaagaggtccccatgtcagcacgggggttcatgtactgggcttccttcaggtggttatcagtgtacgtgcttaagccaattcacaggaaggaactgcgaatccgaaatcacagcctgtttcccaaacccgtgtcgcaacgggggatcctgcgacccaatcggcaacacgtttatctgtaattgcaaggccggactgaccggcgtcacgtgcgaagaggatatcaacgaatgcgagagagaggagtgcgaaaacggcggatcttgcgtgaacgtgttcggttcctttctgtgtaattgtacacccggatatgtgggccaatattgcggtctgcggccagtggttgtgccgaatattcaggccggtcattcatatgtgggaaaggaggagctaattgggattgctgttgtgctctttgtaattttcatcctggtggtgttatttatcgtctttagaaagaaagtttttagaaaaaattatagtcggaataacatcacccttgtgcaggatccagcgacggcagccctgctcaacaagtccaacggaataccgtttagaaatttgcgtggctccggtgacggtcggaacgtttaccaggaggttggtcccccacaggtcccagtccgccctatggcttacacaccctgtttccaatccgacagccggagcaatctggataagattgtggatggcctcggaggggagcatcaagaaatgacaacttttcacccagagagtccacgaatcctgactgcccgtcgtggagttgttgtgtgttccgttgcacctaaccttcccgcagtaagcccctgtcgaagcgattgcgactccatcaggaagaacgggtgggatgctggaaccgagaataaaggcgtggacgatcctggagaagtgacctgttttgccggtagcaataaaggctcaaacagcgaagtgcagtcactgagttccttccaatcagactctggggatgacaatgcctaccattgggatacatccgactggatgcccggagcccgtctgagcgatatcgaggaagtgccaaattacgaaaaccaggatggtggtagtgcccatcaggggtcaacacgggaactggaaagtgactactatctgggcggatatgatatagattcggagtaccctccacctcacgaggaggaatttctcagccaggatcagttaccaccccctctcccggaggatttccctgaccagtacgaggccctccctccatcacagccagtttctttggcctctacattgtctcccgactgtcgccgacgccctcaattccatccttcacagtacttgccaccacacccttttcccaacgagactgacctcgtgggccctcccgcttcctgtgagttcagcacgttcgccgttagcatgaaccagggtaccgagcctactggaccggctgacagtgtgagcctttcactacacaattcacgcggaacatcaagtagtgatgtctccgcgaattgcggtttcgacgacagcgaggtggctatgagtgactacgagagtgtcggggaattaagcttagcctctctgcatattcctttcgtcgagacacagcaccaaacccaggtctaa

SEQ ID NO: 222907 - DNA, 3765 bp, Artificial Sequence
  Description of Artificial Sequence: Synthetic coding sequence
atggacatcataatggggcattgcgtaggtacaagacccccagcctgttgtctgattctcctgttattcaaacttttagccactgttagtcaggggctacccggaacgggacccctgggattccactttactcactctatatacaatgcaacagtgtacgagaactctgcagcacgcacatatgtgaacagccagtcaagaatggggatcactctgattgatctgtcatgggacattaagtaccggattgtgagcggagatgaggagggcttcttcaaggcagaggaagtgatcatagcagatttctgcttccttagaatcagaactaagggagggaacagtgctatacttaacagagaaatccaggataattatctgctaatcgtgaagggaagcgtcaggggagaggacttagaggcttggaccaaggtgaacatccaggtgctggatatgaatgatctgcggcctctattcagccccacaacctacagtgtgacaattgctgaatctacccctctgaggacttccgtcgctcaggtgacagccacggatgctgacatcgggtccaatggtgagttttactattactttaagaataaagtggatctattctcagtccatccaacatcaggcgtgatttctttatccgggagattgaattacgatgagaaaaatagatacgacctggagattttggcagtggacaggggaatgaagttatatggcaataacggggtgtcttctacagccaagttgtacgtgcatattgagaggataaatgaacatgcccctaccatccacgttgtgactcacgtgccattttcccttgagaaagaacccacttacgccgtcgtaacagtcgatgatctcgacgacggggctaatggagagatagagagtgtgtctatcgtggccggagacccactggaccagttttttcttgcaaaggagggtaaatggttgaacgagtacaagataaaagagagaaagcagatagactgggaaagcttcccatacgggtataaccttacgctgcaggccaaagataagggttcaccccagaagtgttccgctttgaaagcggtctatatcggcaatcccaccagggacacggtgccgattaggtttgagaaagaggtttacgatgtctcgatcagcgagttttctcctcccggagtggtggtggcaattgtgaaactgagtcccgaacctatagatgtagagtacaaattgagcccaggcgaggacgccgtgtatttcaaaatcaacccgagatctggactgatcgtgacagcgcgaccactcaacacggttaaaaaagaggtatataagcttgaggttactaacaaggaaggggatctgaaagcccaggtcaccatctccatagaggatgctaacgatcatactcccgagtttcagcaaccgctgtacgacgcttacgttaacgagtctgttcctgttggcacttccgtgctgaccgtaagcgcttccgacaaggataaaggagagaacggctatatcacatactctatagcttctctgaacttgctccccttcgtgattaatcaatttaccggtgttatcagcaccactgaagagctggattttgagtccagcccggaaatctatcgcttcatcgtgcgagcttccgattgggggtccccataccgccatgagagtgaggtcaacgttacgattagaatcgggaatgttaatgataactctccattgtttgagaaggtggcctgtcagggcgtcatttcctatgattttcccgtgggcggtcacatcacagctgtgtctgctattgacatcgatgaactggaactggtgaaatataagattatttcaggcaatgaactcgggtttttctaccttaaccctgattccggggtccttcagttgaaaaaatctctgacaaatagcgggattaaaaatggcaacttcgccctgcgtatcacagccaccgatggggaaaacctggctgatccgatgagtataaacatttccgtgttgcatggcaaggtgtcctcaaagtccttctcatgcagagagacaagggtggcccaaaagcttgccgaaaaactcctgataaaggcaaaagccaatggcaaactgaatctggaggatggctttttggatttctattctatcaatcgccagggcccttacttcgataagagtttcccctcggacgttgctgtaaaagaggacctgcctgtaggggctaatattctcaaaattaaggcctatgacgcagattccgggtttaacggcaaggttctgtttactattagtgatggcaatactgacagctgctttaatatcgatatggagacgggtcagctgaaggtacttatgcccatggaccgggaacacaccgacctgtaccttttaaatataaccatctacgacttggggaatccacagaagtcctcatggcgcctcctgaccattaacgtcgaggatgcaaacgacaattcccccgtgtttatccaggattcatactctgtcaacatcctggagtcatccggcatcggtactgagattatccaggtggaggccagagataaggaccttggctccaacggggaggttacatatagcgttcttacggacacacagcagtttgctatcaacagcagcacaggaatagtgtatgtagccgaccagctggatagagaatccaaagctaattactcactgaaaattgaagctagagacaaggccgaatcggggcagcagctcttcagtgtagtcaccctgaaggtattcttggacgatgttaatgactgctctccagctttcataccctcatcgtatagcgtcaaggtgctggaggacctccccgtagggacggtgatcgcatggctggaaacccacgaccccgatctcggtctgggcggacaggtgaggtatagtctggtgaacgattataacggtcgcttcgagatagataaggccagcggcgctatcaggctgagcaaggagctggattatgaaaagcagcagttctacaatctcacagtgagggcaaaggataagggaagacccgtctcgctaagcagtgtgagtttcgtggaggtggaggttgtggacgtcaatgaaaacctccacaccccctatttcccagactttgctgtcgtcggtagcgtcaaagagaatagccgcatcggcacatcagtcctgcaagtgaccgctcgtgatgaggactccgggcgtgatggagaaatccagtactccatcagggacgggtctggcctgggtagatttagcatcgacgacgagtccggggtgatcacggcggcagacatactggaccgagaaacgatgggaagttactggctgacagtctacgccaccgaccgcggtgtcgtccctctgtattccaccatcgaggtgtacatcgaggttgaagacgtcaacgacaacgcccctcttacttctgagcccatttactatcccgtggttatggagaattctccaaaagatgtgagcgtgattcaaatccaagccgaagatccagattcctcatctaacgagaaacttacgtaccggataacaagcggcaatcctcagaacttctttgccataaacatcaagacagggagctgctccgtcgctcaggctggaatgcagtggcacgaccactcaagcctgcaaagtaggactccagggtttaagggctatccctgtctgtctctgctcagttcttgggactaccggcatgctcccccatgccccgcaacatttctcaactcttag

SEQ ID NO: 222908 - DNA, 9668 bp, Artificial Sequence
  Description of Artificial Sequence: Synthetic coding sequence
atggtcaccacagtagttgccgtgggcgacacgttggctcagccgctggctgctgcagaggtttttatcgtcgagatcaccttgcaagatattaatgacaaccctcccgtgtttcccaccgatatgctggaccttacagtggaagaaaatattggcgatggctccaagatcatgcagctcaccgccatggatgccgacgaaggggctaatgcccttgtgacctataccataatttcgggcgcagatgacagtttcagaatcgaccctgaatccggagatctgattgccaccagaaggcttgacagagagagacggagcaagtacagtttattggtgcgagccgatgatggactgcaatcaagcgacatgcgtataaatatcacagtttccgatgtaaacgatcacacaccaaagttttcacgacctgtgtactcttttgatatccccgaggacaccatacccggtagtctggtggccgctattctggctacagatgatgactctggggtaaatggtgagatcacatatattgtcaatgaggatgacgaagacggaatcttctttctcaaccccatcaccggcgtcttcaatttgacccgattgctggactatgaggtccagcaatattacatcctcacagtaagagctgaggatggaggtggccagttcaccaccattagagtctattttaatattctagatgttaacgacaacccccctatcttcagcctgaattcttactccacgtctctgatggagaatcttcctgtggggagcactgtgttggtcttcaacgtcactgacgccgatgacggtatcaacagccagctgacatacagtatagcctccggcgatagtctggggcagttcaccgtggataagaacggcgtactaaaagttctcaaagcacttgatagagagtcacagagcttttacaacttggtggttcaggtccatgacttgccacagatccccgcttcccggttcacatcaactgcccaggtgtcaatcatccttctggacgtgaacgacaaccctccaactttcctgagccccaagctgacctacattccagaaaacacacccattgacaccgtcgtgttcaaggcccaggctaccgatcccgatagtggacctaatagctacatcgaatatactctcctgaatcctcttggaaataagttcagcataggtacaatcgacggagaggtcaggctcaccggtgaactagatcgggaggaggtgtctaattacaccctgaccgttgtcgcaacggacaaaggtcagcccagcttgagctcatccacggaagttgtagtcatggtgttggacatcaatgacaacaacccaatattcgcgcaggccttatataaagtcgagatcaatgaaaacactcttaccggaaccgatatcatccaggtctttgctgctgatggtgacgagggcaccaatgggcaagtacgctatggcatcgtgaacggaaatacaaaccaggaattccgtatcgattccgtgacgggtgccataaccgtggccaagcccctggaccgagaaaagacgccaacataccaccttaccgtgcaggccactgataggggaagcacacccagaaccgatacttccactgtgagcattgtacttcttgatattaacgatttcgtaccagtgtttgaactgagtccatactccgtcaatgtccccgagaatttgggaactcttccacggacaatcctgcaggttgtggctcgcgatgatgaccgaggaagcaatagcaagctttcctacgtgctctttggtggcaatgaggacaacgcttttacgttgagtgccagcggagagcttggtgtgacccagtcgttggatagagagactaaggagagattcgtgctcatgatcaccgccactgattccgggagccctgccctaactgggacaggaaccatcaacgtgattgttgacgacgttaacgataacgtgccgacattcgcttccaaagcatatttcactactattccagaagacgccccaaccggaaccgatgtcctgttggtgaatgctagtgacgccgatgccagcaagaacgctgtcattcgtatcatcggcggaaatagtcagttcaccattaacccgtctaccggacagatcattaccagcgccttactggaccgcgaaacaaaggacaactatacactggttgttgtgtgctctgacgccggaagccccgagcctttaagtagttccacatctgtgctagtgaccgtcactgacgtcaatgacaatcctcccaggttccagcaccatccatacgtcacccacatcccatctccaactcttcctgggtcatttgtgttcgcagtcaccgtcactgatgcagacatcggccctaactctgagctgcattattccttgagcggacggaacagcgaaaagtttcacattgacccacttagaggcgctatcatggccgcaggacccctcaacggggcaagcgaagtcactttctcggtgcacgtgaaagacgggggttcttttccgaaaacagactctaccacagttaccgtgcggttcgtaaacaaagccgactttcctaaggtgagggctaaagaacagactttcatgttccccgaaaaccagccagtctccagcttggtcactacaattacgggcagctctcttcgcggagagcccatgtcctactatatcgctagcgggaatttaggaaataccttccaaatagaccaacttaccggacaggtgagtatttcacaacccctggactttgaaaaaattcagaagtacgtggtgtggatagaggcacgagatggaggattccctcctttcagctcatatgaaaagcttgacattacagtcctggacgtgaacgacaatgctccaatttttaaagaggacccttttatctctgagatcttggagaacctaagtcccagaaagattttgacagttagtgcgatggacaaagattccggacccaacggtcagctagattacgagatagtcaatgggaacatggaaaattccttcagcatcaatcacgctacaggtgaaattaggtcagtacggccactcgaccgagaaaaggtgagccactatgtcctaactatcaagagctcagataaaggttctcctagccagtctacatctgtgaaagtgatgatcaacatactcgacgagaacgacaatgcaccccgattctcgcagatcttttccgcgcatgtacctgagaactcaccgttggggtatactgttacccgagtgacaacctcagacgaggatatcgggattaatgccatctcgcgctactccattatggacgcaagtctgccgtttacgattaacccgtccaccggggacatcgttatctcacggcctctcaaccgcgaagatacagataggtataggattagagtctcagcccacgacagtggttggacagtctcaacagacgtcacaatctttgtaacagacatcaacgataacgctcctagattttcccgcacaagctactacctggattgccctgaactaacagaaataggaagcaaagtgacccaggtctttgcgacagaccctgacgaaggttccaatggccaggtattctattttatcaagtcacaaagtgaatatttcagaattaatgctactacgggagaaattttcaataagcagatcctcaaataccagaacgttaccggtttttcaaacgttaatataaatcgtcatagctttatcgtcaccagctcagatcggggtaaacccagcctcatttcagagaccactgtcacaatcaacatcgttgactctaatgataacgccccacagttcctaaagtctaaatacttcacacctgtaaccaagaacgtgaaggtggggactaaactgattagggtgacggctattgatgataaagactttggtctcaactccgaagtggagtatttcatatcaaatgacaaccacctggggaagtttaagctggacaacgacactggttggataagcgtcgcttcttccctcatctccgatctgaatcagaacttttttatcacagtgaccgccaaagacaaaggcaatcccccactgtcttctcaggctacagtgcatatcacagtcaccgaagaaaactaccacacacccgagttctcacagtcacatatgtcagctacaattccagagtctcattcaatcggcagtattgtccgaaccgtgagtgcccgagatagagacgcagccatgaatggccttatcaagtactcaatctcctctgggaatgaagaggggatattcgcgattaacagctccaccggaatcctgactctggcaaaagcattagattatgaactctgccaaaagcacgagatgacaatctcagcaattgatggagggtgggttgccagaacaggctactgctcggtgactgtgaatgttatagacgtaaatgataattcgcctgtttttctctctgacgactacttccccactgtgctcgagaacgccccatctggcacgactgttatccatctgaacgcaaccgatgctgacagcggcactaatgctgtgatcgcatacacagtgcagtctagcgatagcgacctgttcgttatcgacccgaatactggggtcataacaacccaggggtttctggacttcgaaactaagcaatcataccacctgaccgtgaaagccttcaacgttcccgatgaggagcggtgtagcttcgctaccgttaatatccaacttaaaggcacaaacgagtacgtccccaggtttgtgagtaaattgtactatttcgagattagcgaagcagctccaaagggaactattgtaggtgaggtgttcgcatcagacagagacttgggaactgacggggaagtgcactaccttatcttcggtaactccaggaaaaaaggattccagattaacaagaaaactggacagatttacgtctccggtattctcgatagggaaaaggaagagcgagtgtcactgaaagttttggctaaaaatttcggaagtatccgaggcgcagacatcgacgaagtgactgtaaatgtcacagtgctggacgcaaacgatcctcctatctttacattgaatatctatagcgtacagattagtgagggcgttccgatcggcacgcacgttacgttcgtgtcagccttcgactctgatagtatccccagttggtcaaggttttcgtactttattggctctggtaacgaaaacggagccttcagcattaatcctcagactggccagataacagttaccgctgagctcgacagggagacactgcctatttataacttatcagtgttggctgtcgactctggaactccctccgcgaccggctccgcctccttattagttacccttgaagacattaacgacaacggaccaatgctgaccgttagcgagggcgaagtgatggagaacaagcgcccaggcacactggtcatgactctgcagtctactgatcctgatctccctccgaatcaggggccattcacctactatttgctttctacgggccctgctacatcttatttctctctgtcaacggcaggtgtgttaagcaccactcgggagatcgatagggaacagatcgctgacttttacctttcggtggttaccaaggattcgggtgtcccccagatgtcttccactggcactgtacacataactgtaatcgaccagaacgataatccaagccagagcagaactgtagaaatatttgtgaattactatggcaatcttttcccaggaggcatcctgggcagcgtcaaacctcaggatcctgacgtcttggacagtttccactgcagcttgaccagcggagttacgtctctcttttcaattccgggaggaacttgtgacctgaactctcaacccagaagcaccgatggcacttttgatctgacagtgctgtcaaacgacggagtccatagcacggtgacttccaatatccgggtgtttttcgccggattcagcaatgcgacagtggacaattccatcctcctacgcctgggcgtccctactgtcaaagattttttgacgaatcattatctgcatttcctaaggatcgcttcctctcaactgacaggccttggcaccgccgtgcagctctattcagcctacgaagaaaataacagaacattcctgcttgcagccgtaaagcgcaatcataatcagtatgttaatccttctggtgtggcaacattcttcgaatctattaaagagatcctcttgcgacagagcggcgtcaaggtagagagcgttgaccacgactcctgcgtgcatggaccctgtcagaacggagggagctgcctcaggagactggcagtttcttccgtactgaagtcaagagagagcctgcccgtcattatcgtcgctaacgaacctctccagccctttctctgcaaatgtctacctggctatgccggatcttggtgcgagatcgacattgacgaatgcctgccgtctccatgtcattcagggggtacttgccataatcttgttggcggtttttcttgctcctgcccagacggctttactggtcgagcttgcgaacgcgatatcaacgagtgtctgcagtctccttgcaagaacggtgccatctgtcagaatttccccggaagcttcaattgcgtgtgcaaaacaggttacaccggggtgttcggcaagcattgcgagctcaattcttacggtttcgaggaactgtcgtatatggagttcccatctcttgatcctaacaacaattacatctacgttaagtttgccaccattaaatcacatgcgctactgctgtacaactatgacaaccagactggtgaccgggctgagttcctcgcactcgagatcgcggaggagaggctgcgcttttcctataaccttgggtcaggtacttataagctgaccaccatgaagaaagtgagcgatggacacttccacaccgtaattgctcggagggctggaatggcagccagtttgacagtggatagctgcagcgaaaatcaggaaccaggctactgcactgtcagtaacgtggctgtcagcgatgattggaccttggatgtgcagcccaacagggtgaccgtggggggaatcagaagcctagaacccatactgcaacgccgaggccacgttgaaagtcacgatttcgtcggctgtattatggaatttgctgtgaacgggagacctttggagccaagccaggcacttgcagcccaggggatactggaccagtatggggatttcattagttattgctttaaagaaaagaaatgtaagaaggtctgcttcactgtcacaccagatacagccctgtcactggaaggcaagggacggctggattaccacatgtcccagaatgagaagcgagagtaccttctgcgacagagcctccgcggtgccatgctcgagccattcggggtgaactctctagaagtcaagttccgaacaaggagtgaaaatggcgtcttgatccatatccaggagtcttcaaattacacaacagtgaaaatcaaaaacggtaaggtgtactttacgtccgacgccggaattgctggcaaagtggagagaaatatccccgaggtctacgtggccgacggtcactggcatacatttttgatcggcaagaacgggaccgctactgtcttgagcgttgaccggatatacaaccgtgatattatccatcccacgcaggattttggagggcttgatgtccttaccatttctctggggggtatcccacccaatcaggctcaccgcgatgcccagaccgcaggcttcgatggctgcatcgcatcaatgtggtacggtggtgagagcttgcccttctcaggcaagcattccctggcatccataagcaagacggacccatccgtcaagattggctgtcggggtccgaacatctgtgcttccaatccatgctggggtgatctcctttgtatcaatcagtggtatgcctaccggtgcgtgccacccggtgactgtgcctcccacccgtgtcagaacggaggatcctgcgagcccggtctgcattcgggatttacatgcagctgtccagactcccacactggtcgaacctgtgaaatggtggtagcctgtctgggggtcctgtgtccccaggggaaggtgtgcaaggcaggatcacccgctggccatgtctgcgtcttgtcccagggacctgaagagatctctcttcccctgtgggccgtgccggcaattgttggaagctgcgcaactgttctcgccctcctcgtactgtctctgattctctgcaaccagtgccgaggtaagaaggccaaaaaccctaaggaagagaagaagccaaaggaaaaaaagaaaaagggcagcgaaaatgttgcatttgatgatcccgataacatcccgccatatggcgacgatatgaccgtccgtaagcaaccagagggcaatcctaagcccgatatcatagagagagagaatccatatttaatttacgatgagaccgacattcctcacaactcagagaccataccgagcgctcctcttgcctcccctgagcaagaaatcgaacattatgatatcgataatgcctccagcatagccccttcggacgccgatattattcaacactacaaacagtttcgaagccacacacctaaattcagcatccaacggcacagccccctcggattcgcccgtcagtcgccgatgccgcttggcgctagttcactcacataccaaccctcgtacgggcagggcctgcgcactagtagcttgagtcatagcgcctgtcccaccccaaatccacttagcagacacagtcctgcgccatttagtaagagttcaaccttctaccgtaattcacccgctagggagttgcacctgcctatccgagacggaaacacgttggaaatgcatggagatacatgtcagcctgggatcttcaactatgccacacggctgggcagaagaagcaaaagtccacaggccatggcgagtcacggaagccgcccaggctctaggctgaaacagccaattggccaaattcctctggaatcaagtcctccagttggactgtctattgaagaggtggaacgactcaacactccacggcctcgaaatcctagcatctgcagcgcagatcatgggagatcatcttctgaggaggactgtcggagaccactgtcccggacacgcaacccagccgatggcatcccagcgcctgaaagtagcagtgacagtgattcacatgaatccttcacttgctcagagatggagtatgatcgagaaaagccaatggtctacacctccagaatgcccaaactgtcccaggtaaatgagagtgacgcggacgacgaagacaattatggcgctcgccttaagcctcgacgttatcacggcagacgggctgagggagggcctgtaggcacacaggccgctgccccaggtactgcagacaatactctacctatgaaattgggccagcaggccggtacctttaactgggataatttactgaactggggccctggctttggacattatgtggacgttttcaaggatctcgcgtctctgccagaaaaagccgcagccaatgaggaggggaaggcaggaaccactaagcccgtccctaaagatggggaagcagagcagtacgtcta

SEQ ID NO: 222909 - DNA, 14946 bp, Artificial Sequence
  Description of Artificial Sequence: Synthetic coding sequence
atggacttagcccctgatagggccacgggacggccttggcttccactccatacgctaagcgtctcccagttgctgcgggtgttttggcttctcagtctgttacctggccaagcttgggttcacggcgctgaaccaagacaggtgttccaggttttggaggagcaacctccgggtacacttgttggcactatccagaccaggccaggcttcacgtacaggctctccgaaagtcacgcactgtttgctatcaactcgtccactggggctctgtacaccactagcacgatagacagggagagcctcccttcagacgtgatcaatctggtcgttttgagctctgctccaacataccccaccgaggtgcgggtgcttgtgagggatctgaacgacaatgcccctgtctttccagaccccagtattgtggtaacattcaaggaggatagttcgtccggacggcaggtgattcttgataccgctacagattctgacattggctccaacggggtggaccaccgaagctaccgcatcatacgaggaaacgaggctggaagatttaggctggatattacactgaacccctctggtgaaggcgcttttcttcatctggtgtctaagggcggactggaccgcgaggtcacgccccagtatcagctgcttgttgaagtcgaggataagggggagccgaagcggagggggtatctgcaggttaacgtaaccgtgcaggacattaacgacaacccgcctgtgtttggatcttcccactatcaggctggcgtgccggaagatgctgtcgtggggagctctgtactgcaagtggctgctgccgatgctgacgagggaacaaacgccgacattagataccggctgcaggatgagggaactccattccaaatggatcctgaaaccggcctgatcacggtgcgagagccccttgactttgaagcccgtagacagtattccctgactgtgcaggctatggatcgtggcgtgccctcccttactggccgagcagaggccctgattcagcttctggatgtgaatgacaatgatccagtcgtaaagttcaggtactttcccgctaccagccgatatgcaagtgtggacgaaaacgcgcaggtaggcacagtagtggctcttttgacagtaacggatgcggactcgcctgccgctaatggaaacatatctgtgcagatcctaggcggtaatgaacagcgtcatttcgaggtacaatcaagcaaagtgccaaatctctcccttatcaaggttgccagcgcactggaccgggaaagaatccctagttataacttgactgtgagcgtcagcgataattacggcgcaccccctggcgctgctgtccaggccagaagctcggttgcaagtctcgtgatattcgtgaacgatataaacgaccacccaccggtattctcacaacaggtgtacagggtcaatttgagcgaggaagcgccaccagggtcctatgtgtccggcatctcagccacggatggggactctggactgaacgctaacttgaggtattccatcgtctcgggtaatggtctcggatggtttcacataagtgagcactcagggttagtgactactggcagctcggggggactagaccgggaattggcatcccaaatcgtcttaaacattagcgccagagatcagggagtgcatccaaaagtgagctacgcacagcttgtagtaacattattggacgtgaatgatgagaaacccgtattttctcagccggagggctatgatgttagcgtcgttgaaaacgcccctaccggcactgagttacttatgctgcgcgctacagatggagacttgggcgacaacggcacggtgcggtttagtctgcaggaagccgagactgaccggaggtcatttagactggaccccgtgagcggtcgactttctaccatttccagtctggaccgcgaagaacaggcgttctatagcctcctcgtgcttgcaaccgacctggggtctccaccacagtcatctatggccagaattaatgtgagcctgctggatattaacgacaatagccctgtcttctaccccgtgcagtactttgctcacataaaagaaaatgaacctggcggtagctacatcactactgttagtgccacagacccggacctggggacaaatggtacagtgaaatactccatctcagccggtgatcgatcgagattccaggtcaatgcccagagtggcgtgattagcacacgcatggccctcgatagggaagaaaaaacagcctaccagctgcagatcgtcgcaaccgatggtggaaaccttcagtcccccaaccaggccattgtcactatcaccgtccttgacacacaggacaacccacctgtattttcgcaggtagcctattcattcgttgtgttcgagaacgtagctctggggtaccacgtagggagtgtaagtgcaagcacgatggacctgaacagcaacatcagctacttgattaccacgggagaccagaaaggcatgttcgcgattaaccaggtgactggccagctcactaccgccaacgtgattgaccgggaggaacagagcttctaccaactcaaagtggtggcttccgggggaacagtcactggggatacaatggtcaatatcacagttaaggacctgaatgacaattctcctcatttcctgcaggccattgagtccgtgaacgtagtggagaactggcaggccggacatagcatcttccaggcgaaggcagtggatcccgacgagggggtgaacggaatggtgctctattctctcaaacagaatccaaagaatctcttcgctatcaacgagaagaacggaacaatatccctgctgggtccactcgacgtgcacgcaggctcatatcagatcgaaatccttgctagcgacatgggggtgcctcagttaagtagcagtgtgatactgactgtgtacgtccatgatgtaaacgacaactccccagtgtttgatcagctgtcatatgaggtcaccttatccgagagcgaaccagtgaattcaaggttcttcaaagtccaagcgtccgacaaggactctggtgcgaatggcgagatcgcttacaccatagccgaggggaacaccggcgatgcattcggcatctttcctgatggacaactgtatattaagagtgagcttgatcgtgaacttcaggacagatatgttctcatggtcgtagcttccgaccgtgctgtagaaccactgagcgccactgtaaatgtgaccgtcatcctcgaggatgtgaacgacaaccggccactcttcaacagcacaaactatactttctactttgaagaggaacaacgcgcagggtccttcgtcgggaaggtatcagccgttgataaggactttggacccaacggcgaagtgagatattcttttgagatggttcaaccagacttcgagctgcatgcaatttccggcgaaatcactaatacgcatcaatttgacagagaatctctcatgcggagaagagggacagcggtgttctcctttaccgtgatcgcaactgaccagggcatcccacagcctctgaaggaccaggccaccgtgcacgtttatatgaaagatattaacgataacgcccctaagttccttaaggatttctaccaggctaccatcagcgagagtgcagcaaatctgactcaggtactgcgggtctctgccagtgatgtggacgaaggtaacaacggcctcatacactattccatcataaaagggaacgaggaacgacagtttgcaatcgactctacgtctggtcaggttaccctgataggaaagttggattacgaggcgactcctgcttactccctcgtaatacaagccgtagattcaggaactatccctctgaatagtacatgcactctcaacatcgacattctagatgagaatgataacacgcccagctttcctaagtctacgctcttcgtggatgtgcttgagaacatgcggatcggcgaactggtttctagcgtgactgctactgactccgattctggagataacgctgacctctactactcaattaccggaactaataaccacgggacattctccatcagcccgaatactgggtctatctttctggctaaaaagttagatttcgagactcagagcctgtataaacttaatatcaccgcaaaggatcaaggcaggcctcctagaagttcaacaatgtcagtagtgattcatgttcgggacttcaacgacaaccccccatcctttccgccaggtgacatttttaagtctattgtggagaatatccccatcggcacctctgttatctcagttaccgctcatgacccggatgcagacattaatggccagctgtcctacactattatccagcagatgccccgtggcaaccactttaccatcgatgaggtcaaggggacaatctatacaaacgcggaaattgacagagaattcgctaacctgtttgagttaacagtcaaggcgaatgaccaggccgtccccattgagacccggaggtacgccctaaagaacgtaactattctggtaactgatttgaacgacaatgtcccaatgtttattagtcagaacgctctggcagctgatccctctgccgtcatcgggagcgtactcactacgatcatggcggcagaccctgatgagggtgcaaacggtgagatagaatatgaaatcatcaacggagatacagatacatttattgttgataggtacagcggcgatctccgcgtggcttctgccctcgtcccaagtcaactcatttacaatctcattgtgtccgccaccgatttgggtcctgaaagacgtaagagcaccacagagctaacgatcatcctccaaggactcgacgggcctgtcttcacccagcccaagtatatcactatcctaaaagaaggagagcctattggaacgaacgttatcagtatcgaggctgcttctcccagaggcagcgaagctcctgtggagtattacatcgtcagtgtgaggtgtgaagagaaaactgtgggccgtctgttcacaatcggtaggcatactggcattattcagactgccgcaattctcgaccgagaacaaggagcatgcctctacctcgtcgacgtgtatgcgatagagaagagtactgccttcccacggacccagcgagccgaggtggagatcaccttgcaagacattaatgataatcctcccgttttcccaacggacatgctcgacctgacagtggaggagaatattggcgatggaagtaagattatgcaacttacagcgatggacgctgatgagggcgctaacgctttggtgacatatactatcatatcaggggctgacgatagcttccgcatagatcctgagtctggagacctcatcgccacccggcgactggaccgggagcggcgatctaaatatagcttgctcgtgcgtgcggatgacggtctgcagtcctctgacatgaggatcaacattacagtctccgacgttaatgatcacacccccaagttttcacggccagtgtacagcttcgacattcccgaagacacgataccgggttccctggtcgcagccattctggccacggatgatgattctggtgtcaacggcgagattacctatatcgtgaacgaagatgacgaggatggaatatttttccttaaccctatcactggagtttttaacctgacccgccttcttgattatgaggtgcaacaatactatatcctgactgtgcgcgctgaagatggcggaggccagttcactacaatcagggtttactttaacatactcgacgtcaatgacaatcccccaattttttctctgaactcctactccacatcactgatggagaaccttcctgttggatcgaccgtgctggtgtttaacgtgactgatgctgacgacgggatcaatagccagttaacatatagcatcgcatccggcgacagcttgggccagtttaccgtggataagaatggcgtgctaaaggtgttaaaggctctggacagggagtcacagagcttctataatctggtcgtgcaagttcatgacctcccccagatccccgctagccggttcacatctacggcccaggtcagtattatcttgctcgacgtgaacgacaaccccccaacattcctatcccctaaactgacctacatccccgagaatactcctattgatacagtcgtgtttaaggctcaggctactgatccagactcagggcctaacagttacatagagtataccttattaaatccgctgggcaataaattctccatcggcacaatagacggcgaagtcagactgactggagaattggacagggaagaagtctccaattatacactcaccgtggtcgctacagacaagggccagccaagcctgtcatcatcaaccgaggtggtcgttatggttcttgatatcaacgataacaaccctatattcgcccaggcgttatacaaggtggaaattaatgagaacaccttaaccggaaccgatatcattcaggtctttgcagctgacggtgacgaaggaaccaatggacaagtgcgttatggaatagttaacgggaatactaaccaagagttcagaatcgatagtgtcactggggctatcacagttgcaaagcctttagatcgcgaaaaaaccccaacctaccatctgacggtgcaggccactgacaggggaagtacaccaaggaccgacacctccacagtgtcgatagttctcctggacattaacgactttgtgcctgtcttcgaactttccccatacagcgtaaatgtgcctgagaatttgggcacgctgcctagaactattctgcaggtggtggcaagggacgatgatcggggatccaactctaaattgtcctacgttcttttcggcggtaatgaggataatgccttcacgctctccgcctcaggcgagctcggcgtgacgcaatctctggacagagaaactaaagaacgatttgtattgatgatcacagccactgacagtgggagcccggcattgacaggtaccggcacgatcaacgtgattgtggatgatgtgaacgataatgtgcccacctttgccagcaaggcttacttcacgaccattcccgaagatgcaccaacggggaccgacgtcctcctcgtcaacgctagcgatgctgacgcaagtaagaacgccgtgattcggattatcggcggtaacagtcaattcactattaatccatctaccgggcagattatcacctcagcactgctcgaccgcgaaaccaaagacaactacaccctcgttgtcgtgtgcagtgacgccggtagccccgagcccctatcatccagcactagtgtgttggtgacagtcactgatgtcaatgacaacccaccacggttccaacaccatccttacgtgacccacatcccttcgccaacattaccgggttcattcgtctttgcggtcaccgtgaccgacgccgatattggtccaaactctgaattgcactactcactctctgggcgaaattcagagaagttccatatcgatcccctgcgtggtgcgattatggcagcgggtcccctcaacggggcatctgaggtgactttctccgtccacgtcaaagatgggggtagtttccctaaaacagactctacaacggtgaccgttcgctttgtcaataaggctgattttccaaaagtgcgggctaaggaacagactttcatgttccctgaaaaccagccggtgagctccctcgtgacaacaatcactgggtcgagccttagaggagagcccatgagctactacatcgcttcagggaacctaggaaacactttccagatcgaccagcttaccggacaggtttcaatatcccagccgcttgatttcgagaaaatccagaagtacgtagtgtggattgaggctcgcgacgggggattccccccattctcgagctatgaaaaactcgatattactgtgctagatgtgaatgataatgctcctatattcaaagaggacccctttatcagcgagatactggaaaatctgagtccaaggaagatcctcaccgtgtcagccatggataaagacagcggtcccaatgggcagctcgactacgagattgtgaacggaaacatggaaaacagctttagcattaaccatgctactggggagattcggagcgtgcggcctttggatcgggaaaaagtatctcactatgtgcttacaataaagagctcagataaagggtctcccagtcagtccactagtgtgaaggtcatgatcaacatcctcgacgagaatgataatgcgcctaggttttcccagattttttccgctcatgtgcccgagaatagcccgctgggttacactgtgacgcgggtgactacctccgacgaggacataggaatcaacgcgatttcccggtactctattatggacgctagccttccattcaccatcaatccatcgaccggggatatcgtaatcagcagacctctgaaccgtgaagatactgacagatatcggattagggtttcagctcatgacagcggctggaccgtgtctacggacgtgacaatcttcgtgacagatatcaacgataatgcccctcggttctctaggacatcctactatttggactgccccgaactgacggagatcggatccaaagtgacacaggtgtttgccaccgaccccgacgaggggtcgaacggccaggtgttttactttatcaagtcccagtcagagtacttcaggatcaatgctaccactggagagatttttaacaaacagattctaaagtaccagaacgtaaccggtttttctaatgtgaacatcaataggcactcttttatcgtgacttcctcggatagggggaagcctagcctgataagcgaaaccacagtgacaataaatatcgtggattctaatgataatgccccacagtttctcaagagcaagtactttactccagtgaccaaaaacgtgaaggtcggaaccaaacttattcgcgttaccgcaatcgacgataaagacttcgggttgaatagcgaggtggagtacttcatctcaaacgataaccatctaggaaagtttaagctggataatgacaccggatggataagcgtcgcctccagcctgatttcggatctaaaccaaaacttttttatcaccgtgacagcaaaggacaaggggaaccccccactctctagtcaggcaacggtgcacattaccgtcaccgaagaaaactatcacacccctgagttttcgcagagccacatgtccgctactatacccgaatcccattccatcggctctattgtcaggacggtgagcgccagagacagggacgcagctatgaacggcttaataaaatattcgatatccagtggcaatgaggagggaatattcgctatcaattcctccaccgggatcttaactttggccaaggcactggactacgagctgtgtcagaaacatgagatgactatctctgcgattgacggaggctgggtcgcacgaactgggtactgttcagtgaccgtcaatgtgattgacgttaacgacaattcccccgtgtttctgagcgatgattacttccctacagttctcgaaaatgctccatccgggaccacggtcatccatctgaatgccaccgatgccgacagcggaaccaacgctgtcattgcatacaccgtccagagttctgattctgatctgttcgtaattgatcccaacaccggcgtgatcactacccagggctttctggatttcgagaccaaacagagctatcaccttaccgttaaagccttcaacgtgccagacgaggaacgttgctcattcgcaacagtgaacattcagcttaagggtaccaacgaatacgtcccccgtttcgttagtaaactgtactattttgaaatctctgaagccgcaccgaagggcaccattgtcggcgaagttttcgctagcgaccgagaccttggtaccgacggcgaggttcactatctaatattcggcaactcacgtaaaaaggggtttcagatcaataagaaaacgggccagatctatgtttctggaatactcgatcgcgaaaaagaggaacgggtgtccttgaaggtcctggcaaagaactttgggtccatcagaggggcagatattgatgaggttactgttaacgttactgtgttggacgctaacgatccacctattttcacccttaacatttacagcgtgcagatttccgagggggttcccatcggaacccatgtgaccttcgtgagtgccttcgattccgattctatccccagctggagccgtttctcttacttcatcgggagtggcaatgaaaacggggcattttcaattaacccacaaaccggccagatcacggtgactgcggaactcgacagagaaacactgcccatctataatctgtctgtactcgccgtggactccggcaccccttcggcgaccggaagtgctagcctccttgtcacattggaggacattaatgataatggtccaatgctcaccgtctcagaaggcgaggtcatggagaataagcgacctggtacgctggtaatgactctccaaagtaccgaccccgacctaccacctaatcagggcccattcacatattacctgttatctacgggccctgcgacaagttacttttctttatctaccgcaggtgtccttagtacaactcgcgaaatagacagagagcagatcgcggacttctatctgagcgtggtaaccaaagattcaggggtgcctcagatgtcaagtacaggaacggtgcatatcaccgtaatagaccaaaatgacaatccttcacaaagcaggacagtggagatattcgtcaactactacggcaatctgtttcctgggggtattctcggaagtgttaaaccacaagatccggatgtactggactcctttcactgttccctgacatctggggttacaagcctgttctccatccctggtggtacctgcgatctgaacagccagccacggagcactgacggaacctttgacctcacagtcctgtccaacgatggggtgcacagcacggtaacttctaacattcgagtattcttcgccggattttcgaacgctacagtggataattccattctcctaagattgggcgtgccaaccgtgaaggattttctgactaaccactatctacatttccttcggatcgcttcctcacagctaacggggctggggacggcggtgcagctctacagcgcttatgaggagaataatagaacgtttcttctagcagccgtgaaaaggaatcataaccagtatgtcaatccttctggtgtcgcaaccttttttgaatccatcaaggagattctcctgcgacaatccggagtcaaagtcgaatcagtcgaccacgactcctgtgtgcacggaccctgccagaacggcggttcatgcctgaggcggcttgcagtgagcagtgtgctaaagagccgggagtccctccccgtgatcatcgtcgccaacgaacctctgcaaccttttctgtgcaagtgtctcccagggtacgccggatcatggtgcgaaatcgatatcgatgagtgcctgccctccccctgccatagtggagggacgtgccataacctggtcggaggctttagctgcagctgtccagatggtttcacaggacgcgcatgtgaacgcgacataaacgaatgtctacaatcaccctgtaagaacggcgctatttgtcagaactttcctgggtcatttaactgcgtctgcaagaccggctataccggaaagatgtgtgaatcctcagtcaattactgtgaatgtaacccatgtttcaatgggggatcatgtcagtcgggggtggattcctactattgtcattgccccttcggcgtttttggtaaacattgtgaactcaatagctatggctttgaggaactttcttatatggaatttccttcactcgatcccaataacaactatatctatgtcaagttcgctaccatcaaatcacacgccctcctgctctataattacgataaccagactggtgatcgggcagaatttcttgcgctggaaatagccgaagagcgattgagattctcgtacaacctgggcagtggaacatataaacttactacgatgaaaaaagtctcagatggccacttccacaccgtgatcgctaggcgtgctgggatggctgccagccttactgtggactcctgctccgagaaccaggagccaggttattgtaccgtctccaatgtcgcagtatccgacgactggactctggatgtgcagcccaaccgtgtgacagtcggaggaattcggagtctagagcctatactgcaacgcaggggtcacgtcgaaagccacgatttcgtgggatgtatcatggagtttgccgttaacggccgaccactggagccgtcacaagcgctagccgcacaggggatcctcgatcagtgccccaggctggaaggtgcctgtactcggagtccgtgtcagcatggtgggacctgcatggactactggagttggcagcagtgtcactgcaaggaaggactcactggcaaatattgcgagaaatctgttacccctgatacagctctctcgctggaggggaaggggagattggattatcatatgtcacaaaacgagaagcgagaatatctcttgcgtcagtctctgagaggcgctatgttggaaccttttggggtcaattctctggaagtcaagtttagaacacgcagcgagaatggggttctgattcacatacaggaaagttcaaattacacgaccgtgaaaattaagaacggaaaagtgtactttacatccgacgctgggatagctggtaaagtagagcgtaatattcctgaggtgtatgttgctgacgggcattggcataccttcctcatcggaaaaaacggcaccgccacggtgctttccgtcgaccggatctataatcgagatattattcaccctactcaggattttggaggtctggacgtactaacaattagcctgggcggtatacctcctaaccaggcccacagggacgcgcagaccgccggtttcgatgggtgtatcgccagcatgtggtacggcggtgaaagcctcccttttagcgggaagcacagccttgcttccatctcgaagactgatccttctgtgaagattgggtgtcgagggccaaatatttgcgctagtaacccctgttggggcgaccttctctgcatcaatcagtggtatgcctaccggtgtgtcccccctggggactgtgctagtcacccatgccagaatgggggatcctgcgaacccggtctgcattctggattcacctgctcatgccccgattcccacacagggaggacctgtgaaatggtggtggcttgcctgggtgttctctgccctcagggaaaagtctgtaaagcagggtctccggctgggcacgtgtgcgtgttgtcacaggggcctgaggagatctccttgcctttatgggcagttcccgcaatagtgggttcctgcgctactgtgttagctctgcttgtattgagcctcattctatgcaatcagtgccgagggaaaaaggccaagaatccaaaagaggagaagaagccaaaagaaaaaaagaagaagggatctgagaatgtggcgttcgacgaccccgacaacattcctccttacggtgacgatatgaccgtgagaaaacaaccggagggaaacccgaaacccgatatcatcgagcgtgagaatccatatctgatttatgacgagacagacataccgcataattctgaaacaatcccatccgctccattggccagtcctgagcaggagatagagcattatgacatcgataacgcaagttctatcgcgccatccgatgcagatatcattcagcattacaagcagttccgcagccatactcccaaattttcaattcagcgacattcccccctggggttcgcgagacagagtccgatgcctctcggggcatcatccttgacataccagcccagctatggccagggccttaggactagctcactgtcccactctgcctgtccgacacccaatcccctttcgcgccactcgccagctccgttctccaaaagctcaactttttaccgaaattctcccgctagagagttgcatctaccaattagagacggcaatactctcgaaatgcacggcgatacctgccagcctgggatctttaattatgccacaagactcgggaggcgttctaaatcccctcaggctatggcgagccatggatcccgacccggtagtcgactcaagcagcccatcggacagatcccccttgagtcctcgcctccggtggggctgtccattgaggaggttgagcggcttaacacaccacgaccacgcaacccgtctatctgttcagctgatcatgggagaagtagcagcgaagaggattgccgcaggccactgtcacgcacccgcaacccagctgatggcatcccagccccagagagtagtagcgactccgactctcacgagagctttacctgtagtgagatggagtatgacagagagaagcccatggtgtacacatccaggatgccaaagcttagtcaggtgaatgagagcgatgctgatgatgaagacaactatggcgctcgattgaaacccaggcgatatcacgggagaagggctgagggcggtccagtgggtacccaggccgcagcacctgggacagcagacaacaccttacccatgaagctgggacagcaggcgggaaccttcaactgggacaatcttttgaactggggccctggttttgggcactacgtggatgtgttcaaggatctggccagcctgcctgagaaggccgctgcaaatgaagagggtaaagctggcacaacaaagcctgttccaaaggacggagaggctgagcagtacgtttag

SEQ ID NO: 222910 - DNA, 1239 bp, Artificial Sequence
  Description of Artificial Sequence: Synthetic coding sequence
atgggcctgcatcttagaccatatagggttggcttgctgcccgatggactcctctttttactgttgcttctcatgctgctcgcggacccagccttgccagccggtagacaccctcctgtagttttagtgccaggcgatctcggaaaccaattggaagctaaactcgacaagcctacggttgtgcactacttatgtagtaaaaaaacagagtcatactttaccatatggctcaatctcgaactattgctgccggtcattatcgattgctggattgataacatccgactggtgtataacaaaactagtcgcgctacacagttcccagacggggtggacgtgagggtgcccggttttggaaaaacgttctccctcgaatttctggatccttctaaaagcagcgttggttcctacttccatactatggtggagtccctagtaggatggggttacactcgcggagaggatgtcaggggggcaccttacgactggcggagagctccaaatgagaacggcccatattttcttgcattacgagagatgatcgaggagatgtatcaactgtatggcggacccgtggtcttggttgctcacagcatgggtaacatgtatacactatatttcctgcaaaggcagcctcaggcttggaaagacaaatatatcagggcctttgtgtcactgggagcaccgtggggaggggtagctaaaacattgcgagtcctggcgagcggcgataacaaccgaatcccggttattgggcctttgaagatccgggagcagcagagaagcgctgtgtctacctcgtggctgttgccatacaattatacatggtcccccgagaaggtgttcgtacagactcccacaattaactacactcttcgggattatcggaaattctttcaggatatcggattcgaggacggatggctcatgaggcaagatacagagggacttgttgaggcgaccatgccacccggagtgcaacttcattgcctgtacggaaccggcgtcccaacacccgactcattctattatgaatcttttcctgatcgcgacccgaaaatctgcttcggcgatggagacggaaccgtgaacttaaagtctgccctgcagtgccaggcatggcaatcgcgacaggaacaccaagtactacttcaggaactgcccggatccgagcacattgaaatgctggcgaacgccacaactttggcatatctgaagcgggtgctcctgggcccatag

SEQ ID NO: 222911 - DNA, 480 bp, Artificial Sequence
  Description of Artificial Sequence: Synthetic coding sequence
atgttccctgggctgtttatgttgggaaccttcctgtggtcgctcatcgaatatctgatacataggttcttgttccatatgaagcctccatccgattcttattacctgattatgctccattttgtgatgcacgggcagcaccacaaagcccctttcgatggtagcagattggtctttcccccagtcccggcttccttggtgatcggcgttttttatttatgcatgcagttaatactccctgaagcagtgggtggtaccgtgtttgcgggaggactgcttgggtatgttctgtatgatatgacccactactatcttcacttcggctctcctcacaagggcagctacctgtacagcctgaaagctcaccacgtgaagcatcactttgcgcaccaaaagagcggcttcggcatttctaccaagctgtgggattattgttttcacacattgacaccagaaaagccacaccttaaaactcagtag

SEQ ID NO: 222912 - DNA, 1740 bp, Artificial Sequence
  Description of Artificial Sequence: Synthetic coding sequence
atggtgcagtacgagttgtgggccgctttaccaggcgcatccggcgtcgccttagcctgctgcttcgtggctgccgctgtcgccctgcgctggtcaggaaggcgaacagcccgtggtgcagtggtgcgcgctcgccagaggcaaagagccggacttgagaacatggacagggctgcccaaaggtttagactccaaaatccagacttggactccgaagctctgctggccttgcctctcccacaattagttcagaagttacactctcgtgagttagctcccgaggcagtgctttttacttacgtgggtaaggcctgggaagttaacaaaggtacaaactgtgttaccagctatttagctgattgcgagactcaactgtcccaagcgccaagacaggggctactgtatggcgttcccgtgtctctgaaggaatgctttacgtataaaggacaggacagtaccctcggtctgtcgttgaatgagggcgtacccgctgaatgtgattctgtcgtggtacatgtgctgaaattgcagggcgcagtgccctttgtgcacaccaatgtcccccagagcatgttcagctatgactgcagtaaccccctctttggacagacggtgaacccctggaagagtagcaaatcccccggaggtagctctggtggtgagggtgctctgatcggatcagggggtagcccgctgggactgggaactgacatcggtggctccattcgatttcccagtagcttttgtggcatttgcggtctgaagcctaccgggaataggctatctaaatccggactgaaagggtgcgtgtatggacaagaagccgtgcgactgtcggtgggcccaatggccagggacgtggaatcactcgcactatgtctgagggcactgctttgtgaggatatgttccgactcgatcctactgtacctcctctgccctttcgcgaagaggtgtacaccagctcccagcccctgcgtgtaggctattatgagacagacaactacaccatgccttccccagcgatgaggagagccgtacttgagactaaacagtcgctggaggctgccggacatacactggtgcctttcttaccctctaacattccgcacgcgctcgagaccctctcaaccgggggacttttcagcgatgggggacacacatttctccaaaactttaaaggcgatttcgtcgacccatgcttgggcgacctggtttcaatcctaaaactgcctcaatggttgaagggactcttggctttcttagtgaagccacttctgcctcggttgagcgcctttctatccaatatgaagtctcgaagtgctggaaaactgtgggaattacagcacgagatcgaagtgtatcgtaaaacggttatcgcacaatggcgagcgctcgacctcgacgtggtgttaacacccatgctagcccctgctctcgacctcaacgcacccggtcgagcgaccggcgctgtctcatatactatgctgtacaactgtctggactttcctgctggggttgtgcccgttactacagtcacagccgaggacgaggcgcagatggaacactatcgaggatactttggcgatatttgggacaagatgctccagaagggaatgaaaaagtccgttggccttcctgtcgctgtgcagtgcgtggctttgccatggcaagaagaattgtgtttgcgctttatgagggaagtcgagagactgatgactcctgagaagcagtcctcctag

SEQ ID NO: 222913 - DNA, 456 bp, Artificial Sequence
  Description of Artificial Sequence: Synthetic coding sequence
cggcgtcagcaccccctgcccctgctcctgctgaggcatctccgccctcaggctcatagagagcctcctcaagtttatacctccagtcagcccctgcgtgtggggtattacgagacagataattataccatgccatctcctgcaatgcggagagccgtgttggagacaaagcaaagtcttgaggctgccggacacacccttgttcctttcctcccaagcaatatccctcatgctttggaaaccttgtccacgggcggactgttctcggatggtggtcacacctttctccagaacttcaagggcgactttgtagatccctgtttaggagatctggtatcaattctgaaattgccccaatggctaaaagggcttctcgcctttctcgtaaaacctctactgccgcgtctcagcgcatttcttagtaacatgaaatctcgatgtcggccattaccttag

SEQ ID NO: 222914 - DNA, 1599 bp, Artificial Sequence
  Description of Artificial Sequence: Synthetic coding sequence
atggcgccttccttcactgcccgtatacagcttttcttgttacgcgctctgggattcctgatcgggcttgttgggagagccgctttagttttgggcggacccaaattcgcatcgaaaacccctagacccgtcaccgagccattgttacttctcagtgggatgcaactggcaaaattgatcagacaacgtaaagtcaagtgtattgatgtggtgcaagcatatattaaccgcatcaaagatgtgaatcccatgattaatgggatcgtgaaataccgcttcgaggaggcaatgaaagaggcacacgcagttgaccagaaactggccgagaagcaggaggacgaggcaactctggaaaacaagtggcctttcctgggcgtgcccctcactgtgaaagaggctttccagttgcagggaatgccaaattccagtggactgatgaaccgcagagacgccatcgcaaaaactgatgctactgttgtcgcccttctgaagggggcaggagccatacctctgggcataacaaactgttccgagttgtgtatgtggtacgaaagctctaacaagatctacggccgttcgaacaacccatacgacttacagcatattgtggggggtagttccggtggcgagggctgtacactggccgctgcatgttctgtgataggcgttggatccgatattgggggatcaattaggatgccggcattcttcaatggcatttttggccacaaaccgagtcctggcgtggtgccaaacaagggccagttccccctggccgtaggcgcacaagagctctttctgtgtactggacccatgtgtcgctacgccgaggacttggcacccatgttgaaagtgatggcgggaccagggattaagcgccttaaactggacaccaaagttcacttgaaggatttgaaattctactggatggagcacgatggtgggtctttcctcatgagtaaggtggatcaggacttgatcatgactcaaaagaaagtggttgtccatttagaaactatcctgggcgcatctgtacagcacgtgaaactgaagaaaatgaagtacagtttccagctttggattgctatgatgagtgcaaagggacacgatggaaaggagccagtgaaattcgtggacctgttgggcgaccatgggaagcacgtgtcgccgctatgggagttaatcaaatggtgcctcgggctgtccgtttacactatccctagtatcgggctggctcttcttgaggaaaagttgcgctattccaacgaaaagtaccagaaatttaaagctgtggaggaaagtctcagaaaagaactcgtagatatgttgggggacgacggagtatttttatatccctctcaccctacagtcgccccaaagcaccacgtaccactgactaggccgtttaattttgcctacacgggtgtgttcagcgccctggggctgcctgttacccaatgcccactgggactgaacgccaaaggcctaccactgggaattcaggtggtggctgggccattcaacgaccacctgactttagctgtagcccagtatctggagaagaccttcggcggatgggtgtgtccgggtaagttttag

SEQ ID NO: 222915 - DNA, 384 bp, Artificial Sequence
  Description of Artificial Sequence: Synthetic coding sequence
atgagcttttctggcaaatatcaattgcaatcgcaagagaatttcgaagcatttatgaaggccattggcctgcctgaggagctgatccagaaggggaaagatattaagggtgtcagtgagatcgtgcagaacggaaagcactttaaattcactattaccgccggaagcaaggtgatccagaatgagttcaccgtgggcgaagagtgcgaactggaaactatgaccggggaaaaggttaaaaccgtcgttcagttagaaggtgacaacaaacttgtgacaaccttcaagaacattaaatctgtgacggagttgaacggagacatcatcaccaacactatgacactgggagacattgtcttcaaaaggatctcgaaacgtatctag

SEQ ID NO: 222916 - DNA, 399 bp, Artificial Sequence
  Description of Artificial Sequence: Synthetic coding sequence
atggcatttgattccacctggaaagtggaccggagcgagaattatgacaagttcatggagaagatgggcgtcaacatcgtgaaacggaaattggcagcccacgacaatctgaaactgactattactcaagaagggaataagtttaccgttaaggagtccagtacatttcggaacatcgaggttgtcttcgaattgggcgtgacatttaattacaacttggccgacgggactgaacttaggggcacatggtcattagagggcaataagttaatcgggaaattcaagcgcactgacaacggaaatgaattgaacacggtgagagagatcattggcgacgaactggtacagacctacgtgtatgagggggtggaagccaaaagaatctttaaaaaggactag

SEQ ID NO: 222917 - DNA, 402 bp, Artificial Sequence
  Description of Artificial Sequence: Synthetic coding sequence
atggtggacgccttccttgggacttggaaactggtcgattcaaaaaactttgatgactatatgaagagcctgggggttggcttcgccacaagacaggtggccagcatgacaaaaccaaccacaattatagaaaagaatggcgacattctgaccctgaagacacattcgacttttaaaaacacagagatttcatttaaattgggggtcgaatttgatgagaccaccgctgatgatcgaaaagtgaagtctattgtgactcttgacggaggtaaactggtgcatctgcagaaatgggatgggcaggaaacgactctggttagggagctgatcgacggaaaactcattctgacactcacccacggcaccgcagtctgcacaagaacatacgaaaaagaggcctag

SEQ ID NO: 222918 - DNA, 408 bp, Artificial Sequence
  Description of Artificial Sequence: Synthetic coding sequence
atggcaaccgtgcaacagttggaggggaggtggaggcttgtcgatagcaaggggtttgatgaatacatgaaagagcttggcgtaggcatcgctctccgtaagatgggagcgatggccaagccagattgcatcatcacctgtgacgggaagaacctcacaataaaaaccgaatccaccctgaagacaacacaattcagctgtactctgggagaaaaattcgaagagaccacagccgacgggaggaaaactcagacggtatgcaatttcactgatggagctttggtgcagcaccaggagtgggatggcaaagaatctacgattactcgcaaactcaaagacggaaagctcgtggttgagtgcgtcatgaataacgtgacctgcactcgcatctacgaaaaggtcgagtag

SEQ ID NO: 222919 - DNA, 534 bp, Artificial Sequence
  Description of Artificial Sequence: Synthetic coding sequence
atgaaaactgtaacaatgatgatggtagttgagatgcaggctttaacccaggtgctccgggctgttcttagtgcatgcacctgggtcagtagaaaaggtgacctgcagaggatgaagcagacacacaaagggaagccccctagtagcatggcatttaccggcaaattcgaaatggagtccgagaaaaactacgatgagtttatgaagctgctaggcatctcatccgatgtaatagagaaagcacgcaacttcaagattgtcacagaagtccaacaggacggacaggacttcacatggtcacaacattattctggcggtcataccatgaccaacaagttcactgtgggaaaggagtcgaacatccaaacaatgggcggtaaaacctttaaagcaactgtccaaatggaaggagggaaattggtggtgaacttcccaaattaccatcagacatcagaaatagttggtgacaagctcgtggaggtgagtacaataggtggggtgacatatgaaagagtgtcgaagagactggcctag

SEQ ID NO: 222920 - DNA, 534 bp, Artificial Sequence
  Description of Artificial Sequence: Synthetic coding sequence
atgaaaaccgttacgatgatgatggttgtggagatgcaggcgctgacacaggtgctcagagccgtgttgtctgcctgtacttgggtctcccgcaaaggagatctgcaaaggatgaaacaaacacacaaaggtaaacctccttcaagcatggcttttacaggaaaattcgagatggaatctgagaagaactacgacgagttcatgaaactgttgggcatcagctccgacgtgatcgaaaaggcaaggaattttaaaattgtcaccgaggtgcagcaagatggacaggacttcacttggagtcagcattatagcggtggtcataccatgacaaataagtttaccgttggaaaggaaagcaacattcaaacgatgggaggaaaaactttcaaagctaccgtgcaaatggaagggggtaagctggtcgtcaattttcctaattaccaccaaacaagcgaaatagtgggagataagctagtggaagtgtctaccatcggcggtgtcacatacgagcgcgtttcaaagagacttgcgtag

SEQ ID NO: 222921 - DNA, 387 bp, Artificial Sequence
  Description of Artificial Sequence: Synthetic coding sequence
atggcatttacaggcaaattcgagatggagagcgaaaaaaattatgacgagtttatgaagttactagggatttccagcgacgtgattgaaaaagcacgtaactttaaaatcgtcactgaggtgcagcaggatgggcaggacttcacctggtcccagcattactccggcggtcatactatgaccaacaaatttacggtgggaaaggagtccaacatccagactatgggcggaaaaacttttaaggccacagtgcagatggaggggggaaagttagttgtgaatttcccaaactatcatcagacgtccgaaattgttggagataaactggtcgaagtttccacaattggaggggtgacatatgaacgggtctcaaagagattagcctag

SEQ ID NO: 222922 - DNA, 501 bp, Artificial Sequence
  Description of Artificial Sequence: Synthetic coding sequence
atggtggaggccttttgcgctacttggaagctcaccaacagtcagaactttgatgagtacatgaaagccctgggggtgggtttcgccacccgccaggtgggtaacgtgacaaagcccacggtgataattagccaagaaggagacaaagtggttattcggaccctgtctacattcaaaaataccgagatttcgttccagctgggggaggagtttgacgagactactgccgacgacagaaactgtaaatctgtggtctctcttgatggcgataagctcgtccatattcagaagtgggatggcaaagagacaaactttgtcagagaaatcaaagacggaaaaatggtgatggtgtcgaacgacaatagtccattctttcttgtttttttctcttccccccataccagtcacttactaccgagttcatccttgttgctgccattcttcctccttccaagctttttcaacaataccagcttggccagatttttcaattacatgtag

SEQ ID NO: 222923 - DNA, 399 bp, Artificial Sequence
  Description of Artificial Sequence: Synthetic coding sequence
atggtggaagctttttgcgctacgtggaagctgaccaactcacagaacttcgacgaatacatgaaagccctgggggttggcttcgcaacacgacaggtaggcaacgtcactaaaccaacagtcatcatatcccaggagggggacaaggtcgtaatccgtacactgtcgacctttaaaaacacagagattagtttccagctgggagaagagttcgacgaaactacggctgacgacagaaattgtaaaagtgtggtaagtctggatggggataagcttgtgcatattcagaagtgggacggaaaagaaacaaactttgtgcgggagattaaggacggcaaaatggtgatgacactgacgtttggtgatgtagtggccgtgagacactacgaaaaggcctag

SEQ ID NO: 222924 - DNA, 1506 bp, Artificial Sequence
  Description of Artificial Sequence: Synthetic coding sequence
atggggacgcgggcagcgcgaccagccggtctgccatgtggcgctgaaaacccagctagacgcaggctggcacttggggctagacagcagatacacagctggtcccctagaacgccctccaccagattgaccgccccagctggcccagcaagaggtgtagcccgacctgcgatggccccagacccggttgctgcagagaccgccgcacagggcccaacaccacgctattttacctgggacgaggtggctcaaagaagcggctgtgaagagagatggctggttatcgaccgtaaagtttacaatatatctgagttcaccaggaggcacccaggcggatccagggttatctcgcactacgctggccaggacgcaacagaccccttcgtggcgtttcacattaataagggcctggtcaagaagtacatgaattccctcttgattggtgaactgagccctgagcaacctagctttgagcccactaaaaataaagagctgacagacgagttccgggaactgcgcgctaccgtcgagcggatgggactgatgaaggccaatcacgtgtttttcctgctgtacttactacacattctgctgctggacggagccgcttggctgacactgtgggtcttcggaacatcattcctgcctttcttgttgtgcgcagtcctcctgagcgccgtacaggctcaggcaggctggcttcagcacgacttcggacacctatctgtctttagtacctctaagtggaatcacttgcttcaccattttgtcattggccacctcaagggcgcacccgcaagttggtggaatcatatgcactttcaacaccatgctaagcccaactgctttagaaaggaccctgacatcaatatgcatccatttttttttgccttggggaaaattctgtcggtggagcttggcaagcagaagaagaagtacatgccttataaccatcagcacaagtacttctttctgattgggcctcccgctctgctgcccctttattttcaatggtacattttctactttgtgattcagagaaaaaaatgggtggacttagcttggatgattaccttttatgtgaggtttttcctaacatacgttccactgctggggctaaaagcattcctgggtctgttcttcatcgtcaggtttctggaatccaactggttcgtgtgggtgactcagatgaatcatatacctatgcacattgaccatgacaggaacatggactgggtgtctacccaattgcaggccacatgtaacgttcataagtccgctttcaacgactggttttctggacatctgaattttcagattgagcaccaccttttccccacaatgcctagacacaattatcataaggtggctcccttagtgcagagtttgtgcgcaaaacatggcatagagtaccagtctaagcccctcctgagcgcctttgctgatatcatccactcactgaaagagtctggacagctgtggcttgatgcttacctccaccaatag

SEQ ID NO: 222925 - DNA, 1083 bp, Artificial Sequence
  Description of Artificial Sequence: Synthetic coding sequence
atgaactcactcctgatcggcgaactgagtccagagcagccctccttcgaacccaccaagaacaaagagttgacagacgagtttagggagctgcgagcgaccgttgagcggatggggcttatgaaggccaatcatgtgttcttcctgctgtatctactgcatatcttgctgctcgacggagccgcatggctgaccctttgggtttttggcaccagctttctgcctttcctactgtgtgcagtactcttgagtgccgtgcaagcacaggctggctggctacagcatgattttgggcatctaagtgtgttctctacaagcaaatggaatcacctgctgcatcattttgtaattgggcaccttaagggcgctccagcgagctggtggaaccacatgcacttccaacatcacgcgaaaccaaattgtttcagaaaagaccctgacatcaacatgcatcccttcttcttcgccctggggaaaatattgtcggtggagctgggaaagcaaaagaaaaagtatatgccctacaaccatcagcataagtacttctttctgataggtccaccagcactgctgccactctacttccagtggtatattttttatttcgtcatccaacggaaaaagtgggtcgatctggcctggatgatcaccttctacgtgagattctttctgacatatgtgccactcttggggcttaaggcgttcctcggacttttcttcattgtgcggttcctggaatcaaattggtttgtatgggtgactcagatgaaccacattccaatgcacatcgatcatgacagaaatatggactgggtctcgacacagctgcaagccacatgcaacgtccataagtccgcctttaatgattggttctctggacacctgaatttccaaattgagcatcatcttttccccacaatgcctaggcataattatcataaagttgcccctcttgtgcagtctttatgtgctaaacacggtattgagtaccagagcaagcctctcctgagcgctttcgcagatatcatccactctcttaaagagtccggtcaactctggctagacgcgtacctgcaccagtag

SEQ ID NO: 222926 - DNA, 1083 bp, Artificial Sequence
  Description of Artificial Sequence: Synthetic coding sequence
atgaattccctgttgatcggagagttgtcccctgagcaaccctctttcgagcccactaaaaataaagagttaacagatgagttcagagagttgcgtgccaccgtagaacggatgggactgatgaaagccaaccatgtgtttttcctgctgtatctactgcatattctgctccttgacggggcagcttggcttacactgtgggtttttggcacttcttttctgcctttcttgctttgcgctgtcttgctgtcagccgtccaggcacaggccggatggttacagcacgacttcgggcatttgtcagttttctccacttcgaagtggaaccatttgctgcatcattttgtgataggacatttgaaaggcgctcctgccagctggtggaatcacatgcactttcagcaccatgctaaacccaattgtttccgtaaagaccccgacatcaacatgcaccctttcttttttgcactaggaaagatcctgtctgtggagctgggcaaacagaaaaagaaatacatgccatataaccaccagcataaatatttcttcctcatcggccctccagcactgctgcccctgtacttccagtggtacatcttctacttcgtgatacaaagaaagaaatgggtggatctggcctggatgatcacattttatgttaggtttttcctgacatacgtcccactcttagggcttaaggcctttcttggactgttctttatcgtccgctttctcgagtcaaactggttcgtgtgggtgacccagatgaaccatattcccatgcacatcgaccatgacagaaatatggactgggtcagcacccagctgcaggctacttgtaatgtccacaagtccgccttcaacgattggttcagcggccatcttaatttccagatagagcaccacttgttccctaccatgcccagacacaactatcacaaggtcgctcccctggtccagagcctgtgcgctaaacatggaattgaataccagtcaaagcccctgctcagtgcctttgccgatattatccacagtctcaaggagtcggggcaactgtggctggacgcttatctccaccagtag

SEQ ID NO: 222927 - DNA, 1083 bp, Artificial Sequence
  Description of Artificial Sequence: Synthetic coding sequence
atgaacagcctactgatcggcgagttatcccctgaacagccatctttcgaaccaaccaagaataaggaactgaccgacgaatttcgagaactcagggccaccgtggagagaatgggcctgatgaaggctaaccacgtatttttcctgctgtacctcttgcatatcctactgctcgatggagccgcttggttgacactgtgggtatttgggacctcatttctccctttcttgctgtgcgccgtgctgctgtctgccgtgcaggcccaggcaggctggcttcagcatgactttggacacttaagcgtgttctccacatccaaatggaaccacctcctgcaccactttgtaatcggccatttaaaaggggcacccgcttcctggtggaatcatatgcattttcagcaccacgccaaacccaactgctttaggaaggatcccgatattaacatgcatcctttcttcttcgccttgggcaaaattttatctgttgaattgggcaagcaaaaaaaaaagtatatgccatataatcaccagcataaatactttttcctcattggaccccctgccctattaccactctattttcagtggtacatcttttacttcgtgattcagcgcaaaaagtgggtggatttggcctggatgatcacattttacgtacgttttttcctgacatatgttcctctgcttggtctgaaagcattcctcggactgtttttcatcgttcgctttctggagtccaactggtttgtctgggtgacacagatgaaccatattcctatgcatatcgatcacgatcgaaacatggattgggtgtccactcagctgcaggcgacatgcaacgtccacaagtctgcctttaacgattggttctctgggcacctgaacttccagatcgagcatcacctcttcccaaccatgccccgacataactaccataaagtggcccctctagtacagtcactctgtgcaaagcacgggatcgaatatcaatcgaagccacttctgagtgcattcgcggacataatccactccctgaaagagtcgggccaactgtggttggacgcctacctgcatcaatag

SEQ ID NO: 222928 - DNA, 1131 bp, Artificial Sequence
  Description of Artificial Sequence: Synthetic coding sequence
caggacgcctttcgcgcatttcaccaggacttgaacttcgttcgaaagtttttacagccgttactcatcggcgagcttgcccctgaagaaccgagtcaggacggacctctgaatgctcagctggttgaagactttagagcccttcatcaggccgctgaggacatgaaattatttgatgctagtcccacattcttcgcctttctgctgggccatatactggctatggaggtgcttgcctggctcctgatttatctcctaggacccggttgggtgccttctgccttagccgcattcattttagcaattagtcaggctcaggcgggttggctgcaacacgacttcggacacctctctgtatttagcaccagcaagtggaaccatctccttcaccacttcgttatcggccacctgaaaggcgctccagcgagttggtggaatcatatgcacttccaacaccacgccaaacccaactgctttagaaaggatccagatattaatatgcacccattcttctttgctctgggaaagatcctctccgtcgaattgggaaagcagaaaaaaaaatatatgccttataatcatcagcacaagtacttcttcctgattggcccacccgctctcctgcccctatactttcagtggtatatcttctactttgtgatccaaaggaaaaaatgggttgatttagcttggatgattacattctatgtaagatttttcctcacatacgtccccttactcgggcttaaggcatttttaggactgtttttcattagatttcttgagagcaactggttcgtatgggttacacagatgaaccacatccccatgcacatcgaccacgataggaatatggattgggtgtcaacgcaattgcaagcaacgtgtaatgtccacaagtccgcttttaacgattggttctccggccacctgaatttccagatagaacatcacctatttcccacaatgccgagacataactaccataaggttgcaccattggttcagagtctgtgtgcaaagcacggtatcgaataccagtccaagcccctgctttccgcttttgctgacattattcacagccttaaggaatcaggccagctctggctggacgcatacctgcaccagtag

SEQ ID NO: 222929 - DNA, 1269 bp, Artificial Sequence
  Description of Artificial Sequence: Synthetic coding sequence
atgcacggacgagaggcgggaccatttgtctgcgtctgcgtgttgctggcctctatcccaacaccccagaccccgctccttcaggcatcattgccgccttttcatcctgcatcagctgggcatcccataaccggccagcaggatgctttcagggccttccatcccgacctcgagttcgtcggcaaatttttaaagccccttctgatcggcgagctggccccagaagaaccaagccaagatcacgggaagaatagcaaaattacagaggacttccgggctttacgtaagactgcagaggacatgaacctgtttaagaccaaccatgtgttctttcttcttctgctggcccacatcatagctttagaatcaatcgcgtggttcacagtgttctatttcgggaatggctggattcctaccttaatcactgcatttgtccttgccacctctcaggcgcaggcaggatggcttcagcacgactatggccacttaagcgtatatagaaagccaaagtggaatcaccttgtccacaagtttgttattgggcatcttaaaggcgcaagcgcaaactggtggaaccacagacattttcagcaccatgccaaaccgaatatctttcacaaagatcctgatgttaacatgcttcacgtgtttgtgctgggtgaatggcagcccatagaatatgggaagaagaagctgaaataccttccatataaccaccagcacgaatacttcttcctgattgggccacccttgttgatcccaatgtatttccagtatcagatcattatgaccatgattgtgcataaaaattgggttgatctcgcttgggcagtgtcttactatatccggttctttatcacttacatccccttctacggcattcttggcgcactacttttccttaactttatcaggttcctcgaatctcattggttcgtctgggtcacccagatgaatcatattgtaatggaaatcgatcaggaagcctaccgggattggttctcatcccagctgactgctacctgcaatgtggagcagagtttctttaacgattggttctctggccacctgaacttccaaatcgagcaccacctctttcctacgatgccaaggcacaacctgcataaaattgcccctcttgtcaagagtctgtgcgcaaaacacgggattgagtaccaggaaaagccccttctgcgcgctttgctggatatcatacgaagccttaaaaaaagcggcaaattgtggctcgacgcctatctccacaaatag

SEQ ID NO: 222930 - DNA, 1335 bp, Artificial Sequence
  Description of Artificial Sequence: Synthetic coding sequence
atggggaagggcggaaatcaaggtgagggcgcagccgaaagagaggtgtccgtgcctacctttagttgggaggagattcagaaacataatctgaggaccgacagatggctggtgatcgatcgaaaggtttacaacattaccaaatggagcatccagcatcctggtggccagagagtcatcggccattacgccggtgaggatgcgactgatgcttttagggcatttcatccggatctcgagtttgttgggaagtttctcaagccgctcctcattggcgaactggctcctgaagaaccctctcaggaccatgggaagaacagtaaaattaccgaggactttagagcacttcgcaagacggccgaagatatgaatctgttcaagaccaatcacgttttttttctattactgctggcacacattatcgcccttgagtcaattgcgtggttcacagtcttctatttcggcaacggatggatacctacgctgatcactgcatttgttctggctacatctcaggcccaggcaggatggctgcaacatgactatggacatctgtctgtgtatcggaagcccaagtggaaccatctcgtacataaattcgtgattggacacctgaagggggcaagcgcgaactggtggaaccacaggcacttccaacatcacgccaaacccaatatcttccacaaagaccccgacgtgaatatgctgcatgtgtttgtgttgggggagtggcagccaatcgagtatggcaaaaaaaaactcaagtatctgccttacaaccaccagcacgagtattttttcctgattgggccacctctccttattcccatgtactttcagtaccagattatcatgacgatgattgtgcacaagaattgggttgaccttgcctgggctgtgtcgtactatataaggttttttataacctatattccattttatggtattcttggcgcactcttgtttctcaattttatccgcttcttggaaagtcattggtttgtgtgggtgacccagatgaatcatatcgtcatggagatcgatcaggaggcttacagagattggttttcttcgcagctgaccgccacttgtaacgtggagcagagcttcttcaacgattggttttctggacacctgaattttcagattgagcaccacctgtttcccaccatgccacggcataacctgcataaaatcgccccacttgtgaagtccctgtgtgcaaagcacggaatcgagtatcaggaaaagcccctgctgagggcattgctcgatataatcaggagccttaagaagtccggaaagctttggctggacgcgtatttgcacaagtag

SEQ ID NO: 222931 - DNA, 1161 bp, Artificial Sequence
  Description of Artificial Sequence: Synthetic coding sequence
atgggaaaaggtggcaaccagggggagggtgcggcagaaagagaagtgagcgtccccaccttctcctgggaggagatccagaagcataatcttcgcacagatcgctggctggtcattgatcggaaggtctacaatattacaaagtggtctattcaacatcccggaggtcagcgagtgatcggacattatgcaggggaagacgcaacagacgcgttcagagcgtttcatcctgatttggaatttgtggggaagttcctgaaacccttgcttattggggaactcgccccagaggagccttcacaagatcatggaaaaaattcaaagattacagaagattttcgggctctgcggaagactgcagaagacatgaacctgtttaagacaaaccatgttttcttcttactcctcctggcacatatcatcgcacttgaatctatcgcatggttcaccgtgttttatttcggaaacggctggatcccaactctcattacagctttcgtcctggcgacgagccaggcccaagcgggttggctgcagcacgattatggtcatctgtctgtctaccgcaagcctaagtggaaccacctggttcataagtttgttattggccatctgaaaggggcttccgctaattggtggaaccatagacacttccagcaccacgcgaagcccaacatattccacaaagaccctgacgttaacatgctgcatgtgtttgtgctcggggagtggcaaccaatcgaatatgggaagaagaaactgaagtatctcccgtataaccatcagcatgaatacttctttctcatcggaccaccccttctgatccctatgtactttcagtaccaaataatcatgactatgatcgttcataagaattgggttgatctggcctgggccgtctcttactatattaggttttttattacttatatccctttttacggcatcttaggagccttacttttcctgaactttatcagatttctggagtcacattggttcgtttgggtgacgcagatgaaccacattgtaatggaaatcgaccaggaggcttaccgcgactggttcagctctcaattaaccgccacttgcaacgttgaacaatctttttttaatgactggttctcagggcatctgaactttcaaattgaacaccagtag

SEQ ID NO: 222932 - DNA, 1338 bp, Artificial Sequence
  Description of Artificial Sequence: Synthetic coding sequence
atgggaggagtgggcgaacctgggccaagggaaggacctgcccagcccggtgctcccctccctaccttctgctgggagcaaattcgggctcacgaccagccaggtgacaagtggctggttattgagcgacgggtgtatgacattagcagatgggcccagcgccatccaggaggttcccgccttattgggcatcatggcgctgaagacgcaactgatgctttcagagcatttcaccaggatctcaattttgttcgtaagtttctgcaaccactgttaatcggtgagctggccccagaagagccgtctcaggacggaccactcaacgctcagctcgttgaggattttcgggctctacaccaagccgcagaggatatgaaactgtttgatgcttcaccaacattctttgcatttctcctgggtcacatcttggctatggaggtccttgcttggcttttgatctacttgctgggcccaggctgggtaccgagcgctttggccgcatttatcttggctatctcccaggctcagagctggtgtctgcaacatgacctggggcacgcctccattttcaaaaagtcctggtggaaccatgtggcgcagaaattcgttatgggtcaattgaaaggatttagcgcacattggtggaacttcagacacttccagcatcacgccaagcctaatattttccataaggatcccgacgttacagtggcccctgtattcctattaggcgagagctccgttgaatatggtaagaagaagcgtcgttacctgccctacaaccaacaacacctctacttctttctgataggccctcccttgctgactcttgttaatttcgaagtggagaatttggcctatatgctggtgtgcatgcaatgggccgacctcctgtgggccgcaagcttctacgcgagattcttcttgagctaccttcccttctacggtgttcccggagtgctacttttcttcgttgccgtgcgcgtcttggagtctcattggtttgtttggataacccagatgaatcacattccaaaggagattggccatgagaagcaccgcgattgggtctcctcccaactcgcagccacctgtaatgtagaaccgagcctgttcacgaactggttttcaggtcatctgaatttccaaatcgagcaccacctatttcctcggatgccaaggcacaattattccagggtggccccactggtcaaaagcctttgcgccaaacacgggttaagctatgaggtgaagccttttctcaccgcgctggtagacatcgtgagatcactaaaaaagtctggggatatctggctggatgcataccttcatcaatag

SEQ ID NO: 222933 - DNA, 1158 bp, Artificial Sequence
  Description of Artificial Sequence: Synthetic coding sequence
atgggaggggtgggtgaacctggccctcgggaaggcccagctcagccaggggctcctcttcctacgttctgttgggagcagatccgagcccacgaccagcccggtgataagtggctggttattgaaagaagggtttatgacatttcaaggtgggcccaaagacaccctgggggatcccggttaatcggccatcatggagcggaagatgcgactgacgcattccgagcttttcaccaagatctcaacttcgtcagaaaatttctacaaccactgctgatcggcgagctcgcacccgaggagccctctcaggatggccctctgaacgcccaacttgtggaagactttagagcattgcatcaggcggctgaggacatgaagttattcgacgcatctcccactttcttcgccttcctgttgggtcacatcctggcgatggaagtgcttgcctggttgctgatctaccttcttggcccaggttgggttccaagtgctttggcagcctttatcctggccatctcccaagcccagagctggtgcctccagcatgacctcgggcacgctagcatcttcaagaagtcctggtggaaccacgttgcacagaagttcgttatgggccagctaaagggatttagcgcgcactggtggaactttaggcatttccaacaccacgcaaagcccaacatatttcataaggaccccgacgtaactgtcgcccctgtctttctgctgggcgaatcatcagtggagtacggaaaaaagaaaaggcgatatcttccatacaatcagcagcacctctatttctttctcattggccctccattgctcactctagttaatttcgaggttgaaaatctagcctatatgctggtgtgtatgcagtgggccgacctcctctgggcagcgagtttttacgccagattctttctgagttacctaccattctacggcgttccaggtgtgctgctattcttcgttgccgttagatacggcagagaatggcgcggacacacacaggctacaggggatcctcattgctctccccctcctgagttacctttctcccggctgcaaaatggcgcttccgggacggcgtcattggcctgttggtggaaccacatcaatacaagcgtggcgggagcacagggacggtgggtctag

SEQ ID NO: 222934 - DNA, 1017 bp, Artificial Sequence
  Description of Artificial Sequence: Synthetic coding sequence
atgttccaggcattcccaggcgattacgattcggggtcgcgctgtagttcatctccctccgccgaatcccagtatctaagttccgtggactcattcggaagtcctccaaccgcagccgcaagccaggagtgcgccggtttaggtgaaatgcccggatcttttgtgcctacggtgacggcaatcacaacgagtcaagatctccagtggctagtgcagcccaccctgatatcatcgatggcccagagtcaggggcagccgctcgcctcccaacctccagtcgtcgatccctatgacatgcccggaacttcctattctacgcctgggatgtccggatactctagtggaggcgcatctggatctggtggtccttctacatcaggcaccactagtggaccaggccctgccagaccagccagggccagacctagacggccacgagaggaaaccctgaccccagaggaagaggaaaaaagaagggttcgacgtgaacggaacaaactcgcggctgccaaatgccggaatcgcaggagggagctaaccgacaggctgcaggctgaaacagaccagttggaagaggaaaaggcagagttggaaagtgagattgccgagctgcaaaaggagaaagaacgcctcgaattcgtactcgtcgcccacaagcctggttgtaagattccatatgaagaaggcccagggcctggaccactggcggaggtcagggacctgcctggttcagcaccagctaaggaagatggcttttcatggcttctgcctcctcccccacctccacccttgccgtttcagacctctcaggacgcacccccaaacttgactgccagcctgtttacccattcagaagtgcaggttttaggagatcctttcccggtggtgaatccctcatacacctccagcttcgtgttgacctgcccggaggtctctgccttcgccggagctcaacgaaccagtggttcagatcagccctcagaccccctgaactcaccgagtctcttagcgctctag

SEQ ID NO: 222935 - DNA, 909 bp, Artificial Sequence
  Description of Artificial Sequence: Synthetic coding sequence
atgtttcaggccttccccggtgattacgattccggctctcgctgcagttcgagcccgtccgctgagtcacagtatttgtcctccgttgacagcttcgggagtccgcctactgcagctgcctctcaggagtgtgccggtctcggtgagatgcctggctcgtttgtccccaccgttaccgcaataaccacctcccaggatctccagtggctcgtgcagcccactctgatcagttccatggcccagtctcagggacagccattggcttctcaaccccctgtggtggatccttatgacatgcccggtacctcctatagtactccaggaatgagcgggtatagctctgggggagcctcaggtagcggcggtcctagtacatcaggaacaacatccggccctggcccagctcgcccagcgagggcgcgtccacggaggcccagagaagagacggagacagatcagctggaggaagagaaagctgaactggaatccgaaatcgccgagctgcaaaaggaaaaggagcgcttggaattcgtgctggtggctcataaacccggttgtaaaattccttatgaggagggccctgggcctgggcctctggccgaggttagggatttacctgggtcggccccagcgaaggaggatgggttctcatggttgcttcctccccctccccctccaccgcttccattccagacatctcaggacgcccctccaaacctgactgccagtctgttcacccactcagaggtgcaggttcttggcgatcctttcccagttgttaacccaagctacacatcttcgttcgtactgacttgccccgaggtatccgccttcgctggggctcagagaacatctggctccgatcagccatccgaccccctgaactccccctctcttcttgcactgtag

SEQ ID NO: 222936 - DNA, 588 bp, Artificial Sequence
  Description of Artificial Sequence: Synthetic coding sequence
atgttccaggcattccctggtgattatgattcagggagccggtgctcgtccagccccagcgcagagagccaatatctctcatctgtggattcgtttggttctccacccaccgcagccgcttctcaggagacagaccagctggaagaagaaaaagcagaactggaaagtgaaattgctgagctgcagaaggaaaaagagcgcctggaattcgtgctagtagcccacaaacctggttgcaagatcccctatgaggaaggtccaggcccaggacctctggctgaagttcgcgatctccctggaagtgctcctgccaaggaggatggattttcatggctgcttcctccccctcctccaccccctctgccgtttcagacaagccaggatgcacctcccaatctcactgctagcttgttcacccactcagaggtgcaggtcctgggagatcccttccccgttgtgaatccgtcctatacatcgtctttcgtcctgacctgtccagaagtgtcagctttcgcaggggctcaacgaacctcagggagcgaccagccatccgaccccctgaatagtccaagccttctagctctgtag

SEQ ID NO: 222937 - DNA, 876 bp, Artificial Sequence
  Description of Artificial Sequence: Synthetic coding sequence
atgtttcaggctttcccgggagattatgatagtggcagcaggtgcagcagcagtccctctgccgaatcccagtacctgtctagtgtagattctttcggctccccgcctaccgccgcagcaagtcaggaatgtgccggacttggggaaatgccgggttctttcgtgccaaccgtgactgccataaccacaagccaggacttgcagtggctcgtccagccgacgctgatctcgtccatggctcagtctcagggtcagccactcgccagccaaccgccagtggtggacccttacgatatgcccggaacctcatattccactcctggcatgtcaggctattcctctggcggagcctccgggagtggcggaccttctacatcaggaacgacctctggcccaggacctgcacggcctgctcgcgcacgtccacggaggccaagagaggaaacgttaacacctgaggaagaagagaagaggagggtacgtagggagagaaataagttggcagcggcaaagtgcagaaatagacgcagagagttaacagacagactacaggcagagacagatcagctcgaggaggaaaaggcagagcttgaaagtgagatagccgagttacagaaagagaaggagcgcctcgagtttgtgttggtggctcataaacccggatgtaagattccctacgaggaggggcctgggcctggtccactggccgaggaggtgcaggtcctgggcgatcctttcccagtcgtgaacccttcttacacatcctcttttgtgctgacctgccccgaggtttccgcttttgctggtgctcagagaacgagtggttcagaccaaccaagcgatcccctgaatagcccttccctgctggccctgtag

SEQ ID NO: 222938 - DNA, 912 bp, Artificial Sequence
  Description of Artificial Sequence: Synthetic coding sequence
atgtcagataatggtgtgtgtgtgctggcatttaaatgtcctggcctgttaagatatacagcctatcgctgcaagcagctttccgacacatccatcatagcggtagcaagccattgccctctgctccagaaggtacacgtggggaatcaggacaagctgaccgacgagggcctcaaacagctcgggagcaagtgccgcgagttaaaggatatacactttgggcagtgctataagattagtgacgagggcatgattgtgatcgctaagggctgcctcaagctccagcggatatatatgcaggagaacaagctcgtaactgatcagtccgtgaaagcttttgcagagcattgccctgagctgcagtacgtgggctttatgggatgttctgtcacgagcaagggagtaattcatttaacaaaactgcgcaatctgtccagtctggatctgcgccacattactgaactggacaacgaaactgtgatggagatcgttaagcgatgcaagaatctatccagccttaacctgtgtttaaattggatcataaatgataggtgtgtggaggtcatcgccaaggaggggcagaacctgaaagaactgtacctcgtgtcctgcaagattactgattacgcgctgattgcaattggcaggtacagcatgaccattgaaaccgtggatgttggatggtgcaaggagatcacagaccagggcgctacacttatagcccagtcatcaaaaagccttcgatatctggggttgatgagatgcgataaggtgaatgaggttaccgttgaacagctcgtgcagcagtatccacacattactttctcaacagttttgcaggattgcaaaaggacacttgaaagagcataccagatgggctggacccccaacatgagtgcggcttcaagctag

SEQ ID NO: 222939 - DNA, 945 bp, Artificial Sequence
  Description of Artificial Sequence: Synthetic coding sequence
atgagcgataacggcgtgtgcgtcctggccttcaagtgccctggtcttctccgctacacagcgtaccgatgtaagcagctgagcgacacatcaatcatagctgtcgccagccactgccctctgctgcagaaagtccatgtcgggaaccaggacaagctgaccgatgaaggcctgaaacaactgggatccaaatgtcgggaactcaaagatatccacttcggacagtgttacaaaatctccgacgagggaatgattgtgatcgccaagggttgcctgaagctgcagaggatttatatgcaggagaataaactggtgactgatcagtcagtgaaagcattcgctgagcattgccccgaattacagtacgttggatttatgggctgttccgtgacaagcaagggtgtaatccacctgaccaaactaaggaatctctcttcgctagatttgaggcacataaccgaactggataacgagacagttatggagattgtgaaaagatgtaaaaatctctcaagtctgaacctttgcctcaactggatcatcaatgatcgctgcgtcgaggtcatagcaaaggagggccagaatctcaaagagttatacctcgtcagctgcaagattacggactatgctctgatagcgattgggagatatagtatgaccatagaaaccgtggatgtcggatggtgtaaagaaataaccgaccagggtgccaccctgatcgctcagagctcaaagtctctgagatatctgggccttatgcgctgtgacaaggtgagggtagattatcaggtggtgtgcttcctgcacatttccatcgtgaatagccttatgtcctaccccctctcatttagcattagcactcccgtgtattacatcctttacatccatttcatctgtatttacgccataattgccatgcactgtctgccagccttcgtcaattag

SEQ ID NO: 222940 - DNA, 2106 bp, Artificial Sequence
  Description of Artificial Sequence: Synthetic coding sequence
atggggcacctactgagcaaggaaccgaggaataggccttcccagaagagacctcggtgctgctcttggtgtcggcgtagaaggcccctcctcaggctacctaggcgcacccccgctaaggtgccaccccagccagcagctccgagatcacgagattgtttttttagaggaccatgcatgctatgtttcattgtacacagtccgggagctcctgcacccgcaggcccagaagaagagcctccactttccccaccgccaagagacggcgcatatgccgctgcttcctcttcacaacatctggccagacgatatgctgcgctggccgcagaggattgcgcggcagctgccagacgctttctgctttcctctgccgctgccgctgcggctgcagccgcatccgctagctctccagcgagctgttgtaaggagctgggcttggccgcagcggcagcttgggaacagcagggccgaagtctctttctggcaagcttggggccagtcaggtttttgggaccacccgcagcggtccagttgttcaggggaccgaccccatctccggctgagctgcctacccctccggagatggtgtgcaaaaggaaaggggctggagtgcccgcatgtactccatgcaagcagccaaggtgtgggggtggcggatgtgggggagggggtggcggaggagggggaggcggaccggctggcggtggggcatccccacctaggcctcctgatgcaggttgctgccaggcccctgaacagccgccacagccgctgtgcccgccacctagcagtccgacttcggagggggcaccaactgaggccggaggcgacgcagttagagccggaggcaccgccccattgagcgcgcagcaacagcacgagtgtggcgatgcagattgcagggagtctcctgaaaatccttgcgactgccatcgcgagcccccaccggagactcctgatattaaccagcttcctcccagtatccttctcaagatattctcaaatcttagcttggacgagagatgtctgtcagcctcattggtatgtaagtattggcgcgatctgtgtctcgattttcagttctggaagcaactggatttaagctcaaggcagcaagtgacagacgagcttttggagaaaatagcgagtagaagtcagaatattattgagattaatatttctgactgtcggagtatgagcgataacggagtttgtgtgctggcttttaagtgtccagggttgctgagatatactgcctacaggtgcaagcaactaagcgatacttctataattgctgtggcttcacactgtccactcctgcagaaggtgcatgtagggaatcaggataaactcacagatgaaggtcttaaacagctcgggtcaaagtgcagggaactgaaagatatccatttcggacagtgctacaaaatttccgacgaaggcatgattgtgattgcgaaaggctgcctgaaactgcagaggatttacatgcaggaaaataagctggtgaccgatcagagcgttaaagcctttgcggaacactgtccagaactacagtatgtgggattcatgggatgttcagtgacctctaaaggagttatccatctgaccaagttgagaaatttgtccagcctcgacttacggcacattacagaactcgataacgagaccgtaatggagatagtgaagagatgcaagaacctgtcctcccttaatctgtgtctgaattggattatcaacgaccgttgcgttgaagttatagctaaggagggccagaacctgaaagagctctatctggtgtcttgtaagataaccgattacgctctgattgctatcggcaggtactcgatgacgatcgagacggtggacgtgggttggtgtaaggaaatcaccgatcaaggagcgacattgatcgcacagtcgtccaagagcctcagatacttgggactgatgcgttgtgacaaggtaaatgaggtgacagttgagcagctcgtccaacagtaccctcatatcaccttctcgaccgttctccaggactgcaaacgcactctcgaacgagcataccagatgggctggacacctaacatgagtgccgctagtagttag

SEQ ID NO: 222941 - DNA, 2025 bp, Artificial Sequence
  Description of Artificial Sequence: Synthetic coding sequence
atgtcaagttccagtcggggaccaggcgctggcgctagacggagacgcacgcggtgtcgacgttgccgggcatgtgttcggacagagtgtggagactgccatttctgtcgagatatgaagaaattcggcggaccaggtcgtatgaaacagagctgcctgctgagacaatgcacagcacccgtgttgccccatacggctgtctgtcttctgtgtggggaggctggcaaggaggacaccgtcgagggcgaagaggagaagtttggactaagcctgatggagtgcactatctgcaatgaaattgtgcacccaggttgcctgaaaatgggcaaggccgagggcgtgataaatgcggagattccaaattgctgggagtgtcccagatgtactcaagagggcaggacctcaaaggactctggggagggacctggccgaaggcgagcagacaacggcgaagaaggtgcatcgctcgggagtggttggaaacttacagaagaaccgcctcttccacccccacccccacgtcgaaagggacccctgcccgcaggccctccacctgaagatgttcccggacctcccaaacgcaaagagcgggaagcagggaatgaaccacctactcctcggaagaaagtaaaaggtggccgtgagcggcaccttaaaaaggttggaggtgatgcctgtctacttagagggtcggaccccggaggccctggcttgctgccacccagagtcctaaatccttcacaggccttcagttcctgtcatcctgggctacctcctgaaaactgggaaaagccaaagcctcccctggctagtgccgagggacccgcagtgccaagccccagtcctcagcgtgaaaaactggagagatttaaaaggatgtgccagctgcttgaacgcgtacccgatactagctcttcctcctctgactctgattccgacagtgactcgtctgggacttcgctctccgaggacgaagcccctggtgaggcgaggaacggtagacgcccagcgagaggcagtagcggcgaaaaggagaacaggggcggtagacgggctgtgaggcctggatctggagggcctctcctgtcctggcccctcggccctgcgccacctcccaggccaccccaactcgaacgacatgtggtaaggccaccgccaagatctcctgagcccgacacgcttccactcgcagctggcagtgaccacccactgccacgagccgcttggctccgcgtctttcagcacctgggacccagagaactgtgcatttgcatgcgggtgtgcaggacgtggtcacggtggtgctatgacaagagactctggcccagaatggatctgtcacgcaggaagagcttaaccccaccaatgctgagcggtgtggtcagacggcagcccagagcacttgacttgtcatggacaggcgtgagcaaaaaacaactgatgtggttactaaacagacttcaaggcctgcaagaactggtactctctggttgtagctggctgagcgttagcgccctggggtccgccccattacctgccctacgcttactggacctcagatggattgaggatgtgaaggatagccagttgcgagaactgctactgcctccgcctgacaccaagcccggtcagacagaaagccggggacggctacagggcgtggcagagctgagactcgcagggttggaattaacggatgcatcactccggttgctcttaagacacgcccctcagttgtccgcgctggacctctctcactgtgcccacgtgggggaccctagcgtgcatctgctgacagcacctacaagcccacttcgggaaactctggtgcacctcaatctcgccggatgccacaggctgaccgatcattgtctgcctttattcagacggtgtccacggctccgccgtctcgatttgagaagctgcagacagctttctccagaagcctgcgccagacttgcagcagcagggccacctgggccttttcgctgtccagaagagaagctcctgctcaaagactcctag

SEQ ID NO: 222942 - DNA, 2085 bp, Artificial Sequence
  Description of Artificial Sequence: Synthetic coding sequence
atgggtatgaaggtgcctggcaagggagaatctgggccatcagcactgctgacgcccccaatgtctagttcctccagaggccctggcgctggcgcacgtagacggaggacaagatgtagacggtgccgcgcttgtgtgagaaccgagtgcggagattgtcatttttgtagagatatgaagaaattcggaggccctgggcgtatgaagcagtcatgcctgctgcgacagtgtactgctcctgtactaccgcacactgcagtttgtttgctctgcggggaggccggtaaagaggataccgtcgagggcgaggaagaaaagtttggactgtcgttgatggagtgtacaatctgcaacgagattgtgcaccccggttgtctgaagatgggcaaagccgagggtgtcatcaatgctgaaataccgaactgctgggaatgcccaagatgtacacaggagggcaggacgtccaaggattctggggaaggtccaggacgacgtagggccgataacggggaggagggggcaagcctagggagcggttggaagttgaccgaagaacctccattacctccacccccaccacgccgaaaaggtcccctgcctgccggtcccccaccagaggatgtgcccggtcctcctaaaaggaaagagagggaggccggaaacgagccaccgactcctagaaaaaaagtcaagggcggtagggaaaggcatcttaaaaaagtaggaggcgacgcgtgcctcctacgcggttccgaccccggaggtccaggactgctcccacccagggtactgaatccctcccaggcattcagctcttgccaccctggtctcccccctgagaactgggagaagcctaagcctccgctcgcctccgccgaggggccagcagttccctctccaagtccacaacgggagaagctggagagatttaaacgaatgtgtcaacttctcgagcgcgtgccggatacttcaagttccagtagcgacagcgatagtgattctgattcgagcggcacctccctcagcgaggatgaagctcccggtgaggccaggaatggtagacggcctgcacgagggagcagcggggaaaaggagaaccggggtggtaggagagctgtgcggccaggcagtggaggccctctcctaagctggcctttaggtccggcaccacccccacgccctcctcaactcgaacggcatgtcgttcggccaccaccacgcagtcctgaaccagatacactgcctttggctgccggtagcgaccatccactccctcgcgcagcgtggctgcgcgtcttccagcacctcggacctcgcgagctgtgtatctgtatgcgcgtctgtagaacctggtccagatggtgttatgataagaggctttggccgaggatggacctaagccgtaggaaatccctgacaccaccaatgcttagcggggtggttcggaggcagcctagagctctggacttgtcctggaccggtgtctcaaagaaacagcttatgtggctcttaaatcgccttcaaggacttcaggaactagtgttgtctggatgtagttggctgtccgtctctgccctcggctctgcacctttgcccgctctgcggttgcttgacctccgctggatagaggacgtaaaggactcccaactgcgagaactattgttgcctccgcctgataccaaacctggacagacagagtctcgtgggaggctgcaaggagtggccgagttaaggctggcgggacttgaactcacggacgcgagcctaaggcttctgctgcgacacgcccctcagctgtcggccctcgatctttcccactgtgcgcatgtaggcgatcccagcgtgcacctgttgacggcaccaacgagtccactgcgagaaactttggtccatttaaatctcgcaggatgtcaccgattaactgaccactgtctgcccttatttcgtaggtgcccacggctccgccgactggacctgcgctcatgccgccagctctccccagaggcctgcgccaggctcgctgctgccggtcctccaggaccctttaggtgtcctgaagagaagttgctgctcaaggattcttag

SEQ ID NO: 222943 - DNA, 1761 bp, Artificial Sequence
  Description of Artificial Sequence: Synthetic coding sequence
taacggatgaagcaatcttgcctgctccggcaatgcaccgcaccagtgctgccccataccgcagtgtgtcttttgtgcggcgaagccggaaaggaggataccgttgagggcgaggaggaaaagtttggattaagcctgatggaatgtacaatctgtaacgagatcgtgcatccaggctgtttgaagatgggcaaggccgagggcgttataaatgccgaaattcctaattgttgggagtgtcctcgctgtacccaggagggaagaacgagcaaggactccggtgaagggccaggcaggcggcgagccgacaacggggaagaaggggcatccctggggagcggctggaagttgacggaagagcccccacttccacccccaccgcctagacgcaaggggcctctgccagccggaccaccacctgaggatgttcccggaccccctaaaaggaaagagagggaagccggaaatgagccccctactccacggaagaaggtgaagggtggcagggaacgccatctcaaaaagaaaccaaagcctcccctagcaagcgccgagggccctgctgtcccgagcccgtccccccagcgagaaaagctcgaaagatttaaacgcatgtgtcagctcctggaacgcgtgcctgatacaagtagctcgtcctctgattctgattctgactcagatagttctggcacctccctgagcgaggatgaggcacccggagaggcgaggaacgggcgaagaccagccagagggtcctctggcgagaaagagaatagaggtggaaggcgagccgttaggcccggaagtggaggtcctctgttatcttggccccttgggcctgctcctccacctagaccccctcagcttgagcggcacgtggtccgcccaccccctcgctcccccgagccggatactcttccactggcagctgggtctgatcacccattgccccgtgctgcctggttgagggtgttccaacacctcggaccaagagaactgtgtatatgtatgcgtgtgtgcaggacgtggtcacgctggtgttatgataagcgactgtggcccagaatggacctgtcaagacgcaaatctcttacccctcctatgctttcaggtgtggtacgtcgacagccacgcgctctggacctgtcctggaccggcgtctccaaaaagcagctcatgtggctgctgaaccgcctccagggactgcaggaattagttttgtctggctgcagctggctgagcgtttcagccctcggtagtgcgccactgccagccctgaggctgctggacctgaggtggattgaagacgtcaaggatagccagttgagagaactgctcctgccccctccagataccaaaccgggacagactgagtccagaggccgattacagggcgtcgctgagcttcggctcgcagggctggaattgactgatgcgagcctgcgcctgttgctgaggcatgccccacaactgtcggcgctcgacctgtcgcattgcgcacatgtgggcgacccgtcagtacatctgctgaccgcccctacttctcccttaagggaaaccttggtccaccttaacctggctggatgccaccggctgaccgaccattgtctgccactttttcggagatgtccacggcttagaagactggatctgcgatcctgccgccagctgagcccagaggcctgtgccagactcgcggcagcagggcctccaggcccattccggtgtccggaggaaaaactgctattgaaggactcctag

SEQ ID NO: 222944 - DNA, 495 bp, Artificial Sequence
  Description of Artificial Sequence: Synthetic coding sequence
atggacctggaggaatgcattttgatcactgactcaacccttatccagttgagtattcattgtcccaagctacaggccctggtgagcctgtctttttcagatattattcatcttctgaaaatgaaagaaccaagccaccataataaaaagctcttcgggttttctttttgtaagtcactcagccactgtgagctcatcactgatgacgggattctacatctcagcaattcaacctgtggtcacgagcggctgcgagttcttgagctggacaattgtctactgattaccgatgtagccttagaacacctggagaactgtagaggcctggagcgcctggagttatatgattgtcaacaggtgacccgggctggtataaagagaatgcgggcacagctgccacatgtgaaggttcatgcttatttcgctccagtcacccccccaaccgccgtggcagggagcggccagagactgtgtcgatgttgtgtgattctatag

SEQ ID NO: 222945 - DNA, 1272 bp, Artificial Sequence
  Description of Artificial Sequence: Synthetic coding sequence
atggtattttccaataatgacgaaggcctgattaacaaaaagctgccaaaagaactgctgctgaggatatttagttttcttgatatcgtgacactgtgcaggtgcgcccagatcagcaaagcctggaatattctggccctggacgggtcgaactggcaaagaattgacctgttcaatttccaaacagatgtagagggccgagtcgtggagaacatctccaagcggtgcgggggattcctccgtaaactgtccttaagaggatgtataggcgtaggcgattcctctttgaagacattcgctcagaactgccggaatatcgaacatctgaaccttaacggatgcacgaagatcactgatagtacctgttattctctcagtcgcttctgttctaaactaaagcacctggacctgaccagctgcgtgtcaatcactaactcatctctcaaaggaatatcagaaggatgtaggaacttggaatacctcaacctgagctggtgcgatcagatcacgaaggacggaatagaagctcttgttcgcggatgccgtgggctgaaggctttgttgcttcgaggatgtacccagctcgaggacgaggcactcaagcatatccaaaactactgccacgagcttgtttccttgaacttgcaaagctgctcacggattaccgacgagggagtcgttcagatttgcaggggatgtcaccggcttcaggcactgtgtctgtcaggatgttcaaacctgacagacgcctctttaacagctcttggactgaattgtcctcggctgcagattttggaggcagcacgctgttctcatctgaccgatgcaggattcactctgttagcaagaaattgtcatgagttagagaaaatggacttagaggagtgcatcctgatcactgatagcaccctgatccaactgagcatccactgccctaagctgcaggcgctgagcctgtctcactgcgaactgattacagatgacgggatcctacacttatccaattctacatgtgggcatgagcgccttcgcgtgctcgaactggacaactgtctcctgatcacagatgtggccctggagcacctcgaaaactgcaggggtttggagagactcgaactgtacgactgtcagcaggtcacccgcgctggcatcaaaagaatgcgcgcacagctcccccatgtgaaggtgcacgcctatttcgccccagttacgccccctacagcggttgctggcagcggtcaacggctgtgccggtgttgtgtcattctgtag

SEQ ID NO: 222946 - DNA, 1020 bp, Artificial Sequence
  Description of Artificial Sequence: Synthetic coding sequence
atgtatatagctctcgtgtggatcctctttgttatgtggactttcgctcagaactgtcgaaatattgagcacttgaacctgaacggatgcactaaaatcaccgacagtacgtgttactcgctgagccggttctgcagcaaacttaagcatctggacctgacatcttgtgtgagcatcaccaatagctctctgaagggcatatcagaggggtgccgtaacttggagtatctgaacctgagctggtgtgaccagattaccaaagacgggatagaagccctggttcgagggtgccgtggactgaaggccctgctgcttcggggatgtactcagctcgaggatgaagccctcaaacatatccagaattattgccatgagctggtcagcttgaacctgcagtcatgcagcagaatcaccgatgagggggttgtgcaaatttgtcggggatgccaccggctccaggccctgtgcctctcaggttgcagcaacttgaccgacgcttccctgaccgccttgggattgaactgccctaggctgcagatactcgaggccgcacgatgcagccacttgaccgatgcaggcttcactttactcgcaaggaactgccatgagctggaaaaaatggacctcgaggagtgcattctcattacagactcaacccttatccagttgtctatacactgccccaagttgcaggccctgtctttgtctcattgcgaactgattacggatgatggcattctccacttaagcaatagtacgtgtgggcacgaaaggttacgtgttctggagcttgacaactgtcttcttatcaccgacgtagctttggaacacttagagaattgcagaggcctagagcggttagagctatatgactgccagcaggtgacccgtgccggaattaagaggatgcgagcccaactgcctcacgtgaaggtccacgcttatttcgcccctgtgacccccccaaccgctgtcgccggttcaggccaacgactatgtcgctgctgcgtcatcttatag

SEQ ID NO: 222947 - DNA, 1068 bp, Artificial Sequence
  Description of Artificial Sequence: Synthetic coding sequence
atggtcttctcaaataatgacgagggtctgataaataagaagctcccaaaggagctgctcttgcggattttcagctttctggacatcgtcacactctgtagatgcgcccagatcagcaaagcctggaatattttggctctcgacggctcaaactggcagcggatcgatctgtttaactttcagaccgacgtggagggcagagtggtcgagaacattagtaaaagatgcggcggttttttaaggaagctgtcccttagggggtgcattggggtcggcgattcgagcctgaagacctttgctcagaactgtcgtaatattgagcacttgaatctgaacggatgcactaagatcacagattcaacatgctatagcctgtctagattttgttctaagctcaaacatattcaaaactactgccatgagctagttagcttgaacctgcagagctgtagcaggataacggacgagggggtggtccagatatgcagaggatgtcatcgcctgcaggccttgtgcctgagcggctgttccaacctgacagacgctagcctgacagccctcggtctaaattgtccaaggctgcaaattctggaagccgcacggtgctctcatttaaccgatgcagggttcacccttttggccaggaattgccatgagctcgaaaaaatggaccttgaagagtgcattcttataactgactctacattgatccagctgagtattcattgtcctaagctacaggcacttagtttgagtcattgcgagttgattacggacgacggcatcttgcatcttagtaattcaacctgcgggcatgaacgactccgggtgctcgagttagataactgtctcttgatcactgacgtggccttagaacatctggagaattgtcggggactggagcgattagagctctatgactgccagcaggttacccgggctggtatcaagcggatgagagcacagctgccccatgtgaaggtccacgcctatttcgcccctgtgactcccccaactgctgtcgcgggtagcggtcagagactgtgcaggtgttgcgtcatcctgtag

SEQ ID NO: 222948 - DNA, 402 bp, Artificial Sequence
  Description of Artificial Sequence: Synthetic coding sequence
atggacctggaggagtgtatcctaattaccgattccaccttgatccagctctctatccactgtcctaagctgcaggcgctgtcactgagccactgcgagctgattacagacgacggaatcctgcacctctctaatagcacgtgtgggcacgagagactccgggtgctcgagcttgataactgtttacttataaccgacgttgctctggagcatttagaaaattgccggggattggagaggctcgagttgtacgattgccagcaggtcacccgcgctgggattaaacgtatgcgggctcagctcccacacgtgaaagtgcacgcctactttgccccagtcaccccccctactgccgtggccggatcaggacaacgtttatgtcgctgctgtgtcatcctttag

SEQ ID NO: 222949 - DNA, 1068 bp, Artificial Sequence
  Description of Artificial Sequence: Synthetic coding sequence
atggtgttctctaacaatgatgaaggactgattaacaaaaaactgcccaaagagctcttgttacggattttcagctttcttgacatcgtaaccttatgtaggtgcgctcaaattagcaaagcttggaacatactggctcttgacggaagcaattggcaaaggatcgatctttttaattttcagaccgatgtcgagggcagggttgtcgagaatatttctaagagatgtggcggatttttaagaaagctatccctgcgcggatgcataggtgtcggagattcttccctgaagacctttgcacagaactgccgaaatatagaacacttaaatctgaatgggtgcaccaaaatcactgacagcacctgttactctctgagccgcttctgcagcaagctaaaacacatccagaactactgccatgagctggtgtccttgaacctgcagagctgctcaaggattacagacgaaggagtcgtccagatctgcaggggatgccataggctgcaggcgttatgcctgtcaggttgtagtaacttgaccgacgcaagcttaacagcactcggcctgaattgcccgagacttcagatcctcgaggctgcccgttgtagtcacttgacggacgccggtttcaccctgctggcccgaaattgtcacgaactggagaaaatggaccttgaagaatgcatactgattacggactctacattgatacagctgagcatccattgccccaaacttcaggctctcagcctgagtcattgcgagctgatcaccgacgatggcatcctccatctgagcaactcaacctgcggacacgaacgcctacgtgtactcgaactcgacaattgcctgctgatcaccgatgttgccctggagcatctggagaattgtagaggtctggaacggctggagctctatgattgccagcaggtgacccgggcaggcatcaaacggatgcgggctcagttacctcacgtgaaggtgcatgcttatttcgcacctgtcacacctcccaccgcagtggctgggtctggtcaacggctctgtcggtgttgcgttatattatag

SEQ ID NO: 222950 - DNA, 1260 bp, Artificial Sequence
  Description of Artificial Sequence: Synthetic coding sequence
atggttttctcggccgtgttgactgctttccacaccgggaccagcaataccacgtttgtggtatacgagaacacgtacatgaatatcaccttgcctcctccgtttcaacatcccgacctgtcgccactgcttcgctactccttcgagaccatggccccaaccggcctgtcttcccttacagtgaatagcacagcagtgccaacgacccccgctgcattcaagagcctgaacctaccactgcagattacgttatccgctattatgattttcattctctttgtttcttttctggggaacttggtggtgtgtttaatggtgtatcagaaggccgctatgaggtccgcaatcaacattttgttggcaagcctagccttcgcagacatgctattggctgtactgaacatgccattcgccctggtgaccattttgaccacacgctggatatttggaaagttcttttgtagggtgtctgccatgtttttctggcttttcgtgatcgaaggtgtggccattctgctgattatctctattgatagatttttgattatcgtacagcggcaggacaagctcaacccataccgagcgaaagtgcttatcgctgtgagttgggccacgagtttctgtgttgccttccctcttgctgtcggaaaccccgacctgcagattccttctcgggcaccgcagtgcgtgttcggctataccacaaatcctggctaccaagcctatgtaattctgattagcctgatatcgttcttcatcccgtttctcgtcattctctactcttttatgggtatactgaatacactcagacataacgcgctgaggattcactcttacccagagggtatttgcctcagtcaggcctctaagttaggcctcatgtctcttcagaggccttttcaaatgtccattgacatgggattcaaaacaagggcatttaccaccattctgattctgtttgccgttttcatcgtttgctgggcgccatttaccacctacagcctagttgctacattcagtaaacacttctactaccagcacaatttcttcgagatttctacttggctgctctggttgtgctatctcaagtcagcccttaatcccctgatttattactggagaatcaaaaagttccatgatgcttgcctggatatgatgccgaagtctttcaaattccttccacaacttcctgggcatacaaaaaggcgaatacggccatctgctgtttacgtgtgcggtgagcatcgtactgtcgtttag

SEQ ID NO: 222951 - DNA, 1866 bp, Artificial Sequence
  Description of Artificial Sequence: Synthetic coding sequence
atgagcccagtgtttcctatgctgaccgtgttgacaatgttttactacatttgcctgcgccgaagggccaggactgcgacacgcggtgagatgatgaatacccacagggccatcgaatcaaatagtcagacatcacctctcaatgccgaagtggtgcaatacgcgaaggaggtggtcgacttctctagccactacgggtctgagaactctatgagttacacgatgtggaacttagcgggtgtcccaaatgtgtttccaagcagtggcgacttcacccagaccgctgtgttccggacttatggaacctggtgggaccagtgccctagcgcttcattgccctttaaacgaaccccgcctaatttccagtcacaggactacgtggaactgacattcgaacaacaggtttaccctacagccgtgcatgtgctagagacataccacccaggtgccgtcattcgaattctggcgtgcagcgcgaatccttattcccccaatccgcctgccgaggtccgatgggagatactctggtccgaaagacccactaaggtgaatgccagccaggcaaggcagttcaaaccctgcattaagcagattaattttcctacaaacctcatccgactggaggtgaactcttctctgctggagtactataccgagctggacgcagtggttctgcatggagtcaaagataagcctgtgttatcactgaagacttccctcattgacatgaatgatatagaggacgacgcctacgcggaaaaggatggatgcggaatggatagcctgaacaagaagttctctagtgccgtcctgggcgagggcccaaataacggctattttgacaaactgccttacgagctgatacagctgattctgaatcatctgaccttgcccgacctgtgcaggcttgctcagacgtgcaagctgctgagccagcactgctgtgatccactgcagtacatccatctcaatttacagccgtactgggcgaagctggatgacacgagccttgagtttctgcaatctagatgtaccctcgtgcaatggttgaacctctcttggacaggcaaccgcggattcatctcagtagccggtttctccaggtttctgaaggtgtgcgggtccgaactagtgaggctcgagctctcatgcagccactttctcaacgagacctgcctggaggtgatcagtgagatgtgcccgaatctacaggccctgaacctgagttcttgcgacaagttaccaccccaggcttttaatcacattgcaaagctctgttctctgaaaagattagtgctctatagaacaaaggtggagcagaccgcactgttgtctatactgaacttctgctctgaacttcaacacttgagcctggggtcatgtgtcatgatagaagactatgatgtgattgccagtatgattggcgcaaagtgcaaaaagctacgcaccctggacctttggcggtgcaaaaacattacggaaaacggaatcgctgaactggcttcaggttgccccctcttggaagaactggatctgggatggtgccccacactgcagtccagcaccgggtgctttactcggcttgcgcaccagctgccaaatttgcagaagctgttcctgaccgcaaatcgttcggtttgtgacacagacatcgatgagctcgcatgcaattgtacacgcctgcagcagctggatatcctaggtaccaggatggtgagcccggcttccctgcgaaaactgctagagagctgtaaggatctaagtcttttggatgtgagcttttgcagccaaatcgataatagagcagtactcgaattgaatgcctcctttccgaaagtgtttatcaagaagtcattcactcagtag

SEQ ID NO: 222952 - DNA, 2076 bp, Artificial Sequence
  Description of Artificial Sequence: Synthetic coding sequence
atggccccttttccagaggaagtggatgtgttcacagccccacactggaggatgaagcagctggtgggtctctactgcgacaagctgagtaagacaaattttagcaacaacaacgattttcgcgctcttctacagagtctatatgcaacatttaaggagtttaagatgcacgagcaaattgaaaatgaatacattataggccttttgcagcagcggagccagacaatttataacgtgcactcggacaataagctgtccgaaatgttatcattgttcgaaaaaggactgaagaatgtaaagaacgagtatgaacaactgaattacgctaaacaacttaaagagcggttggaggcttttactcgagacttccttccacatatgaaggaagaggaagaagtgtttcagcctatgctgatggagtatttcacttacgaagaacttaaagatattaaaaagaaagtgattgcgcaacattgtagccagaaggatacagccgagctcctgcgagggctctccctgtggaatcatgccgaggagagacagaagttcttcaagtactccgtagacgagaagagtgacaaagaagccgaagtgtccgagcattcgacaggtattacccatcttccccctgaagtaatgctgtccatattcagttaccttaacccccaggaactgtgtcgatgcagccaggtctcaatgaagtggtcccagcttaccaagaccgggtcactctggaaacatttatacccagtgcactgggcacgtggagattggtactctggtccggcaacagaactggatacagagccggatgacgagtgggtgaagaatcggaaggacgaaagccgtgcctttcacgaatgggacgaagacgccgacatcgatgagagcgaggagtctgccgaagagtccattgccatcagtattgcccagatggagaagcgccttcttcacgggttaatacacaacgtcctgccttatgtgggtacatctgtgaagaccctcgtactagcatactcttcagcagtttcctccaaaatggtccgacagattctcgaattgtgccctaatctggaacacttagacctgactcagactgacatcagtgatagtgccttcgactcctggagttggttgggctgctgccaaagcctccggcacctggacctctccggttgtgaaaagattaccgatgtcgccttagaaaaaatttcgagagccctgggaatcctgacatcacaccagtctggtttcctgaaaacttcaacttcaaagatcacgagtaccgcttggaagaataaggatataactatgcaaagtaccaaacagtatgcttgtctccatgacctcactaataaaggcattggtgaggagatagacaatgaacacccttggaccaaaccagtctccagcgagaacttcacttcaccatatgtgtggatgcttgatgccgaggacttggcggacattgaagataccgtggaatggcggcatcggaacgtggagtccctctgtgttatggaaaccgcaagtaactttagctgcagcacttcaggctgtttcagcaaagatatagttggtctccgcacctctgtttgctggcagcaacattgcgcctcccccgcttttgcctactgtgggcactccttttgttgtacagggaccgcgctgaggacaatgagcagcctgccggagagctctgccatgtgtcgtaaggccgcaaggacaaggctgccacggggaaaggacctcatctactttggcagcgagaagagcgatcaggaaacgggacgggtgctcctcttcctctcactctccggctgctaccaaatcactgatcacgggttgcgagtgctcacccttggaggcggattaccctacctggaacacctgaatctttcaggatgtcttacaattacgggagcagggttgcaggatctggtgtcggcttgcccctctctcaacgatgaatatttctactactgtgacaatattaacgggcctcacgccgacacagcttccgggtgccagaacctgcaatgcggatttagagcctgttgcagatctggggagtag

SEQ ID NO: 222953 - DNA, 1698 bp, Artificial Sequence
  Description of Artificial Sequence: Synthetic coding sequence
atgaaagaggaggaagaggtatttcagcccatgctgatggaatattttacttacgaagagcttaaagatatcaagaagaaagtcatcgctcagcactgctcgcagaaggacacagcggaactgctccggggtctcagcctctggaaccatgcggaagagaggcagaagttcttcaaatattcagtggacgagaagtccgataaggaagccgaggttagcgaacattccactggaattacgcacctgccgcctgaagtaatgttgtctattttttcttacctgaacccacaagagctatgccggtgcagccaggtctcaatgaagtggtcccagcttacaaagactggaagcctctggaagcatctgtatcctgtgcactgggccaggggcgactggtactctgggcctgcaaccgaattagatacagaaccagatgacgagtgggttaagaatagaaaagacgaatcaagagcatttcatgaatgggacgaagacgccgatattgacgaaagcgaggaaagcgcagaagaatctatcgcgatctctatcgcgcagatggagaagcggctcctccatggtctgatccataacgttttgccatacgtcggtacctccgtcaaaacattagtgctggcatacagcagcgccgtttccagcaaaatggtgagacagattttggaactgtgcccaaatcttgagcacctggacctgacccagaccgatataagtgactccgctttcgatagttggtcttggcttggctgttgccagagccttcggcacctggacttgtccggctgtgaaaagatcacggatgtagcccttgaaaaaattagccgcgctttgggcatccttacatcccaccagagcggatttttaaaaacttccacaagcaaaataacaagtacagcttggaagaacaaggatattactatgcagtcaaccaaacaatacgcttgcttgcacgatctaaccaataagggcatcggcgaagaaatcgacaatgagcacccttggaccaaaccagtcagtagcgaaaatttcacctctccatacgtgtggatgctagatgcggaagacttggcagacatcgaagatacggtggagtggcgccacaggaacgtagaatccctgtgtgtgatggagacagcctctaacttctcttgtagtacgtccgggtgtttttccaaggatattgtgggtctcagaacttccgtgtgttggcaacagcactgcgcgagccctgcattcgcttattgtggccattctttctgctgcactggcaccgcactgcgcactatgagctcactgcctgagagcagtgccatgtgcaggaaagccgctcgcactcgactgccgagaggtaaagacctcatttacttcggttccgagaaatcagaccaggaaactgggagggtgctgttattcctgagcctgtcggggtgctaccagataaccgaccacggtctgcgcgttttgaccttgggaggaggcctgccatatctagaacacctgaatctgtccgggtgcctcacgatcactggcgcagggctccaggatctggtcagtgcctgcccgagcctcaatgatgaatacttttactattgtgacaacatcaacgggccacatgcagatactgcaagcggctgccaaaacctccagtgcggcttccgcgcttgctgccggagcggcgagtag

SEQ ID NO: 222954 - DNA, 2025 bp, Artificial Sequence
  Description of Artificial Sequence: Synthetic coding sequence
atggccccatttccagaagaggtcgacgtattcacggctcctcactggcggatgaaacagttggtggggctttattgcgacaagtctctgtatgcaacctttaaagagttcaagatgcacgaacagatcgagaatgagtacatcattggactgctgcagcagcgttcccagaccatctataacgtgcactctgacaataagttgagcgaaatgctgagcttattcgagaagggactgaaaaacgtgaaaaacgagtatgaacagctaaattacgctaaacaactgaaggaacgtttggaggcctttacgagggactttttgccacatatgaaagaggaagaagaagtcttccagccgatgctgatggagtactttacttatgaagagcttaaggacatcaagaaaaaggtgattgcacaacactgcagccagaaggacaccgccgagctgctgagaggtctgagcctgtggaaccatgccgaggagcgccagaagttctttaaatatagtgtggacgaaaagtccgataaagaagccgaggtgtcagagcattcaactgggataacgcacctcccacctgaggtcatgctctcaatctttagttacctgaacccccaggaattatgtaggtgcagtcaggtgtcaatgaaatggtcccagctgaccaaaacgggatccttgtggaagcacctctaccccgttcactgggctagaggggattggtactcgggtcccgctaccgaacttgatacagagcctgacgatgagtgggtgaaaaatcggaaggacgaatcgcgagcgtttcacgagtgggacgaggatgcagacattgacgagagcgaggagagtgccgaggagagtatcgctatctctatcgcacagatggaaaagcgactgctgcacggactgatccacaacgtgctcccgtacgtgggaacgtctgtcaaaacccttgtcctcgcatactccagtgccgtttctagtaagatggtcagacagatcttggaactctgtccgaaccttgagcacctggacctgacacaaacagatatctctgattctgccttcgattcctggtcatggctggggtgttgccagtcgctcagacatttggacctgtccggctgcgaaaagataacagacgtcgccctggagaagatctccagggccctggggatcctgaccagccatcagagtggattcctcaagactagtacttccaagatcacatccaccgcttggaagaataaggacattacaatgcagtccacaaaacagtatgcatgtcttcacgacctgacaaacaaggggatcggagaggaaatcgataacgagcacccctggactaaaccagtgtcatcagaaaactttacaagtccctacgtgtggatgctcgacgcagaggacctcgccgacatcgaagatactgtagaatggcggcataggaatgtcgaaagcctttgtgtgatggagacagcatctaattttagttgttcaacctccgggtgtttctcaaaagatatagttggtctgcggacgagtgtgtgctggcaacagcactgtgcctctccagcctttgcctattgcggacactccttttgttgtacgggcacagctttaaggactatgtccagtctacctgagtctagcgcaatgtgccggaaagccgctcggactcggttaccacgcggtaaagacctgatctattttggatcagaaaaaagcgatcaggaaaccggccgtgtactcctcttcttgagcttgagtggctgctaccagataacagatcatggcctccgcgtcctgacactggggggagggctcccatatcttgagcacctcaacctgtccggatgcctgacaatcacgggggcaggattgcaggacttggtgtctgcgtgtcccagcctcaacgatgaatacttttactattgtgataatattaacggaccgcacgctgataccgccagcggatgccagaatctccagtgtggcttccgggcttgttgtagatcaggcgagtag

SEQ ID NO: 222955 - DNA, 1440 bp, Artificial Sequence
  Description of Artificial Sequence: Synthetic coding sequence
gggaaggggtcctcgtctatctcttctgatgtgtcctcgtcaaccgatcatactccaacaaaagctcagaagaatgtggccacctccgaagattctgacctttccatgagaactctgagcacacctagtcctgctctcatatgcccacccaatttgccgggatttcagaatggcagaggatccagcactagctccagttcaatcacaggcgaaactgtggctatggtacatagtcccccacctactagactcacccaccccctgatccggctcgcttccagacctcaaaaggagcaagccagtatcgatcggctcccggatcactctatggtacagatttttagttttcttcctactaatcaattgtgccggtgcgcgagagtgtgccggagatggtacaatctggcctgggatcctcggttgtggagaaccatccgcctcactggagaaactattaatgtcgacagggctctgaaggtgctaaccagacggctttgccaggacacacccaatgtatgtctgatgctcgaaactgtgaccgtcagtggatgccggagactgaccgaccggggattgtataccattgcacagtgctgcccagaactgagacggttagaagtgtccgggtgctataacatttctaacgaagctgtcttcgatgtggtgtcactgtgccctaatctggagcacctggacgtctcaggttgctctaaagtcacctgtatttccctgacgcgtgaggcctccatcaaactgagccccctccacggcaaacaaatttcgatcagataccttgatatgacagattgtttcgtgctcgaagacgagggattacatacaatcgccgctcactgtacgcagctgacacacttgtatttgcggaggtgtgtccgacttaccgatgagggtttacgctacttggttatttactgtgcatccatcaaggagctgagtgtcagtgactgtagattcgtgagcgatttcgggttgagggagatcgctaaactcgagagtcggctaagatatttgtcgatagcccattgtggacgagtgacggacgtgggtatcaggtatgttgcaaagtattgttccaaactccggtatctcaacgctaggggttgtgaggggattaccgaccatggtgtagagtacctagccaagaattgcacgaaattgaaatcactggacatcggtaagtgtccgctggtcagcgatacaggtctagaatgccttgctctgaactgtttcaatctgaagagactgtctctgaaatcctgcgagagcattactggccaggggttacaaatcgtggccgctaactgtttcgatctccagacccttaatgtacaggattgtgaagtttcagtggaagccctacggtttgtgaagcgccactgcaaaagatgtgttatcgaacatacaaatcccgcatttttctag

SEQ ID NO: 222956 - DNA, 1476 bp, Artificial Sequence
  Description of Artificial Sequence: Synthetic coding sequence
atgggtgcaaataatggcaaacaatacggtagcgaagggaagggctccagctcgatcagctccgatgtgagtagcagcacagaccatactcccaccaaggctcaaaagaatgttgcaacgtccgaggactccgacttatccatgcgcacattgtccacacccagtccagctctgatctgtccgcctaatttacctggattccagaatggtaggggctcatcaacatccagttcatccatcaccggcgagacagttgcaatggtgcactctccccctcccacaagattaacccacccgctaattaggctcgcttctaggccacagaaggagcaagcaagtattgataggctccctgatcattctatggtgcagatcttctctttcctcccaaccaatcagctgtgtcgttgcgccagagtttgtagacgttggtataatctggcatgggatcctcgactctggcggaccattcgccttactggggaaactatcaacgtggatcgtgctctgaaagtgctaacaaggcgactgtgtcaggacacccctaatgtctgcttgatgctcgagactgttaccgttagtggttgtcgcaggttaaccgatagggggctatataccattgcacagtgctgtcctgagctgcgtagacttgaagtgagtggctgttataatatttccaatgaggcggtatttgacgttgtgtctctctgccccaaccttgaacatcttgacgtgagtggttgttcgaaggtgacatgtatctcactgacaagagaggcctctattaagctttcacccctacacggcaagcagatcagcatccgttacttggacatgaccgactgctttgtgctggaggacgagggcctgcataccatcgccgctcattgcacacaactgacacatctgtacctccgtcggtgtgtacgccttacggacgaaggtttgcgctacttggtgatctactgcgcctccattaaagagctctccgtaagcgattgtcgcttcgtttccgattttgggcttagagaaattgctaagctagaatcccgcctgcgatacctgagcatcgcacattgtggaagggtgaccgacgtgggaatcagatacgtagccaaatactgctcaaaactgcggtatttgaatgcacgtggatgcgaagggatcacagatcacggagtggagtatctagcaaaaaactgcacaaagctgaaatccctcgatatcggaaaatgccctctggtgtcagacaccgggctagaatgtttggcgctgaattgttttaatcttaagcggctcagtctcaaatcctgcgagtctataactggtcaaggactccagattgtcgccgcaaattgtttcgatctgcagacgcttaatgtgcaggattgtgaggtatctgtcgaggcgttaagattcgtcaaaagacactgtaagaggtgtgtgattgaacacacaaatcctgcattcttttag

SEQ ID NO: 222957 - DNA, 3000 bp, Artificial Sequence
  Description of Artificial Sequence: Synthetic coding sequence
atggaaaacctagagtccaggttgaagaatgccccatatttcagatgtgaaaaaggcactgacagcatcccactttgtcgaaagtgcgagacatgtgttctggcatggaaaatcttcagcacaaaggagtggttttgcaggatcaacgacatcagtcagagaagattcctggttggcatcttaaaacaattaaactccttgtacctactccattactttcagaatatcttgcagactacacaagggaaggatttcatctataatcggagcagaattaatctgtccaaaaaggagggcaaagtggtgaagtcatccctgaaccagatgcttgacaaaacagtcgagcaaaaaatgaaggagatactgtactggttcgctaacagcacacagtggaccaaagctaattacaccctcctcttgcttcaaatgtgtaatcccaagctgcttctcaccgccgctaacgtcatcagggtcctgtttctgcgggaggagaataacatttcaggcctgaaccaggatattacagatgtgtgcttttcccctgaaaaagaccacagtagcaagtccgccacgtctcaagtctactggaccgccaagacccaacatacgtcacttcctctgagcaaggccccagagaatgagcacttgttaggagcagcatctaaccccgaagaaccgtggcgaaactccttaaggtgcatatcggagatgaatcgactcttcagcggcaaaggagatataaccaaacccggatacgacccatgcaacctcttggtcgacttggacgacattagagatctcagctccggattttcaaagtaccgggattttatccgctatctgcccatccaccttagtaaatacatcctacgcatgctggatagacacactctgaataagtgcgcctccgtttcccagcactgggctgcaatggcacaacaggtgaagatggatcttagcgcgcacgggttcatccaaaaccaaatcacatttctccagggcagctatacaagaggaattgacccaaactacgctaataaggtgagtatccctgtgccgaagatggtcgacgacgggaaaagcatgagggttaagcaccccaagtggaagcttcgtaccaagaatgaatacaacctgtggacagcttatcagaatgaggagacacaacaggttctgattgaggagaggaatgttttctgcggtacctataatgtgcgtatactgtctgatacgtgggaccagaatagagtgattcactacagtggcggagacctcattgccgtgtccagtaatagaaaaattcatctgctagacatcattcaggttaaggcaataccggtggagttccgcggtcatgcgggatctgtacgagcgctgttcctttgcgaggaagaaaatttcctgctttctgggtcctacgacctctcgatcagatactgggatctcaagagcggagtgtgcacccggattttcggagggcaccagggtactattacatgtatggatctgtgcaaaaatcggctggtgtctggcggtcgtgactgccaggtgaaggtgtgggacgttgacacagggaagtgtctgaaaacattccgccataaagaccccatcctggctacgcggattaatgatacttacatcgtgtcgtcttgcgagagggggttagtgaaggtgtggcacattgcaatggcacagttagtgaagacgttaagtgggcatgaaggtgcggtcaaatgtctgttcttcgatcagtggcacctcctctccgggagcactgacggcttggtgatggcttggagtatggtgggcaaatatgaaaggtgcctcatggcctttaaacatccaaagatggtcgtgaacacagaatctaacgtgctaatgtttcagtttgagcacattaagtggcagtacgctgtagaaaaaactaaacagaaaaaaaacaaagagaaggaggaggagaaggaagagaatagtcttatggagatcctgagtaaatgcaatatccaggtccatagccccagagagagcgtgtctagcaagcagactgtcatccaggagctgctgcccggaaagccccctaaatctagggtcctcttgaaaccagctaagttttccagcgccgttcttatcgaagagctacaatcacaagggaaatccaagtcacctcgacgcgacgcggatgatgtagaaaaagctcagaaacaaggacaactcgaaacacctgggaaactgccttcgcacccgaaaaaaaaaagctggaagatccctatgtcccccgatcaatttctgctgacagtttccgcacttcagcatgctcacaattctggtgagtttgcctacccttgtcggcctcagacggagattaccgacgtctggggcccttctatcagttatccgagaaaagtgcttaatttcaagggcaaatctatccagcgagcggtcgatcggctgcgtctctctaacccacctattgatgtcaaacggaccagcatcccacttgagattcagaagctccagcccaaccttaaaatctcccttcatagtcccagagtgcaatctacaatcccacagcctatgattattcggtcccggttttctggttcactcaagggcggtgatcaggttacttccagcatcgagcgagcagtttgctccacgggcccacttacatcaatgcaggtgataaagcccaatcggatgctggcgccacaggtcggaacagccaccctcagcctaaagaaagaaagacccaggatctataccgccctggacccctttagagtgaatacggagttcgtccttttgacggtaaaggaggaaaaagaacaccaggaagcaaagatgaaggagtaccaggcaagagagtccacaggagtcgttgacccgggaaaagtgtctaaggcagcttggatccggaaaataaaggggttaccaatcgataatttcactaagcagggcaagacagctgcacccgaactgggccaaaatgttttcatatag

SEQ ID NO: 222958 - DNA, 3186 bp, Artificial Sequence
  Description of Artificial Sequence: Synthetic coding sequence
atggagaatctcgagtcacggctgaagaatgctccttattttcgttgcgaaaaggggacagatagtatccccctgtgtagaaagtgtgagacctgcgtgcttgcttggaagatattcagtacgaaggaatggttctgccggatcaatgacatctcacagagaagatttctggtggggatactcaagcagctgaattcattgtaccttctgcactacttccagaatattttgcagaccacgcagggcaaagactttatttataatagaagtcggattaacttgagcaagaaggagggtaaggttgtgaagtcttctctgaatcagatgctggataaaaccgtagagcagaaaatgaaagaaattctatactggtttgcgaattctactcagtggactaaggcaaactacaccctactgctgctgcagatgtgcaaccccaaattgcttctgactgcggctaatgttatacgggtgctttttctgcgtgaagagaacaacataagcggtttgaaccaagatattacagatgtctgtttcagccccgaaaaggatcactccagcaaatctgcaacatcgcaggtgtattggactgctaaaacgcagcatacatcccttcccctgagtaaagcccctgaaaacgagcaccttctgggcgcagcaagcaacccagaggaaccttggagaaactcactgcgatgcatatcagagatgaacaggctgttttccggcaagggggacattactaagcctggctacgacccctgtaacctcctggtcgatctcgacgacatccgcgacctcagttctggattttcaaagtacagagactttatcaggtacctccctatccatctctccaagtacatcttgagcatgcttggatgcatgcgtggttttcctcgacacctcccgtcatggccctcaagtggcgttagcggatctatttttttcttccccggtatgctggaccgccacacgctcaacaagtgcgcaagtgtttcacagcactgggccgcaatggcccagcaagtcaaaatggatctgagtgcgcatggcttcattcagaaccaaatcaccttcttacagggaagctacaccaggggtatcgatccaaattatgctaataaagtgtccatcccagtacctaaaatggtggatgacggaaagagtatgcgggttaagcacccgaagtggaagctccgtactaagaacgagtacaacctgtggacagcttatcaaaacgaagaaacacagcaagtgctcatagaggagcgcaacgtcttttgcggcacgtataacgtgaggattctgtcagacacttgggatcaaaaccgagtcattcattactctggcggtgacttgatcgcagtatctagcaacagaaaaatccacctgcttgatatcatacaggtaaaagctatccccgtggaatttcgcggtcatgccggatctgtgcgagcactatttctgtgcgaggaggaaaattttttgctaagtgggagctacgatctctccattaggtattgggacctgaagtcgggagtatgtactcgaatcttcgggggtcaccaaggtaccatcacatgcatggacctctgcaaaaaccgtctggtctccggcggtcgagattgccaggttaaggtatgggatgtcgatactggaaagtgtttgaagacatttcgacacaaagatccaattctggcaacaaggatcaacgacacttacatcgtgagtagttgtgagaggggcctggtgaaagtgtggcacattgccatggctcaactcgtcaagactttgtctggccatgaaggcgctgtgaaatgcttgttcttcgaccagtggcatctcctttctggatccaccgacgggctggttatggcatggagcatggtaggaaagtacgagcggtgtctgatggcttttaagcaccctaaagaagtgctggatgtgagcctcctgtttcttcgagtcatctctgcatgtgccgatggcaagatcaggatatacaattttttgaatggtaattgcatgaaagtgctaaaagcaaacggtcggggagatccagtcctgagctttttcatacagggaaatcggatggtggtgaacacagagagcaatgtgctcatgtttcagttcgaacacatcaagtggcaatacgccgtcgaaaagaccaaacagaagaaaaataaagagaaggaggaggagaaggaggaaaactcattaatggaaatcctgagcaagtgtaacattcaagtgcatagtccgagagaatccgttagctctaaacaaacggtcatccaggaactgcttccgggtaaaccacctaaatcacgcgtattacttaaacccgctaaatttagtagtgacgacgtggagaaagcgcagaaacagggccagctggagactccaggaaaactgccctcgcaccccaaaaaaaagagctggaagattccaatgagtcctgaccaatttttgctgacagtgagcgcactgcaacacgcacataactcgggagagtttgcttacccgtgtcgacctcagaccgagatcacagacgtgtggggaccttcaataagttatccacgcaaggttctcaatttcaaggggaaaagcatccagcgagcagtcgaccggctgcgccttagtaatcccccaatagacgtgaagcgcacaagcatccctctggaaatccagaagctgcagcctaacctgaaaatttcactgcacagtcccagagtgcagagcactatcccacagccaatgattatccggtcccggttcagcgggtccctgaagggcggagatcaggtgaccagcagtatagaaagagccgtatgcagtactggcccattgacgtccatgcaagtgataaagccgaacaggatgctggcccctcaggtgggaacggctactctctcacttaaaaaggagcgtccaaggatctatactgcactggacccgttcagggtcaacacggaattcgtattactaactgtgaaggaagaaaaagaacaccaggaggccaaaatgaaagaataccaggctcgcgagtctactggcgtggttgacccagggaaagtgtctaaggccgcttggattaggaagatcaaaggactgcccatagacaattttacaaaacaggggaagacggccgcacccgaactgggacagaatgtgtttatatag

SEQ ID NO: 222959 - DNA, 3159 bp, Artificial Sequence
  Description of Artificial Sequence: Synthetic coding sequence
atggagaatttggagtctcggctgaaaaatgcaccttattttcgatgcgagaagggcaccgattctattccgctttgtaggaagtgcgaaacttgcgtgctcgcatggaagatcttttctaccaaagagtggttctgccggatcaacgacatttcccaaaggaggttcctggtgggaatcctcaagcagctgaacagcctgtatttactgcactactttcagaatattctccagacgactcaggggaaagactttatttataatagatcccgtattaatctgtccaaaaaggagggcaaggtcgtgaaaagttcattgaatcaaatgctggacaagaccgtggaacagaagatgaaggaaattctgtattggtttgccaatagcactcaatggaccaaagctaattacaccctgcttcttctccagatgtgcaacccaaaactgctgctgacagccgctaatgtgatcagggtactctttctgcgggaggagaacaatatatccggcctgaatcaggatataaccgatgtgtgcttttcacccgagaaagatcactcatccaaatcagccacaagtcaggtgtactggaccgccaagacgcagcatacctccctgccactgagcaaggctccagaaaacgaacatctcttgggtgccgcatccaaccccgaagagccatggagaaattcactgagatgcattagcgagatgaaccgactgtttagcggaaaaggggatattacaaagccgggttacgatccatgtaatttactggtggatttggacgatattcgcgatctcagctccggattttccaaatatcgggactttatccgctacctccctatccatttgagcaagtacatcttgcgaatgctggatcggcacacactgaacaaatgcgcttcagtctcacaacactgggcagctatggcccagcaagtcaaaatggacctctcagcacacggattcattcagaaccaaataacgttccttcagggatcctacaccaggggaatcgacccgaactatgccaataaagttagtatccctgttccaaaaatggtggatgacggcaagtcaatgcgcgttaagcatcccaagtggaagctgcgcacgaagaatgagtataacctgtggaccgcttaccaaaatgaggaaacccagcaggtattaatcgaagaacgcaacgtgttttgcgggacatacaacgttcgaatcctgtctgatacgtgggaccagaatcgcgtgatccactactcaggcggagacctgattgctgttagctcaaatcgtaagattcacctgctcgatattattcaggtgaaggcaatccccgttgagttccggggtcacgcaggcagtgtccgcgctttgtttctgtgtgaggaggagaatttcctcttaagcggtagttacgatctgtcaataaggtactgggatctgaaaagcggcgtatgtaccagaatcttcggaggccatcaggggactatcacatgtatggatctgtgcaaaaaccggttggtctccggcggaagggattgccaggtgaaggtgtgggacgtggacaccgggaaatgccttaagaccttccgtcacaaagatcccattctggcaacacgaatcaacgatacatacattgtctcatcttgcgaacgcggtttagtaaaggtctggcacatagcaatggctcagctggtgaaaactctctccggacatgagggcgcagtgaaatgcctcttctttgaccagtggcacttgctgtcaggcagcaccgatgggctcgttatggcctggagcatggtgggtaagtacgagcggtgtcttatggcattcaagcacccgaaagaagtgctggacgtctctctgctgtttttgcgagtcattagtgcttgcgccgatggtaaaattcggatctataacttcctcaacggaaattgtatgaaagttctcaaagccaatggccgtggtgatcccgtgctgtccttttttatccagggcaatagaatggtggtgaataccgagtcaaacgtcctgatgttccagttcgagcacataaaatggcaatatgctgtagaaaagaccaagcaaaagaagaataaagaaaaagaagaagaaaaagaggagaatagcctgatggaaatcctgtccaagtgcaacatacaggtacatagtcctcgcgaaagtgtgtcatccaagcagacagtgattcaggaactcctaccgggaaaaccacctaaatcacgcgtcttgttgaagcccgctaaattctcctcagccgttctgatcgaggaactgcaaagccagggcaaatctaaaagccctcgccgagacgccgacgatgtagagaaggcacagaaacagggacagctggagacacccggtaaactgccttcccacccgaagaaaaagagttggaagatacccatgtctcctgaccagttcctccttactgtatccgcattgcaacatgcacacaattccggggaattcgcctacccatgtaggccacaaactgaaattaccgacgtgtggggtccctccatctcttacccgaggaaggtcctgaatttcaagggaaagagcatccagcgagccgtggatcggctgaggttaagtaaccccccaatcgatgttaagagaacctctatacccctcgagatccagaaactccagcctaatttgaaaatttccttgcactctcctcgtgtacagtccacaattccccagcccatgataatccgctcaagattttccggctccctcaagggcggagatcaagtaacaagcagtatcgagcgggcagtttgcagcacagggccattgacatctatgcaagttatcaagcctaacagaatgttggcaccccaagttggcacagccaccctgagtcttaaaaaagagcgcccacgtatttacacagctttggatccttttagagtcaatacagagtttgtccttttgaccgtcaaagaggagaaagaacaccaggaggccaaaatgaaggagtatcaggcacgcgagtccacaggagtggttgatcctgggaaagtatccaaggccgcttggattaggaagattaaaggactcccaattgataatttcactaagcaggggaagaccgctgctcccgaactgggccagaatgtttttatctag

SEQ ID NO: 222960 - DNA, 3156 bp, Artificial Sequence
  Description of Artificial Sequence: Synthetic coding sequence
atggagaacctggagtcacgcctgaaaaacgctccgtacttccgctgcgagaaaggaacagacagtatccccctctgcagaaagtgtgagacttgcgtgctggcctggaagatcttttccacaaaagaatggttctgtagaattaacgatatctcccagcggaggtttctcgtcggtattctcaaacagctgaattcactgtatttgctgcattattttcagaacattctgcagaccacccagggcaaggactttatctataaccgcagtcggattaacctgagcaagaaggagggtaaagtggttaaatcctccttgaatcagatgctggacaagacagttgagcagaagatgaaggaaatcttatactggttcgctaatagcactcaatggacaaaggccaattacacgctgctgctcctgcagatgtgcaaccctaagctgcttttaactgctgccaatgtcataagggtgttgttccttcgggaggaaaacaacatcagtggcctaaatcaggatataactgatgtctgcttttccccagagaaagaccacagctctaagagcgctacctctcaggtttactggacagctaaaactcagcatacaagcctcccattgtccaaggcacccgagaatgaacatcttctgggtgcagcttccaaccctgaagagccctggcgtaattcgctgaggtgcatttcagaaatgaaccgcttgttttctgggaaaggtgacataactaaaccgggatacgatccatgcaacttactggtagacttagacgatatcagagacctctcttccgggttcagcaagtaccgggacttcatacggtaccttccaatccatctcagcaaatacattctccggatgttagaccgacacactctaaacaagtgtgcctctgtctcacagcattgggctgccatggcgcagcaagtcaaaatggacctgagtgcccatggcttcattcagaatcagattacattcctacagggatcttacactcggggaatcgatccaaattatgcaaacaaggtgagcatccccgtgcctaagatggtcgacgacggcaagagcatgagagtgaagcatcccaagtggaaacttcgcacaaagaacgagtacaacctgtggaccgcctatcaaaatgaggaaacccagcaggttctgattgaagagagaaatgtgttctgcggtacttacaacgttcgtattctatccgatacctgggaccagaatcgggtgattcactatagcggcggagacctgatcgcagtctcctctaaccgtaaaattcacctcctggacatcatccaggtaaaagcaattcccgttgagtttcgaggccatgccggttccgtccgagctctgtttctgtgcgaagaagaaaactttctgcttagcgggagctacgacctatcgatccggtattgggatctcaagtcaggcgtctgtactcgcattttcggagggcatcagggaaccattacctgcatggacctgtgtaaaaacaggctggtgtcggggggaagggattgccaggtaaaggtttgggacgttgacaccgggaagtgcctgaagacctttcggcataaagaccctatactcgcaacgaggatcaacgacacttacattgtgtctagctgtgagcgcggactggtgaaggtgtggcatatcgcgatggcccagctggttaaaaccctgtcaggccacgaaggcgcagttaagtgcctgtttttcgaccagtggcacttactctctggaagtacagacggcctcgtgatggcctggagcatggtaggcaaatacgagaggtgccttatggcctttaaacaccctaaggaggtcctggacgtgagcctcctattcttgcgggtaatcagcgcatgtgcagatggaaagattaggatctacaattttttaaacggtaactgcatgaaggtattgaaggccaatgggagaggagatcctgttctcagcttttttattcaggggaatcggatggtggtgaatacagaatccaacgtgctcatgttccagtttgaacacatcaagtggcagtacgccgttgaaaaaacaaaacagaaaaagaataaggaaaaagaggaagagaaggaagagaactcactgatggagatcctgtccaaatgtaacattcaagtgcatagtcctagggagtcagtttcatccaaacaaacggtgatccaggagctcctccctggaaagccacctaaatcgcgggtcctgctcaagcccgctaagttttcttccgcagtacttattgaggagctgcaatctcagggaaagtctaagagccccaggcgggacgacgatgtggaaaaagcacaaaaacagggccaactggaaacccctggcaaacttccatcccaccctaagaagaaatcgtggaagattcccatgtcaccagatcaattcctgttaacagtgtcagcactgcaacatgcacacaactccggagaatttgcttacccttgccgtcctcagactgagattaccgatgtgtggggccctagcatcagctatccccgaaaggttctcaatttcaagggaaaatcgatccagcgagcggttgatcggttacggttgagcaaccctcccattgacgtgaagagaaccagcattcccttggagatacagaaactgcagccaaatctgaaaatttccctgcattcacctagagtccagtcaactatccctcagcctatgatcattcgatcacggttttcaggctctttgaaaggcggtgaccaggtgaccagttctattgaacgcgctgtgtgctccactgggcctcttacaagcatgcaggtcattaaaccaaaccgcatgctcgcacctcaagtaggcacagcgactctgtctctcaaaaaggaaaggcccaggatctacaccgccctggacccgttcagagtgaacacagagtttgtactgctcacagtgaaggaagagaaagagcaccaagaggctaagatgaaagaatatcaggctcgtgaatccacaggggtggtggacccgggaaaggtgagcaaagcagcgtggatccgcaaaatcaaaggactgccgattgacaatttcaccaaacagggaaagactgccgctcccgaactggggcagaatgtttttatatag

SEQ ID NO: 222961 - DNA, 1629 bp, Artificial Sequence
  Description of Artificial Sequence: Synthetic coding sequence
atggagccggatagcgtgatcgaagacaaaacgatcgaacttatgtgcagcgttccaaggagcctgtggttaggatgcgctaatctggttgagagcatgtgcgccttgtcttgcctccagagtatgccctccgtgcgctgtttgcaaatcagtaacggtacttcgtcggtaatagtctctcggaagagaccgtcagagggcaattatcagaaggaaaaggacctgtgtatcaaatactttgatcagtggtcagagtccgatcaggtagaattcgtggaacacctcatatctagaatgtgtcactatcagcatggacacattaactcatatctgaagcctatgctacagcgtgattttatcaccgccctgccagagcaggggctggaccacatcgcagagaatatcctgtcctacctcgacgctagaagtctttgcgctgcagaacttgtttgtaaagagtggcaacgcgttatctcggaaggcatgctatggaagaagctgatcgaacgtatggttcggaccgaccccctgtggaaggggctctccgaaaggagagggtgggatcaatacttgtttaaaaatcgccctaccgacggccctcctaattcattttatagaagtctctaccctaaaattatccaggatattgagacaattgagagtaactggcgatgtggacgacacaacctccagcgtatccagtgcaggagtgaaaattcgaaaggcgtctattgcctccagtatgacgacgagaagattataagcggtctgagagacaacagtatcaagatttgggacaagacatccctggagtgcctcaaggtgctgaccgggcacacagggtcggtgctttgtctgcaatatgacgagcgagtgattgttaccggatctagtgactcaacagtaagagtctgggatgtgaacaccggagaagtcttgaatacattgatccatcataacgaagcggtattacacctgaggttctccaacggcctcatggtgacgtgttctaaggatagatccattgccgtgtgggacatggccagcgccactgacattactctccggagggttctggtggggcacagggccgctgtcaatgtggttgacttcgatgacaagtatatagtgtctgccagcggggacagaaccataaaggtttggagtacaagcacatgcgaatttgttagaaccctcaacgggcacaaaagaggcatcgcctgcctccagtatagggacaggcttgtcgtctcaggctccagcgacaatactatccgcctctgggatattgagtgcggggcatgtctccgagtcctcgagggacacgaagaactggtgaggtgcattcgcttcgacaacaagagaattgtgagcggggcatatgacggcaagataaaagtttgggacttacaggccgcactggaccctagggccccagcaagtaccctttgcctcagaacgctggtagagcactccggaagggtcttcaggctccaatttgacgaattccagattatatcttcttctcacgacgatacaatccttatatgggactttttaaacgtgcccccatccgcccaaaacgaaactcgatccccttccaggacatatacgtatatttctaggtag

SEQ ID NO: 222962 - DNA, 1590 bp, Artificial Sequence
  Description of Artificial Sequence: Synthetic coding sequence
atggagcctgattccgtaatcgaggacaagacaattgagctgatgaatacatctgtaatggaggaccagaatgaagatgaatcccccaagaaaaataccctgtggcaaatctctaatggcacgagcagtgtgatcgtgtccaggaagaggcccagcgaaggtaactaccagaaggagaaggacctgtgtatcaaatattttgaccagtggtccgaatcagatcaggtggagttcgtagagcacctgatttcaaggatgtgtcattaccagcatggccatatcaattcttacctgaagcccatgcttcagcgtgacttcattactgccctacctgagcagggcctggaccatatcgctgagaacatcctgagttacctggacgcccgatccctttgcgccgcagagctggtgtgtaaagagtggcaaagggtgatttcggaaggcatgctctggaagaaattaatagaacgcatggtaagaacagatccactgtggaagggactgtcagagcggaggggctgggatcagtatttgtttaagaatcgccctacggatggcccacccaactctttttatcgtagtctgtatcccaaaataatacaggacatcgagactatcgaaagtaactggcgatgcggaaggcataatttgcagcggattcagtgtcgctcagaaaactctaaaggtgtttactgtctgcaatacgacgacgaaaagataataagtggcctgcgggacaattcgattaaaatctgggacaaaaccagcctggaatgcctgaaagtcctaactggccacaccggcagcgtgctatgccttcagtatgacgagagggtcatcgtcacaggaagctccgatagcaccgtgcgcgtatgggatgtaaacaccggggaggttctcaacacactgatccaccacaatgaggcagtgctgcatctgcggttttccaatggtctgatggtaacatgctccaaggaccggtccatcgccgtatgggacatggcctctgctaccgatattaccctgcggagagtactagtcggccatcgagccgctgttaatgtcgtcgactttgatgataagtatatagtgtctgcatccggagacagaacaattaaagtgtggagtacttctacgtgcgaattcgttcgaacattaaacggacataaacgaggcatagcatgcctgcagtacagagatcgcttggtggttagcggaagctctgataatacgatacgactgtgggacattgagtgtggcgcatgcctgagggtgctggaaggacacgaggaactggtcaggtgcattaggttcgacaataagaggatcgtgtccggggcatacgacggcaaaatcaaggtgtgggacttacaagcagctttggacccaagggcacctgcctctacactgtgccttagaactctggtagagcatagcgggagagtttttcgcctgcaatttgacgaattccagatcatcagcagttcccatgacgacacaatcttgatctgggacttcctcaacgtaccacctagtgcacagaacgagacacgcagtccttcccggacatacacgtacatctctcgctag

SEQ ID NO: 222963 - DNA, 1527 bp, Artificial Sequence
  Description of Artificial Sequence: Synthetic coding sequence
atggaaccggattcagttattgaggacaagactattgagctgatgataagtaacggtacctcatccgtgattgtctctaggaaaaggccgagcgaggggaactaccagaaggagaaggacctctgtattaaatacttcgaccagtggagcgaatcagaccaggtggagttcgttgagcatctgatatctcgaatgtgccattatcaacatggtcatatcaactcataccttaaaccaatgctgcagcgagatttcattacagcacttcctgagcagggtctggatcatattgccgagaacatcctgtcttacctggacgcacgctcactgtgtgctgcagaactagtttgcaaggaatggcaaagagttatatctgaagggatgctgtggaagaagctcattgagcgcatggtgcgtacagatcccctctggaagggcctgtccgaaagacgtggctgggatcagtacctgttcaagaacaggccaacagacggcccacccaactctttctaccggagtctgtatccaaagattattcaggatatagaaactatcgaatcgaactggcggtgtgggaggcacaatcttcagagaatccagtgtcgcagcgaaaattctaaaggagtctattgtctgcagtatgatgatgagaaaattatttccggtctgagagataacagcattaagatatgggataaaacctctctggagtgcctcaaagtcctgacaggccatacagggagtgtgctctgcctgcagtacgacgagcgcgtgattgtcaccggaagcagtgactctactgtgagggtgtgggacgtgaatactggcgaggtgttgaacacactgattcaccataacgaggcagtgctgcatttacgcttctcaaatgggctgatggttacttgctccaaggatcggtccatcgcagtctgggatatggcatccgccacagatattacgctgcgtcgggtactggtagggcacagggcagctgtgaacgtggttgatttcgacgacaagtacattgtgtcagcatctggggatagaacaatcaaggtttggtctaccagcacttgcgaattcgtgaggaccctgaatggtcacaagcggggaattgcctgcttacagtaccgggacaggttagttgtgtccggaagctccgacaacaccattagactgtgggacatagagtgtggcgcttgcctgagagtgctagagggacacgaagaacttgtccggtgtataaggttcgacaacaaaaggatagtgtccggcgcatacgatggcaagattaaagtgtgggatctgcaggctgccctagacccacgtgcgcctgcttccaccctctgcctaagaaccctggtagaacatagcggacgggttttccgcctgcagttcgacgagttccagatcatctcgtccagccacgatgacaccatcctgatttgggatttcctgaacgtccctccaagtgctcagaacgagacccggagcccaagcaggacctacacgtatattagccggtag

SEQ ID NO: 222964 - DNA, 1533 bp, Artificial Sequence
  Description of Artificial Sequence: Synthetic coding sequence
atggaagaccagaacgaagatgaaagtcctaaaaaaaacacactctggcagatctccaacggaacctcttcggtcatcgtgtcccgcaaaaggccctcagagggcaattaccagaaggagaaagacttgtgtattaagtactttgaccaatggtcagaatccgaccaggtcgaatttgtggaacacctgatcagtaggatgtgccactatcagcatggtcacatcaattcctacttaaagcctatgctgcagagagattttattacggcgctgcccgaacagggactagatcacatagctgagaatatcctttcctacctggatgcccgaagcttatgcgcagccgaactcgtgtgtaaggaatggcagcgagtaataagcgagggcatgctgtggaaaaaattaatcgagcgcatggtgcgcacggaccctctgtggaagggattgtcagaacggagaggctgggaccagtacctctttaagaacaggcctaccgacggcccacctaactcattctataggagcctctacccaaaaatcattcaggacatcgagactatcgagagcaactggagatgcgggaggcataatttgcagaggatacagtgtcggagcgaaaactcgaagggagtctattgcctgcaatatgacgacgagaagattatctccggtctcagggataactcgatcaagatttgggataagacaagccttgagtgtttgaaggttttaaccggacatactgggtctgtcttgtgcctacagtacgacgaaagggttattgtgacagggtccagtgacagcacagtgcgagtctgggacgtgaacactggagaagtcctcaacacattaattcatcacaacgaggccgtcctgcaccttcggttttctaatgggctcatggtgacctgcagcaaggatagaagcatcgcggtttgggacatggcgtcagcaactgatatcactctcaggcgggtcttagtcggtcatcgggcagctgtgaatgtggtcgattttgatgacaagtatatcgtgtcagcctctggagaccgtacaattaaagtgtggagcacttcaacatgcgaatttgttcgcactctaaatgggcacaagagaggaatcgcctgccttcaatatcgggatcgtctcgtggtctctggcagctccgacaataccatcaggctgtgggatatagaatgcggagcctgcctcagagtgctggaggggcacgaggagctcgtccgctgcattagattcgataacaagaggatcgtgagtggggcatacgacggaaagattaaagtttgggacctacaagctgctctggatcccagggcccctgcctcgacactctgtttacggactctggtggagcactccgggagagttttcaggctccagtttgacgaatttcagataatttcatcttcccacgatgacaccatcctgatctgggattttctgaatgtcccaccctccgcacagaatgaaactagatcacctagtcgaacttatacatacataagtaggtag

SEQ ID NO: 222965 - DNA, 1395 bp, Artificial Sequence
  Description of Artificial Sequence: Synthetic coding sequence
atggagattcggttaccggacctggcactcaaacgaatcttcagcttcctcgacttgttcgggctgctccaggtgtcacaagtgaataaacactggaacaggatcgcggactctgattacctttggcgctcactgtcccttcagcggtgggactgttcaaattttaccaatcagcaccttggcacacacacgtggaagcagtttttccttcaccagaggcgaaaagagctgagactggccctcgcccagccccacaactttatctataaggtcactaagaacattgcttttgagactgagctggcttacctgagcggcaacaggctgaccgtcgatgagcaggagaaatcgataatttgtagcgtttcgccaaaacaagagctgtgtgcctgggacgtgcaggagggcacaatgatctggagtagtccggtgcaggagttccatttttccaacctagtcaccctcccccaaatgcatcttgccatcacgatggacagaaaaaagacaataaaagtctggaactgccaggaccgcgacgcattggcagtgttaccgatgcctcagccctgttattgtatggaggcttacctgactaaagacggcccattccttatggtgggtgacgcggcaggagacatctataccttcactcttccaggactgcgagacgtttcaaaggtcaccgcgttccaatatggcatcgtcctcctgcattgctccccagataaaaagtgggtatttgcatgtggaacatactccagaactcttcctcaggtctttcttacagaaagtttgcttaggcccagcgagggaagtgtgccactgtctaccttcctgccgcataaactgtgcgcctctgcatgttggacaccaaaagttaaaaacaggataacactgatgagccagtccagcactggaaagaagaccgaattcatcacttttgatttgaccactaaaaaaacgggtgggcagaccgtgatccaggcgtacgaaatagcctcatttcaagtggcagctcacctcaagtgtccaatatggatgggcgcatctgatgggtatatgattgtatttacaagtggcccatatctgctgctgttcagtataacgggatttcttcttcaacgattcgaggatcatcaagcagccattaataacttttgggtggatccatgctatgtgctaaccacctcagagaactctgtccacgtctatatgtgggaggaaggaggtagacacccttacctgcgatcttgttgtcatctggaaaacacctggcacgaccacaccactgacagttgtatttcctccgttatgtgcgacaatgctagcattgtgctgcgagtacggaaggttagtgatagctctatactggttatgtatagcctgaatacctag

SEQ ID NO: 222966 - DNA, 1092 bp, Artificial Sequence
  Description of Artificial Sequence: Synthetic coding sequence
atgttggccctgcgcgacgagcctcattcccctgatagcagaagccaggcctttgaaaccgaactggcctacctttctgggaataggttgaccgtcgacgaacaagagaagtcgattatatgttccgtgtcccccaaacaagagttgtgtgcctgggacgtgcaggaaatgcacctggccattaccatggaccgcaagaagaccattaaagtctggaactgccaggacagggacgcccttgccgtacttcccatgccccagccatgctactgtatggaggcctatcttaccaaggacggaccatttctgatggttggagacgctgccggagacatctatacattcactctgcctggcctccgcgatgtgagcaaggtcacagcatttcagtacggcattgtgctcctgcattgcagccccgataagaagtgggtgttcgcatgtggaacatactctagaacccttccacaggttttcctgaccgagtcccttttgaggccctccgaaggttcagtccctctgagtactttcctaccgcacaaattatgtgctagcgcttgctggacgccgaaggtaaagaatcggataacactaatgagccagagctcaaccggcaagaagacagaattcattactttcgacctcacaacaaagaagacaggcggacagacagtcattcaggcctacgagatagcctctttccaggtggccgcacatctgaagtgccccatctggatgggagcatctgatggatacatgattgtcttcacctcgggcccttacctgcttctgtttagtatcaccggattcctgctgcagcggttcgaggatcaccaagcagccattaacaacttctgggtggacccttgctacgtcctgaccactagcgaaaattccgtgcatgtttatatgtgggaggaaggagggcgacacccttacctcaggtcatgttgccaccttgagaacacctggcatgatcataccacagattcatgtatttcgtccgtgatgtgcgacaacgcctctatcgtcctgagagtgcggaaggtctccgactcgagtattctggtcatgtatagcttaaacacttag

SEQ ID NO: 222967 - DNA, 1185 bp, Artificial Sequence
  Description of Artificial Sequence: Synthetic coding sequence
atggagattcgactccctgacctggctctcaaaaggatcttctcttttttggatctgtttgggctgctgcaggttagtcaggtgaacaagcactggaaccgaattgctgactccgactatctttggaggagcctgtcactccagcggtgggattgtagtaatttcaccaatcagcacctaggaactcacacgtggaaacagttttttttacatcaaagacgtaaggaactccgcttggcgctggcccagccacataatttcatctacaaagtcactaaaaacatcgcttttgagaccgagctcgcctacctatctggaaacagactcaccgtggatgaacaggagaaatctatcatatgcagtgtcagtccgaaacaagagctttgtgcttgggatgtgcaggaggtgggcgacgccgctggcgatatttataccttcactctgcccggattacgggacgtctctaaggttacagcctttcagtacggcatagtgctgttacattgctctccagacaagaaatgggtgtttgcatgcggcacctactcacggactctccctcaggttttcctcaccgagtctctgctccggccttccgaggggagtgttcctctgagtaccttcctgcctcataagttgtgcgcttctgcctgctggacacctaaagtcaagaataggattacacttatgtcacaatctagcactggtaagaagaccgaattcatcaccttcgacctaactaccaagaaaactggcggacagacagtaattcaggcatatgaaatcgcatcatttcaggtagcggctcacctcaaatgccccatctggatgggtgcctcagatggttatatgattgtgtttacttccgggccttatcttctcttgttctccattacaggattcttgctacagcggtttgaggaccaccaggccgctattaataacttctgggtggacccatgttacgtgctgacgacatctgaaaactccgtccatgtgtacatgtgggaggaggggggacgtcatccctatttacgctcttgttgtcatctggaaaacacatggcacgaccacaccacggattcatgcatctcttctgttatgtgtgataatgcaagtattgtgctgcgggtgcggaaggttagcgacagttccatcctagtaatgtattctttgaacacctag

SEQ ID NO: 222968 - DNA, 1338 bp, Artificial Sequence
  Description of Artificial Sequence: Synthetic coding sequence
atgtctccaactcaccagattcaggacccaaagcattggaaccggatcgcagactccgattacctgtggcggtccctctccctccagaggtgggattgctctaactttactaaccagcacctcggtacccacacatggaaacaattcttcctccaccaacggagaaaggagctgcgtcttgcattagcacagcctcacaacttcatctataaggtcacaaaaaacatcgcattcgagacggagctggcatatctgtcaggcaatcgcctcacagtcgacgagcaggagaaatccataatctgctcagtgtccccaaaacaggaactgtgcgcgtgggatgtccaggagggtacaatgatttggtcctcaccggtgcaggaattccacttttcaaaccttgtgaccctgcctcagatgcacctggctattactatggatagaaagaagaccattaaggtgtggaattgccaggaccgagatgccctagcggtcctcccgatgccgcagccttgctactgcatggaagcctatttaacaaaagatgggccatttctgatggtcggagacgctgctggagacatttatacctttactttgccaggtctccgagacgtctccaaagtgactgccttccagtacggtatcgttttactgcactgctcacctgacaaaaaatgggttttcgcatgtgggacatattctaggacacttccgcaggtgttcctaacggagtcactgctgagaccatctgagggaagcgtgccactgagtacattcctgccccacaagctgtgcgcgtccgcttgttggacacctaaggtgaaaaaccggatcactcttatgagccagtcctccaccggcaagaagactgaatttattacttttgatcttacaacaaagaagacgggaggacaaaccgtcatacaggcttacgaaattgcttcgttccaggtggcagcacacttgaaatgcccaatttggatgggcgcttccgacggttatatgattgtatttacctccgggccatatctcctgcttttttccataacggggttccttttgcagcgcttcgaggaccatcaggccgctattaacaacttttgggtagatccgtgctacgtgcttaccacttctgaaaacagcgtgcacgtgtacatgtgggaagagggcggtcgccacccatacctgcgaagctgttgccatctggagaatacatggcacgaccacaccaccgacagttgcatctctagtgtgatgtgcgataacgcttccatcgtgcttagagtacgcaaagtgtcggactcgagcattctggtgatgtattctctcaacacatag

SEQ ID NO: 222969 - DNA, 1239 bp, Artificial Sequence
  Description of Artificial Sequence: Synthetic coding sequence
atggccgctgcagccggagaagaagaggaagaggaggaggcagccagggagtctgccgctcgtcccgcagcgggtcctgccctctggcggctacccgaagagctcctgctgctcatctgcagctatctggacatgcgcgctctcggccgtctggcacaggtttgcagatggctgcggagatttacatcctgtgatcttttgtggcggcgaattgcacgggcttccctcaactcaggctttaccaggctgggaactgacctgatgacctcggttcccgtcaaggaacgggtcaaagtgagccagaattggcggctgggtcgttgtcgcgaaggcattctcctaaaatggcggtgtcgccaaatgccatggatgcagttggaagacgattcactatacatctcccaggctaatttcatcttggcctatcagttccgacccgacggtgcatctctgaatagacggcctttgggagtgtttgcgggacacgacgaggacgtttgtcactttgtgctggcaaactctcacatcgtgtccgcgggtggggacgggaagatcggaatacataagattcactccactttcacagtcaagtatagcgcccatgaacaggaagttaactgtgtggactgtaagggcggaattattgtttccgggtcaagggaccgcacagctaaagtgtggccactggcatccggcaggctgggacagtgcctccacaccatccagaccgaggacagggtatggtctattgccatcagcccgctgctgagttcttttgtgaccggtactgcatgctgcggtcactttagccctcttcgaatatgggaccttaactctgggcagctgatgactcatctcggttcagattttcctccaggagctggtgtgctggacgtcatgtatgagagccccttcacactattatcttgcggctacgatacttacgtgaggtattgggacctgcgtacttctgtgcgcaagtgtgtcatggagtgggaagagccacatgactcgaccttatactgtctgcagaccgacggcaatcacctgctggccactggaagcagctactatggggtcgtgaggctttgggatcgcaggcagagggcatgcttgcacgcctttccactcacctcaacccccctttccagtccagtgtactgtctcagactgactaccaaacatctgtacgcagccctgtcttataatctacatgtgctagactttcaaaacccgtag

SEQ ID NO: 222970 - DNA, 1239 bp, Artificial Sequence
  Description of Artificial Sequence: Synthetic coding sequence
atggctgcagcagccggagaagaagaggaggaggaggaagctgctcgggaatcagccgcacggcctgcagccggtcccgctctgtggcgactgcccgaagagcttcttctgctgatctgtagctatctggacatgcgagccttgggacgtctggcacaggtgtgtcggtggctccggaggttcacttcatgcgacctgctttggagaaggattgcccgtgcaagcctcaatagtgggttcacacggctcgggacggacttgatgactagtgtgccagtgaaggagagggtcaaggttagccaaaattggaggctgggaaggtgtcgcgagggtattttactcaagtggcgctgttctcagatgccgtggatgcaacttgaggatgactcgctttatatttctcaggccaatttcatcctggcttaccaatttcgaccagacggagctagcctgaatagacgacctctgggggtgtttgccggacacgacgaagatgtgtgccatttcgtgctggcgaattctcacatcgtttcagcgggaggcgacggtaagattgggattcataagatccattcaacctttaccgtgaagtacagtgcccatgagcaagaagtcaactgcgtggactgtaagggcggtatcatcgtttccgggagccgcgaccgcactgccaaagtctggccattggctagcggcagactcggccagtgtctgcacaccattcagaccgaggatagagtatggagcatcgcaatctcgcctctcctctctagttttgtgaccgggaccgcctgttgtggacacttcagtcccttaaggatttgggacctaaacagcggacagcttatgactcatctgggctccgacttccccccaggcgctggagtcctggacgtcatgtacgagtccccattcacgctcctgtcctgcggatacgatacatacgtgaggtattgggatctgagaaccagtgttcggaagtgcgtgatggaatgggaggagccccatgattccactttgtattgtctgcagaccgatggaaaccacctattggctaccgggtcttcatactacggtgtggttcggttgtgggaccgcagacagcgtgcctgtctgcacgcctttccactgacaagcacgcccctgagttctccagtgtactgtctgcgcctcactacaaaacacctctacgcggcactgagctacaacctccacgttctggactttcagaatccctag

SEQ ID NO: 222971 - DNA, 639 bp, Artificial Sequence
  Description of Artificial Sequence: Synthetic coding sequence
atgcgagccctcggtcggctggcgcaggtgtgtcgctggttgcgcaggtttacttcatgtgacctgctgtggaggcgcatagccagggcgtccctgaattcaggcttcaccaggctaggcacagatctcatgaccagtgttcctgtcaaggagagagttaaagtaagtcaaaattggcgcttaggcagatgccgtgagggcatcttgcttaaatggcgatgtaggcaaatgccttggatgcaactcgaagatgactctctgtacatctcccaggccaacttcattctcgcatatcagttccggcctgatggggcaagcttgaatagacgacctcttggcgtttttgccggtcacgacgaggacgtgtgtcactttgttttggccaacagtcacatagtgagcgccggaggcgacggtaaaattggaatccataagattcattcaacattcacggtcaagtatagtgctcatgagcaggaggtcaactgtgtggactgtaaaggcggaatcatcgtgtcgggttcgagggacagaaccgccaaagtctggcctctggcttccggtcggctggggcagtgtcttcacaccattcagacagaggatagagtttggtccatcgctatctcccctctgctctag

SEQ ID NO: 222972 - DNA, 576 bp, Artificial Sequence
  Description of Artificial Sequence: Synthetic coding sequence
atgacttcagtgccagtgaaagaacgtgttaaggtatctcagaactggagactgggtcggtgccgcgagggtatactgctgaagtggaggtgcaggcagatgccatggatgcagctggaagatgacagtttgtatatctctcaggccaatttcattctcgcctatcagtttagacctgatggcgcttccttgaatagacgaccgctgggtgtgttcgcagggcacgatgaggatgtctgtcacttcgtgctggctaatagtcacattgtgtcggctggcggagatggaaaaatcggaattcataagattcacagcacgtttactgttaaatatagcgcccacgaacaggaggtaaactgtgtggactgtaagggcggaatcatcgtttccgggagcagggacaggactgctaaggtctggcccctagcctccggtagactgggccagtgcctacatactattcagacggaagaccgggtgtggtcaatcgctatttcgccactgctcagttctttcgtgactggtaccgcgtgttgtgggcatttctccccactgaggatctgggatttgaactag

SEQ ID NO: 222973 - DNA, 1884 bp, Artificial Sequence
  Description of Artificial Sequence: Synthetic coding sequence
atgtgcgtgccaagatccgggctgatactatcctgcatttgtctctactgcggtgtgttgctccctgttttattacccaatcttcctttcctaacctgcctcagtatgtccacactggagtccgtgacctatttaccagagaaaggcttgtattgccaaagactgccttcttccaggacgcacggcggaactgagtccctgaaaggcaagaatactgaaaatatgggattctatggtacgctgaagatgatcttctacaaaatgaagagaaagttggaccacggatccgaagttcgaagcttctccctgggaaaaaaaccttgtaaagtaagcgaatatacatctacaacgggactagtgccgtgtagcgctacgccaaccacattcggtgatctgagagccgcaaatggccagggtcagcagagaagaagaatcacctctgtgcagcccccaacagggctccaggaatggctcaagatgtttcagtcctggagcggtcctgagaagctgctggctctggacgaactaatcgactcttgcgaaccgacacaggttaagcatatgatgcaggtgatcgagccacagttccagagagacttcatctccttgctgccaaaggagctggcgctgtatgttcttagctttcttgaacctaaggatctgctccaggccgctcaaacgtgtaggtactggcgcattctggctgaagataacctgctgtggcgcgagaagtgtaaggaagaaggtattgacgagcccctccatatcaaaagacgcaaagtaatcaaacctggctttatccactcaccatggaagtcagcctacatccgccagcaccgcatagatacaaactggaggcggggtgaactgaaaagccccaaggtactgaaggggcatgacgatcatgtcatcacatgtctgcagttctgtggaaatcgcatcgtatctggatcggacgataacactctgaaagtttggtccgctgtcactgggaaatgcttacggaccttggtggggcataccggtggcgtgtggtcctcacagatgcgggataacattattatctcaggcagtaccgatcggaccctgaaggtctggaacgccgagaccggggaatgcatacataccttgtatggccatacttctaccgtccggtgcatgcatctgcacgaaaagcgcgtggtgtcaggaagcagagatgccaccctcagagtgtgggacatagagaccggccagtgtttgcatgtgctgatgggccatgttgctgccgtgaggtgcgtacagtacgacggtcgtcgcgttgtgagcggggcttatgacttcatggtgaaggtgtgggaccctgaaactgagacgtgcctgcacactcttcagggccacacaaacagagtgtactctttacagttcgatgggatccacgtggttagcgggtcgctggatacatccatccgcgtctgggacgtagaaactggcaactgtattcatacccttactggccaccaatcactcaccagcggcatggaactgaaggataacatactcgtgtctggcaatgccgactcgacggtgaagatttgggatattaagacaggtcaatgcctgcaaaccctgcaggggcctaataagcaccagtccgcagttacgtgtctgcagttcaataaaaactttgtgataacaagttccgatgacggtaccgttaagctgtgggacctcaaaacgggcgagttcatccggaacctggtgacacttgagagcggtggaagtggtggagtagtgtggcgcatcagagcctccaacactaagctggtctgtgccgtgggttctaggaatggaaccgaagagacaaaactcctcgtactggattttgatgtggatatgaaatag

SEQ ID NO: 222974 - DNA, 2124 bp, Artificial Sequence
  Description of Artificial Sequence: Synthetic coding sequence
atgaatcaggaattgctttcagtgggcagtaaaagacggcgtaccggcggttcactgcgaggcaatccatcctcatcacaagtggatgaagaacaaatgaaccgtgtggtggaagaggagcagcagcaacaattgcgtcagcaagaagaggaacatactgctcgcaatggagaggtagtgggcgtggaacccagaccaggtggacagaatgactcacaacagggacagctcgaggaaaataataaccggtttatcagcgtagatgaggactccagtggtaatcaggaagagcaggaagaggacgaagaacatgcaggggaacaggacgaggaagacgaagaggaagaggagatggatcaggagtccgacgacttcgatcaatccgacgactcatcgagagaggatgaacatacccacacgaattcagtaactaacagttcaagtatcgtggatcttcccgtacaccagctttcaagcccattctacactaagaccactaaaatgaaacgaaaactcgaccacggatctgaggttaggagtttctccctggggaagaagccatgcaaagtcagcgaatacacctccactaccggcttagttccctgctcagccacaccaactacctttggggatctgcgcgctgcaaacggccaggggcagcaaagaagacgtatcacgtctgtgcaaccaccaactggcctgcaggagtggctgaaaatgttccagagctggagcggacctgaaaagttgctcgcattagatgaactaatagacagctgcgagcccacacaagtgaaacacatgatgcaagttatcgagcctcagttccaacgcgactttatctccttgctgcctaaggaactggctctgtacgttcttagcttccttgaaccaaaagacctgctgcaagcagcccagacatgcagatactggcggatactggcagaggacaatctgctttggagagaaaagtgtaaagaggaggggatcgacgaaccgctacatatcaagagacggaaggtgatcaagccagggtttattcatagtccctggaagagcgcttacataagacaacaccgtattgacaccaattggcgtcggggagaacttaagtctcctaaagtgcttaaaggacatgacgatcacgtgatcacctgtctgcaattttgcggcaatcgtattgttagcggtagtgatgataataccctgaaggtctggagtgcggttacaggcaagtgtcttcgcacactagtggggcatactgggggtgtatggtccagtcagatgcgcgacaacattataatctctggatcaactgacagaaccctgaaggtgtggaatgcagaaaccggagagtgcatccacacactgtacggacacacctccactgtccggtgtatgcacttgcacgagaagcgggtggtatccggcagcagggacgccacgctgagggtgtgggacatagaaaccggccagtgtctgcacgttttaatggggcatgtcgccgcagtgagatgcgttcagtacgatggtaggagggtcgtgtctggtgcatacgatttcatggttaaggtctgggacccagaaactgaaacctgccttcacacactccaagggcacactaaccgagtgtactcacttcagtttgatggcattcacgtggtgtcgggctctttggatacatctatcagagtttgggatgttgagacaggaaattgcatacataccctgactggtcaccagagcctgacctctggaatggaactgaaggacaacatcctggtatctggcaatgctgactcaacagtgaagatctgggatattaaaaccggacaatgcctacagacattacagggccctaacaaacatcagagcgctgtgacttgtctccagttcaacaaaaactttgtcatcacctcaagtgacgacggcacggtgaagctgtgggacctgaaaaccggcgaattcattaggaaccttgtaaccctggaatctggaggctccggcggagttgtgtggagaattcgagcgagcaatacaaaactggtatgcgccgtcggctcgcgaaacgggacagaggagactaagctgcttgttctggattttgacgtagacatgaaatag

SEQ ID NO: 222975 - DNA, 1770 bp, Artificial Sequence
  Description of Artificial Sequence: Synthetic coding sequence
atgtctaagccgggaaagccgaccctaaatcacggcttggtaccagtggacttgaaaagcgctaaggaaccgttacctcatcagacagtgatgaaaattttctcgatctccataatcgcacaaggtctacccttttgtaggagaaggatgaaacggaagttggaccacgggagcgaggtcaggtcttttagcttggggaagaaaccctgcaaggtttccgagtatacctccaccaccggcctcgttccatgctctgctacaccaacgaccttcggcgatctgcgcgctgccaatgggcaagggcaacagagacgccgtatcacctcagtccaacccccaaccggtctgcaagagtggctgaagatgttccagagttggtctgggcctgagaaactgctggccttagatgagctcatcgattcttgtgaacccacgcaggttaagcatatgatgcaggtgatcgaacctcagttccagagggacttcataagtctcctccctaaggagttggcactatacgtcctatcattcctcgaaccgaaagacctgctccaggctgctcagacatgcagatattggagaattctcgctgaagacaatctcttgtggcgggagaaatgcaaggaggagggcattgacgagcccctgcacatcaagcgcaggaaggtgattaagccaggttttattcattccccttggaagagcgcctacatccgacaacacagaatagataccaactggcgaagaggagagttgaagtcacccaaagttttaaaggggcatgacgaccatgtcataacctgtctgcagttctgcggaaatcgaatcgtctctggtagcgatgataacaccctcaaagtctggtctgccgtgactggcaaatgcctgcgtactctcgtcgggcataccggaggcgtgtggtccagccaaatgagggataatatcataatcagtggctctacagatcggactctgaaggtatggaatgccgagacaggagaatgcatccacactctttatggccacacgagtactgtgaggtgcatgcacctccacgaaaagagagtggtcagcggatccagagatgcaactctgagggtgtgggacattgagaccggtcagtgcctgcatgtactgatgggtcatgtggctgcggtgagatgtgtgcagtatgatggtcggagagttgtgtctggcgcttatgacttcatggtcaaagtgtgggatccggaaaccgagacttgcctgcacacgctacaaggtcatacaaaccgtgtgtacagtctgcagtttgacggcattcacgtggtgtcagggtccttagacaccagtatccgggtctgggacgtagaaacaggaaactgtatccacactctgacaggacaccagtcactcacttctgggatggagcttaaggacaatatcctcgttagtgggaacgcagatagtactgtgaaaatctgggatatcaagaccggtcaatgtctgcagactctccagggccctaacaagcaccagagtgctgtgacctgcctgcagttcaacaagaattttgtaattacctcatctgacgatgggactgtgaagctctgggacctaaagactggggagttcattcgtaacttagtgacactcgagtccgggggatcagggggtgtggtatggagaatacgcgctagcaatactaaactcgtgtgtgctgtcggctctcggaacggcacagaggaaacaaagctactggttctggatttcgacgtcgacatgaaatag

SEQ ID NO: 222976 - DNA, 1596 bp, Artificial Sequence
  Description of Artificial Sequence: Synthetic coding sequence
atgctgttttttaaatgcatttcccttcttcttatctggttgattcccggtcaatccaccaccggactagtcccatgctccgctacaccgacgacattcggagatttacgcgcagccaacggccagggccagcagagacggagaatcaccagcgtgcagcctcccactggcctgcaggaatggctgaagatgttccagagttggagcggccctgaaaaactcttggccctggacgagttgattgactcttgcgagccaacacaagtgaagcatatgatgcaggttattgaaccccagttccagagggactttatctctctgcttcctaaagaactagcattatatgtgctttcctttctggagccaaaggacctgctccaggctgcacaaacctgtaggtattggcgtattctggcggaggacaacctcctgtggcgagagaagtgtaaagaggaggggattgacgaaccactacacatcaaacgaaggaaagtcattaagccaggttttatacatagcccatggaagagcgcgtatataaggcaacacaggatcgacacaaactggagaaggggcgaactcaagagcccaaaggtcctgaaggggcacgacgaccatgtgataacttgtctgcagttctgcggaaatcgaatcgtaagtggcagtgacgacaacacactgaaggtatggtctgccgtgactgggaaatgcctccggactctggtgggacacactggtggcgtttggtcctctcagatgagagataacattatcattagcggcagcaccgatagaacacttaaagtgtggaacgcagagactggggagtgcatccacaccttgtacggtcacacctccactgtccggtgtatgcatttgcatgagaagcgcgtggtctcaggcagtagagatgccacccttagggtgtgggatatcgagactggccagtgcctgcacgtactgatgggacacgtggccgcagttcggtgcgtacagtatgacgggaggcgtgtggttagcggggcttacgatttcatggtcaaggtgtgggaccccgagacagagacttgtctccacacactgcagggacataccaatcgagtgtatagtttgcaattcgacgggatccacgtcgtgtctgggtcattggatacctctattagagtctgggatgtagagacaggcaactgcatccacaccctgactggccatcagtccttgacgtccggcatggaactgaaagataacatcctagtgagcgggaacgcggatagtaccgtgaaaatctgggacatcaaaacggggcaatgcttgcagaccctgcagggacccaacaaacaccagagcgccgttacatgtctgcagtttaataaaaacttcgtcatcacttcctcagatgatggaacagtgaaactgtgggatctcaaaaccggcgagtttatccgcaatctcgtaaccctggaatcaggaggctccggcggagtcgtctggcgaattagggcaagtaacactaaactagtatgcgccgttggatcccgtaatggcacagaagagaccaaactcctggtcttagactttgacgtagacatgaaatag

SEQ ID NO: 222977 - DNA, 1797 bp, Artificial Sequence
  Description of Artificial Sequence: Synthetic coding sequence
atggacgattactcattggatgaatttaggaggcgctggcaggaggagctggcccaggcacaagccccaaagaagcgcaggaggcctgaggctgccgagcggcgtgcgaggcgacccgaggtgggatctggcaggggggaacaggccagcggcgaccccgcactggctcagcggctgctcgagggcgctgggagaccacctgccgctcgtgccactagagccgagggacaggacgtggcctctcgctcacgcagccccctggctagggagggagcgggtggcggagagcagctggtcgatcagttgatccgagacttgaacgagatgaacgacgttcctttctttgacatccagctgccctacgaactggcaattaatatctttcagtatctagatcgtaaagaactggggaggtgcgcacaggtctcgaagacatggaaggttatcgccgaggacgaagtcctttggtaccgtctgtgccagcaggaggggcacctcccagacagtagcatcagcgattactcatgctggaaactgatttttcaagaatgccgagctaaggagcatatgcttcggaccaactggaagaaccgcaagggagctgttagcgaactggaacacgtcccagatacagtgctgtgtgatgttcatagccacgatggagtggtgatagctggatacaccagcggcgacgttagagtgtgggacacacggacatgggactatgtcgccccttttctcgaatccgaggacgaggaggacgaacctgggatgcagcccaatgtgtcctttgtgcgaatcaattcttctttagcagtggccgcttatgaagacggcttcctcaatatttgggatctccggactgggaagtatccagtgcaccgtttcgagcacgacgctaggatacaggcacttgccctgagccaggacgatgctaccgtcgcaacggcaagcgctttcgatgtcgtgatgctctcccccaacgaggagggatattggcagatagccgcagagttcgaagtccctaagcttgtgcagtatctggagattgtgccggaaacaagacggtacccggtggcggtcgctgcggcaggtgatctaatgtacctgttgaaagccgaggattctgcaaggacccttctgtatgcccatggaccgcctgtgacgtgcctggacgtgagtgcgaaccaagtcgcgtttggcgttcaggggctgggatgggtgtacgaaggctccaagattctcgtgtacagtctggaagccggtcgtaggctgctgaagctgggcaacgttctccgggattttacatgcgtcaatcttagcgattctcctcctaatcttatggtgtcgggcaacatggatggaagggtccggattcacgacctgcgcagtggaaatattgccctgagcctctcagctcaccagctacgggtctctgctgtccaaatggacgactggaagatcgtgtcaggaggtgaagaagggctggtgtctgtgtgggattacaggatgaaccagaagctctgggaggtgtattccggacaccccgtgcaacatatttctttttcctcccactccctcattaccgccaacgttccgtatcaaactgtgatgaggaatgcagatttggatagctttacaacacacagacgacatcgcggactgattcgagcttacgaatttgcagtcgaccagctcgctttccagtcacctctccctgtgtgcagatccagctgtgacgccatggcaacccactattacgacctagctctcgctttcccatacaaccacgtctag

SEQ ID NO: 222978 - DNA, 1599 bp, Artificial Sequence
  Description of Artificial Sequence: Synthetic coding sequence
atggatgactactccctggacgaatttaggcggcgttggcaggaagagttggcgcaagcacaggccccaaaaaagcgccgtcggccagaggccgctgaaaggcgcgcacgcagaccagaaaacgagatgaatgacgttccttttttcgacatccagctgccatacgaactggctatcaacatctttcaatacctggatcggaaagagctcggcagatgtgcccaagtctccaagacttggaaggttattgctgaagacgaggtgctgtggtacagactgtgccagcaggagggacacttgcccgactcatctatctccgactactcatgttggaagttgatctttcaggaatgtcgtgccaaggagcatatgctccgcactaactggaagaatcggaaaggagccgtttcagaactcgagcatgtgccagacaccgtcctttgcgatgttcattctcacgacggcgtggttatcgcaggctataccagtggggatgttcgcgtgtgggatacacgaacttgggattatgtggctcccttccttgaaagtgaggacgaggaagatgagcctggcatgcagcccaacgtgagtttcgtgagaatcaattcaagcttggctgtcgcggcatacgaagacggctttctcaatatatgggatttaaggaccggtaagtatcccgtgcataggttcgagcatgatgccaggatacaggccctggccttatcacaggacgacgctacagtcgctaccgcctctgcgtttgatgtggtgatgctctcacctaatgaagagggctactggcagattgctgctgagtttgaggtgcccaagctagtccagtacttggaaatcgtgccagagaccaggaggtatcctgtggcagttgctgcggcaggggatctgatgtatctcctcaaagccgaggacagcgcgagaacgttactgtacgcccacggcccacctgtcacgtgtctggatgtttccgctaatcaggtcgccttcggcgtgcagggattgggctgggtgtatgagggatctaaaatcctggtgtattctctcgaggctggtcgcaggttgctcaaactgggcaacgtattacgcgattttacctgcgtcaacctgtcggactcccctcctaaccttatggtgtcagggaatatggacggccgtgtgagaatccatgatctgaggagcgggaacatcgccctgtccctgtccgcccaccagctaagagtgagtgctgtgcagatggacgattggaaaatagtaagcggcggtgaagaggggttagtgtctgtctgggactaccgaatgaatcagaagttgtgggaagtttatagtggacatcctgtgcagcacatttccttttccagccactctttgatcaccgcaaatgtaccctaccagacggtcatgagaaacgccgacctggatagttttacgacccataggaggcacaggggactgattcgggcttatgagtttgccgtcgaccagcttgcgtttcagagtccactgcccgtatgccgctcaagctgtgatgccatggctactcactattacgacctggccctcgccttcccatataatcacgtatag

SEQ ID NO: 222979 - DNA, 1599 bp, Artificial Sequence
  Description of Artificial Sequence: Synthetic coding sequence
atggatgactacagtctggatgagtttagacgcaggtggcaggaggaactggcacaggctcaggccccaaagaagcggaggcgcccagaagcagccgagcgtagagcgagacggccagaaaacgagatgaatgacgtccctttttttgacatccagttaccttacgagctggcaatcaatatatttcagtacctggataggaaagaactcggtcgctgcgcacaggtgtccaaaacctggaaagtgattgctgaggatgaagtactgtggtaccgcctatgccaacaagaagggcacctgcccgacagcagcatctctgactacagctgctggaaactgatttttcaggagtgtagggccaaggaacacatgctgcgaactaactggaagaaccggaaaggagcggtatcagaactcgaacatgtgcccgataccgtactgtgcgacgttcactctcatgatggagtggtcatcgccggttatacaagtggggacgtcagagtgtgggacacgcggacgtgggactatgtggcaccattcctcgaatccgaggacgaggaagatgaacccggtatgcaacccaatgtctctttcgtcaggatcaactcatccctggcagtcgcagcgtatgaagacggatttctgaacatctgggacctgcgaaccggcaagtatcctgtgcatcggtttgaacacgatgcaagaattcaagccctagccctttcacaagacgatgcgacagtggctactgcctctgctttcgacgtggtgatgctgtccccaaatgaggaagggtactggcagattgccgctgagtttgaagtaccaaagttggtacaataccttgagatcgtgccagaaacgagaagatatcctgttgctgtggccgcagctggggacctgatgtatctcctgaaggccgaggatagtgcaagaacccttttgtacgcccacgggccacctgtcacctgtcttgatgtgtctgcaaaccaggtcgcgtttggggttcaaggactgggctgggtgtatgaaggctctaaaatcttggtatacagcctagaggcaggacgacgattgttgaagttgggcaacgtgttgcgggatttcacttgtgtgaacctaagcgactctccccctaacttgatggtcagcgggaatatggatggccgtgtcaggatccacgaccttcgaagcgggaatattgccctgagcctcagcgctcaccagctccgcgtgtctgccgtgcagatggatgactggaaaatcgtttctggaggagaagaaggactggtaagcgtgtgggactatcggatgaatcaaaagctctgggaagtttactcggggcacccggtgcagcacatttccttctccagccacagtctgattaccgcaaatgtcccctatcagacagtgatgagaaatgccgaccttgatagctttacgacgcacaggcggcatagagggctcatccgtgcgtacgagttcgccgtagaccagctggccttccagtctccactccccgtgtgccgcagtagttgtgatgcaatggccacccattactacgacctggccctagccttcccttataatcacgtttag

SEQ ID NO: 222980 - DNA, 2871 bp, Artificial Sequence
  Description of Artificial Sequence: Synthetic coding sequence
atggaggccggagggctgccattggagctctggcggatgattctggcctacttacacttacccgatctgggcagatgctccctggtgtgcagggcttggtatgagctgatcctctcccttgattcaacccgctggcgccagctgtgcttgggctgcactgagtgccggcaccctaattggcctaatcagcccgacgttgagcctgagagttggcgcgaagctttcaaacagcactatctggcatctaagacctggacaaaaaacgcgcttgacctcgagtcgagcatttgcttttcattgttccgcagaagacgggagcggagaacgctgtccgtgggccctgggagagaattcgactccctcggcagtgcattggctatggccagtttgtatgataggattgtgctgttccccggagtgtacgaggagcagggggagatcatcctgaaagtgcctgtggaaattgtgggacaaggaaagttgggagaagtggcactcctcgcctctatagatcagcactgttctacgacacgcctgtgcaatcttgtgtttactcctgcgtggttctcccctatcatgtataagacaacatcaggccacgtccaattcgacaactgcaatttcgagaacggtcatatccaggtgcatggcccagggacctgccaagttaaattttgtacctttaaaaacactcacattttcctgcataatgtgccactgtgtgtgctggaaaattgtgagtttgttggatcagagaataatagcgtgacagttgaggggcaccccagcgcagataagaactgggcatacaaatacctcctcggcctcatcaaatcatcaccgactttcctccctacagaagattcagacttcttgatgtcgctggatttagaatcccgagaccaggcctggtctcccaaaacgtgcgatattgtaattgagggatctcagtcgcctacctcaccagctagtagcagccccaagccaggctccaaggcgggatctcaagaggctgaagttggatctgatggggagagagtggcccagacaccagactcaagcgatggtgggctatctcccagtggagaggacgaagatgaagatcaattaatgtacaggctgtcataccaggttcagggtcctagacccgtgttgggaggttccttcctcggcccaccgctgcctggcgctagcattcagctgccttcttgtctggttcttaattcgcttcagcaggaacttcagaaagacaaagaagctatggccttggcaaatagtgttcaggggtgcttgatcaggaagtgcctcttccgtgacgggaaaggtggtgtgtttgtctgtagccatgggagggcaaaaatggagggaaatatcttcagaaacctgacatacgcggttcgctgcatccacaactccaaaatcattatgttgcgaaatgatatctataggtgcagagcctcaggcatctttcttcgcttagaggggggtggcttaatcgctggaaataacatctatcataatgccgaagcaggtgtcgacattcggaaaaaatcaaacccactgatcttgtgcaaccagattcatcatggcttaaggtccggcattgttgtactaggtaacggaaaaggtattatcaggaataaccaaatcttctcaaacaaggaggctggaatctacattctctatcatgggaaccccgtagtgtccgggaaccacatcttcaagggaagagctgccggaatagctgtgaacgagaatgggaagggcctcatcaccgagaacgtaatacgtgagaatcaatgggggggtgtcgacatccgaagaggcggaatcccagtcctgagaagcaacttaatttgcttcgggtattctgacggtgtggtggtgggcgatgagggaaagggactgattgaaggaaatacaatttatgcaaacaagggttgtggtgtgtggatgatgagctcctctctcccacatgttacctccaaccacgtgtcctataatggcctgtacggagtcgctgtgttcagccagaaagatgggagtagtgagctgccgaggggacaccgggctcaagaaaacttctcggaagacggagatgctatcctctgggagactgaattggaaaaggaggatgaccctttgaggcgcccaattactattgcgctggttgaatcaaattccatcaaccataatggcgcaagtggtctatatgtacagtcaagcgaggcgctccatgtaattactaacgttattcacgcaaacggtgacagagggatcacagtggcccaaagcagtcagccaaccagagtcgcaaacaattcaatctcttgtaaccgacagagcggtgtgaaggtggaagcccagtgcaaagtggaactgcgcggaaacggtatttacgataatagaggccacggaattattactaaaggtgacagcacaatagtgattgagaacgatattattggtaaccgtggctctggtcttcagctcctccctagaagcgacaccaaagtaatcaaaaacaggatccattctttccgtgcctacggaatcgcagttcgcggtagagctaaagctctcgtgcaggagaacattattttccaggggaagacctctaagaccatcttccagcaaattagcaataacagggagtgcatcatgcagaataacaaattcctcgtttttaagaaaaagtccgacacctggcgtctggtcaatcctcccgcaagaccccatctggagaactcactgcgcaggccttccgccgctcataatggacagaaggtcactgccatggctaccagaatcactgcgagagtggaaggtgggtatcacagtaacagatctgtgttttgcacaatcctgtag

SEQ ID NO: 222981 - DNA, 216 bp, Artificial Sequence
  Description of Artificial Sequence: Synthetic coding sequence
atggaagccggtgggctgcccctggagctctggcgcatgattcttgcctacctacacctacccgacctgggtcgctgctccctggtctgtagggcatggtacgaacttattctcagccttgattctaccagatggagacagctatgcctggggtgcacagaatgtcgccaccccaactggcctaaccagcccgatgtcgaacccgaaagttggtag

SEQ ID NO: 222982 - DNA, 1446 bp, Artificial Sequence
  Description of Artificial Sequence: Synthetic coding sequence
atgctccgaaacgacatttacagatgcagggcatccgggatctttcttaggcttgagggaggtgggctgattgccggaaataacatttaccataacgccgaggccggagtggatatccggaagaagtcaaaccccctgatactctgtaaccagattcatcacggactgcgatccgggatcgtagtattgggcaatggaaaaggtattatcagaaataatcagattttcagtaataaggaagctgggatatatattctgtaccatggcaatcccgtggtaagcggcaaccatatcttcaaggggagggctgccggtatcgcagtcaatgaaaatggcaaggggcttatcacggagaacgtgatccgtgaaaatcagtgggggggagtcgacataaggaggggcggtatcccagtgcttcgtagtaacctgatttgcttcggctattcagacggggtcgtagtgggcgatgaaggcaagggccttatcgaaggtaacacgatttacgcaaataaggggtgcggggtgtggatgatgtccagctccctcccgcacgtgacatcaaaccatgtgagttacaacgggctatatggggtcgcagtgttttcacagaaggatggaagcagcgagcttcctagaggccatagggcccaggagaatttctctgaagacggtgacgccatactctgggagacagagctggagaaagaagacgatcctttaagaaggcccatcactatcgccctggtggagtcaaactctatcaaccacaacggggcttctgggctgtatgttcagtctagcgaagctctgcacgtgatcaccaatgtaatccatgcaaacggagatcggggaattactgtcgcccaaagcagtcaacccacaagagtggccaacaatagcatctcctgcaatagacagtcaggagtcaaggtggaagcccagtgcaaggtcgagctgcgagggaacggaatctacgataaccgcggtcatggtatcatcactaagggtgacagcaccatcgttatcgagaacgatatcatcgggaatcgcggttcaggcctccagcttctgccgcgttcagacaccaaggtgataaagaaccggattcacagcttccgggcttatggcatcgcggtgcgcggacgggcaaaggcactggtgcaggagaacataatcttccagggcaaaaccagtaagacaatatttcagcagatctccaataatagggagtgtatcatgcaaaacaataagttcctggtgttcaaaaaaaagtctgacacctggcggctcgtcaatccacccgcacggccacatttggagaacagcctacggagacctagtgctgctcacaacgggcagaaggtcactgccatggctactaggataaccgcacgcgtggagggtgggtaccactccaatcggagtgtgttctgtacgattctctag

SEQ ID NO: 222983 - DNA, 2532 bp, Artificial Sequence
  Description of Artificial Sequence: Synthetic coding sequence
atggtcgccgaagaatcaggccctggcgcacagaactcgccatatcagctgagaaggaaaacgttgctgcccaaacgcaccgcttgtccaacaaagaactctatggagggtgcctccaccagtaccacagaaaacttcggccatcgcgctaagcgcgctcgtgtaagtgggaagtcccaggacctgtcggctgcccctgcagaacagtatttgcaagaaaagttgcccgacgaagtggttctcaaaattttcagctatctccttgagcaggacctgtgcagagctgcatgcgtgtgcaaaaggttcagcgagttggctaacgatccaattctatggaaacgactttatatggaagtatttgagtatacaaggccaatgatgcatcccgagcccggtaagttttatcagatcaatcccgaagagtatgaacaccccaacccctggaaggagagcttccagcagctctacaagggcgcacacgttaaacccggatttgccgaacacttctatagtaatcccgcacgctacaaagggagggaaaatatgttgtactatgacaccattgaggacgcacttggcggtgtgcaggaggcacattttgacggactaatctttgtacattctggaatctatactgatgaatggatctatattgaatccccaatcaccatgatcggcgcagcacccggaaaagtggccgataaggtgattattgagaacacacgggactccacattcgtgttcatggaggggtccgaggatgcctacgtcggttatatgacaatccggtttaatcccgatgacaaatctgcgcagcaccataatgcccaccactgcctagagatcactgtgaattgcagccctattatagaccactgtattattcgatcgacctgcacagtcggctccgccgtttgtgtctccggtcagggtgcttgccctactatcaagcactgtaatatctctgactgcgaaaacgtgggcctgtacataacagaccacgctcagggtatctacgaggataacgagatcagcaacaatgccctcgctggtatatgggtcaagaaccatggcaacccgatcattcggagaaatcatatccaccacggcagagatgtgggcgtctttacgtttgaccacgggatgggatatttcgagagttgcaatatacaccggaaccggatagccggattcgaggtcaaagcctatgccaatcccacagtcgtgagatgtgaaattcatcacggccagaccgggggaatctacgtgcatgagaaaggcagaggacagtttatcgaaaataagatctacgctaataattttgctggagtttggattaccagcaacagcgatcctaccatcaggggtaattccatattcaacgggaaccagggcggagtttacatcttcggcgacggacgcggtcttatagaaggcaatgatatctatggtaacgccctggctggcatccaaattcgtacaaactcctgccccatagtgagacacaataaaatccacgacggccagcatggtggcatctatgttcacgagaaagggcagggcgttattgaagagaatgaagtttactctaataccctggctggagtgtgggtgactaccggatctacgcccgtcctacgcaggaaccgtattcattcagggaagcaggtgggtgtctacttctatgacaatgggcatggagtcctcgaggacaacgacatttacaatcatatgtactcaggcgtacagatcaggactggcagtaaccctaagatcagacgcaacaagatttggggagggcagaacggcggtatattggtttacaactcaggccttggatgtattgaggataacgagatcttcgacaatgccatggccggagtgtggatcaagaccgactctaaccctaccctaaggagaaataaaatacacgatggcagggacgggggtatctgcatcttcaacgggggacggggtcttcttgaagagaacgacatcttccggaatgcacaggctggagtactgatctccacaaacagtcacccaatactgaggaagaaccgcatcttcgacggcttcgcagctggaatagaaatcactaaccatgctactgcgacgctagaagggaaccagattttcaataatagattcggcggactgtttctggcaagcggcgtaaatgtcaccatgaaggataataagattatgaacaatcaggatgctatagagaaggcagtgagtaggggtcaatgtctgtacaaaatttcatcctacacgagctatccaatgcacgatttctatagatgtcacacctgcaatacaactgatagaaatgcgatatgcgtgaattgtataaaaaagtgtcatcagggccatgatgtcgagtttatccggcatgacaggtttttttgtgattgcggggcaggcaccctgagtaacccttgcaccctcgctggggagccaacccacgatactgataccctgtacgatagtgccccacctatcgaatcaaacacacttcagcataattag

SEQ ID NO: 222984 - DNA, 282 bp, Artificial Sequence
  Description of Artificial Sequence: Synthetic coding sequence
atggagggtgcctccaccagtacgactgagaattttggtcatagggccaagagagctcgagtttctgggaaaagccaggacttatcggcagctcctgccgaacagtacctccaggaaaagctgcccgatgaagtggtgctgaagattttcagctacctccttgaacaggacctttgccgggcagcttgtgtgtgtaagcgcttcagtgaacttgccaacgatcccattctttggctgggggaggttgcccatgcctacaacccttctacattaggagggtag

SEQ ID NO: 222985 - DNA, 2532 bp, Artificial Sequence
  Description of Artificial Sequence: Synthetic coding sequence
atggtggccgaggagagcggaccaggcgcacagaatagtccttaccagctgaggaggaagacactgctgcccaagcgaacagcctgtcccaccaagaatagcatggaaggtgcttccacctcaaccaccgaaaattttggtcatagagccaagagggcacgggtcagcggaaagagtcaggatctgtccgccgctccagcagaacagtacctccaggaaaaactacccgacgaggtggtgttaaagattttcagctatctgcttgaacaggacctttgtcgagctgcttgcgtctgcaaaaggttcagtgagctggccaacgacccaattctgtggaaaaggctgtatatggaggtctttgaatataccaggccaatgatgcatccagaacccggtaagttctatcagatcaatccagaggagtacgagcacccaaacccttggaaagaaagttttcaacagctgtataagggcgcacatgtaaagccaggatttgcggagcatttctattctaatccagcgagatataaaggacgagaaaacatgctctactacgatactatcgaagacgctctcggcggagtgcaagaggcacatttcgacggccttatctttgtgcacagcgggatttacactgatgagtggatttatattgagtcacctattactatgatcggcgctgcccctggcaaggtcgcagataaggtgatcattgagaacaccagagactctacttttgtcttcatggaagggtctgaagatgcctacgtggggtacatgaccattcggttcaacccagatgacaaatccgctcagcatcacaacgcccaccattgcctggaaatcactgtgaactgttctcctatcatcgatcactgtattatccgcagcacttgcacagtgggatcagctgtgtgcgtctccggacaaggagcctgtccaacaattaagcattgcaatattagcgactgcgagaacgtcggcctttacattacagatcacgctcagggcatttacgaggacaatgagatatcgaataatgccctggctgggatttgggtcaaaaaccacggcaacccaattatcagacgtaatcacattcaccatgggagggacgttggagtgttcacctttgaccatgggatgggctactttgaaagttgcaacatccaccgcaatagaatcgccggtttcgaagttaaagcttatgccaacccaaccgttgtgagatgcgaaatacatcacgggcaaacaggaggaatttatgtgcatgaaaaaggtagaggccagttcatagaaaacaaaatttacgcaaataacttcgcaggggtgtggatcacaagcaacagcgacccaacgattcgcggtaactcaattttcaatgggaatcagggcggagtgtatatctttggcgacggtcggggtttaatcgaaggaaatgacatttacgggaacgcattggctggtatccagattaggacaaattcttgtccaattgtgcgccacaataagatacacgatggccaacatggtggtatttatgtccatgagaaagggcagggcgtcatcgaagagaatgaggtgtattcaaatactctggccggagtatgggttacaactggttcaacaccggtgttacgacggaataggatacacagcgggaaacaggtgggcgtttacttttacgacaacggccacggagtcctggaggataatgacatctacaaccatatgtacagcggcgttcagattcgaactggaagcaaccctaagattcgtcgtaataagatctggggcggtcagaacggcggaatcctggtgtacaactccggccttgggtgtatagaggataatgaaatttttgacaatgccatggccggtgtttggattaagactgactccaatcccacgctgcggagaaataaaattcacgatggcagagacggcggtatatgcatctttaatggaggccgagggctgctagaagaaaatgatatctttaggaatgcacaggccggtgtcctgatatcaactaactcacacccaatcctgaggaagaatcggatcttcgacgggtttgctgccggtatcgagatcaccaatcatgccaccgcaactctcgaaggtaatcagatctttaacaataggttcggcggattgttcctcgcatcaggcgtcaatgtcactatgaaggataacaaaatcatgaacaatcaggatgcgattgaaaaggctgtttcaaggggacagtgcctatacaaaatatcctcctatactagttatcctatgcatgacttctaccggtgccacacctgtaacactactgaccggaacgcaatctgcgtgaattgtataaagaagtgccatcagggtcacgatgtcgagtttatacgccatgatcggttcttttgtgattgcggggctggcacacttagcaatccctgcacccttgcaggtgagcctacacatgacactgacaccctctacgattccgcacctcccatcgagagcaacaccctgcagcacaattag

SEQ ID NO: 222986 - DNA, 2784 bp, Artificial Sequence
  Description of Artificial Sequence: Synthetic coding sequence
atgaactctgtcagggcagccaaccgcaggcccaggcgagtctcccggccacgccctgttcagcagcagcagcagcagcctccccagcagccacccccacagccgcctcaacagcagccaccccagcagcagccaccccctccgccacagcagcaacagcaacagcaacccccaccgccaccccctcctcctccccctttgccacaggaaagaaacaatgtcggtgagcgggatgatgatgtcccagcagacatggtggccgaggaatcaggcccaggcgctcaaaattccccttaccaactgcgcaggaaaactctgctgcctaagaggaccgcttgtcccactaaaaattcaatggaaggcgctagcacaagtaccactgagaatttcggccatcgtgcgaagagggcacgggtgtccggtaagtcacaggatttatcagcagctccagcggaacagtacctgcaggagaagctgccagatgaggtcgttcttaaaatcttttcatatttgctggagcaagacttgtgtagagccgcatgtgtctgcaagaggttcagtgagctcgctaatgatccaatactgtggaaaaggctgtatatggaggtgttcgagtacacccggccaatgatgcacccagagccaggcaagttctatcagatcaacccagaagaatatgaacaccctaatccctggaaggaatctttccagcagctctacaagggggctcacgtaaaaccaggcttcgcagaacatttctattccaatcctgccagatacaagggtcgcgaaaatatgttatactatgacactatagaggatgccctgggcggtgtgcaggaggcccatttcgatgggctcatatttgtacactctggcatttacaccgacgaatggatatacattgaatctccaatcaccatgatcggtgccgctcctggtaaggtcgccgataaggtcatcatcgagaacaccagggactcaacatttgtgtttatggaagggagtgaagatgcatacgtggggtatatgaccatcagattcaatcctgacgataagtctgcccagcatcataatgctcaccactgtttggaaattactgtaaactgtagtcctatcatcgaccattgcattatacgcagcacatgtaccgtagggtcagctgtgtgtgtatccggtcaaggcgcatgccctactataaaacactgtaacatcagcgactgcgaaaatgtgggtctgtacattaccgaccatgctcaaggcatttacgaggataacgaaattagtaataacgctttggccggaatctgggtcaagaaccacgggaaccccattatcagaaggaaccacatccatcatgggagagacgtaggagtcttcacattcgaccacgggatggggtacttcgaatcttgcaacatacatcggaatagaatcgctggcttcgaggtgaaggcctatgcgaatccaacagtcgtgcgatgcgaaattcatcacggccagacggggggtatatacgtgcacgagaaggggagaggccagtttatcgagaataaaatttacgccaacaactttgctggagtatggattacgtccaactccgaccctacgataagagggaactccatcttcaatggtaaccaaggcggtgtttacattttcggcgacggaaggggactgattgaaggaaacgacatttacggaaacgccctagcaggcatacagattcgaacgaatagctgccctatcgtgcggcacaacaagattcacgacggccaacacgggggaatctacgtgcacgagaaagggcagggcgtcatcgaggagaacgaggtgtatagtaacactctggccggtgtttgggtcaccacaggcagcaccccagtactaaggagaaaccgcattcactccggtaagcaggtgggagtctacttctatgacaatggccacggggtactcgaggataacgacatatacaatcacatgtatagcggagtgcagattcggactggcagcaatcccaaaattcgcagaaataagatatgggggggacagaacgggggtattttagtatataattctggcctcggctgcattgaagataacgagatcttcgacaacgctatggcaggcgtctggatcaagactgactctaacccaactctgcgcaggaacaaaattcacgatggtcgtgacggtgggatatgtattttcaacggaggacgtggattgctggaggaaaatgatatttttaggaacgcacaggcgggtgttctcatttctacaaacagccatcctatactcagaaaaaacaggatatttgacggattcgcagccggaatcgaaatcaccaaccatgccaccgccaccctggaggggaaccagatttttaataaccggttcggaggcctattcctcgcctccggtgtcaatgtgacaatgaaggataacaagatcatgaacaaccaggacgccatcgagaaggctgtttcacggggtcagtgcctgtacaagatcagttcttacacctcctatccgatgcacgacttctaccggtgtcatacatgtaatacgacagatcgcaacgcaatttgcgtgaattgcatcaagaaatgtcaccaggggcatgatgttgagttcatccggcatgaccgctttttttgtgactgcggagccggtacattgtccaacccatgcaccctggcgggagagccgacccacgacacagacaccctctacgatagcgctccaccaattgagtccaatacactgcagcacaactag

SEQ ID NO: 222987 - DNA, 1056 bp, Artificial Sequence
  Description of Artificial Sequence: Synthetic coding sequence
atggagatcaaggaagagtttacgtcgctggttatggacgaggccctactgaaggaaatgactttcatgcacgagaagggacagggtgtcattgaagagaatgaggtatactctaatactctagccggagtttgggttactactgggtcaacccctgtgctgagaagaaaccggatccactccggcaagcaagtgggagtgtacttttacgacaacggtcatggcgtgctggaagacaacgatatctacaatcatatgtactccggagtccagatccggaccggctcaaatcccaagatccgcaggaacaaaatctggggcggtcaaaatggcggtatcctggtgtacaacagcggactgggttgcattgaggacaacgagatttttgacaacgccatggctggcgtttggataaagacggattcaaatcccactctcagaaggaacaagattcatgacggccgagatgggggtatctgtatcttcaacgggggacgaggactcctggaagaaaatgacatattcagaaacgctcaggccggtgtgctgatatctaccaactcgcatccaatcctgaggaagaatcgcatcttcgatggattcgccgctgggattgagatcacaaatcatgctactgccaccctggaaggcaaccagatcttcaataaccgcttcgggggtttgttcctggctagcggggtgaacgttaccatgaaagataacaaaataatgaataaccaggacgcaatagagaaggcagtgtcacgcggtcagtgtctctataaaatctcctcttatacatcatacccaatgcatgacttctaccgctgccatacatgtaacaccaccgatcgtaacgccatttgtgtaaattgcatcaaaaaatgccaccaggggcatgatgtcgagtttatccggcatgaccgattcttttgcgattgcggcgctgggacattatctaatccctgtaccttagctggggagcctacacatgatacggacaccctatacgacagtgctccacccatagagtccaacaccctgcagcataattag

SEQ ID NO: 222988 - DNA, 1305 bp, Artificial Sequence
  Description of Artificial Sequence: Synthetic coding sequence
atgccatccgaaatcttactcaagatcttcagttatctagacgccgtcagtttactctgtaccggctgcgtgagccgcaggttttatcatttggccaacgacaacttcatctggattgggatatacagcacagccttctctccggcacgatccaactggaagttcaactcagttgagaaaatcgccatgtctatgagcttcttaagcgttcaggataaagaagccggatactggaagaaagagtacattactaagcaaatcgcatctgtgaaggccgctctggcagatatactaaaacccgtcaacccctacaccggtttgccagtgaagaccaaagaagcactaagaatcttcggcctggggtgggccatcatattgaaggagaaaggtgggaaagagtatatcatggagcatgtggatttgagcattaacgatacgagtgttacagtgatatggtacggtaagaagtggccctgtcttgccagtctatctacactggacttatgtggcatgactccggttttcactgactggtacaaaaccccaaccaagcatagacttcggtggcactccctgattgcgaaatataacctctcccacctgacaatcagcacaatgattggttgcgataggctgattaggattttctgcctccaccccggtctgctggtcggcgtatggaaaaaggaagaggaactggcgtttgttatggcgaatctccatttccaccacctggtggagagaagcactctcggcagcgccacgatcccctacgaacttcctccacacagcccctttttggatgattcccccgagtacggactgcacggataccagctccatgttgaccttcacagcggaggggtattctacctctgcggcacatttcggaatctgtttaccaaaaggggaaatattgagaatggccacgtgaagctgatcgtgatccacctcaaaaataaccgagaacacctgcccttaatcggaaaggtggggctgtcctggaaaactgatatctttgacggttgcatcaaaagctgcagcatgatggacgtgaccttactggatgagcatggaaagccattttggtgtttttctagcccagtttgcttaagatcccctgcaacaccttccgacagctcttcattcctcgggcagacttacaacgtcgattacgtcgatgccgagggcagagtccatgtcgagctggtgtggataagagagacagaggagtatctgattgttaatctggtattgtatttgtcaattgccaaaatcaatcactggtttggcacagagtactag

SEQ ID NO: 222989 - DNA, 1533 bp, Artificial Sequence
  Description of Artificial Sequence: Synthetic coding sequence
atggcaactgggagaggtaggattctgcagcaacattggttagggctccagacacttaggggtccgtctcgcggagggggtgccgctaggggccgagctagggccttcggatgtcgcaagggtcccggagtgaagctgagcgcaggcagtgctgcgctgaggtgccacgccggaggtggccaacactgggagtctagcttcagctgttgttctggctttctggacggaatgccatccgagattctgctgaaaatattttcctatctggacgcagtgagccttctgtgcactggctgcgtgagtaggcgcttctaccatctggccaatgataattttatctggatcggaatatacagtaccgcttttagcccggctaggtctaattggaaatttaattccgtagagaagattgccatgagcatgtcattcctgtctgtacaagataaggaggctggctattggaaaaaggaatatatcaccaaacagatagcgagcgtaaaagcggctttagccgatatcctgaaacctgtgaacccatacaccggtctcccggtaaagactaaggaagccttaagaatatttggattaggttgggcaataattctgaaagagaagggaggcaaagagtatattatggagcacgtggacctttctatcaatgacactagcgttaccgtgatttggtacggaaagaaatggccctgtctagcttccctatctacacttgacctgtgtggcatgaccccagtgtttacagactggtacaaaaccccaacaaagcacagactccgctggcattcccttatcgctaagtacaatctctctcacctcacaatcagcacaatgatcggttgtgacaggctgattaggatcttttgtctccatccagggctgttagtcggcgtgtggaaaaaagaagaagagctggccttcgttatggctaatctgcactttcaccaccttgttgagcgatccaccctcggttctgccacaataccctacgagctccctccacacagtcctttcttggacgactccccagaatatggcctgcatggatatcagttgcacgttgaccttcactctggcggtgtcttctacctttgcggcactttccgcaaccttttcactaagcgcggtaatatcgaaaacggccatgtcaagctgatagtcatccatttgaaaaacaaccgcgagcacctccctcttatcggtaaagtcgggctgtcctggaagacagatattttcgatggctgtataaaatcctgctccatgatggacgttaccctattagacgagcatggtaagcccttctggtgctttagctctcctgtttgcctgagaagtcccgcaaccccctctgactcgagtagcttcctgggccaaacctacaatgtcgattacgtagatgccgaggggagggtgcatgtggaattggtttggattcgggagaccgaagaatatttaattgtcaacctcgttctctacttgagtattgctaagataaaccattggttcggaaccgagtattag

SEQ ID NO: 222990 - DNA, 879 bp, Artificial Sequence
  Description of Artificial Sequence: Synthetic coding sequence
atgatggcattcgcaccaccaaaaaatacggacggcccaaaaatgcagaccaagatgagcacatggacccctctcaaccaccaactgctgaatgatagggttttcgaagagagaagagcattactggggaaatggtttgataagtggaccgactcacagcggaggcgcatcctgaccgggctgctggagcgttgttccctgtctcagcagaaattttgttgcagaaagctgcaggagaaaataccggcagaagcgctcgactttacaaccaagctacctagagtgctctccctttatatcttttctttcctggatcccagatctctgtgccgctgtgctcaggtgtgctggcactggaagaatctcgccgaattagatcaactgtggatgctcaagtgtctgcgattcaactggtatatcaacttctcccctactccttttgagcagggcatatggaagaagcactatatacagatggtcaaggaactccacatcacaaaacctaagaccccaccgaaggacggatttgtgatcgcggacgtgcagctggtcacgtctaactctcctgaagagaaacagagcccccttagcgccttccgtagttctagctctttacggaagaagaacaacagcggagagaaagcactgcccccatggaggtctagcgacaaacacccgaccgacattattcgatttaattacctggacaacagggaccccatggagactgtccaacaggggaggagaaaaagaaatcaaatgacacctgatttctctcgccaaagtcacgataaaaaaaataagctccaggatcgcacccgattgcgcaaagctcagtcaatgatgagtcgcaggaaccctttccccctgtgcccatag

SEQ ID NO: 222991 - DNA, 891 bp, Artificial Sequence
  Description of Artificial Sequence: Synthetic coding sequence
atggacggagatggggatccggaaagtgtggggcagcctgaggaggcctctcccgaggaacagcccgaggaggcgtcagcagaagaggaaagacccgaggatcaacaggaggaggaggccgcagcagcagctgcctatctcgatgaacttcccgagccgttgctgctaagagtcttggcggctctgcctgccgcagagctggtgcaggcttgccgcttggtgtgcctccggtggaaggaactagtagacggcgcacctctgtggttgcttaagtgtcagcaggaaggcctcgtgcctgagggaggggtcgaggaagagagagaccactggcagcagttttactttctgtcgaagcgacggagaaacttgctcaggaacccctgcggggaggaggacttggaaggctggtgcgacgttgagcatggaggcgacggctggagagtggaggagctgccaggagattccggagttgagtttactcacgatgagagcgttaagaagtattttgccagtagcttcgaatggtgccgaaaggcacaggtgatcgatcttcaggccgagggatactgggaggaacttctggacaccacgcaaccggcaatagtggttaaagattggtatagcggcaggagcgacgctggatgtctctacgagttaactgtgaaactgttgagcgagcatgagaatgtcttggccgaattctcctctgggcaggtggctgttccccaggattccgatgggggtggctggatggaaatttctcacactttcacagattacggcccaggcgtgagattcgtgcgctttgagcatgggggacaggatagcgtttattggaaaggctggttcggggcacgcgtcaccaattcaagcgtttgggtcgagccatag

SEQ ID NO: 222992 - DNA, 594 bp, Artificial Sequence
  Description of Artificial Sequence: Synthetic coding sequence
atggacggggatggcgaccctgagagtgtgggccagccagaagaagcatctccggaggagcagcctgaagaggcttcagcagaagaggagcgccctgaggaccaacaggaggaggaggcagctgctgctgccgcttaccttgatgaattgcctgaacccctgctgctccgtgtgctggccgcattaccagccgcagagttggtgcaggcttgcaggctggtgtgcctgagatggaaggaattagtggacggtgcccctttgtggctcctcaagtgccagcaggagggattagtccccgaggggggagtcgaggaagaacgggaccattggcaacagttttattttctcagcaagcggagacgcaacctactgaggaacccctgcggtgaggaggacttagaaggatggtgtgacgtggagcatggcggtgacggctggagggttgaggagctgccaggcgattcaggtgtcgagtttacccacgacgagagtgcaccagtcttacctggaggtgtggctaagcatagaggactgttgggcggagctgctggtcacgactctgcagggcatcggggagaaggtctggtcagatag

SEQ ID NO: 222993 - DNA, 1614 bp, Artificial Sequence
  Description of Artificial Sequence: Synthetic coding sequence
atgaagcattactctcccaccgactacgttaattggctcgaagaatacaaagtgcgtcagaaagcaggcttagaagctagaaaaattgtcgcaagtttcagcaagaggtttttctcagagcacgtaccttgcaacggattctcggacatcgaaaatcttgagggcccagaaattttcttcgaagatgaactcgtttgtatccttaacatggaaggtcggaaggctttgacctggaagtactatgccaaaaagatcctgtattacctccggcaacagaaaatactgaataatctgaaggccttcttgcagcagccggacgactacgagagctacttggaaggggctgtatatatcgatcagtactgcaacccattaagcgatattagcctgaaggatattcaggctcagatcgactccattgtagagcttgtctgcaaaacgctgagaggtattaatagccggcatcccagccttgcattcaaagctggtgaatcctccatgataatggaaatcgagttacagtcccaggtcctggacgccatgaattacgttctgtacgaccagcttaagttcaaaggaaaccgcatggactattataatgcacttaacctgtacatgcaccaagtgctcatcaggagaacaggaattcctatcagtatgtctcttctatatcttaccattgctcgacagctaggcgtgccactggagcctgtgaactttccctcccacttcctgctgaggtggtgccagggtgccgaaggcgctaccctggatatattcgattatatctatatagatgcctttggaaagggtaagcagttaacagtgaaggagtgtgaatatttgataggtcagcacgttaccgccgctctgtatggtgtagtcaacgtgaaaaaggtccttcaacgaatggtcggaaatcttctcagcctgggcaagcgagaagggatcgatcaatcctaccaactactccgagattccctcgacctctacctggctatgtaccccgatcaagtgcagctacttttgctacaagcccgtctctatttccacttgggcatctggcccgagaaagtgcttgacatcctgcagcacatccagacactggatccaggacagcacggtgccgtagggtatttggtgcagcacacgcttgagcacatcgaacgcaagaaggaagaggtcggcgtggaagtgaaactccggagcgatgagaaacaccgtgacgtctgctattcaatcggactgattatgaagcacaagcgctatggctacaactgcgtgatttacgggtgggatccgacctgtatgatgggacatgagtggattcgaaacatgaatgtccactcccttcctcatggccaccaccagccattttataatgtcctggtggaggacggctcatgtcgctacgcagcgcaggagaatttggagtataatgtcgagccgcaggaaatctcacatcccgatgttggaaggtacttttcggaattcacaggcacacactacattcctaacgctgaacttgagatcaggtaccccgaagacctggagtttgtgtatgagactgtacagaacatctactctgcgaagaaggagaatattgacgagtag

SEQ ID NO: 222994 - DNA, 1887 bp, Artificial Sequence
  Description of Artificial Sequence: Synthetic coding sequence
atggccgcagccgcagtggacagcgccatggaagtcgtgccagccttagcggaggaggcggctcctgaggttgctggtctgtcatgccttgttaatctgcctggagaagttttggagtacattctgtgctgtggaagtttaacagcggcagacattgggagggtgtcttccacctgtagacgactccgagagctttgccagagctcagggaaggtttggaaggaacagttccgggtgagatggccaagtttgatgaagcattattcccccacggattacgtgaattggctcgaagagtacaaggttcgccagaaggctggcctggaagcccgaaaaatagttgcttctttttctaaacggttctttagtgaacacgtcccgtgtaacggcttctccgacatcgaaaacctggagggccctgagatcttctttgaggatgaactggtgtgcattttaaacatggaaggccgtaaagcccttacctggaagtactacgccaagaagatactgtactacttaaggcagcagaaaatactgaacaatcttaaggcgtttctacagcagcccgacgattacgaatcttaccttgagggcgcagtgtatattgaccagtattgtaatccgctctccgacatttcactgaaagatatccaggcccaaatcgattctattgtagaactcgtatgcaaaactctgcggggtatcaattcacggcatccgagcctggcttttaaggcaggcgaaagctcaatgatcatggagattgagcttcagtctcaagtgttagatgccatgaactacgtgttatacgatcagttaaagtttaagggaaacaggatggattactacaatgctctgaatttatatatgcatcaggtgctcatccgcagaacaggcatacccatttcaatgagtctgttgtatttaaccattgcacggcagctgggggtaccacttgagccggtcaacttccctagccactttcttctgaggtggtgtcaaggtgctgaaggcgctacgctagacatttttgactacatatacatagacgcgtttggcaaggggaagcaactcaccgttaaagagtgcgaatacttaatcggccaacatgttacagctgcgctgtacggtgttgtgaatgtgaaaaaggttctgcagcgtatggtcggtaaccttctctctttgggcaagagggaaggcatcgatcagagctaccagcttttgagagacagcctcgatctttacttggccatgtacccagaccaggtgcagctgctactgctgcaggccagactctattttcacctgggtatctggcctgagaagtcattctgcctcgtcttgaaggtcttagatatcctgcagcatatccaaaccctggatccaggccaacacggcgcagtgggatacctggtgcagcatacgctcgagcatattgaacggaagaaggaggaggtcggtgtggaggtaaaattaagaagcgacgaaaaacaccgcgatgtgtgttactctatcggacttatcatgaaacacaagcgttacggctacaattgtgtaatctatgggtgggaccctacttgcatgatgggccatgaatggatccgcaatatgaacgtgcacagcctgccacacgggcaccatcagccattttacaatgtcttggtagaggatgggtcatgccggtatgccgcacaggagaaccttgagtacaatgtggaaccccaggaaatttcccatccagatgtcgggagatatttttccgagttcaccgggactcactatatccccaacgccgagctcgaaatcaggtacccggaggatcttgagtttgtgtatgaaactgtgcaaaatatatacagcgccaaaaaagagaacattgacgagtag

SEQ ID NO: 222995 - DNA, 1866 bp, Artificial Sequence
  Description of Artificial Sequence: Synthetic coding sequence
atggcagctgccgcagtggattcagccatggaagtggtgcccgctttagcagaggaggcagctccggaggtggccggactttcatgcctggtgaacttgccaggtgaagtactggaatacattttatgctgtggaagtctgaccgccgctgacattggcagggtgtcctccacatgccgcaggcttagggaactttgccaatccagcggaaaagtttggaaagaacagttcagagtgcggtggccctctctcatgaaacactatagtcctacagactatgtcaattggctagaggaatataaggtgcggcaaaaagccggattggaggccaggaagatcgtcgcctcattctcaaagcgttttttcagcgaacacgtgccctgcaacgggttcagcgatatcgaaaatctggaaggacctgagattttcttcgaggacgagctagtctgtatcctgaacatggaaggcaggaaagctctgacctggaagtactatgcgaagaagatcctgtattacctacgccaacagaagattctaaacaatctgaaggcattcctccagcaacccgatgactacgaaagttatctcgaaggtgctgtctatatagaccagtactgcaatccactgtcagacatttctctcaaagatatacaggcccagatcgactcaattgtggagctcgtgtgtaagacactgagaggtattaacagcagacacccgagtctggcttttaaggctggtgagagctccatgataatggagatcgaacttcagagccaagtcctcgatgctatgaactatgtgctatatgaccagttaaaatttaagggtaacagaatggattattataacgcgctgaacctgtacatgcatcaggtgctgataagaagaactggaatacctatttcaatgtctcttctctacctgactatagcccgtcaactgggggtgccactggagccagtcaattttcccagccattttctgctcaggtggtgccagggggctgagggcgcaacattagatatcttcgactacatatacattgatgctttcggaaagggcaaacagctcaccgtgaaggagtgtgaatatctcatcggccaacacgtgacagctgcactgtacggagtcgtgaacgtcaaaaaggtcctccagaggatggtcggaaaccttctctctctgggtaaaagggaggggatcgatcagagctatcagcttttgagggattcccttgacctgtatctcgctatgtacccagatcaggtgcaactgcttctccttcaggctcggctctactttcacctgggcatttggccggagaaagtgttagatatcctgcagcatatccagaccttagatccagggcagcacggtgcagtaggctatctcgtgcaacacacactcgaacatatcgaaaggaagaaggaggaggtgggcgtggaggtaaaactccgctccgacgagaagcaccgtgacgtctgctatagcataggcctcattatgaagcataaacggtacggatacaactgtgtgatctacggctgggaccccacctgtatgatgggtcatgagtggattaggaatatgaatgtgcacagcctgcctcatggccaccatcaaccgttttataatgtcctggttgaggacgggagctgtaggtacgccgctcaagaaaatctggagtacaatgtggagccacaggagatctcacaccctgatgtgggaaggtattttagcgagtttactgggacacattacatcccgaacgcggaactcgagatcaggtatcccgaagatctcgagttcgtctatgagaccgtgcagaatatttattcagcaaagaaagaaaacattgacgagtag

SEQ ID NO: 222996 - DNA, 1434 bp, Artificial Sequence
  Description of Artificial Sequence: Synthetic coding sequence
atgaagcactattcccctaccgattacgtcaactggcttgaagaatacaaagtcaggcagaaggcgggtttagaagcaagaaagatcgtagcctccttctcaaagaggttcttctcagaacacgtgccttgtaacggtttttcagatatagagaatctggagggtccagaaattttttttgaagatgagttagtgtgcatcctcaatatggaaggaaggaaggcactgacttggaagtactatgccaagaagattttgtactacctccggcagcagaagatcctgaataaccttaaggcattcctgcagcagcctgacgactatgagtcttatctcgagggggcagtgtacatcgaccaatattgcaatcccttgtcggatattagtctcaaggacatccaggcacagatcgacagcattgttgagctagtttgtaaaacactcagagggataaatagtcgccatcctagtctcgccttcaaggccggtgagtcttctatgatcatggagattgaactacagtctcaggtgttagacgccatgaattacgttctttatgatcagctgaaattcaaaggtaacaggatggactattacaacgcattgaatctttacatgcaccaagtcctcatccgtcgaacgggaatccctatctctatgagtctgttatacctcacaatcgcgcgtcagctcggagtacccttagagcctgtcaattttccaagccacttcctcctgaggtggtgccagggtgccgaaggcgagggtatcgaccagagttaccagctgctgcgcgactctctcgatctttatctggcgatgtatcctgaccaggtccagctgctgctactacaggcaagactgtacttccacctgggaatatggcccgagaaggtgctcgacatattgcagcacattcagactcttgacccaggccaacacggcgctgtgggctatctcgtgcaacacacattggagcatatcgaacgcaagaaggaggaggtaggagtggaggttaagctgagatccgacgagaaacacagggacgtttgctacagtatcggtctgattatgaaacacaagagatatggctacaactgtgtcatctatggttgggacccgacctgcatgatgggccacgaatggatccgcaacatgaacgtgcactcccttccccatggtcatcaccagcccttttacaatgtgctcgtcgaagatgggagctgtagatacgctgcccaagaaaacctggaatacaacgtggaaccacaggaaatcagtcacccagacgtcgggaggtattttagcgagtttaccggcacacactacattcccaacgccgagctagagataaggtaccctgaagacctggaattcgtgtacgagactgtgcagaacatctattccgccaagaaggagaacatagacgaatag

SEQ ID NO: 222997 - DNA, 1212 bp, Artificial Sequence
  Description of Artificial Sequence: Synthetic coding sequence
atggaaccggtgggatgttgcggcgagtgcagggggtcttctgtggatcccagatccacatttgttctgtcaaacctggctgaggtggttgagcgagtccttactttcttacccgctaaagcccttctcagggttgcatgcgtttgccggctatggcgcgaatgcgtgaggcgggttctccgcacccaccgatcagtgacctggatcagcgctggcctggcagaggccggtcaccttgaggggcactgcctcgtgcgcgtggtcgcagaagaacttgaaaatgtccgaatcctgccccataccgttctttatatggcggatagcgagacttttatatcgctggaggaatgccgcggtcataagagagccagaaaacgcacatctatggaaactgctttggcgcttgaaaagctcttccctaagcagtgccaagtgctgggcatcgtcaccccgggtatcgtggtgacacccatgggctccggctccaaccgtccgcaggaaattgagattggggaatctggatttgcactattattcccacaaatcgagggcatcaagatccagcccttccatttcattaaggatccaaagaatcttacccttgaacggcaccagctgacagaagttggactcctcgacaatccagaactacgtgtcgtcctagtctttgggtacaattgctgcaaagtgggcgcttccaactacttacagcaggtggtatctacattcagtgatatgaacattatattggcgggtggccaggtggataatctcagtagcctcactagcgagaagaacccattggatatcgatgcctccggcgtcgtcggcctgtctttctccggtcatcggattcaaagtgctaccgtgctgctgaacgaggatgtttccgatgaaaagaccgctgaggctgctatgcagcggctcaaagccgctaatatacctgagcacaacacaataggcttcatgtttgcttgcgtgggtaggggtttccagtactatcgagccaaggggaatgtggaagctgatgcctttcggaaattctttccatctgtaccgctctttggcttcttcggcaatggcgagataggctgcgacaggattgtgaccggaaactttatcttgcgcaaatgtaacgaagtcaaggacgacgaccttttccatagttacacaaccattatggctcttatccacttgggctcttccaaatag

SEQ ID NO: 222998 - DNA, 831 bp, Artificial Sequence
  Description of Artificial Sequence: Synthetic coding sequence
atggaaccagtgggctgctgcggcgagtgtaggggcagtagcgtagacccacgcagtacattcgttctttctaacctggcagaggtcgtcgagcgcgtcctgacatttttgcccgcaaaagcattgctaagggtcgcctgtgtctgtcgattgtggcgggagtgcgtgcgacgtgtgctacgaacccatcggtccgttacatggattagcgccggtctcgccgaagctggccatcttgagggccattgcttggtcagggtggtggccgaggagctggagaatgtgcggatactcccacataccgttctgtacatggcagacagcgagacatttatatcactcgaggaatgccggggacacaagcgagcacgcaagaggacatcaatggaaacagccctggcactggaaaagttattcccaaaacagtgccaggtgctggggattgtaactcccggtatcgtggtgacccccatgggaagcgggagcaaccgacctcaagagattgagattggtgaatccgggttcgccctgctgtttccccagatagagggcatcaagattcaaccattccacttcatcaaagatcctaagaatttgacattagagaggcatcagctgactgaggttgggttactcgataaccccgaactcagagtggttttagtgtttggatacaattgctgtaaagtgggggcttcaaattacctgcaacaggttgtatctacattctccgacatgaatattatcttggccggaggccaggttgataacctgtcctccctgaccagcgaaaagtacgtgctctgcgcgagcgatttcgtgtgcgaatag

SEQ ID NO: 222999 - DNA, 900 bp, Artificial Sequence
  Description of Artificial Sequence: Synthetic coding sequence
atggccgacagcgaaacgtttatctctcttgaagaatgtagaggccataaacgcgctcgtaagcggactagtatggagacggccctagcccttgaaaaactatttccaaaacaatgccaggtcttggggatcgttactcctgggattgtggtgacacctatggggtcaggatccaatcggcctcaggagattgaaataggggaaagtggctttgccttgctgttccctcaaattgaaggaatcaagatccagcccttccactttatcaaggaccccaaaaatcttactttagagaggcatcagctcaccgaggtcgggctgttagataatcctgaactccgcgtagtccttgtctttggctataactgctgtaaagtgggcgcttcgaattacctccagcaggtcgttagtaccttttctgacatgaacataatattggctggcggacaggtggacaatctgagctctctgacctccgagaaaaacccccttgacattgacgcttcaggtgttgtcggactctcattttccgggcatcgtattcagtctgctaccgtgttgctcaatgaggatgtgagcgatgaaaaaacagccgaggcggcaatgcagcggttgaaagcggctaacattccggaacataacaccatagggttcatgtttgcatgcgtggggagaggtttccagtattacagggccaaaggcaacgttgaggctgatgcgttccgtaaatttttcccctcagttccactgttcggattttttggtaatggggaaatcggctgtgatcggatcgtgaccgggaattttatcttgaggaagtgcaacgaggtaaaagatgatgacctgtttcattcatacaccacaatcatggcattgatccatttgggaagctcaaaatag

SEQ ID NO: 223000 - DNA, 1743 bp, Artificial Sequence
  Description of Artificial Sequence: Synthetic coding sequence
atgggggagaaagctgtcccactgctgcgccgtcgcagggtgaagaggtcctgtccctcctgcggatctgagttgggcgtcgaggagaagagaggaaagggcaatccaatatccattcagctctttcccccagaactcgttgagcacataatctcttttctgccagtccgcgatctagtggcactgggccaaacttgccggtacttccatgaagtgtgcgacggagagggagtttggcggagaatctgtcggcgtctgagccccagattgcaagaccaaggatcgggagtgaggccatggaagagggccgcaattctgaactacacgaagggcttgtactttcaggcattcgggggtagacgcagatgcttgtccaagtctgtagcgcctctgttggcacacggatatagaaggtttctgcctacaaaggaccacgttttcattctggattatgttggcaccctgttttttctgaaaaatgccctggtttcaacactgggccagatgcagtggaaaagagcctgccgatatgtggtcctgtgcagaggtgcaaaagatttcgcatccgatcccaggtgtgacactgtctatcggaagtacttgtacgttctggccaccagggaaccccaggaggtagttggtacgacttcatccagggcctgcgattgtgttgaagtttacctccaatcaagtgggcaacgggtgtttaagatgactttccaccactccatgaccttcaagcagatcgttttagtgggacaggaaactcagcgggcactgctgctgttgacagaagagggcaagatatactctctggtggtgaacgaaacacagctggatcagccgcgatcttataccgtccagcttgctctgagaaaggtatcacattatctaccacatctgagggttgcttgcatgacatcgaatcagtcgtccactctgtacgttacggaccagggaggcgtgtactttgaagttcatacaccgggtgtctaccgagacctgtttggtaccttgcaggccttcgatcctcttgatcagcagatgcctctagctctgtcacttccagccaaaatactcttttgcgcgctaggatacaatcacttaggtctggtggatgagttcgggcgtattttcatgcaggggaacaacagatatggacagctgggcacaggcgacaaaatggatcgaggtgagcccacacaggtttgctacctgcagcgacctattaccctttggtgtggcctgaatcatagcctggtcctatcccagtcaagcgaattctctaaggagctgctgggctgcggttgcggcgctggtggccgactgccaggctggccaaagggaagcgccagcttcgttaagttgcaggtaaaagtgccactatgcgcatgcgcactgtgtgctactcgggagtgcctgtatatcctgtccagtcatgatatcgaacaacacgccccttatcggcatctgcccgcatcccgcgtcgtgggtactccagaaccgtcccttggcgctagggccccacaggaccctggcggtatggcccaggcatgcgaggagtacctgtctcagatacactcctgccaaacattgcaagaccggactgagaagatgaaagaaatcgtgggctggatgccactgatggcggctcagaaggactttttctgggaggcactggacatgctgcagcgcgctgagggcggaggaggcggagtgggacctcctgcgccagaaacttag

SEQ ID NO: 223001 - DNA, 957 bp, Artificial Sequence
  Description of Artificial Sequence: Synthetic coding sequence
atgggagagaaggctgtccctctgttgaggagaaggagggtgaaacgtagttgtcccagctgcgggtcagagctgggagtagaggagaaacgtggcaagggaaatcccatctctatccaactttttccccctgagctggtggaacacatcatctccttcctccctgttagggacctagttgcactgggacagacctgtcgatatttccacgaagtgtgcgatggtgagggcgtatggcgcagaatctgcagacgcctgtcaccaagactgcaggaccaggatacgaaggggctctacttccaagccttcggaggaagaagaagatgccttagcaagagcgtagctccattgcttgctcacgggtacagaagattccttcctacaaaagatcacgtgttcatcctggactacgtgggaacactgttctttcttaagaacgccctggtcagtaccctcggccagatgcaatggaaaagagcctgccggtacgtagtcctttgtcgaggggcaaaggatttcgccagcgacccaaggtgtgatactgtttaccgtaagtatctttatgtcttggctaccagggagccccaagaggtcgtgggcacaacaagctcaagagcatgcgactgtgtggaagtctatctgcagtcctccggacagcgcgttttcaaaatgacattccaccattctatgacatttaagcagatcgttctggttggtcaggagacacaacgtgcactcctgctgctaactgaggagggtaaaatctactccctcgtggtgaacgaaacccagttggaccagccacgctcttataccgtccagctcgcactgcggaaggtgagccattatttaccgcatctgcgagtggcctgcatgactagcaatcagagctcaacgctgtacgttaccgaccctatcctctgttcatggctgcagcctccctggcctgggggttag

SEQ ID NO: 223002 - DNA, 1857 bp, Artificial Sequence
  Description of Artificial Sequence: Synthetic coding sequence
atggtgtgggagagccaacaggagagaggcggacagggccctcggaggcaggaagggagaagccgggagggagccataaggatggtccgcggatcacagagaagaaagctccagaaattcacaaggctctgcggtcgtgaggagggtctgagagttaagcggtcatgcccttcctgtggcagcgagctcggcgtcgaggagaaacggggtaagggtaatccaatttcaattcagcttttcccgccagagctcgtcgagcacattatctcattcttgccagtgagggatttggttgccttgggacagacgtgccggtatttccacgaggtatgcgacggagaaggagtgtggagaagaatttgtagacgcctgtccccaaggttgcaagatcagggttcaggcgtacgtccatggaagcgcgcagcaatcttaaactacactaaaggcctgtattttcaggcttttggaggacgaagacgatgtctgagtaagtcggtcgcacccctgttggctcacggatatagacgctttctgccgactaaagatcacgtttttatacttgactatgttggtacgctgttttttctcaaaaatgcgctggtgagcaccctgggacagatgcagtggaaacgggcttgtcgctacgtggtgttatgcagaggagccaaggatttcgcttcagatccccgatgcgacacagtgtatcgaaagtacctctatgttctcgctacccgcgaaccacaggaagtggtgggtaccacctcttccagagcctgtgactgtgtagaggtttatctccagtccagcggtcagcgggtgtttaaaatgacctttcaccactctatgacattcaagcagatcgtccttgtggggcaggaaacacaacgagcactcctgctgctgaccgaggagggcaaaatctattcacttgtcgttaatgagacccagctagaccagccacgaagctatacagtacaacttgctctgcgcaaagtctctcattacctgccccatctgagagttgcctgcatgacttcaaaccaaagctctacactctacgtgaccgaccagggaggagtgtatttcgaggtgcacacacccggagtttatcgggacctttttggaaccctccaggcctttgacccccttgatcagcagatgccgcttgcactgtccctcccggcaaaaatattattctgcgccttaggctacaaccatcttggcctcgtggatgaattcgggagaatattcatgcaaggaaacaatcgctacggtcaactagggaccggtgacaagatggatagaggtgagcccacacaagtgtgctatctacaaagaccaatcacactgtggtgcgggcttaatcattccctggtcttatcccaatcgtctgagtttagtaaagagttgctgggctgtggttgcggggcagggggtagactcccaggatggcccaaaggatcagcttcttttgtcaagttgcaggtgaaagttcctctttgtgcatgcgcgttgtgcgcgacgcgcgagtgtctgtacatcttgagctcacacgacatcgagcagcatgcaccgtacagacacctgcctgcctctcgagtcgttggcacccccgagccttcccttggagcacgcgctcctcaggatccaggtggcatggcgcaagcctgcgaagaatatctttcccagatacactcctgccaaacattacaggaccggacggagaaaatgaaggagatcgtgggctggatgcccctgatggcagcccagaaggatttcttctgggaagcactagacatgctgcagcgcgcagagggtggtgggggtggagtgggccctccagctccagaaacgtag

SEQ ID NO: 223003 - DNA, 957 bp, Artificial Sequence
  Description of Artificial Sequence: Synthetic coding sequence
atgggggagaaggccgttcctctgctgaggcggcgtagagtcaagagatcttgcccaagctgtggctccgagctgggcgtagaggaaaagagaggcaagggcaaccccatctccatccaactctttccacctgaactggtagagcacatcatctcctttctgccagtgcgagacctcgtggctctcgggcagacctgtaggtacttccacgaggtctgcgatggcgagggggtatggcgccgaatctgtcggaggctgagtcccagacttcaagaccaggatactaagggtctttatttccaagctttcggaggcaggcgacgctgtttaagtaagtctgtagctcctctgctcgctcacgggtaccgcagattcctgccaacgaaagaccatgtgttcattttggactatgtggggaccctgttcttcctcaaaaacgcgctagtgtccacgctgggtcagatgcaatggaagcgggcttgtcgctacgtcgtcttatgtagaggcgcaaaggacttcgccagcgatcctcgatgcgatactgtgtataggaagtacctgtacgtgctggctactagggagccccaggaagtcgtggggacaaccagctctcgcgcatgtgattgcgttgaggtgtacctccagagcagcggtcagcgggtttttaaaatgactttccaccattcaatgacgttcaagcaaattgtgctggtgggccaggagacgcagcgggcactgctgctcttgacagaggagggaaagatttactccttagtggtgaatgaaacacagttggaccaacccagaagttataccgttcaacttgccctgcgcaaggtcagccactaccttccccacctccgagttgcttgcatgacgagcaaccagagtagtaccttgtacgtgactgatcctatcctttgcagttggctgcaaccaccctggcccggtggctag

SEQ ID NO: 223004 - DNA, 1707 bp, Artificial Sequence
  Description of Artificial Sequence: Synthetic coding sequence
atggtaaagcgcagttgcccaagctgcggttccgaactcggtgtagaggaaaaacgcggaaagggtaaccccatttccattcaattatttccacctgaattggtggagcatatcattagcttcttgccggttcgggacctcgtggccctcgggcagacctgccgatatttccatgaagtgtgcgatggcgagggcgtctggaggcggatctgtaggcggctgtccccccgactccaggaccagggatccggcgtgaggccgtggaagcgcgctgcgattcttaactacaccaagggcctctactttcaagcgttcgggggacgtcgcagatgcctctctaagtccgtggccccattgctggcacatggatataggaggtttttgcctaccaaggaccacgtgtttatactcgattacgttggtacactttttttcctaaaaaacgccctggtctccaccttgggtcaaatgcaatggaaacgcgcatgcaggtatgtcgtattgtgccgaggcgctaaagattttgcttctgatcctcgttgcgacacagtctacaggaagtacctgtatgtgttagcaacaagggagccgcaggaagttgtgggaacgacttcttcacgtgcctgtgactgtgtcgaggtctacctgcagtccagcggccagagggttttcaaaatgacatttcaccatagcatgactttcaaacaaatcgtcttagttggtcaggagactcagagggccctgctgctgctgacagaggagggcaaaatatactcgctggtggtgaatgagacccagctggaccagcctagaagttatacagtccaactggccctgcggaaggtgtctcattatctcccccatttgagggtggcctgcatgacatctaaccaatcctcaacactgtatgtgacagaccagggcggagtctactttgaagtgcatacgccgggtgtctaccgggacctgtttggaactctgcaggccttcgaccccctggaccagcagatgccactcgctttgtccctcccggcaaaaattcttttctgcgccttgggctataaccacttgggcctggttgatgaatttgggagaatttttatgcagggtaacaatcgctatggtcagctgggcaccggtgacaaaatggatcgcggagagccaacccaggtatgctacctgcagaggccaatcactctgtggtgcgggctcaatcacagtttggtattgtcacagagcagtgaattcagcaaggagctcctgggatgcggctgcggtgccggtggtaggctgcctggttggccaaaaggatcagcctcattcgtgaaactgcaagttaaagttcctttgtgtgcctgcgcgttgtgtgctacccgggagtgcctttacattctgagctcccacgacatcgagcagcacgctccatatcgacacctcccagcatcgcgggttgtaggcactcctgagccctcactgggagcaagggctcctcaagatccagggggtatggcccaagcatgcgaggagtatctgagtcagattcactcgtgccagactctccaggatcgaacagaaaaaatgaaggagatcgtgggctggatgcctctaatggcagctcagaaagacttcttctgggaagctcttgacatgctccaacgggcagagggtgggggtgggggtgtggggccaccagcccctgagacctag

SEQ ID NO: 223005 - DNA, 1104 bp, Artificial Sequence
  Description of Artificial Sequence: Synthetic coding sequence
atgccttttctgggccaagactggcgttctcctggctggtcgtggatcaagactgaggatggctggaagcgatgtgaatcttgttcacaaaagctggagagagaaaacaacaggtgcaatatcagccattcaattatcttgaattcagaggatggggagattttcaacaatgaggaacatgagtacgcctctaaaaaaaggaaaaaagatcacttccggaatgacacaaacactcaatccttttatcgggagaagtggatttatgtacacaaggagagcaccaaagagcgccacgggtactgtacactgggtgaagcgttcaacagactggacttcagttcagccatacaggatatccgccgtttcaattatgtcgtgaaactgctgcagttgatcgccaagtcgcagctcacatccttgagtggcgttgctcaaaagaattacttcaatatattagataaaatcgttcaaaaagtcctggatgatcatcacaatcctagactgattaaggatctccttcaggatctgtcatccactctctgcatcctcatcagaggagtcgggaaaagtgttcttgtcggcaacattaatatctggatctgtcggctggagactatattggcctggcagcagcaactgcaagacctgcaaatgaccaaacaagtcaataacggtctgactttgtcggatctccctctgcatatgctcaataacattctgtaccgctttagtgacggatgggacatcatcactcttggccaagttacccccactctgtatatgctcagtgaagaccggcagttgtggaagaagctttgccaatatcacttcgctgaaaagcagttttgccggcacttgatcctgagcgagaagggacatatcgagtggaaactgatgtacttcgcactgcagaagcattacccagctaaggaacagtatggcgatacgctgcatttctgtaggcattgctccatcttgttttggaaggattaccacctggctctattgttcaaggactcaggccacccctgcacagccgcagacccagactcttgtttcacacctgtgtccccgcaacacttcattgatctgttcaaattctag

SEQ ID NO: 223006 - DNA, 1077 bp, Artificial Sequence
  Description of Artificial Sequence: Synthetic coding sequence
atgccttttctgggacaggactggaggtcacctggctggagttggattaagacagaggatgggtggaagagatgcgagtcatgttctcagaaattggaacgcgaaaacaaccggtgcaatataagccactctattatcctaaattctgaggatggtgagatttttaacaacgaggaacacgaatatgcctcaaagaagcgcaagaaagatcattttcggaacgatactaatacccagagtttctatagggagaaatggatatacgtacataaagaatctaccaaggaacgtcacggatactgtaccctgggcgaggctttcaatagactcgactttagtagcgccatccaggatatcagaaggttcaactacgttgtaaaactcttgcaattaatagcgaagtctcagcttacttctctgtcgggagtcgcccagaagaattactttaacattctggacaaaattgtacagaaggttctagacgaccaccacaatccgagactaatcaaggacctgctccaggacctctctagtacgttatgcatactgattcggggtgtggggaagagcgtgcttgtggggaacataaatatctggatttgcaggctggagacaattctggcatggcagcagcagctccaagacttgcaaatgaccaagcaggttaacaacggcctgaccttaagtgacctcccactgcatatgttgaacaatatcctgtatcggtttagcgatggctgggacattataacactgggccaggtaacgcccacactgtatatgctgtccgaagacagacaactgtggaagaagctctgccagtatcacttcgcagagaagcagttttgtaggcatttgatcctcagcgaaaaaggccatattgaatggaaactgatgtacttcgctttacagaagcactatcctgccaaggaacagtacggagatacgctgcacttttgcaggcactgcagcatcttattctggaaagactctgggcatccttgtaccgcagccgatccagactcctgtttcacaccagtgtctccacagcacttcattgacctattcaaattttag

SEQ ID NO: 223007 - DNA, 876 bp, Artificial Sequence
  Description of Artificial Sequence: Synthetic coding sequence
atggagaaatatagtatcatgaagtctatgaatatgcatagaaagaaaggcaagcgcactatcttggaaatgacacaaatccttaaaaggcacggatactgcactctgggggaagccttcaatcgcctagacttctctagcgctatccaggacattcgccgttttaactatgtagtaaaactgttgcagctgatcgccaaatcccagctgacctctctgtcaggagtcgcccagaaaaactatttcaacattttagacaagattgtccagaaagttctcgacgatcaccacaaccctcgcctcatcaaggacctgctccaggatttaagttccaccctatgtatccttattcgcggagtcggcaaaagcgttctggttggcaatattaatatctggatctgtcgacttgaaactatcctggcatggcagcagcagctacaggatctgcagatgacaaaacaagtcaacaacgggctgactctgtcagacttgcccctgcatatgcttaacaacattctgtatcggttctccgatggatgggacataattacgttggggcaggtgactcctaccctttacatgttaagcgaggacaggcagttatggaagaagctctgtcagtatcactttgccgaaaagcaattttgcagacatttgatcctttcagagaagggacatatagagtggaagttaatgtactttgccttgcagaagcactatccagctaaagagcagtacggtgataccctccacttctgccgccactgctcaattcttttttggaaagactctggacacccctgcactgctgctgacccagactcctgctttaccccagtgtccccccagcacttcatcgacctcttcaaattctag

SEQ ID NO: 223008 - DNA, 876 bp, Artificial Sequence
  Description of Artificial Sequence: Synthetic coding sequence
atggagaaatacagtattatgaaaagcatgaatatgcacaggaaaaaaggcaaaagaacaattctcgagatgacccaaattctcaagcggcatggctactgtacactcggcgaggcattcaatcgactggatttttcgtctgccatccaggatattcgcagatttaattatgtcgtcaaattgctgcagttaatcgccaagagtcagctgacatctttgagcggagttgctcagaagaactactttaacatcctggataagattgttcaaaaagtcttagatgaccaccacaatcccaggttgattaaggaccttctccaggatttgagctccacactgtgcattctgatccgtggcgtaggcaaaagtgtgctggtagggaatattaacatctggatctgcagattggagacaatcctggcatggcaacagcagcttcaagacttgcaaatgacaaaacaggtgaataatggcttgaccctgagcgacctgcccctacacatgttgaacaacattctgtatcgtttttctgacgggtgggatatcatcacattaggacaggtgacccctaccctctacatgctttcggaggatcgacagctctggaaaaagctctgtcagtatcattttgcagaaaagcagttttgccggcacctgatattgagcgagaaggggcatatcgaatggaagttgatgtattttgctctccagaagcattaccctgccaaggagcagtacggcgatacccttcacttttgccggcactgctccattctgttttggaaggacagcgggcacccttgcacagccgctgatcctgactcctgttttaccccggtgtctcctcagcactttatagatttgttcaaattctag

SEQ ID NO: 223009 - DNA, 993 bp, Artificial Sequence
  Description of Artificial Sequence: Synthetic coding sequence
atgccatttcttggccaggattggaggtctcccggatggagctggattaaaactgaagacgggtggaagcgttgcgagtcctgctcccagaaacttgaacgcgaaaataaccggtgtaacattagccactccataattctgaattccgaagacggcgagattttcaataacgaggaacacgagtacgcatccaagaaacgcaagaaggatcacttcagaaatgatacgaacactcagagtttctacagggagaaatggatatacgttcataaagagagtaccaaagagaggcacggatactgtacattgggggaagccttcaaccggttggattttagttccgccatacaggatatccggagatttaactacgtggtgaaattgctgcagttgatagccaaaagtcaactgacctctctgtctggagttgcacaaaaaaattacttcaatattctcgataagatcgttcagaaggtactagatgatcaccacaatccacggctgattaaagatctcctccaggacctttcttcaacactgtgcatcttgattcgcggagtaggcaagtctgttctggtgggcaatataaacatttggatttgtcgtttggagactatcctggcctggcagcagcagctgcaggacctgcagatgacaaaacaggtgaataatggcctcaccttgtcagatctcccgctgcttagcgaggaccggcagttgtggaaaaagctgtgccagtatcacttcgcagagaaacagttctgcagacatctcatcctgtctgagaaaggccacatcgaatggaagctcatgtattttgctctgcagaaacattatcccgcaaaggaacagtatggagatactcttcatttctgccgccactgcagtatcttgttttggaaagatagtgggcacccctgcaccgctgccgacccagacagttgcttcacaccagtctcaccgcagcatttcatcgatcttttcaaattctag

SEQ ID NO: 223010 - DNA, 378 bp, Artificial Sequence
  Description of Artificial Sequence: Synthetic coding sequence
atgccgttcctgggtcaggattggcgcagccctggctggtcctggataaagacagaggatggctggaagcgatgcgagtcctgtagtcagaagttggagagggagaataaccgctgtaatatctcccactccataattttaaattctgaagatggtgaaatcttcaacaacgaggagcacgaatatgcgtccaagaaacggaagaaggaccatttccggaatgatacaaacacccagagcttttaccgggagaagtggatctacgtgcacaaagagagcactaaggagcgtcacggatactgcactctgggggaggctttcaatcgccttgacttctccagcgccatacaggacatcaggaggttcaactatgtttag

SEQ ID NO: 223011 - DNA, 852 bp, Artificial Sequence
  Description of Artificial Sequence: Synthetic coding sequence
atgggcgcatcagtgagccggggacgcgcagcaagggtcccggctcctgagcccgaaccggaggaggctctcgatctatcccaacttcctcccgagctactgctggttgtgctttctcacgtgccaccccgaactctcctgggccgatgtaggcaggtctgcagaggatggcgagctcttgtggacgggcaggcactctggctgctgattttagctagggaccacggagctacgggacgcgcattactgcacttggctcgtagctgccagtctcccgctcgaaatgctcgtccctgtcctctcggtaggttttgtgccagacgccctatcgggcgaaatttaattcggaacccttgcggtcaggagggactccggaaatggatggtccagcacggaggagatggttgggtggtcgaggaaaatcggactacagtgcctggcgctcctagtcagacctgtttcgttactagcttctcatggtgctgcaaaaaacaggttctcgacttggaggaggagggcctatggcccgaactgcttgacagcggtaggattgaaatctgcgtttcagattggtggggagcccgtcacgactctggctgtatgtatcggctccttgtacagcttttagacgcaaaccagacggttttagacaaattcagtgctgtgcccgatccgataccccaatggaataataacgcttgcctgcacgtgacgcacgtgtttagcaacattaagatgggagtgcggtttgtgtcttttgagcatagagggcaggacacacagttttgggccggacactacggagccagagtaactaatagctctgtcattgtcagagtgcgtctgtcatag

SEQ ID NO: 223012 - DNA, 852 bp, Artificial Sequence
  Description of Artificial Sequence: Synthetic coding sequence
atgggcgcttcagtttctcgaggtagagccgcaagagtgccagccccagagcctgaacccgaggaagcccttgatctgtcccagctgcctcccgaactgctgctggtggtcctaagtcacgtccctcccaggacgttactagggaggtgtcggcaggtctgtcgcggatggagagcgttggtcgacggccaagcactctggctgcttatcttagcgagagaccacggggcaaccggacgcgctctgctgcacctggctaggtcttgccagtcccccgctcggaacgcacgtccctgccctctaggaagattctgcgcgagacggccaatcggtagaaacctgataagaaacccctgtggacaggaaggactgaggaaatggatggtgcagcacggcggtgatgggtgggtggtggaggaaaatagaacaacagtgcccggagctccctcgcagacctgcttcgtgacatccttctcatggtgctgtaaaaaacaggtgctggatctggaagaagaggggctatggccggagctgctcgactccggacgaattgaaatctgtgtcagcgattggtggggggctcgtcacgatagtggttgtatgtatcgattactggtccaacttcttgacgccaatcagactgtccttgacaagttctctgcagtcccggacccgatcccccagtggaataacaacgcttgtctgcacgtaacacacgtgtttagcaacatcaagatgggagtgcgcttcgtgtctttcgaacaccgagggcaggacacacagttctgggctggacactatggagcacgggtgactaatagttccgtgattgtaagagtgcgactgtcttag

SEQ ID NO: 223013 - DNA, 1107 bp, Artificial Sequence
  Description of Artificial Sequence: Synthetic coding sequence
atggcagctgccgctgaagagcgcatggccgaggagggcggaggcggacagggggatggcggatccagcctggctagcggatccacccagaggcaacccccacctccggcacctcagcacccccagcccggatcccaggcactcccagcacccgctctggccccagaccagctgccacagaataacacactcgtcgccttgcctatcgtcgctatagaaaacatactgagcttcatgtcctacgatgaaatatcccagctgcggctggtctgcaaaaggatggatctggtctgtcaacgtatgttaaatcagggctttctgaaggtggagagataccataatctgtgtcagaagcaggtaaaggcccagctccctcgccgtgagagcgaaagaaggaatcacagtctagccaggcatgcagacattttggccgcagtcgagaccagactgtctctgctcaacatgacgttcatgaagtatgtggatagtaacctgtgttgctttatccccggaaaggtgatcgatgaaatctaccgtgtacttaggtacgttaactctacaagggccccacagagagcacacgaggtgctgcaggagttacgagacatcagctctatggccatggagtacttcgacgagaaaatcgtccctatactcaaacgaaagctgcccggatccgacgtgtcgggcaggctaatggggtcccctcccgtgcccggtccgagcgctgctctgaccacgatgcagctgttcagcaaacagaacccgtctcgccaggaagttactaaactgcagcagcaggtgaagactaacggagcgggtgtaacggtgctgaggagggaaatatcagagctgcggaccaaagttcaggagcaacagaaacagctgcaagatcaagatcagaaacttctggaacaaacgcaaataattggggaacagaacgcacggctggcagaactcgaacggaaattgcgcgaggtgatggagagtgcagtgggaaactctagtggcagtggacagaacgaagaaagtcccagaaaacggaagaaagccacggaggccattgacagtctgcgcaagtctaagcggttgaggaatcgcaagtag

SEQ ID NO: 223014 - DNA, 540 bp, Artificial Sequence
  Description of Artificial Sequence: Synthetic coding sequence
atggctgcggctgctgaagagaggatggccgaggaaggaggcggtgggcaaggtgacggcggatcctcgctggcttcagggtctacgcagaggcagccgccaccccctgcccctcagcacccacagccaggttcgcaggccctgcccgcacccgcactggcccctgatcagttaccccaaaataataccctggttgctcttccaatcgttgccatagaaaatattttgtcctttatgtcttatgacgagatttcacagcttaggctcgtctgcaagcggatggaccttgtgtgccagcggatgctgaaccagggattccttaaggtggaacgctatcacaatttgtgccagaaacaggtgaaagcacaattgcccaggagggagtccgagaggcgcaaccattcccttgcgcgtcatgccgacatactagccgctgtggaaaccagactatccctgctgaacatgacttttatgaagtatgttgattctaatctgtgctgtttcatccccggaaagttccaggaccgactgcagccatag

SEQ ID NO: 223015 - DNA, 1416 bp, Artificial Sequence
  Description of Artificial Sequence: Synthetic coding sequence
atggccgcaatggaaactgagacagccccacttacacttgagtcgcttcctaccgatcctcttctgttaatcctaagctttcttgactaccgagatctgattaactgctgctacgtttctcggagactgtcacagttgagtagtcatgacccgctttggagaagacattgtaaaaagtactggctcatcagtgaggaagagaaaactcaaaaaaatcagtgttggaagagtttgttcatcgatacctattctgacgtgggccgatacatagaccactacgcagccatcaagaaagcttgggacgatctaaaaaaatatctggaaccaagatgtccacgcatggtgctgagtttgaaggagggcgctagggaagaggacctggacgcagtggaagcccaaattggttgcaaactgcccgatgattatcgttgcagctatcgcattcacaacgggcaaaaactggttgtacccggtctcttagggagcatggccctctccaaccactatagaagcgaggacctgttagacgttgacaccgctgctggaggcttccagcaacgacagggcttgaagtattgtctacctctcacattctgcattcacacagggctgtcacagtacatagccgtcgaggctgctgagggcaggaataaaaacgaggtcttctaccagtgtccagaccagatggcgaggaatccggctgcaatagatatgttcattattggagctaccttcaccgactggttcaccagttacgtgaaaaacgttgtgtccggcggatttccgatcattcgagaccagattttcaggtatgtgcatgatccagagtgcgtagcaacaacgggtgatatcacggtgtccgtatccacgtcttttctgcccgagctgtctagcgtgcatccgccacactacttttttacatatcgcataagaatcgagatgagtaaagacgctcttcccgaaaaggcatgtcagcttgactctcgctactggcgtatcaccaacgccaaaggagacgtagaggaggtgcaaggtcctggagtggtcggagagtttcccatcatatcgccaggtagggtgtacgagtacacctcctgtacaaccttctcaaccacgtccggctacatggaggggtattacacttttcatttcctgtacttcaaagacaagattttcaacgtggctatacccagatttcatatggcttgccccaccttcagggtttcaattgctagattggaaatgggccctgacgaatacgaggaaatggaggaagaggaggaggaggaggaggaagaagatgaggacgacgactctgcggatatggacgaaagtgacgaggacgatgaagaagaaagaaggcgaagggtgtttgatgttcccatacgccgacgaagatgcagtcgactgttctag

SEQ ID NO: 223016 - DNA, 519 bp, Artificial Sequence
  Description of Artificial Sequence: Synthetic coding sequence
atggaaaccgagaccgccccactgactctggagtccttacctaccgaccccttgctgctcatcctctcctttttagactatagggatcttatcaactgttgctacgtctcaagaagactgagtcagctgtcatcccacgaccccctgtggaggcggcattgtaagaaatactggcttatttcagaagaggagaagacccaaaagaatcagtgctggaagtctctgttcatagacacctattctgacgtgggccgttacatcgaccattatgccgctatcaagaaggccggtatgatctcaagaaacatctggtcccctggagtcctgggttggtttgtgagcataaaccggggatgctctaggggcaggccacgctgctgtggaagcgccgattggtgcaagctgcccgacgactacaggtgttcttataggatacacaatggacagaagctggtggtacccggatcctactgggaagcttggcattgtctaatcaccatcgtcctgaaaatatgctag

SEQ ID NO: 223017 - DNA, 1248 bp, Artificial Sequence
  Description of Artificial Sequence: Synthetic coding sequence
atggcggctatggaaacggagaccgcccctctaactctggagagtcttcccaccgatcccctactgcttattttgtccttcttggattatagggacctcataaactgttgttacgtatcaaggcgactgtctcaactgtcctcgcacgaccctctgtggcgcaggcactgtaagaagtactggcttatttccgaggaagagaagacccagaagaatcagtgttggaagtcgttgttcatagatacctacagcgatgtcggacgctatatcgaccattacgccgctataaaaaaggcctgggatgatctgaaaaagtacctggagcctaggtgtccaagaatggttctctccctgaaagagggagcacgcgaggaagacctggacgcggtagaagcccagatcggctgtaaactccccgatgactacagatgctcttacaggattcacaatggccagaaactcgtggtgccaggcctgcttggctcaatggcactttcgaaccactacaggagcgaggatcttctggacgttgatacagcagccggtggattccagcagagacaggggctgaaatattgcctcccactgacgttctgcatccatacgggactgtctcagtatattgccgtggaagccgcagaggggaggaacaaaaacgaagtgttctatcagtgtcccgaccaaatggcaaggaatccagccgcaatagacatgttcattattggtgccacattcaccgactggttcacaagttacgttaagaatgtggtttctggcggattccctataattcgtgaccagatatttagatatgtccacgaccccgagtgtgtggctaccactggggatataactgtgagtgtgtcaacatcatttctgcccgagctaagcagcgtgcatccccctcattacttctttacatacagaatccggattgagatgagcaaggacgcactgcctgagaaggcgtgccagttagacagccggtactggcggatcacaaacgcaaaaggcgacgtggaggaggtgcaaggtcccggagtggtaggtgagttcccaattatctcacctggcagggtttatgagtacacatcttgcaccacattctctaccactagtggctacatggaaggttattacactttccacttcctgtatttcaaggataaaatatttaatgtcgcaatcccacggttccatatggcatgccctacttttcgcgtatcaattgccaggttggtgtcctag

SEQ ID NO: 223018 - DNA, 2238 bp, Artificial Sequence
  Description of Artificial Sequence: Synthetic coding sequence
atggaggaagaacttcaacactcccattgcgtgaattgcgtctcacgacggtgcatgaccagaccagagcccggaattagctgtgatttgatcggctgccctctagtctgcggagccgtgttccacagctgtaaggcagatgagcatcggctcctctgcccatttgagagagtgccttgcttgaactccgacttcggctgtccctttacgatggcacgcaataaggtggcggagcacttggagatgtgccccgcttccgtggtgtgctgcaccatggaatggaaccgatggcccgtcagttatgccgaccgcaagagctatgagaatctctcacgtgacgtggatgaggtggctcagctggacatggcactcgctttacaggaccaaagaatgctgctggagtctttgaaggtggccacaatgatgtctaaagccacagataaagtgagcaagccaagggaacaaatcagcgtcaagtctagcgtccccgagattcctcacgccaacggactggtttcagtggatgaggaatcctacggtgccttgtatcaagctaccgtagagacaacccggtctctcgcagccgctctggatatcctgaacacggccacaagggatattgggatgctgaacacctctgtgcccaacgatatggatgaacagcaaaacgcacgggagtccttagaggatcagaatctcaaggaccaggaccacctttacgaggaggagataggtgccgtaggagggatcgactacaacgataccaatcagaatgcccaatcagagcagaacggcagcagcgacctgctgtgcgatcttaacaccagtagctatgacacatcagcattgtgtaatgggtttcctctggagaacatctgtacacaagtaattgatcagaatcagaaccttcacggcgattccaagcaaagtaatctgactaatggggactgcgtggcgtcatccgacggaaccagtaaaccctcttcgtcacttgctgtggccgcacagctgcgggaaatcatcccttcctccgccttacctaacggaaccgtccagcacattctgatgcccgacgacgaaggtgagggagagctgtgttggaagaaggtcgacctcggggatgtgaagaacgtcgacgtgttgtcattctctcacgcaccatcgtttaattttctgtcaaacagctgctggtccaaaccgaaggaagataaggcagtggacacatccgacctcgaagtggccgaagatcccatgggactgcaagggatcgatttgatcacagccgctcttctgttctgtctgggcgattccccaggcggaagaggtatctcggattctcggatggcagacatctaccatatcgatgtgggtacccagacgttctcgctgccctcagccatcttggccacgagcaccatggttggtgagatcgcttctgcatctgcctgtgatcatgctaatcctcagctgagcaacccgagccctttccagaccctgggattagacttggtgctcgagtgtgtcgccaggtaccagcctaagcagcgtagtatgtttactttcgtgtgcggacagctcttcagacgtaaagagttcagcagccattttaagaacgtccatggggatatccacgccggattaaacggttggatggaacagcgctgtccactggcctattacgggtgtacatatagtcagagacggttttgccctagcattcagggtgctaagatcatccacgataggcatttgagaagcttcggagtgcaaccatgtgtcagtaccgttctggtggagcccgcacggaactgcgtgctgggccttcacaatgatcatctgagctccctgccgttcgaagtgctgcagcatattgccggattcctggacggattttctctctgtcaactcagctgcgtgagcaaacttatgagagacgtttgcggctctttgctgcagagtcggggaatggttattttgcagtgggggaagagaaagtacccagagggcaacagcagctggcaaattaaggagaaggtgtggcgcttttcgaccgccttctgctccgtgaatgaatggaaatttgcagatatcctgtctatggcagaccacctcaaaaagtgttcatacaatgttgttgaaaaaagagaggaggccatacctcttccatgtatgtgcgtgactcgcgagctgaccaaagaaggtcgatccctgcgctcagttctgaagcctgtgctctag

SEQ ID NO: 223019 - DNA, 1620 bp, Artificial Sequence
  Description of Artificial Sequence: Synthetic coding sequence
atggcagtgtgcgctcggctgtgcggagtaggtcctagtagaggttgccgtagacgccagcagcgacgcggacccgcagaaacagctgcagccgatagtgagcctgatacagatcctgaagaggagaggatcgaggcctccgccggtgtggggggaggcttatgcgccggaccttcccctccacctccacggtgttccttgctggagctccctccagaactccttgtggaaatattcgcctccctacctggcacagatctgccgagcctcgcacaggtttgcacaaaattccggagaatcctgcataccgacactatatggcggaggcgctgtagagaggaatacggagtgtgtgaaaatcttcgcaaactggagatcacaggggtgtcgtgtcgcgacgtttatgctaagctccttcataggtaccggcacatactggggctatggcagcccgatatcggtccatatggagggctgctgaatgtcgtggtggatgggctctttattatcggatggatgtacctaccacctcatgatcctcatgtcgacgacccaatgaggttcaaacccctgttccggatccacctgatggagcgcaaagctgccactgttgagtgtatgtacggccacaaagggcctcaccatggccacatccagattgtgaagaaggacgaatttagcacaaaatgcaatcaaaccgatcaccaccgaatgtccggtggaaggcaggaggaatttaggacatggctgcgggaggagtggggaagaaccctggaggacatttttcatgaacatatgcaggagctgatcctgatgaagtttatctatactagtcagtacgacaattgcctaacctatagacgtatctacctgccaccctcacgccctgatgatctgattaaacctgggctctttaagggtacctatggaagtcatgggctcgagatcgtgatgcttagtttccacgggagaagagccagagggacaaagattactggggatcccaacatccctgccggtcagcagacagtggagatcgatctgcggcaccggatacagctgcctgacctagaaaatcagcgcaactttaatgagctgagccggatagtgcttgaagtcagggaacgcgttcggcaggaacagcaggagggcggacacgaagccggagagggtagaggaagacaaggtccccgtgagagtcagcctagccccgcacagccccgagccgaggcgccaagcaagggcccagacgggactccaggtgaggacggcggagaaccgggagacgccgtcgcagccgcagagcagcccgctcagtgtggtcagggtcagccatttgtcctccccgtgggtgtatcctcccggaacgaagactacccaagaacttgccggatgtgtttctacggaacggggctgattgcaggccatgggttcacctccccagaaaggacaccgggtgtgttcatcctcttcgacgaagatcgctttggttttgtctggttggagctcaaatcgttctccctgtatagtagggtccaggcgacctttagaaacgccgatgccccaagcccacaggcgttcgacgagatgctgaagaacattcagtcgctgacaagttag

SEQ ID NO: 223020 - DNA, 1068 bp, Artificial Sequence
  Description of Artificial Sequence: Synthetic coding sequence
atgcccttcctgggacaggattggagatcccccggacaaaactgggttaaaacggcggacgggtggaaaagattcctggatgagaagagcggatcattcgtgtctgacctgtcctcatattgtaacaaggaagtgtataacaaggagaatttgttcaatagcctgaactacgacgtcgctgccaaaaagcggaaaaaggacatgttgaattctaaaaccaagactcagtacttccatcaggagaaatggatttacgtccataaaggatccaccaaggagagacacggctattgtacgctaggcgaagcctttaatcggttggacttttctacagccatactggacagtaggcgatttaactacgttgttaggctgctggaactcatcgctaagtcccagctgacatcactttccggcatagcccaaaagaacttcatgaacattctggaaaaagtggttcttaaggtgctggaagaccaacaaaacatacgtcttatcagagaactgctgcaaaccctgtacacatcactgtgtacgctggtccagcgcgtggggaaatctgtcctggttggcaatattaacatgtgggtgtacagaatggagacaatcctgcactggcagcaacagctgaataatatacaaatcacaaggccggcatttaaagggttgacttttactgatcttcctttgtgtctgcaactgaacattatgcagcgcctcagcgacggcagagatttagtgtcccttggccaggcggcaccagatctccacgtgctgtctgaagatagactgttgtggaagaaactgtgtcagtaccacttctcagagaggcagattaggaagcgcctcatcctgagcgacaagggacagcttgattggaaaaagatgtattttaagctagtacgatgttacccgaggaaagaacaatatggagacactttacagctgtgcaagcactgtcacattctaagctggaagggaaccgaccacccatgcacagctaacaatccagagtcatgttccgtctcactgtcacctcaggacttcataaacctattcaagttttag

SEQ ID NO: 223021 - DNA, 789 bp, Artificial Sequence
  Description of Artificial Sequence: Synthetic coding sequence
atgccattcctcggtcaggactggcggtcacctggacagaattgggtcaagacagccgatggctggaagaggttcctcgatgagaagagcggctcatttgtcagcgatctgtcttcatactgtaacaaagaggtctacaacaaggaaaatctgttcaactcgcttaactacgatgttgccgcaaagaaaaggaaaaaggatatgctgaactctaagacaaaaacacagtattttcaccaggagaaatggatatacgtccacaagggctccactaaagaacgccacggctactgtactcttggggaggcttttaatcgcttagacttttctaccgccattctcgatagccgacgcttcaattacgtggtgagaccagcatttaagggtctaaccttcactgaccttccgttatgcctgcagctgaacatcatgcagcgactttccgacggcagagatttagtgagcttgggccaagccgctcctgacctgcacgtgctatctgaagacaggctgttgtggaagaaactttgccagtaccacttcagcgagcgacagatccgtaagagactaattctgtccgacaagggccagctggactggaagaaaatgtacttcaagttggtgcgatgctacccgagaaaagagcagtacggcgatacgctgcagctgtgcaagcattgtcacattctgagttggaagggcaccgaccatccctgtactgccaacaacccggagtcctgctccgtgagcctgagcccccaggactttatcaatcttttcaagttctag

SEQ ID NO: 223022 - DNA, 1668 bp, Artificial Sequence
  Description of Artificial Sequence: Synthetic coding sequence
atgttattgttcttgagcgtgcctcagccgaggccccctggggctagaacacgggctggtgcagcacgcgtcgcccgatggcgccgtttgagactccagcagctccgccgactcagagggctgctcagagtactgcgtgggcgtccgggagcaggaagccgcagaaggggcaggatggccctctgtgggcaagcagctggggcagccagcctgccttccgagctgattgtgcacatattctctttcctgccagcccctgacaggttaagagcctccgcctcttgcagccactggagagaatgcctcttttaccctgcgctctggcctcagcttcgaatctgcctgagggtgagtccagccgaacagcctagactggagttcctcatgagaaaatgcggctggttcgtaagggaattgcgtgttgagtttgccgctgaaaattatctgtcgggaggtggccctggggacggcggaggggcagacaccggcaccgggggagaggaagtggaagccttacagctttccgcaaggtggcttgaggtactgcggacgtatcttgagctggtcctatgtgttctggtgtctatcagaaacaacagaaatctgcaaaagttcagtctttttggggatataagcgttctacagcagcaggggtctctgagtaatacatacctctccaaggtcgaccctgacggcaaaaagattaagcagattcagcagttatttgaagagatactaagcaacagcaggcagctaaaatggttatcttgtggcttcatgctcgagatcgttacgcctacttcactgagcagccttagcaacgcggtcgctaacacaatggaacacctgtcactcctggataataatatcccaggtaacagtacactgatcactgccgttgagctggagagatttgtgaatctgcattccctggccctagatttttgcgactttacagcagagatggctcgggtgcttacagacagcaaccacgttccactgcagcggctgtcccttctcgttcacaacgttagcgtgatgcacaaaagcctggataatatgcctaacgacgaacattggaaggcattgtcgcgaaagagcacgtctttccgcgtgtacatcatggctttcgacataaaaagtgaggatatgttgaagatcctgaaaccaagtattcccctggagcgcattcactttgattcttatatcacttgcgtatctggcgcaatcgtggatctaatatcgcggcagtatgataaattcctgactcactttatcctgatgaatgatgttatcgacacgtctgggtttcctgatctcagcgacaaccggaacgaagaccccctggtgctcctggcctggcgctgtactaagctttcccttctagccatacacggctacacggtgtgggcccataacctgatcgcaattgccagactaagaggatccgatctgaaggtgcttgaagtgaccgaggaatctattgactttgaccagggtgaactggccgatcaggacgtggacccagtacataacttgattgaacaggtcagcctgggtctgggacagccttggcatgctgtgatggatatcgagtctcttagtgtttttactgagcccaaccggcacttttaccgtgagatgcagtcctttagcgaagacatctag

SEQ ID NO: 223023 - DNA, 9 bp, Artificial Sequence
  Description of Artificial Sequence: Synthetic coding sequence
atgcggtag

SEQ ID NO: 223024 - DNA, 2136 bp, Artificial Sequence
  Description of Artificial Sequence: Synthetic coding sequence
atgcatctcaaaccctactggaagctgcagaaaaaggagcacccaccagaggtttcacgcgagactcaacgcactccaatgaatcaccagaaagccgtgaacgatgaaacgtgcaaggcttcacacatcaccagtagcgtgtttcctagtgccagcctcgggaaggcctcctctcgtaaacccttcgggatcctttcacctaatgttctgtgcagtatgagcggtaaatctcccgttgaatcgtctctcaacgtgaaaacaaaaaagaatgctccatccgctacgattcatcagggcgaggaggagggacctttggacatttgggccgtggtcaagccgggaaataccaaggaaaaaattgcattcttcgcctctcatcaatgctcaaaccgcattgggtctatgaaaatcaagagcagctgggacatcgatggtcgtgccacaaagaggaggaaaaagtctggcgatcttaaaaaagccaaggtccaggttgagcggatgcgcgaggtgaactctaggtgttaccagcccgagccatttgcttgcggcatcgaacactgctcagtccattatgtgagcgactcgggggacggagtttatgccggacgcccactgagtgtgatacagatggtggccttcctggaacagcgcgcttcagcactcctggccagttgctcgaagaattgtactaactctccagccatcgtgcgcttttcaggccagtccaggggagttcctgcagtctcggaatcctactctgcacccggtgcctgcgaggagccaacggagcgagggaacctcgaggtaggcgaaccccagtcagaacccgtgcgagttttagacatggtggcaaaactggaatccgagtgcctgaagcgtcaaggccaacgggaaccaggtagcctgtctaggaacaattcattccggcgtaacgtaggcagggtgctgttagctaactctactcaggcagacgaaggcaaaaccaagaagggcgtgctcgaggctcctgatacacaagtgaatcctgtggggagcgtatccgtcgactgtggcccatcccgcgctgatcggtgttcacccaaagaggatcaggcgtgggacggcgcttcccaggactgcccaccactgccagcaggtgtgtcattccacattgacagcgctgagctcgagccaggatctcaaacagcggtgaaaaattcaaacagatacgatgtggaaatgaccgatgaactcgtgggcttgcccttctcatctcatacttactctcaggcctcagaactcccaaccgatgccgtggattgtatgagtagggagctggtctccttgacttcccggaaccccgaccagcggaaggaatctctgtgcatcagcataaccgtgtcaaaagtcgacaaagatcagcccagcattttgaattcctgtgaggacccagtgcccggtatgttgttttttctgcccccaggccaacatctcagcgattattcccaacttaacgaatccacaaccaaggagtccagtgaggcctcccaactggaggatgctgctggcggagactccgccagcgaggaaaaatctggtagtgccgagcccttcgtgcttccagctagtagcgtcgagtcaaccttgcccgtgctggaagctagctcttggaaaaagcaggtgagtcacgactttcttgagactcgcttcaaaatccagcagctcttggagccacagcaatacatggcttttctgcctcaccatatcatggtgaaaatatttcggctactcccaaccaagagccttgtggccctaaaatgcacctgctgctattttaaatttatcatagagtactacaatattcgccctgcagattctcggtgggttagggatcctaggtatcgagaggatccatgcaaacagtgcaagaagaaatatgtcaagggagatgtgagcctgtgtaggtggcatcctaagccctattgccaggcccttccatatggacctggctattggatgtgctgccataggtcgcaaaaaggatttcccggttgtaagctgggtctgcatgataaccattgggtgcccgcatgtcatagcttcaatagggccatccacaaaaaagctaagggaacagaggccgaggaggagtactag

SEQ ID NO: 223025 - DNA, 2136 bp, Artificial Sequence
  Description of Artificial Sequence: Synthetic coding sequence
atgcatcttaaaccctactggaaactgcagaagaaggaacatcccccagaagtgagtcgagaaacacagcgaaccccaatgaaccatcagaaggcggtgaatgatgagacatgcaaggccagtcatattacgtcttccgttttcccctctgcttcccttgggaaggcgagctcccgcaaaccatttggaatcctaagcccaaatgtgttgtgcagtatgagcgggaaatcccccgtggagtcaagcctgaatgtaaagactaaaaagaatgccccttctgccacaatccaccaaggagaggaagaagggccattggacatttgggccgtggtgaaacccggtaacaccaaggagaagatagcgttttttgcatctcatcaatgctctaacaggatcgggtccatgaagatcaagagtagctgggacattgacggcagagccactaaaaggagaaaaaagtctggggatctgaagaaggccaaggtacaggtggagaggatgcgggaggtgaacagcaggtgctaccaacccgagcccttcgcttgtggcatagaacactgctccgtgcactacgttagcgactctggagacggcgtgtatgccggaaggcccctgtccgtgatccaaatggtggccttcctggagcagagggcctcagccctcctggccagctgttctaagaactgtactaactcccccgcaatcgtcagattttccggacagtctagaggagtgccagcagtcagtgagtcatatagcgcaccaggcgcttgcgaggaacccacagagcgagggaacctcgaagttggggagccacagagtgaacctgtccgagtgcttgatatggtggctaagttagaatcagaatgccttaagcgccagggccagagagagcccggtagcttgagccgaaataacagcttcagacgcaacgtcggacgggttctcctggccaactcgacccaggcagacgagggcaaaactaagaagggagtcttggaagccccagacacccaagtgaaccccgtagggagtgtgtcggtcgattgtggcccatcccgggctgatagatgctcaccaaaggaggatcaagcgtgggatggcgcttctcaggattgcccacccctgcccgcaggtgtttcttttcatattgactctgcggagctggaacccggatctcagacagctgtcaaaaactccaatagatatgatgtcgaaatgacggacgaactcgtggggcttccatttagtagccatacctattcacaggccagcgagctccccacagacgctgtagactgtatgagccgggagctcgtctccctgactagccgcaaccctgatcagaggaaagagtcactgtgcatttctattacagtcagtaaggtggacaaggatcagccttcaatcctgaattcctgtgaggacccagtacccggaatgctcttcttcttaccaccaggacaacacctgtccgattactcccagttgaacgaaagcaccacgaaagagtcatctgaagcatctcaactggaggatgcagcgggaggcgactcagccagtgaagaaaaatcagggagtgccgagcctttcgtgcttccagccagtagcgttgagtccactctccctgtgctggaagcctcctcgtggaaaaaacaggtatcacacgacttcttagagacaagattcaaaatacagcagcttttagagccccaacagtatatggcctttctgccacaccacatcatggtgaaaatctttcggctgctgcctacgaaatccctggtcgcccttaagtgtacttgctgttactttaagttcattatcgaatactataatatcagacccgcagacagccggtgggttagagatccaaggtacagggaggacccctgtaaacagtgcaaaaaaaaatacgttaaaggagatgtcagcctgtgtaggtggcacccaaagccctactgccaggcattgccttatggcccaggctattggatgtgctgtcacagaagtcagaaaggttttcctggatgtaagcttggactccatgacaatcattgggttccagcctgccatagttttaatagagccattcacaagaaagcaaagggcaccgaggcagaggaggagtactag

SEQ ID NO: 223026 - DNA, 567 bp, Artificial Sequence
  Description of Artificial Sequence: Synthetic coding sequence
atggccagctggctgccggagacactatttgagaccgtgggacagggcccaccaccctctaaagactactaccagctactagtcacccggtcccaagtgattttcagatggtggaaaatctctctccggagcgagtaccggtcaacaaagccaggagaagcgaaagagacccacgaggacttcctcgagaacagtcatttacaggggcaaacggctctcatcttcggcgctaggatcctggattatgtgataaacctgtgcaaaggcaaattcgattttctggagaggctaagcgatgacctactgctcacaatcatctcatatctggacctggaggacattgcccgattgtgccagaccagccacagatttgccaaactgtgtatgtctgacaagctctgggaacaaatcgtgcagagtacctgcgacacgattacacccgatgtgagagcactagctgaggatacgggttggcgccagctctttttcacgaataagctgcagctgcagaggcaactccgcaaaaggaaacaaaagtacggcaacctccgcgaaaagcagccatag

SEQ ID NO: 223027 - DNA, 2832 bp, Artificial Sequence
  Description of Artificial Sequence: Synthetic coding sequence
atgggtccccgaaagaaatcggttaagacctgtattatgaacaatgagatccctgaagagatgaccgcagatgagaccaaggactacatgaatcagttatctcatgaggtattgtgccacatctttaggtatctaccattgcaagacatcatgtgcatggagtgcctgtccaggaagcttaaagaagctgtgaccctgtatcttcgcgtggtgcgtgtagtggacctttgcgctggaaggtggtgggagtatatgccttccggatttaccgacgcttccttccttactctcctcaagaaaatgccagatgtggagcagctgtatggcctgcaccctcgatacttggagcggcgtagggtgaggggccatgaggcattcagtatcccgggtgtgctggaagcgctgcaggcatgcccgaacctagtgggagtcgaaacttcccacttggaattggtggagtcaatatggacctatatgcctcacgtgcacattcttggcaaatttcgtaacagaaatggagcctttcccataccaccggagaacaagctcaagatccctatcggagccaagatacagacactgcacctggtgggagttaacgtgcccgaaatcccatgcattccaatgttgcgacacctttacatgaagtgggtacgactgaccaagccgcagccgttcaaagactttttgtgcatctcgctcagaacgttcgtcatgcgcaattgcgccggaccaacaaactctctcaagtatgtgcccctggtgacaggtttggccagcgccaggaacctggaacacttggaaatggtgcgagttccgtttctgggaggcctcatccagcacgtggtcgaggacagctggagaagtggtggattcaggaacctgcatacgatcgtattgggtgcgtgcaagaatgccctggaggtggacttgggttacctcattataaccgctgctcgcagactgcacgaggtgaggatccagccgtctctgactaaagacggtgtcttctcagccctcaaaatggccgaactggaattcccacagttcgagactttacacctgggctacgtcgatgaattcttactgcaatcacgaatggccaatgctgatctggttaaatacggactggcggacgttgtggaaaatcctggcataattacggatattggtatgaaagcagtaaacgaggtgttttcttgcatcaaatatctcgccatatacaattgccctcacttgcataacccttacaactggatcagtgaccacagtcgttggactcgtctggtcgacatcaatctcgtgagatgccatgcacttaagctggattcttttgggcaattcatagagctacttccctctctcgaattcatcagcctggaccagatgtttagagagccacctaagggctgtgctcgtgttggcctgtccgccggaaccggtatcggggtctcctcagcattagtatcaaatcagaactccaataatgatgacaacaacgctcagaataacaatgcaaacattcacgataacaaccaccaccatcctgacgactctgatgaggagaatgacttccgccaggacttgcagcctggtgagcagcagtttgccgctgacgcgttgaatgagatggaagacatagtccaagaggatggagaggtggttgccgaatccgggaataacaccccagctcattctcaagcgatcattccggtggatgtcgatgaggagcaagcagggccaagcggcttacaaagggtggtgaagccaaccagtatcactgtgcacgatagcgaatctgacgacgaggaggactcccttgaactgcaggaggtctggattcctaagaacgggactcgccgatattccgagagggaggaaaagactggggagtctgtccaatctagggagctgtctgaagtggcaaagacgaagccaagacacgccatgaagcggaaacgtacggcggataagtctacctcgactagcgatcctgtcatcgaagacgaccacgtgcaggtcctggtgttgaagtccaagaacctggttggagtgactatgacaaactgcggcatcacggatctcgtcctgaaggactgtcccaaaatgatgttcattcacgccactcgatgccgcgtgctcaaacatctgaaagtggaaaatgctccgattgtaaaccggttcgactacgcacagtgtaagaagctaaatatggaccaagtgctcgaccaaatcctgagaatgcccccagaacgtaatcgtatcatttatctgcgccctatgcagcaggtggacactttaactctcgaacagaagctgtttagcggcccttatccatatcacatttgcatcatccacgaattctctaacccccctaacgttcgcaataaggtccggatccgtagttggatggataccattgctaatataaatcaagaactgatcaagtatgaatttttccccgaagccactcgaagtgaggaggatcttaaaaagtatccaaaatacccatggggtcgtgagatctacactttagagggggttgtggatggagcaccctacagcatgatcagcgatttcccttggctgcgctccctccgggctgccgaaccaaatagcttcgcgaggtatgattttgaggacgatgaagagtctacgatttacgctccaagacgaaaagggcagctgtccgcagacatttgtatggagaccatcggagaggaaatcagtgagatgagacaaatgaaaaagggtgtcttccagagggtggtggctatcttcatacattattgcgacgtcaacggcgagccagtggaggacgactacatctag

SEQ ID NO: 223028 - DNA, 3567 bp, Artificial Sequence
  Description of Artificial Sequence: Synthetic coding sequence
atgggccctagaaaaaagtcggttaagacatgtatcatgaacaacgaaatccccgaggagatgacggccgacgagaccaaggattacatgaatcagctgtcccacgaggtcctgtgccatatctttcggtatctccccctccaggacatcatgtgcatggagtgcttgtcgcgcaagctgaaagaagctgtgacgctttatctgagggtcgtgcgggtggtggacctgtgcgcgggacggtggtgggagtacatgccgtccggcttcaccgatgcctcttttctcaccctgcttaagaaaatgcccgatgtcgaacagctgtatggtttacatcctcgctatctcgagcgaagacgagttcgcggtcatgaagccttctcgatcccaggtgtcctggaggccctccaggcgtgccctaatctcgtcggtgtggagacctcccatcttgagctcgtggagtccatttggacatacatgcctcatgtccatatacttggaaagttcaggaaccggaatggtgcttttcccatacctccagagaataagcttaaaattcctattggggctaagatccaaacactccacctggtcggcgtgaacgtccctgaaattccttgtattccaatgctgaggcatctgtatatgaagtgggttcgactgaccaagccgcagcctttcaaggacttcctgtgtataagcctgagaacctttgtgatgcgcaactgtgcaggtcctacaaattcgctaaaatacgtgcctctggtaacaggtctggcttcagcgagaaacctagaacatctcgaaatggtgagagtgccatttctgggagggctgattcaacatgttgtggaagacagttggcgttccgggggattccggaacctgcacacaattgtcctgggcgcatgcaagaatgctctggaggtggacctggggtatctgatcatcaccgccgctagaagacttcatgaggtgagaatccagcccagtctgacaaaggacggggtgttcagtgccttaaaaatggccgagctcgagtttccacagtttgagaccctgcacctgggctatgtcgatgaattccttctgcagtctcgcatggctaacgccgacctcgtaaagtacggccttgcagacgtcgttgagaatccaggtataattaccgacataggtatgaaggcagtcaacgaggtgttctcatgtattaagtatttggctatttacaattgtccacatctgcacaatccgtacaactggatatccgatcattcaagatggaccaggttggtcgacatcaacctggtcagatgtcacgctcttaagcttgattctttcggacagtttattgagttgctgccatccctagaattcataagtctggaccagatgttcagagagcccccaaagggctgcgcacgcgtaggactatcagctggaacaggaattggagtgagtagcgctctggtcagcaaccagaactctaataacgacgataacaacgcccagaataacaacgccaatattcatgataacaaccaccaccatcccgacgattcagacgaggagaacgatttcaggcaagatcttcagcctggcgagcaacaattcgcggcagatgcccttaatgaaatggaagatattgtgcaagaggacggagaggtagttgccgagtcaggaaataacacccccgcacacagccaggctatcataccggtcgatgtggatgaagagcaggccggaccatctggcttgcaacgggtcgtcaagccaacgtcaattacagtacacgattcagagagcgatgacgaggaggacagcctggaactgcaggaagtctggatacctaagaacggaacacgccgatatagcgagagagaagagaaaaccggggagagtgtacagtctcgagagctgtctgtgtccggaaaaggtaaaaccccactcagaaaacgctacaactcacatcaaatgggccagtcgaagcagttccctctggaggaatcttcatgcgaaaagggctgtcaggtcacatcagagcagatcaaagctgacatgaaggctgcccgagacatccccgaaaagaaaaaaaataaagacgtgtacccttcttgcagttctaccaccgcaagcactgtgggcaacagctccagtcataacactgcctcccaaagtcccgatttcgtacgcactgtgaatagcggcggatcatccgagccctcaccaactgaggtggacgtttctagacagtgtgcttgtagccccggaggctccgaggacagtgaggccatggaagagggcgatgccgaatcttcagtttgtcctaggtgttgttgtcacagacctcaagagagccagagacgaactagccgctgctccgatgaggaaagaccgagtacatcccgtgcctgtgtcgtgaatggaccagatgggaccagatccgcctttagctttcgcacacttccacaaggaggttcatcaggccctgcacatgatgagaggacgaatggttccgggtcaggcgctaccggggaggatcgtcggggttcatcacagccagagtcatgtgatgtacagtcaaacgaagactaccctagacgccctttaaccagagctcgttctagactctcacacgtgctgttggtgtctgagtcggaagtcgccaagaccaaaccgagacacgccatgaaacgcaaaaggacggccgacaaatccacctccacatccgaccctgttattgaagacgaccacgtccaagtgctcgtcctgaagtcaaagaatctcgtgggagttacgatgaccaattgcgggataaccgacttggtcctcaaggattgtcctaaaatgatgttcattcacgccacaaggtgcagggtactaaaacacctgaaagtggaaaacgcacctattgtgaatcggtttgactatgcccagtgtaagaaacttaacatggatcaggttctcgaccaaatattacgtatgccacccgagcgcaatcgcataatctatctccgcccaatgcagcaagtggacaccctcacactcgaacagaaactgtttagcgggccttatccgtaccatatctgtatcattcacgaatttagcaatcccccaaacgtgcggaacaaggtcaggatccgttcctggatggataccatcgcgaacatcaaccaggaactgatcaaatacgaattcttccctgaggccacccggtccgaggaagatctgaagaagtacccaaaatacccgtgggggcgtgaaatctataccctggagggggtggtcgatggggctccgtattccatgatttcggacttcccctggctccgatcactccgtgcagctgaaccgaactcatttgctcgctatgatttcgaagacgacgaagagtctacaatatacgccccacgtagaaagggccagctttcggccgacatttgcatggagacaatcggagaagagatctcagaaatgagacagatgaaaaagggggtgttccagcgagtcgttgctattttcattcactactgcgacgttaacggagaaccagtggaggatgactacatttag

SEQ ID NO: 223029 - DNA, 3342 bp, Artificial Sequence
  Description of Artificial Sequence: Synthetic coding sequence
atggggccacgaaagaaatctgttaagacctgtattatgaataatgagatcccagaggagatgactgccgacgagactaaggattacatgaatcagctttcccatgaagttctctgccacattttccggtatcttcccctccaggatatcatgtgcatggaatgtctgtccaggaagctcaaagaggccgtgaccctctacctgagggtggtgagagtggtagatctttgtgcaggtaggtggtgggagtacatgccatccggatttacagacgccagctttttaacactgcttaagaagatgcctgatgtggaacagctctacgggcttcaccccagatatttagaacggagacgcgtgcgaggtcacgaggccttctctatccctggagtactcgaggcactgcaggcttgtcccaaccttgtcggagtggagacctctcatctggagctggtggagtcgatctggacatatatgccacatgttcacatattgggcaagttcaggaaccgcaatggtgcattccctattccgccagaaaacaagctgaagattcccattggcgcaaagattcaaaccctgcacttggtgggcgtgaatgtgcctgagattccctgcatccccatgcttcggcatttgtatatgaagtgggtgcgattgacgaagccccagcccttcaaggattttttatgtatctctctgagaactttcgtgatgcgtaattgcgccggtcccaccaattcacttaaatatgttccactggtaacaggtctcgcttctgctcggaacctggaacatctagaaatggtgcgtgtgccttttctgggagggttaatacagcatgttgtggaagatagctggagatccggcggatttcgtaacctgcacactattgtgctgggcgcatgtaaaaatgcccttgaggttgatttaggatacttgatcattaccgctgcccgacgcctccatgaggtgcgcatacagcctagcttgactaaggatggtgtgttctcagctctcaaaatggcagagctggagtttccccagttcgagacactacatctggggtatgtcgacgagtttctcctgcagtccagaatggccaatgccgaccttgttaagtacggtcttgcagacgtcgttgagaatcccggaattatcacggatataggcatgaaggccgtgaatgaggtcttttcttgcattaagtacttggccatatacaattgcccacatctgcacaatccttacaactggatctcggatcactctaggtggactcggcttgttgatataaatctggtacggtgtcacgccctcaagctggacagctttggtcagttcatcgagctgctgccaagcttggagttcataagtctcgaccaaatgttcagggagcctcccaagggctgcgccagggtgggcctgagtgccggaaccgggattggcgtaagtagcgccctggtgtcaaatcaaaattccaacaacgatgacaacaatgcccagaataataacgccaatatccatgataacaaccatcaccaccctgatgattcggacgaggagaatgacttcagacaagacctacagcctggcgagcagcagtttgccgcagatgccttgaatgagatggaagatatcgtgcaagaggatggggaagtagtagctgagagtggaaataatacaccggctcactcccaagctataatacccgtcgatgtggacgaggaacaggcgggtcctagtgggcttcagcgagtcgttaaacccacttcaataacggtgcacgatagtgaaagcgacgacgaggaggactctttagagttacaggaagtttggatccctaaaaacggcacccgtcgttactccgagcgggaggagaagacaggagaaagcgtccaatctagggagctgtcagtgagtggcaaaggtaagaccccgcttcgaaaacgttacaactcccaccaaatgggccagtcaaagcagttccccctagaggagtcctcttgtgagaaagggtgccaagtgacttcggagcaaatcaaggctgacatgaaggccgcacgagatatcccggagaagaaaaaaaacaaggacgtgtatccgtcatgttcctctacgacagcttctacggtaggcaactcgagctcacacaacaccgcctctcaatccccagatttcgttcgcactgtcaattctggaggatccagcgagccctcaccgaccgaggtggatgtgagtaggcaatgtgcctgtagcccaggcggatccgaggacagcgaagccatggaagagggcgatgcagagtctagtgtttgtccacgctgttgctgtcaccggccacaggagtctcagaggagaacctctcgctgcagtgatgaagaacgtccttcgactagcagagcctgtgtggtgaatggtcccgacgaggtggcgaaaaccaagcccaggcatgctatgaagcggaaacgaaccgcagataagagtacatctaccagcgatcccgtcattgaagatgaccacgtgcaagtactggtccttaagtcaaagaacttggtcggagtcacgatgacaaattgcggtatcaccgacctggtgttgaaagattgtccaaaaatgatgttcattcacgcaacccgctgccgggttttaaagcatcttaaagtcgaaaacgccccaatagtgaatagattcgactatgcacagtgcaaaaagctgaatatggatcaggtcttggaccaaatcctgcggatgccgcctgagagaaatcgcattatttacctcagaccaatgcagcaggtggataccctcacactcgaacagaaactttttagcggaccgtatccatatcacatttgtatcatccatgagttttccaatcctccgaacgtgaggaacaaggtgcggatcaggagctggatggacacaattgctaacatcaaccaggagctgataaagtacgagtttttccctgaggctactcggagcgaagaggatcttaagaaatacccgaaatacccttggggcagagagatctacacgctagagggtgtcgtggatggcgctccttattccatgatctcggatttcccatggcttcgcagcctgcgggcagctgagccaaattcattcgctcgctatgactttgaagacgacgaagaatccaccatttatgcccctcgcaggaagggccagctatcagccgacatctgtatggagaccataggcgaggagatcagcgagatgcgccaaatgaaaaagggggtgtttcagcgggttgtcgccatcttcatacactattgtgatgtaaacggggaaccagtggaggacgactacatatag

SEQ ID NO: 223030 - DNA, 2832 bp, Artificial Sequence
  Description of Artificial Sequence: Synthetic coding sequence
atgggcccaagaaaaaagagtgtcaagacttgcatcatgaataacgagatccccgaggaaatgaccgcagatgagacaaaagattacatgaatcagttgtctcatgaagtcctgtgccacatttttaggtacctccccctgcaggacataatgtgtatggagtgtctgagcagaaagctcaaggaggcagttactctctatcttagagtggtcagggtagtcgacttgtgcgctggtcgttggtgggaatacatgccgtcaggctttaccgacgcctctttcctcactctgctgaagaagatgccagacgtggaacagctttacggactgcacccacggtacctggaacgcagaagagtccgaggccacgaagccttctccatccccggagtgcttgaggcgctgcaagcgtgtccgaacctggttggagtcgagacaagccacctggagttagtggagagcatatggacttacatgccccacgtccatatcctgggaaaatttcggaatcgcaacggcgctttcccaatccctcctgaaaacaagctgaagattccaataggtgcaaagatccagactctccacttggtaggcgttaatgtccccgagatcccttgcattcctatgctaaggcacctgtacatgaagtgggtgcgtctcaccaaaccacaaccattcaaagatttcctgtgcatcagtcttaggaccttcgtgatgaggaattgtgctggaccaacaaatagccttaaatacgtgcctctcgttacaggcctcgcctccgctcgcaacctggagcacctggaaatggtccgagtgccctttctgggcggactcatccagcatgtagtggaggatagttggcgcagtggaggcttcagaaacctgcacacgatcgtgctgggggcttgcaagaatgctctcgaagtggacctcggatatcttatcattaccgctgccagacgcctacatgaggtgaggatccagcccagcctaaccaaggatggggtgttcagcgcactcaagatggcagaactggagttcccccagtttgaaacgctgcacttaggctacgtggacgaatttctgctgcagagtagaatggccaacgccgaccttgtcaaatatggattagcagacgtggtcgaaaaccctggtatcatcactgacatcggaatgaaagccgtgaatgaggtcttcagctgcataaaatatctggccatctacaactgtccacatttgcacaacccatataactggatctccgaccacagccggtggactaggctggtcgacatcaacttggtgcgatgccatgcattaaaacttgactcattcggccaattcatcgaactgctgcccagcttggaatttatctctttagatcaaatgttcagagaaccccctaaggggtgtgctcgcgtgggtctctctgccggaactggcataggcgtcagtagcgcactggtgagcaaccagaacagcaacaatgacgacaataacgcgcagaacaacaatgcaaatattcacgataacaaccatcaccacccagacgactctgacgaggagaacgatttccgccaggacctgcagccgggagagcagcagtttgccgcagacgctctgaatgagatggaggacattgtccaagaggatggtgaagtcgtggcagagagtggaaacaacaccccagctcattcacaagcgatcatccccgttgacgtggacgaggagcaggcgggtcccagcgggttacagagggtggtgaagcccaccagcatcaccgttcatgattccgagtctgatgatgaagaagatagtctggagctgcaggaagtgtggatcccgaagaatggtacacgtcggtactcagagagggaggagaaaacgggcgagagtgtacagtctagggagttgtccgaagtcgcaaaaaccaagccccgacacgccatgaagaggaagcgaaccgcggacaaatctacctcaacatccgacccagtcatcgaagatgaccatgtgcaagtactggtgttgaagtcaaaaaatcttgtaggcgtcactatgactaactgtggaataaccgatctagtgctgaaagactgccccaagatgatgtttatccatgcgactcgatgtagagtattgaagcatctgaaagtcgagaatgctccaatagtcaatcgctttgactatgcacagtgtaagaagctgaatatggaccaggtactcgatcagatcctgagaatgcccccagagaggaataggatcatatatttgaggcccatgcaacaagtcgatacactcactttggagcaaaaactgttctctggcccatatccctaccacatttgtatcatccatgaattttcaaatcctcctaatgttagaaacaaggtccgtattcgttcctggatggataccatagccaacatcaatcaggagctcatcaagtatgaatttttccctgaggccacccggtcagaagaagatctcaagaaatacccgaagtacccctgggggagagaaatctataccctggaaggagtcgttgatggggcaccgtattccatgatatccgacttcccttggttgcggtccctgagggcagccgaaccgaacagctttgctcgctacgatttcgaggacgacgaggagagcacgatttacgcacctcggcgaaaagggcagctgtcagccgatatctgcatggagacaatcggagaagagattagcgaaatgcgccaaatgaagaagggggtgtttcagcgggtcgtggccatcttcatccactattgtgacgtaaacggtgagcccgtggaagacgactacatctag

SEQ ID NO: 223031 - DNA, 1329 bp, Artificial Sequence
  Description of Artificial Sequence: Synthetic coding sequence
atggacgaggagagtgagctcattcagccccaggatcagagttgctgggctttcctccctgatctgtgcttgtgccgcgtattttggtggctcggcgatcgggaccggtcccgggctgcactggtgtgcaggaaatggaatcagatgatgtacagcgccgaactctggagataccggacaataaccttctctgggagaccatcgcgggtccatgccagcgaagtggaaagcgccgtctggtacgtcaaaaagttcggccgttacctggaacacctcgaggtcaaatttatgaatccatataacgccgtgctcaccaaaaagttccaggttacgatgcggggtctattatcctgccttagtaaatcaaataacaggttgaagtccttgtccatccagtatttagaattggatcgactggtgtggagaaattcgatacggagcagctttattagtagtctgagttttttcctgaagaagatgggcaagcgcctggactacctgaacctgaaaggtgctcgactaactgtagaacaaggctgccagatactggactccctcagttatatgcgtaatgagaacgtgatttctgagctgaacattgaagactacttctcccaccaccttgcggtgtataatagtccccagtttaaaaagaccatgtctactttccacaacttggtctccttaaaccttaattataactgtatctccgacgagcttctcgagaacctttgcgagaacgcgtctactctgcggactattaacataaagtgtcacgtccacgacccacacggccaggtaatctggggaatgtcatgggcaaagctcgcgaggcaggccactaatctcaaggtaaatttcttttttgagaggattatgaaatatgagagactggctcgtatactgctccaggagatacccatccggagcatttccttacggagttgttattttagtgaccccgattgttccatgaggccgacacttatagatctattacccactttcaggcatactctgcagaaattaacttgtgaattcaataacaaccatgagagtctcgatgaggaactgcatctgctgatcatctcttgccgtaagctgttctactttaaaatttgggcctttctggacgtttctttcgttgagcgaatccttaaaagtcagaaggagcggcaatgtgctttgcgcgtgtttaaggccaggatctacactaatcgttacgagacgaacgaagaggacaaaactctccaggaaatttatcgtaaataccgaaagctcatcgaaagcgagctgtcatacttcgtgatagtttactccgttatgtag

SEQ ID NO: 223032 - DNA, 1164 bp, Artificial Sequence
  Description of Artificial Sequence: Synthetic coding sequence
atggctggaagcgaacctaggagtggtactaatagtcctccaccgcctttttccgactggggacgccttgaggctgccatcctgagtggctggaaaacattctggcaatctgtctctaaagaaagagtggccagaacaacaagtcgtgaagaggtggacgaggctgcgtcaactttgaccaggctccccattgacgtccaactgtatattcttagcttcctgtccccgcacgacctttgtcagctcggatcgacaaaccactactggaacgagactgtgagagatcctatcctgtggcgatactttctcttacgcgacctcccatcctggagctccgtggattggaagagtcttcctgacctggaaatcttaaaaaagcccattagtgaagttactgatggcgctttttttgactacatggcagtttatcgaatgtgctgcccctacactagaagggccagcaagtcgtcccgccctatgtatggagccgtaacaagtttccttcattccctcatcattcaaaatgagcccagattcgctatgttcgggccagggttagaagagcttaataccagtctcgttctttccctgatgtcctctgaagagctgtgcccgacagctggcctgcctcagcgacagattgatggcatcggaagcggagtgaacttccaactgaacaaccagcataagttcaacatcctgatcctgtactctactaccagaaaagaaagagacagggctcgcgaggaacacacaagcgctgtgaacaagatgttctcgaggcacaatgaaggagacgatcagcaggggtcccgctatagcgtgataccccagatccagaaagtatgcgaagtggttgacggatttatctacgtcgccaacgctgaggcacacaaaagacatgagtggcaagacgagttttctcacatcatggctatgacagatcccgcttttggctcttccggcagacctctgctggtgttatcctgcatttcccaaggtgacgtcaagcgtatgccctgtttttacctcgcacacgaactccatctaaaccttttaaaccacccctggttggtacaggacactgaagctgagaccctgacagggtttctgaatgggatcgagtggatactggaggaagtggaaagcaaacgggctcgttag

SEQ ID NO: 223033 - DNA, 924 bp, Artificial Sequence
  Description of Artificial Sequence: Synthetic coding sequence
atggcaggctctgaaccacgcagcggcacgaatagccctccccctccattttcagactggggacggcttgaggctgctattctgtccggctggaaaaccttctggcagagcgtgtccaaggagcgcgttgctagaactacttctcgggaagaggtggatgaagccgcatctaccctgacaaggctgccaatcgatgtacagctctacattctgtcttttctaagccctcacgacttgtgtcaacttggtagcacaaatcattactggaatgagaccgtgcgagaccctattctgtggaggtacttccttctgagagatttgcccagctggtcatctgtggattggaagtctctcccggatctggagatcttgaagaaaccaatcagcgaggtgacagatggggcattctttgattacatggccgtgtacaggatgtgctgtccctacacacgcagagccagcaaatcaagtaggcccatgtacggtgctgtcacctccttccttcacagcctaataattcagaacgaacctcgttttgctatgtttggacccggtcttgaggaactgaacacgtccctggtcctgagcctcatgtcttccgaggaactgtgccccaccgctggtttgcctcagaggcagatcgacggcatcgggagcggcgtaaatttccagctcaataaccagcacaagtttaacatcctgattctgtactcaaccacacgtaaggaaagggacagagccagggaggagcacaccagtgcggttaacaaaatgttctcccgacataatgagggggatgaccaacaggggagtaggtactccgtcatcccgcagattcaaaaggtgtgtgaagtggtggatggcttcatctacgtggccaacgcagaggcgcacaaaagtaaatactcctacgtccatttttag

SEQ ID NO: 223034 - DNA, 2130 bp, Artificial Sequence
  Description of Artificial Sequence: Synthetic coding sequence
atgggtaaagctcggaggtctccccctggacaccataggcactgcgaaggttgcttcaacaggcattgtcacattccagtcgagccaaatacttcttgcctggtgatcagttgtcatctcctatgtggagccacctttcacatgtgcaaggaggctgaacaccagctcctttgcccactggaacaagtgccctgtttaaattctgagtacggctgcccactcagcatgagtaggcacaagctcgccaaacatctccaggtgtgccctgcctccgtcgtgtgttgttctatggagtggaacaggtggcccaatgtagacagcgaaacaacacttcatgagaacattatgaaagaaacaccttccgaggagtgtctagacacagcccttgcattacaagaccagaaggttctgtttaggtcgctgaaaatggtggagttatttcccgagactagggaggccaccgaggaagagccaacgatgaacggcgaaacatccgtggaagagatggggggtgctgtaggtggcgtcgatatcgggctggtgcctcacggcctctccgccacaaacggggaaatggctgagttaagccaagaggaacgcgaggttttagctaaaactaaggagggaatggatctggtcaagttcgggcagtgggaaaacatctttagcaaagagcatgccgcttccgcactcacaaattcatcagcaagttgcgaatcgaagaacaagaacgatagtgagaaggagcagatcagttccgggcacaacatggtcgaaggcgaaggggctcccaaaaaaaaggagccccaggagaaccagaaacagcaagatgtgagaacagccatggagaccaccgggctggccccatggcaggacggggtattggaaagactcaaaacagctgtcgacgccaaggactacaatatgtacctggttcataatggcaggatgctgattcacttcggccaaatgccagcctgcaccccaaaagaaagggacttcgtgtatggcaagttggaagctcaggaggttaagaccgtgtacaccttcaaggttccagtgtcctactgcggtaagagagctcggttgggcgatgctatgctaagctgtaaaccctccgagcataaagctgtcgacacttctgatctgggaatcaccgtggaggacttgcctaagtctgacctgataaaaacgacactccagtgcgccctggaaagagagttaaaagggcacgtgattagcgagtctcgatccattgacggcttgttcatggacttcgcaacacagacctataacttcgagccagagcagttcagttctggcaccgttcttgccgatcttacagccgctacccctggcggtttgcatgtggaactacactccgagtgcgtcacaaggcgccataacaaaagttcctccgcatttacttttacctgtaacaagtttttcagacgagatgaattccctctccattttaaaaatgtgcacacagacatccagtcttgcctaaatggctggtttcagcatcggtgccctctagcctacctgggatgtacctttgtgcagaaccacttccgaccaccaggacagaaagctaaagtaatctacagtcaggaactgaagacctttgccatcaaacctgaggttgcgcctgaattgtcggaaggcaggaagaataaccacctcctcgggcatggaggcaagtcccagaactccctgacgtctctgccgttggaaattctcaagtacattgccggatttcttgattccgtttctctggctcaactcagccaggtcagcgtgctgatgagaaacatttgtgcaaccctactgcaggagcgaggaatggtactgctgcaatggaaaaagaagaggtactcacatgggggtaccagctggcgggtgcaccgagagatatggcagttctcatccctgttctctaaaatcaaaagctgggaattcaatgaggtgaccagcatgagtgagcatctgaagtcatgtccttttaacattgttgaacataaaaccgatcccatactgcttaccagcatgtgtcagccaagggaacaggcacgtgaatcactcgtgagtacttttagaattcgccctcgaggaagatacgttagctag

SEQ ID NO: 223035 - DNA, 2811 bp, Artificial Sequence
  Description of Artificial Sequence: Synthetic coding sequence
atgactacagggctttccgaccagcaggtggtctgcgatctcgatcaccgcgctgtggaggccctgctccaggctgtccgaaagcggatggcaggcgcttctcccgcagtaccacatgaacgggctcgactgacagggggagcggctgccgttgaaccggcatgcagaggcggagggggtgccatggcgtcactagatctcccttatcggtgtccccgatgtggggagcataaaagattccggagcctttcgagcctgagggcacacctggagtatagccacacttatgagacattgtacatcctgagcaaaaccaattctatctgcgatggggctgccgcagctgcggcagcagcagcggctgcttctggctttccactggctcctgagcctgccgctctgctcgcggttcccggtgctcggcgagaagtcttcgagtcaacaagcttccaggggaaagagcaggctgcaggcccttcaccagccgctccacacttgctccatcatcatcatcatcacgcccctttggcacattttcctggggacctggtccctgcctctcttccatgcgaggagttggctgagcccggtctcgtgcctgcagctgcagctcggtatgcactgcgggagatcgagattcccttgggcgaactgtttgcccgaaaatccgtcgcatcctcagcgtgcagtaccccaccaccaggcccagggccaggcccttgccctggcccagcatcagccagcccagcaagtccaagcccagccgatgttgcttacgaagagggacttgccagacttaaaataagggccctcgagaagctcgaggttgaccggcgattggagcgactctctgaagaagtcgaacagaagattgcaggccaggtcggacgcttacaagccgaactggagcgcaaagcagccgaactggagacagcccgacaagaaagtgcccgactggggagagaaaaagaagagttagaagagagagcctctgaactgagccgccaagttgacgtcagcgtggagttattggcttccttgaaacaggatctggtgcataaggaacaggagttgagtagaaaacaacaggaggtggtccagatcgatcaattcttgaaagagacagcggctagagaggcatccgcgaaactgcggctgcagcagtttatcgaagagctattggagcgcgctgatcgtgctgagcggcaacttcaggtaatctccagcagttgcggcagtacgccctccgcctccctggggagagggggaggcggtggaggcgcaggcccaaatgcacggggtcccggtcgcatgcgtgaacatcatgtcggccctgcggtcccgaacacttatgccgtctctcgccacggcagcagtccatcaactggggcttccagcagagtgcccgctgcctcccagagctctggctgctatgacagcgattccctagagctgccacggccagaagagggcgctccagaggacagtggaccgggaggactggggacccgggctcaggcggctaacggtggcagcgagaggagccagccacccaggtcctccgggttgcggaggcaggccatccaaaattggcagagacgcccacggaggcattccaccgaaggcgaggagggagatgtctcagacgtgggctcccgcaccactgaatccgaagcagaaggcccattagatgcacccagaccgggtccagcaatggcaggcccattgtcctcatgccgcctaagtgcacgaccagaagggggatctggtagaggcaggcgggcagagagggtatcaccaagcagaagtaacgaggttatctctccggaaatcctcaagatgagagctgctttattctgtatttttacttaccttgatacgaggactctgttgcacgcagctgaggtgtgcagagactggcgcttcgtcgccagacatccggctgtatggacacgagtgctactcgagaacgcaagggtctgcagtaaattcttagccatgctggctcagtggtgcacacaagcccattccctgaccctgcagaacctgaagccaaggcaacgcggaaaaaaagagagtaaagaggaatatgcccgttccactcgcggatgtctcgaagcaggtctggaaagtctcctcaaagcggcagggggaaatctgctcattctacggattagccactgtccaaatatactgacagacagatcgctatggctggccagttgttactgcagggctctacaggcagtcacctataggtccgctactgacccagtgggccacgaagttatctgggccctgggcgcaggctgcagagagatcgtgagcctgcaagtcgctccgctgcacccttgccagcaacccaccaggttctcaaaccgatgcttgcaaatgattgggagatgctggccgcacctccgcgctctgggtgtcggcggtgccggttgcggcgtgcaaggtctggcaagtctggcgcgtaactgtatgcggctgcaggttcttgagctggatcacgtgtctgaaatcacgcaggaagtcgcggctgaggtgtgtcgagaaggactaaagggcttagagatgctggtactgacagccacaccagtgactcccaaggcgttgttacattttaactctatctgcaggaatttaaagtccatcgtggtacagattggtatcgccgattattttaaggaaccatcatctcctgaagcccagaagctctttgaggatatggtcactaaactccaagccctcagaagaaggcctgggttttcaaagatcctccatattaaggtggaagggggttgctag

SEQ ID NO: 223036 - DNA, 2628 bp, Artificial Sequence
  Description of Artificial Sequence: Synthetic coding sequence
atggctagcctggacttaccatacagatgccctcgctgcggagagcataagcggttccggagtctcagctcccttcgcgcacacttagagtattcccacacatacgaaacactatacattctgtccaagaccaacagcatctgcgatggagcggctgccgcagccgctgccgcagctgcggcatccggattcccattggcaccagaaccggctgccttactggctgtgcctggggcaaggagagaggtgtttgagagcacctcatttcagggaaaggagcaagccgctggcccttccccagccgctcctcacctgctccaccaccaccaccaccacgctcctcttgcccactttcctggagatctcgtaccggcttccctgccttgtgaggagctggcagagccaggactcgtgcctgcagctgctgcccgttatgcattgcgggagatcgaaataccgttgggcgagctgtttgctcggaagtcagtcgcgagcagtgcatgctcaacaccccctcccggacctggacccggaccttgtcctgggccagcgtcagcctcgcctgcaagtccaagccccgctgatgttgcatatgaagagggcctggccaggctgaagataagggccctagagaagctggaagtcgatcgaaggctcgagcgtctgtccgaagaagtggaacagaaaatcgccggacaggtcggcaggctccaggctgaactcgaacgaaaggcagcagagctggaaacagctaggcaggagtcagcacgtctgggcagagagaaggaggaactggaggagcgggcatctgaactttctcggcaggtggatgtgagtgtggagctcttagccagtctgaaacaggatttggtgcacaaggagcaggagctgagtagaaaacagcaagaggtggtgcagatcgaccagtttctgaaagagaccgcagccagagaggcttccgccaaacttcgcttgcagcagttcatagaagaattgttagagagggctgaccgggctgagcgccagctacaggtaatctcgagctcctgtgggtctaccccgtcggcctcgctgggtcgaggcggtggcggtgggggtgcaggtcccaatgctcgcggacctggcagaatgcgagagcaccacgtgggaccagccgtgccgaacacctatgcggtgtctaggcacgggagcagccccagcaccggcgctagctcccgcgtgcccgctgcctctcaatcttccggctgttacgattctgatagcctagagctgccaagaccggaagaaggcgctcctgaggattctggaccgggaggcctgggtacccgggctcaagctgcaaacgggggttcagaacgctcacagccccctagatctagcgggcttcgacggcaggccattcaaaactggcagcggcgtcctcgcagacacagtactgaaggcgaggaaggtgatgttagtgacgtcggatctcggacgacagaaagcgaggcggaagggcctctcgatgcacccaggcccggacccgctatggccggtcccctgagcagctgtaggctctctgcgcgacccgagggaggcagcggacggggtcgcagggcagagcgggtctcaccttctaggagtaacgaggtcatcagcccagagatcctcaagatgagggccgctctcttttgtatttttacttacctcgacactaggacactcctccacgcagctgaggtgtgtcgtgattggagatttgtggctaggcatcctgccgtgtggaccagggtcctcctcgagaatgccagggtatgcagcaagttccttgccatgctcgctcagtggtgcacccaggcccattccctgacccttcagaacctgaagcccagacagcgcggaaaaaaggagtccaaggaggaatatgccagatcaacgcgcggttgcctggaagctggcctggagagtctgcttaaagccgcaggtgggaatctcctgattctacggatcagtcattgtcccaacattctgactgaccgatcactgtggctagcttcgtgttactgtcgtgcactgcaggctgtgacatatcgtagcgccacggatccagtggggcacgaagtgatttgggctctgggggcagggtgcagagagattgtttctcttcaggtcgcccctctgcatccatgccagcagcctacgcgctttagcaatcggtgccttcagatgattggtcggtgttggccacacctcagagctctgggagtggggggagcaggctgcggcgtgcaggggttagcaagtctggccagaaactgcatgagactccaggttttggaactcgatcatgtcagcgaaatcactcaagaggttgccgctgaagtttgtcgagagggcctcaagggcctggagatgctggtgctcacggcgacccccgtgacgcccaaagcactgctgcatttcaactccatctgtaggaatttgaagagcatcgtcgtgcagattgggattgcggactatttcaaagaacccagctctccagaggcccagaagctttttgaagacatggtcacgaagctgcaggcactgcgacgaagacccggatttagcaaaattctgcatattaaggtcgaggggggatgctag

SEQ ID NO: 223037 - DNA, 2154 bp, Artificial Sequence
  Description of Artificial Sequence: Synthetic coding sequence
atggcaagctcctcagattccgaggatgacagtttcatggccgtcgaccaggaggagactgtgctggaaggtactatggatcaggacgaggagccacaccctgtgctggaagctgaggaaacaaggcataaccggagtatgtcggagctgccggaagaagtgctggaatacatccttagctttctgagtccataccaggagcataaaacagcagcactggtttgtaaacagtggtaccggctcatcaagggtgtcgcacatcaatgttaccacggctttatgaaagcagtccaagagggaaatatacaatgggagtcgaggacttacccgtatccaggaactccaatcacccagcggttttcccattcggcatgttattatgatgcgaatcagtccatgtatgttttcggtggttgtacccagtcgtcgtgcaacgctgcattcaatgacctctggcgcctggatctcaattctaaggagtggatcaggcctttagccagcggctcttatcctagccccaaagcgggagcgacgctggtggtgtacaaggatctgttagtgctgttcggagggtggacccgtccatccccgtatccgctgcatcagccagaacgcttttttgacgagattcacacatacagcccctccaagaattggtggaactgcattgttactacccacgggcctccacccatggctggccacagctcttgtgtgatcgatgacaagatgatagtatttggcggtagccttggaagccgtcagatgtccaacgatgtttgggtccttgatcttgaacagtgggcctggtccaagcccaacatctctggtcccagtccccacccgaggggaggtcagtcccagattgttatcgatgacgcgactatcctgattctgggcggatgtggaggccctaatgccttgttcaaagacgcttggctgctgcacatgcattcgggaccgtgggcctggcagcctttgaaagtggagaatgaggaacacggcgctcccgagctatggtgccatccggcatgtagagtgggacagtgtgtggtggtattctcccaggccccatcagggcgtgcacctttaagtcccagccttaacagtaggccaagccctatctccgctactcctcccgcactggtaccagaaacccgagagtaccgatctcaatctcccgtacgctccatggatgaggcaccctgtgtcaacggccgttggggaaccctgcggcctagggctcagcgacagactcccagtggcagcagagagggctccctctcgccagccagaggcgacgggtctcctatccttaatggtggcagcctgagccccggaaccgccgctgtcggaggatctagcctggactctcctgttcaagccatctcaccaagtaccccaagcgcacccgagggatacgatctgaaaatcggtttgtccctcgcaccgcgtcggggaagtctgcctgaccagaaggacctgcgattgggttcgatcgatctgaattgggatttaaagccagcaagtagctccaacccaatggacggcatggacaaccgcaccgtcggtggttcaatgcggcatcctcctgagcaaactaatggtgtgcacactccaccccacgtggccagcgctctggcgggtgctgtgtctcccggtgccttacgcaggtcactcgaggccattaaggccatgtccagcaaaggaccgtccgcttcagctgccctctctcctccactcggatcatcacccggatccccaggatctcagtctctctcctctggagaaaccgtccccatccccaggcctggtccagcccaaggggacgggcattccctacctccgatcgctcgacggttgggccaccacccaccccaaagtcttaacgtcgggaagcctctctaccagagtatgaattgcaaaccaatgcagatgtacgtactcgacattaaagacacgaaagaaaagggcagagtgaaatggaaggtattcaactcgagcagcgtggtaggaccccctgagacttcacttcacaccgtggtgcagggccgaggggaattgattattttcggcggactgatggacaagaagcaaaatgtgaaatattatcctaaaacgaacgccctgtatttcgtcagggcaaaaagatag

SEQ ID NO: 223038 - DNA, 900 bp, Artificial Sequence
  Description of Artificial Sequence: Synthetic coding sequence
atgtcctctccccctcagatcgtcatagacgacgcaacaattctcattctgggtggatgcggtggtccaaatgctttatttaaagatgcgtggcttctgcacatgcactcaggaccctgggcatggcagcctctgaaggtagaaaatgaggagcatggtgcccctgagctgtggtgccatccagcctgtagggtcggccagtgcgtggtggtgttcagccaggcgccttccggtagggctcccctgtcgccatccctcaacagccggccatccccaatcagtgcgacacctcctgcactcgtcccagaaacgagggagtaccgctctcagtctcctgtgcgtagcatggacgaggccccttgcgtgaacggacgctggggaaccctgagaccacgggcacaacggcagacccccagcggcagcagagagggtagcctaagtccggctaggggcgatggctcaccgatcctgaatgggggtagcttgagtcctggaaccgccgcagtgggcggatctagcttggatagccctgtgcaggccatctctccctccacgccttcggcccctgaggggtatgatctaaagattggcctatcactggcccctcgccgagggagtttgccagatcagaaggatctgagactgggctctatcgacctgaattgggacctcaaaccggcttcctcctcaaatcctatggacgggatggataatcgcaccgtgggtggaagcatgcggcatccacctgaacagacgaacggggttcatacacctccccacgtagcgagtgcactcgcaggggcagtgtcacccggtgctctgcgtaggtccctggaagccatcaaggctatgagcagcaagggcccatccgccagtgcagccctcagccctcccctctag

SEQ ID NO: 223039 - DNA, 900 bp, Artificial Sequence
  Description of Artificial Sequence: Synthetic coding sequence
atgagttcgccccctcagatcgttattgatgatgcaacgatactgatccttggagggtgtgggggacccaacgccctgttcaaggacgcttggctgttacacatgcactctggcccttgggcatggcagccgctaaaggttgagaatgaggagcatggtgctcccgagctgtggtgtcacccagcttgcagggtgggacagtgcgtagttgtttttagtcaggccccaagcggcagagcccctctgtcgccttcactaaatagccggccttcaccaattagcgctacaccaccagcactggtccccgaaacccgggagtaccgcagccagtcccccgtgcgctcaatggacgaagctccgtgcgtgaacgggcgatggggaaccctgaggccacgcgctcagcgccaaaccccaagcggatcccgggaaggctcactaagccctgctcgaggtgacgggtcaccgattctgaacggcggtagcttgagccccggtactgccgcagtgggtgggagttctctagactccccggtgcaagcaataagcccttcaacacctagcgcccctgaaggctatgacttaaagatcggtctgtcactcgcgccaaggagaggatctctacctgatcaaaaagatctacggctcgggtccattgatctgaattgggatctgaaacccgcttcaagctcaaaccccatggacggtatggacaatcgtactgtggggggttcaatgaggcatccacccgagcagacaaacggagttcatacacctccacatgtggcatccgcactggctggcgcagtcagcccgggagccctgcggcgaagtttggaggccatcaaagctatgagtagtaagggacctagcgctagcgcagctctgtcccctccactgtag

SEQ ID NO: 223040 - DNA, 2127 bp, Artificial Sequence
  Description of Artificial Sequence: Synthetic coding sequence
atgtcatttaaggacaaggatgagcgtatatcctgtctggaggcatatgtgactctaacctcaaagtcatctcgatttacagatgagaccgaaatcctgaagatgtctcaaagacattctggacaggctggaacagaagctggaaatggtgccgattctcctcccattgtgaacagtaaatattccactttcagggacttctgcagcacttcctcattccaagattctggatataatgaattgaagagctgttcgttcgacaacattgacaaagaatatctcggtaaaaaggaaaaaggcccaacactgctttatgagcaccccgagacaagtggcctagggctaacgcaccccctggagtcaccaacccaaaagaaaaagtgcattctgcctcgaaaggaaaaggataagacacccgagctctgtgagactcccaagatcagtggcaaaaaatgcttaccgcgaagacgccttaatgtttccttcgctttactgaagggggacttcgagtctcagaacagctctctggaaagctccatctctcaggttattaatctggagaaaaatatcccatcatccgctagcggctttagccgcgcaaacaatttttctcccctcgtgactagcacattaaaaacggaggaagtgacatcctgtagtcagaagctcaggctgaacttctctcagcagaagaccagcactattgacgattcaaaagatgattgctccttattcgaggtagagtgtatcagccccattcagggtaacaactttaaggactccatcactcacgacttcagtgatagctctctttgtattaatgacgaaaatgcctgtccagaactcctgggttcatctgtctccgggacaacctgcggtactgacgaagatatttttgttacccccatttccaatctggttgcaaacatccggtttaatgctagccagattctctctcccagtcccgaggttaggggctcaattagcaccccagaggattctgggtttaatagtctgtccttggaaaaatctgaagatagcctcagcgaccaggagggctcgtttcaagaactcctgcagaaacataaggggacacccaaagtaggcgacactatccgcaaaacgcgtcatctcggaaggtctagacgcctgagtactctccgcgagcaaagttcccagtccgagacagaagaggagaagcagatcgtgcacccagattcagaaaaacgtgctgcggctgctagtgctatcagtgaagggcagctgagttccgatgagagcggggatctgacgttttccctcaaaaatctctcgaagaccccagcgctgcagctagtccatgagctgttcatgaagtctaagaggaaacgcctccaggagaactccggtcacgagttcctggagcagggggacggagaaaaaatcgctgtgttgcagtgcatcctggccggactgatagggaagaagatggggatcgaaaagttggacatcctgacagagttaaaatataggaatctgaagcacatactcgccatggtgctggaaagccttaccgccgaaagcctgtgctctgtttggaaagtttctagaaattggagggagattgttgtgcaggataaaaacgccaatcggagaaggaaattttacattacccaactgaaaactgactccgaaggcgctgtgcttaacgtggaggatgctgccactcgcctgcagctgttgaacagatcagctttaagatccgtgcaggcccaggcaagaatcccagggagtcaacgggagcagggctccacgctttcaccgtggggagaagtcctcacgccactggcgagctcgagcgtgacccacctcagctccaaacaggaggagtacgtgaaggtggccaaaaccctgttcactgatgaagctcttaagccctgtccccgttgccaatccccagcaaaatatcaaccatataaaaaacgtggtctctgtagtcggaccgcatgcgggtttgatttttgcgttctgtgcctttgtgcctatcacggctctgaggaatgtagcagaggggcagccaagcccaggaataggaaggacgccctacctggaagtgcccagagtaagagaaaccttaagaggctgtag

SEQ ID NO: 223041 - DNA, 675 bp, Artificial Sequence
  Description of Artificial Sequence: Synthetic coding sequence
atggccgttgggaacattaacgaactgcccgagaatattttacttgagctgtttactcacgtgcccgcaaggcaactcctacttaattgccgtctggtgtgtagcctatggcgagacctcatagacctagtcaccctgtggaagcggaagtgtctaagggaaggtttcattactgaggattgggatcaaccagtggccgattggaagattttctactttctcagaagcctacataggaatttgcttcataatccttgcgccgaggaagggtttgagttctggtcattggatgtcaatgggggtgacgagtggaaagtggaggatctcagtagagatcagcgtaaggagttcccaaatgaccaggtaagatctcaggccagactccgcgtgcaggtgccagcagtccggtctgcacctgtggtacgggctcgggcttctggcgatctacccgctcgccctggagaccacccggcagaggaaaggtgccaagtggagggaggtctccctcatattttacaactgccggctagacggcctctccatctggtgagcgctaggaggaggggtcattctctcctgggtaggctcgtgaggccagagggacaccagcagcagcaccaccaccgggctcccgcagcgctaacgcctccagaaccccctagcgcagagccatag

SEQ ID NO: 223042 - DNA, 768 bp, Artificial Sequence
  Description of Artificial Sequence: Synthetic coding sequence
atggctgtgggaaacatcaacgagcttccggagaatatccttttggagctctttactcacgtgcctgccagacagctgctgctgaactgccgcctcgtgtgctccctgtggagggatttaatcgatcttgtgaccttatggaaaagaaagtgcctgagagaagggttcatcaccgaggattgggatcagcccgtggccgactggaaaatattctatttcttaagatccctgcaccgtaacctgttgcacaatccatgcgccgaagaggggtttgagttctggtctctcgacgtcaatggaggagacgaatggaaggtggaagatctcagcagggaccagcggaaagagttccctaacgatcaggttaaaaagtatttcgtgacttcatactacacctgtctgaaaagccaggttgttgatctcaaggcagaggggtactgggaagaactgatggataccaccaggcccgacatagaagttaaggattggttcgctgctaggcctgactgtggcagcaagtaccagttgtgtgttcagcttctttctagtgctcacgctccgctgggtacattccagcccgatcctgctaccatacaacagaagagcgacgccaagtggcgcgaagtgagtcataccttttcaaattatccacctggcgtgcgctatatttggtttcagcacggaggggtggacacacattactgggccggatggtacggtcccagagtgacaaattcctccataaccatcggaccccctttgccttag

SEQ ID NO: 223043 - DNA, 675 bp, Artificial Sequence
  Description of Artificial Sequence: Synthetic coding sequence
atggctgtcggcaacataaatgaattgcccgaaaatattctgttagaactgtttacacatgtgccagccaggcagcttttgttgaattgccgcctggtgtgttctctctggagagaccttatcgaccttgtcaccttgtggaaacgaaaatgtttgagggagggttttatcacggaggattgggaccaacctgtggctgactggaaaattttttacttcctccgttcgctacataggaatttgctgcataacccatgcgcagaagagggcttcgaattttggtccctagacgtaaatggtggtgacgaatggaaagtggaagacctatctcgagatcagagaaaagagttccctaacgatcaggttcgaagccaggccaggctgagggtacaggtacccgctgtgagaagcgcgcctgtcgttcgggcacgggcatccggggacctgcccgctagacccggtgaccatcccgctgaggagcggtgtcaggtcgagggcggtctgccgcatatcttacagcttcctgcaagacgaccgctgcatttagtgtctgcacggagaaggggccactcactgcttggcaggctggttaggccagaagggcaccaacagcaacaccaccaccgggctcccgcagctctcacgccacccgaacccccatctgccgaaccctag

SEQ ID NO: 223044 - DNA, 675 bp, Artificial Sequence
  Description of Artificial Sequence: Synthetic coding sequence
atggcggtgggaaacatcaatgagttgcctgagaatatcctgctcgagctcttcactcacgtgccagcaagacagctcttactcaactgccgacttgtctgttctttatggcgcgatctgatcgacctcgttacactgtggaagagaaagtgtttgcgagagggcttcattaccgaggactgggaccagccagtggccgactggaagattttttacttcctcaggagcctacaccgaaatctgcttcacaacccatgcgctgaagaaggcttcgagttttggtccctggacgtaaatggtggtgatgaatggaaggtcgaggacctatcccgggatcagcgcaaagagttcccgaatgaccaggttcggtcccaggctcggttaagggttcaggtgcctgccgtgaggtccgcccctgtcgtgcgagctcgggcttcgggagacctacctgccaggccaggggaccacccagcggaagagagatgccaggtggagggagggcttccacacatcctgcaattgccagcccgacgtccactccatctcgtgtcggctcggagacgaggtcattctctactgggtcgtttagtgagacctgaggggcatcagcagcagcaccaccatcgggctcctgccgctctaacccccccagaacccccatccgctgagccatag

SEQ ID NO: 223045 - DNA, 771 bp, Artificial Sequence
  Description of Artificial Sequence: Synthetic coding sequence
atggcggttggaaatatcaacgaactgcccgagaatatcttactggagctgttcactcatgtgcctgccaggcagttactgcttaattgccgactcgtttgttcactgtggagggacctgatcgacctcgtgaccctatggaagcggaagtgcttacgcgaaggattcattactgaagattgggaccagcccgtggccgactggaagatcttctattttctcagatcacttcaccgcaacttgctgcataacccctgtgctgaggaggggttcgaattctggtcactcgatgtgaacgggggagatgagtggaaagtcgaggacctgtcgagggaccagaggaaagaatttcccaacgatcagcacctgcctcaggtcccaggtgggggtccacaaggacgcagagtactcgggggtgcggacggataccatacagcaggacaccgaggtcaagggctcgtgcgaagccaagcaagactgcgcgtacaggtgcctgctgtcaggagcgccccagtggtaagggctcgtgcctctggggacttaccagcccgtcctggtgaccaccccgctgaagaacgttgccaggtcgagggcggattaccccacatactgcagttgccagccagacgacctctccatcttgtgagtgcacgtcgaagggggcatagtttgctgggcagactcgtgaggcctgagggtcatcagcaacagcaccatcatcgggctccagcagccttgactccaccagagcccccttcagccgaaccatag

SEQ ID NO: 223046 - DNA, 768 bp, Artificial Sequence
  Description of Artificial Sequence: Synthetic coding sequence
atggccgtgggtaatataaacgagttaccggaaaacatcttactcgaactgttcacacatgtgccagcaaggcagttgctgttgaactgtcggctcgtgtgctctctctggcgggaccttattgatctggtcaccctgtggaagagaaagtgtctccgggaaggatttatcactgaggactgggatcaaccggtagcggactggaagattttttacttcctgagaagtctgcaccggaacctgctgcataacccatgcgcggaggaaggctttgaattctggtctctcgacgtcaatgggggtgatgaatggaaagtcgaagacctatcgagggaccagcggaaggagtttccgaacgatcaggttaaaaaatattttgtgacctcctactacacatgtcttaagagccaggtggtagatctgaaagccgagggttattgggaggaactgatggacactacccggccagatatcgaggtcaaagattggtttgcagcgcgtcctgattgcgggtctaagtaccagctctgcgtgcagctgttgagtagtgctcatgcacctctggggacatttcaacccgaccccgcaaccatccagcagaaatcagatgcgaagtggcgcgaggtctcgcacacattttctaattatccccctggagtgaggtatatatggttccagcacggtggcgtggacacacactattgggctgggtggtatgggcctcgggtgacaaattcctccataaccattgggcctcccctcccatag

SEQ ID NO: 223047 - DNA, 498 bp, Artificial Sequence
  Description of Artificial Sequence: Synthetic coding sequence
atggcagttggcaacatcaatgagctgcccgaaaacattttacttgaactttttacacacgtgccagctcggcaactcctattgaattgtcgcctagtgtgttctttgtggcgggacctgattgacctcgtgacactgtggaagcggaagtgtctcagggagggattcattaccgaggattgggatcaaccagtcgcagattggaaaatcttctatttccttagatcgctccacagaaatctattacacaacccttgtgctgaggaagggttcgagttctggtcactcgatgtaaatggcggtgacgagtggaaggttgaggacttaagcagggatcagaggaaggaatttccgaacgaccaggttcgttcacaagctcgattgagggtgcaggtgccggcagttcgaagtgcccctgtggtgagagccagagcatccggcgaccttcccgcacgccctggcgaccatccagcagaagagcgctgccaggtggagtag

SEQ ID NO: 223048 - DNA, 861 bp, Artificial Sequence
  Description of Artificial Sequence: Synthetic coding sequence
atggctgcacctgcacctggcgctggagccgcttctggaggcgctggctgtagcggaggtggggctggtgccggagcaggaagcggcagcggcgctgcaggggctgggggacgactgccttccagggtgctggaactggtattctcttatctagaactgtccgagctgcgttcctgtgccctggtctgcaaacattggtaccgttgtctccacggcgacgagaatagcgaggtgtggcggagtctttgtgccaggagcctggcagaagaggcgctgcgcacagacatcctttgtaatctgccgtcgtataaggccaaaatccgcgcattccagcacgcttttagcaccaacgattgttcacggaacgtttatatcaaaaagaatggttttacacttcaccgcaatccaatcgcccagagcaccgatggggctcggacaaagattgggtttagcgaggggagacacgcatgggaggtgtggtgggaggggccattgggtactgtagctgtgattgggatcgccacaaagagggctcctatgcagtgtcagggatatgtggcattgttgggctcagatgaccaatcttgggggtggaatttagtggataataaccttctgcacaacggggaggtgaacggaagttttcctcaatgcaacaacgctcccaaataccagataggtgagaggatacgtgtcattctggacatggaggataaaaccctggcttttgagcgcggatacgaattcctgggcgtcgcttttagagggctccctaaagtgtgtctttaccctgcagtctctgcagtatatggaaatactgaagtcaccctcgtttacctgggaaagccactcgacgggtag

SEQ ID NO: 223049 - DNA, 1812 bp, Artificial Sequence
  Description of Artificial Sequence: Synthetic coding sequence
atggatcgcggatctctgttgcctttccagctgtggtgtccaaggccttttggcacatattctcagaatcaaccgcgacctcctagtgccgcactgaagccatccgcatgccccgaaccagggggaggcgcagaaccagatcacgggccagcgcacagcgaaaacacacccccagccctggccaccgaggtccctgcgtcccagcccgctcccctcctgagcgctgcagccgcaggagacgaaggccgtgtactgctcgacacttggtacgtaatcaaaccagggaatactaaggaaaaagtagccttctttgttgctcaccagtgcgggggaggaagtcgagcgtcttcaatgaaagtgaaagggcactggggaagtgatagttcaaaagcaaagcgacgcagaagatgtctagaccccacaaaggctccgcctgacccgggaggtcgtgagggtcccccagccgctgaagaagggccagctagcgccggagaggacgtcgacctgttgagtgtagcagaaatggtggccttggtggagcagcgagcggctttggcactgcagagctaccccagaccgactaccccagctccagtggtctttgtatccgcagagcagggtggacctgccaagggagtcggctctgagagacgctccggcggaggcgactgctcgcgagttgcggaagccgtcgcccacttcgaggcccagagggattccccgccaaccaaaggcttaaggaaagaagagcggcctggcccagggcctggcgaagtcaggatcgcctttagaatttccaatggcagggagccacgagcccctgattccggcttgccttctggaggcggagggagacctggctgcgcttatccgggatcccccggaccaggtgcgagggccaaggacaaaattacatgtgatctgtatcagctgatctcaccttcaagagacgcccttccgagcaacgtggagttcttgctagccagagccgatgaggcttcagagggtgacagcccagcacccgctcggcctgaagacacgccacccgctcctcctcctcctccagccagagactgcggtgcaagcggctttcacgtggatgtggttgtcaccggagtggtggacgaatgcatcttctttggcaaggacggcacgaagaatgttaaggaggagactgtatgcctcacggtgagcccagaagagccacccccacccggtcaactgttcttcctccagaaccgcggacctgacggcccaccagaaccacctccagcagacagccctgccacagcaccagggcctgacgacgccgaggggaccgctgacacctctctgtgtaggttgtatcgccatgtttctcacgatttcctggaaatcaggtttaaaatacagaggttactggagcctcgacagtatatgttgctgctccctgagcacgtgctggtaaagatttttagttttctgcctacacgagctttagcagcactgaagtgcacttgtcaccatttcaagggcattattgaggctttcggtgtgcgcgctacggattcaaggtggtcaagagacccgctgtaccgggacgacccgtgtaagcagtgcagaaagaggtacgaaaagggcgacgtcagcctgtgcaggtggcacccaaagccctatcatcatgatctgccatatggcagatcttattggatgtgctgcagacgagctgatagagaaaccccaggatgcagactgggattgcatgataataattgggtgttgccatgcaacggaccaggcggaggcagagccggtagggaagagggacggtag

SEQ ID NO: 223050 - DNA, 609 bp, Artificial Sequence
  Description of Artificial Sequence: Synthetic coding sequence
atgacttgtttgaccgacgtgcccactggttgcgctgccgtggagcccacagcacgcttacctgccgctgcctgggcctccacaatcactaccgggtgttgccccgcaatggggcaggccggagccggacccgctggaagaaggggaggcgaggccggaggcggagagggaagagcacatcacgcccatccaagccccttaccacgcgaacccagggttcggacaggacctccagcccacagtccaacaccagggtcaatcgacccctcgccagaactcagctggggatcagctggcgtgacgcaggaatcgcctctcctggaccccgtagatttccttttgttcagaacccgagccgtggatcccctgcggcgagtgtttttctttttctatcagcatcttaccttcttctctattcaaccccagccacctccttgtcacgcttttcaccctaaggacccgcctgcgggtagtaggcgccagctgatccttgtgcctcttaaaggtccgcctattctggccccaatactgagcctcacccctattctgtctagatggtcctgttatttcccgcgatccaggattgcccaagggtggcacttaagctag

SEQ ID NO: 223051 - DNA, 1359 bp, Artificial Sequence
  Description of Artificial Sequence: Synthetic coding sequence
atggcatcacggattaataccaacttcacgctgatcccaaaccagaagcttaggaggtcaaatcggcaaacttcttgttatagcaagaccctgggaagtgggttccagccaataagcacgttcggtaacttcaaggccctcccactggagatatttcagattattctcaagtacctgagtgtcaaggacatttctatgcttagcatggtgagtaaaaccgtgagccagcatataataaattatatctcaacctctagcggcagtaagagactcctgctacaagactttcacaacctggaactgcccgatcgcagacaggacagtgccattctggagcactatagatccctgggattactgttcaagcgctgcacactactgttacccactaaggaaaggctgaaatacatccataagattctgacagaggtttcctgttttaagtttaatgggtgcgcagcacccatgcaatgcttgggcttgacttgctacggcatgtttttacagacactgacagccggatgggatgaactagagtgccacagggtgtacaacttcctgtgcgaactgaccaatctttgtcgcaagatccaaatggcggtgtgttccaagcctggcagcgcccagaagctggagctgagaattaggcttttttgcagaaatgtcttgctggaccactggacccataggagtgatagcgccttttggctgactaggatcctcaagccctggcccatggtgaatcaggctagattgctttatattatcttcgggccaatctcaccacaggacggccaggtcgtgtggcaggagatgatcgaggaaccaactgatgagtttagcctgaaggggctggcagacgcgattaaacttttatatgacgctagcaccaaagagtggaccgcagacgatgtgatctctctggttgacgagctaagcgtagtacctcgagagtggcttctcgagaataacgcaagactcctgatgctctctggaaataacatctgcttcagcttcatggcttctaaagccgtcaatgggagaacgatcgagctcgctcgtcttgtcgtgttcttggccctggtgtgtgaaaaagagctctactgtatggattggacagttaagatgatgcagaaagtgtgcaaggttttctcaacaccagtcgagcgcaagaactttctccagaatgttgccaacgctttcgcctgtgtgattatggagatgctgcagagcattatgtctggcgacagagacgaagacgataggtctttcctgaacctctttcatcttgttcacgcccaggctaattttcacaaagaagtgctgtatcttaccatgaatactcctctcagcacatag

SEQ ID NO: 223052 - DNA, 2133 bp, Artificial Sequence
  Description of Artificial Sequence: Synthetic coding sequence
atggggggaaagcagagagatgaggatgatgaggcctatggcaagcctgtaaaatacgatccatccttcagagggccaattaagaatagatcttgcaccgacgtgatatgttgtgtgctttttctgctctttatcttaggctatatcgtggtggggattgtggcatggctgtatggagatcccagacaggtgctctatcctcgaaacagtactggagcatactgcggaatgggcgagaataaagataaaccctacttgctgtatttcaatatattcagctgtattctctcctcgaacatcataagcgttgctgagaatgggctgcaatgccctacaccacaggtttgcgtatcctcctgtccagaggatccatggacagtcgggaagaacgaatttagccaaactgttggcgaagtcttctacaccaagaatcggaatttttgtctgccaggtgtcccctggaacatgaccgttatcacctcactccagcaggaactgtgcccatccttcctcctgccttcagcacctgccctgggaaggtgcttcccctggacaaatgttacccctcctgccctgcccggtattaccaacgacaccactatccagcagggcatatctgggctgattgactctctgaatgccagggacatctcagtcaaaatttttgaagactttgcccagagttggtattggatactggtcgcattgggggtggcacttgttttgtccctgttgttcattctcctgctccgactggtggccggtcccctagtccttgtacttatcctcggagtgctcggagtgctagcctacgggatttattactgctgggaggagtaccgagtgttaagagataaaggggcatccatctctcagctgggctttaccacaaatctttctgcctaccaatctgttcaggaaacctggttggcggcactaattgtgttagccgttctcgaggcaattctgctgctaatgctgattttcttgaggcagagaattcggattgccatagccttgctcaaggaggcctctaaggccgtggggcaaatgatgtccactatgttctatcccctggttaccttcgtgttgttactgatatgcatcgcctattgggcgatgacagccctgtacttggcaacctctggccagccccagtacgtcctgtgggcatcaaacatatcgtctcctggctgcgaaaaggttccaatcaacaccagttgcaaccctactgctcatctcgtcaatagcagctgccccggtctcatgtgcgtgtttcagggatatagctccaaagggttgattcagcggtcggtgttcaatctgcagatatatggggtcctggggcttttttggacgctgaattgggtgttagccctgggccagtgcgtgctggcgggtgctttcgccagcttttactgggctttccataagccacaggatattccaacgtttcccctaattagcgctttcatcagaaccttgagataccatactggctccctggcgttcggcgcattgatcctgaccctcgtacagatcgcccgtgtgatactggagtacatcgaccataagctgaggggcgtgcagaatcccgtcgccaggtgtatcatgtgctgctttaagtgttgtttatggtgtcttgagaaatttataaagttcctgaacaggaacgcctatattatgatcgccatttacggaaagaacttctgtgttagtgcgaaaaacgccttcatgcttctcatgaggaacattgtaagggtcgtggtcctggacaaggtgactgacttgttgctcttctttggaaaacttctggtggtgggcggtgttggtgtgcttagctttttttttttttctggtagaataccaggcctgggcaaggatttcaagagtcctcacttaaactactattggctgcccataatgacctccatccttggagcctacgtgatcgcctcaggtttcttttccgtgttcggcatgtgcgtggatactctgttcttatgttttctcgaagatttggaacggaacaatgggagcctggaccggccatattatatgtctaaatcccttctgaagatcctggggaagaaaaacgaagctccccctgataacaagaagcggaagaagtag

SEQ ID NO: 223053 - DNA, 1206 bp, Artificial Sequence
  Description of Artificial Sequence: Synthetic coding sequence
atgaagtgcgattttaactgcaatcacgtacactccggtcttaagcttgtgaaacccgatgatattggcaggctagtgagctataccccggcttaccttgagggcagctgtaaggattgcatcaaagactatgaaagactgtcctgcatagggtcccccatcgtgtccccgagaatcgttcagctggagaccgaatctaagaggcttcataacaaggaaaaccagcacgtgcaacaaaccttgaactctacaaacgaaatagaggctttggaaacttctaggctgtacgaggattctggctactcatccttctcactgcaatcaggtctctcggaacatgaagaaggatccttgctcgaagaaaattttggagatagtctccaatcatgtttgctgcagatccagtcacctgaccagtaccccaacaaaaatcttctccctgtcctgcattttgagaaggttgtctgttctacactaaaaaagaacgcaaaaaggaacccaaaggtggatcgcgaaatgctcaaagagatcatcgcccgtggcaacttccggctccagaatatcataggacgcaagatgggcctggagtgtgtggacattttgtctgagctatttagacgtgggctgcggcacgtgcttgcaacgatcctggcacaactgagtgatatggacctcattaacgtgtctaaggttagtactacctggaagaaaatacttgaagacgataagggggcattccagttgtacagcaaggccatccaaagggtgacagaaaataataataagttcagccctcatgcttctacgcgcgagtacgtgatgtttcggaccccattagcctcagtgcagaaatcagctgcccagacctcactgaagaaggatgctcaaaccaagttaagcaaccaaggggatcagaaaggttccacgtacagtaggcataatgagttctctgaggtggccaaaactttaaagaaaaatgaatcactcaaggcgtgcatccggtgtaatagtccggctaagtacgattgttatcttcagagagctacatgcaagcgagaaggatgtggatttgattattgtacaaaatgcttgtgcaactaccacacaacaaaagattgcagcgatggtaagctgctgaaagccagctgcaagatcgggcctctgcccggtacgaagaagtctaaaaagaacttgcgcaggctatag

SEQ ID NO: 223054 - DNA, 882 bp, Artificial Sequence
  Description of Artificial Sequence: Synthetic coding sequence
atggacgcaccccattccaaggctgcactcgacagcatcaacgagctgcctgaaaacatccttctggagctgtttactcatgtcccggcacgccagttgcttctgaactgtagactggtatgttctctgtggcgcgatctcatcgacctgatgacactttggaagaggaaatgccttagagaaggttttataaccaaagattgggatcaacccgtggccgactggaaaatcttctatttcttaaggagcctccatagaaacctactcaggaacccttgcgccgaggaagacatgttcgcatggcagatagatttcaacggcggagacagatggaaagtggagtctctgccgggagcgcacggcactgattttcccgaccctaaagtaaaaaagtacttcgttactagctacgagatgtgcctcaaatcccagctggttgacctggtggctgaaggttattgggaagagctccttgacacattccgaccggatatcgttgttaaggactggttcgctgcgcgtgcagactgtggttgcacctatcagctcaaggtgcaactcgcgagtgctgactattttgtgctagcttcttttgagccacctccagtcactatccagcaatggaacaacgctacctggacagaggtgtcgtacacatttagtgattatccccgaggagtgaggtatatcttgttccagcatggcggacgtgacacacagtactgggccggatggtacggaccacgggtgaccaactcatctatcgtcgttagcccaaagatgacacgaaaccaagccagttctgaagcacagccaggccagaagcatggacaggaagaagctgctcagagcccgtatagagccgtagtccaaatattctag

SEQ ID NO: 223055 - DNA, 750 bp, Artificial Sequence
  Description of Artificial Sequence: Synthetic coding sequence
tgaaacgaactccctgagaatattttgctagagctgttcacccacgtgccagccagacagctgttacttaattgccgtctggtttgctcattgtggcgggatcttattgacttaatgacactctggaaaaggaagtgtctgcgagagggattcataaccaaagactgggatcagcctgtggccgactggaaaattttctattttctgagaagtctgcaccgcaacctgttgaggaatccgtgcgcggaagaagacatgttcgcctggcagatcgattttaatggcggagaccggtggaaagttgagagcctgcctggagcccacggaaccgacttcccagacccaaaggtgaagaagtatttcgtaacttcctatgagttcgccgctagggcggactgtggatgcacttatcaattgaaggtgcagctggcatctgcggactattttgtactggctagtttcgagccgccacctgtgacgatccaacagtggaacaatgcaacctggacagaagttagctataccttctcagattacccgagaggagtgagatatatcttgtttcagcacggaggcagggatacccagtattgggccggatggtatgggcctcgcgtaacaaattcctctattgttgtgtcacccaagatgacccggaatcaagcgtccagtgaagcacagccaggacagaaacatggacaggaggaagctgcacaatcgccttatcgagccgtggttcagatcttttag

SEQ ID NO: 223056 - DNA, 1569 bp, Artificial Sequence
  Description of Artificial Sequence: Synthetic coding sequence
atgcggctaagggtccgattgttaaagcgcacctggcctttagaagtgcctgagactgaaccgactctaggccacctgaggtcccatttgaggcagtctctcctgtgcacttggggatatagtagcaacactcggttcaccatcacgttgaactataaggatccactcaccggagacgaagaaactcttgccagttatggaatcgtgagtggtgacctgatctgtttgatcttgcaggacgacattccagcccctaatataccatcgtccacggattccgagcattcctccctgcagaacaacgaacagcctagtctggcgacaagctcaaatcagaccagcatgcaggacgagcagccatccgactctttccagggccaggccgctcagtccggagtgtggaatgacgattccatgctcggcccatctcaaaatttcgaggccgaatcaattcaggacaacgcgcacatggcggaggggacaggcttttacccgtctgaaccaatgctgtgctctgagagcgtcgagggccaagtgcctcattcactggagacactgtaccagtcggccgattgtagtgacgccaacgatgctctgatcgtcttgattcacctgctgatgctggagagcgggtatataccgcagggtacagaggctaaagcccttagcatgcccgaaaaatggaaactgtccggagtatacaagctccagtacatgcaccctttgtgtgagggatcttcggccaccttgacctgtgtgcccttgggcaacctcattgtcgtgaatgcgactttgaagataaataacgagattcgctctgttaaacggctgcagcttctcccagaaagcttcatctgcaaggaaaagttgggggagaacgtggccaacatttacaaagatctacagaagctctcccgcctgttcaaagaccagctcgtctacccgctgctcgcctttaccagacaggccttaaatctgccagacgtctttggcctcgtggtattgccgctcgagcttaagcttcgcatttttcgtttattagacgttcggtcagtactgtctctgtccgccgtctgcagagacttgttcaccgcctctaacgacccacttctatggaggttcctgtatctaagggacttcagagacaataccgtcagggtccaggatacagactggaaagagctataccggaaacgtcatatacagaggaaggaatcaccgaagggacgttttgtgatgcttctcccgtcttcgacccatacaatccccttctatccaaaccctcttcaccctagacccttcccatcttctcgtctgcccccagggataataggcggtgaatacgaccagaggcccacgctcccatacgtgggcgatcctatttcttcccttataccaggacctggcgagactcccagccagttccccccactccgaccacggttcgaccctgtgggcccactgcccggaccaaatcccattctacctggtcgaggtggacccaatgataggttccctttccgcccttcccggggacgacccactgatggcaggctgtcgttcatgtag

SEQ ID NO: 223057 - DNA, 1332 bp, Artificial Sequence
  Description of Artificial Sequence: Synthetic coding sequence
atggctcgccctcctggcggaagcggacccctgctcgatagtgaacattctagtctacagaacaatgagcagccaagcttggccaccagctccaaccaaacctctatgcaggacgagcagccatccgactcctttcagggacaggcggcacagtctggtgtgtggaatgacgatagcatgctggggcctagtcagaacttcgaggccgagagcattcaggataacgcccacatggccgagggcacagggttctacccctcggaacctatgctgtgctctgagtcggtggaaggccaagtgcctcactcgctggagacactctaccagtccgccgattgctccgacgcaaacgatgcacttatcgtgcttatccatctgctaatgctagaaagtggatacattcctcaggggactgaggcgaaagcactgagcatgcctgaaaaatggaaattgtctggtgtgtataaattacagtacatgcacccactctgcgagggtagttccgctacattaacctgtgtacctctgggtaacttgatcgtggtcaacgcaaccctgaagatcaataacgaaattcggtcggtgaaacgactgcagctgctgcctgagtcattcatctgtaaggaaaaactgggagagaacgtggccaatatctacaaagacctgcagaagttaagtcgtctctttaaggaccagctggtgtaccccctgttggccttcacccggcaggccctgaacctaccggacgtgtttggtcttgtggtgctgccccttgaactgaagctgagaatcttcaggcttctggacgtgcgttcagttctcagtctctcagcggtctgtagggatctcttcaccgcttcgaatgatcctttgctctggcgcttcctgtatctgcgcgactttcgcgacaacacagtgcgcgtgcaggacaccgattggaaggaactctataggaaacgccacatccagaggaaagagtccccaaaaggcagattcgtgatgctattaccttctagtactcataccattcccttctatcccaaccctctccacccaaggccatttccttcgtccaggctgccccctggaatcataggtggggagtatgatcagcggccaacactgccctacgtgggggaccctatcagctcactcatccccggaccaggcgaaacaccgtcccagtttccccctcttcgccctaggttcgaccccgttggcccactgccaggcccaaacccaattctacccggaagagggggaccaaacgatagattccctttccgaccctcacgtggtcggcctacagacggcaggctgtcatttatgtag

SEQ ID NO: 223058 - DNA, 1227 bp, Artificial Sequence
  Description of Artificial Sequence: Synthetic coding sequence
atgcaggatgagcagccatctgatagttttcaggggcaggctgcccagtcgggagtatggaacgatgacagtatgcttggaccgagccagaattttgaagccgaaagtattcaggacaacgcacatatggccgaggggacgggattctatccatcagagcccatgttgtgttcagaaagcgttgaaggccaggtgccccatagccttgagactctgtatcaatcagccgactgtagcgatgcgaatgacgcgctgattgtactaatccacctgctgatgttggagtctgggtatattccccaggggacggaagctaaggccttgtccatgcccgaaaaatggaagttgtccggggtttacaagctgcagtatatgcaccctctttgcgaaggctcttctgccacgctcacctgtgtgcctctcggcaacctgattgtcgtgaacgctactctgaagatcaacaatgagattagaagtgtcaagcgattacagctcctgccagaaagtttcatctgtaaggagaagctgggagagaatgtggccaatatctataaagatttacagaagctgtccaggctgtttaaggatcagctagtctacccactgctggcatttactcgccaggcactcaatctccctgacgtgtttggactggtggtgcttcccctggaactgaagttacgaattttccggctactcgacgtgcggagtgtgctcagtctgtctgccgtctgtcgcgatcttttcaccgcgagtaacgacccattactgtggagattcttgtacctgagggacttcagagataacactgtgagggtacaggatacggactggaaagagctgtacagaaagaggcacatccagcggaaagaaagccctaagggacgtttcgtcatgctactaccctcttcaacgcacaccatccccttctacccaaaccctttacatcctcgccctttcccatcatcccgtctacccccaggtattatagggggagagtatgatcagcgccctaccctcccatatgttggcgaccctatctcaagtctgatacctggccctggagaaactccttcccagttcccaccactaagacctcggtttgatccagttggtccactgcccggaccaaatcccattctgcccggacgcggaggtccgaatgataggtttccttttcgcccatcaagagggcgaccgacagacggcaggctgagcttcatgtag

SEQ ID NO: 223059 - DNA, 699 bp, Artificial Sequence
  Description of Artificial Sequence: Synthetic coding sequence
atgcagctcacatttgcatggttgcacgtatttggaaggacactgaggatgatgaatttttctggtaaagggtgcgccaacccctgggggcattgtagtatttataataagaacccccctttgggattttccttccgtaaactgtacatgcagcttgacgaggggagtctgacatttaacgccaacccggacgagggggtgaattactttatgagtaaggggatcctcgatgacagccccaaagaaatcgctaaattcatcttttgtactcggaccctgaactggaaaaaactgaggatttacctggacgagaggcgtgacgtgctggacgacctggtcactttacacaatttccgcaatcagtttttgcccaatgccctacgcgagtttttccggcacatccatgcccctgaggagcggggagagtacctagagacacttatcaccaagtttagtcatagattttgtgcatgtaaccccgacctgatgagggaactcggactgagcccagacgccgtatacgtcctgtgttattctttgattctgctgagcatagacttgacctcgccacacgtgaagaacaagatgagtaaaagggagttcattcgtaataccaggagggcagcccagaacatttctgaagactttgtaggtcatttgtacgataacatatacctgattgggcatgtggccgcttag

SEQ ID NO: 223060 - DNA, 960 bp, Artificial Sequence
  Description of Artificial Sequence: Synthetic coding sequence
atgggccaaggactctggcgagtggtgagaaaccaacagctgcagcaggagggatattcagagcagggctacctcactcgagagcagagtaggcgcatggctgccagtaatatcagcaatacgaatcatagaaagcaggtacaggggggaattgacatctatcacctcctaaaggcgagaaaaagcaaggagcaggagggattcataaacttggagatgcttccgcctgagctatcctttactatcctgtcatacctgaatgccacagatttatgcctcgcttcttgtgtctggcaagacctcgcaaatgacgagctgttgtggcagggcttgtgcaaaagcacatggggccattgctccatatataacaaaaaccctcctctcgggttctcattccgcaaactctatatgcaattggacgaggggtcgctgacctttaatgctaatcctgacgaaggtgtgaattatttcatgtccaaaggcatcctcgacgattctcctaaagaaatcgctaaatttattttctgtaccaggactctcaattggaaaaaactcaggatctacctggacgagagaagggatgtcttagatgacctggtgacacttcacaattttcgcaaccaatttttaccaaacgccctgagggagttttttaggcatattcatgcgccagaagagcggggagagtacctggagacactcatcaccaaattctcccacaggttttgcgcctgtaatcctgacctgatgcgagagctgggactctctccagatgcagtgtacgtgctttgctacagcctgattctgctcagtatagatctaacctcaccacacgtgaaaaataagatgtcaaagcgagagtttatccggaacacccggagagctgctcagaatatcagcgaggattttgtcgggcatctgtacgataatatttacctcatcggacacgtagcagcttag

SEQ ID NO: 223061 - DNA, 555 bp, Artificial Sequence
  Description of Artificial Sequence: Synthetic coding sequence
atgggtcaaggtctttggagagtggtgcggaaccagcaactgcagcaggaggggtactccgagcagggctacctaaccagggagcagagtaggcggatggccgcttcaaacatcagtaacacaaaccataggaagcaggtgcaaggaggtatcgacatttaccatttgctgaaggccaggaaatccaaagagcaggagggattcattaacctcgaaatgctgccccctgagctctccttcactatcctaagttacctcaatgccactgatctgtgcctggcttcctgtgtttggcaggatctcgctaacgatgaattgctttggcaggggttatgcaagtctacctggggacattgctccatatataacaagaatccaccattaggcttttcattccgaaagctgtacatgcagcttgatgaaggatctctgacttttaacgccaatcccgacgaaggggtgaattacttcatgtctaaagggattctcgacgactctccgaaggagatagccaagtttatcttttgtacaaggactcttaactggaaaaaatag

SEQ ID NO: 223062 - DNA, 1344 bp, Artificial Sequence
  Description of Artificial Sequence: Synthetic coding sequence
atgcctgatattatttgggttttcccgccacaggccgaagctgaggaggactgccattccgacaccgtgagggccgacgatgatgaagagaacgaatcccccgctgaaaccgacctgcaagcccagctacaaatgttcagagcacagtggatgtttgagcttgctcctggggtgtcgagctctaatctcgagaacagaccgtgcagggcagcgcgtgggagcttgcagaagacaagtgccgacactaagggcaagcaggaacaggctaaggaggaaaaagcacgagaactgtttcttaaagccgttgaagaagagcaaaacggagccttatatgaggccattaaattttacagaagagctatgcagctggtaccagacatagagtttaaaatcacctacactaggtcacccgacggagacggggtaggcaattcctacatcgaggataatgacgatgactctaagatggctgacctgctgtcctactttcaacagcagctcacatttcaagaatcagtactgaagctgtgtcagccagagctggaatccagccaaatccacatcagcgttctgccgatggaggtcctgatgtatatcttccgatgggtggtgtcgagtgaccttgatttacggtcactggaacagctgagcctggtatgtaggggcttctacatatgcgcaagggatccagagatttggcggctggcttgtcttaaggtatggggacgctcctgcatcaagttggtgccctacacaagctggcgtgagatgttcttagagcgtcccagagtcagattcgacggagtgtacatcagcaaaacaacctacatccggcagggagaacagtctttggacggcttctacagagcctggcaccaagtggaatattacaggtacattcgcttttttcccgacgggcatgttatgatgttgacaacccccgaggagccacagtcaattgtcccgaggctgagaacgcgcaacacccgaaccgacgccatccttctgggacattaccgcctgtcgcaagatacagacaatcagaccaaggtgttcgccgtcatcacaaagaaaaaggaagagaagccactggactataagtacagatacttccggcgagtaccagttcaggaggctgaccagtcgttccatgtgggcctgcaattatgctcgtccgggcaccagcgttttaataagctgatctggatccaccactcatgccacattacctataaaagcacaggagagacggcagtgagcgcttttgagattgacaagatgtatacacccctcttcttcgctagggttcggtcctataccgcatttagtgagaggcccttgtag

SEQ ID NO: 223063 - DNA, 1314 bp, Artificial Sequence
  Description of Artificial Sequence: Synthetic coding sequence
atggcggaggcggaggaggactgccactctgacacagtgagggctgacgacgatgaagagaacgaatcaccagccgaaacagacttgcaagcccagctacagatgtttagggcccaatggatgttcgaactggcccctggggtgtcctccagcaatctggagaataggccttgtcgcgcagcaagaggcagcctgcaaaagacttccgccgacacaaaaggcaaacaggagcaagccaaggaggaaaaggctcgcgagttgtttttgaaggctgtggaggaggaacagaacggagcactgtatgaggcgatcaaattttaccgtagagcaatgcaattagtgcccgacattgagtttaaaatcacatataccaggtcacctgacggggatggcgtcgggaatagctacatcgaggacaatgatgacgattctaagatggctgatctacttagctactttcagcagcagctgacattccaggagagcgtgctgaagctgtgtcagcccgagcttgagagtagccaaattcacataagcgtgctgccaatggaagtactgatgtatatcttccggtgggtcgtctcttccgatttagacctgaggagcctggaacagctgagcctagtttgtcgcggattctacatttgcgcccgagatcctgagatctggagacttgcctgcctcaaagtgtggggaagatcctgtatcaaactagtgccttatacttcgtggcgggaaatgttcttggagagaccaagagtccggtttgatggggtgtatattagtaaaacaacatatatacgccaaggggaacagtccctggatggtttctacagagcctggcatcaggttgaatattaccggtatatccgattttttccagacggacacgtgatgatgctgacaacacctgaagagcctcagtcgatcgtacccagactgagaacaaggaacacccgcacagacgccatactgttaggacactatagacttagccaggatactgacaaccagaccaaggtgtttgccgtgatcacaaagaagaaggaggagaaaccactggactacaaataccgctactttcgcagggtgccggtgcaggaagctgaccagtcatttcatgtgggtttgcagctgtgctcatccggccatcaacggttcaataagcttatttggatccatcattcctgtcatatcacctataagagtactggtgagaccgccgtatcagcttttgagatcgacaagatgtacacacccctgttttttgcccgagttcgctcttacaccgccttttccgagaggccactttag

SEQ ID NO: 223064 - DNA, 1212 bp, Artificial Sequence
  Description of Artificial Sequence: Synthetic coding sequence
atgttccgcgcacagtggatgttcgaactggcaccaggcgtgtctagctctaatctcgagaacaggccatgtagggcagcacggggttctttgcagaagacctctgccgatacaaaaggaaaacaggagcaggccaaggaggagaaagcccgtgagcttttcttgaaggccgtggaggaagaacagaatggagccctttacgaggcgatcaaattctatagaagggccatgcagctagtacccgacatcgaattcaaaattacgtatactcgtagcccagacggagacggcgtaggaaacagctatatcgaggacaatgacgacgattctaaaatggcggacttactctcatatttccaacagcaattgacctttcaagagtccgtgcttaagctgtgtcagcctgagctggagtccagtcaaattcatatctctgtgctccctatggaggtgctgatgtatattttcaggtgggtggtgtcgagcgacctcgacctccggtctcttgaacagctgtctctggtctgccgcggtttctacatctgcgcaagggatcctgaaatctggcgtctcgcttgtttgaaagtgtgggggagatcctgtataaagctggtcccctatacaagctggcgagaaatgttcctggagcgacctagggttcgtttcgatggcgtctatatcagtaaaaccacatacatccggcaaggcgaacagtctctcgatgggttctacagagcctggcaccaagtggagtactacaggtatatacgctttttccccgatggacacgtgatgatgctcaccacacctgaggaaccccaatccatagtcccccgactgcgcactcgcaacactcgaacggatgcgattctcttgggacattatcgtctcagccaagacactgataaccagacaaaggtgtttgccgtgatcacaaagaagaaagaagagaagccacttgactacaagtaccggtactttcgccgtgttccagtgcaagaagccgaccagtctttccacgtcggcctacaactctgttcatctggacaccagcgcttcaacaagttgatttggatccatcatagttgtcatattacatataaatctaccggggaaaccgctgtttccgctttcgagatagataaaatgtacactcccttgttctttgcccgtgtgcgcagctataccgcattttcggagcgtccattgtag

SEQ ID NO: 223065 - DNA, 147 bp, Artificial Sequence
  Description of Artificial Sequence: Synthetic coding sequence
atgtttagagcccagtggatgtttgagttagctccaggcgtttctagcagtaacctggaaaatcggccttgtcgcgctgccagggggagcttgcagaagacctcagcagataccaaggggaaacaagaacaggcgaaagaggaatag

SEQ ID NO: 223066 - DNA, 357 bp, Artificial Sequence
  Description of Artificial Sequence: Synthetic coding sequence
atgttccgagctcaatggatgtttgagttagctcccggagtctctagttccaacctagagaatcgcccatgtcgcgctgccagaggttctctgcaaaagacctctgccgacacaaaagggaaacaagaacaggcgaaggaggaaaaagccagagagttgttcttgaaggcagtggaagaggagcaaaacggcgctctctatgaagctatcaaattttatcgcagggctatgcagctagtacccgatattgaattcaaaatcacctacactagatcacctgacggcgacggggttggcaatagttatatcgaggataacgacgacgattccaagatggcagacctgctctcatattag

SEQ ID NO: 223067 - DNA, 438 bp, Artificial Sequence
  Description of Artificial Sequence: Synthetic coding sequence
atgtttagggcccagtggatgtttgagttggcccctggcgtgtcatctagcaacctcgagaaccgcccatgtagagccgcaagaggctccctgcagaaaacaagtgctgatactaaaggcaagcaggagcaggcgaaagaagaaaaggcacgtgagctgttcctcaaagcagtggaggaggaacaaaacggcgctctgtatgaagctattaaattttacaggcgcgcaatgcagcttgttcctgacatcgaatttaagatcacctatacaagaagtcctgacggtgacggcgttggcaactcttatattgaggacaatgacgacgactccaaaatggctgacttgctgagttactttcagcagcagctgaccttccaggagtccgtgcttaaactgtgccagcctgagttagagtccagccagatccacatttcctag

SEQ ID NO: 223068 - DNA, 3132 bp, Artificial Sequence
  Description of Artificial Sequence: Synthetic coding sequence
atgaggagatttaaaaggaagcacctgaccgctatcgactgtcagcatttagcgagaagtcaccttgcggtgacccagccattcggtcaaagatggacaaatcgcgaccccaaccacggcctctatccgaaaccaaggacaaagcggggttcccgcggtcagggttctcaaaggtgtatccccgaattctttcttgccggaaaacagccctgcaccaacgatatggccaagagcaacagtgtcggccaggactcctgccaagactccgaaggggacatgatatttcctgccgagagtagctgcgccctgccccaggagggaagcgcaggtccaggctccccagggtcagcacccccatcccggaagagatcatggtcatccgaggaagagagcaatcaggctactggcacaagcaggtgggatggggtaagtaagaaagctcccaggcaccatctttccgtaccctgcactaggcctagagaagcgaggcaggaagccgaggacagcacatctaggttgtccgctgaatcgggagagaccgaccaggacgccggtgacgtcgggcctgacccaattccagactcttactatggattactcggcaccttgccttgtcaggaggcactgtctcatatttgttcgctgccttccgaagttctgaggcatgtgtttgcttttctgcccgtggaagacctctattggaacctcagcttggtgtgtcacctttggagagaaataatatccgaccccctatttatcccgtggaaaaaactgtatcaccgctatctaatgaatgaggagcaggctgtctctaaggtggatggcattttgtccaactgcggtatcgagaaggaatcagatctgtgtgtcctaaatctgatccgctatactgctaccaccaagtgttcaccaagtgtggaccctgaaagagtgctgtggtcgctccgagaccatcccctgctacctgaggctgaagcctgcgtcagacaacacctccccgatctgtacgcagctgcgggaggtgtcaatatatgggctctggtggccgctgtggtgctactgtcttcctctgtgaacgacatccagcggctgctgttctgtctacgccgtccttcatcaactgttacgatgccagacgttaccgaaaccctgtactgtattgcggttctgctgtacgctatgcgagagaagggcattaatatcagcaaccggattcattacaatatcttttactgcctttacctgcaagagaacagctgtacgcaagctacaaaagtcaaagaggagcctagcgtgtggccgggtaagaagactatccagcttacgcatgaacagcaactgatcctgaatcataagatggaacccttacaggttgttaaaatcatggccttcgcaggaaccgggaagacgagcacgctggtcaaatatgctgaaaaatggagtcaatcccgctttctctatgtgactttcaacaagtccatagcaaaacaagccgaacgggttttcccaagtaacgtcatttgtaagaccttccactccatggcttatggccatataggacggaagtaccagtcaaagaaaaagcttaatctctttaaactaaccccatttatggtaaacagcgttctggctgagggcaagggaggatttattagggctaaacttgtctgcaagacgctcgagaatttcttcgcttcagcagacgaagaactcactatcgaccatgtcccgatctggtgtaagaattcccaggggcagcgggtgatggttgaacagtccgagaagctcaacggcgttcttgaggcctcaagattatgggataatatgcgtaagctcggcgaatgcaccgaagaggctcaccaaatgacccacgatggatatctgaagctctggcaactgagcaagccctcgctagcatcattcgatgcaatcttcgtcgatgaggcacaggactgcacaccagccatcatgaatattgtgttatcccagccttgcggaaagattttcgtgggggacccgcaccaacagatttacacctttaggggagcagtcaatgccctcttcactgtcccccacacccacgtgttctacctcacccagtccttccgttttggagttgaaattgcttatgttggagcaacaattctggatgtctgtaagagggtgcggaagaagacgctggtgggaggcaaccaccaatctggcattcgtggcgatgccaaggggcaagttgccttgctgagccggactaacgcaaatgtatttgacgaggctgtacgcgtgacagagggcgagttcccaagtcgtatccaccttatcgggggtattaagtcgtttgggctggaccgaattattgacatttggattctgctccagcccgaggaagaacgcagaaagcagaacctcgttatcaaggataaatttatcaggcgttgggtccataaggagggtttctctggattcaagcgctatgttaccgccgctgaggacaaagaattagaagccaaaatcgctgtggtggaaaagtataatattcgcatacccgaactcgtccagcgaattgaaaaatgtcatattgaggacctggattttgccgagtatatactgggaactgtgcataaagccaaggggctggaatttgacaccgttcacgtattggatgacttcgtgaaggtgccctgcgcaagacataatttgccgcagctgcctcacttccgggtggagtctttttccgaggatgaatggaatctgctgtatgtcgccgtcacaagggcaaaaaagcggctaatcatgaccaagtcactggagaacatcttgaccttggccggagagtattttctccaggccgaattaacttccaatgtgctgaaaaccggggtcgtccgatgctgtgtgggacaatgcaacaatgcaatacccgtagacaccgtactcacgatgaaaaagctccccatcacctactccaacaggaaggagaataaaggtgggtacctgtgtcattcttgtgctgaacagagaataggtcccttggctttcctgacagctagccccgaacaggtccgggcaatggagcggactgtggaaaatattgttttgcccagacacgaagcgctcctctttcttgtgttctag

SEQ ID NO: 223069 - DNA, 1215 bp, Artificial Sequence
  Description of Artificial Sequence: Synthetic coding sequence
atgaatgaggaacaggcagtatccaaggtggacggcatcttaagcaattgcggcattgaaaaggaatccgatctctgtgtcctgaacttaattaggtacactgcaacaacgaagtgttcccccagtgtcgaccccgagcgggtgctctggtcattgagggaccatccactccttccagaagctgaagcatgcgtcagacagcaccttccggacttgtacgcagcagccggaggagtaaacatatgggcacttgtggccgctgtggtccttctgagcagttctgtcaacgacatccagaggttattgttttgtctccggcgaccctcttctaccgttaccatgcccgacgtgactgagacactctactgcatcgcggtgctgctttacgcgatgcgcgagaaggggataaacatctccaaccggatacactataacatcttttactgtctatatcttcaagagaactcctgtacgcaggctacaaaggtcaaagaggagccaagcgtctggcctggaaagaaaaccatccagctcacacatgagcagcagctcatcctgaatcataaaatggaaccccttcaagtggtcaagatcatggcttttgctgggaccggaaaaacttctacactggttaagtacgcggagaaatggtcgcagagcagattcctttatgtgaccttcaacaagagtattgcaaagcaggccgaacgggtgtttccatccaacgtcatttgcaagactttccattctatggcctacggccatatcggacgtaagtaccaaagtaagaaaaaactaaacctttttaagctgaccccattcatggtcaatagcgtcctcgcagagggcaaaggaggattcatcagggcaaagctggtgtgcaagactctcgagaacttttttgccagtgcagacgaggaactaactatagaccatgtccctatttggtgcaaaaattctcagggccagcgagtgatggttgaacagagcgagaagctcaacggcgtcctggaggccagccgtttgtgggacaacatgcgaaagctgggtgagtgcaccgaggaggctcatcaaatgacccacgatggctacctgaaactgtggcaactgtccaagccatcccttgcctctttcgacgccatctttgtggatgaagcacaagccggagccagacacggagctcactgcggtgaacataggaccgccccagcgtag

SEQ ID NO: 223070 - DNA, 3285 bp, Artificial Sequence
  Description of Artificial Sequence: Synthetic coding sequence
atgagctacgaagttacgagcggatgtcattggacttgccaggtgccagagtcttgtgacaatggcttgcattgtgccggacccctggggcacctccacagaaggtgccaacgtacaagcgctcacctgctcgtgtttacagaacatgcggaaatgagacgcttcaagcgaaagcacctgactgccattgattgccagcatttggcacggagccatctggccgttacacagccatttggtcaacgctggaccaatcgtgatcctaatcacggtctgtatcctaaaccaagaacaaaacgtggttccaggggccagggcagccagagatgtattcctgaattctttctcgccggaaagcagccatgcactaatgacatggccaagtcaaattctgtaggccaggatagctgtcaggattccgaaggcgatatgatatttccggcagaatcatcttgtgccctgcctcaggagggctctgctggacccggttcacccggatcagctcccccatcccggaagagaagctggagttccgaggaggaatccaatcaggctaccggaacttccaggtgggacggggtctccaagaaggcccctagacaccatctatcagttccctgcaccagacccagagaggcgagacaagaagcagaggattcaacatctaggctgagcgccgagtccggagaaactgaccaggacgccggagacgtgggcccagacccgatccccgattcttattacggcctcctaggtacactaccctgccaagaagccttgtcccacatttgttcgctgccaagcgaggttctgcgccatgttttcgcctttctcccagtcgaagatctttactggaatctcagcctcgtgtgccacctatggagggagattattagcgatccactatttataccgtggaagaagttataccatcggtatctgatgaacgaggagcaggcggtatcaaaggtcgacgggatcctgagtaattgcgggatagaaaaggaatccgatctgtgcgtactgaatctgatccgttacacggctacaactaaatgttcgccaagtgttgatcctgaacgcgtcttatggagtcttcgtgaccacccgctgctccctgaagccgaagcatgcgtgcgacagcacctcccagatctctatgctgcagctggtggcgtgaacatttgggcattagtagccgctgttgtgctgctgtcttcttctgttaatgatatacagaggttgctgttttgtctacgcagacccagttccacggtaaccatgcccgacgtgactgagaccctctattgcattgccgtgttactgtacgccatgagagaaaagggaattaatatctcaaatcggattcactacaacattttttactgcttgtacctgcaggagaattcctgcacccaagccactaaggttaaagaagaaccttcggtgtggccaggcaagaagacgattcaactcacacacgaacagcagctgatcctgaaccacaagatggaaccactccaggtggtgaaaattatggccttcgccggtactgggaaaacatccacgctggtcaagtatgcagaaaaatggtcccagagcaggttcctgtacgtgacattcaacaagagcatagctaaacaggctgagcgagtgttcccctcaaatgtcatttgcaaaacctttcattcaatggcttacggacatatcggtcgaaaataccagagcaaaaagaaattgaacttattcaagctgacacctttcatggtgaacagtgtcctcgcggaaggaaagggcggatttattcgtgctaagcttgtttgcaagacactggaaaattttttcgctagtgccgacgaagaattgactatcgatcatgtcccgatctggtgtaaaaatagccagggacagagggtgatggtcgagcagtccgaaaagctcaatggagttctggaggctagccggctttgggacaacatgcggaagttgggcgaatgcaccgaagaagctcaccagatgactcacgacgggtacttaaaattatggcagctctcaaaaccctctttggccagctttgatgctatcttcgtagatgaggctcaagattgcaccccagctatcatgaatatcgtgctgagtcagccctgtggtaaaatttttgtgggcgatcctcatcagcagatctacacattccgaggagcagtgaatgcccttttcaccgttccacatacacatgtcttttacctcacccagtcattccgatttggcgtggagatcgcctatgtcggggctacaattctggacgtgtgtaaaagagtgagaaaaaaaaccctggtcggagggaatcaccaatccgggattaggggtgacgcaaaggggcaagtggcattgttgtccagaacaaatgccaatgtttttgatgaggctgtgagggtgactgagggagaatttccatcacgcatccatctgatagggggaatcaaaagctttgggcttgaccgcatcatagacatctggatcttgttgcaacccgaggaggagcgccgaaagcagaatctggtgatcaaggacaaattcattcggaggtgggtccataaagaaggattttcaggctttaaacgttacgtgacagcagcagaagacaaggaactcgaggccaaaatcgctgtcgtggagaagtacaacatacgaattccagaactagtgcagcgtattgagaagtgtcacatcgaagatcttgattttgccgagtatatattaggcactgtgcacaaggccaagggcttagagttcgacaccgtgcatgtgcttgacgatttcgttaaggtgccatgtgcgagacataacctgcctcagcttccgcacttcagagtcgaatcatttagcgaagatgagtggaatttactgtacgtggctgtaacccgtgcaaagaagcgattgatcatgaccaagtccttggagaacatactgacactggctggcgagtatttcctgcaggccgaactgaccagcaatgttttaaaaactggagtcgtaagatgttgcgtcgggcagtgtaacaatgccatcccagtggacactgtgttgacaatgaaaaagctgcctataacctacagcaacaggaaggagaacaagggaggttacctgtgtcacagctgtgctgaacaaaggataggccctctggccttcctgacagcatcacctgagcaagtcagggcaatggaaagaaccgtagagaatattgtgctgccccgacacgaggctcttctgtttttggtgttctag

SEQ ID NO: 223071 - DNA, 1644 bp, Artificial Sequence
  Description of Artificial Sequence: Synthetic coding sequence
atggcttacgggcacataggcagaaagtatcagtcaaagaaaaaactgaatctgtttaagctgactccatttatggttaattctgtgctggcagagggtaagggcggatttatccgtgccaaattagtgtgcaagacactggagaattttttcgcatcagcagatgaagaactcaccatagaccatgttccaatttggtgcaagaactcccaggggcaacgcgtgatggtggaacagtccgagaaattgaacggcgtgcttgaggcctcaaggttatgggataacatgagaaaactaggagagtgtaccgaggaggcacatcagatgacccatgatggatatctaaagttgtggcagctgtcaaaacccagcctggccagttttgatgctattttcgtggacgaggctcaagattgtacacccgctatcatgaacattgtgctgtctcagccttgcggtaagatatttgttggggaccctcaccagcagatttacacattcagaggggcagtgaacgccctgttcactgtcccccatacccatgtgttttatctgactcaaagcttcagattcggcgtagaaatcgcttatgtgggggctaccatcctggatgtctgcaagcgggtcaggaagaaaacactggttggtggcaatcaccagtcgggaatcagaggtgacgcgaaaggccaagtggctctactgtccagaaccaacgcaaacgtgttcgatgaagcagtccgggtgaccgagggcgagtttccatcccgaatccacctaattggcggaattaaaagcttcggactggatcgtattattgatatatggattctcctccagcctgaggaggaacggaggaaacagaacctggtgatcaaagacaagttcatacgcaggtgggtgcataaggaagggtttagtggcttcaaaaggtacgtaactgccgctgaggacaaggagttagaagcaaagattgctgtagtcgaaaaatataacattagaattccggagctcgttcagcgcatcgagaaatgtcacatcgaggatttagactttgccgagatggagtctcaccatgtgggacaggcaggcctcgagcttcccaccagtgagtatatcctgggaacagttcacaaggctaagggcttggagtttgacaccgtacacgtgttggatgattttgtcaaggtgccctgcgcacgccacaaccttccacagctacctcacttcagagtggagagcttttcggaagacgagtggaatttactctatgtcgcggtgacaagagccaaaaagaggctcattatgaccaaatctctggagaacattctgaccctggctggtgaatattttttacaggccgaactgacttccaacgtgctcaaaactggagttgtcaggtgttgcgtgggccagtgtaataatgccattccggtggacaccgtgctgaccatgaagaaattgcccatcacatatagtaatcggaaggagaataaaggagggtatttgtgtcatagctgcgccgaacagcgcataggccctttagccttcttaacagcatcaccggagcaggttcgcgctatggagcgaacagtggagaatatagtgctgcccagacacgaggcgctgcttttcctggtgttttag

SEQ ID NO: 223072 - DNA, 1215 bp, Artificial Sequence
  Description of Artificial Sequence: Synthetic coding sequence
atgaatgaggagcaggccgtgtccaaggtcgacggcattctgtctaactgtggaatcgaaaaagaatctgacctatgtgtgctgaatcttattcggtacaccgctacaaccaagtgttcgcccagcgttgatcccgagcgcgtgttatggtccctgagagatcacccattactgccggaggcggaggcctgcgtcagacagcatctgccagacctttacgccgcagctggcggtgtgaatatctgggcactggtggccgcagtggtactgctgtcttcttctgtgaacgacatccagagactgttattctgtctgaggcgaccatcttctacagtcaccatgcctgatgtaaccgagaccttgtactgcatcgctgtattactctacgcaatgagggagaaaggtattaacatcagtaaccggattcattataacatcttttactgcctgtacctgcaggaaaacagctgcactcaggccaccaaggtcaaagaggaaccctctgtgtggcctgggaaaaaaactattcagctgacacacgaacagcagttgatcctgaatcacaaaatggagccgctgcaagtcgtgaaaataatggcgttcgccggaactggaaaaactagcaccctcgtgaaatatgcggaaaagtggtcacaatcccggtttctctacgttacatttaataaaagcatagcgaagcaggctgagcgggtatttccatcaaacgtaatctgcaaaacatttcattccatggcgtacggtcatatcggcagaaagtatcagtctaagaaaaaattgaacctctttaagctgacacctttcatggtcaactctgtgctagcggaggggaaaggcggtttcatccgcgcaaaattggtgtgtaagacactggaaaatttcttcgcctcagcggacgaggagctgactattgaccacgtaccaatctggtgcaagaatagtcagggtcagagggtgatggtcgaacagtctgagaaactgaacggcgttctcgaagcttcacgtctttgggacaatatgagaaagctaggcgaatgtaccgaagaggcgcatcaaatgactcacgacgggtatttaaagttatggcaactgtccaagccaagcttagcaagctttgacgcaatctttgttgacgaagctcaggcaggggctagacacggcgctcattgtggcgaacaccgaacagcacctgcctag

SEQ ID NO: 223073 - DNA, 576 bp, Artificial Sequence
  Description of Artificial Sequence: Synthetic coding sequence
atggaccctaagcaaactaccttgctttgcttagtgctgtgccttgggcagcgaattcaggcccaagagggggacttcccgatgcccttcataagtgccaaatctagccctgtcattccactagacggcagcgtaaagattcagtgccaggccattcgcgaagcctaccttactcagttgatgatcatcaaaaactcgacttatagggagattggtcggcgactgaagttttggaacgagacagatcctgaatttgttattgatcatatggatgcaaacaaagctggcaggtatcaatgtcagtatagaattgggcattaccgctttcggtactctgataccttagagctcgtggtgacagactcaatccaccaagattacactacacaaaatctcatccgcatggctgtggctgggcttgttctggtagctctgctggcaatattggtggaaaactggcatagtcataccgccctaaataaagaggcttctgccgatgtcgctgaaccatcctggtcacaacaaatgtgccagcccggattgactttcgccaggactccatcagtctgtaagtag

SEQ ID NO: 223074 - DNA, 537 bp, Artificial Sequence
  Description of Artificial Sequence: Synthetic coding sequence
atggatcccaaacaaactactctgctgtgtttgggtctctatggcaaaccattcctctcggccgacagggggctggtgctgatgcccggtgaaaacatctcgctgacgtgtagctccgcacacattcctttcgacagattttctttggcaaaggaaggggaacttagccttccacagcaccaatctggtgagcacccagccaatttttcgctgggcccagttgatcttaatgtgagcggtatttacagatgctacggctggtacaacagaagcccctacctttggtccttcccatcaaatgctctggagctcgtggtgacggattctatccatcaggactacaccacacagaatctgatcaggatggcagtggctggtcttgtcctcgtggccttgctggcaatcctagtggagaactggcacagccacaccgcactcaacaaagaagctagcgcagatgtggcggaaccatcgtggagccagcagatgtgccagccaggcttaacctttgcccgtacaccaagtgtttgcaagtag

SEQ ID NO: 223075 - DNA, 864 bp, Artificial Sequence
  Description of Artificial Sequence: Synthetic coding sequence
atggacccaaaacagactacactgctctgcctggtcctctgtttagggcagaggatacaagctcaggagggcgatttccccatgccttttattagcgctaaaagctcccctgtgattcctcttgatggaagtgtgaaaatccagtgccaggctatccgcgaggcgtatctgacacagctgatgatcattaaaaactccacttaccgcgagatcggaaggcgactgaagttttggaacgagaccgaccccgagtttgtgatcgaccacatggatgccaacaaggcaggacgatatcagtgccagtacaggattggccactaccggttccggtactcagacacactggaactggtggtgacggggttgtacgggaagccattccttagcgccgatcgcggtctggtgctgatgcccggagaaaatattagtctcacatgttcctcagcccacatcccatttgacagattctcgctggctaaggaaggagagttgagtttgcctcagcatcaaagcggtgaacacccagcaaacttttccctgggacctgtcgatctgaatgttagcggaatttaccgttgctatgggtggtataaccgctctccatatctatggtcatttccaagtaatgcacttgagttagtcgtgaccgattccatccatcaggattacaccacacagaacctgataaggatggctgtcgccggactggttttggtcgctctactggccatcctcgtagaaaattggcactcccacactgccttaaataaggaggcaagtgcggacgtggctgaaccttcctggtcacagcagatgtgccagccagggctgacgttcgcccgtacacccagtgtatgcaaatag

SEQ ID NO: 223076 - DNA, 828 bp, Artificial Sequence
  Description of Artificial Sequence: Synthetic coding sequence
atggatcccaagcaaaccaccctgctctgtttaggcgactttcccatgcccttcatctcagcaaaatctagcccagttatccccttagatggttctgttaaaattcagtgtcaggccatccgggaggcatacctcacccagctgatgattatcaaaaacagtacatatcgcgagattgggagacgattgaaattctggaacgaaacagatcctgagttcgtcatcgaccatatggacgccaataaggcaggtcgctaccaatgccagtacaggatcggacactatcgattccggtattctgatacacttgagctcgtggtgaccggcctctatgggaagccattcctgtcggcagataggggactggttctcatgcctggggagaacatttccctgacctgctctagtgcgcatattcccttcgataggttttcgctcgcaaaagaaggcgagttgtctcttcctcagcaccaatcgggggagcaccccgctaactttagtttaggaccggtggaccttaacgtgagcggcatctaccggtgttacggctggtacaacaggagtccatatttgtggagcttcccaagcaacgcactggagttggtggtgaccgattccatccatcaagattacacaacacagaacctgattcgcatggccgttgcgggactcgtgctggtggccctgctcgcaatcctggtggagaactggcatagtcacacggcgctaaacaaggaagcgagcgctgatgtggctgaacccagctggtctcagcagatgtgccaaccaggcctgactttcgccaggacacctagcgtttgcaaatag

SEQ ID NO: 223077 - DNA, 630 bp, Artificial Sequence
  Description of Artificial Sequence: Synthetic coding sequence
atggatcccaagcagaccactctcctatgcctgggtgacttcccgatgcctttcatttctgctaagagcagtcctgttattccgttggacggctcagttaaaatccaatgccaagctatacgagaagcctatcttacccagctcatgatcatcaagaattccacctaccgagaaatcggcaggcggctgaagttttggaacgagactgatcccgaattcgtcattgaccacatggacgccaataaagcaggacgctatcagtgccagtacagaataggccattacaggttccggtactcagacacactggagctcgtcgtcactggcttgtatggcaaaccattcctgagcgcggatcgtggtcttgtattaatgccaggggagaacatcagcttaacatgcagcagtgctcacatccctttcgacagatttagtcttgccaaggagggagaactcagcctccctcagcaccagtccggggagcatccagcaaacttcagtctcgggcctgtggatctgaatgtctctgggatttacaggttgcatccccctcggcttcacgacgccgagttagacccgcacgggaggggcagaacgggaccgagaggctcgctgggacataccggctag

SEQ ID NO: 223078 - DNA, 762 bp, Artificial Sequence
  Description of Artificial Sequence: Synthetic coding sequence
atggatcccaaacaaactactctgctgtgcctgggcgactttccaatgccatttattagtgctaagagcagcccagtgatcccacttgacggatctgttaaaattcagtgtcaggccattcgggaggcatatctgacccagctgatgatcatcaagaattccacctaccgcgaaatcgggcgtcgcttgaagttctggaacgagactgatccagagttcgtaattgaccatatggatgctaataaagctggcagataccaatgccagtacagaatcggccactacagattcaggtactccgatacactggaactcgtggtgacaggcctatacggcaaacccttcctgtcagcagaccggggattagtcctgatgccgggtgagaacataagcttgacttgttcatctgcgcatattcctttcgatcgcttttccctcgcaaaggagggggaattgtcactgcctcaacatcaatcaggagagcatccagcaaacttctccctagggccagtggatcttaacgtgtcaggcatctatcggtgttacgactccatccaccaggactacacaactcaaaatctgatcaggatggctgtggccggtctggtgttagtggcactgctcgccattctggtagagaattggcacagccacactgcactaaacaaagaggcctccgcagacgtagccgagccttcctggagccagcagatgtgccaacctgggctgaccttcgccagaacacctagcgtatgtaaatag

SEQ ID NO: 223079 - DNA, 798 bp, Artificial Sequence
  Description of Artificial Sequence: Synthetic coding sequence
atggaccccaagcagaccacacttctctgcctggttctgtgcctgggtcagagaattcaagcacaagaaggggatttccctatgccatttatcagtgcaaagagttccccagtgatcccgttagatggcagcgtgaagatccagtgccaagccatccgggaagcctacttgacacaattaatgataataaagaatagcacatacagagaaatcgggcgtagactgaaattttggaatgagaccgatccagagttcgtgattgaccacatggacgccaacaaggccggtcgatatcagtgccaatacaggatcggccactacagatttcggtacagcgacactctggaactcgtggtcaccgggctctatggaaaaccttttcttagtgccgacagaggtctcgtgctgatgcctggcgaaaatatctccctgacctgtagttctgcgcatattccctttgaccgatttagcctggccaaagaaggcgaactgtcactgccacagcaccaaagtggggagcatcccgctaatttctcccttgggcctgtggacctcaatgtatcaggcatttatagatgctatgattctatccaccaggattacaccacacagaacttgattagaatggcagtggccggtcttgttttggtggctctgctggctatcctggtggaaaactggcactctcacaccgctcttaacaaggaagctagtgccgacgtggccgaaccatcttggagtcaacagatgtgtcaacccggacttacctttgctcggactccatccgtctgtaaatag

SEQ ID NO: 223080 - DNA, 540 bp, Artificial Sequence
  Description of Artificial Sequence: Synthetic coding sequence
atggaccccaagcaaactaccctcctgtgcttaggagactttcccatgccctttatatctgctaagtcttccccggtaataccgttggacggctccgttaagattcaatgccaggctatccgggaagcctacttgactcagctcatgattattaaaaactcaacttatcgggaaataggtcggcgtctaaaattctggaatgagaccgaccctgaatttgtcattgatcacatggacgcgaataaggctggcaggtaccagtgtcagtataggatcggccactatagattcagatattcagacaccctggaactcgtagtcacagactcaatccatcaggattacaccactcagaacctgatccgaatggcggtggcaggtctcgtgctggtagctttattggctattctcgtggagaactggcacagccacaccgccctcaataaggaagcaagtgcagacgtcgcagaaccctcttggtcccagcagatgtgccagccgggactcaccttcgcccgaaccccctccgtatgcaagtag

SEQ ID NO: 223081 - DNA, 720 bp, Artificial Sequence
  Description of Artificial Sequence: Synthetic coding sequence
atggaccctaaacagaccactcttctatgcctggtgctctgtcttggccaaagaatccaggcccaagagggcgattttcctatgccctttatatccgccaagagcagtccagttatcccactggacggatcagtcaaaattcagtgtcaggccatcagggaggcatacttgactcagttgatgattataaagaactcaacatacagggaaattggcagacggctgaagttctggaacgagaccgaccctgagtttgttattgatcacatggacgccaataaagcgggtcgttaccagtgtcagtaccggattgggcactaccgattccggtactcggacactttagagctggttgtgaccggcctttatggaaaaccatttctgagtgccgatagagggctggtgcttatgcctggggagaacatctccctgacttgttcgagcgcccatatcccattcgacagatttagcctggcgaaggagggcgagctttccctgccccagcatcagtccggagagcatccagccaactttagcctcgggcctgtggatctgaacgtgtcaggaatttaccggtgttacggttggtataaccgcagtccgtacctgtggagtttcccaagcaatgccctggagctcgtggtaactggcaggtataggcctgtccagccatgtgtgtgggtcggctgccccggtccttgtcaccgggcaggaatatag

SEQ ID NO: 223082 - DNA, 774 bp, Artificial Sequence
  Description of Artificial Sequence: Synthetic coding sequence
atggcgccagctatggagtctcctaccctgctgtgtgtggccctgctatttttcgcccctgatggggtgctggccgttccacagaaacctaaagtcagtctcaaccctccatggaacagaattttcaagggagaaaatgtgacactaacttgtaatggcaacaacttcttcgaagtgtcatcgacaaaatggtttcacaacggcagcctttccgaagaaaccaacagcagcctgaacattgtgaatgctaagttcgaggacagtggggagtacaagtgccagcaccagcaggtgaatgaaagcgagccagtgtatctggaagtttttagcgattggctactgttgcaggcgtccgccgaagtggtcatggagggacaaccattatttctcagatgtcatggctggcgaaattgggacgtctacaaagtcatttattacaaggatggtgaagcattgaaatattggtacgagaaccataacatttcaataactaacgcaaccgtggaggactcgggcacatactactgcacaggcaaagtgtggcagctggactatgaaagcgaaccactgaacatcactgtcatcaaggccccacgcgagaaatattggctgcagtttttcatccccctcctggtcgttatcctctttgccgtggatacaggactctttatttctactcagcagcaagtaacttttctgttgaagatcaaacggacccgaaaggggttcaggttattgaaccctcaccccaagcccaaccccaaaaataactag

SEQ ID NO: 223083 - DNA, 261 bp, Artificial Sequence
  Description of Artificial Sequence: Synthetic coding sequence
atgatcccagccgtagtgctcttactgttgttgcttgttgagcaggctgcagccctcggcgaaccacagctgtgctacatcctggacgcaattctctttttatatgggatagtgctgaccctgttatactgtagactgaagattcaagtgcgcaaagccgcaattacttcatatgaaaagtccgatggagtatacacagggctcagcaccaggaaccaggagacctacgaaaccctaaagcacgagaagccaccccagtag

SEQ ID NO: 223084 - DNA, 339 bp, Artificial Sequence
  Description of Artificial Sequence: Synthetic coding sequence
atgatccccgcagttgtgttactgttgttgctgctagttgaacaggccgctgcactgggtgaacctcagctttgctacatcctcgatgccattctgttcctgtatggtattgtgctgaccctgctgtattgccgtctaaagatccaagtcagaaaagccgcaattacatcgtatgaaaaatccgacggcgtttacactatggaatccccctcgatcacacgcctggaatgcagtggtatgatttgggcccactgcaatctttgtctcctcgggtctcgagatagccgcgcatcgccatccagggtcgccaaaacaaccgggaccaccatgccttcatag

SEQ ID NO: 223085 - DNA, 792 bp, Artificial Sequence
  Description of Artificial Sequence: Synthetic coding sequence
tgatgttcttttggagtccaacttatgggcaagtgggtcccatgggtgagcgtgtttcaggaggagacagtcacactgcattgtgaggtcttacacttacctggcagcagttcaactcagtggttcctgaatggaaccgccacacagaccagcaccccgagctataggatcacaagtgcttccgtcaacgactccggtgaataccggtgccagcgaggcttgtccggcaggtcagaccctatccagctggagatccacagaggatggttactgttgcaggttagcagtagagtgttcatggaaggagagccccttgccctgagatgtcacgcttggaaagacaaactggtctataacgtactgtactaccgcaatggaaaagcatttaaatttttccactggaacagcaaccttacgattctgaagactaacatatctcacaacggtacttaccactgtagcggcatggggaagcacagatatacatccgcaggtatatcccaatacacagtgaaggggctgcaattacctactcccgtgtggttccatgtgctcttctacctcgcagttggcatcatgttcctggtgaatacagtgctgtgggtcacaatccgcaaagaacttaaacgaaagaaaaaatggaacctggagatttccctggatagcggacacgaaaagaaggtgatatcatccctccaggaggatagacacttggaagaggagttaaagtgtcaggagcagaaggaggagcagctgcaggaaggggtgcaccgcaaggaaccccagggatag

SEQ ID NO: 223086 - DNA, 567 bp, Artificial Sequence
  Description of Artificial Sequence: Synthetic coding sequence
atgtggttcctcaccactctgctgctgtggggctggttgctcctgcaagttagcagccgtgtattcatggagggagagcccctcgccttgcgctgccatgcctggaaggataagctcgtatataatgtgctatattaccgtaatggaaaggcgtttaagttctttcactggaattctaacctgactatactgaaaaccaacattagccacaatgggacctatcactgctcaggaatgggcaaacaccgctacacgagcgccggaattagccaatacacagtgaagggccttcaactgcccactccagtttggtttcacgtgctattctacctcgccgtcggcatcatgtttctggtgaatacagtactctgggtcacaatcaggaaagaactgaagagaaagaaaaagtggaacttagaaatttcccttgacagtggccacgaaaagaaagtgatatctagtcttcaagaggataggcatctggaagaagagttaaaatgccaggagcagaaagaggaacagcttcaggaaggcgttcacaggaaggagcctcagggcgcaacctag

SEQ ID NO: 223087 - DNA, 843 bp, Artificial Sequence
  Description of Artificial Sequence: Synthetic coding sequence
atgtggttcctcacgacactgttgctgtgggtgcctgtggatggccaagttgatacaacaaaagccgtcatcaccttacagccaccctgggttagcgtattccaggaagaaacagtcactctccactgcgaggtccttcatttgccgggtagcagcagcactcaatggttcttgaacggcaccgccacgcagacctccaccccaagttatcgtattacatccgcctctgttaacgatagcggcgagtatcgctgtcagcgcggactatctggtagatctgacccaatccagctcgagattcaccgtggatggctgctactgcaggtgagttctagagttttcatggaaggcgagcccctggcccttcggtgtcatgcttggaaggataagcttgtgtataatgttctctattatcgcaacgggaaggcctttaaattctttcattggaattccaatcttacgatccttaaaactaacatctcacacaatgggacataccactgtagtggaatgggcaagcatagatacactagcgccggaatcagccagtataccgtgaagggattgcagttacccaccccagtttggttccacgtgctgttttatctggccgttgggatcatgtttctggtgaataccgttttgtgggtgaccatacgaaaggagctaaagcggaaaaaaaagtggaatttggaaatttctctcgattcaggccatgagaagaaagtcattagctccctgcaggaagatcggcatcttgaagaggagctgaagtgccaggaacagaaagaagaacagctgcaggaaggcgtgcaccgaaaggagccacagggcgctacatag

SEQ ID NO: 223088 - DNA, 954 bp, Artificial Sequence
  Description of Artificial Sequence: Synthetic coding sequence
atgactatggaaacccagatgtcacaaaatgtatgccccaggaatctgtggctgttacaacctctgacagttctgttgctcctggcctccgcagattctcaggccgctgccccacccaaggccgtcctgaagctggaaccaccctggatcaacgtgctccaggaggatagcgttaccctgacatgtcagggcgctcgatctcctgaatccgactctatccaatggtttcacaatggaaatcttatcccaactcatacccagccttcttatcggttcaaggcaaacaacaacgactcaggcgagtatacttgccaaacaggacaaacgagtcttagtgatccagtgcatctcaccgtgctgagtgagtggttagtcctgcaaacgccacatttagaattccaggagggggaaacgatcatgctcagatgccattcatggaaggataaaccactagttaaggtgaccttcttccagaatggaaagtctcagaaattttcgcacctcgatcccacattcagcattccccaggccaatcatagccattccggcgattaccattgcactgggaacattggatacactctcttctcgtccaaacccgtcaccatcactgtccaagtcccctccatgggctcttcatcacctatgggcatcatcgtcgccgtggtaatcgctaccgccgttgctgcaatcgttgcagccgtggtggcactgatttattgtcgtaagaaaagaatatcagcaaacagcacagaccccgtcaaagccgcacagtttgaacctccaggcaggcagatgatagccatccgcaaacgccagcttgaagaaaccaataatgattacgaaaccgccgatgggggatacatgacccttaatcccagagccccaaccgacgatgacaagaatatctatctgaccctccctccaaatgatcatgtaaactctaacaactag

SEQ ID NO: 223089 - DNA, 951 bp, Artificial Sequence
  Description of Artificial Sequence: Synthetic coding sequence
atgacaatggaaacgcagatgtcccagaatgtgtgtcctcgcaacctctggctgctgcaaccactgacagtcctgctcctgctcgccagcgctgactctcaggccgctcctccaaaagccgtattaaaactcgagcccccatggataaacgtgctgcaagaagatagcgtgaccctcacatgtcagggggcaaggtcaccagagtcagatagcatccaatggtttcacaacggcaacctaatccccacccacacacagccgtcttatcgattcaaggccaataataatgattctggcgagtacacttgccaaactgggcagacttccttatcggatcccgtacatctgacagttctgagtgagtggttggtcctccagacccctcatctcgagttccaagagggggagaccataatgctacggtgtcactcatggaaagataagcctctcgttaaggttaccttctttcaaaatggaaagagtcagaagttctcacatcttgatcctactttctcaattccccaagccaatcactcacattctggggactatcattgcacaggcaacatcggatataccctgttctcatcaaagccagtgaccataaccgtccaggtgccctccatgggctcaagtagtcccatgggcatcatcgtcgccgtagttatagctactgccgtagcagctatcgttgccgctgtcgtggctctaatatactgtcggaagaagcggatcagcgcgaattctaccgaccccgtaaaagctgctcagttcgagccccctgggaggcagatgatcgcaattaggaaacgacagctcgaagaaacaaataatgattacgaaaccgccgatggaggctacatgacccttaaccccagggctccgaccgatgatgacaagaacatttatttaaccctgcctccaaacgatcacgtgaatagcaacaactag

SEQ ID NO: 223090 - DNA, 876 bp, Artificial Sequence
  Description of Artificial Sequence: Synthetic coding sequence
atgggcatcctgtcctttctgcctgtcctcgcgacggaatcggattgggcagactgtaaaagccctcaaccctgggggcacatgctcctatggacagcagttcttttcttagcgccagtggccggtactccggctgctcctcccaaagcagtgctgaagctcgaaccccagtggatcaatgtgttgcaagaggattcagtgacacttacatgcagggggacacactccccggaaagcgactcgatccagtggtttcataatgggaacctcattccaacacatacccagccatcttacaggtttaaagcgaacaacaatgactccggagagtacacctgccagacagggcagaccagcctctccgatcctgtgcacctgaccgtgctgtccgaatggctcgtcctgcaaacccctcatctggagttccaagaaggcgaaaccattgtgctccgctgccacagttggaaagacaagcctcttgtgaaagttacattcttccagaacgggaagtccaagaaattctcgaggtcagaccctaacttttccatcccccaggcaaatcacagtcactcaggtgactaccactgcaccggaaacatcggctataccctgtatagcagcaagccagttactataactgtgcaagcgcctagttcgtccccaatggggatcattgtcgcggtggttactggcatcgccgtagcagctatcgtggccgctgttgtggcattaatctactgccgtaagaagcggatcagcgctaatcccaccaatcctgatgaagccgataaggtgggggcagaaaacacaattacgtactctctgctgatgcaccccgacgcgcttgaagaaccagatgatcagaaccgaatttag

SEQ ID NO: 223091 - DNA, 933 bp, Artificial Sequence
  Description of Artificial Sequence: Synthetic coding sequence
atgggtatcttgtcgttcctgcccgttctggccacagaaagtgactgggccgattgtaagtcaccccaaccatggggccacatgcttttgtggaccgcggtcctgtttttagctccagtggcaggtacgccagccgcacctccaaaggccgttttgaaacttgagccacaatggatcaacgtgctccaggaggactctgtcacacttacttgcagagggacgcacagtcccgagagtgattcaatccaatggttccataatggtaacctcattccaacccatacccaaccatcttatcgctttaaagccaacaacaatgattccggggagtatacctgccagacaggacagacttcactcagcgatcctgtacacctgaccgttcttagtgaatggctggtgttgcaaactcctcatctggaatttcaggaaggggagacaatcgttttacggtgccactcttggaaagacaaacctctggtaaaagtgacattctttcagaatgggaaaagcaagaagttctctaggagcgatccgaacttctcaattcctcaggctaaccattcacacagcggagactaccattgcaccgggaatataggctataccctgtattcatccaagccggtgactattactgtccaggcccctagttctagtccaatgggtatcatagttgccgtcgtcactgggattgcagttgcagccatcgtagccgctgtggttgctcttatctattgcaggaaaaaacgtatcagtgcacttcctggttaccccgaatgtagagaaatgggggagactttgccagaaaagccagcaaatcccaccaaccctgatgaggccgacaaagtgggcgctgaaaacaccattacctactctctgctgatgcaccccgacgccctggaggaacctgacgaccagaaccgaatatag

SEQ ID NO: 223092 - DNA, 912 bp, Artificial Sequence
  Description of Artificial Sequence: Synthetic coding sequence
atgggtattctgagttttttgccagtgctggccaccgaaagtgactgggcagactgtaaatccccgcagccatggggccatatgctgctgtggactgccgtcctctttttggctgcccctcccaaggcagtgttaaagctggagccgcaatggatcaacgttcttcaggaggactctgtaacgttgacttgccggggtacacacagccctgaaagtgattcaatccagtggttccacaacgggaatctgattcccacgcacacgcaaccttcctataggttcaaagcaaataataatgactcgggggagtacacctgtcagactggccaaaccagcctctccgacccagtccacctgaccgtattgtctgagtggctcgtactgcagacccctcacctggagttccaggagggggagacaattgtcctgcggtgtcacagctggaaagacaagcccctcgtaaaggtaaccttttttcaaaacggcaaatcaaaaaagttctctagatctgaccctaacttttccattcctcaggcaaatcattctcacagcggagattatcattgtactgggaatatcgggtacactttatacagcagcaagcctgttactattactgtacaggcaccgagcagttcaccaatgggaattattgtggccgtggtaacagggatcgcagtggctgctatagtcgccgctgtcgtcgccctgatctactgccgcaaaaaaaggatttctgcgttaccaggatatccggagtgtagagaaatgggcgagacccttcccgagaaacccgcaaaccccacaaatcccgacgaggccgacaaagtgggcgctgagaatacgattacatacagtctcctgatgcaccccgacgctttggaggagcccgacgaccagaatcgtatctag

SEQ ID NO: 223093 - DNA, 912 bp, Artificial Sequence
  Description of Artificial Sequence: Synthetic coding sequence
atgggaatcctgagctttttacccgttctggcaactgaatctgattgggcagactgcaaaagccctcagccatggggacacatgctgctgtggaccgccgtgcttttcctggctgccccacccaaggccgtgctgaagctggaaccccaatggatcaacgttcttcaggaggactctgtgactctcacctgtagagggacccatagtcccgaaagtgacagcatccaatggtttcacaacggcaatctgatcccaacgcatactcagccatcctaccggtttaaagccaacaataacgattctggcgagtatacctgtcagaccggacaaacctccctgagcgaccctgtgcacctcacagtcctgtctgagtggctcgtgcttcagactccgcatttggagttccaggagggcgagaccatcgtcctgcggtgccattcttggaaggacaaaccgctggtaaaggtgaccttcttccagaacgggaagtccaagaagttctcaaggtcagatccaaatttctccataccacaggcaaatcatagccacagtggcgattatcattgcaccggtaatatcggatacactctgtatagtagcaagccagttaccatcacggtgcaggcacccagcagttcccccatgggtattatagtcgccgtagtcacaggtattgctgtagccgctatcgtggccgcagtcgttgcactgatatattgcagaaagaagagaatcagcgctctgcccggttatccagagtgccgggaaatgggcgagacgcttccagaaaagcctgctaatcctaccaatccagacgaagcagataaggtgggcgctgaaaacactatcacttattctctgctgatgcatccagatgccttggaagagccagacgaccagaaccgaatttag

SEQ ID NO: 223094 - DNA, 933 bp, Artificial Sequence
  Description of Artificial Sequence: Synthetic coding sequence
atggggatactgtccttcctcccggtcctggcaacagagtcggactgggctgactgtaaatctccacagccttgggggcacatgcttctctggactgcggtcctgtttttggcgccagtcgccggaacgccagctgctccacctaaagcagtgctcaagctcgaaccacaatggataaacgttcttcaagaagactcggttacactgacctgtcgaggcacgcacagccccgaaagtgattcgatacagtggttccacaacggcaacctgatcccgactcacacccagccgtcttatcgattcaaagctaacaataacgacagcggagagtatacatgccagaccggacagaccagcttgtcagaccctgtccacctgacagtgttgagtgagtggctggtgcttcagacaccccatctcgaatttcaagaaggagagactatcgttttaagatgtcattcctggaaggacaaacccttggtaaaagtgacattctttcaaaatggcaagtcaaagaaattttctagaagcgacccaaatttcagcatccctcaagccaaccatagccattctggcgactatcattgcacaggcaacatcggctacactctctacagctctaagccagtcaccatcaccgtgcaggcccctagcagctctcccatgggaatcattgttgcagtggtgacaggtatcgctgtggcagccatagtggctgctgtggtggccctgatctactgccgaaagaagcgtatcagtgccctgcctggttatcccgaatgcagagagatgggtgagaccctaccagaaaagcccgcaaaccctactaatcctgacgaggccgataaggttggtgccgagaacaccattacatatagtcttctgatgcaccctgatgccctagaagaaccagacgaccagaaccggatctag

SEQ ID NO: 223095 - DNA, 876 bp, Artificial Sequence
  Description of Artificial Sequence: Synthetic coding sequence
atggggatactgtcctttcttcccgtgcttgcaactgagtccgactgggcggactgcaaaagcccccaaccgtgggggcatatgctgctgtggacggccgtgctgttcctggcccctgtcgccggtacacccgcagcccctcccaaagcggtgctgaaactcgagccacagtggatcaatgtgctccaagaggatagcgtcaccttgacgtgtcggggtactcactcccctgaatctgattccattcaatggttccacaacgggaacctgatccccacccatacccagccatcatatagatttaaggccaataacaacgactccggagaatacacatgccagaccggacagacctccctgagcgatccagtgcacctaacggtgttgtcagaatggttggtgctgcagaccccgcacttggaattccaggagggagagactattgtgctccggtgccattcatggaaagataagccgcttgtgaaagtgacattttttcagaatggcaaatcaaaaaagttctcgagaagtgatcccaatttcagcatccctcaagcgaaccacagccactcaggcgattaccattgcaccgggaacataggctacaccctgtattcttcaaagcccgtgacaattacggttcaggcaccatccagcagcccaatgggaatcatcgttgccgtggtcactgggatagctgtagcagccatcgttgctgcagtcgtggccctcatctactgccgaaaaaaacggatctcggcaaatcccacaaacccagacgaggcagataaagtgggcgcagaaaatactataacttactccttgctgatgcatcctgatgcactggaggaaccagacgatcaaaataggatatag

SEQ ID NO: 223096 - DNA, 705 bp, Artificial Sequence
  Description of Artificial Sequence: Synthetic coding sequence
atgggcattctgtctttcttgcccgttcttgccactgaaagcgattgggccgattgcaagagccctcagccttggggccatatgctactctggacagccgtgctgttcttagcacccgttgcgggtacgccggctgccccaccaaaggcagtgctaaaattagagccccagtggattaacgtgttacaggaggatagtgtgacactcacatgccgaggcactcactcgcctgagagcgattctatccaatggttccacaatggtaatctaattcctactcatacacagccttcttaccgctttaaggcgaataacaatgacagtggggagtacacttgtcaaacaggtcagacatcattatccgatcctgtgcacctgaccgtgctgtcagagtggctggttctgcagacaccccacttagagttccaggaaggcgaaaccatcgttctcaggtgccactcatggaaggacaaaccactcgtgaaagtgacgttttttcagaacgggaaatctaaaaaattttcaaggtctgacccaaattttagtatcccccaggctaaccatagtcattccggtgattaccactgtaccggaaacataggatatacgctgtacagttcaaaacccgttacgatcaccgtgcagggcccacggctgaggactgcagcaaaacaaagttccctggtgggagctgaggtcccttag

SEQ ID NO: 223097 - DNA, 771 bp, Artificial Sequence
  Description of Artificial Sequence: Synthetic coding sequence
atgggaatcctgtcgtttctcccagtactggcaactgaatccgattgggctgattgtaagagtccccagccctggggccacatgcttctgtggacagccgtactttttctgggggaaagtgggcctcctgccgcaccacccaaagcagtgttgaagctcgaaccacagtggattaacgtcctccaggaggactccgtcactctcacttgtcggggaactcatagcccggaaagcgattcaatacaatggttccacaacgggaacctgatacccactcacacgcagccaagttatcggttcaaggccaataacaatgattctggcgaatacacctgccagaccggccaaactagtctcagcgaccccgtgcacctgaccgtgctttctgaatggctagtgctccagaccccacatctggagttccaggaaggagaaactatcgtacttcggtgccactcttggaaagataaacctctcgtaaaggtgactttcttccagaacggcaaatccaagaagtttagccggagtgacccaaacttttccattccacaggcaaatcatagccacagcggagactatcattgcactggcaacattgggtacaccctgtactccagcaaacctgtgacaattactgtacaggctccatcgtccagcccaatgggaatcatcgtcgccgtcgtcaccgggattgctgtggcagcaatagtggcagcagttgttgcactcatctactgccgcaagaagcgtattagtgtgtctacctggtag

SEQ ID NO: 223098 - DNA, 765 bp, Artificial Sequence
  Description of Artificial Sequence: Synthetic coding sequence
atgtggcagctcctgctccctacagcattattgctgctcgtgtctgccggaatgagaactgaggaccttcccaaggccgtagtgttcctggagccacaatggtaccgcgtgctcgaaaaggacagtgtgacactcaagtgtcagggtgcctactcaccagaggacaacagcacccagtggttccataacgagtcattaatcagcagccaggcctctagctatttcatcgacgcagcaaccgtggacgactccggggagtatagatgccaaaccaacttgagcacactgtccgacccagtccagcttgaagtccacatcggctggctgctgctccaggccccacgatgggttttcaaggaggaagatcctattcatctacgttgccatagctggaaaaacaccgcacttcataaggtgacgtacctacagaacggcaaagggagaaagtacttccatcataattcagatttctatatccccaaagcgaccttaaaggacagcgggtcatacttctgccggggactgtttggtagcaaaaatgtgagttctgagaccgttaatattaccattacccaggggttggcagtcagcaccataagttctttcttccccccaggctaccaggtttctttttgcctagtgatggtgctgttattcgcagtggataccgggctatacttcagcgtgaaaaccaacatcagatcgagtacgcgcgactggaaggaccataaattcaagtggagaaaggatccccaagataagtag

SEQ ID NO: 223099 - DNA, 873 bp, Artificial Sequence
  Description of Artificial Sequence: Synthetic coding sequence
atgggcggaggtgcaggagagcgcctgtttacgagctcctgcctggtaggcctggtgcccctgggtctgcggatctcccttgtcacttgtccgctccagtgtggaatcatgtggcaactgctgctccctaccgccttgttgctgctcgtctccgccggaatgagaacagaagacttacctaaggctgtcgtgttcctcgagccccagtggtaccgcgtgctcgagaaagattccgttacactgaaatgccaaggtgcgtattctccggaggacaactccactcagtggtttcataacgaatctctaatttccagccaggcatctagctacttcatcgacgcagccaccgtggacgattctggggaatatcgctgtcaaaccaacctatctaccctgtcggatcccgttcagctagaggtgcatatcggttggttgctcctgcaggctccccgttgggttttcaaggaagaggatcccattcatctccggtgtcattcctggaagaatacggctcttcataaggtgacttacctacagaacggaaagggcagaaagtatttccaccacaattctgacttctatatcccgaaggccaccctgaaagactccggctcctacttctgtcgagggttattcggtagcaagaacgtgtcttccgagactgtcaacattaccattacccaaggactcgccgtgtcgacaattagctcattctttccacccggataccaagtgtcattttgtttggtcatggtccttctgttcgcggttgatacaggattatacttctccgtcaagacaaatatccgcagttccacacgggattggaaagaccacaagttcaagtggcggaaagatcctcaggataaatag

SEQ ID NO: 223100 - DNA, 816 bp, Artificial Sequence
  Description of Artificial Sequence: Synthetic coding sequence
taaccactagggctccggatcagcctggtgacatgcccactgcagtgtggcatcatgtggcagctgttacttccaaccgccctccttcttctggtatctgctggtatgcggactgacctgccgaaggctgtggtcttcctggagcctcagtggtacagagtgctggaaaaagatagtgttacattgaagtgtcagggggcatatagtcctgaagacaatagtactcagtggttccataacgagagtctgatcagctcacaggcctcctcctatttcatagacgccgcaaccgtcgacgactcaggcgaataccgctgtcagaccaaccttagtaccctttctgatccagtgcagttagaggtgcatattggctggctgctgctccaagccccaaggtgggtgtttaaagaagaggaccctatccatttacgatgccactcatggaagaacaccgctttgcataaggtaacctatcttcagaacggtaaggggaggaagtactttcatcataactctgatttctatatacccaaggccacactcaaagattctggttcatacttctgccgcggtctgtttggctctaagaatgtcagctctgaaaccgttaacatcacaatcacccagggcctcgctgtatccactattagctcatttttccctccagggtatcaagtgtcattctgtttggtcatggttctgctgttcgctgttgacacgggcctctatttctctgtgaagaccaacattagatcatcaaccagggattggaaagaccacaaatttaagtggcggaaagatccacaggacaagtag

SEQ ID NO: 223101 - DNA, 765 bp, Artificial Sequence
  Description of Artificial Sequence: Synthetic coding sequence
atgtggcagctgctccttcccactgcgctgctgctgttagtatccgcagggatgcggacagaggatctgccaaaggccgtggtgttcttagagcctcagtggtacagggttctggagaaggatagtgtaacactgaaatgccaaggggcttactcccctgaggacaactccacgcagtggtttcacaacgagagcttgatttcatcccaagccagcagctactttatagacgccgcaactgtggatgacagcggtgagtatcgctgccaaactaacctgtccacgctgagcgatcctgtccagcttgaggtccacataggctggctgttgcttcaggctccgcgttgggtgttcaaggaagaggatccaatccacttgagatgtcacagttggaagaatactgccctgcacaaagtgacctacctgcagaatggtaaggggcgaaagtattttcatcacaattccgacttctacatacctaaggccacacttaaagattctggctcttatttctgtaggggactgtttggaagtaagaatgtcagttctgagacagtgaacattacaatcacgcaaggtctggcggtttcgactattagctccttctttccgcctggctaccaagtgtctttttgcctggtcatggttctcctgtttgctgtcgatactggattgtactttagcgtaaagacaaacattagatcgagtaccagagactggaaggaccataagttcaaatggcgtaaagatccccaggacaaatag

SEQ ID NO: 223102 - DNA, 318 bp, Artificial Sequence
  Description of Artificial Sequence: Synthetic coding sequence
atgtggcagctcctcttgcctactgccctcctgttgctggtctcagcgggtatgcgaacagacttgccaaaagctgttgtgttcctggagccccagtggtatcgcgtgttggagaaggatagcgtcactctcaagtgtcaaggagcttacagccccgaggataattcaactcagtggtttcacaacgagagtctgattagcagccaggcctcctcttacttcattgatgctgccaccgtggatgattctggcgagtacagatgtcagacgaacctgagtaccctgagcgatccagtacaactggaggtgcatatctag

SEQ ID NO: 223103 - DNA, 870 bp, Artificial Sequence
  Description of Artificial Sequence: Synthetic coding sequence
atgggcggtggcgcaggcgagagacttttcacgtcttcctgtctcgttgggttggttcctctggggctgcggatttctctggtcacttgtcccctccaatgtggaattatgtggcagcttcttctccctacggccctgctcctgctggtcagcgccggaatgcgcactgacttacccaaggcagtggtcttcctggagcctcagtggtatcgcgtgttagagaaggactctgtgacacttaaatgtcagggcgcatattcgcctgaagataattctactcaatggttccataacgagtcgctgataagctcccaggcttctagctatttcattgatgcagctacagtagacgattccggcgagtacaggtgtcaaaccaacttatcaaccttgtcagatccagtccaacttgaggtacacatagggtggctgcttcttcaggctcccaggtgggtttttaaggaggaagatccaatccacctgcgatgtcattcctggaagaataccgccttacacaaagtgacctacctccagaatggaaaaggcagaaaatacttccatcacaactcagacttctacattccaaaagcgaccttgaaagactctgggtcttacttctgcagaggcctgttcggcagcaaaaatgtctcatctgagactgtgaatattacaatcacccagggtctggctgtctctacaattagcagtttctttccaccaggctaccaggtgtcattctgcctagtgatggtgctgctgttcgctgtagataccgggctgtacttctcagttaagactaacatccgcagctctactagagactggaaagaccataaatttaagtggagaaaagacccacaagataagtag

SEQ ID NO: 223104 - DNA, 765 bp, Artificial Sequence
  Description of Artificial Sequence: Synthetic coding sequence
atgtggcagctgctcctgccaacggccttgttgttgttagttagcgccggaatgagaactgaggatctgccaaaggcagtcgtgtttctggaaccgcagtggtatcgggtgctcgaaaaagactcggtgacactgaagtgccagggcgcatacagtcccgaagacaacagcactcagtggtttcacaacgagtcacttatttcatctcaggcgagcagctacttcatcgatgcggcaacggtagatgattctggcgaataccgttgccagaccaacctgagtacactcagcgaccctgtgcagcttgaggttcatatcggatggctgttactgcaggccccaagatgggtgtttaaggaggaagatcccatacacctgcgttgtcacagctggaagaatacagcgctccacaaggtgacatacctccaaaatgggaaaggacggaaatatttccaccataactctgatttttacatcccaaaagccacacttaaagattctggctcttacttctgcagagggttgtttggctcaaagaacgtgagctccgagacagttaacatcacaataacccagggcctggcagtcagcactattagctcctttttccctcctggctaccaggtcagcttctgtctggtcatggtactgttattcgccgtggacacagggttgtatttttcagttaagactaatattagatcttcaaccagagattggaaagatcataagtttaaatggagaaaagatcctcaggacaagtag

SEQ ID NO: 223105 - DNA, 702 bp, Artificial Sequence
  Description of Artificial Sequence: Synthetic coding sequence
atgtggcaactgctgcttcccactgccctcctactcttagttagcgctggcatgcggactgaggacctgccaaaagcggtagtgtttcttgagccacagtggtatagcgtgctggaaaaggattcggtgactctgaagtgccagggtgcgtactcgccagaggataactctacgcagtggttccataacgagaacctgatttctagccaagcatcctcatacttcattgacgccgctacggtgaacgattctggagagtatcgctgccagactaacctgtccactctgtctgaccccgtgcagctcgaagtgcatatcggatggctgctgcttcaggctcctcgctgggtattcaaagaggaggacccaatccacctgcgatgccactcatggaagaacacagccctgcataaggtcacttaccttcaaaacggaaaagacagaaagtacttccaccataattcggatttccacataccaaaggcaactctcaaggactctggttcttatttctgcaggggcctggtcgggagcaagaatgtgagttctgagactgtcaatatcactatcacgcaaggacttgccgtaagtaccatttcaagcttctccccacccggatatcaggtcagtttttgccttgtaatggtccttctattcgctgtggacacaggcttgtatttctccgttaagaccaacatctag

SEQ ID NO: 223106 - DNA, 702 bp, Artificial Sequence
  Description of Artificial Sequence: Synthetic coding sequence
atgtggcagctcctgctacctaccgccctccttttgctggttagcgctggcatgaggaccgaggatctcccaaaagccgtcgttttcttagagccccaatggtacagcgtgctggagaaagactctgtgactctaaagtgccagggggcttactcgcctgaggataatagcacgcagtggtttcacaatgagaatcttatatcctctcaagcctcttcatacttcattgacgctgccaccgtcaacgactccggagaatatcgttgtcagaccaacctgagcaccctgtctgatccagtccagcttgaggttcacatcggctggctgctgctccaggcaccgcgatgggtctttaaggaggaggatcccatccacctgcggtgtcactcatggaagaacacggcactgcataaagtcacgtatctccagaatggcaaggaccgcaaatatttccatcacaatagcgattttcatatcccaaaggccactctgaaggatagcggctcttatttttgtcgaggcctggtcgggagtaagaatgtctcctccgaaactgtgaacattactatcacccagggtctcgctgttagcacaatttctagcttttccccacctggttaccaggtgagcttctgtctcgttatggtactgctgttcgcagttgatactggtttgtatttcagcgtgaagacgaatatatag

SEQ ID NO: 223107 - DNA, 2076 bp, Artificial Sequence
  Description of Artificial Sequence: Synthetic coding sequence
atggaaattgcgcctcaggaagcgcctccagtccctggagccgatggagacattgaggaagcgccagccgaggctggatccccaagccccgctagccctcccgctgatggccgtttgaaggcagctgcaaagagggtaacttttcccagtgatgaagatattgtgtcaggcgctgtggaaccgaaagacccctggcggcacgctcagaacgtgaccgtcgatgaagtcatcggggcatacaagcaagcttgtcagaaacttaactgtcggcagattccaaaactgcttaggcagctccaggaattcacagaccttggacaccgcctggactgtctagatttgaagggagaaaagctggattacaagacctgtgaggcgctggaagaggtcttcaaacgcctccagttcaaagtggtggacctggagcagacaaacctggacgaagacggcgcttctgctctgtttgatatgatagagtattacgagagcgccactcacctaaatatttcctttaataagcacatcgggacacgcggatggcaggctgctgcccacatgatgcggaaaaccagctgtctgcagtaccttgacgcacggaatactccccttctggaccattctgccccattcgtagcgagggccctgaggattaggtccagtctggccgttctacacttggaaaatgcttctcttagtggcagaccactcatgctgctggccactgcgttaaagatgaatatgaacctgagggagctctacctggcggataataagctgaatggcctgcaggatagcgcacagctgggcaacctcctcaagtttaattgtagtctgcagatcctcgaccttagaaacaatcacgttctggacagcggcctagcctatatttgcgagggtttaaaagaacagcggaaaggattggtgacactggttctttggaacaatcagctcacgcatactggcatggcatttcttggcatgaccctgccacatacccagtctctggagactctcaatctggggcacaatcctatcggtaatgagggagtccggcatttaaagaatggactgataagtaatcgctctgtgctgaggctggggctcgcatcaaccaagctcacctgcgaaggagccgtggcagtggctgagtttatcgctgagagcccaagactccttcggttggatctccgggagaatgagataaagaccgggggactcatggccctttcactcgcattgaaggtaaaccactccctgctgcggctggatttagacagagaaccaaagaaggaagccgtcaagtcattcattgagacgcaaaaagctctcttggctgagatccagaacggttgcaagcgtaacttagtgctcgcccgagaaagagaggaaaaagaacagccaccccagctgagcgcttctatgcctgagacaacggccactgaaccgcagcctgacgacgagccagcggcaggcgtgcaaaacggcgctcctagccctgccccttccccagactctgattctgacagcgactcagatggcgaagaagaggaagaggaggagggcgagcgcgatgagactccctgccccgcactggttccccctactgactctcttggaccgggtgaccggagccccccaggctcgcctagtacgccaacagagcaaaggattagcgtgtctagtccaggcaggggccataaggtcttcgtagtaaccagagtggagagtccacctgaacgtgctgaacccccagcatcgccaacgcctccgtcccctccaccccctccctcccccccagccagcccctcgttgcctccggcaggtgccatcgatacccgagataccgggtcctcggaacctcagccgcctcctgagccccctaggtcaggccctcctctacctaatggacttaaaccagagtttgccctggcactccctcccgagcctccacccggtccggaggttaagggcggttcttgcggactggaacacgaacttagttgttctaagaacgagaaagagctggaagagctgctcctcgaagctagccaagaatcagggcaagaaactctgtag

SEQ ID NO: 223108 - DNA, 459 bp, Artificial Sequence
  Description of Artificial Sequence: Synthetic coding sequence
atgggagttccacgaccgcagccttgggccctcggactccttctgttccttctgccaggctccctgggggctgagagccacctcagtctgctgtaccatcttactgccgtgtccagtccagcgccaggtacacctgcgttctgggtttccgggtggctcggtcctcaacagtatctaagttacaactcactgaggggggaagctgaaccatgcggcgcttgggtctgggaaaatcaagtgtcttggtactgggagaaggaaacaacagacctgcgcattaaagagaaattattcctggaggcatttaaggcactcggagggaagggaccctatactctgcagggtttgctcgggtgcgagcttggtcctgacaatacgtcagtacctacagcctgtggaagcacttggcgcggagcggctgaaacttggtccgggagatccccgcctccttgcgcatag

SEQ ID NO: 223109 - DNA, 1098 bp, Artificial Sequence
  Description of Artificial Sequence: Synthetic coding sequence
atgggcgtgccgcgtcctcagccttgggccctagggctgctgctgtttctcctccctggctctttgggggcagagagtcatctgagtctgctgtaccatcttaccgctgtttcgtctcctgcgcctggcacgccggcattctgggtatctgggtggttgggaccccagcaatacctgagctataatagtctccggggagaagcagaaccgtgcggggcatgggtctgggagaatcaggtgagttggtactgggagaaagaaactacggatctgcgcattaaagaaaagttgttcttggaagccttcaaagcgttgggtgggaaaggcccttacacccttcagggactgctggggtgcgaactgggcccagataataccagcgtccctactgccaagtttgccttgaacggcgaagagttcatgaactttgatttgaagcagggtacttgggggggtgactggcctgaggcattagcgatttcgcagagatggcaacagcaagacaaagccgctaataaagagctgacatttctgttgtttagctgtccgcacaggctccgagaacacctggaacgcggacgcggaaacctggagtggaaagagccaccatccatgaggctaaaagctcgacccagtagtcccggattctctgttctgacctgttcagcctttagcttttatcctcccgagctgcagctgcggttcctcagaaacggcttagcagccggtaccggccaaggtgactttggcccaaacagcgacggatcttttcatgcctcctcatccctgaccgttaaatccggcgatgaacatcattattgttgcatcgtgcaacatgccggtcttgcacagcccctcagagtcgagttagagtccccagcgaagtccagcgtgcttgtcgtagggatcgtgataggggtgctgctgttgaccgcagcagccgtgggcggagctctactgtggagaaggatgcgctccggtctgccagctccatggatctctctaaggggtgacgatacgggagtgctcttacccacacctggagaggctcaggacgctgatctgaaagacgtgaacgtaattccagccacagcttag

SEQ ID NO: 223110 - DNA, 708 bp, Artificial Sequence
  Description of Artificial Sequence: Synthetic coding sequence
atgggggtaccacggcctcagccgtgggcgttggggcttctcctattcctattgcccggaagcctaggtgcagaaagccatctaagtttgctctaccacttaacagcagtgagctctcccgcaccaggcacgccagccttctgggtttccggatggctcggcccacagcagtacctttcctataatagcttgcgtggggaggcagaaccgtgcggtgcatgggtctgggaaaatcaagttagttggtattgggaaaaagagactactgatttgcgaatcaaagagaagctttttctcgaggcgttcaaggcattaggaggcaagggcccatacactctccaaggtttgctgggctgcgaacttggcccagacaatacgtccgtgcctaccgccaaatttgcattgaatggagaggagttcatgaacttcgacctgaaacaaggaacctggggcggtgattggcccgaggccctggctattagccagcgttggcagcaacaggataaggccgcaaataaggagctgacttttctgctattttcctgtccacaccggctcagggagcaccttgaacgcggacgcggtaatctggaatggaaaggctgctggaccaagattgatacctcctggggctgcgctcagattttcattccttcagcaaccaaggaaaaactgaggctgaaccagagtccacccccttgcgcttag

SEQ ID NO: 223111 - DNA, 1734 bp, Artificial Sequence
  Description of Artificial Sequence: Synthetic coding sequence
atggacggggaggctacggtgaagcctggcgaacaaaaggaagtcgtccgccgagggagagaagtggactattctcgcctgattgctgggacactgcctcagagccacgtgacatcccgtcgcgctggctggaagatgccgctttttctgattctgtgtctcttgcagggaagttcttttgcactgcctcagaaacgcccacatcccaggtggctgtgggagggtagcctgcctagccgcactcacctccgcgcaatgggcacgctgcggccttcttctcctctatgctggagagaagaatccagctttgccgctcccaattctctgaagggttctcggctcgtgtcaggcgagcccggaggcgcagttactattcagtgtcattatgcaccatctagcgtgaaccgtcaccagcgaaaatactggtgcaggctcggacctccacgctggatctgtcaaacaatagtgtccacgaatcagtacactcatcatagatatagagatagggttgcgctcaccgatttcccccagaggggcctgttcgttgtgcgattatcccagttgagtccagacgatatcggttgctatctttgcggaatcgggagtgagaataatatgctgttcttgtctatgaacctgaccatcagtgcgggtcccgctagcaccctcccaacggcaactcctgccgctggcgagctcacaatgcgcagctatggaaccgcaagtcccgtggctaaccggtggaccccaggcacaactcaaacattgggccagggaactgcttgggatactgtggcatctacgcccggaacgtcaaagaccaccgccagcgctgaaggcagaagaactccaggcgctaccagaccagctgctcctggcacagggtcctgggcagagggaagtgtgaaggcccctgctcccataccagagtccccaccatctaagagtaggtccatgtcgaacacgaccgagggggtgtgggagggaacccgttccagcgtgaccaatcgggctagggccagcaaagaccgtcgtgagatgacaactacaaaggctgaccgtcctcgagaggatatcgagggcgtgcggatcgcgctggatgcagccaagaaagtcttaggaacaataggtccacccgctctggttagtgagaccctcgcctgggagatcctgcctcaggcaactccggtcagcaagcagcagagccagggcagcatcggagaaacaacaccggctgcaggaatgtggactctggggactcctgctgccgatgtgtggattttgggcacccccgcagctgacgtatggacctccatggaagccgcaagtggtgagggttctgcggctggcgacctggatgctgcaacaggcgaccggggaccgcaggctactctgagtcagacgcctgctgtcggcccttggggacccccaggtaaggaatcgtctgtgaagaggacttttccagaagacgagagctcttccaggaccctcgcgccagtctctactatgctggctctcttcatgctcatggcattagtcctactgcagagaaagttgtggcgcagacgcacaagccaggaggctgaacgcgtgacactcatacagatgactcatttcctcgaagtgaatcctcaggccgatcagctgccacacgtagaaaggaagatgctgcaggacgatagtctgccggctggagccagcctgaccgctcccgagcggaacccgggaccatag

SEQ ID NO: 223112 - DNA, 1608 bp, Artificial Sequence
  Description of Artificial Sequence: Synthetic coding sequence
atggatggagaagctactgtcaaacccggagagcagaaggtgccgctgtggacccacgggtggccgcctgatgaccctagtcccagcttcgctgctggcagttcgtttgccttgccgcaaaagcggccacatccccgttggctatgggagggatccctgcccagccgcacgcatttgcgagccatgggcacccttcgaccatccagcccattgtgctggcgcgaggaaagttcgtttgctgcacccaactccctgaagggtagccgcttagtgagcggcgaacccggtggggcagttactattcagtgtcactatgcaccatccagtgttaatagacaccaaagaaagtactggtgtcggcttgggcctcctcgatggatttgtcagaccatcgtttccaccaatcagtacacccaccaccggtacagagaccgggtcgctcttaccgacttcccccaaaggggtttattcgtggttcgccttagccagctgtcccctgatgacattggctgctatctatgcggcattggcagtgagaataacatgcttttcctgtccatgaacctgacaatttcagcagggccagcttcaactttgccaacagccactcccgctgcgggagagctgaccatgcggtcttacggtaccgcttcgcctgttgccaacaggtggacgcctgggaccacacaaaccttgggccagggcacagcatgggatacagtagcctcaacaccgggaaccagcaagacgaccgcttcagccgagggcaggcggaccccgggtgctaccaggccggcagcccctggcacgggaagctgggcagagggaagcgtgaaggcccctgccccaattcccgagtccccgccttcgaaaagccgctccatgtctaatacaaccgaaggggtgtgggaaggaactcggagttcagtcaccaaccgagcacgcgcaagcaaagacagaagggagatgacaaccaccaaagccgatcgaccaagggaagatatcgagggagtgaggatcgcactggacgccgctaagaaggtgctcgggactataggccctcctgctctagtgagtgagacgctcgcatgggagatacttcctcaggctactcctgtctctaagcaacaatcccagggcagcattggggaaacaacgccagcagccggaatgtggactttaggcacccccgcagcagacgtatggattactagcatggaggccgcttctggcgaggggtctgccgctggggacctggacgccgcaaccggagataggggccctcaggctacattgtctcaaaccccggcagttgggccttggggcccacccggaaaagaatcttcagtcaagcgcgcaacatgtccagggctgtccacactgaaagagatcaaggtgagtgcagtactgacgcaaaaccctcatagtctgttgtgtgtgtctgctgcccaagaagccgaacgcgtgacacttattcagatgacccacttcctggaagtgaatccccaggccgaccaactcccccacgtagagcggaaaatgctgcaggacgactctctacctgcaggcgcaagccttactgctcccgaacgtaatccaggaccctag

SEQ ID NO: 223113 - DNA, 798 bp, Artificial Sequence
  Description of Artificial Sequence: Synthetic coding sequence
atggacggcgaggccaccgtgaagccgggtgagcagaaggaggtggtgcggagaggtcgggaggtggattactccaggttgattgccggaacactcccccagtcacatgtgacgtcccgacgggcaggctggaaaatgcctctgtttttgatcctgtgcctgcttcaaggaagcagttttgccctccctcagaagagaccacatccacgctggttgtgggaaggaagcctaccctcgcggacccacctgcgggcaatggggaccttacgcccaagtagtcctttatgttggagggaagagtcatccttcgccgcacccaatagccttaagggctccaggctggtctcaggggaaccgggaggcgctgtgacaatccagtgtcactacgccccaagtagtgtgaacaggcatcaaagaaagtattggtgtaggctcgggcctcctcggtggatctgtcagaccatcgttagtacgaatcaatacacacaccatcgttatagggacagggtggcattgacggattttcctcagcggggactgtttgtggtccgcctatcacagctcagccccgacgatatcggctgttacctgtgtggcatcggatccgagaataatatgttgttcctttccatgaacctgactatctcagctgtgctttttcagaaaatgaaagcggcactggggccatggctcctgtcacttccatgctggccatgcctctgcctatggttgtggttctattgcaaaggcagcagcggcgaaggtgggccactgaggcgtcagaagggcagtccatag

SEQ ID NO: 223114 - DNA, 798 bp, Artificial Sequence
  Description of Artificial Sequence: Synthetic coding sequence
atggatggagaagccaccgtgaaacctggagaacaaaaggaggtggtgcgtagaggccgagaagttgactattctaggttgatagcgggaactctccctcaaagccacgttaccagtcgcagggctgggtggaaaatgccactatttttgatcttatgtctgctccagggatcttcttttgctttaccccaaaagaggccacaccctagatggctctgggagggaagtttacccagcaggacccatctgagagctatgggaacactccgtcccagcagccctctgtgttggcgtgaggagtcttcattcgccgctcctaattccctgaaaggaagtagacttgtgtctggcgagcctgggggtgcggtgactatccagtgccactacgctcccagcagcgtcaatcggcaccaacggaagtattggtgtcgtctgggtccccctagatggatctgccagaccatagtcagtactaaccaatacacccatcacaggtatagggatcgggtcgctttaacggatttcccacagcgtggcctatttgttgtgcgtctctcccagttaagtccagatgatatcggctgttatctgtgcggcatcggctccgagaacaacatgctcttcctctccatgaatttgacgattagtgccgttctgttccaaaaaatgaaagcagcgttaggaccatggctgctgtctctcccatgctggccctgcctgtgtctctggctgtggttttattgtaaaggctcaagcggagagggcggtccacttcggaggcagaagggatctccatag

SEQ ID NO: 223115 - DNA, 1101 bp, Artificial Sequence
  Description of Artificial Sequence: Synthetic coding sequence
atgctgccgcgactgctgctgctcatttgtgctccattgtgcgaaccagcagaactattcttaatcgctagccctagccaccctaccgaagggtccccagttactctcacatgcaagatgccctttctccagagctcagacgcccaattccagttctgctttttccgcgatacacgtgctttgggcccagggtggtccagctctccaaagttacaaatagcagccatgtggaaagaagatacaggctcatattggtgtgaggcccagaccatggcatccaaagtcctgcgcagcagacgaagtcaaattaacgtccaccgggtgcctgttgcggacgtgtccctggagacacagccacccggagggcaggtcatggaaggagatcgcctggtgcttatctgtagcgtcgcgatgggcacaggagatataactttcctctggtacaagggcgctgtaggactgaaccttcagagtaagacgcagcggtcccttaccgctgaatacgaaattcccagcgtgcgtgaaagtgacgctgaacaatactactgtgtcgctgagaacggctatgggccaagtcccagcggactggtgagcatcaccgtgaggatcccggtgagtcggcctatcctgatgttgagagccccacgagcacaggctgccgtggaggacgtccttgagctccactgcgaggcattgagaggctcgcccccaattttatattggttttaccacgaggacattacactgggatcaagaagcgcgcctagcggtggcggagcatcgttcaacttatcccttaccgaagagcactccggcaactattcctgtgaggccaacaacggattaggagcccagaggtcagaagcagtcacactgaatttcactggtaggagaagcgcacgcgatcccctcaggagtttacccagtccactccctcaagagtttacctatctaaacagccctacccctggacaattgcagccaatctacgaaaacgagccgcgagagcagagcgtcgccgtgcacggcaggcaacagcacagttccgaacaaaaggctcagaagccatggggccacatctggaggactaggttcccgtag

SEQ ID NO: 223116 - DNA, 1290 bp, Artificial Sequence
  Description of Artificial Sequence: Synthetic coding sequence
atgctgccaagactcctgctgctgatttgtgcacccctctgcgagcccgctgagttgtttttaatcgcatcaccttctcaccccacggagggctctccagtaaccctgacttgtaaaatgccattcttgcaaagcagtgatgcccaatttcagttctgcttcttccgcgacactagagcattagggcctggctggtcctcctccccgaagttgcagatcgcagccatgtggaaagaggatacaggcagttactggtgtgaagcccaaaccatggcaagcaaagtcctgagatcaagacggtcccagatcaatgtgcatagagtacccgtcgcggacgtatcactggagacccagccccctggtggccaggtcatggagggagatagacttgtcctgatttgtagcgtcgctatgggcacaggcgatattacatttctttggtacaaaggggcagttggactgaacctccagagcaagacgcagcgctccctgactgccgaatatgaaatcccctcagtccgtgagagcgatgccgaacagtactactgtgtggctgaaaatgggtacgggcctagtccctctggcttggttagtataaccgtaaggatacctgtgtcccggccaattctaatgttgagggcccctcgcgcacaagccgcagtggaagatgtattggagctgcactgtgaggccctaaggggctcccctccaatcctttactggttctaccatgaagacattacacttggcagtagatctgctccaagcgggggtggggcatcctttaatctgagtcttacggaggagcactctggaaattactcgtgcgaggcgaataacgggctgggcgcacaaagaagtgaggcagtaaccctgaattttacagttcctaccggtgcgagatctaaccatctgacaagtggagtgatcgaagggcttctgtctacactcggtcctgcaaccgtcgctctgctcttttgctacggtttgaagcggaagataggcagaagatccgctagggaccctcttaggagtctgccttctcccttgccacaggagtttacttatttgaactcacctactccaggccagctacagcccatctacgaaaatgtgaatgtagtttcgggtgatgaggtttattctctggcctactacaaccagccggaacaggagtcagttgccgctgaaactctcggaactcatatggaagataaggtgtccctggatatatactcaagacttaggaaggcgaatatcactgatgtggactacgaggatgcaatgtag

SEQ ID NO: 223117 - DNA, 1287 bp, Artificial Sequence
  Description of Artificial Sequence: Synthetic coding sequence
atgctacctcgtctcctccttctgatatgtgcccctctgtgcgagccggcagaactgtttttgatcgcctcacccagccatcccacagaaggctcccctgttacacttacttgcaaaatgcccttcctgcagtcctctgatgcccagttccagttctgttttttccgagatactcgagcgctgggccctggatggagcagctctcccaagctgcagattgctgctatgtggaaggaagacaccgggtcctattggtgcgaggcacaaacaatggcctctaaagtgctgcgttcgcggcgatcccagatcaatgtgcacagagtccccgtggcggacgtgagtctggagacgcagccccctggcggacaggtaatggaaggcgatcggctggtcctgatttgctctgtggctatgggcaccggcgacatcacttttctgtggtacaagggggcagtgggcttgaatctccagagtaagacccaacggtccctcactgctgagtatgagatcccctcagtgagggagagtgacgcagagcagtattactgcgtggctgaaaacggctacggtccgagccccagtggcctggtgtcgattactgtcaggattcctgtcagtagacccattctgatgctgagagctccgagagcccaagcagccgtggaggacgtattggaactgcactgtgaggcactccggggtagccctccaatcctctactggttctatcacgaggacattacacttgggtcaaggtctgcacctagtggcggaggggcaagtttcaacctcagtcttaccgaagaacactctggtaattacagctgcgaagctaataacggcctgggcgcacagaggagcgaggccgttaccttgaattttacagtccccacaggagcgagatctaatcacctgacttctggggtgatagaaggtctcttgtctacgctggggcctgctaccgttgccctgctcttctgctatggcctcaagcgcaagatcgggaggcggtccgcccgtgatcctctgagaagcttgccaagcccgctgccccaggaatttacctatctcaacagtcctacaccagggcaactgcaaccaatctacgaaaatgtcaacgtggtttcaggggatgaggtctactctttagcttactacaatcaaccggagcaggaatccgtagctgaaacattgggaactcatatggaagacaaggtgtctttagatatttatagccggttacgaaaggctaatatcactgatgttgactatgaggacgccatgtag

SEQ ID NO: 223118 - DNA, 2670 bp, Artificial Sequence
  Description of Artificial Sequence: Synthetic coding sequence
atgtcatactttggagagcatttctggggagagaagaaccacggtttcgaggtgctgtatcatagtgtgaaacaggggccaatcagcaccaaagagctggctgactttatcagggagcgggcaaccattgaggaaacatattcgaaggccatggcaaaactgtctaaattggccagtaatggcacccctatgggtactttcgctcctctgtgggaagttttccgcgtgtctagtgacaaactggccttgtgtcatctggagctcaccagaaagttgcaggacctcatcaaggacgttctacggtacggagaggagcagctgaaaactcacaaaaaatgtaaagaagaggtggtgagtacactggacgcggtgcaggtgctttccggcgtgagtcagctactgcctaaatctcgagaaaattacctcaatcgctgcatggaccaggagcgtctacggcgagagagtacctcccagaaagagatggacaaggcagagactaaaaccaagaaagcggcagaatctctgcgtcgcagtgtcgagaagtataactcagccagagcagacttcgagcagaaaatgctggattctgccttgaggtttcaggccatggaagagacgcacctgagacacatgaaagctttgttagggagttatgcgcacagcgttgaagacacacacgtgcagattgggcaggtccacgaagagttcaaacaaaacatcgaaaacgtgtctgttgagatgctgcttcgaaaattcgcagaatccaaggggacaggacgggagaagcccggaccactggattttgaggcctattcagctgccgctctgcaggaagctatgaagagattgcgaggggctaaggctttccgactgcctggactgtcccgacgggaaagggagcccgaaccccctgcggcagtcgactttttggagccagactcagggacctgccccgaggtggacgaggaggggtttaccgtgcgccctgatgtcacccaaaattcaaccgccgagccttccaggttctcttcctcagatagcgattttgatgatgaggagccgaggaaattctacgtgcatattaagcccgctcctgcaagagctcccgcttgttccccagaggccgcagctgctcagctgcgagctaccgctggcagtctcatccttccgcctggaccagggggaacaatgaagaggcactcatccagagatgccgcaggcaagccccagcgccctcgtagcgcacccaggacttccagttgcgcagagcgtcttcaaagcgaggaacaggttagcaagaatctgtttgggccacctttggaaagcgccttcgatcacgaagacttcacaggctcctcttccctggggtttacctctagccctagtccattttcttcgtcttcgccagagaatgtggaagacagcggtctggactctccctcacacgccgcacccggaccttcccctgattcgtgggtgcccaggcccggtaccccacagtcgccaccttcttgtcgagctccacctcctgaagccagaggaatacgcgctcctccactgcctgactcaccacagccgttagcttcctctcccggaccttgggggttggaggccctggctggtggcgacttgatgcccgctcctgcagatccaacagctagagaaggtctggccgcacccccacggagacttaggagcagaaaggtgtcctgcccgcttacacgttccaatggagacctatcccgtagcctcagcccatctcctctgggtagctcggccgcatcaacagcccttgagcggccatccttcttgtctcaaaccgggcatggcgtgtctcggggaccttcccctgtcgttttgggcagtcaggatgcccttcctattgcaaccgcctttactgaatatgttcatgcctatttcaggggacattcaccttcttgtctggccagagttactggcgaactgactatgacctttcccgcaggaatcgttcgagtgttcagcggcacccctccaccacccgtgctgtcctttcgcctggtgcacacaactgcgatagaacattttcagcctaatgccgatttactattttcagatccttctcagtctgatccggagacaaaggacttctggcttaatatggccgcactgaccgaggcattgcagcggcaggccgagcagaacccgacggcatcctattacaatgtggtgcttctgcggtatcagttcagccgtcctggtccacagtccgtgcccctgcagttgtcagcacattggcagtgcggggctacactgacgcaagtgtctgttgaatatggttaccgccctggagctacagccgtgcccaccccacttacaaatgtccagattctgttgcccgtcggcgaaccagttaccaacgtgcgactccagcctgctgccacctggaatctagaggaaaaaaggctgacttggagacttcctgatgtgagtgaagctggagggtctggacgtctcagcgcctcgtgggaaccactaagcggcccaagcacaccttctcctgttgccgctcagtttacctctgagggtacaacactgagcggggtggacctggaattagtgggcagcggctacaggatgtcgctggtaaagaggcgctttgcaactggtatgtatctggtctcctgctag

SEQ ID NO: 223119 - DNA, 2670 bp, Artificial Sequence
  Description of Artificial Sequence: Synthetic coding sequence
atgtcatactttggagagcacttctggggtgagaagaaccatggcttcgaggtgctctaccactccgtgaagcaggggccaatatctacaaaagagctagccgacttcatacgcgagagggctacaattgaggaaacttatagtaaagcgatggctaagctatctaagctcgcctcaaacggtacacctatggggactttcgctcccctctgggaggtttttcgcgtttcatccgacaagctggctctctgtcacctagagcttacacggaaactccaggatttaattaaggatgttcttcgttatggggaagaacagctgaaaacccacaagaaatgtaaagaagaagtggtgtccaccctggatgccgtgcaagttttgtccggcgtatcccagctcctgcccaagtctcgggaaaactatcttaatcggtgcatggatcaggagcggttgcgccgagagagcacctctcagaaggagatggataaggccgagacaaagactaagaaggctgccgaatcattgaggcgcagcgtggagaaatacaatagcgcaagagcagatttcgaacagaagatgttagatagcgcactccgattccaggcaatggaagaaacccaccttcgccacatgaaggccctgttaggctcctacgcccattctgtcgaggatacacatgtgcaaattggccaagtgcacgaggaattcaagcagaatattgaaaacgtgtccgtggagatgcttcttcgaaagttcgctgagagcaaaggtacaggtcgcgagaaacctggccctctcgacttcgaagcctacagcgcagcggcattacaggaggccatgaaacgacttcgcggagccaaggcctttcggctgccaggactttcacggagggagagggagccagagcccccagctgccgttgatttcctggaacccgacagcggtacttgccctgaggtagacgaggaggggttcacagtgcggcctgatgtgactcaaaacagtaccgcagagccgagcaggttttcctcgtccgactctgatttcgatgatgaggagccgcgtaaattttacgtgcacatcaagccggctccagccagagccccagcatgttcccccgaagccgctgctgcccagctgcgggcaactgcagggagcctgattctgcctcctggacccggtggcaccatgaagcggcacagtagccgcgatgctgcagggaaaccacagagaccacggtctgccccacggacatctagctgcgctgagaggctgcagtccgaagaacaggtatccaagaacctgtttggtccaccactcgaatcagctttcgatcacgaggactttactggcagctcctctttaggatttacaagcagcccttcgccattcagcagctccagcccagagaacgtggaagattcaggcctggatagcccttctcatgcagctcccggaccttctcccgacagctgggtgccacggcctggaactccacagagcccaccctcctgccgcgctcctcctcctgaggctcggggtatccgtgcacctcctctgccagactctccccagcccttggcctcatctcctggtccatgggggctcgaagccctggccggaggcgacctgatgcctgctcctgctgaccctaccgcgagagaaggactcgcagcgccacctcgtaggcttagaagccgaaaggtgtcctgccctctgacccgctccaacggtgatctgagtaggtccttgagcccatctccgctcggatcgtccgcagcaagcaccgcactagaacgcccaagtttcctgtctcaaaccggccacggagtgtctagagggcctagccctgtggttttgggctcgcaggacgctttgccgatagctaccgcttttactgagtacgtgcatgcctactttcgcggacattctccatcgtgtctagcgcgtgtgaccggagagctcactatgacatttcccgctggtattgtaagagtcttttcaggtacaccacccccaccggtactctcctttagactggtgcacaccacggccattgagcactttcagcccaacgcagatttattattctccgaccccagccagagcgatccagagaccaaagacttctggctcaacatggcggctctaacagaggctttgcagagacaagccgagcagaatcccacagcaagctattacaacgtagtgctccttcgttatcagttcagtcgaccaggcccacaaagtgtccctctccagttgagtgcccactggcaatgcggggcaactctgacccaggtctctgtcgagtatggatacagaccaggggctacggcagtccccactcctctcaccaacgtgcagattttgttaccggttggcgagcctgtgacaaacgttaggctccagcccgctgctacttggaatctcgaggagaaaaggctgacttggcgactgccagatgtgtctgaagcaggaggctctggacgcctgagcgcctcctgggaacctttgagcggcccatctactccttctcctgtggctgctcaatttacctcagaaggaacaaccctgtccggagttgacttagagttagtgggatctggctaccggatgagtctggttaagcgtcgctttgccacaggcatgtatttggtcagttgttag

SEQ ID NO: 223120 - DNA, 2670 bp, Artificial Sequence
  Description of Artificial Sequence: Synthetic coding sequence
atgagctactttggggagcacttttggggggagaaaaatcacggatttgaggtactgtatcattctgtcaaacaagggccaatctctacgaaggagcttgcagattttattagggagcgcgcaacaatcgaggagacctactcgaaagcaatggccaagctgtccaagctggccagcaatggtacacccatgggcacatttgctcctttgtgggaagtcttccgggtttcttccgacaagctggccctgtgtcacctcgaactaacacgtaagttacaagacttaattaaggatgttttaagatacggggaggagcagctgaagacacacaaaaagtgcaaagaggaagtggtcagcacacttgatgccgttcaggtgctgagtggcgtctcccagctactgccgaagtccagagagaactatctcaacaggtgcatggatcaagagagactgcggagagagagcacttctcagaaggagatggataaggctgaaaccaagacgaagaaggcagccgagagcctgcgaagaagcgtggagaaatataatagtgcacgcgctgactttgagcagaagatgttggactccgccctgaggttccaggccatggaggagacacacctcaggcacatgaaggctctgctgggatcgtatgctcacagcgtcgaagacacacacgtgcaaattggacaagtgcacgaggagttcaaacaaaatatcgagaacgtctccgtcgagatgctgcttagaaaattcgccgaatccaaaggcaccggtcgggagaagcccggtccacttgatttcgaggcatacagcgccgctgctctgcaggaggctatgaagcgactgaggggggcaaaagccttccgtctgcctggactgtcgagaagggagcgggagccagagccacccgctgctgtcgactttttggaacccgacagcggcacctgcccagaagtggacgaggagggcttcactgtccgcccagacgtgacacagaacagcaccgctgaacccagcaggttctcgtcgtccgactccgatttcgatgatgaagaaccgaggaagttttacgtccacatcaagcctgctccagccagggcaccagcatgtagtccggaggccgctgcagctcagcttcgagccacggcaggctcactgattctgccacctgggccaggcggaaccatgaagcgccactcctctagggacgctgccggtaaaccacaaaggccacgaagtgcccctcgcaccagctcctgcgctgagcggctgcagtccgaggagcaagtttccaaaaacctattcgggccacccttagagagtgcctttgaccacgaagatttcacaggcagctcatccttaggctttaccagctctcccagtccgttctctagcagcagccctgagaacgtggaagattctggcttagactccccctcacacgctgcaccgggaccttcaccagatagctgggtgccacggcctggcaccccacaatcgcccccatcgtgtcgggctcctccccctgaagccagaggaatccgggcacccccactgcctgattctccgcaaccactcgccagttcaccaggaccctggggccttgaagctctggctggtggcgatctgatgcccgctcctgctgaccctacggcgagagagggtctggccgctccaccgagaagactccggagtcgaaaggtctcatgtcccctaacacgcagtaacggggacctgtctcgctccttatccccttctccgctgggatcctccgcggcttcaacagcactagaaagaccgagctttctgtcacagacaggccacggtgtgtccagaggcccttctcccgtggtcctgggctcgcaagatgctcttcccattgcgacagctttcactgagtacgtgcacgcctactttcgaggccacagtccatcttgtttggccagagtgaccggcgagctgaccatgaccttccccgctgggatcgtgcgcgttttcagtggcacaccgcctccaccagtactgtcatttcgccttgtccacacgactgctattgaacattttcagcctaatgcggacttattgttcagcgacccttcacagtccgatcccgaaacaaaggacttttggctaaacatggcagccttgacggaggcactccagagacaagcggagcaaaacccaacagccagttactacaatgttgtgctcctgcgatatcagttttcacggcctgggccacagtccgtcccccttcagctgtcagcccattggcagtgcggggctaccctcacacaagtctccgttgaatatgggtataggccgggagccacagccgtcccaactcccctgactaacgtccagatcctcttaccagtaggtgagcctgtgacgaacgtgaggcttcagcccgcagctacatggaatctggaggaaaaaagactcacctggaggcttccagatgtcagcgaagccggagggtccggtaggctgagcgcctcttgggagccgctgtctggcccatccaccccctcccctgtcgcagcccagtttacatccgagggaactaccctgtcgggagtagatcttgagttggttggcagcggctaccggatgagtcttgtaaaacggagattcgccactggtatgtatctggtgtcctgttag

SEQ ID NO: 223121 - DNA, 2676 bp, Artificial Sequence
  Description of Artificial Sequence: Synthetic coding sequence
atgagctattttggagagcatttctggggcgagaaaaatcacggattcgaggtcctctaccactctgtcaagcaggggccaatttcaacgaaggaactggcagacttcatacgtgagcgagctaccatcgaggagacctacagcaaggctatggcaaagctctcgaagctcgcctctaatggcactccgatgggcacgttcgcccctctgtgggaagtgttccgggtcagttccgacaaactggccctgtgtcacctcgaactgaccagaaagctgcaggacctcataaaggatgtgttgaggtacggagaagagcaattgaaaacccataagaaatgcaaagaagaggtcgtctctaccctggatgcggttcaggttctatctggagtgtcgcaacttctaccgaagtccagagagaactaccttaaccgatgtatggatcaagagcggctgaggcgtgagtcaacctcccaaaaagagatggacaaggccgaaacgaagacaaaaaaggccgcagaatcactgcgtcgatcagttgagaagtataactctgctagggctgactttgaacagaagatgcttgacagcgcccttcgattccaggccatggaagagacgcatctccggcacatgaaggccctcctgggaagctacgcacacagcgtggaagatacccacgtgcagattgggcaggtacacgaagagttcaaacagaacattgaaaacgtctctgtggaaatgcttctcagaaaattcgcagagagcaaaggaacagggagggagaagcctggtccccttgatttcgaagcctattctgcggctgccctacaggaggccatgaaacggctacgtggcgctaaagcttttcggctgccaggactttcccggcgtgaacgggagccagagccgccagccgctgtggacttcctcgagcccgattcaggcacgtgtcccgaggttgatgaggagggttttaccgtgagaccagatgtgacacagaatagtactgcggaaccctcaagattcagctcaagtgactctgactttgatgatgaggaacctaggaagttttatgttcatatcaagcccgctcccgctagagctcctgcttgtagcccagaagccgctgctgcccagctccgggctacagccggttctctgatcctccctcccggtccgggaggaaccatgaagcgccattctagtagagacgctgcgggtaaaccgcaaaggcccaggtcagctccccgaaccagtagttgtgcagagagacttcagtcagaagagcaggtgagtaagaacttatttgggcctccactggagtcagcattcgaccatgaagactttaccggttcaagtagtctgggattcacatctagcccctccccctttagctcttccagtccagagaacgttgaagacagtggcctcgattctccgtcccatgctgcacccggaccatcccccgatagttgggtgcctagaccagggacaccacagtcacccccttcatgcagagcacctcctcccgaggcacgaggaatcagggcgcctcccctgcctgattccccgcagccattagcttccagccctgggccatggggactggaggccctggccggaggcgacctgatgcctgcaccagccgaccccaccgcccgtgaggggctggcggctcctccaagaaggctgaggagtcggaaagtgtcttgtccactgactcgaagcaacggcgatctgtctcgctccctgtccccctctccattagggtcctctgccgcatcgacggccttggaacgtccatccttccttagtcaaacgggtcatggagtgtcgcgcggaccatctcccgtcgtgcttggatctcaagatgctctgcccatcgccactgcctttaccgaatacgtacacgcgtacttccggggtcactctccttcctgcttggcaagggtcacaggtgaattgaccatgaccttcccagccggtatcgtgagggttttttctggaaccccccctccccctgtgctgtcatttagactggtgcatacgaccgcgatcgagcactttcaacccaatgcagacctcctttttagtgacccaagccagagtgatcccgagacaaaagatttttggttaaatatggctgcattaaccgaagccttgcagcgtcaagccgaacagaatcctacagcgtcgtactataacgtcgttcttttgcgctatcagttttcccgacctggaccccagagtgttcctctgcagttatccgctcattggcagtgtggggcaacattaacgcaagtttctgttgagtacgggtacagacctggtgccacagccgttcctacccccctgacaaatgtacagatcctgctgcccgtcggcgaacctgttaccaacgtccgcctccaacctgccgcaacttggaatttggaagagaaaagactcacatggcggctcccagacgtgagcgaggctggaggttccggcagactttctgctagttgggaaccgctcagtgggccaagcactccttcccccgtggcggcacaatttacatccgaaggaacaacacttagtggcgtcgacctggagctggtggggagtggatacagaatgtccctggtgaaaagaaggtttgccaccgccgcaccaccccaggggtgtacttggtag

SEQ ID NO: 223122 - DNA, 2520 bp, Artificial Sequence
  Description of Artificial Sequence: Synthetic coding sequence
atggcaaagctgagtaaacttgctagcaatggtacccccatgggcacttttgcacccctgtgggaagtgttcagggtctctagtgacaaattagccctgtgtcacctcgaactcactaggaagctccaggatctaattaaggacgtgctccgttacggcgaggagcagctgaagacccacaaaaagtgtaaagaagaggttgtgagtaccctagacgcagtacaggtgctgtcgggagtcagccagctactgccgaaatccagggaaaactacttgaaccggtgtatggaccaagagagactccgacgggaatcaactagccagaaagaaatggacaaggcagagaccaagacaaaaaaagccgctgagtcgctgagaaggagtgtagaaaagtataactccgccagagcagactttgaacagaagatgctcgacagtgccctgcgattccaggccatggaggaaactcatctcagacatatgaaggcgctcctcggcagctacgcacacagcgtcgaggacacacacgtgcagatcgggcaggtgcacgaagagttcaagcagaacatcgaaaacgtctccgtcgaaatgctgctgagaaaatttgctgagagcaaaggcacaggacgggagaagcctgggcctctagacttcgaggcctactcggccgctgctctccaggaagcaatgaaacgactccgcggagccaaggcattcagattgcctggccttagcagacgggagagagagcccgagcctcctgccgctgtggactttctggaacctgacagtggaacttgtccggaagtggacgaggaggggtttacagttcgccctgatgtgacgcagaatagtacggcagaaccgagcaggttctctagctccgactccgattttgatgacgaagaaccaaggaagttttacgttcacattaagccagctccagcacgcgcacctgcgtgctcgccggaggctgccgcagctcagttgagagctactgccggttctctcattctgccaccgggtccaggaggaaccatgaagcggcactcatctagggacgctgcaggaaagccacagcggccacgatcagccccacgtacctcctcatgtgcagaacgactccaatcggaagaacaagttagtaagaatctctttggaccgcctctggagagtgcatttgatcacgaagactttaccggatcttctagccttgggtttacttctagcccttcaccattttctagctcctctcctgagaacgtggaggattctggactggactcgccaagccatgctgctcccggtcctagtccggatagctgggtgcctcgccctggaactccccagtctccaccaagttgcagggcccctcccccagaagcgcgaggtatccgtgccccaccactgcctgatagccctcagcctctggcgtcatcccccggaccctggggcctggaggcactggccggtggtgatctgatgcccgcacccgcagatcccacagcacgcgagggactggccgcaccacccagacgtttgaggtcaagaaaagtatcatgcccactgactagatcaaatggtgacctttcccggtcactgagtccgtcccccctggggagctctgccgcttcaacggccttggagcgaccctccttcctgagccagaccggacacggcgtgagccgcggaccaagcccagtcgtccttggctctcaggacgccctgcctatcgccacagccttcactgagtatgttcatgcctattttagaggccattctccatcctgtctggcacgtgttactggagagctgacaatgacttttcccgctggtatcgtgcgggtttttagcggtacacctccacccccagtgttgagttttcgactggtccataccacagccattgaacacttccaaccgaacgctgatttgttgtttagtgaccccagccagagcgacccggagaccaaagacttttggttaaacatggccgctttgactgaggcactccagaggcaggccgaacagaaccccactgcaagttactacaatgtcgtgctgctgagatatcagtttagtcggcctggccctcagagtgttcctttacagctgagcgcacattggcagtgcggcgcaaccctgactcaggtcagcgtggagtatgggtatcgccctggcgctacagctgtacccaccccattgaccaacgtgcagatcctcctgcccgtgggagaacctgtaacgaacgtccgcctgcaaccagctgctacctggaacctagaggaaaagaggttgacttggcgcctacccgacgtgtccgaagccggaggctccgggcgactctccgcttcatgggaaccgctaagtggaccctccacaccaagtcccgttgctgctcagttcacgagcgagggcactactctgagcggtgtggatttggagctggtggggtccggatatcgcatgtccctcgtgaagcgtcgttttgctacgggaatgtatctggtgtcttgctag

SEQ ID NO: 223123 - DNA, 2670 bp, Artificial Sequence
  Description of Artificial Sequence: Synthetic coding sequence
atgtcctacttcggtgaacacttttggggagagaaaaaccatggattcgaagtgctgtaccattctgtgaagcaggggcctatctcaaccaaagagctagccgattttataagagaacgggctaccatcgaggagacttatagtaaagctatggccaaactgagcaagctggctagtaatggaacacccatgggcaccttcgccccactgtgggaagtttttagagtgtcttcagacaagctggccctatgccacctggaactgacccgcaagctgcaggacttgataaaggatgttttaaggtacggagaagaacagctcaaaactcacaagaagtgcaaggaggaagttgttagtacgttagatgctgtacaggtcttgagtggagtgtctcaactcttgccaaagtccagggagaattacctcaaccggtgcatggaccaggagcggctcaggcgggagtcaacgagccaaaaggagatggacaaagcagaaacgaaaaccaagaaggccgctgaaagcctgcgtcggtctgtggaaaagtataactccgccagagccgatttcgagcaaaagatgcttgacagtgccctgcggttccaagccatggaggaaacacacttgcgccacatgaaggccctgctgggatcctacgcccattcagtagaagacacccacgtccagatcggccaggtacacgaggagtttaaacagaacatcgaaaatgtttccgtcgaaatgttgctgcgcaaatttgccgagtctaagggaaccggcagggaaaagccagggccactcgatttcgaggcctattctgcagctgcccttcaggaggctatgaaaagactgaggggggcaaaggccttccgactcccagggttaagtcgacgcgaacgggagcccgagccccctgccgctgtggactttctagagccggactccggcacttgccccgaggtggatgaggaaggatttactgtgcgaccagacgtgactcaaaattcaaccgcagaaccgtctaggttctcaagctctgattcggatttcgatgatgaggagcctcggaagttttacgtccacattaaacctgctcctgcccgagccccagcatgctcacccgaggccgctgctgctcagctgcgggctaccgccggatctctcatactgccccctggacctggcggtacgatgaagcggcacagttccagggacgctgccggtaagccacaacgccctcgttccgccccacgaacctcatcctgtgccgagcgcctgcagagcgaggaacaggtaagcaaaaatttgttcggtccccctctggagagcgccttcgaccacgaagatttcactggcagctcctctcttgggttcactagctcccctagtcccttttcctcttccagtccagaaaacgtcgaggattccgggcttgactccccctctcatgccgctccagggccatctccagactcatgggttccaagacccggaacccctcagtccccaccctcttgtcgcgctccaccccctgaggccagaggtatacgcgctcccccactgcctgattccccacagccacttgcgtcctcacctgggccttgggggttagaggctctggccggaggtgacttgatgcccgctccagctgacccaaccgcacgcgagggtttggccgctccaccacgacgcttgcgcagcaggaaagtcagctgccctctgacccgttccaatggtgatcttagccggtccttgtccccttctcctctcggctccagcgcggcaagtaccgccttggagcgaccctcttttctaagtcagacagggcacggcgtgtcacgagggccttctcccgtagtcttgggttcccaagacgcactccccatcgcaacggcgtttacagagtacgtccacgcctactttcggggacacagccccagctgtctcgcacgggtcactggagagctcacaatgactttcccggctgggattgttcgcgtgttcagcggcacgccccctcccccagtgctgtcattcaggctcgtacacaccaccgctatcgaacacttccaacccaatgccgacctgctgtttagtgacccatcacaatctgatcccgagaccaaagacttctggttgaacatggctgcattgaccgaggccctgcaacgacaggccgagcagaaccccacggcttcctactacaatgtggtccttctgaggtatcagtttagcagaccgggaccacagtccgtgcctcttcagcttagcgcacactggcaatgtggagccaccttgacacaggtgtctgttgaatatggctatcgtcccggagcgactgcagttcctacgccactgactaatgtgcagattctgctgcctgtcggcgagcccgttacgaacgtgaggctccagccagcagcgacctggaatctagaagagaagcgactgacatggagactgccggatgtgtcagaagccggaggctccggccgactgtcggcctcttgggagccactaagcggaccttctacacccagccccgtggcggctcaattcacctctgagggaacgaccctctccggcgtggacctggagctggttgggtctgggtaccgtatgtcactcgtgaagagaagattcgccacagggatgtacctggtgtcttgttag

SEQ ID NO: 223124 - DNA, 2670 bp, Artificial Sequence
  Description of Artificial Sequence: Synthetic coding sequence
atgtcctacttcggggagcacttctggggagagaagaatcacgggttcgaggtactctaccatagcgttaagcaggggccaatcagtaccaaggaactcgcggattttataagggagcgcgctacaatcgaggagacgtattccaaagcaatggcaaagcttagcaaactcgcatctaacggaaccccgatgggaacttttgctcctctgtgggaggttttcagggtgtcctcagataagttggccctctgccacttggaattaacgagaaaactgcaggacctgattaaggacgtgttacgttatggtgaggagcagcttaaaactcacaaaaagtgcaaggaagaggtcgtctccacactggacgctgtgcaagttctgtctggggtgtcacagctcttacctaaatctcgggagaattatctgaatagatgcatggatcaggagagactgagaagggaatctacatcacaaaaggagatggataaagccgaaaccaagaccaagaaggctgccgagtcacttagaagatcggtggagaagtataattctgccagggccgatttcgagcagaagatgctcgacagcgccctacggtttcaggcgatggaagagacacacctacggcatatgaaggcactgttgggcagctacgctcacagcgtggaagatacccacgttcagattggtcaggtacacgaggagtttaagcagaacatagagaatgtatccgtcgagatgctgctgcggaaatttgcagaatccaagggcacaggcagagaaaaacccggaccactcgacttcgaggcttactctgctgccgctctccaagaggctatgaagagactacgtggggctaaagctttccggctgcctgggctctcccggcgagaaagggagcctgaaccgccagcggcagtggactttctggagcccgactcagggacatgtcccgaagtagacgaggaagggttcaccgtacgtcctgacgtcacacagaattcgaccgccgagccatccaggttttccagtagcgatagcgattttgacgatgaagaaccccgtaagttttatgtacacattaaaccagcaccagcgagagcaccagcttgttcccctgaagcagccgcagctcagctgagggctactgcaggatccctcatactgccacctggcccaggcggaacgatgaagagacatagtagccgagacgccgctgggaaaccccagcgcccacgcagcgcacctcgcacaagttcctgcgcagagagactccagtctgaagaacaggtgtccaaaaacctgtttggcccacccctggagagcgccttcgatcacgaagatttcacagggagctcttctctggggttcacttccagcccaagcccattctccagcagcagccccgagaatgtggaggactctggtttagacagccctagtcacgctgccccaggcccttcccccgattcctgggtgccccgtcctggtacaccccagagcccccctagttgcagggcacctcctccagaagccagaggcatccgggctccacccctgcccgattctcctcaaccactggccagttccccagggccatggggactcgaagcgttggccggaggagaccttatgcccgcaccagccgaccccacagcgagagagggactggcggctcccccaagacgcctgagatcccggaaggttagctgccctttaacccggtctaacggtgatcttagtagatcactgtcccccagtccgttgggtagttcagccgctagtaccgcactggagcgacctagttttttgagtcagaccggacacggcgtttcacgaggcccttctcctgttgtcctgggcagccaggatgccctgcctatcgctacggcctttacggaatacgttcatgcgtacttccgaggtcatagccccagctgcctcgctagggtgactggggagctaactatgacattccccgcaggaatcgtccgggtgttcagtggaacaccacctccccctgtgctcagcttccgactggtgcacactacagctattgaacatttccagccgaatgccgaccttcttttctctgacccaagccagagcgacccagagaccaaggacttttggctcaacatggctgctctaaccgaggcattacagcgccaggcagagcagaatcccaccgcctcgtattataacgtggtgctgctgcggtatcaattctcaaggccgggaccccagagcgtgccgttgcagctatccgctcactggcaatgcggcgcaacacttacacaagtcagtgtagagtacgggtatagacccggtgccactgcagtcccaaccccactgaccaatgttcaaattctgctgccagttggagaaccggtaactaacgtaagactccagcccgctgcgacatggaacttggaagagaaacggctgacatggaggttgccagatgtgtccgaagctggtggaagtggaagactttctgcctcatgggagcccttaagcggcccatctacaccgagtccagttgccgctcagtttacaagcgaaggcactacactcagcggagtggatctggaactagtgggctcgggctacagaatgtctctggttaaaagaagatttgctaccgggatgtacctagtcagctgctag

SEQ ID NO: 223125 - DNA, 1137 bp, Artificial Sequence
  Description of Artificial Sequence: Synthetic coding sequence
atggtaatggcatatttcgtagaaaacttctggggagagaaaaactctggtttcgacgtcctttaccacaacatgaagcacggtcagatctctactaaggaactggctgattttgtaagggaacgggcaaccatcgaagaggcgtactctcgtagcatgacaaagctcgctaaatccgcatctaactattcacagctgggcactttcgccccagtgtgggacgtctttaagacctcaaccgagaagctggccaactgccatcttgatcttgtgaggaaactgcaggaactgatcaaggaggtgcagaagtatggggaggaacaggtgaagagccacaaaaagacaaaggaagaagttgcaggaaccttggaggctgttcaaacaatccagagtatcacccaggcactgcagaaatctaaggagaattacaacgccaagtgcgtagagcaggagcgtctgaaaaaagaaggcgctactcaacgtgaaatagagaaagccgctgtcaagtctaagaaggcaactgatacctacaagctctacgtggagaagtacgccttggctaaggcggattttgaacaaaagatgacggaaaccgctcagaaattccaagatatcgaggagacgcacctcatacatatcaaggagattatcggaagtctgagtaatgcgatcaaggagattcatttgcagatcgggcaggtccatgaggagtttattaacaacatggcaaatactacagtagagtccctgatccagaagtttgctgagtcaaaggggactggcaaggagagaccagggctaatcgaatttgaggaatgtgatactgcatccgccgtggagggcattaaacccagaaaacgtaagacgtttgcgctgcccggtattataaagaaagagaaagatgcagagtccgtgtggtcttttacagtggttgcccaggtaggcatgcagtggcgcgacctgggtttactccattcacctccacccagattcaaacgtttttcatcctatttgtcattgcctagcagctggaactacggggctcaccaccacatttggctcatcttctgcatcttctcaagagacagagtgtccccatactggccgggatggtctcgaacacctgatctcagatag

SEQ ID NO: 223126 - DNA, 2433 bp, Artificial Sequence
  Description of Artificial Sequence: Synthetic coding sequence
atggtgatggcctacttcgtcgagaacttctggggcgaaaagaacagcggcttcgacgtgctgtatcataacatgaagcacggccagataagcaccaaggaactggcagactttgtgcgcgaaagggcaacgattgaggaagcttactcccggtcaatgactaagctggcaaagtctgctagcaactattcacagctgggcacctttgctcctgtttgggacgtattcaagactagcaccgaaaagcttgctaattgccacctagacctcgtgcggaaactgcaggagctgattaaagaggtgcagaaatacggagaggaacaagtgaagtcacataagaagacaaaagaagaagtggccggaaccctcgaggccgtccagactattcagagtatcacacaagccctccagaagagcaaagaaaattacaacgctaagtgcgttgaacaggagaggttgaagaaggagggggcaacgcagcgggaaatcgaaaaggccgcagtgaaatctaaaaaggctacagatacttataaactctacgtggagaaatacgctctggcgaaagctgattttgagcagaagatgactgagaccgctcagaagttccaggatatcgaggagacacatctgatacacatcaaggaaatcatcggtagcctaagcaatgcgatcaaagaaatacacctgcaaatcggccaagtgcacgaagagttcatcaacaatatggccaataccactgtggagtcactcattcagaagttcgccgaatccaaaggtaccggtaaagaaaggcctggtctgattgagttcgaagagtgtgacacggcctcagctgtggaaggcattaagcccaggaagagaaagacctttgcacttcccggtattattaaaaaagaaaaggacgcagaatccgtggaatgcccagacgcggattcgctgaacataccagacgtggacgaagaaggctactccatcaagcccgagaccaaccagaacgacactaaagaaaaccatttctattcgtcttctgactctgattccgaagacgaggaaccaaagaagtacagaatcgagattaagcctatgcacccaaataacagccaccatacgatggcttctctggacgagcttaaagtgtcgattggaaacatcactttgtctcctgccatttccgtttccactaacacacgcctcaaccgcaattttaatgacgaggaactcactaagagtaaaccatcagcacctccaaatgagaaggggacaagcgacttgctggcttgggatcccctgttcggcccatccctcgactccagcagctcgagttctctgacatcctcttccagcgcgagacctacgacacctctgagcgtgggaacaatcgtcccaccacctcggccagcatctcgaccaaaactgacctcaggtaaacttagcggcatcaatgaaatcccaagacccttttcgccgcctgtcacttcgaacacgagtcctccaccggcagccccactggccagggctgagtcctccagtagcatttcctcttccgccagcctgtccgccgcaaacacgcctaccgtgggggtcagcagaggtcctagccctgtgtcgctaggcaatcaggatactttgcccgtggcagtggccttaacagagagtgtgaacgcatactttaagggcgcagatcccacaaagtgcatcgtcaagatcacgggcgacatgactatgagcttccctagtgggataattaaagtcttcacaagcaacccgacacccgcagtgttatgtttcagagtcaagaacatctcccgcttggagcaaattttaccgaacgcacaacttgtattttctgacccaagccagtgcgatagcaacaccaaggacttttggatgaatatgcaggcggtgaccgtctacttgaaaaagctctccgaacagaatcctgccgcttcctattacaatgttgacgtcctgaagtatcaagtgtcatccaacggtatacaaagcactccccttaaccttgcaacttactggaagtgtagtgccagtactaccgatctcagggtggattacaaatacaatccagaagccatggtggctccaagtgtgctcagcaacatccaagtagtcgtcccagttgatggcggtgtcactaacatgcagtcactgccccctgccatttggaatgccgagcagatgaaggcattttggaaactcagcagtatttctgagaagagcgagaatggtggttcaggcagcctcagagctaaattcgatctcagtgaaggtccctccaaaccgacgaccctcgccgtccagttcctcagcgagggatccaccctgagtggagttgatttcgaactcgtggggaccggttaccgtctctcactcattaagaaaaggttcgctaccggtagatacctcgccgactgttag

SEQ ID NO: 223127 - DNA, 2433 bp, Artificial Sequence
  Description of Artificial Sequence: Synthetic coding sequence
atggtgatggcatacttcgtggagaacttttggggcgagaagaacagcggcttcgacgttctgtatcacaatatgaaacatggtcagatcagcaccaaagagctcgctgatttcgttagagagagagcaaccattgaggaagcatacagccgaagcatgaccaagttagcaaagagtgctagtaattacagtcagttggggacatttgccccagtgtgggacgtatttaagaccagcaccgagaaactcgctaattgccatctggacctggtcaggaaattgcaggaactgataaaggaggttcaaaaatacggcgaggagcaggttaagtcgcataaaaaaacaaaagaggaagttgctgggacactggaggccgttcagaccattcagtcaatcacccaggctcttcagaagagcaaggaaaactataacgccaagtgtgtggagcaggaaagactgaagaaggaaggtgcaactcagcgagaaatcgaaaaggcagcagtgaaatctaagaaagctacagatacgtataagctgtatgtagagaaatacgcactggccaaagccgatttcgagcagaaaatgaccgagacggcccagaaattccaggacatcgaggagactcatctaatccatatcaaggaaatcattggatcgttatcgaacgcaatcaaggagatccatctccagattgggcaggtccacgaagagttcattaacaacatggctaacacaaccgtggaatcactcatccaaaagttcgccgaatccaagggtaccggtaaggagcgcccaggactgattgagttcgaagagtgtgatacagcaagtgctgtcgagggcattaaaccccgaaagagaaagaccttcgccctacctggaataatcaagaaggaaaaagacgcagagtctgtggagtgccctgacgccgactccctcaatatcccagatgttgatgaggaagggtactcaatcaaacccgaaaccaaccaaaatgacactaaagagaatcacttctactcttcaagtgacagtgatagcgaggacgaagaacccaagaagtatcgtattgagatcaaaccgatgcacccaaacaattctcaccatacgatggcatccttggacgagctgaaagtgtccattggcaatatcactttgtccccagccatttctcggcacagccctgtacagatgaaccggaacttatccaatgaggagcttactaaatctaagccaagcgcaccccctaatgagaaaggcacgtcagatctcctggcctgggacccgctgtttgggccatctcttgacagctccagctcctcctctcttacatcaagctcaagtgctcgtcctaccacacctttgtctgtcggaacgattgtgcccccacctcgccctgctagtcgacctaagctgactagcgggaagctctcaggcatcaatgagattcctcgccctttctcacctccggttacttctaacacttctcccccaccagccgcacccctggcacgcgcagagagtagttcatccatctcgtctagtgcgtcactcagcgcagccaacacaccaaccgtcggagtctcacgcggaccgtcccccgtctcacttggaaatcaggataccttacctgttgccgtagcgctgactgagtctgtgaatgcatacttcaaaggcgctgacccgaccaaatgcatcgtaaagatcaccggcgacatgaccatgtctttcccaagcggaataattaaggtcttcacaagcaatccaacacctgccgtcctgtgttttagggttaaaaacatttcacggcttgaacaaattctccctaatgctcagctcgtgttctccgacccttctcagtgcgatagcaataccaaagatttttggatgaatatgcaggcagtgactgtgtatctgaaaaagctgtcagagcaaaatcctgccgctagctattacaacgtggatgtcttgaaatatcaggtgagctccaatggcatccagagcactcctctcaacttagccacatattggaaatgttcagcatctactacagatctgcgggtcgattacaaatacaacccagaagctatggtggccccatccgtgctgtctaatatacaggtcgtagtacctgtggacgggggagtaaccaacatgcaaagcctgcctcctgcgatttggaatgctgagcaaatgaaggcgttctggaaactttcctcaatctctgagaagtccgaaaacgggggttccggttctctacgagccaaatttgatctgagtgagggtccttctaagccaaccacccttgcggttcagttcctgtcagaagggagcacattatcgggtgttgacttcgagcttgttggaaccgggtaccggctgtccctgatcaagaagaggttcgccaccggcagatatctcgccgactgttag

SEQ ID NO: 223128 - DNA, 2334 bp, Artificial Sequence
  Description of Artificial Sequence: Synthetic coding sequence
atggtgatggcgtattttgtggaaaacttctggggagaaaaaaactcagggttcgatgtcctgtaccacaatatgaagcatggacaaataagtaccaaggagcttgccgattttgtacgagaacgggcaaccattgaggaggcctattccagatcaatgacaaaactcgctaagagcgcaagcaactacagccaactgggaacattcgctccagtgtgggacgtgtttaaaacatctaccgagaagctagctaactgtcatctggacctggtcaggaagctgcaggaactaataaaagaggtgcagaagtacggcgaggaacaggtaaagtcccataaaaaaaccaaggaggaagtggctggcacactggaagctgtgcagacgatccagtctattacccaagcactgcagaagtctaaagaaaattataacgccaagtgcgtcgagcaggagcggctgaaaaaagaaggcgctacacagcgagagattgaaaaggctgcagtgaaatcaaagaaggcaactgatacatacaaattgtatgttgagaagtatgctcttgctaaagctgacttcgaacagaaaatgaccgaaacagctcaggtacacgaagagttcatcaataatatggcaaatacgactgtggagtccctcatccagaagtttgccgaatctaaaggcacagggaaggagaggcctgggctgatcgagttcgaagagtgcgacacggcaagcgctgtggaaggcattaaaccgagaaagaggaagacatttgctctgcctgggattatcaagaaggaaaaagacgctgagtcagttgaatgtcctgacgctgactcactaaacatcccagacgtggacgaagaagggtactctatcaagccagagaccaaccaaaatgataccaaggaaaatcacttctattcctcgtctgacagcgactcagaagacgaagaacctaaaaaatatcgaatagagatcaagccgatgcacccaaataacagtcatcacaccatggcgtctctggacgaactgaaagtcagtataggaaatatcaccctgtctcctgcaatcagccggcacagtccagtgcagatgaacaggaatctttccaacgaggaacttactaaaagcaagccaagcgcccctccaaatgagaagggaaccagcgatctgctcgcatgggatcctctctttggtcccagcttggattcctccagctcttcgtccttgaccagctccagctctgctcggccaacaactcccctctccgtggggacaatcgtgccaccaccacgaccagcatcgcgcccaaagctaacaagcggaaagttgtcaggtattaatgagattccacggccatttagccccccagtgacaagcaatacatcgccaccacccgctgccccactggcacgcgcagaatcaagctccagcattagctcctccgctagcctctcagctgctaataccccgacagtgggagtctcaaggggaccttccccggtgtctctgggaaatcaggacacactgcctgtggcagtagctcttaccgaaagcgtgaatgcttacttcaagggggcagatcccaccaaatgtattgtgaagattacaggagacatgactatgagcttccctagtggcatcatcaaagtatttactagcaatcctacaccagctgtgctttgttttcgtgtcaagaatatcagtcgtctcgagcagatcctgcccaacgcccagctcgtcttttccgacccctcgcagtgcgactcaaataccaaggacttctggatgaatatgcaggcagtcacagtctacctgaagaagttgtctgaacagaatcccgctgcatcatactataacgttgatgtgctcaaatatcaggttagtagcaacgggatccaatctactccattaaacctggccacctactggaaatgtagtgcctcgaccaccgacctgcgggtggactataaatacaaccctgaagctatggtagctcccagcgtcctctctaatatccaggtggtggtcccagtggacggaggcgtgactaatatgcagtctctccctccagctatctggaacgccgagcaaatgaaggccttttggaaattaagctctattagcgagaagagtgagaatggcggatccggaagcctcagggctaagtttgacctgagcgagggcccatccaaacctactacactggccgtgcagttcctcagcgagggttctactctgagcggagttgacttcgagctggtcggtacggggtatcgcctcagcctgataaagaaacgctttgcgacagggaggtacctcgcagactgttag

SEQ ID NO: 223129 - DNA, 1668 bp, Artificial Sequence
  Description of Artificial Sequence: Synthetic coding sequence
atggctcgccctgacgacgaggagggagccgctgtcgctccgggacaccccttggccaaaggttatttgcccttgcctcgcggagcacctgtgggcaaagaatccgtggagttgcagaatggacctaaggcaggaacctttcccgttaatggcgcaccccgagactccctcgcagctgcctccggcgtcctcggaggccctcagaccccccttgccccagaggaagagacccaggcgagactcctccccgctggggctggcgctgaaactcccggtgctgaatcctctccgttgccgctgaccgctctctcccctaggcgctttgtggttttgctgattttttctctatactccctcgtaaatgcattccagtggattcagtactccatcatttccaatgtcttcgaaggcttctatggcgtgacacttctgcacatcgactggttatctatggtgtacatgttggcttatgttcctctgattttccccgctacttggcttctggatactcgaggtcttaggctcaccgcgctcctgggctccggcctcaactgcctgggagcctggatcaaatgtgggtccgtgcagcaacatctgttctgggtgacaatgctgggacaatgcctgtgtagcgttgcacaggtgttcatcctcggcctgccaagccgcatcgctagcgtctggtttggacctaaagaagtgagcactgcatgcgctacagccgtattgggcaaccaactgggcaccgctgttggttttcttctgccccctgtgctggtgccaaacacccagaatgatacaaatctattggcctgtaatatctccactatgttctatggcaccagtgccgtcgcaaccctgctcttcattctgactgccatcgctttcaaggagaaaccacgttatcctccttcgcaggctcaggccgctctgcaggattccccccctgaggagtatagctacaaaaaaagcatccggaacctcttcaagaacataccatttgtgctgctcttgatcacatacgggataatgactggtgctttctactccgttagtaccctattaaaccaaatgatcctcacgtactatgagggagaggaagtgaatgcgggacggatcggtttaacattagtcgtcgccggtatggtcggaagcattctttgtggcctgtggctcgactatactaagacatataagcagacgaccctgattgtgtatatattgagctttatcggcatggtcatatttacatttaccctggatctgaggtacatcatcattgtgttcgttactggcggtgtgctcggcttttttatgacgggatacttgcctctgggctttgaattcgcagtggagattacctaccctgagagcgagggaacttctagcggacttctcaatgcctctgcgcaaatcttcggcatactttttactttagctcaaggcaagctgacctccgattatgggccaaaagctggaaacatttttctatgtgtgtggatgttcatcggcattatcttgaccgccctgatcaaaagcgacctccgtaggcataatattaacattggaataacaaatgtagacgtgaaagcgattcctgcggactcccctacagaccaggaacccaagaccgtgatgctgtctaaacagtccgagagtgcaatctag

SEQ ID NO: 223130 - DNA, 2469 bp, Artificial Sequence
  Description of Artificial Sequence: Synthetic coding sequence
atgggctttggctcagatctgaagaattcccatgaagccgtgctcaaactgcaggactgggaacttcgcctgctagagactgttaaaaaattcatggccctgcgcataaaaagtgacaaagagtatgctagtactctgcagaatctgtgtaatcaggtggacaaggaaagcaccgtacagatgaactacgtgtccaacgtaagtaaatcatggctgctgatgattcagcagactgagcagctaagcaggatcatgaaaacccatgcggaggaccttaactccggaccacttcacagactgaccatgatgataaaggataaacaacaggtaaaaaagtcatatatcggggtgcatcagcaaatcgaagccgaaatgatcaaggttaccaaaacagagctggaaaagttgaagtgtagttaccgacagctgattaaggagatgaatagtgccaaggaaaaatataaggaggcacttgccaaaggcaaggagacggaaaaggctaaggaaaggtatgataaagcaacaatgaaactccacatgctgcacaaccagtacgtgttggccctgaaaggggcacagttacaccagaatcaatactacgatatcaccctgcccctgctgttagacagcctccagaagatgcaggaggaaatgatcaaagccctgaaggggatatttgatgagtattcgcagatcacatcactggtcacggaggaaatcgtcaatgtgcacaaggagattcagatgtctgtggaacagatcgacccaagtacagagtacaataatttcattgatgttcatcggacgactgccgctaaagaacaggagattgaatttgatacctcactgctggaggaaaacgagaacctgcaggccaacgagattatgtggaataacctgactgccgagagtctgcaggtgatgctcaagacgctggccgaagaactgatgcagacgcagcaaatgcttctgaacaaagaggaggcagtgctggagctcgagaagagaatagaagaatctagcgaaacatgtgagaagaagtcagacatcgtcttgctgcttagccagaagcaggctctggaagaactgaagcaatccgttcaacagctacggtgcactgaggcaaaattcagtgcccagaaggaacttctggaacagaaggtgcaggagaatgacggaaaggagcccccacctgtagttaattacgaagaggatgcacggtcagtgacatccatggagaggaaggagaggctgtcgaaattcgagtctattagacattctattgctggaatcattcgatcaccaaagagcgctttggggagtagcgctttgtctgacatgatctctatctccgaaaaacctttagctgaacaggactggtatcacggagccatccctcgtatcgaggcacaggaacttctcaagaaacaaggcgacttcctggtgcgtgaatctcatggcaaaccaggagagtacgttctttctgtttattccgatggccagaggcgacattttattattcagtacgtcgataatatgtatagattcgagggcacaggtttcagcaatatcccacagctcatagaccaccattacaccaccaagcaggtgattacaaaaaaatccggggtggtgctactgaatcctattccgaaagacaaaaaatggatattaagtcacgaggacgttatcctgggcgagctgttggggaaagggaacttcggggaggtgtacaagggaactctcaaggacaaaactagcgttgccgtcaagacctgtaaggaagatctcccccaggagctaaaaatcaagttcctgcaggaggccaaaattctcaagcaatacgatcaccccaacattgttaaactgattggtgtgtgcacccaacggcaaccagtctacatcattatggaattggtcagcggcggagacttcctcaccttcctgaggagaaagaaagacgagctgaaactgaaacagctggttaagttcagccttgatgcagctgccggtatgttgtacctcgaatccaaaaattgcatccatcgcgatctcgcggctagaaattgtctcgtgggagagaacaatgtgcttaagatctctgattttgggatgtctcgccaagaagatggcggtgtctattcttcaagcggccttaaacagattccaataaagtggacagcccctgaagcactgaattatgggaggtatagcagtgaaagtgacgtgtggagttttgggatcctgctctgggaaaccttctctctcggtgtctgcccatatccaggtatgactaaccagcaggctagagagcaggtcgagcggggataccgtatgagcgccccacagcactgtccggaagacattagcaaaatcatgatgaaatgctgggattacaagcccgaaaataggccaaaatttagcgagctccagaaggagctcaccataatcaagcgcaaacttacctag

SEQ ID NO: 223131 - DNA, 1944 bp, Artificial Sequence
  Description of Artificial Sequence: Synthetic coding sequence
atgaagctacacatgctccataaccagtatgtacttgccttaaagggggcacagctccaccagaaccagtattacgacatcaccctgcctcttctcctcgattccctgcagaagatgcaggaggagatgattaaggcgctgaaggggatctttgacgagtacagccaaattacttccctggtgaccgaagagattgttaacgtccacaaggaaattcagatgtcagtcgagcaaatcgatccaagcacggaatataataattttattgacgtacaccggaccaccgccgcaaaagaacaggaaattgagtttgacactagtttactggaggagaacgaaaatctgcaggctaatgaaattatgtggaacaatttgaccgctgagtctttacaggtgatgctcaagactctggcggaagagctgatgcaaacacagcagatgctgctgaacaaggaagaagccgtgctggagttggagaaaagaatcgaagagtcaagcgaaacctgtgaaaaaaagtctgatatcgtgctgttactttcacagaaacaggctctggaagagcttaagcagtccgtgcagcaattgcgatgtactgaggcgaaattctcagcgcagaaggagctcctggagcagaaggttcaggagaatgacggaaaggaaccgcctcccgtggtaaattacgaggaggacgcgaggagcgtcacaagcatggaacgtaaagaacgattgtccaagtttgaaagtatccgccacagcattgccggaataatacggtctccaaaatctgccttaggctcatcagctctgagcgatatgatttcaatcagcgagaagcctcttgctgagcaggactggtatcacggcgcaattccaaggatcgaggctcaggagctactcaagaagcagggggattttcttgttcgggaatcacacggcaaacctggcgagtacgtactctccgtctacagcgatggccaacgcaggcacttcatcattcagtacgttgacaatatgtacaggttcgaaggaaccggtttctccaacatcccccagctgattgaccatcattataccaccaaacaggtcatcaccaagaaatccggcgtggtcttactcaatcctatcccaaaggacaagaaatggatccttagccatgaagatgtgattctcggcgagcttctcggaaaaggaaattttggtgaagtctataaggggactctgaaggacaaaacatcagtcgccgtgaagacttgcaaggaggatctcccgcaggaactgaagatcaagttcttgcaggaggcaaagatcctgaaacaatacgatcaccctaacatagttaagctgatcggtgtctgcactcagcgccagccagtgtatatcataatggagctggtgtctggcggagatttcctcacatttctgagacgaaaaaaagacgaacttaaactcaagcaacttgtaaagttctccttagatgccgcagccggtatgctgtacctggagagcaagaattgcattcaccgggacctggcggcacgcaactgcctggtgggggaaaacaacgtgttgaaaatttctgacttcggaatgtctcgtcaggaggacggcggagtgtattcttctagcggtctgaaacagattcctattaaatggactgccccagaggcactgaactacgggagatattcttccgaatccgacgtgtggtcctttggaatattattgtgggaaacgtttagcttgggcgtgtgcccgtaccctggcatgaccaatcagcaggctagagaacaggtggagcgaggctacagaatgtccgctccgcagcattgtcccgaggatatctccaaaataatgatgaagtgttgggattacaaaccagagaacagacctaaattttccgagctccaaaaggagctcaccattattaagaggaaactcacatag

SEQ ID NO: 223132 - DNA, 981 bp, Artificial Sequence
  Description of Artificial Sequence: Synthetic coding sequence
atgggatttggtagtgatttgaagaattcacacgaagccgtgctgaaactgcaagattgggagctcaggctgctggagacagtgaagaagtttatggccctcaggattaaatccgacaaagagtacgctagcacactgcagaacctgtgtaatcaggtggacaaagagagtaccgtacaaatgaactatgtatccaacgtgtccaaatcttggctgcttatgatccaacaaacagagcagctttcccggattatgaagacacacgccgaagacttgaattcgggtcctctccataggttgaccatgatgatcaaggacaaacagcaggtgaagaaaagctacatcggggtccatcaacagattgaggccgaaatgatcaaggtgacaaaaaccgagttagagaagttaaagtgtagctaccgacagctcattaaggaaatgaacagcgcaaaagagaaatacaaggaagcgcttgccaaagggaaagagactgagaaagcgaaggagagatatgacaaggctactatgaagttgcacatgctgcataatcagtacgtactggcactaaagggcgcacaactccatcagaaccaatattatgacatcacattaccactcctcctggactccttgcagaagatgcaggaggagatgatcaaagccctcaagggcatatttgatgagtactctcagattacttcacttgtgactgaagaaatagtgaacgtacataaggagatccagatgtcggtggaacagattgatcccagtactgaatacaataactttattgacgtgcatcggaccaccgcagcaaaggagcaggagatcgaattcgacaccagccttctggaagaaaatgaaaacttacaggccaacgaaataatgtggaacaacctgactgcggagtccctgcaggtgatgaaagaaagacggggataccccaacctgaacctgttcgtaattcagctgctcgagtag

SEQ ID NO: 223133 - DNA, 3855 bp, Artificial Sequence
  Description of Artificial Sequence: Synthetic coding sequence
atgcacgtgtttattgtcggaatgagcctgtcttccgtgaccctagcttccgcccttcaagtcagaggagaagccctgtccgaggaggagatttggagcctactatttcttgcggcagagcagctacttgaggatcttcgcaacgacagctctgactacgtagtgtgtccttggtctgccctgctttctgctgccggatcactctctttccaaggcagagtgagtcacatcgaagccgctcctttcaaagcccctgaactgctgcaggggcaaagcgaggacgagcaaccagatgcaagccagccgctccaactttgcgagccactacacagtatactattaaccatgtgtgaggatcagcctcacaggaggtgcactttacaaagcgttctggaagcctgccgggttcacgagaaagaggtctcagtttatcccgctcccgctggactgcatatccgcagactggtgggacttgtgctgggcaccatctctgaggtggaaaagcgtgtggtcgaggagagttcatccgtgcagcagaacagatcatacttactgagaaaacggttgagagggaccagctctgaatcacccgcagcccaagcccctgagtgtttgcatccttgcagggtgagcgagaggagcacagagactcagtcctcacctgagccgcattggagcaccttgactcactctcactgctctctgcttgtgaacagggccctaccaggagccgacccccaggaccagcaggccggtcgtcgcttgtcaagcggatccgtgcatagtgccgcagactcttcatggcctacaaccccatcacagagaggctttttacagcggaggtccaaattctcccgccctgagttcatcctgctcgccggtgaggcgcctatgacactgcatttgcctggcagtgtggttaccaaaaagggcaaatcctacctagccctgcgggacctctgcgtagtgcttttgaatggacaacacctcgaagtgaaatgcgatgtcgagagcacagtgggggctgtgtttaacgccgttaccagttttgcaaacctcgaggagctgacgtatttcggtcttgcgtacatgaagtccaaggagttctttttcctggattcagagacgcgactctgcaaaattgcaccagaaggttggcgcgagcagccgcagaaaacctccatgaatacatttacactcttcctgcgcattaagttttttgtcagccattatggcctgcttcaacactccctgacccggcaccagttttatcttcagctgcgcaaagacattttagaagagaggctgtattgtaatgaggagattcttctccagctcggcgtgcttgccctccaagctgaatttggtaattaccccaaagaggttgagagcaagccatactttcacgtagaagactacatccctgcctctctgattgagcgaatgacagccctccgcgtacaggtggaagtgagcgaaatgcaccggctctccagtgctctctggggagaggacgcagaattgaagttcctcagggtcacacagcagctccccgagtacggtgtacttgtgcatcaggtctttagcgaaaagcggcgacctgaggaggaaatggctctgggcatttgcgcaaaaggggtgatcgtgtatgaggtcaagaataactccaggatcgcaatgctacggtttcagtggagagaaacggggaaaattagcacctaccagaaaaagtttaccatcacctccagtgtgactggtaagaagcataccttcgtgacagactccgcaaaaacaagtaaataccttctggacctgtgcagcgcgcagcacggcttcaacgctcagatgggtagcggccagccatcgcatgtgctatttgaccatgacaagtttgttcaaatggccaacctatctcctgcccaccaagcaagaagcaaaccactgatctggatacaacggttgtcatgctccgagaatgaactgttcgtgtctcgcctgcaaggtgccgcagggggattgctgagtacaagtatggacaacttcaacgtggacggttctaaggaagcaggagctgaaggaatcggcagaagcccttgtaccggcagagaacagctgaagtcagcctgtgtaatccagaaaccaatgacctgggatagtcttagcgggccaccagtccagtctatgcatgccggatccaaaaacaatcggaggaaatcttttatagccgaaccaggcagagaaatcgtacgtgtaacgctgaaaagggatccccacagaggatttggattcgtcattaacgaaggagagtattcgggacaggccgaccccggtatctttatctcctctataatacctggtggcccagctgaaaaggccaaaaccattaagcccggaggacaaattttggcgctgaaccatattagcttggaaggctttacgtttaacatggcagttcgtatgatccaaaattctcctgacaacattgagcttatcatttctcagtctaagggggtcggtggcaacaatcctgacgaagagaagaattctacggccaactccggcgtgagtagcaccgatattctttcgttcggataccagggatccttgctgtcccatactcaggatcaggatcggaacaccgaagagctggatatggccggtgtgcaatctctggtccccaggctgaggcatcagctgtcctttctgccgctgaaaggtgctggttcctcctgcccaccgtcaccgcctgagatttccgctggcgaaatttatttcgtcgaactcgtgaaagaggatggcaccctggggtttagtgttaccggcggaattaatacgtctgtgccgtacggagggatttacgtgaaatccatagtacctggaggccctgctgccaaggaaggtcagatactgcagggcgatagacttttgcaggtcgatggcgtaattttatgcggcttgacccacaagcaagcggtgcaatgcttaaccggacctgggcaagtggctcgtctggtgctcgagcggcgagtgcccaggagcacccaacagtgcccatcggcgaatgattccatgggcgatgagcgcacggctgtgtctctggtgaccgccctgccgggtcgacctagttcttgtgtgagtgtgaccgacggacctaagtttgaggtcaaactcaagaaaaatgctaacggactcggattttcctttgtgcagatggaaaaagagagctgcagccacctcaagagcgatcttgtgcgcattaagaggctgttcccaggacagcccgctgaagaaaacggagccatcgcagccggtgacattatcttagcagtgaacggacggagtaccgaaggcctgatattccaggaagttttgcatctgctgcggggtgcccctcaggaggtgactctcctcctgtgcagacctcccccaggtgcactcccggaactggaacaggagtggcagacccctgagttgagcgccgacaaagaattcacgcgcgctacctgtactgacagttgtacctctccgattctagaccaggaggattcctggcgcgattctgcttcgcccgacgccggtgaaggcctaggtctaagaccagagagtagtcagaaggcaatccgggaagcacagtggggtcagaatcgcgagcgcccatgggcctcttccctcacacattccccagagtcccacccacacctctgtaaacttcaccaggaaagggatgaatcgactctggctactagcctcgaaaaggacgtacggcagaactgttatagtgtttgcgacattatgcggctcggcaggtactctttctcatctccccttacccgcttatcaactgatatcttttag

SEQ ID NO: 223134 - DNA, 3930 bp, Artificial Sequence
  Description of Artificial Sequence: Synthetic coding sequence
atgcagccacttacaaaggatgccggaatgtccctctcctccgtcactttggcaagtgctctgcaagtgaggggcgaggccctgtcggaggaagaaatatggagcttgctcttcctggccgctgagcagctgcttgaagatctcagaaatgactcatccgactacgtcgtctgtccttggtccgccctgcttagtgcagcgggaagcctctctttccaggggagagtgtctcacatcgaggcagccccatttaaagctcccgagctactgcaagggcagtccgaagatgagcagcccgacgcctctcaaatgcatgtctattcactgggcatgaccctgtactggagcgccggattccatgtgccccctcaccaacctttacagttatgtgaacctcttcattcgattctgctgacaatgtgtgaagatcagccacaccgcaggtgcacactacaatctgtgctggaagcatgcagagtgcacgagaaagaggttagcgtgtacccagcgccagccggactccacattcgtcgactcgttggactcgttctaggtactatctccgaagtggaaaagcgggtagtggaagagagttcatcagtgcagcaaaatcgctcatacttactgcgcaaaaggcttcgcggaacctcatccgagtctccggcagctcaagccccagagtgtctgcacccgtgtcgtgtgtcagagaggtccacagaaactcaaagtagccctgagccacactggtcaacactgacccattctcactgtagcctcctggtcaatagagcgctgcctggggcagacccccaagaccagcaggccggaagacgactgtcctcaggctcagtccactccgccgctgattctagttggccaaccaccccatcacaacggggattcctgcagcgtagaagtaagttttcacggccagagttcattctccttgctggagaagcaccgatgacactccacctgcctggaagtgttgtcactaagaaaggcaagtcctaccttgccctgcgagatttgtgtgtggtcctcttgaatgggcagcatctagaggtgaagtgcgacgttgaaagcacggttggggctgtgtttaatgccgtcacaagctttgcaaacctggaagaactgacctactttggactggcttatatgaagtcaaaggagttttttttcttggactctgaaacgagactgtgtaagatagcacctgagggctggagggagcagcctcagaaaacctcaatgaacaccttcacactttttctgcggatcaaattcttcgtgagccactatgggttgctgcagcattccctgaccaggcaccagttctatttgcagttgagaaaggacatacttgaggagaggctctactgcaacgaggaaatcctgttgcaattaggcgtgctggctctgcaggctgaattcggtaattacccgaaagaacaggtcgagtcaaagccctacttccacgtcgaagactatatccccgctagtctgatcgaaaggatgacagcgcttcgggtgcaggttgaagtgagcgaaatgcatagactgtcaagtgccctgtggggcgaagacgctgaactgaagtttctgagagtgacacagcaactgcccgaatacggcgtgctggtgcaccaggtcttctcagaaaaacggcgaccggaggaggagatggccttgggaatctgtgcaaagggcgtcattgtgtatgaagtgaagaacaacagccggattgctatgctgcgattccaatggcgagaaaccgggaagatatcgacctaccaaaaaaagtttactatcaccagctccgtcacgggaaagaaacatacttttgtcaccgattcagccaagacctccaagtacttgctcgatctctgtagcgcgcaacatggctttaacgctcagatggggagcgggcaaccaagccatgtcctttttgatcacgacaaattcgtccagatggcaaacttgtccccagcacatcaagctcggtctaaaccgctcatttggatacaacgcttaagctgtagcgaaaatgagctgtttgtgtctcgactacagggcgcagcaggtgggctcctctccacctcgatggataactttaatgtggatggttccaaagaggcaggggctgagggtatcggacgttctccctgtactgggagagagcagctcaagtccgcgtgcgtgatacagaagcctatgacttgggactctctgagcggccctcctgtgcagtcaatgcatgctgggtcaaaaaataacagacgcaaaagctttatcgcagagccaggaagggagattgtccgggtcactttaaagagggatccccaccggggattcggtttcgtgatcaacgagggggagtactctggccaggctgatcctggcattttcatatcttccattattcctggcggacccgctgagaaagccaagacgatcaaaccagggggtcaaatcctggcactgaaccacatttctttagaaggctttactttcaacatggccgtgagaatgatacagaactctccagacaacattgaactgatcatatcgcagagcaagggcgtagggggtaacaaccctgatgaagaaaagaattctactgcgaacagcggtgtatcctctaccgatatattgtcctttggctaccaagggtcattactgtcccacacccaggaccaggacagaaatacagaagagctggatatggccggagtacagagcttggtaccgaggttgagacatcagttaagctttctgcccttaaagggagccggttcgtcgtgtccacctagcccgccagagatatccgcaggcgaaatttactttgtcgagcttgtgaaggaagatggaacccttggtttttcagtgacaggcggaattaatacatctgttccctacggcggaatatacgtgaaatctatagtgccagggggacctgccgcaaaagagggccagatcctccagggcgatagactgttgcaggtcgacggcgtcatattgtgtggtttaactcataaacaagcagtgcaatgcttaaccggccctgggcaggtggctcgactagtgttagagcggagggtccctcggagcacccagcaatgtccaagcgcgaacgactctatgggtgacgagagaacagccgtctctctggtcacggccttgcctggcagaccgtctagctgtgtctcagtgactgacggccctaagttcgaggtgaagttaaagaaaaatgccaatggcctaggatttagctttgtacagatggagaaagagtcttgcagccatctgaaatcagacctggtacgtattaagaggctttttccaggacagcctgctgaggaaaacggcgcaatcgccgcaggcgatatcatcctcgcagtaaacggcaggtccactgagggtttgattttccaggaggtcctccacctgcttaggggtgcgcctcaggaagtgacgcttctgctctgtagaccccctcccggagccctgcccgaactcgaacaggagtggcagactccagaactgtcagccgataaagagtttacccgcgctacatgcaccgatagttgcacgtctccgattcttgaccaggaggattcttggagggactccgcttctccagacgctggagaggggctgggtctccggccagaaagctcacagaaagccatacgcgaggcccagtggggtcaaaatagagagagaccatgggcttccagtcttacccattcccccgagtcccacccccatttatgcaagcttcaccaggaacgtgatgagtcgaccctggccacctcactggaaaaggatgtccgacagaattgttacagtgtttgtgatatcatgcgcctcgggaggtactctttcagttctccactgactagattgtcaactgatatcttctag

SEQ ID NO: 223135 - DNA, 3834 bp, Artificial Sequence
  Description of Artificial Sequence: Synthetic coding sequence
atgtctttgagctcagtcacgcttgcttcagcgttacaggtgcggggtgaggcactttctgaggaagaaatctggagcttgctgttcctcgcagccgagcagctgttggaagatttacgcaacgacagcagtgattatgtcgtgtgtccttggtctgccctgctgtcagccgcaggttctctgtcctttcagggcagggtttcacacattgaagctgcaccctttaaggcccctgagctcctgcagggccagagtgaggacgaacagcctgatgcaagtcagccactccagctgtgcgaacccctgcactcaattctcctgactatgtgcgaggaccaaccacacaggcgttgtaccctgcagtcagtcctcgaggcttgccgagtccacgagaaggaagtctctgtctaccctgccccagcaggactgcatatccggagactggttggacttgtactgggcaccatcagcgaggtggagaagagggttgtcgaagagtcgtcatctgtgcagcagaacagatcctatctgctccggaagcgcctgcgaggcacctcatctgagagccccgctgcacaggctccagagtgtctacacccgtgccgtgtctctgagcgctcaaccgaaacacaatcatcgcctgagccgcactggagcacccttactcattcacactgctccctcttagtgaatcgcgctttgcccggtgctgatccccaggatcagcaggctggacgcaggttgagtagtggaagcgtgcatagcgctgctgattcaagttggcccactaccccttcccagcgaggcttcctgcaaaggagaagcaaattttcgcgaccagaatttatccttctggctggcgaagcccctatgacccttcacctacctgggtctgtggttactaagaagggaaagagttacctggctctgcgcgatctgtgtgtcgttctcttgaatgggcaacacttagaggtcaagtgtgacgtcgagagcaccgtgggggcagtgtttaatgccgtcacctctttcgctaatctggaagagctgacgtattttggtctggcatatatgaagagtaaggagttctttttcctggacagcgaaacgaggctgtgcaagatagcgcctgaagggtggcgtgagcagccccagaagacatctatgaacacctttactctgttcctgcggatcaagtttttcgtgagccactacgggctcctgcagcattcactgacaaggcaccagttttatctgcaactgagaaaggatatattagaagagcgcctgtattgtaacgaagagattttgcttcagctgggcgtattagcactccaagctgagttcggcaactatccaaaagaggtagagagtaagccttacttccacgtggaggactacattcccgcatccttgatcgaacggatgactgccctcagggtgcaggtggaggtttctgaaatgcataggctctccagtgccctatggggcgaggatgctgaactgaagtttttgcgcgtgacccagcagttaccagaatacggggtactggtgcaccaggtctttagcgaaaaacggcgaccggaggaagaaatggccctcggaatttgcgcaaaaggagtcattgtgtatgaggtgaagaataatagcagaatcgcgatgctgcgctttcagtggcgcgaaacggggaaaattagtacctaccaaaagaagttcaccatcacgtcctcggtgaccggtaagaagcatacgttcgtcactgattccgcgaagacctccaagtatcttctagatctttgttctgcccaacatggctttaatgcccagatgggctcaggacaaccgtcacacgttctgttcgatcacgacaaattcgtgcaaatggccaacttaagccctgctcaccaggctagatcgaaaccgcttatatggattcagaggcttagctgctcagagaacgaactgtttgtgagtcgtctgcaaggcgctgccggtggcttactgtcaacttccatggacaactttaatgtggacggtagcaaagaggccggagctgaaggaattgggagatcgccctgtacaggccgtgagcagctcaagtccgcttgtgttatacagaaacccatgacctgggattccctgagcgggccacccgttcagagtatgcacgcagggagcaagaacaaccgtcggaaaagcttcattgcggaacccggtagggagatcgtgagagtaacactgaagcgagatcctcaccggggatttgggttcgtgatcaatgaaggagagtatagcggccaagcagatccgggtatcttcatctcttctataattcctggagggccagcagaaaaggcgaagacaataaaacctggcggacagatcctggctttgaatcatatttctctagaagggtttacttttaacatggccgtgcggatgattcagaactccccagataacattgagctcattatctcccagagcaaaggagtggggggtaacaaccctgacgaggagaagaatagcacagcaaatagtggcgtaagctcaacagacattttgagctttgggtatcagggatctctgctaagccacacgcaggatcaggaccggaacacagaagagttggatatggccggagtccaaagcctggtgcccagactaaggcatcaactgagtttcctgcctctgaagggcgctggaagttcttgccctcccagccccccagagatctctgccggtgaaatttacttcgtagaattggtcaaggaagatggtacgctgggcttttcagtgactggaggtattaacacatccgtgccctacggtggtatttatgtgaaatccatcgtgcctggaggtcctgccgctaaagagggacagatattgcagggagaccgcctgctccaagttgatggcgtcatcttatgtggcctcacgcataagcaggctgtgcagtgtctcactgggccaggccaggttgccagactcgtcctggaaaggcgggtgccaaggtcaacacagcaatgccccagcgccaacgacagcatgggagatgaacgcacagccgtctcattggtgactgccctcccaggtaggccttcatcctgtgtctctgtgacggacggccctaaatttgaagtgaagctgaagaaaaacgctaacggcctgggattcagttttgtgcaaatggagaaggagtcctgctcacatctcaagtctgacctggttagaatcaagcgtctgtttccgggacagcctgcagaggaaaacggggcaatcgccgcaggggatatcatcctagctgtgaatggcaggagtaccgaaggcttaatcttccaagaggttctccaccttcttcgcggagctcctcaggaagtaacacttctgttatgtcgcccaccgccaggagcgttaccggagctggaacaagagtggcagactccggaactgagcgcagacaaggaatttacgagggccacttgcactgacagctgtacttcccccatcctggaccaggaggactcttggagagacagtgcctcccccgacgcgggagaagggctcggacttcggcctgaatccagccaaaaggccatcagagaagcacagtggggacagaatcgggagcgcccttgggcctcttcgctgacgcatagccccgaaagccacccccatctatgtaagctccatcaggaaagggatgaatccaccctggcgacaagcctggagaaggacgtccgccagaattgctacagcgtctgcgacataatgagacttggtcggtactccttcagctcccccctgaccaggctctctaccgacatcttttag

SEQ ID NO: 223136 - DNA, 786 bp, Artificial Sequence
  Description of Artificial Sequence: Synthetic coding sequence
atgggagatgagcgaactgctgtctctctggttacagccctaccaggcaggcccagctcgtgtgtcagcgtgactgatgggcctaagttcgaggtaaagctcaaaaagaatgcaaacggacttgggttttctttcgtgcagatggaaaaagaaagctgctctcacttgaaaagtgacctggtgcggattaaacgcctatttccaggacagcctgccgaagagaacggcgcaatcgctgctggagacataattcttgccgtaaatggcagatcgacagaaggactgatctttcaggaggtgttgcacctcctgaggggtgcgcctcaggaagtcactctgctgctgtgccgacctcctcctggcgctctccctgaactcgagcaggagtggcaaacacctgagctcagtgctgacaaagaatttactcgcgcaacatgcaccgacagctgtaccagccccattctggatcaagaggactcctggcgtgacagcgcatccccggatgcaggagaggggttggggctccgaccagagtcctcccagaaggcaatcagggaggctcagtgggggcaaaaccgagagaggccatgggcttccagtctgactcatagtcctgaatcgcacccgcatctttgcaaactgcaccaggagcgggatgagtcaacactggctaccagcctggagaaagatgtgcggcagaattgttattctgtgtgtgacattatgcgcttaggcagatacagcttttcctcccctcttacccggctgagcacagatattttctag

SEQ ID NO: 223137 - DNA, 3936 bp, Artificial Sequence
  Description of Artificial Sequence: Synthetic coding sequence
ttttcatcacataggacaaagtcttctggttggcccccaccgagtggcacgtgggggctgtctcaggtgcctccatacggatgggagatgaccgcaaacagagatggtagagactatttcataaaccacatgactcaggccataccatttgatgatccccgtttagagtcgtgtcaaatcatcccgcctgcccctcggaaggtagaaatgcggagggatcctgtattgggctttggattcgtggccggtagcgagaagcccgtggtcgtacgctcagtgactcccggagggcctagcgaagggaagcttattccgggtgaccaaatagttatgattaatgatgaaccggtctcagccgctcccagagagcgcgtgatcgacctcgtgcgcagctgcaaagagagtatccttctcactgtgatacaaccgtaccctagtccgaaatcagcctttataagtgccgctaagaaggctagactgaaatccaatccagttaaggtgagattttcggaggaggtaataatcaacggacaggtatccgagacagtgaaggataattctctgctgtttatgcctaatgtgctgaaagtttaccttgagaacggccagacgaagagcttcaggttcgactgttctaccagcatcaaagatgtgatcttgacactgcaggagaagctgagtataaagggaattgaacattttagtttgatgctggaacagagaaccgagggcgctgggactaagctcctgctgctccacgaacaggagacgctgacccaggtaactcaacgcccttcaagccacaaaatgcgctgcctgttccgtatcagtttcgtgcccaaggatcccatcgatctactgagacgcgaccctgtggcttttgagtacctgtatgtgcagagttgcaacgacgtcgtgcaggagcgtttcggaccggaactgaagtatgacatagctctcaggctggccgctttgcagatgtatatagcaacagtgaccactaaacagacacagaagatctcgctgaagtatattgaaaaagagtggggccttgagacctttttgccaagcgccgtgctccaatcgatgaaagagaaaaatataaagaaagccctatcccatctcgtgaaagcgaatcagaatttagtacctccaggtaagaagctttccgcgctgcaggccaaggtccactatttgaagttcttgtctgacctgcgactctatggaggcagagtgtttaaagctactctggttcaggccgaaaagcgttctgaggtgaccctgctggttgggcctcggtacgggattagtcacgtgattaacactaagacaaacctggtggccctcctggccgacttttctcacgtgaatcgtatcgagatgttttctgaagaggagagcctggtaagagtggagctgcatgtgttggacgttaagcccattaccctcctgatggagtcctccgacgccatgaatctcgcgtgcctgacggcaggctactaccggctgctggtggattcacggaggagcatctttaatatggcaaataaaaaaaacacagccactcaggaaactggcccagagaataagggcaagcacaacctgctgggtcccgactggaactgtatccctcaaatgacaaccttcatcggcgaaggggagcaagaggcccaaatcacatacatagacagcaagcagaagacagtggagatcaccgattcgactatgtgccctaaagagcaccgacatctgtacattgacaatgcttacagcagcgacggactgaaccagcagttatctcagcctggcgaggctccatgcgaagctgactatcggtcccttgcgcagcgttcattgttgaccctgagcggacccgagactctgaagaaggcccaggagtctcctagaggcgcaaaggtatcgtttatcttcggcgacttcgctctggacgatggcattagccccccaactctgggttatgaaaccctgctcgacgaggggccagaaatgctggagaagcaacgcaacctgtacatcgggtccgctaacgatatgaaggggctggacctcacccctgaggcagaagggatccagtttgtggagaactctgtgtatgctaacatcggtgacgtaaagagtttccaggcagccgaggggattgaagagcccctgctgcacgacatttgttacgccgagaatacagacgatgctgaggacgaggacgaggtgtcatgcgaggaggacctggtagtgggcgagatgaatcagccggctatcctgaatctttccggctcatccgacgacattattgatttgacttccctcccccctccagaaggagacgataacgaagacgacttcctactgaggagtctgaacatggcaatcgctgccccaccacccggatttcgcgacagctccgatgaggaggactctcagtcccaggccgctagttttccggaggataaggagaaaggatcgagccttcagaatgatgaaatcccagtgtccctgatcgacgccgtgcccacctccgcggaagggaaatgcgagaagggcttagataacgcagtggtcagcaccctcggggctttagaagctctcagcgtgagtgaggaacagcagacaagtgataactctggagttgcaatcctgcgagcgtactcccccgaaagtagttctgatagcggtaatgaaactaattcttccgaaatgaccgagtccagcgaacttgccaccgcccagaaacagagcgagaacctctccaggatgttcctcgccactcacgaggggtaccacccattagccgaagaacagacagagttcccggcatctaaaacccccgcagggggattgccccctaagagcagtcatgctcttgccgctcgaccagctacggatctcccaccaaaggtggtcccatctaaacagctgctccattctgatcacatggaaatggagcctgaaaccatggagactaagtccgtgaccgattattttagcaagctgcacatgggtagtgtggcatattcatgcaccagcaagaggaagagtaaactcgctgatggtgaaggcaaggcacccccaaatggcaacacaaccggaaaaaaacagcagggaaccaaaacggcagaaatggaggaggaagcaagcggaaaatttggaacagtgtcgagtcgagatagccagcacctgagtaccttcaacttggagcgtaccgccttccggaaggacagtcagcggtggtatgtggcaacggaagggggaatggccgagaagagcgggctcgaggcggcaaccgggaagacctttccaagggcctcaggtctgggagcacgggaagccgaggggaaggaggagggggcaccagacggtgagacaagcgatggcagtggactcggtcagggcgatcggtttctgaccgacgtgacttgtgcttctagcgccaaggacttggacaatcccgaagatgcagattcttctacctgcgaccatccctctaaactgccggaggccgacgagtctgtggctcgcctgtgcgattatcatctggctaagaggatgagttcactgcagtccgagggacacttttccctgcaatcctctcaggggagttcagtggacgctgggtgcggtacaggaagcagtggctcggcatgcgccactccagtcgagagtcctttgtgtcccagcctagggaagcacctcatccccgacgccagcgggaaaggagtgaactacattccgagcgaggagagggcacccggactgcctaaccatggggctacatttaaagagctgcacccacagacggagggaatgtgtcctcgtatgacggtccctgcgctccacacggccatcaataccgagcccttatttggcacacttagagatgggtgccaccggctgcctaaaattaaagagaccacagtgtag

SEQ ID NO: 223138 - DNA, 3969 bp, Artificial Sequence
  Description of Artificial Sequence: Synthetic coding sequence
atggacgtgtttagtttcgtcaaaatagctaagctgtctagccacagaacgaagtcatccggctggcctcccccaagtggaacttgggggctgagccaggtgccaccttacggttgggaaatgacagcgaaccgtgatggccgtgactacttcatcaaccatatgactcaggctatcccttttgatgatccacggctggaatcgtgtcagattattccgcctgcccctcgtaaagtggaaatgaggcgagatcccgtcctcggcttcggtttcgtggctggctctgaaaaaccagtggtggtcaggagcgtgactcctggagggccttctgagggtaagctcattcccggagaccaaattgtaatgatcaacgatgagccagtgagtgcagcacccagggagcgcgttattgatctggttagatcatgtaaagaatcaatcctcttgacagtgatacaaccctatcctagcccgaaatcggcattcatttcggccgctaaaaaggctaggctcaaatcaaaccctgtcaaggttaggttttccgaggaggttatcatcaacggtcaggtcagcgaaacagtgaaggataactctctcctgttcatgccaaacgttcttaaggtctatctagaaaacgggcagaccaagtcctttaggtttgattgtagcaccagtatcaaagacgttattctcaccctgcaggagaaactgtccatcaagggaattgagcatttttcactgatgctagagcaacggaccgagggtgccggaactaagcttttacttttacacgaacaggagacactaactcaggtgacccagcgaccaagctctcataaaatgaggtgccttttccggatcagcttcgtcccaaaagatcctatcgacctgctgaggagggatcccgtggccttcgaatacctttacgttcagtcttgcaatgacgtcgtgcaggagaggttcggccctgagctcaagtacgacattgccctgcggctcgccgcactccaaatgtatattgccacggtcacaaccaagcaaactcaaaagatctccctgaaatacatcgagaaagagtggggacttgagacgtttcttcccagcgcggtgctgcagtccatgaaagagaaaaacatcaagaaggccctgtctcatcttgtgaaagcaaaccaaaaccttgtgcccccagggaagaaattatctgctttgcaggcaaaagttcactatttaaagtttttgagtgacctgcgcctatacggagggagggtgttcaaggccacactcgtacaggcagagaagcgctctgaggtaaccctcctcgtcggacctcgctatggaatttcccatgtgatcaataccaagacaaatttagtcgcactcctggccgacttttcccatgtgaacagaatcgagatgttcagcgaggaggaatccttggtccgtgtggagctgcacgtattagacgttaaacctatcaccctgctgatggagtcatcagatgcgatgaacctggcatgcctgacagcaggctactatagactgctagtcgatagccgcagatccatctttaatatggctaacaaaaaaaatactgctacacaggaaacaggacccgagaacaagggaaaacacaatctgctaggccctgattggaattgtatcccacagatgaccacctttattggggaaggagagcaggaggcacaaatcacatacatcgactctaagcaaaagacagttgaaataactgacagcaccatgtgcccaaaggagcatagacacttatacattgataatgcatattcctctgacgggttgaatcagcagctctcccagccaggtgaagccccatgtgaggccgactatagaagcctagcacagaggtccctcctaaccctatctggtcctgagactctgaaaaaggcccaggaaagtcctcgcggagccaaggtgagctttatattcggcgattttgctttggacgatggcatttccccacccacattggggtatgaaactctcttagacgagggtcctgaaatgctagaaaagcaaagaaatctatatatcggtagtgccaatgacatgaaagggttagacctgactcccgaggccgagggcatccagtttgtggagaatagtgtgtatgcaaacatcggtgacgttaagagttttcaggctgctgaaggaatcgaagaacctctactacatgatatctgctacgcagagaatacagacgatgcggaggatgaggacgaagtgtcttgcgaggaggacctggtcgtgggcgaaatgaatcagccagcaatacttaatttatctggctcctccgacgacatcatcgacctgacatcccttccaccacccgagggcgatgacaatgaggatgatttcctcctgaggagtctcaacatggccatcgcggcacctcctcccggatttagagacagcagcgatgaggaagacagtcaatcccaggctgctagcttcccagaggataaggagaagggctcatccctacagaacgacgagatacctgtgagcctgattgacgctgttccgacgtccgctgaagggaaatgcgagaaggggctggacaatgccgtagtgtctacactgggagcacttgaggccttaagcgttagtgaggagcagcagacctccgacaattccggcgtggccatcctgcgggcttattccccagagtctagctccgatagtggcaacgaaacaaactcttcagaaatgactgaatcaagtgaacttgcaacagcccaaaaacagtcagaaaacctgtctcgcatgtttcttgccacacacgagggttatcatcctctggcggaagagcagacagaatttcctgccagcaaaacaccagctggaggacttccaccgaagagcagtcacgccctcgccgcaaggcccgctactgacctaccgcctaaagtggtgccgtctaagcagctgctgcactccgaccacatggagatggaacctgaaacgatggagaccaaatccgtcactgactacttctctaaattgcatatggggtcagttgcttattcctgtacaagcaaacgcaagagcaagctcgccgacggcgaagggaaggcgcctccaaatgggaatacaactggaaaaaaacaacagggtacgaaaactgcagagatggaggaagaggccagcggcaagttcggcacagtcagtagcagggacagtcaacacctgagcacatttaatctggagcgtactgctttccgcaaagactcccaaagatggtatgtggccacggaggggggaatggctgaaaaatccggcttagaagccgctactggtaaaaccttccctagggcttcaggcctgggcgctcgggaggccgaagggaaagaagagggcgctccagacggagagacctccgatgggagcggattaggccagggcgacaggtttctgacggacgtcacctgtgcaagttccgctaaggatttggacaacccggaggatgcggacagctccacttgcgaccatcccagcaagttacccgaggccgatgagtctgttgccagattatgtgactatcaccttgcgaagcggatgagcagcctccagagtgaaggccacttctcactccaaagcagtcaaggctcctctgtggatgcaggctgcggcacaggctcatcaggcagcgcgtgtgctaccccagtggagagcccactgtgcccttctctgggaaagcatctgatccctgatgcctcaggaaaaggagttaattacatcccatcagaggaaagagctccaggcctaccaaaccacggggcaaccttcaaggaactgcatccccaaacggagggaatgtgccctaggatgaccgtgccggctcttcacaccgctattaatactgaacctctgtttggaactctcagagacggctgccaccgcctaccaaagatcaaagagacgactgtctag

SEQ ID NO: 223139 - DNA, 3942 bp, Artificial Sequence
  Description of Artificial Sequence: Synthetic coding sequence
aagtctcacagcccacaccggacaaagagttctggatggccccctccatctggaacctggggattgagccaggtccctccatacggttgggagatgacagccaatagagatggcagagattactttatcaaccacatgactcaggccatccccttcgacgaccccaggctggagagttgtcaaataatacctccggctccgagaaaggttgaaatgaggcgagaccctgtactcgggtttggttttgttgcaggctccgagaagcccgtggtggtcagatccgtgaccccgggaggcccatccgagggaaagttaatccccggtgaccagattgttatgatcaatgacgaaccagtgtcggctgctccacgggagagggtaatcgatctagtaaggagctgcaaagagtcaatcttgctgaccgtcatccagccatatcccagccccaagtcagcctttattagcgctgctaagaaggcaagactaaagtccaaccctgtaaaggttagatttagtgaggaagtgatcatcaatggccaggtgagtgagacggtgaaggacaattccctgctgtttatgccaaacgttctcaaagtttatctggaaaacggtcaaactaagagttttcggtttgactgcagtacttcaatcaaagacgtcatcctcaccttacaagagaagctgtcaatcaaggggatagagcacttctccctgatgttggaacagaggacagaaggcgctggcaccaagctcctgcttctccatgaacaagagactttgacccaagttacccagagaccttcttctcacaaaatgcgctgtctgtttcgaatttccttcgtaccaaaagaccccatcgacctgcttcgcagggaccccgtggccttcgagtacttatatgtccagagttgtaatgatgttgtccaggaaaggttcggacccgagctgaagtacgatatcgccctgcgcttagccgcacttcagatgtacatcgcaaccgtcactacgaagcagacccaaaagattagcctgaaatacatcgagaaggaatgggggcttgagacatttctgccctctgctgtgttacagtcaatgaaagagaaaaatatcaagaaggccctgtcccacttagtaaaagccaatcagaacttggtacctcccggaaagaagctgagcgctctgcaagcaaaggtgcactatttgaaattcctttcagacctccgtctgtatggcggtagggtctttaaggctacactcgtgcaggccgaaaagcgaagtgaagtaacactgctcgtgggtccacgctatggaataagtcacgtgatcaataccaagaccaatctggtggccctgctggctgatttctcgcatgtaaaccgaattgagatgttcagtgaagaggagagtctggtgagggtggagttgcacgtcctggacgtgaaaccaattactctgttgatggagagcagtgatgccatgaacctggcgtgcctaaccgcaggctactataggctcctggttgacagcagacgcagtatattcaacatggcaaacaagaagaacactgccacccaggagaccggacctgagaataagggaaagcacaatctgctcggtccagactggaactgcatacctcaaatgactacatttatcggcgagggcgagcaggaggctcaaatcacttacattgactcaaaacagaagacggtggagatcactgactcaacaatgtgccctaaagagcataggcatctgtacatcgataacgcttatagctccgacggccttaaccaacaactctcccagcctggcgaggcaccctgcgaagccgactaccggagcttggcccagcggagcctcttgacactcagcggtcccgagacgttgaagaaggcccaggagagtccacggggagccaaggtgagctttatttttggagatttcgccctggatgatggtattagccctccaactctgggctacgagactcttctggacgaggggcctgagatgctggagaagcaaaggaatctgtacatagggtctgctaatgatatgaagggccttgacctaacccccgaggcagaaggcattcagttcgttgaaaatagcgtctatgctaacattggagatgtgaaatcgttccaggccgctgaaggaattgaggaacccctgctgcacgatatttgttacgctgagaatactgacgatgccgaagacgaagatgaggtgtcatgcgaagaagatctagtggtgggcgagatgaatcaacctgccattctgaacttgtccggttcttctgatgacattatcgatctcaccagcctgcctcccccagaaggtgatgacaacgaagacgattttcttttgaggtcactgaacatggccatcgccgcaccgcctcctgggttccgggatagttctgatgaagaagatagtcaaagtcaggccgcttcattcccggaagataaagagaagggcagtagcctgcagaatgacgagattccagtcagcctgattgatgccgttcctacgtcagccgaggggaaatgcgaaaagggcctggataatgcagtcgttagtaccttgggcgcactcgaagctctgagtgtttctgaggagcagcaaacttccgacaattccggggtggctattctgagagcctattcacccgagtcttctagcgacagtggtaatgagaccaacagttctgaaatgacggagagcagtgagctagccacagcgcagaaacaaagcgagaatcttagtaggatgttcctggcaacgcacgaaggttaccatccgctcgctgaggagcagaccgagtttcccgcttcaaaaacccctgcagggggactgccgcctaagtcttcccacgcactcgccgcaagacccgctaccgacctgcccccaaaggtggtgccatctaaacagctgttgcattccgatcatatggaaatggaacccgaaacaatggaaacgaaaagtgtcacggactattttagcaagctccacatggggagcgttgcatacagctgcaccagtaagcgcaaaagtaagctcgcagatggcgaaggtaaagccccacctaatggcaacactaccggcaaaaagcagcagggaactaagactgctgagatggaggaagaagccagtggcaaattcgggacggtaagctcgagagactctcaacacctgtcaacatttaatctggagcgcactgctttccgaaaggacagtcagagatggtatgtggcaaccgagggagggatggcggaaaaaagcggattggaagccgctaccgggaagaccttcccacgagcatccggcttgggcgctcgtgaagccgagggtaaagaggaaggcgcacccgatggcgagacctctgatggatccggacttggacagggcgatcgctttttaacagatgtgacttgtgccagttccgccaaggacttagacaatcccgaagacgcagactcctccacctgtgaccatcccagcaaattgccagaggctgacgagtccgtggcaaggctgtgcgattatcacttagctaaaagaatgagcagtctgcagagcgagggacacttctcgttgcaaagctcacaaggtagttctgtggatgctgggtgtgggacagggtcttccggttcggcatgcgcgacacccgtcgagtcaccattgtgtcctagtctgggaaaacacctcatccccgatgcttcaggcaaaggcgtaaactatatccccagcgaggaaagggcacccggactgcctaatcacggcgctaccttcaaagaattacaccctcaaaccgaaggcatgtgtcctagaatgaccgtgcccgcactgcataccgcaattaacacagaacctctcttcggtaccctacgagacggctgccaccgccttccaaagattaaggagacaactggttag

SEQ ID NO: 223140 - DNA, 1794 bp, Artificial Sequence
  Description of Artificial Sequence: Synthetic coding sequence
atgtttgcctcatgccactgtgtccccagagggagaaggactatgaaaatgatccacttccggtcttcatctgtgaaatcgctgtcccaggagatgcgatgtactatccgcctgttggatgactcggaaatttcatgtcatattcaacgcgagacaaagggccagtttctgattgatcacatttgcaactactactccctgctcgaaaaagattacttcggtatccgctacgtggaccctgagaaacagcgccattggctggagcctaacaaaagcatctttaaacagatgaaaacccaccccccttatactatgtgttttagagtaaaattctatccacatgaaccactcaaaattaaagaagagttaacacggtatctgctctatctgcagatcaaaagagacatttttcacgggagacttctgtgcagtttttccgacgctgcttacctgggagcctgcatcgttcaggcagaattgggagactatgaccctgatgaacaccctgagaattacatcagtgagttcgagatcttccccaaacagtcccagaagctcgagaggaaaattgtggaaatccataaaaacgagctgcgtggccagagccctccagtagccgagtttaacctccttctcaaggcccacacactggagacctacggtgtcgacccccacccatgtaaggatagtactggtacaacaaccttcctaggcttcacagccgctggttttgtggttttccagggaaacaaacggatccatctgattaagtggcccgacgtgtgcaagctgaaattcgaaggcaaaacattctatgttatcggtacgcagaaggagaaaaaggccatgctggcgtttcacacctccacaccagccgcttgcaagcatctttggaagtgtggcgtggagaatcaggctttttacaaatacgcgaagtcttcacagattaaaactgtgtcaagttctaagatctttttcaaaggttccagatttaggtacagtggcaaagtagcaaaggaggtggtcgaagcttcgtctaagatacagagggagccaccagaggtgcacagggccaatatcacccagtctcgaagctcacatagtcttaacaaacagctgattataaacatggaaccgctccagcctctgctgcccagcccatctgagcaggaagaggaactgccgctgggggaaggggtgcccctgcccaaggaggaaaatattagcgctcctctgatcagcagctcccctgtcaaggccgctagagagtacgaagaccccccaagtgaagaggaggataagattaaggaggaacctcttaccatttccgaactcgtgtacaaccccagcgccagcctactgcccacaccggtggacgatgatgaaatcgacatgctgtttgattgcccctcgaggcttgaattggagagggaggacaccgattccttcgaggacctggaagccgacgagaacgcgttcttgatcgccgaggaggaggagctgaaggaggctcgacgtgccttaagctggtcctatgacattcttactggtcatatacgcgtgaatcctctggtgaagtctttttctcggctgctcgttgtggggctgggcctgctgctttttgttttccccctgctgctactgttgttggaatctggtattgaccttagttttctttgcgaaattaggcaaacacctgagtttgagcagtttcattatgagtactactgccccctgaaggagtgggtggcgggaaaggtgcacctgattctctacatgcttggatgtagttag

SEQ ID NO: 223141 - DNA, 642 bp, Artificial Sequence
  Description of Artificial Sequence: Synthetic coding sequence
atgcaggccgaggagacaaaaggaattggaattacatcaatggccaagtgtttggttaagattcagactcgacgatctctccaattacacatggtaaatcattgtaatagcaacgttttcgtgcgcctcctgaggctggggagcaaggtgactgccagaaacactggcgttccgctccctaaggaagaaaacatttctgcaccattaatctcgtcgagtccagtcaaggcggctcgcgagtatgaagacccaccgagtgaagaagaagataaaataaaggaagagcccctaaccatatctgagctggtgtacaacccttcggccagtctccttcccactccagtggacgacgatgaaattgacatgctgttcgattgccctagccggttggagcttgagcgtgaggacactgattctttcgaagacctggaagcggacgaaaatgctttccttattgcggaggaggaagagctgaaagaagccaggagggctctgagctggagttatgacatactgacgggacatatccgtgtaaacccgttggtgaagtcattcagccgactcctcgttgtaggtctcgggcttctactgttcgtgtttccgctgctgctactcctcctcgaatcggtttctatgcagtag

SEQ ID NO: 223142 - DNA, 804 bp, Artificial Sequence
  Description of Artificial Sequence: Synthetic coding sequence
atgtgcttcagagttaagttctacccccacgagccgctgaagatcaaggaagagctgacacgatatctgctttacctccaaatcaaaagagacatatttcacggcaggctcctgtgtagcttttcagatgcagcatatctgggcgcatgtattgtgcaggctgagctgggggattacgacccagatgagcaccccgaaaattacatcagcgagtttgaaatatttcccaagcagtcccagaaactggagcgcaaaattgtggaaatacataagaacgaactccgaggccagtcccctccagtggctgagtttaatctactcctgaaggcccatactttggaaacatatggagtggaccctcacccatgcaaggatagtacaggcaccacaacgtttcttggctttactgccgctggtttcgtggtcttccaggggaataagcgtattcatcttataaaatggcctgatgtctgtaagttgaaatttgaaggcaagactttttacgtgatcggtacccaaaaagaaaagaaagcaatgctggcctttcatacttcaactcctgccgcttgtaaacatctctggaaatgtggtgtggaaaaccaggccttctacaagtacgccaaaagttcccagataaaaaccgtttccagtagcaagatcttttttaagggttctcggttcaggtactcagggaaagtggcaaaagaagtggtggaggccagcagcaaaattcagagagagccaccagaggtccaccgatgcgttcaaaagaagatctgttcatgtttcggcgtcacatggtag

SEQ ID NO: 223143 - DNA, 1089 bp, Artificial Sequence
  Description of Artificial Sequence: Synthetic coding sequence
atggtttttaggcgaggacagtccccacctgttgctgagttcaatctgcttctcaaggcccacacccttgagacttacggcgtcgacccccacccctgcaaggatagcaccggaacgacaactttcctcggctttaccgccgcaggattcgtggtctttcagggcaataaacgcatccacctgatcaagtggccagacgtctgcaaactgaagttcgaaggaaagaccttctacgtcatcggcacccaaaaagagaagaaagccatgcttgcttttcacactagcactcctgcagcatgtaagcatctgtggaagtgcggcgttgaaaaccaggctttctacaaatacgctaaatcttcccaaatcaagactgtgagctcatctaaaatttttttcaaagggtcccgatttcgatatagtggcaaagtggccaaagaggtggtcgaagcaagctcaaagatccagagagaaccccctgaggtgcatcgcgctaacattacccagagtcgttcctcacacagtttaaacaaacaactgatcatcaacatggagccgctgcagcccttactcccgtcccctagcgagcaggaagaggagctgcctctgggcgaaggtgtgccactgcccaaagaagaaaatatctctgctcccctcatttcctcttcccccgtgaaagcagctagagagtatgaagaccccccaagtgaagaggaggataaaatcaaggaggagccgcttactatctccgagctggtgtacaacccgtcagcttcccttttacccactcctgtggacgatgacgaaattgacatgctatttgactgtcctagtcggctggaactggagcgcgaagatactgattcattcgaggaccttgaagctgacgagaacgcattcttaattgctgaggaagaagaacttaaggaggccagaagggccctttcctggtcatatgacatcctgaccgggcatattcgggtgaatcccctcgtcaaaagctttagtagactccttgtagtagggctggggttgctgctgtttgtgttccctcttctcctgttgctgttggaatcagtctcgatgcaatag

SEQ ID NO: 223144 - DNA, 1671 bp, Artificial Sequence
  Description of Artificial Sequence: Synthetic coding sequence
atgttcgcttcctgtcactgcgtcccacgtgggcgtcggaccatgaagatgatccacttcagatctagctccgtcaagagcctttcccaggagatgcggtgcactatcagactgcttgatgactcggagatctcttgccatatccagcgtgagacaaaaggtcagttcctgatcgatcatatctgcaactattattctctactggagaaggattacttcggcattaggtatgtggatcccgaaaaacagaggcactggttagaacccaataaatctatcttcaaacagatgaaaacacatcccccttatacgatgtgcttcagggtgaagttctaccctcatgagccattgaagatcaaggaagagctgacccgttacttactgtacctccagataaagagagatattttccacggacggctgctgtgtagctttagtgatgcggcttatctcggggcttgtatcgtgcaggccgaattgggcgactatgacccagacgagcaccctgaaaattacatctcagagttcgaaatcttcccaaagcaaagccaaaagctagagcgaaagattgtagaaattcataagaacgagctgcggggtcagtccccaccagtggcagagttcaaccttcttctgaaagcacacacactagaaacatacggggtggacccacacccctgtaaagacagcactggcacgactacatttctcggattcaccgcagcagggtttgtcgtcttccaggggaataaacggatccatctgattaaatggcccgatgtgtgcaagctgaagtttgagggtaaaaccttttatgtgattggcacacagaaagagaagaaggcgatgctagcttttcacacgagcactccagctgcctgcaaacacctctggaaatgtggggttgagaatcaagctttttataaatatgctaaaagtagtcaaatcaagaccgtgtctagctcaaagatcttcttcaagggatcgagattccggtattcagggaaagttgccaaagaggttgtggaggccagcagtaagattcagcgtgagccccctgaagtccaccgagcaaatataacccagtcaaggtcctcacattcgctgaataagcaattgatcatcaacatggagcctctgcagccattgctgccgtccccctcagagcaggaggaggaactacccttaggagaaggtgtgcctctgcctaaggaagaaaacatcagcgcaccattgatctctagctcaccagtgaaggctgcacgagagtatgaagaccctccctcagaagaggaggacaagattaaagaagaacctcttacaatcagcgaactcgtgtataacccttcagcctccttgttacccacccccgtagatgacgacgagattgacatgctgttcgactgcccaagcagactcgaattggagagggaggacaccgactccttcgaggacctggaggcggatgaaaacgccttcctgattgccgaggaagaggaactgaaggaggccaggcgtgctctttcgtggtcgtatgacattttgacaggacatatcagagttaacccactagtgaaatccttcagcaggcttctggttgtcgggctcgggctgctcctgtttgtctttcccttacttctgttattactggagagcgtgtcaatgcagtag

SEQ ID NO: 223145 - DNA, 423 bp, Artificial Sequence
  Description of Artificial Sequence: Synthetic coding sequence
ggcactactacatttttaggcttcaccgccgcaggttttgtggtctttcaggggaataaaagaatacatctgattaagtggccggatgtctgcaaactgaagttcgaagggaaaacattttacgtcatcggtactcaaaaagagaaaaaggcgatgctggcctttcacaccagcacccctgcagcatgtaagcacttatggaagtgcggagttgagaatcaagcattctataaatatgcaaaatcttctcaaataaaaaccgtgtcctctagtaagatatttttcaaaggctctcgatttaggtacagcggtaaagtcgccaaagaagtggtcgaggcatcatcaaaaatacaaagggaacccccagaggtccaccgatgcgtacaaaagaagatctgctcatgtttcggggtgacatggtag

SEQ ID NO: 223146 - DNA, 2145 bp, Artificial Sequence
  Description of Artificial Sequence: Synthetic coding sequence
atgctccatctgaaggtccaattcctcgatgacagccagaaaatctttgttgtcgatcagaagagcagtggcaaagcgctcttcaacctgagctgtagccaccttaatctggctgagaaagaatacttcggactagagttctgcagccatagcggaaacaatgtgtggttggagttgctgaagccaatcacaaaacaggtcaagaatcccaaggagattgtgttcaagttcatggtgaaatttttccctgtggaccccggacaccttcgagaagaactgactcgctacctgttcaccctgcagattaagaaagacctggcgctgggcaggctgccttgtagcgataattgtaccgccctcatggtgtctcacattttacagtccgaactgggtgatttccacgaggagaccgaccggaaacatctggctcagactcgttacctacctaatcaggattgcctggaggggaagattatgcactttcatcagaagcatattggaaggtcccctgctgagagcgatatactgttgttagacatcgcgagaaagttggatatgtatggcatcaggccacaccccgcatccgatggcgaaggcatgcaaattcatctggcagtggcacatatgggagtgctggtgctcagagggaatacaaaaattaacacctttaactgggctaagattcggaagctgtcatttaaaaggaagcactttctgattaagcttcatgctaacattctggtgctgtgcaaagataccctagaattcacaatggccagccgagacgcctgtaaggctttctggaagacgtgtgtggaataccacgccttctttagactgagtgaggagccgaagtctaagcctaagaccttgctgtgcagtaaggggagttcctttcgatattccgggcgaacacaacggcaactgttggaatacggcagaaagggtaggctcaagagtctgccatttgaacggaaacattatccttcccagtatcatgagcggcagtgtcgtagcagcccagaccttctgtccgacgtgagtaagcaggtggaggaccttcgtctggcttacggagggggatattatcaaaatgtaaatggcgtccatgctagcgaacctgtgctggaaagtcggaggagaaattctgcccttgaggtgactttcgccacagagttagaacactccaagcccgaggcagatccgacgttattgcaccaatcacagtctagctcaagctttccgttcatttatatggacccagtattcaacaccgaacccaatcctaatccggaccctagagatatcttttcagagcgctctagcctgtccagcttccagaccagctgtaagttctcagggaaccatatgtccatttactctggccttaccagcaaggtgcggccagctaaacaacttacatacaccgatgtgccctatatcccctgcacaggacaacaagttggcatcatgcccccacaggtgttcttctacgtcgataagcccccacaagtgccacgctggtcgccaattagagcagaggaacgaacctcaccacactcttacgtggaacccaccgctatgaaacccgctgagcgcagccccagaaacattcgaatgaaatcatttcagcaagatctccaggttctgcaagaggccattgcaagaaccagtggccgatcaaatattaacgtcgggcttgaggaagaggatcccaatttagaggacgccttcgtgtgtaacatccaggagcaaacccctaagaggtcacaaagtcaatcagatatgaagaccatccgattccctttcggctctgagtttagaccacttggaccctgtcccgcactctcacataaggcagacttgttcaccgacatgttcgctgaacaggagctgcctgccgttctcatggatcagtctaccgctgagcggtacgtcgccagtgagtccagcgattcagagtcagagattctgaaacctgattactacgccctctacggtaaggaaatcagaagcccgatggccaggatccgactttcatcgggatccctccagttggatgaagaagacgaggatgcatactttaatacccctacagccgaggatcgcaccagtttgaaaccctgcaattacttcttagcttag

SEQ ID NO: 223147 - DNA, 1785 bp, Artificial Sequence
  Description of Artificial Sequence: Synthetic coding sequence
atggtgtctcatattctccagtcagagctaggggattttcacgaagagactgacaggaagcacttggcacaaaccaggtacctgccaaaccaggactgccttgagggaaaaatcatgcacttccatcagaaacacattggtaggagtcctgctgagtccgatatcctgctgttggacatagcccgtaaacttgacatgtatgggatccgtccccacccggcttccgacggggagggtatgcaaatacacttggcagtggcacatatgggagtgctggtgcttcgcggtaataccaaaataaatactttcaattgggcgaaaatccggaagctgtcattcaaacggaagcactttttgattaagcttcacgctaatatcctcgttctgtgtaaggacaccctggaatttaccatggcctcccgagacgcctgcaaggccttctggaaaacctgcgtcgaataccacgccttttttcgcctctctgaagagccaaaatccaaaccaaaaactcttctgtgtagtaagggatcctcctttagatattcaggcaggactcaaaggcagttgctagaatacggacgcaaaggtcgcctaaagagtctgcctttcgaacggaaacattacccttcccagtaccacgagcggcagtgtcggtcgtcccctgacctcttgagcgatgtgagtaagcaagtggaggacctgcgcctggcctacgggggtggctattatcagaacgtaaacggggtccacgctagcgagcctgttttggagagtagacgaagaaattccgcactggaagttacattcgcaaccgaattagagcacagtaaaccagaggccgatcccactctgctgcatcagtctcagtctagttcttcatttccgttcatctacatggaccccgtgttcaacacagaaccaaatccgaatcccgacccccgtgatatctttagtgagaggtccagcttgagttccttccaaacgagctgcaaatttagcggcaatcacatgagcatatatagtggcctaacctccaaggtacgcccagcaaagcagctcacttataccgacgttccctacattccttgtaccggccaacaagtcggtataatgccacctcaggtatttttctacgtggacaaaccccctcaagtacctcgatggtctcccatccgcgcagaggaacggactagtcctcactcttacgtggagcccactgccatgaagccagccgagcgaagcccacgcaacattaggatgaagtccttccagcaggatctgcaggttttacaggaggcgattgcgaggacttcgggtcggagtaacattaacgtcggacttgaggaggaagatccaaatctggaagatgctttcgtttgcaatattcaagagcagacacccaagaggtctcagtctcagtctgacatgaagactattaggttcccattcggatccgaatttcgccctctgggaccctgcccagccctgtcccataaagcagacctcttcactgatatgttcgccgaacaggaactgccggctgtgctgatggaccagagtaccgcagaacgttacgtggccagcgagtctagcgactctgaatcagagatcctaaaaccagactactatgccttgtatgggaaggaaatacgatccccaatggcccgtattcggctgtcaagtggatctctgcagttggacgaggaggacgaggatgcctatttcaacacaccaacagccgaggatagaacctctcttaagccctgcaactatttcttggcctag

SEQ ID NO: 223148 - DNA, 2043 bp, Artificial Sequence
  Description of Artificial Sequence: Synthetic coding sequence
atggccctcgatggaatacgaatgcctgacgggtgttacgccgatgggacctgggagttatctgtccacgtcaccgatctcaacagagacgtaaccctacgggtcacaggagaggtgcatatcgggggtgtcatgctcaagttggtggaaaagctggacgtgaagaaagactggtccgaccatgccctgtggtgggagaaaaagcgtacctggctgctgaagacacattggactctggacaagtatggcattcaggccgatgcaaaactgcagttcacccctcaacacaaactcctgcgacttcagctacctaacatgaaatatgtcaaggttaaagtaaatttttctgacagggtgtttaaagccgtgtctgacatttgcaaaacttttaacataaggcatcctgaggagctatccttacttaaaaaacctagggatccaacgaagaagaaaaaaaaaaaactcgacgatcagagcgaggacgaagcgctggagttggagggccctttgatcactcctggaagtgggtctatttactcttcacctggtctctactctaagaccatgacaccgacctacgacgcacatgacgggtcaccactgtcccctacgagtgcctggttcggggacagcgccctaagcgaaggaaaccctggcatcctggcggtctcccaaccaataacctctcccgaaattctcgccaaaatgttcaagcctcaagctctcctcgacaaagccaagattaatcagggatggctcgactctagcaggagcttaatggagcaggatgttaaagagaacgaggctctgcttcttaggtttaagtattatagcttttttgatctaaatccgaagtatgacgccatccgcatcaatcagctgtacgaacaggcaaagtgggccatcctgcttgaagagattgagtgtacggaggaggaaatgatgatgttcgctgcccttcagtaccatattaacaagctctcaataatgacatctgaaaaccacctcaacaatagcgacaaagaagtggatgaggtggatgctgcccttagcgatcttgagatcaccctcgaaggcggaaagacttccacaattctcggcgatattacctctattccggagctcgctgactatatcaaggtgttcaaaccaaaaaagctgacactcaaaggctataaacaatattggtgtaccttcaaggatacctcaatctcatgctacaaatctaaggaggagtccagtggcacccctgcccatcagatgaatctgcgtggctgcgaagtcacccccgacgtgaacattagtggtcagaagtttaacatcaaacttctcatcccggtggctgaaggaatgaacgagatttggctgcgttgcgacaatgagaagcaatacgctcattggatggcagcctgcagactcgcttcaaaagggaagactatggctgattccagctacaacctggaggtgcagaacatcctgagttttctgaagatgcaacatctgaacccggatccccaattgatacccgagcaaataaccactgatatcacaccagagtgtctcgtcagccccagatatcttaagaagtacaagaataagcagatcacagctcgcatccttgaagcccaccagaatgtagcccagatgtctctgatcgaagcgaagatgcgatttatccaggcctggcagagcctgccggagtttggaataacgcatttcattgcgcgttttcagggaggcaagaaggaagaacttatcgggatcgcctataacaggctgatcaggatggacgcctctacaggggacgcaataaagacttggaggttcagcaacatgaagcagtggaatgtcaactgggagatcaagatggtaactgtagagttcgccgacgaagttagactgtcctttatttgcacggaagtcgattgtaaggtggtgcatgagttcataggagggtacatctttcttagtaccagggcaaaggatcagaatgagtctctggacgaggagatgttttacaagctgactagcggctgggtctag

SEQ ID NO: 223149 - DNA, 2064 bp, Artificial Sequence
  Description of Artificial Sequence: Synthetic coding sequence
atggcccttgacggcattagaatgcccgatggctgttatgctgacggcacctgggagctatctgtgcacgtgacggaccttaatcgcgatgttaccctcagagttacaggggaggtccacatcgggggtgtgatgctcaaactcgtggagaagctggatgtgaaaaaagattggtcagaccatgccctctggtgggagaagaagcgcacttggctgctgaagacccattggaccctggacaaatacggtatccaagccgacgcaaagctccagttcacaccccagcataagctgctacgccttcaactgcctaacatgaaatacgtgaaagttaaagtgaacttctccgaccgggtgtttaaagccgtgtctgacatatgtaagactttcaatatccgtcatcccgaggaattgtccctgctgaagaagccgagggacccaactaagaagaaaaaaaagaagctggacgaccagtctgaggacgaagctctggagttggagggcccattaatcactcccggttccggcagcatctactcctctccaggcttgtattcaaaaaccatgacacccacctacgatgctcatgatggcagtccactttcccctacttctgcttggttcggtgactcagccctaagtgagggcaatcccggaattctcgctgtgtctcagcctataactagcccagaaattctggcgaaaatgtttaagccccaggccctgttagacaaggcaaagattaaccagggctggttagactctagccgctctcttatggagcaagacgtgaaggagaacgaggctctacttctgcgattcaaatattactcattcttcgatttaaacccaaagtacgacgcgatcagaatcaaccagctgtatgaacaggctaaatgggccattctgctagaggaaatcgagtgcacagaggaggagatgatgatgtttgcagctctacaataccatatcaacaaactgagcatcatgacctccgaaaatcacctgaataattcggataaggaggttgacgaagtggatgccgctttaagtgaccttgagattactctggaggggggaaagacctccacaattttaggggatattacgtccatccccgaactggccgactacatcaaagtcttcaagccgaagaaactgacactgaagggttacaaacaatattggtgtactttcaaggacacctctatcagctgttacaaaagcaaggaggaatcatcagggacccccgctcaccagatgaatctgcgcggatgtgaggtcacccccgacgtgaatatcagcggccagaaattcaacattaagctgctgatcccggtggctgaggggatgaacgagatctggctccgctgtgacaatgagaagcaatacgcacattggatggccgcttgtcgcctggcgagcaagggaaagacaatggcagacagctcatacaacctggaagttcaaaatattctgagtttcctgaaaatgcaacacctgaaccccgatccccagctgatccccgaacagattacgacagacatcacccccgaatgtctggtcagtccacgttacctgaagaaatataagaacaagcaaccagggtatatcagggatctgattaccgcgaggattttagaagctcatcaaaatgtcgctcagatgtctctgatcgaagcaaaaatgcgctttatacaggcctggcagtccctgccagagttcggaattacccacttcatcgcaagatttcaggggggtaagaaggaggagctaatagggatagcctacaaccgccttatccggatggacgcctctactggtgatgccatcaaaacatggcggttttcgaacatgaaacagtggaatgtgaactgggagataaagatggtcaccgtagaatttgccgacgaggtgcgactttctttcatttgtacagaggtcgactgcaaagtagtgcacgaatttatagggggatatatttttctaagcaccagagcaaaggaccagaatgagtccctcgatgaagagatgttctataagttgacgtcaggctgggtctag

SEQ ID NO: 223150 - DNA, 2043 bp, Artificial Sequence
  Description of Artificial Sequence: Synthetic coding sequence
atggcgttggatggtatccgaatgcccgacggctgctatgccgacggcacatgggagctgtccgtacacgtgactgatttgaaccgcgacgtcaccctgagggtgacaggtgaagtccacatcgggggagtcatgctcaaacttgtggagaaactggatgtgaaaaaggattggtccgatcacgcattgtggtgggagaaaaaacggacttggcttctgaagactcattggacactcgacaaatacggcatccaagccgatgccaagctacagttcaccccccagcacaaacttctgcgcctccagctgcctaatatgaaatacgtcaaagtaaaagtgaacttttctgaccgcgttttcaaagccgttagtgacatctgtaagacatttaacattagacatccggaggaactctctctgctcaagaagccccgtgacccaaccaaaaaaaaaaagaagaaactggatgatcagtccgaagatgaagcgctggagctggaagggcctttaatcacccctgggtccggctccatctattcttccccaggcctgtatagcaagaccatgaccccaacctatgacgcccatgatggctctcccctttcccctacaagtgcatggttcggggactctgccctgtccgaaggaaatccaggcattctggcagtctcccagcctatcacctctccggagattctagccaaaatgtttaaaccccaggctcttttagacaaggctaagatcaatcaaggctggctggattcatctagatccctcatggagcaggacgttaaggaaaatgaggcactgcttctgcggtttaagtattactccttcttcgacttaaatccaaaatacgatgccattaggatcaatcaactgtacgagcaggccaagtgggcaatactgctagaagagattgaatgtacagaagaggagatgatgatgttcgccgcactgcaatatcatataaacaaattgtcaatcatgacatcggaaaaccacctgaacaacagcgacaaagaggtggatgaggtcgatgctgccctgtcggatctggaaataactctggaaggcggtaaaaccagcaccattctgggggacatcacatcaatcccagagctggcagattacattaaagtcttcaagccaaagaaactgaccttaaagggctacaagcagtactggtgtaccttcaaggacacatctataagctgctacaagagcaaggaggagagctcaggtacgcccgcacaccagatgaacctccggggatgcgaggtaacaccggatgttaacattagtggacagaagtttaacataaagctgctcatccccgtcgcagagggcatgaacgagatatggctaaggtgcgacaacgagaagcaatacgctcactggatggcagcttgtaggctggctagtaaaggcaaaaccatggccgattcttcgtacaacctggaagttcagaacatactgagcttccttaagatgcaacatttgaatcccgacccccagctcatcccagaacagattactaccgatataacacctgaatgcctggtctcacctaggtacttgaagaagtataaaaacaagcagattaccgccaggatactggaagctcatcagaacgtagcccaaatgtctttgatcgaggccaaaatgcgtttcatccaggcatggcaaagccttccggaatttgggatcacacactttatcgctaggtttcagggtggcaagaaggaagagcttatcggcatcgcgtacaatcgcctgatcaggatggatgcttctactggggacgccatcaaaacctggagattctcaaatatgaagcagtggaatgtgaactgggaaatcaagatggtgacggtcgagttcgcagacgaggtcagactgtcatttatttgtactgaggtggattgtaaagtggtgcacgagttcattggagggtacatctttcttagcacacgggctaaagaccagaacgagtcgctcgacgaggagatgttctataaactgaccagtggctgggtgtag

SEQ ID NO: 223151 - DNA, 1902 bp, Artificial Sequence
  Description of Artificial Sequence: Synthetic coding sequence
atggcgctggacggcattagaatgccagacggttgctacgctgacggaacctgggagctgagcgttcatgtaacagacttaaatagggatgtcaccctcagggtgaccggagaggttcatattggtggggtgatgttaaagttagtggagaaactggatgtcaagaaggattggagtgaccacgctctgtggtgggagaagaaaaggacatggctgctgaagacacactggactctggataagtatggcatccaggccgacgcaaaattgcaattcacgccacaacacaagctgctaagactgcagctgcctaatatgaagtatgtgaaagtcaaagtgaactttagcgaccgcgtcttcaaggccgtaagtgatatttgtaaaactttcaacataaggcatccagaagagctgtcattgttgaaaaaaccacgggatcctactaagaaaaagaaaaagaaactggacgaccaatctgaagatgaggcattagagctggagggtcccctgatcactcctggttcgggcagcatctactcctcaccgggactgtacagcaaaacgatgacacctacatacgacgcacatgatggctctccgctgtctccaacctccgcctggttcggagattctgcactcagcgaggggaatccagggattttggcggtgtctcaacctataaccagtcctgagatcttggcaaagatgtttaagccccaagccctacttgataaagccaaaatcaaccagggctggctggactcttcgaggagtctgatggaacaggatgtcaaggagaatgaagctcttctcctgcgcttcaaatactattccttcttcgacctgaaccctaagtatgacgcgattcgtattaatcagctctatgaacaagccaaatgggccatcctgctggaggagattgaatgtacggaggaagagatgatgatgtttgccgctctgcagtaccacattaacaaattgagcataatgacaagcgagaaccacctgaacaattcagacaaggaggtggatgaggtggatgccgcactttctgacctggaaattaccctggagggcggtaagacctcaaccattttgggtgacataacctctatccctgagctggccgactatataaaggtgttcaaaccaaaaaaactgaccttgaaagggtataagcaatactggtgcacctttaaggatacatccatcagctgttacaagagcaaggaggaatcctctggcactcctgcccatcagatgaatctccggggttgcgaggtgacccccgatgtgaatatctccggccagaaattcaatatcaagttattaattccagtggcagaaggcatgaacgagatctggctgaggtgcgacaacgagaaacagtacgcacattggatggcggcttgtagactggccagtaagggtaaaacaatggccgatagctcttacaacctcgaggtgcaaaacattctctctttcctcaaaatgcagcatctcaatcctgatccacaactgatcccagagcagatcacaacggacatcacacccgaatgtctcgtgtctcctcggtacttgaaaaaatataagaataagcaaccagggtacatccgcgacctcattacggctcgcatcctggaagcccatcagaatgtcgcacagatgtccttgatcgaggccaagatgcgcttcatccaagcatggcagtctctcccagaatttggcatcactcatttcatcgctcgctttcaggggggtaaaaaggaggagctaattggaattgcctacaatagacttatcaggatggatgcttccacgggtgacgccatcaagacatggcgattctcaaacatgaaacagtggaacgtcaattgggagatcaaaatggtgaatagctag

SEQ ID NO: 223152 - DNA, 2064 bp, Artificial Sequence
  Description of Artificial Sequence: Synthetic coding sequence
atggccctcgacggtatacgtatgccagatgggtgttatgccgatggaacatgggaactgtccgtgcatgtcaccgacctcaaccgcgacgtaaccctgagggtgacgggcgaggtgcatataggcggagtaatgttgaaactggtggagaaattggacgtaaagaaagactggtcagaccacgcactctggtgggagaaaaagaggacgtggctacttaagacacattggaccctagacaaatacggcatccaagctgacgctaagctgcagttcaccccacaacacaagctgctacggctccagcttcccaacatgaagtatgtgaaagtaaaggtgaattttagcgaccgagtgtttaaggccgtgtcagacatatgcaaaactttcaacatacgtcacccagaagaactgtctctccttaaaaaaccacgcgaccctactaagaagaagaaaaaaaagctggatgaccagagcgaggacgaagcattggagttggagggccctctaatcacccccggtagtggtagtatatactccagtccagggctgtattctaaaaccatgacaccgacatatgacgcacatgatggctcccccctgtccccaaccagcgcttggttcggcgattccgccctcagcgaagggaatccgggaatcctggctgtctctcagccaatcacctcgcccgagatactggcaaagatgtttaagcctcaggcgctgctggataaggccaagatcaatcagggctggctggattcttcccgatcactgatggagcaggacgtgaaagaaaatgaagccctgctcctgcgttttaagtactacagttttttcgacttgaacccgaagtatgatgcaatcaggatcaatcagctgtatgagcaggcgaagtgggccatcctgctggaagagattgaatgtaccgaggaggagatgatgatgttcgctgcgctgcagtatcacatcaataaactgtccataatgacctccgagaatcacttgaacaactccgataaggaggttgacgaagtggacgccgcactgtccgacttagaaatcacactagaggggggaaaaaccagtaccatactgggcgatattacaagtatcccagagctcgcggactatattaaggtctttaagcccaaaaaattgacgctgaaagggtataaacaatactggtgtactttcaaggatacatccataagctgttataagtcgaaggaagaaagtagcggcacacccgcacaccagatgaacctccggggttgcgaggtcacacccgacgtgaatatttcaggtcaaaaatttaacataaagctactgatacccgtcgcggaggggatgaatgagatatggctcagatgcgataatgagaaacagtacgctcactggatggctgcctgccgactagcgagtaagggaaaaacaatggccgactctagttataacctcgaggtccagaatatcctgtcttttctcaagatgcagcacctgaatcctgatccccaattgatccctgaacagatcacaacagacatcacaccagagtgtttagtgagtcccagatatctgaagaagtacaaaaataagcaacctggctacatccgagatctgattacagcaagaattctcgaggcccaccagaacgtggcgcagatgtctctaatcgaggccaagatgaggttcattcaagcctggcagtccctgcctgagtttgggattacccatttcatcgcccgttttcaaggagggaagaaagaggaactaataggaatagcttacaacaggctgatacggatggacgcgagcacaggagatgctatcaaaacttggcggtttagtaacatgaaacagtggaatgtcaattgggagatcaaaatggtgaccgtggaattcgctgacgaagtccgcttgagctttatttgcactgaagtagattgcaaagtggtccacgagtttatcggcggttatattttcctgagtactcgtgccaaagaccaaaacgagagcttagacgaagagatgttctataaactaacatccggctgggtgtag

SEQ ID NO: 223153 - DNA, 462 bp, Artificial Sequence
  Description of Artificial Sequence: Synthetic coding sequence
atggctttggacggcattcgcatgcctgacgggtgttacgcagatggcacatgggagttgtctgtccatgtgacggatcttaatagagatgtgactctgagagtgacaggcgaggttcatattggcggagtgatgctgaaactcgtggagaaactggacgtgaagaaagactggagcgaccacgccctctggtgggagaaaaagagaacatggctgctgaaaacccactggaccctggacaagtatggaatccaagccgacgccaagctgcagtttactccccagcataaacttctgcggttacagttgcctaacatgaaatacgtgaaggtgaaagtcaacttcagtgacagagtctttaaggctgtgagtgacatatgcaagaccttcaacattcgccatcctgaggaattgtcattactgaagaaaccacgggatccaactaaaaagaaaaaaaaatag

SEQ ID NO: 223154 - DNA, 2004 bp, Artificial Sequence
  Description of Artificial Sequence: Synthetic coding sequence
atggccggtatgaagacggcctcaggagactacatcgactctagttgggagctcagggtgttcgttggggaggaagaccccgaggcagagtcagtgacgttgagagtgactggggagtcccacattggcggtgttcttctgaaaatcgtggagcagataaatcggaaacaggattggtctgaccatgccatctggtgggagcagaagaggcagtggctgctgcagactcattggacgttggataaatacggaatactggctgatgcacggctgttcttcggacctcagcaccgacctgtcattctgcggctgcccaatcgacgagcacttagactgcgtgcttcattttctcagccgctgtttcaagccgtagcagccatctgtaggctactgtcaatccggcacccagaggaacttagtttgctgcgcgcaccggaaaaaaaagaaaaaaagaagaaagaaaaggagcccgaagaggaactctacgatcttagtaaggtagtgctcgccggaggcgttgcccctgctctgtttcggggaatgcccgcacatttcagtgactccgcccagactgaagcatgttatcacatgctcagccgtcctcagccaccacctgatccactcctgctgcagcgtctgcccaggccttcttcactaagcgataagactcagctgcacagccgctggcttgacagtagcaggtgtctgatgcagcaagggataaaagctggcgatgccctctggctccgcttcaagtactactcgtttttcgacttggacccaaaaactgatcccgttaggcttacgcagctgtacgagcaagctcggtgggatttattactcgaagaaattgactgtacggaggaggaaatgatggtgttcgccgctctgcagtaccacattaataagctgagccaatccggcgaggtcggggagcccgcaggcaccgaccctggtctggatgacttggacgtagccctgagtaatctcgaggttaaattagaaggctccgcaccaaccgacgttcttgacagcctcaccacgatccccgaactgaaagatcacttgcgtatcttcagaattcccagaagacccaggaagttaactttgaaaggctacagacagcactgggtcgtgtttaaggagaccaccctgagttactataagtcccaagacgaggcacccggtgatcccattcagcagctcaatctgaaaggatgcgaagtggtgcccgacgtgaatgtgtctggccagaagttttgcattaaactgctggtgccgagcccagaggggatgagcgagatctacctacgctgccaggatgaacaacaatacgctcgatggatggctggctgtcggttggcgtcgaaagggagaaccatggccgactcctcttataccagtgaggttcaggccattctagcctttctaagtctccagaggaccggctccggaggaccagggaaccacccccacggacctgatgcttccgcggaaggactcaatccttacggcttagtcgctcctaggtttcagagaaagttcaaagcgaaacagcttaccccgagaatcctcgaagcccaccagaatgttgcccaattaagtttggccgaagcacaactccgattcatccaggcgtggcaaagcctgccagacttcggtatatcgtacgttatggtccgcttcaaggggtctcgcaaggacgagatccttggcattgcaaacaatcgactcattcgcatagacttagcagtcggagatgtggtgaagacgtggagattttccaatatgcggcagtggaacgttaattgggatataagacaggtggccattgagttcgacgaacacattaatgttgccttctcatgcgttagcgcatcctgtcgcattgtccacgaatatatcggcggatacatttttttgagcacacgggagagagcccgaggtgaagaactggatgaggatttgtttctgcaactgacaggcggacatgaggccttctag

SEQ ID NO: 223155 - DNA, 1992 bp, Artificial Sequence
  Description of Artificial Sequence: Synthetic coding sequence
atggcgggtatgaaaacagcttctggggactacattgacagttcgtgggaacttagagtgttcgtcggagaagaagaccccgaagcagagagtgtgacactgcgggttaccggggagtcgcacattggtggggtcttactgaagatcgtagagcagattaacaggaagcaggattggtcagatcacgcaatctggtgggaacagaaaagacagtggttgctgcagacacactggacactcgacaaatacgggatcctcgcagatgctcggctcttcttcgggcctcagcataggcctgtgatactgcggcttcccaatcgcagagccctgcggctgcgagccagctttagccagccactttttcaagccgtcgccgctatctgcagactcctgtctatacggcatcccgaggaactgagcctgctgagggcaccagagaagaaggagaaaaaaaagaaggaaaaagaaccagaagaggaattgtatgacctgtcaaaggttgtcctggcaggcggagtggctcccgcactctttagggggatgccggctcacttctcggatagcgctcagacagaagcatgctaccatatgcttagccgccctcaaccacccccagaccctctgttgctgcagagattgccaagaccttcttctctttctgataagacacagcttcacagcaggtggctggactcttcccggtgtctgatgcagcaaggaatcaaggctggagacgctctatggctaaggttcaagtattactcatttttcgatctcgatcctaagacagatcccgtcaggctgacccagttgtatgaacaggcgaggtgggatctgctgcttgaggagatcgattgtactgaggaagaaatgatggttttcgcagccttacaataccatattaacaagctttcacagagcggagaggtgggggagcctgctggaactgacccaggtttggacgacttagatgttgctctatccaacctagaggtgaagctcgaggggagcgccccaaccgacgttcttgacagtctgacaactatacctgaattgaaggaccatctaagaatctttaggccacgtaagctgacactgaagggctataggcagcactgggtggtttttaaagagaccacactctcttattataaatctcaggatgaggcacccggtgatccgatccagcagctcaacctcaagggatgtgaagtggtccctgacgtaaatgtgtcggggcagaagttttgcattaagctgctggtccccagtccagagggaatgtctgaaatctacctaaggtgccaggatgagcagcaatatgcacggtggatggcaggctgccggctcgcctccaaagggaggaccatggcggactcatcctacacaagtgaggtacaagccatcctcgcatttctctctttgcaaaggacagggtccggagggcctggcaaccacccccatgggccagacgcgagcgctgagggcttgaatccttacggacttgttgcaccacgcttccagagaaagtttaaagcaaaacagttgactccacgcattctcgaggcgcaccagaacgtggcccagctgagtctggctgaagcccaacttaggttcatccaagcatggcaaagtttacccgatttcggcatttcatacgtaatggtccggtttaaggggtctcggaaagatgaaatcctgggtattgctaataacaggttaatacgcattgacctggccgtcggtgatgtggttaaaacttggagattctcaaatatgcgccagtggaacgtcaactgggatataaggcaagtagccattgaatttgatgagcacataaatgtagcttttagttgtgtgtctgcatcttgtcggatcgttcatgaatatatcgggggttacatcttcttatctaccagagaaagggcaagaggcgaagaactggatgaggatctgttcctgcaactcactgggggacacgaagctttttag

SEQ ID NO: 223156 - DNA, 861 bp, Artificial Sequence
  Description of Artificial Sequence: Synthetic coding sequence
atggctggcatgaagaccgctagtggcgactatattgactcctcctgggaattgcgcgtgttcgttggggaggaggacccagaggccgagtctgtaacacttcgggtgaccggtgagagccacattggaggtgttctgctgaaaatcgtggaacagatcaacaggaagcaggattggagcgatcatgcaatttggtgggagcagaagcggcaatggctcctccagactcattggactctggacaaatacggaatcctggccgacgcccgactgtttttcggcccacagcacagacctgtaattctgcgtctccctaaccggcgtgctcttagactgagagcctctttcagtcagcctcttttccaggctgtcgcagctatttgcaggttgctttctatcagacacccggaagagttgagtctgttgagggctccggaaaaaaaagagaagaagaagaaggagaaggagcccgaggaggagctgtacgacctttccaaggtcgtcctggcgggaggtgtcgcgcctgctctgttccggggaatgcctgcacactttagtgactcagcccagactgaggcctgctatcacatgctgagtcgaccacagccacccccagacccattactgctgcagcgcctacctcgacccagcagcctgtcggacaaaacacagttgcactcccgctggttggacagcagcagatgtctcatgcagcagggaatcaaagcaggggacgcattatggctgcgttttaagtactactctttcttcgacctggacccaaagacagatcccgttcggttgactcaactctacgaacaggccaggtgggacttgttgctggaggaaatcgattgctag

SEQ ID NO: 223157 - DNA, 555 bp, Artificial Sequence
  Description of Artificial Sequence: Synthetic coding sequence
atggccgcagctggcggtgcccgactactgcgggcagcctcagccgtgttagggggtcccgctggcagatggctacatcacgcgggatccagagctgggtccagcgggcttctaaggaaccgcggacctggcggtagcgccgaggcttcacggtcactgtctgtcagcgctagagctcgttctagttcagaggacaagatcacagttcacttcatcaaccgagacggggagacgctaacaacgaaaggtaaggtcggagactctttgctggacgtggtagtggagaataacctcgatattgacgggttcggagcctgtgaagggacgctcgcatgctctacctgtcacctgatctttgaggatcacatctatgagaagctcgacgcgattacggacgaagagaacgatatgctggatttagcgtacggactcaccgatcgatcccggttgggatgtcagatttgcttgacaaaaagtatggacaatatgactgtgcgtgtgcctgagactgtggcagacgctcgccagagcatcgatgttgggaagacaagctag

SEQ ID NO: 223158 - DNA, 1494 bp, Artificial Sequence
  Description of Artificial Sequence: Synthetic coding sequence
atggctagtagatgctggagatggtggggttggtcagcctggccgagaacaaggctccccccagcaggcagcaccccaagcttttgtcatcatttttcaactcaagagaagacacctcagatttgtgtggttgggagtggacccgcagggttttacacagcccaacatctcctgaagcatccgcaggctcacgtggatatttacgaaaaacaaccggtgcccttcggcctggtccgttttggcgtcgcccctgaccacccagaggtgaagaatgtgataaatacattcacacagacggcccactctggccgttgtgccttttggggcaacgtggaagtgggtagggatgtgacggtacccgaacttcgcgaggcctatcatgctgtggtgctcagctacggagccgaggatcatcgcgcactcgagattcctggagaggaattgcccggtgtatgttccgcccgagcctttgtcggctggtataacggactgcccgaaaatcaagagctcgaacctgacctatcctgcgacaccgcggtgattttgggccagggaaatgtcgcccttgacgtggctaggatcctcctgacccctcccgagcacctcgaagccctgctcctatgtcagaggacggatatcaccaaggctgccctgggagtgcttagacagagtagggtgaagacagtatggctcgtgggaagacgcggacctcttcaggtggcttttactatcaaggagttgcgagagatgatacagctgcctggggctcggcctattctcgaccccgtggacttcctgggactgcaggacaaaataaaagaggtccccaggcccagaaagcgcctgactgaactgctcttgagaaccgccaccgagaagcccggtcctgcagaagcagccaggcaggcatccgcaagcagagcttggggcctgaggttttttcggtcacctcagcaggtgctcccctctcccgacggaagaagagcagcaggcgtgcgtctcgcggttaccagacttgaaggggtggatgaagctacccgcgctgtccctacgggcgatatggaggatttaccgtgtggtctcgtgctgtccagcatcggctataagagtcgacccgtggatccatcagtgccttttgactccaagctcggtgttatcccaaatgtggaaggcagagtgatggacgtcccaggcctctactgctccggttgggtgaagcggggaccaacaggcgttatcgcaactacgatgacagactcttttctgacaggccagatgcttctgcaggatctcaaagctgggctgcttcctagcggccctcggcctggatacgcagctattcaagctctgctatcatccaggggagtgcgacccgtgtcattctcagactgggagaagttagatgccgaagaggtggcccgtggccagggtacaggcaagccccgtgaaaaactcgtggaccctcaggagatgctgcgtcttttgggacactag

SEQ ID NO: 223159 - DNA, 1569 bp, Artificial Sequence
  Description of Artificial Sequence: Synthetic coding sequence
atggcaagccggtgttggcgatggtgggggtggagtgcatggcccaggaccaggctaccgcctgcgggtagcaccccgaccttcgggggatcggacgaggtccgggacccagctaacgctaaggctctacgtaataagaggaggcgaatgcaggtgcgagttaaactcggtaagttccagctgcttctggatatacaggaaaaaacaccgcagatctgcgtcgttggaagcggacctgctggcttttacacggctcaacacctgttgaagcatccacaggcacacgtggacatctacgaaaaacagcctgttccattcgggttagttcggttcggagtcgctcccgatcacccagaggtgaaaaacgttattaatacctttacacaaactgcacactcggggagatgcgcgttctggggtaacgtggaggtgggcagggatgtaacagttcccgaactgcgggaggcttaccatgctgtcgtgctgagctacggtgccgaggatcatagggctttggagatcccaggagaggaattgcctggagtgtgcagcgctagggcttttgttggttggtacaacggactgcctgaaaatcaggagctggagcccgacctctcttgtgacactgcagttattctagggcaggggaatgtggcattagacgtggctagaatcttgctgaccccgcctgagcacctcgagcgaacggatatcacgaaagccgctttaggagttctgaggcagtcgagagtgaaaacagtgtggctggtgggacggaggggacccctccaggtggcattcaccatcaaagaacttcgcgagatgatccagctccctggtgctaggcctatattggacccagttgacttcctgggattacaggacaaaatcaaagaggtgcccagacccaggaagagactgaccgagcttctgttgcggactgccacagagaaaccgggaccagccgaagctgctaggcaagcaagtgcctctcgagcgtggggactgcgtttctttcggagtcctcagcaggtcctgccctctcccgacgggaggcgggcagccggagtgagattggctgtgactaggctggagggcgtggatgaggctacccgcgcagttcccactggagatatggaggacctaccttgtggcctggtcctgagtagcatcggctataagtctcgcccagttgacccgagcgttccttttgatagcaaactgggagtaattcccaatgttgagggacgcgtcatggatgtaccaggattgtactgcagcggttgggtgaagaggggccctaccggcgtgatcgcgactaccatgactgattcctttttgaccggccaaatgcttttgcaagatctcaaagctggattattaccatcagggcctaggcccggatatgcagctatccaagcacttctttctagccggggtgtccgtcctgtctccttcagtgattgggaaaaactcgacgctgaagaagtcgcaaggggacaggggaccggcaagcctcgggagaaactggtcgatccccaggaaatgcttagacttctgggacactag

SEQ ID NO: 223160 - DNA, 1356 bp, Artificial Sequence
  Description of Artificial Sequence: Synthetic coding sequence
atggcctcacgatgctggagatggtggggttggtctgcctggcctcgtaccagactgccaccagctggatccacccctagcttctgtcatcattttagcacccaggagaagaccccacaaatttgcgtcgtggggtctgggccagcaggattttacaccgcacaacatcttcttaaacagcacccccaggcacacgtggatatctacgaaaaacaaccagttccctttgggctggtgaggttcggcgtagcccctgaccacccagaggttaagtcatacggggctgaggaccatagggctttagagataccaggcgaagagttgcccggagtatgtagcgcacgggcatttgtgggatggtataatgggctgcctgaaaaccaggaacttgaaccggacctgagctgtgacacagcagtgatcctgggtcaggggaacgtggccctggacgtggctcgtattttgctgacacctcctgagcacctcgaaagaaccgacattacgaaagcggcactcggagtattgagacaatctagagtgaagaccgtctggttggtcggacggagaggccctcttcaggtagctttcaccatcaaagagctccgagaaatgatacaactccctggtgctcggccaatcctggaccccgtggatttcctgggccttcaagacaagattaaggaagtcccccgtcctaggaagcggctgactgaactgctcctgagaactgccactgagaaacccggacccgcagaggctgccagacaagcttctgcatcgcgggcatggggactgaggttctttcggagtccacagcaagttctgccgtcccccgacgggaggagagccgcaggcgtgcggttggccgtgacccgattggagggggtggatgaggccacccgcgcagtgccaactggcgacatggaagatctcccgtgtgggctggttctgagcagtatcggctataagtcaagaccagtggatcctagcgtgccattcgactccaagctcggggtgatccctaacgtggaaggtcgagttatggatgtgccaggcctctattgcagcggatgggtgaagcggggacctaccggggtgattgcaaccacaatgacagattccttcctaaccggccagatgctgctccaggatctcaaggcgggtctgttgccatccgggcctaggcctggttacgctgctattcaggctcttttgagttctcggggagtgagaccagtgagcttctcagactgggagaagctcgatgctgaagaggttgccagaggccagggcaccgggaagccccgagaaaaactggtggatccccaggagatgttacgtctgttagggcattag

SEQ ID NO: 223161 - DNA, 1605 bp, Artificial Sequence
  Description of Artificial Sequence: Synthetic coding sequence
atggcctcaagatgctggagatggtggggttggtctgcgtggcctcggacccgtttgccccctgcaggttccactcctagcttctgccatcacttcagcacgcaagagaaaacacctcagatctgcgtagtggggagcggacctgccggattttacaccgcacagcatttgctcaagcgggttgaggctctttgctctcagcccagggttctgaattccccagccctttcgggcgaaggcgaggatctcggagctagtcagcccctgtcgctggacccaacaagctgccatcccgtaccccaacaacacccacaggcccatgtggacatctacgagaagcagcccgtgcccttcggactagtgaggtttggtgttgcacccgaccacccggaagtgaaaaatgtgataaacaccttcacccagaccgctcattcagggagatgtgctttctggggaaatgttgaagtaggacgtgatgtcacggtaccagagctacgtgaggcataccacgcggtcgtgctgtcttatggggcagaggaccacagagccctggaaattcccggagaggagctgccaggggtctgcagtgctcgcgctttcgtcgggtggtataatggcctccctgagaaccaagaattggaacctgatttgagttgcgatacagcagtgattcttgggcaggggaatgttgcccttgatgttgccagaattctgctgacacctcccgagcacttggaaaggacagatataacaaaagccgctctgggcgtgctgaggcagtccagggtgaagaccgtttggctcgtgggccgtcgtggtcctctgcaggtggcattcaccattaaggaacttcgggagatgatccagctcccgggagcccgaccgattttggaccctgtggactttctgggcctgcaggacaagatcaaggaggtgccaagacccaggaaacggctcacggagcttctgctccggacagccaccgagaaaccaggcccagctgaggcagcccgacaggcctctgcaagcagggcctgggggcttcggttctttaggtccccccagcaggttctcccatctcctgatggacggagagccgctggtgtgagactggcagtgaccaggctggaaggcgtggacgaggccactagagccgtgcccacaggcgacatggaggacctaccatgtgggctggtactgtctagcatcggctacaaatcccggcctgtggacccgagcgttccctttgatagcaagctcggagtgattcctaacgtcgaaggcagagtgatggacgtccccggactttactgctccggatgggtaaagagagggcctaccggggtgatcgccactacgatgaccgatagctttctgacgggtcaaatgcttttgcaggacctgaaggccggtcttctgccaagcggcccaagacccggttacgctgccattcaggcgctgctttcgtcccggggtgtaagacccgtcagttttagcgactgggagaaactagatgctgaagaggtcgctcggggacagggaactggaaagccaagggagaaactcgtcgatccacaggagatgttacgactactcggacactag

SEQ ID NO: 223162 - DNA, 1146 bp, Artificial Sequence
  Description of Artificial Sequence: Synthetic coding sequence
atgaccacttgtaaagcaggtgtggttccattggcttctcaacagcacccgcaggcccatgtagacatctatgagaaacaaccagtgcctttcggcttggtgcgctttggggtagctcccgaccacccggaggtcaagaacgttattaatacgtttacccagacagcccactctggcagatgcgccttctggggtaacgtcgaggtcggccgagatgtgaccgtgcctgagctcagagaagcataccatgccgtggttctgagttatggggcagaggaccaccgcgcactggaaattcctggagaagagctcccgggtgtatgctctgcacgagcttttgtcggctggtataatgggctccccgaaaatcaggagttggaaccagatctgtcgtgcgatactgcggtaattctggggcagggtaacgtcgccctggatgtggcgcgaatcctgctgacgccaccagaacacctagagagaaccgacatcaccaaagcagcccttggagttctcaggcaaagtcgcgtcaagactgtgtggctggttggcaggaggggcccacttcaagtggcttttactatcaaggaactgagggagatgatccagcttccaggagcacggcctatcctggatccagtagatttcctgggtctccaggacaaaatcaaagaggtgccaaggccaagaaagcgtctaacagagttgttactgcgcaccgccacggagaaacctgggcctgcagaggccgctcgccaggcaagcgctagccgcgcatggggtttaagattcttcaggagtccgcaacaggtgctgccgtcacccgacggccgaagagctgcaggcgtgcgactggccgtgacaaggctcgaggtgtccttgatgttcctcaaggatactcccttcccaggtctgtgccatcccccaggggtggcacacaccctgcctaacagagtatcaatgcgcccaccagtgcagtgtccaagagagacatggaaaacctctctggtgggttggtgttctgccgcattgggcattcgtgctgcgttatcaacgcaagcctgtccactgaccccctcactggggtcctcgcctatgtggagagccggtctgtggatgtgtcaagcttctacggccgcagcagggtag

SEQ ID NO: 223163 - DNA, 1320 bp, Artificial Sequence
  Description of Artificial Sequence: Synthetic coding sequence
atggaggacaaagatcgagagcatcctcaggcgcatgtcgatatctatgaaaaacagcctgtgccttttggtcttgtgcgattcggggtcgcaccggatcaccctgaggtgaagaacgtcatcaatacatttacacagacggctcacagcggaagatgtgccttctggggaaacgtggaggtcggcagagacgtgaccgttcctgagttgcgcgaggcataccacgctgttgtgctttcgtacggagcggaggaccaccgtgcactggaaattccaggagaggagctgcctggtgtttgctcagctcgggctttcgtgggctggtacaatgggctgcctgaaaaccaagagttggagcctgatctgagctgtgatacggcagtgatcctaggtcagggcaatgtcgccctcgacgtcgcgaggatcctgttgacaccacctgaacacctggagcggacggacataacaaaagctgccctgggcgtgcttaggcaatccagagtaaagaccgtgtggctcgtgggtcgtcgcggtcccctgcaggtggccttcactattaaggagcttcgagagatgatacagctgcccggtgcccgaccgattctcgacccagtggattttttgggactccaggacaagattaaagaggtgccacgcccaaggaagcgactcactgagttgctgttgcgaaccgcaaccgaaaagccgggacctgccgaagccgctcgacaagctagcgcctctagggcatgggggctcaggttcttcagaagcccccagcaagtactgccctcccccgatggtcgccgagcagccggtgttaggctggccgtaacacgcctggagggagtggatgaagccacccgcgcagtaccgacaggggacatggaagatctaccatgtggccttgtgctgagctcaattggatacaaaagcagaccagtggaccctagcgtgccttttgacagtaaactgggagtcattcctaacgtcgagggtcgggtcatggatgtgcccggattatactgctccggatgggtgaaacgaggccctaccggagtgatagccactactatgactgactcatttctgactgggcagatgctgttgcaagacctgaaagccggtctgttgcccagtgggcctcgacctggttacgcggctattcaggcactgctctcatctcgaggcgtccggcctgtgagtttctccgattgggaaaagttggacgccgaagaagtggctaggggacagggaactgggaagccccgagagaagctagtggatccccaggaaatgctacgactgcttgggcattag

SEQ ID NO: 223164 - DNA, 1494 bp, Artificial Sequence
  Description of Artificial Sequence: Synthetic coding sequence
atggcatcccggtgttggcggtggtggggctggtccgcttggcctcgtactcggcttcctccagccggttcaacacccagtttctgccaccacttctcgacccaggaaaaaactccccagatttgtgtcgtgggttctgggcctgccggattttacacagcacaacatctgttaaagcaccctcaagctcacgtcgacatatatgaaaaacagcctgtaccgttcggcctggtccgcttcggagttgctccagatcaccctgaagtgaagaacgtgattaacaccttcacacagaccgcacattccgggagatgtgctttttggggcaatgtggaggtggggagagacgtcactgtccccgaactccgcgaagcgtatcatgcagtggtgttaagctatggcgctgaggatcaccgcgcactggaaatacctggagaagaactgcccggtgtatgctctgctcgagcctttgtaggatggtacaacggcttaccggagaaccaggaattggagcccgacctgagctgcgataccgccgtgatcctgggccagggaaatgtggccctggatgtggctcggatcctgctcacaccccctgaacatctcgaggcactactgctatgtcaacgcaccgatatcacgaaagctgcactcggggtgctcagacagagtcgggtgaagaccgtctggttagttggtcggcgaggcccactgcaggttgcttttacaatcaaggaattgcgcgagatgattcaactgccaggcgcacgcccaatcctcgacccagtcgatttcctcgggttacaagataagataaaagaagtacccagacctcggaagcggcttacagagctgttattgaggaccgctaccgaaaagcctggacctgcggaagctgctaggcaagcctctgcttcaagggcttggggactccggtttttccgatctccacaacaggtccttccatctccagacggcagaagggctgccggtgtgcgcctggctgttaccaggctagaaggagtggacgaagccacaagggccgtgcccaccggcgatatggaggacttgccctgcggccttgttctgagcagcatagggtacaaaagcagacctgttgacccatcagtaccttttgattctaagctgggggtgattcccaacgtggagggcagagtcatggatgtacccggactctactgttccggctgggtgaagcgtggccctacaggggtaatcgcgactactatgactgattccttcctaaccggccagatgctgctccaagacttgaaggctgggctgctccccagtggcccaagacctgggtacgccgcaatccaggcattgctgagctctagaggagttcgtcccgtgagcttttccgattgggaaaagctggatgccgaagaggtggcgcgtggacagggcaccggcaaacccagggagaaactagtcgatccccaggaaatgcttcggttacttggacattag

SEQ ID NO: 223165 - DNA, 1452 bp, Artificial Sequence
  Description of Artificial Sequence: Synthetic coding sequence
atggcttctcgctgttggcgatggtggggatggtctgcctggcccaggacacgactgccgcctgctggtagcaccccgagcttttgccaccactttagcactcaggagaaaaccccccagatctgtgtggtgggaagtggcccagcagggttctacaccgcccaacacctacttaagcacccccaggcccatgtggacatctatgagaagcagccagtgccgttcggtctggtgcgctttggggtggcacctgatcacccagaggtgaagacggcacacagcgggagatgtgccttttggggcaatgttgaagtgggacgggacgtaacagtcccagagctgcgtgaggcctatcatgcagtcgtcctttcatatggcgctgaagatcacagagctttggagattcctggtgaggagctccctggtgtgtgctccgcgagggctttcgttgggtggtacaatggcctcccagaaaaccaggagctcgagcccgacctttcctgcgatacagctgtgattcttggccagggtaatgtagcattggacgtcgctcgaatcctgttgaccccccctgagcacctggagcgcactgacattacaaaggccgcactgggcgtacttcggcagtccagggtgaagacagtctggctggtggggcgtaggggtcccctgcaagtcgcctttacaattaaggaactgcgagagatgatccagctgcctggggctaggcccatactggatcctgtagattttctcggcctccaggataaaatcaaagaggtgccacgccctcggaaacgtctgaccgagctgttgctacgtactgccacagagaagccgggacccgcagaagcagctcggcaggcatcggcatcccgggcatggggtctcagattcttccgatctcctcagcaagtcctgcccagtccagatggacggagagccgcaggagttaggcttgcagtcacacgcctggaaggcgtggatgaagccaccagggccgtgccaacaggagacatggaagaccttccttgcggtctcgtgctgtcgagtataggatacaaatcacgccctgtggacccttcggtacccttcgacagcaaacttggagtgattcctaacgttgagggacgcgtcatggacgtgcccggtctctactgttctggatgggtgaagaggggacccactggcgtaatcgccaccactatgacggattctttcctgaccggacagatgttgctccaggatcttaaagcaggcctgttgccttccgggcctcggccagggtacgctgctatccaggccctcctctcttcaaggggcgtgcgcccagtttcgttttccgattgggagaagttggacgcggaagaggtcgccaggggacagggcacagggaaaccccgagagaagttagtggacccccaggagatgctgaggctgttgggacattag

SEQ ID NO: 223166 - DNA, 1881 bp, Artificial Sequence
  Description of Artificial Sequence: Synthetic coding sequence
atggcagtgtccggctttaccttaggtacctgcatcttgctgctccacatcagctacgtagcaaattatcccaatgggaaggtgactcagagctgtcacggtatgattcccgaacacggtcacagcccacagtcagtgccagtgcacgacatttatgtgtcccaaatgaccttccgccctggggaccaaatcgaagttaccttgtccggtcacccatttaagggttttctgctggaagcgaggaacgccgaagatcttaatggtcccccaattggaagttttacattaattgacagcgaagtgtcacagctcctgacatgcgaggacatccaaggctccgctgtgtctcataggtcggccagcaaaaagacggagatcaaggtctattggaacgcgccttcctctgcacccaaccatacgcagttcttagtcaccgttgttgagaagtataagatctactgggtgaagattccgggtcctattataagccaaccaaatgctttcccctttacaaccccgaaagccacagtcgtgccactccctaccctgccacctgtgagccacctgaccaagccctttagcgcctctgattgcgggaataagaaattctgtatccgtagtcctcttaactgtgaccccgagaaagaagcatcatgtgtgttcctgtcattcacaagggatgatcagagcgtcatggtggaaatgagtggtccaagcaaaggctacctgtcattcgcattgtcccacgaccagtggatgggtgacgacgacgcctatttatgtatccatgaagatcaaactgtctacatacaaccatctcacctgacaggacgctcccaccctgtcatggattcaagagataccctcgaagatatggcctggcgcctggctgacggcgtgatgcagtgtagttttcgtcgcaatatcaccctgccaggtgtgaaaaatcgctttgacctgaataccagttactatatcttcctcgcagatggtgccgcaaatgatggcaggatctacaagcatagtcaacagccactcatcacctatgaaaagtacgacgttactgattcccccaaaaatatagggggttctcatagcgttctcctcctgaaggttcacggggctcttatgtttgtggcatggatgaccacagtttcgatcggcgttttagtcgctcggttctttaagccagtgtggagtaaagcgttcctgcttggagaagccgcatggtttcaggtgcatcggatgctgatgtttactacgactgtgctgacctgtatcgcattcgtcatgccctttatctacaggggcggatggtcccgccatgccggataccacccttacctggggtgcatcgttatgacactggcagttctgcagcctttactcgctgttttccgccctccacttcacgaccccaggcgccagatgtttaattggacccattggtccatggggacagccgcaagaattatcgcggtggctgccatgttcttaggtatggaccttcctggcttgaatctaccggatagttggaaaacctatgcaatgactggcttcgttgcctggcacgttggcacagaagtggtccttgaactgaaatattggatgatgacggagttccggtctttttctcatctccttcagtggaaacagcgcgtgatgctcctgaagaggcagtgttggcaatttatgtcagtaggtatgctgctgttctctagttacttttatcttcagtccacgatctacgaacaggcaaagaccctggcttttgcaggacaggtgatcatcattattaagccaaagaagttggaggcatgccctgattgcctggaacacatctgcgagttttccttggggaggttgggatcatgcctgtag

SEQ ID NO: 223167 - DNA, 1779 bp, Artificial Sequence
  Description of Artificial Sequence: Synthetic coding sequence
atggccgtgtccgggttcaccctcggaacttgtatactccttcttcatatttcctatgtggctaactaccccaatggaaaggtaacccagagctgccacggaatgattccggagcacgggcactctccgcagtctgtgcccgtacatgatatatatgtgtcccagatgactttccgtcccggagaccagatagaggttacgctatcaggacacccgttcaaaggcttcctgcttgaagcaaggaatgcagaagatctgaatggacctcccatcggctctttcaccctgatcgattccgaagtgtcgcagctgctcacatgcgaagacattcaaggaagcgcagtaagccaccggagtgcgagcaagaagacagaaattaaagtctactggaatgccccaagttccgctcccaatcacacccagttcctggtcactgttgtggaaaagtacaagatatactgggtcaagatcccgggaccaataatatctcagcctaacgccttcccatttactactcctaaggcaactgtggtgccacttccaaccctcccgcctgtctcacacctgactaaaccgtttagcgctagtgactgcggcaacaagaagttctgcattaggtcccctctcaactgcgacccggagaaggaggcaagctgcgtgttcctaagctttacccgcgacgaccagtctgtcatggtagaaatgtctggtccttccaaaggatacctgtcttttgccctcagccatgaccaatggatgggagacgatgatgcatacctctgtattcacgaggaccaaaccgtgtatattcagccatcccacctgacaggccgaagccatcctgttatggattcccgcgacactcttgaagacatggcgtggaggttagccgatggggtaatgcagtgttcatttaggcgaaatataaccttaccaggcgtcaaaaacaggttcgaccttaatacttcctactacatctttctggcggacggcgcagcaaacgatggccgaatctacaagcattcacagcaacctctcattacctacgaaaagtacgatgtgacggacagcccaaagaatatagggggaagccactctgtgctcctgctgaaagtacacggagcgcttatgttcgtggcatggatgaccaccgtctccataggtgtgctcgttgccaggttttttaagcccgtttggtctaaggccttcctgctaggggaagctgcgtggttccaggtgcaccgcatgctcatgttcactaccactgtgcttacttgcatcgcatttgtgatgccattcatttaccggggagggtggagccggcacgcaggctatcatccttatcttggttgtattgtgatgacattggctgttttacagcctttgttggccgtgttccgccctcccctccacgacccgaggcgtcagatgttcaactggactcactggtctatgggtacggccgctcgcatcattgcagttgctgccatgttcttgggaatggatctgccaggcttgaatctgcccgacagctggaagacatacgctatgactggcttcgtggcgtggcacgtcggcacggaggttgtgctggaagtccacgcctatcgtctatctcgcaaggtagagattttggacgatgatagaatccagatcctacagtcttttacagcggtggaaacagagggccacgcgtttaagaaggccgttctggcaatttatgtttgtggaaacgtgactttcctgatcatttttctttcagccatcaaccacctctag

SEQ ID NO: 223168 - DNA, 729 bp, Artificial Sequence
  Description of Artificial Sequence: Synthetic coding sequence
atgctctcctgctttaggctgctctccaggcacatcagtccctctcttgcatcactcagacctgtgcggtgctgcttcgccttacctctgcgctgggccccaggcagaccgctcgatccccgtcagattgctccacgccgacccctggctgcagctgcatcatcacgcgaccctactggccctgcggcaggaccctcgagggtgagacaaaattttcacccggactccgaggctgccattaaccggcagattaatctcgagctgtacgccagctacgtgtatctgtcaatggcctattacttttctcgggacgacgtggctttaaataacttctctcgctatttcttacaccagtccagagaggagaccgagcacgccgagaagctgatgcgactgcagaatcagcgagggggtcggattaggttgcaggatattaagaagcctgagcaggatgattgggaatcaggactccacgcaatggagtgcgctctcctgctcgaaaagaacgtgaaccagtcacttcttgagctgcacgctttagcctctgataagggagacccacatctgtgcgattttctggaaacctactacctgaatgaacaggttaagtccattaaggaactgggcgatcacgtgcacaacctagtgaaaatgggtgctcccgacgcagggctcgccgagtatttgtttgacacccacacccttggaaacgagaacaagcagaactag

SEQ ID NO: 223169 - DNA, 552 bp, Artificial Sequence
  Description of Artificial Sequence: Synthetic coding sequence
atgactaccgctagtacttcacaggtcaggcaaaactaccatcaggacagtgaagcagcgataaatcgccagatcaacctagagctctacgcctcttacgtgtacctatcaatgtcctattactttgacagagacgatgtggctctgaagaactttgccaaatatttccttcatcagtcacacgaagaacgggaacatgctgaaaagctgatgaaactgcaaaaccaacgcggaggacgaattttcctgcaagatataaagaagccagactgtgatgactgggaaagcggattgaatgccatggagtgtgcactccatttggagaaaaacgtaaatcaatccctgctcgagcttcacaagttggcgacggataagaacgatccacatttgtgtgacttcattgaaacgcactatctgaacgagcaggtcaaggccatcaaggagctgggcgatcatgtgaccaaccttcgaaagatgggcgcacccgagagcggattggctgagtacctgtttgacaaacacaccctgggagacagcgataacgaatcctag

SEQ ID NO: 223170 - DNA, 699 bp, Artificial Sequence
  Description of Artificial Sequence: Synthetic coding sequence
tctggattcccagctagtaccgtcttaggaaggaatcccgctttagttcctcacccaggaaggcctcctatcgcaagtccaccgagccccctccaccgcactctcgggctgcctcagggtccgaggagactgtctctagttgccgctatgacgaccgccagcactagccaggtgagacagaattaccaccaggactctgaggctgcaatcaatcgccagattaacctcgagctctatgcatcctatgtatacctatctatgtcctattattttgatcgcgacgatgtagcccttaagaattttgctaagtattttcttcatcagtcccatgaagaaagggagcacgccgagaaactgatgaaactgcagaaccagaggggaggccgtattttccttcaggacattaagaagccagactgcgacgattgggagtctgggctaaatgcaatggagtgcgccctacacctggaaaagaacgtgaaccagtctctgctagaactccacaagctggcaaccgataagaacgatccccacctgtgcgacttcatcgaaactcattacctgaatgaacaggtcaaggctattaaagagctgggagatcatgtgaccaacctgcgcaaaatgggcgctccagaaagcggattagctgaatatcttttcgacaaacataccctcggtgactctgataacgaaagttag

SEQ ID NO: 223171 - DNA, 462 bp, Artificial Sequence
  Description of Artificial Sequence: Synthetic coding sequence
atgaccaccgcttctacatcccagagttattacttcgatcgagatgacgtggctttgaagaattttgccaagtacttcctccatcaatctcacgaagaacgtgagcatgctgaaaagctcatgaagctccagaaccagagagggggaaggattttcctgcaggacataaagaaacctgattgcgatgattgggagagcgggctgaatgccatggaatgcgcgctgcacctagagaaaaatgtcaatcagtctctcctggaactgcataagttggccacagataagaatgaccctcacctgtgcgattttatcgagacccactacctgaatgagcaagtcaaggccatcaaagaacttggggatcatgtgacgaaccttcggaagatgggagcaccagagagtggtcttgctgaatacctttttgacaaacatacactgggcgactcagacaatgaatcttag

SEQ ID NO: 223172 - DNA, 552 bp, Artificial Sequence
  Description of Artificial Sequence: Synthetic coding sequence
atggcgacagctcagcccagccaggtgagacaaaaatatgatacgaactgtgatgccgctatcaattcccacattaccctggagttgtacacctcatatctctatctgtctatggccttctatttcaatagggatgatgtcgcactcgaaaatttcttccgatattttcttaggttaagtgatgacaagatggaacacgctcagaaactcatgagactccagaatcttagaggcggacatatctgtctccacgacattcgaaagccagaatgtcagggctgggagtctgggctagtagccatggagagtgcatttcaccttgagaaaaatgtcaaccagagcctactcgatctgtaccagctggcagtcgaaaagggagacccgcagctttgccacttcctggaaagccactatctgcacgagcaggtgaaaaccattaaggaattggggggttacgtcagcaacttacggaagatctgctctcctgaagccggtctggcagagtacctgttcgataagctgacattgggtggcagagtaaaggagacctag

SEQ ID NO: 223173 - DNA, 528 bp, Artificial Sequence
  Description of Artificial Sequence: Synthetic coding sequence
atgtccagtcagatccggcaaaactactctacagacgtcgaagcagccgtgaattcactagtgaatctgtacctgcaggcgtcatacacctatctgagtctggggttttatttcgacagggatgacgtcgccttggagggagtgagccatttcttcagggaactagctgaagaaaagcgcgaaggctatgaaagactcctcaaaatgcagaaccaaaggggtggacgtgcgctgttccaggacatcaaaaagccagcggaagatgagtggggcaaaacacctgacgcaatgaaagccgctatggctctcgagaagaagttgaatcaggctctcctcgatcttcacgccttagggagcgctagaactgatccacatctctgcgatttcttagagacccacttcctagacgaagaggtaaagctgatcaagaagatgggggaccacttgactaatctccaccgcctcggagggcctgaggctggattgggcgagtatcttttcgagaggctaacgctgaaacacgactag

SEQ ID NO: 223174 - DNA, 573 bp, Artificial Sequence
  Description of Artificial Sequence: Synthetic coding sequence
atgtcctcacagataaggcaaaactacagtacggatgtggaggctgctgtaaattccctcgtgaatctctatttacaggcctcctacacctacttatcacttggcttctattttgatcgagacgatgtcgccctggagggggttagccatttcttcagagaactggcggaggagaagcgtgaaggatatgagcgcctgctgaagatgcagaaccaaaggggcggacgagccctgtttcaggatatcaaaaagcccgctgaggacgagtgggggaaaacaccagacgctatgaaagctgctatggccctggaaaagaagttaaaccaggctctcctggaccttcacgccctggggtctgccaggactgatcctcatctgtgcgactttctcgagacacactttcttgatgaggaggtcaaattaatcaaaaagatgggcgaccacctgaccaacctgcaccgacttggcggaccggaggccggactgggagaatacctctctaagggctctctgagcagcacaaccaagtcccttctttctcccgcaaccagcgaagggccattagccaagtag

SEQ ID NO: 223175 - DNA, 1272 bp, Artificial Sequence
  Description of Artificial Sequence: Synthetic coding sequence
atgagatccctcggtgctaacatggccgctgcattgcgcgctgctggtgttctactgcgagatcctctggctagctctagttggagggtgtgccagccttggcggtggaagagcggtgctgctgccgcagccgtcaccaccgagactgcacagcatgctcaaggcgcaaaacctcaggtgcagccgcagaagcgaaagcctaaaaccgggatactcatgctcaatatgggagggccagaaacactcggagatgttcatgactttcttctgcgtctttttctcgatagggacttaatgaccttacccatccaaaataagctggcaccatttatcgcaaaacggcgaacccccaaaattcaggagcaatatagacggataggcggtggatctccaatcaagatttggacctctaaacagggggagggaatggtgaaactgcttgacgagctttctcctaacacagcaccccacaaatactacattggctttcgctatgtgcaccccttgaccgaagaagccatcgaggaaatggaacgggatggacttgagagagcaatcgccttcacacaataccctcagtacagttgcagcaccacaggtagtagcctgaacgcaatctataggtactataatcaggtcggacgcaagcccacaatgaagtggagcaccattgacaggtggcccacacaccacttgctcattcagtgtttcgccgaccacatccttaaggagctggatcactttcccctggaaaagaggagcgaagtcgtcattctattctccgctcactccttacccatgagtgtcgttaaccgtggagatccctacccccaagaggttagtgccacagtgcagaaggtaatggagcgtttggaatactgcaatccttaccgattggtgtggcaaagtaaggtgggacctatgccatggctgggtcctcaaaccgacgagtctattaagggtctgtgcgagaggggcagaaaaaacattctgttggttccgatagccttcacctccgaccatattgaaacactgtatgaactggacattgaatacagccaagtcttggcaaaggaatgcggcgttgagaacatcagacgggcagaaagcctgaacgggaaccctctcttttcgaaggcacttgcagacttagtgcacagccatattcaaagcaatgagctctgcagcaaacagctcaccctgtcatgtcctctgtgcgtgaaccctgtttgccgagagacaaagtcttttttcacctctcagcagctctag

SEQ ID NO: 223176 - DNA, 1290 bp, Artificial Sequence
  Description of Artificial Sequence: Synthetic coding sequence
atgagaagtcttggagcgaacatggctgctgctttaagggcagcaggggtgctcttacgcgatcctttggctagtagctcatggcgggtatgtcagccgtggcgttggaagtccggggctgcagctgcagcagtaaccaccgagacagcccaacatgctcagggagccaaaccacaggtgcagcctcagaagcgatacgaatccaatatcaggaaacccaagactggaatccttatgctcaacatgggaggtccagagaccctgggcgatgtccacgactttctcctgaggctttttctggaccgagacctcatgaccttacctattcagaacaagctggctcccttcatagctaagcgccgtacccccaaaattcaggaacagtaccggaggattggcggtggctctcctatcaaaatctggacatcgaagcaaggcgagggaatggtgaagttgctcgatgagttgtcacccaatacggcaccacacaagtattatattgggttcaggtacgtccacccgcttaccgaggaagctattgaggagatggaacgggacggcctcgaacgggcaatagcttttacgcaatacccgcagtacagttgtagcacaactggaagcagcctgaacgctatctatcgatactacaaccaggtggggcgtaagcctacaatgaagtggagcacaattgatcggtggccgactcaccaccttctcatccagtgctttgctgaccacatcctgaaagaattggatcactttcccctggagaagcggtccgaggtcgtcatcctgttttctgcgcattcgctgcctatgtccgtggtgaataggggcgatccctacccacaagaggtatcagctactgtgcagaaggtgatggagcgcttagaatattgtaacccataccggctcgtttggcagtctaaagtgggaccgatgccatggctcgggcctcagaccgatgagtcgattaagggattatgcgagagaggtcgaaagaatatcctactggtgcccattgccttcacaagcgatcatatagagacattgtacgagctggatatcgagtactcccaagtcctggcaaaggaatgcggcgtagagaatattaggcgggctgagtccctgaacggcaatcccctattctccaaggccttggctgatttggttcactcccatattcagtccaatgagctatgcagtaaacagcttacactaagttgtcctctttgcgtaaatccggtatgtcgcgagacaaaatctttcttcactagccagcagctctag

SEQ ID NO: 223177 - DNA, 1149 bp, Artificial Sequence
  Description of Artificial Sequence: Synthetic coding sequence
atgggcctcttgctgcctctggccctgtgcatcctggtcctttgctgtggggctatgtccccccctcagctggccctcaacccgtctgccctcctttcacggggatgtaatgattctgacgtactggccgtggcaggttttgctctgagagatatcaacaaagatcggaaagatggatatgtgctgcgactcaaccgggtcaatgatgcccaggaatacaggcgaggaggattaggcagcctgttctatctcactttagacgtcctagagacggactgccacgtacttcggaaaaaggcatggcaggattgtgggatgcgaatcttcttcgagtccgtgtatgggcaatgtaaggccatcttctacatgaacaacccaagccgggtgctatatctcgccgcatataattgcaccttgcgtccagtgtcaaagaaaaagatctacatgacgtgccctgattgcccatcctccattccgaccgactcaagtaaccaccaagtgctcgaggcagcaacggagagcctggccaagtacaacaatgagaatacatctaaacagtactcgctctttaaagtcaccagagcctcctcgcagtgggtggtggggcctagttatttcgttgaatacttaatcaaggagagcccttgcactaagagtcaggcatcctcatgtagtttacaatcctccgactctgttcccgtggggttgtgcaaaggaagcctgacgcgtactcactgggaaaaatttgtatccgtcacttgtgacttctttgaatctcaggcacctgctaccggttctgaaaactctgcagtcaatcagaagcctacaaacctcccaaaggtcgaggaatcccagcaaaagaacaccccaccgaccgacagccccagtaaggctgggccacgcggatcagttcagtatttgcctgacctcgacgacaaaaactcacaggagaaggggcctcaggaggcattccccgtgcatctggatctcacaaccaatccgcagggagaaacgctcgacatatctttcctctttcttgagcctatggaagaaaagctggtggtcctacctttcccaaaggagaaggcacgaacagccgagtgtcctgggccagctcagaatgcctcccccctggtgctcccgccatag

SEQ ID NO: 223178 - DNA, 1149 bp, Artificial Sequence
  Description of Artificial Sequence: Synthetic coding sequence
atgggtttgttgctgccgttggccctctgtatcctcgtgttgtgttgcggagcgatgagccctccccaacttgctcttaacccctcagcactgctgtcccggggttgcaacgattctgacgtgttggccgtagccggtttcgctctgcgggacatcaacaaggatcggaaagatggctacgttctgaggcttaaccgagtgaacgatgctcaggaatatcgcagagggggtctcggctccctgttttacctgacattggacgtgcttgaaaccgactgccatgttttgcggaaaaaagcatggcaagactgcggcatgcggatcttcttcgagagcgtttacggtcagtgcaaggctattttctacatgaataaccccagccgcgttctgtaccttgctgcttacaactgcactctgcggccagtgagtaaaaaaaagatttacatgacatgtcccgattgcccctccagcatcccaacggatagtagtaaccaccaggtgctcgaggctgctaccgagtctctggccaaatacaacaacgagaacacctccaagcagtatagtctttttaaagtgactagggctagctctcagtgggtggtcggtccctcttattttgtcgagtatttgataaaggaatcgccttgcaccaagtctcaagcaagctcatgcagcctgcagtcatcagacagtgtgccggtgggtctgtgcaaagggagtcttactagaacacactgggagaaatttgtctccgtgacttgcgatttctttgaatcgcaagctccagccaccggatctgaaaactctgcggtgaatcagaagcccacaaacctgccaaaagtggaggagagtcaacaaaagaacactcccccaacagattcacccagcaaggccggaccgagaggatcagttcagtacctgcctgatctcgacgataagaattctcaggaaaaggggcctcaagaggcctttcccgttcacctggacttgaccacgaacccacagggcgaaaccctggatatctcattcctgtttttagagcccatggaagagaagctggtggtgcttcctttccccaaagaaaaagccagaaccgctgagtgccccggtcccgctcaaaacgccagccctctggtgctgcctccttag

SEQ ID NO: 223179 - DNA, 705 bp, Artificial Sequence
  Description of Artificial Sequence: Synthetic coding sequence
atgacttgccccgactgcccaagctctataccgacagactcatcaaaccatcaggtgctcgaagctgctacggaatccttggctaagtacaataacgagaacacttccaaacaatactccctgttcaaggtcacacgcgcttcctctcagtgggtcgtgggtcccagctactttgtcgaatacctgattaaggagtcaccgtgtaccaaatcacaggcaagctcctgcagtctgcagagttccgactctgttcctgtgggtttgtgtaagggctctctgacgagaacacattgggagaaattcgtgtctgtaacttgtgactttttcgagagtcaggcccctgctaccggatccgagaattccgccgtgaatcagaagcccacaaatctaccaaaggtggaggagagccaacagaagaacacccctccgactgactcgcctagtaaagcgggaccaagaggctctgtgcagtacctccccgacctcgacgataagaacagtcaagaaaagggtcctcaggaggcatttcccgtgcatctggacctgacaaccaacccacagggcgagacccttgacatctccttcctttttctcgagcctatggaagagaagcttgtcgtgctgccttttccaaaggagaaagcacgcactgccgaatgcccagggccagctcagaacgcttctcctcttgtgctgccgccttag

SEQ ID NO: 223180 - DNA, 717 bp, Artificial Sequence
  Description of Artificial Sequence: Synthetic coding sequence
atgaggcagtcaggcgcaagccaacctttattgatcaacatgtatctgccagacccagtgggcgacggcctcttcaaagacggtaagaatccatcctggggacccctctcgcccgcagttcagaaaggctcagggcaaatccagttatggcagtttctccttgaattactagctgaccgagcaaacgccggttgcattgcctgggagggtggtcacggtgagttcaaactgaccgatcccgatgaggtcgcgagacgctggggagaacgcaaatcaaaaccaaatatgaattatgacaaactctcaagagcgttgcggtattactacgataagaacatcatgtcaaaggttcatggaaagaggtatgcctaccggtttgactttcaaggcttggcacaggcctgccagccccctccagcacatgctcacgctgccgctgctgccgctgccgcagcggcagccgcacaagacggcgctctttacaaactccctgcaggcctcgccccactgcccttccccggactgtccaagctgaatctgatggctgcctccgctggagtggctccggctggattctcttactggcctggcccaggcccagccgctaccgctgctgccgcaactgcggcactgtacccttctccttcccttcaaccacccccaggcccatttggagctgtggctgccgcatcccatctgggcggacattaccactag

SEQ ID NO: 223181 - DNA, 1416 bp, Artificial Sequence
  Description of Artificial Sequence: Synthetic coding sequence
atggactcgtcctgtcataatgctaccaccaagatgcttgctactgcgccagcccgaggtaatatgatgtcgacttctaagccgctggcatttagcattgaaagaattatggccagaacccctgaacctaaagccctgcccgttccacacttcctgcagggagctctgccaaagggcgagcctaagcactccttgcatttgaacagtagcattccatgtatgatccccttcgtgcctgttgcttatgatacgtcacctaaggcaggagtgaccggcagtgagcctaggaaggctagtctggaagctccagcagctccagcggctgtcccttcagcccctgcatttagctgtagtgatctgctaaactgtgcactgagcctgaagggcgatctggctcgggatgcacttcctctgcagcaatataaactggtgaggccccgagtcgtaaaccactcatccttccacgccatgggggcactgtgctatctcaatcgcggagatggaccgtgtcacccagcggctggcgtcaacattcatccggtagcaagctacttcctctcatcccccctccatccccaaccaaagacatatctggccgaaagaaataaattggtggtgcccgcagtggagaagtatccaagcggagtagcctttaaggacctcagtcaggcccagttacaacactatatgaaggagtctgcacagcttctctccgagaagatagcctttaagaccagtgacttctctcgcggttcccctaacgccaaaccgaaggtgttcacatgtgaagtgttcaatgcccattacaacctaacaaggcatatgcctgtccataccggggctcgaccattcgtctgtaaagtatgcggtaagggttttaggcaggccagcactctgtgtcgccataagattatccacacccaggagaagccgcacaaatgcaatcagtgtggcaaggcttttaatcggtcatctaccctgaacactcatacacgaattcatgccggttacaagcctttcgtatgcgaattctgtggcaagggcttccatcagaaggggaattacaaaaatcataaactgacccatagcggagagaaacagtttaagtgcaacatctgtaataaggccttccaccaggtatataacctgaccttccacatgcacacccataatgacaaaaagccttttacatgtcccacttgcgggaaaggattttgtcgaaacttcgatctaaagaaacacgtccgcaaactgcacgatagcagcttaggccttgcccgtactcccgcaggggaaccaggcacggaaccgccaccacctttacctcagcaaccacccatgacactgcccccactgcagccaccccttcccacgcccggacctcttcaacctggcctccatcaaggtcaccagtag

SEQ ID NO: 223182 - DNA, 108 bp, Artificial Sequence
  Description of Artificial Sequence: Synthetic coding sequence
atggactcatcttgccataatgctaccaccaagatgcttgcgactgctcctgctaggggcaacatgatgtcgaccagcaagccactggctttcagcattgagcgatag

SEQ ID NO: 223183 - DNA, 1278 bp, Artificial Sequence
  Description of Artificial Sequence: Synthetic coding sequence
atggactcctcatgtcacaatgccactacaaaaatgttggccaccgcaccggctaggggaaatatgatgtccacttccaagccattagcatttagtatcgaacgtattatggccaggacccctgagcccaaggctctgccagttccacacttcctacagggggctctgcccaagggtgagcccaaacactctctgcacttgaatagcagcatcccttgtatgatccccttcgtgcctgtggcatacgacacctcacccaaagctggagtgactggatcagagccccgtaaggcttcattggaggcgcctgccgctcccgctgctgtgccatcggcgcctgccttcagttgctccgatctgctgaattgcgccctctctttgaaaggagatctggcaagggacgctttaccactacagcagtacaagctcccaaaaacctaccttgctgaacgcaataaattggtcgtgccagcagtggagaagtatcctagcggagtcgcctttaaagatctgagtcaggcacagttacagcactatatgaaagaatccgctcagctgctctccgaaaaaattgcttttaaaaccagcgacttttcccggggatcacccaacgcaaaaccgaaggtgtttacctgcgaagtttgtggcaaggtattcaatgcacattacaacctgacaagacacatgcccgtccacactggggctcgcccatttgtctgcaaggtttgcggcaagggattcagacaggcttcgactctgtgtcgacacaagattattcacacccaagaaaagccccataagtgcaatcagtgcggcaaagcttttaatcggtcctcaacactgaatactcacacccggattcatgctggctataaaccttttgtgtgcgagttctgtgggaagggctttcatcaaaagggaaattataagaatcataaactgactcactctggtgagaaacaattcaagtgcaatatctgtaataaagctttccaccaggtgtataacctgacatttcatatgcatacacacaatgataagaagccatttacatgccccacatgcggcaaaggtttttgccgtaattttgaccttaaaaagcacgtgcgtaagctccatgacagctctctcgggctcgcaagaacgcctgccggagaaccgggaactgaaccaccacctcctttgccgcagcagcctcccatgaccctgcctcctttgcagcctcccctgcccacgccaggtccgctgcagccaggtctacatcagggccaccaatag

SEQ ID NO: 223184 - DNA, 1428 bp, Artificial Sequence
  Description of Artificial Sequence: Synthetic coding sequence
atggattccagctgccataacgctaccacaaagatgctggctaccgcacccgctaggggaaatatgatgtccacctccaagccacttgctttctctattgaacgcatcatggcccgtacacctgaacccaaagcactgcccgtcccacactttttacagggggcacttcctaaaggtgagcccaagcactctttacacctgaactcatcgattccttgcatgatcccattcgtgcccgtggcttacgacacttcccccaaggccggagtcactggtagtgaaccacgcaaggcgtcacttgaagccccagctgctccagccgcagttccttccgctccagcattttcatgcagtgatctactcaactgcgccctgtcgctgaagggagacctagcgagagacgccctgcctttgcaacagtacaaacttgtccgaccacgcgttgtcaaccattctagcttccatgccatgggcgcactgtgctatttgaatcgcggagatgggccttgccaccctgccgctggtgtgaacatacatccagtggcatcatacttcctgtcatccccactacatcctcagcccaagacctacctggcagaaagaaacaagcttgttgtgcctgcagtggagaagtacccttccggagtcgcgtttaaagatttatcccaggcccaactgcagcactacatgaaagagtccgcgcagcttctgagcgagaagatcgccttcaagaccagtgacttctctcgcggatctccaaacgcgaagcccaaggtgtttacttgcgaagtttgcggtaaggtctttaacgcccactacaacctcacacgacatatgcccgtccacaccggcgctcgccctttcgtttgcaaggtatgcggaaaggggtttcggcaggcttccactctgtgccgccacaaaataatccatacacaagaaaaaccacataagtgtaatcagtgtggaaaagcattcaatagaagcagcacacttaatacacatacacgtattcacgctggctataaaccattcgtttgcgaattttgtgggaagggatttcaccagaaaggaaactataagaatcacaagctcacacacagtggagaaaagcagttcaaatgtaatatttgtaacaaggctttccatcaggtatacaatctgacatttcatatgcatacccacaatgataagaaacccttcacttgcccaacttgtggtaaaggattctgccggaacttcgacctgaagaaacatgttcgcaaattgcatgattccagccttggcctggctagaactccagccggagagcctggcaccgaacctcctcccccactccctcagcagccaccaatgactctgccgcctctgcagccgccacttcccacacccggacctctccagccaggtctgcaccaaggtcatcaatag

SEQ ID NO: 223185 - DNA, 1380 bp, Artificial Sequence
  Description of Artificial Sequence: Synthetic coding sequence
atggcttcatctgcctcactggaaactatggttccaccagcttgccctcgagctggcgcttctcctgccacctccaagacacttgccttctcaatcgagcggattatggctaaaaccagcgaacccagggccccttttgagccgcgtcccggagccctggaggccgacggatctcaaggcaaaaaattactcaatctatgtagccccctgccctgtatgatcccactccaaccactggggtatgaagtgcctagcaaaacacttttgtcttattctgaactgtggaagtcaagcctacgcgctggtgggggagggggaggtggcggaggcggaggaggaggcggtggcggtgcaccggtatgcggtgccagcggcttatgtaaaaccaattgcggtgtttgctgtaaagctgagcttggcctggccccatcggcactgcccgctggaagagtgataaaacctcaggttatcaaccaggctgtcggactgccagcctctgggtctctctactactttaactacctcgacagcaccgcctaccctccttccgagttactgtctggtcaccttttcccctcaggactgctgaatgcccaggcccctgccgcactcgccgctcacccaaaattgttcctgctcgagaatgctaagcttgctggactggctgccgacaaattcccacacccggcaccctatccacataaggagcgcctgccagcccctcttgagcaggtgttgaaagagaattccgccctgactgcagaaagaggcggagtaaaaggtcattctaagctccctgggggaagtgcagacggcaagccgaagaactttacctgcgaggtttgtggcaaagtgtttaatgcccactacaatctgactagacatatgccagtgcacaccggcgcacgaccttttgtgtgtaaagtctgtggcaagggctttaggcaagcaagtaccctctgccgtcataagatcattcatacccaggaaaagccacataaatgtaatcagtgtggaaaggcctttaacaggtcgtctacattaaatactcacattaggattcacgcaggttacaagccctttgtctgtgagttttgcggaaagggctttcaccagaagggcaattataagaatcacaagttaactcatagtggcgaaaagcagtacaagtgcaccatctgcaacaaagcctttcatcaggtctacaacctcacattccatatgcacactcacaatgacaaaaagccgttcacatgcgccacatgcgggaaggggttctgtcgtaatttcgacctgaaaaaacacgtcagaaagctgcatgatagcgtgggtccggcagccccatcagccaaagatcttacccgaactgtacagagctag

SEQ ID NO: 223186 - DNA, 1380 bp, Artificial Sequence
  Description of Artificial Sequence: Synthetic coding sequence
atggcgtcttccgcctcgctggaaacaatggtccctccagcctgtccacgagcaggagccagcccggcaacttcaaagacactggctttctccatcgaaagaatcatggctaaaactagtgaaccaagagccccttttgaaccacgcccaggcgctttggaggccgatggcagccagggaaagaagctgttaaatctctgcagcccgcttccatgtatgattccactgcagcctctcggctatgaggtcccatcaaagacgctactcagttacagtgagctgtggaaaagcagcctgagggcaggcggaggtggcggaggcggaggtggaggaggcggtggcggagggggagctcccgtctgtggggcttcaggactgtgtaaaaccaattgtggagtctgttgcaaagccgaattaggtctcgccccaagcgcgctccctgccggacgcgtgatcaaaccccaagtgatcaaccaggctgtgggactgcccgcaagtggctccctatactacttcaattacctagatagcacagcctaccccccttcggaactgctgagtggtcatctatttccttctggcctgttaaatgcacaggcaccagccgcattagctgcccaccccaaactctttctattggaaaatgctaaactcgcgggtttggcggcagacaaatttccccatcccgcaccttatccgcataaagaacgactgcctgctccactggagcaagtgctcaaagagaactctgcactaacggcggagaggggaggtgtcaaaggccatagcaaactgccaggcggatctgccgatggtaagcccaaaaactttacctgcgaagtgtgtggcaaggtctttaacgcccactataatctgacccgccacatgccagttcacaccggggctaggccattcgtgtgcaaggtatgcggtaaaggcttccggcaggcctccacactttgtcgccataaaataatccatacccaggaaaagcctcataaatgcaatcagtgtggcaaggccttcaacaggagttccacactcaacacccacatacgcattcacgctggatacaagcccttcgtttgcgagttctgcgggaaagggtttcaccagaaaggaaattataaaaatcacaaactcacacattcaggcgaaaaacagtataagtgtactatatgtaacaaggcctttcatcaggtgtataatctgactttccacatgcacacccataacgacaagaaaccattcacctgcgcaacttgtggcaaaggtttctgcagaaacttcgacttgaaaaaacacgttagaaaattacacgatagcgttggcccagccgcacccagcgcgaaggatttgactaggacggttcagtcttag

SEQ ID NO: 223187 - DNA, 1380 bp, Artificial Sequence
  Description of Artificial Sequence: Synthetic coding sequence
atggcctctagtgcttccctagagactatggttccaccggcttgccctagggccggtgcttcccctgctacttctaagactttagctttctctatagaaaggatcatggcgaagacttctgaaccacgcgcaccgttcgagccaagacctggagcgctggaggccgacggatcgcaggggaaaaaactcctgaatttatgtagtccccttccttgtatgatccccctgcagccgctcggttacgaagtgccgagcaaaaccctcctgagctactcggaactgtggaagtcttccctgcgagccggtggaggtggtggcggtggcggaggaggtggagggggaggtggcggtgccccagtgtgcggggcttcaggcctgtgcaaaaccaattgcggggtctgctgcaaggcggaactgggcctagcaccatccgctctacccgcaggcagagtcatcaagccccaggtgataaatcaggccgtgggactcccggcttccggaagcctctactactttaactacctcgactccactgcttacccgcctagcgaactgctgagcggacacttgttcccaagtggcctcctgaacgcacaggccccagctgcgctcgccgctcaccccaagctgttcctgcttgaaaacgcaaaactggctggcctggcagcagacaagttcccacaccccgctccctacccacataaggagaggctccctgcgcctctggagcaagtgctgaaagaaaattcagcactgacggccgagcggggtggggtcaagggccactctaagctgcctggaggtagcgccgacgggaaacctaagaactttacttgtgaagtttgtggcaaagtgtttaacgcccactacaatctgacacgccacatgcccgttcataccggagcacggccattcgtgtgcaaggtctgcggaaaaggctttcgccaagcatccacactgtgccgtcacaagatcattcatactcaggagaagcctcacaagtgcaaccagtgcgggaaggccttcaaccggagctctaccctgaacacacacatcagaattcatgctggatataaaccattcgtgtgcgagttctgcggcaagggcttccatcagaagggaaattacaagaatcataagctcacgcactccggagagaaacaatataagtgtacgatctgtaacaaagcattccaccaagtttacaatctgacgttccacatgcacactcacaatgacaagaaaccgtttacctgcgcaacctgcggcaagggattttgccgcaattttgacctgaagaagcatgttcgtaagctgcacgacagcgttggcccagcggctccctcagccaaggacttaacgaggaccgtccaaagttag

SEQ ID NO: 223188 - DNA, 1140 bp, Artificial Sequence
  Description of Artificial Sequence: Synthetic coding sequence
atggccgctacggccgctgcggtggtagctgaagaggatacggaacttagggatctgctggttcaaacacttgagaattctggagtcctgaatcgcatcaaggctgagctgagagccgctgtcttcttggccctggaggagcaggaaaaggtggagaacaaaacgcctctggtgaacgagtctctgaaaaaatttctgaatacgaaagacgggagactggtggcttctctggtggcggagtttttgcagttttttaacctggattttaccctcgccgttttccaaccagagacctccacgctgcaaggcttggaaggacgtgaaaacctggctagggacctgggaataatcgaggccgagggcacagtaggcggtcctcttctgctggaggtgattcggaggtgccagcaaaaggagaaggggcctactacaggcgagggggcattagacctgagcgacgtccattcaccccctaagagtccagaggggaagacttctgcacaaactactcccagtaagaaagcaaacgacgaggctaatcagagtgacacttcagtgtccctctccgaacctaaaagcaaaagctcactgcacttgctcagtcatgaaaccaaaataggtagtttcctatctaaccgtaccctagacggtaaagacaaagctggcctctgtccggatgaagacgacatggaaggcgacagcttcttcgatgacccaatcccaaaaccagagaaaacttacgggctgaggaaagaaccacgaaaacaggccggaagccttgctagcctgtcagatgcccctccccttaaaagcgggttgtctagcctggccggagctccttcccttaaagactccgagtccaagagaggcaacaccgtgcttaaagacctgaagctaatttcagataagataggctcactcggcctgggaaccggcgaggatgacgactacgtagatgattttaactccacatcacaccgtagcgaaaaatctgaaatttccatcggagaggaaattgaagaggacttgagcgtcgaaatcgatgacattaacactagcgataagctagatgatttaactcaggacctgacagtgtctcagctatccgacgtggccgactacctggaggacgtggcgtag

SEQ ID NO: 223189 - DNA, 1200 bp, Artificial Sequence
  Description of Artificial Sequence: Synthetic coding sequence
atggcagccacggctgccgcagttgtggccgaagaggatactgaactgcgggatctgctggtgcagaccctggagaattctggcgtgttgaaccggatcaaggccgagttgcgggctgccgtgttcctggctcttgaggagcaagaaaaagtggagaacaagacgcctctggtaaatgagtcgttgaagaagttcctgaataccaaggacggacgcctcgtggcctctctggtcgccgagtttcttcagttcttcaacctcgacttcacgctggcagtgttccaacctgaaacttctaccctgcagggtttagaagggagggagaacctggccagagatctgggtatcatcgaagctgaaggtaccgtgggcggacccctacttctcgaagtgattaggcgttgtcagcagaaggagaaaggccctacgacaggagaaggcgctttagatctcagcgacgtccattcacccccaaagtccccagaggggaagacttcagctcagaccaccccctcgaagattcccaggtacaagggacagggtaaaaagaagacatctggacagaaggctggggataaaaaggcgaacgacgaagcaaaccaatcagacaccagcgtctccctgtctgagccaaaaagtaagtccagtttgcatttgttgtctcatgagaccaagataggttcatttctgtctaatcggaccctggacggaaaagacaaggctggactctgccccgatgaagacgatatggaaggagactctttctttgacgaccccatacctaaacctgaaaagacatatggattacgtaaagagccacgtaagcaggccggatccctcgcgagtctgtccgatgctcctcctttaaagtctggactctcctcattggcgggagctccttcattgaaggattccgaatctaagcgtggcaacactgtgctcaaggatctgaaattgattagcgacaaaattggcagtctgggcctggggacaggggaagacgacgactatgtggacgactttaattctacatcgcatcggtcagagaagagcgagatctccatcggcgaagaaatcgaggaggatctgtcagtggagattgatgacattaatacttccgataagctcgacgacttaacacaggatctgactgtgagtcagctgtctgacgtggccgactacctagaggacgtggcatag

SEQ ID NO: 223190 - DNA, 1095 bp, Artificial Sequence
  Description of Artificial Sequence: Synthetic coding sequence
atggctgccactgcagccgcagtggtggcagaagaggacacagaactacgggatttgctcgtgcagactctagagaactctggtgtgcttaatcgtataaaggcagagctccgagccgcagtgttcctcgctcttgaggaacaggaaaaggtcgagaacaagaccccgctcgtcaatgaatctctcaaaaagttcctcaataccaaggatggaagacttgttgcctccttagtggccgaattcttgcagttttttaatctcgattttacactagccgtatttcagccggagacatcaaccttgcaaggtttggaagggagggagaacctggcccgagatctgggaatcattgaagcagagggcacagtgggaggacccttgctactagaggtgatccgaagatgtcagcagaaagaaaaaggccctactactggtgaaaaagccaatgatgaggccaatcagtcagataccagtgtgagcctgtccgagccgaaatccaaatcttccctgcacctgcttagccatgagaccaagattgggtccttcctttcaaaccggacactggacggaaaagacaaggctggactttgtcctgacgaagatgacatggagggagacagcttctttgacgatcccatccccaagccagagaagacatatggcctgcggaaagagccgagaaaacaggccggtagtctggcatcgttgtccgatgcgcctcccctgaaaagtggcttgtcttcattagcaggcgcacccagcctgaaagattcggaatccaagagaggcaataccgttttaaaggatctgaagttgatttcggataaaattggtagtctgggactggggaccggggaagatgacgactacgtagacgattttaatagcacctcacaccgtagtgagaaaagtgagatatctattggcgaagagatcgaggaggaccttagcgttgagatcgacgatattaatacttcggacaagacgattactcagcttgaatgtctcctctccatcggagccctgcattttaaaaacaccgcagacattttcaaagtgatcttcatcctactcaacaagatcctcccaatctag

SEQ ID NO: 223191 - DNA, 420 bp, Artificial Sequence
  Description of Artificial Sequence: Synthetic coding sequence
atgagttctcttcctgtcccatataagctgcctgtctctttgagcgtgggatcttgcgtaatcatcaaaggaactccaatccattcatttatcaacgaccctcagctgcaggttgacttttacacagacatggatgaggattcggatattgctttccggtttagagtccattttggaaaccacgttgtcatgaaccgcagagagttcgggatatggatgctggaggaaaccaccgactacgtaccttttgaagacggtaagcagttcgaactgtgtatctacgtccactataacgaatatgagattaaagtgaatggcatccggatctacggctttgtccaccgtatccctccatcattcgttaagatggtgcaagtgagccgagatattagtttaacctctgtctgcgtgtgcaattag

SEQ ID NO: 223192 - DNA, 8615 bp, Artificial Sequence
  Description of Artificial Sequence: Synthetic coding sequence
atgcgcagagggaggctgttggaaattgctttagggttcactgtgctgctggcctcttatacgtcccatggcgcagacgcgaatcttgaggccggtaatgttaaagagactagagcttcccgcgctaaacgtcgcggtgggggaggacacgacgcccttaagggacctaacgtgtgtggcagcagatacaatgcttactgctgccctgggtggaagacactgccgggtggcaatcagtgcatcgtccctatttgccgtcacagctgcggcgacggtttttgcagtagaccgaatatgtgcacctgcccctccggacaaatcgctccatcatgtggatcccgcagtatccagcattgtaacatccggtgcatgaacgggggaagctgttctgatgatcactgtttatgtcagaaggggtatatcggaacacactgcggccaacctgtatgtgagtccggctgcctaaacgggggtcggtgcgttgctcctaaccggtgcgcttgcacctatggattcactggtccccagtgcgagcgggactatcgcacaggaccctgtttcaccgttatcagtaaccaaatgtgccaagggcaattaagtggaattgtgtgtaccaagaccctgtgctgcgccaccgtgggtagagcctggggacacccatgtgagatgtgccccgcacagccccatccctgcagaaggggtttcattcctaacatacggactggagcttgccaagatgtcgacgagtgtcaagcaatccccggactgtgccaggggggaaattgtattaacacagtggggagtttcgagtgcaagtgtccggctggccataagttaaatgaggtgtcccagaagtgcgaggatattgatgaatgcagcaccattccaggtatttgtgaggggggtgagtgtaccaacaccgtgagctcatacttttgtaaatgtcccccaggcttttacacaagtcccgatggtaccagatgtatagatgttcgccctgggtattgctacacagcactcaccaacggtagatgtagcaaccagttgccccagagtatcaccaaaatgcagtgctgttgtgacgcgggaaggtgttggtctcccggagtcaccgtggcaccagaaatgtgtcccatccgggcaactgaggattttaataaattgtgttccgtgccaatggtgatcccgggtaggcccgagtatcccccacccccactcggacctattcctccggtgctgcccgttcctccagggtttccccctggacctcagatcccagtgcctcgacctccggtcgaatatctctatccttcacgggagcccccacgggtgctacccgtgaacgtcacagactattgccagctggtcagatacctatgccaaaatggaagatgcatcccgactccaggctcttgtagatgtgagtgcaataaaggctttcaacttgacttgcggggtgagtgtatcgatgtggacgaatgtgagaaaaatccctgcgcagggggtgaatgtattaacaaccagggtagttacacctgtcagtgcagggccggataccagagcaccctgaccaggacagagtgtcgggatatagacgagtgtctacaaaatggccgaatctgcaacaacggaaggtgcattaatactgacgggagctttcactgtgtatgtaatgcagggtttcatgtgacaagggacggaaaaaactgtgaggacatggacgaatgctcaatcaggaatatgtgcctgaatggaatgtgcattaacgaggacggttcctttaaatgcatttgcaagcccggtttccagctggcctctgacggtcgttattgtaaggacatcaatgagtgtgaaactccgggtatttgtatgaacggtcgttgtgtgaataccgacgggtcctatagatgtgagtgttttccaggtctggccgtcggcttggatggcagagtgtgcgtggacacccacatgagatccacatgttacgggggatacaagcggggacaatgtattaaacctctttttggcgcagtgacaaagtcagaatgctgttgtgcaagcactgagtacgcgtttggcgaaccatgccagccatgtccggctcagaattccgcggaataccaggccctgtgcagctccggcccaggaatgaccagtgcaggcagcgatatcaacgaatgcgccctggatcctgacatctgccctaatgggatttgtgagaacctgagaggaacctataagtgcatatgcaactccggttatgaggtagattcgactggaaaaaattgtgtcgatattaacgaatgtgtgctcaacagtttgctgtgtgataatgggcagtgccgcaatactcccggttcctttgtgtgcacatgtcccaagggattcatttataaaccagatctgaagacatgcgaagatattgatgaatgcgaatctagtccatgcatcaacggggtctgcaagaacagtccaggaagtttcatctgcgagtgctcttcagaaagcaccttagatcctacgaagaccatttgcattgagaccattaaggggacatgctggcagactgtcatagatggtcggtgcgagattaacattaacggtgccactctgaagagccagtgctgctcctctctgggcgctgcatggggctcaccatgcacactctgccaggtggatcccatttgtggcaagggctatagccggattaaaggtacccagtgtgaagacatcgatgaatgcgaggtgtttccaggcgtgtgtaaaaatggactgtgtgtaaatacccgtggcagttttaagtgtcaatgcccttcgggcatgacactcgatgccaccgggcgtatttgtctggacattaggttggaaacctgttttttgcgctacgaggatgaagaatgcacgctccccatcgccggacgccacaggatggatgcttgttgctgtagcgtaggagccgcatggggtaccgaggaatgcgaagagtgtccgatgaggaataccccagagtacgaggaactttgcccaagaggcccaggttttgcaacgaaggagatcaccaatggaaaacctttcttcaaagacattaatgaatgcaaaatgatcccgagcctttgtacccacggaaaatgccggaacacaatcgggagcttcaaatgtcggtgcgactccggatttgccctggacagcgaggaaaggaactgcaccgatatcgatgagtgccgcataagcccagatctctgtgggaggggtcaatgtgtgaatactcccggtgatttcgagtgtaaatgcgacgaggggtacgaaagtgggttcatgatgatgaagaactgtatggacattgatgagtgccagcgcgatccgctcttgtgccggggaggggtgtgccacaacaccgagggcagctacaggtgcgagtgtcctccaggtcaccagttgagccctaacatctcagcctgcattgacatcaatgaatgcgaactctctgcacatctgtgtcctaatggccgatgcgtaaacctcattggaaagtatcagtgtgcgtgtaacccaggctatcattcaacccccgatcggctgttctgcgtggacatcgacgagtgtagtattatgaatggcggttgcgaaactttctgtacaaattccgaaggttcttacgaatgttcttgtcagcccggattcgccctgatgcccgatcaacgcagctgtacggatatcgacgagtgcgaggacaatcctaatatttgcgatgggggtcagtgcactaatatcccaggggaatatagatgtctttgctacgacgggtttatggcaagtgaggatatgaaaacctgcgtagatgtgaacgaatgtgacctcaacccaaatatctgcctcagcggaacttgcgagaacacgaaagggtctttcatttgtcactgtgatatgggctactccggcaaaaagggaaagactgggtgcactgacatcaacgaatgcgagattggcgctcacaattgcggtaaacacgcagtctgcaccaatactgcaggcagttttaaatgcagctgttctcccggatggattggcgacggaattaagtgcaccgacctggacgagtgctcaaatggaacccacatgtgtagccagcatgcagactgcaaaaatactatgggatcttatcgatgcctgtgcaaagaaggatacacaggtgacggatttacatgtactgatctggacgagtgttcagagaatttaaatctgtgcggcaatggacaatgcctgaatgctccaggcggatatcgatgcgagtgcgacatgggttttgtgccgagtgcggacggcaaggcttgtgaagatatcgacgagtgcagccttcctaacatctgcgtgtttggaacttgccacaacctccccggactgtttcggtgtgagtgcgaaatcggctacgagctggatagatccggagggaattgtacagacgtgaatgaatgcctagatcccacaacatgcatttcagggaattgcgtaaacacccccggttcttacatatgtgactgcccacctgacttcgagctgaatccaaccagggtggggtgtgtcgatacccgctctggcaactgctatctggacatcaggcctcggggagacaatggagacacagcctgtagcaacgaaatcggcgtgggggtgtctaaagcctcttgttgttgcagcctaggcaaggcctggggtaccccttgtgaaatgtgtccagcggtgaacactagcgaatacaagattctgtgcccgggaggggagggtttcaggccgaatccaattacggtcattcttgaagacatcgacgagtgccaagaactccctggcctatgtcagggaggaaagtgcatcaatactttcgggagtttccagtgtcgatgccctactggttactatctgaatgaagacacaagagtttgtgatgatgttaacgaatgcgagacccccggaatatgtgggcctgggacatgctacaacactgtgggtaattacacctgtatctgcccccctgactacatgcaggtgaacggaggtaataactgcatggacatgagacgcagtctgtgttacaggaactattatgctgataatcagacttgcgacggcgagctcctgtttaacatgactaagaaaatgtgctgttgcagttacaacatcggcagggcctggaacaagccttgcgagcaatgtccaatcccatccacggatgagttcgcaaccctttgtgggtcacagaggcccggttttgttatagacatctacaccgggctccccgttgatattgacgagtgtagggagatccctggagtgtgcgagaatggggtctgcatcaacatggtgggttcttttcggtgcgagtgccctgtcggcttcttctacaacgataaactcttggtgtgtgaagatatagacgagtgccagaacgggccagtgtgtcagaggaatgcagaatgcatcaacaccgccggttcataccggtgcgattgcaaacctgggtaccggttcacttccaccgggcagtgcaacgaccggaacgagtgccaggagatccctaacatttgtagtcacggacaatgtatcgacacagtgggtagcttctattgtttatgtcacacaggattcaaaacaaacgacgaccagaccatgtgtttggacatcaacgagtgcgaacgggatgcttgtggcaatggaacttgtcggaatactatcggatcatttaattgtcgctgcaaccatggcttcatactgtcgcataataacgattgtattgacgtcgatgagtgtgcatccgggaacggaaacctctgtagaaacggacagtgcatcaacactgtgggctcctttcagtgccaatgtaacgaggggtacgaagtggcgcctgacggtagaacttgtgtcgatatcaatgaatgccttctcgagccaaggaagtgtgcccctggaacctgccagaacctcgatggatcctacagatgcatttgtccacccggatatagtctgcagaatgagaaatgtgaggatattgatgaatgtgtggaggaacctgagatctgtgcattgggaacctgcagtaacactgagggttcctttaaatgcctgtgtcccgaaggattcagtctcagcagctctggaagaaggtgccaggatctccggatgtcctactgctacgcaaaatttgagggaggaaaatgtagttcaccaaaaagccggaaccatagtaagcaggagtgctgttgtgcgctgaaaggcgaagggtggggtgacccctgcgaactatgcccaaccgagcccgacgaagcctttcgtcagatatgcccctatgggtctggtataatcgttggcccagatgattctgccgttgatatggatgagtgcaaagagcctgatgtctgtaagcatgggcagtgcattaataccgacggctcatacaggtgtgagtgcccattcggatacattttagccggaaatgagtgcgtcgacaccgacgagtgcagtgtggggaatccttgcgggaacgggacctgcaaaaatgtaattgggggttttgaatgtacatgtgaagagggcttcgagccagggcctatgatgacctgtgaagacatcaatgagtgtgcacagaacccccttctctgcgcattcaggtgtgtgaatacttatggtagctacgaatgcaaatgtccggtaggctatgtgctgcgagaggatcggcgtatgtgcaaggacgaggatgaatgcgaagagggcaaacatgactgtaccgaaaagcaaatggagtgcaagaatctgatcgggacatacatgtgcatctgcggccctggctatcagagaagacccgacggtgaaggctgcgtggatgagaacgaatgtcaaactaagccgggtatctgcgaaaatggcagatgtctgaacacccggggttcatatacttgcgagtgtaatgatgggtttactgccagtcctaatcaggacgaatgcctggataatcgggagggctattgctttaccgaagtgctgcagaacatgtgccagatcggcagttccaacagaaacccggttaccaagtcagagtgctgttgtgacggaggacggggttggggccctcactgtgagatttgtccttttcagggcaccgtcgcttttaaaaagttgtgccctcatgggagaggattcatgacaaatggtgccgacattgatgagtgcaaagtgattcatgatgtgtgccggaatggggagtgtgtgaacgacagaggttcatatcattgcatctgcaaaacaggttacaccccagatattacaggaacatcctgcgtcgatctgaatgaatgtaaccaggcccctaagccgtgcaactttatctgtaagaataccgaaggctcttatcagtgttcatgtcccaaggggtacatactgcaagaggacggacggtcctgtaaggacctagatgaatgtgccactaaacagcacaattgccaatttctgtgcgtgaacacgatcgggggttttacctgcaaatgccctcctgggtttacccagcaccatacctcctgtatcgacaacaatgaatgcacatccgacattaatctgtgtgggtccaaaggcatctgccaaaataccccaggttctttcacatgtgaatgccagaggggcttttctctagatcagactggtagcagttgtgaagatgttgacgagtgcgagggcaaccatagatgtcaacacggctgccagaatattattggtgggtataggtgctcttgtccccagggatatttgcagcactatcagtggaaccaatgcgtggatgaaaacgagtgcctttcagcccacatctgcggcggtgcctcctgccataacactctgggttcttacaaatgcatgtgtcccgctggcttccaatatgaacagttctcagggggatgtcaagacataaacgaatgtggcagcgctcaagcaccatgttcttacggctgttctaacacggaaggtggctatctgtgtgggtgtccccctgggtatttcagaattggccaaggacactgtgtgtctggtatgggcatgggtcggggaaaccctgagccccctgtctctggcgagatggacgacaacagcctctcacctgaggcgtgttatgaatgtaaaattaatggatatcccaaaaggggacgaaagcggcgaagcaccaatgagacagacgccagcaatatcgaggatcagtccgaaaccgaagctaacgtttcccttgccagctgggatgtggaaaaaacagccatctttgcttttaacatctcccatgttagcaataaggtccgcatcttagagcttctccccgctctcacaactctgacaaaccacaatcgctacttaatcgagtctggaaacgaagacgggtttttcaaaattaatcagaaagagggaatcagctacttacactttacaaaaaaaaagcctgtagcaggaacctattcacttcaaatctcgagcactcctctgtataagaagaaagagcttaaccagttagaggataaatatgacaaggactatctgtccggggaattgggggataacctcaagatgaaaatccaggtactactgcacta

SEQ ID NO: 223193 - DNA, 2958 bp, Artificial Sequence
  Description of Artificial Sequence: Synthetic coding sequence
atggggtttgtgcctagcgccgatggcaaggcatgcgaagacattgatgaatgtagtctgcccaacatatgcgtgttcggaacttgtcacaacttgcctggtctatttagatgcgagtgcgagattgggtacgaacttgatcgcagtggaggcaactgtactgacgtgaatgaatgtttagaccctacaacctgcatctcaggaaactgcgtgaacacacccggatcttatatctgcgattgcccgcctgacttcgaacttaaccccacccgcgtgggttgcgtggatactcggtcgggtaattgctatctggacatccgaccgcgtggcgataatggtgacacagcttgctctaacgaaataggcgttggcgtctctaaagctagttgctgttgttccctgggcaaggcatggggcaccccttgcgaaatgtgccctgcagtcaacacctccgagtacaaaattctgtgtcctggtggggaaggattcaggcctaacccgataactgtcattctggaggatattgatgaatgtcaggagctgcctggcctgtgtcagggagggaagtgcatcaatacatttggctccttccaatgtaggtgccctaccggatactacctcaacgaagatacacgcgtgtgcgacgacgtcaatgagtgcgaaaccccaggcatctgcggcccaggcacgtgttataacaccgtgggcaactatacctgtatatgtcctcccgattatatgcaggtcaatgggggaaacaattgcatggatatgcgtcggtcactgtgctatcgcaattactatgctgacaaccagacctgcgacggggaacttctgttcaatatgaccaaaaaaatgtgttgttgcagttacaacataggtagagcctggaacaagccttgtgagcaatgtcccatacctagcacagacgagttcgcgacactttgtggttcacaacgaccaggctttgtaattgatatttacacaggtctgcctgtagatatcgatgaatgccgcgagattccaggcgtatgtgagaatggagtttgtataaatatggtgggatcttttcggtgtgaatgcccagtgggattcttttacaacgacaagctgctggtgtgtgaggatatcgacgaatgccagaacgggcctgtgtgccagagaaacgccgaatgtataaatacggccggatcttaccgctgtgattgcaaaccaggttaccggttcacttccacgggccagtgcaatgatcgcaatgaatgtcaagaaatccctaacatttgttctcacggacagtgcattgatacagtcggctctttctattgtctgtgccatacagggttcaagaccaatgacgaccagactatgtgcctggatattaatgagtgtgagagggacgcctgcggtaatggcacttgccggaataccattggctccttcaattgtaggtgcaaccatggtttcattctctctcacaataatgattgtatagacgtggacgagtgcgcgtccgggaacgggaacctttgtcggaacggccagtgtataaatactgttggaagttttcaatgtcagtgtaacgaaggctacgaggtggctcccgacggacgtacatgcgttgacatcaacgaatgcctcctggagcctagaaagtgtgcccctggcacatgccaaaacctggatggaagctaccgctgcatatgccctccagggtacagtctgcagaacgaaaaatgcgaagatatcgatgaatgcgttgaggagcccgaaatatgcgccctgggtacttgtagcaataccgaggggagtttcaaatgcttatgtccagagggattttcactgtcatcttctggtcgtagatgccaggatcttagaatgtcctattgttacgctaaattcgaaggaggcaaatgctctagtcctaagagcagaaaccatagcaagcaggagtgctgctgcgccctgaaaggggaggggtggggagatccctgcgagctttgcccaacagagcctgacgaagccttcagacaaatctgcccatatggctcaggtattattgttggtccagatgactccgcggtggatatggacgagtgtaaagagcccgacgtttgtaagcatgggcagtgcataaataccgatgggtcataccgctgcgagtgcccctttggctatattcttgcagggaatgagtgtgtcgatactgacgagtgctctgtaggtaacccatgcggcaatgggacctgtaaaaatgtgatcgggggtttcgagtgtacttgtgaggaagggtttgagcccggtccaatgatgacgtgtgaggacatcaacgagtgcgcacaaaaccctctcctatgcgcttttcgctgtgtgaacacgtacggtagctacgagtgcaagtgccctgtaggatatgtcctccgggaggatagaagaatgtgcaaagatgaggacgagtgcgaggagggtaagcacgactgtacggaaaagcaaatggagtgcaagaacctgattggaacttacatgtgcatatgtgggcctggataccagagacgcccagatggagagggttgtgttgatgagaacgagtgtcagaccaagcccggaatctgcgagaatggcagatgtttgaacacccggggatcctacacctgtgagtgtaatgacgggtttacagcctccccgaatcaggatgagtgcctcgacgtgatcctcagcctgctactccttagcccggctttcccctcatgctttttctccccaagaaccatcgggaagggaaccgcctcacagagatgctataaaacatgcgtgcgctcagctcccgcaacaggcacaccatctcccaaccgcaacgctgctgtcacggagggtgaggcgggtgtgccgactgtccgtagtgcacttagtcggggattgtggctttcaaggaattcagtgccaatggccgaggatagttag

SEQ ID NO: 223194 - DNA, 3450 bp, Artificial Sequence
  Description of Artificial Sequence: Synthetic coding sequence
atgaggcgaggacgcctgcttgaaatcgctttaggatttacagtgctgctggcctcctacaccagccatggggcagatgccaacctggaagccggtaatgtcaaagagaccagggctagccgggctaaacgcagaggtggcggagggcacgatgcactcaagggtcccaacgtatgcggctcccgatacaacgcctattgttgccctgggtggaaaacgctccccggtggcaatcagtgcattgtccctatctgtcggcattcctgtggagatggattttgctcgcgccctaacatgtgtacctgtccttccggccagattgcaccaagttgcggatcgaggagcattcagcactgcaatattaggtgtatgaacggagggtcttgttcagatgatcactgtctttgccagaagggatatatcgggacacattgtggtcagccagtatgcgagtccggttgcctcaatggcggaaggtgtgtcgctcctaacaggtgtgcatgtacatacggcttcaccggccctcagtgcgagcgggattaccgtacaggcccttgtttcacggtaattagcaatcaaatgtgccaagggcagctttcaggtattgtctgtacaaagaccctctgttgcacatacattaatgagtgcgaaatcggcgcacataactgtggaaaacacgcagtgtgtactaataccgccggatcattcaagtgcagttgctctccaggctggattggagacggaattaagtgcaccgacttggacgaatgtagtaatgggacacacatgtgctcacaacacgcagattgtaaaaatacaatgggcagctaccggtgtctgtgtaaagaagggtatacaggggatggatttacctgcacagacctcgacgagtgctcagaaaacctgaacctgtgtggtaatgggcaatgcctcaatgcacccggtggctacaggtgcgagtgtgacatgggttttgtccccagtgccgacgggaaggcttgtgaagatatcgatgagtgttccctgccaaatatttgtgtcttcgggacctgtcacaacctaccgggtctgttcaggtgtgaatgcgaaattgggtatgagctggacaggagtggtggcaactgtaccgatgtgaacgagtgcctggatcccaccacatgcatctccgggaactgtgttaacacccccggttcatatatttgcgactgcccacccgattttgagctgaatcccaccagagtgggttgtgtggacactagaagcggcaactgttacttagacataaggcccagaggcgacaacggtgataccgcctgttcaaatgagatcggagtgggagtttccaaggcctcatgttgctgctcattagggaaagcctggggcacaccttgcgagatgtgtcctgcggttaacacgtcagaatacaaaattctgtgccccggaggagaagggttccgcccaaaccctataactgtgatactagaggatattgatgagtgtcaggaactccccggactttgtcagggtggtaaatgcattaatacctttggctcctttcagtgtagatgccctaccggctattatctgaatgaagatactcgtgtgtgcgatgatgtcaatgagtgcgagactcccggaatctgcgggcctggaacctgctataacacagttggaaattatacatgtatctgccccccagattatatgcaggtcaatggcggaaataactgcatggatatgcgcaggagcttgtgctatcggaattattacgcggacaaccagacgtgtgatggcgaactcctgttcaacatgactaaaaagatgtgctgctgttcatacaacataggacgagcatggaataagccctgtgagcagtgcccgattccatctaccgatgagtttgccaccctctgtggcagtcagcgccctggatttgtgatcgatatctatacaggtttgcctgtggatatagacgagtgcagggaaatccctggcgtgtgcgaaaatggtgtgtgcatcaatatggtgggttcctttaggtgtgaatgcccagtcggattcttttataatgacaaacttctggtctgcgaagatatagacgaatgtcaaaacggtcctgtgtgtcaaaggaatgcggagtgtattaatactgctggcagttataggtgcgactgcaagccaggatataggttcacaagcactgggcaatgcaacgataggaacgagtgtcaggagattccgaacatatgttcgcacggtcagtgcatcgataccgttggaagcttctactgcttatgtcatacaggtttcaagacaaacgacgatcagacgatgtgtctggatattaatgagtgtgaaagggatgcttgtggcaatggcacttgccggaacacaatcggttccttcaattgcagatgtaaccacggcttcatattaagtcacaacaacgactgtattgatgtcgatgagtgcgcctccggaaatggtaacctttgcaggaatggccagtgtatcaacaccgtcggtagtttccagtgccagtgtaacgagggatatgaagtagctcccgatggtcgcacatgtgttgacatcaacgagtgtctcctggaacccaggaagtgcgctcccggtacatgtcagaacctcgacggcagctacaggtgcatctgtcctcctgggtatagtttgcagaatgagaagtgtgaggacatcgatgagtgtgtggaggagcccgaaatatgtgctctgggaacgtgctccaacactgaaggctcatttaagtgcctgtgtccagaaggtttctccctttctagttcgggcaggcgctgtcaggacctgaggatgtcttattgttatgccaaattcgagggagggaagtgctcttctccgaaaagccgtaaccactccaagcaggagtgctgctgcgcactcaagggagagggctggggggacccttgcgaattgtgccccacagaaccagacgaggcttttcgccagatttgcccatacggatctggcattattgtgggacctgatgatagtgccgttgacatggatgaatgtaaggaaccggatgtctgcaaacatggacagtgtatcaacacagatggtagctatcggtgcgagtgcccattcggttacatcctggctggcaacgaatgcgtggacacagatgagtgctctgttggcaacccctgtggtaacgggacatgcaagaatgtgatagggggattcgaatgtacgtgtgaggaaggattcgagcctggacctatgatgacttgcgaagatatcaatgagtgtgctcagaaccccctgttgtgcgcctttaggtgcgtgaatacctatgggtcttacgagtgcaaatgtcccgtggggtacgtactgagggaagaccgccgaatgtgcaaagatgaggacgagtgcgaggaaggtaagcatgattgcacttag

SEQ ID NO: 223195 - DNA, 8739 bp, Artificial Sequence
  Description of Artificial Sequence: Synthetic coding sequence
atgggaagacggcgacgactgtgtctccagctctattttctgtggttggggtgcgttgtgctgtgggctcagggcacagccggtcagccacaaccaccacctcctaagccccctaggccacagccaccccctcagcaggtgagatctgcgacggcgggtagcgaggggggttttctcgccccagaatacagagaagagggcgcagctgtggcttcccgggttagacgcagaggtcagcaggacgttcttcggggtcctaacgtgtgtggctctcgtttccatagttactgctgtcctggctggaagacacttccgggaggcaatcagtgtatcgtgccaatctgccgcaactcatgcggtgacggcttttgctcaaggccaaacatgtgtacctgctcttctgggcagattagctcaacatgcggttccaaaagtatccagcagtgttcagttcgctgtatgaatggaggtacctgtgcagacgatcactgccagtgtcagaaggggtatattggaacctactgtggccagccggtgtgtgagaacggctgccagaatggcggacggtgcatcggcccaaatcggtgcgcatgcgtgtacggctttacaggtccgcagtgtgagagggattacagaactggcccttgttttacacaagtaaataatcagatgtgtcagggccagctgaccggcatcgtgtgtacgaagactttatgctgtgccacaatcggacgggcatggggtcatccatgtgaaatgtgccccgctcagccgcagccctgcagacggggattcataccaaacatcagaacgggtgcctgtcaggacgtcgacgaatgtcaagctatccccggtatttgccagggtggcaattgtatcaataccgtagggagtttcgagtgccgatgcccagcaggacacaaacagtcagagacaacccagaaatgcgaagatatagacgagtgttccattattccgggaatttgcgagactggtgagtgctccaacactgttgggtcctatttttgtgtttgcccacgcggatacgtgaccagtacagacgggtctcgctgtatcgatcagagaaccggcatgtgtttctccgggctggtcaatgggagatgtgcacaggaacttcctggacgaatgaccaaaatgcaatgttgctgcgaacccggacgatgttgggggataggcacaatccccgaggcatgccccgtgcgaggatccgaagagtacaggaggctgtgcatggatggcctgccgatgggaggaatacctggtagtgccggaagccgcccaggcggaacagggggaaatggcttcgctcccagcggcaacggtaatgggtatgggcctggtggaaccggatttatccccattcctggagggaacgggttcagccccggtgtgggcggagctggcgtgggggcaggtggccaaggccctatcattacggggcttaccattctcaaccagaccatcgacatctgcaagcatcatgccaatctgtgcctcaacggccgatgtattcccaccgttagtagctatcgctgtgaatgtaacatgggctacaagcaggacgctaacggcgattgtattgatgttgacgaatgtacgtcaaacccttgcactaacggtgactgcgtgaacactcctggcagttattactgcaaatgtcacgccggattccagagaacccctacaaaacaggcttgcatagatatcgacgagtgcatccagaatggggtgctgtgcaagaatggccgttgcgtcaataccgatggaagcttccagtgtatttgcaatgccggtttcgaactgaccacggacgggaagaactgtgtggatcatgacgagtgtacaaccacaaacatgtgccttaacggcatgtgcattaacgaggatggttcgtttaaatgtatttgtaagccgggattcgtgctggcgcctaacgggaggtactgcaccgatgtcgacgaatgccagacgcctggaatctgcatgaatggacattgtatcaacagcgagggctcctttaggtgtgactgccctcctgggctggccgtggggatggatggaagggtgtgtgtggatacccacatgcgctccacctgttatggtgggattaagaaaggagtatgcgtgaggccctttccaggggctgtcacgaagtctgaatgctgttgcgctaatcccgactatgggtttggagagccttgccagccctgtcccgctaagaactccgcggaattccacggtctatgctcctcaggagtcggaataaccgtcgacggtcgagacattaacgagtgcgcacttgatcccgacatctgtgcgaacgggatatgtgaaaatcttagggggtcctaccgatgcaactgcaactctgggtacgagcccgatgcttcagggcgaaactgcatcgatatcgatgagtgcttggtaaatcgattgctctgcgacaacggcttgtgcagaaacacccctggcagctatagctgcacgtgcccccctggctatgtgtttcggacagagacggagacctgtgaagacatcaacgagtgcgagtccaatccgtgcgtgaatggtgcctgcaggaataatctgggctctttcaactgcgagtgttcacccggaagtaaattgtcctccaccgggctgatttgcatagactctctgaaagggacttgttggcttaatatccaggactcccgttgcgaagtcaacatcaacggtgcaacactcaaatcagagtgttgcgcgaccctaggtgctgcctggggctcaccttgtgagcggtgcgagcttgatacggcatgcccaagaggcctggccaggattaaaggggtgacttgcgaggatgtgaacgagtgtgaggtattccctggggtgtgccccaacggaaggtgtgtgaattccaaaggatcatttcattgtgagtgccctgaaggcctgactctggatggtaccggacgagtctgtctcgatatcaggatggagcaatgttacctgaaatgggatgaagacgagtgcattcatcctgtccccggaaagtttcgaatggatgcctgttgctgtgccgtgggcgcagcatggggaacagagtgtgaagagtgtccaaaacccggtacgaaggaatacgagactctctgccctcgcggagccggttttgccaatcggggagacgtgcttaccggacggccattctacaaggatattaatgaatgtaaggcctttcccggtatgtgtacgtacggcaaatgccgaaacactatcggctcattcaaatgtaggtgtaattccggcttcgcactggacatggaagaaaggaattgcaccgatatcgatgagtgtcggatttctcctgatctgtgtgggtcaggcatatgtgtgaacacgcctgggtccttcgagtgtgagtgctttgagggatatgagtccggattcatgatgatgaagaattgtatggatatcgatgagtgcgagcgtaatccactcctttgcaggggaggtacatgtgtgaacacagaagggagcttccagtgcgattgccctttaggacatgaacttagcccaagccgagaggactgtgttgatattaacgagtgctccctgagcgataacctatgtcgcaacggaaaatgtgtgaacatgatcggtacctatcagtgctcttgcaatccgggttatcaggcaacgcctgaccgccaaggatgcactgatatcgacgaatgtatgatcatgaacggcggatgcgatacccagtgcactaactcagagggttcgtatgagtgcagctgctccgagggctacgctttgatgcccgatgggagatcttgcgcggacatagacgaatgtgagaataaccctgacatttgcgatggcggtcagtgcacaaacatcccaggggagtatcgttgcctgtgctatgacggctttatggccagtatggatatgaaaacttgcatcgatgtcaacgaatgcgacttgaattcgaacatatgtatgttcggagagtgtgaaaatacaaagggatccttcatctgccattgtcaattgggctatagcgtgaagaaggggacaaccggctgcactgacgtggacgagtgcgagatcggcgcacataattgtgacatgcatgcatcatgcctgaatatccctggcagctttaaatgcagttgccgagagggctggattggcaatgggatcaagtgcatcgatctggatgagtgcagtaacggtacgcaccagtgctccatcaacgctcaatgcgttaatacccccggttcttatcggtgtgcttgctccgagggcttcaccggcgatggtttcacatgctctgacgtggatgagtgtgcagaaaacatcaatctttgcgaaaacggccagtgcttaaatgtacctggagcatatagatgcgagtgcgaaatgggtttcacccccgcatcggactcccgatcatgccaggacatcgacgaatgttcattccagaacatctgcgtcttcggcacctgcaataatcttcctggcatgttccactgtatttgcgatgatggctacgagttagatagaacaggtggtaactgtactgatatcgacgaatgtgctgatcccattaattgcgtgaatgggctgtgcgttaataccccgggacgttatgagtgtaattgcccccctgactttcagctcaaccccaccggtgtggggtgcgtggataatagggtagggaactgttatctgaaatttgggccaagaggggatggttccctcagctgcaacactgagatcggagtgggagtgtcccgaagctcttgttgttgttccctgggaaaagcttgggggaacccctgtgagacctgcccccctgtgaattccacggagtattatacgctgtgccccggaggtgaagggttccgcccaaacccaatcaccatcatactggaggatattgacgaatgccaagagctgcccggtctgtgtcagggtggcaattgtataaacacttttggctcgttccagtgtgaatgtcctcagggatactatctgtctgaagatacccggatttgtgaggacatagacgagtgttttgcacatccaggtgtttgtggaccaggtacgtgctacaacacactcggcaattacacctgcatctgtcccccagagtacatgcaggtcaatgggggtcataattgtatggatatgcggaaaagtttttgctaccgtagttacaacggcactacatgcgagaacgagcttccatttaacgtgactaagcgcatgtgctgctgtacctacaacgtgggaaaagcatggaacaaaccctgcgagccctgcccgactccaggaaccgcggacttcaaaactatttgtgggaatattcctgggttcacgtttgatatacacacggggaaagccgtggatattgacgagtgtaaggaaatccccggaatctgtgctaacggcgtgtgtataaatcagattgggtccttcaggtgcgagtgcccaacgggattctcctacaatgacctgctactggtgtgtgaggacatagatgaatgctccaacggcgataacctttgccagcggaacgctgactgcatcaattcaccaggatcataccggtgtgaatgcgccgcaggcttcaagctctcccctaacggcgcttgtgtcgaccgcaacgagtgcctggaaatcccaaacgtctgcagtcacggcctgtgtgtggacttacagggatcctatcaatgtatatgccacaacggctttaaggcttctcaggaccagaccatgtgtatggacgtcgacgaatgcgagcgccacccatgcgggaacgggacatgtaagaacaccgtcggatcctacaattgcctgtgttacccaggttttgagctaacccacaataatgattgtctcgatatagatgagtgctctagcttctttggccaggtgtgtcggaacggacggtgttttaatgaaatcggtagttttaaatgcctttgcaacgagggttatgagctgacaccggatggaaagaattgtatcgataccaatgagtgcgtggccctgccgggaagttgctcaccaggcacctgccaaaatctagaaggaagcttccgttgcatttgtcctcccggttacgaagtgaagagtgaaaactgtattgatatcaacgaatgcgatgaagaccccaatatttgcctgtttgggtcatgcacgaacaccccaggcggttttcagtgcctgtgtccaccaggcttcgtcctgtctgacaacgggaggcgttgcttcgatacacgacagagcttctgttttaccaacttcgaaaacgggaaatgctcagttcctaaagcattcaacactaccaaggctaagtgttgctgtagcaagatgcctggcgagggctggggcgatccatgtgagctatgcccaaaggatgacgaggtggcattccaggatctctgtccatatgggcacggtaccgttccatctctccacgatactcgcgaagatgtaaacgagtgcctggagagccccggtatctgttcaaatggccagtgcattaatacagacggaagcttccggtgcgaatgccccatgggctataacttggattataccggcgtgcgctgcgtcgataccgatgagtgctccattgggaacccatgcggcaacggcacgtgcaccaatgtgatcggttcctttgagtgtaactgcaacgagggattcgagcccggaccgatgatgaattgcgaggacattaatgagtgcgcacagaatccgcttctgtgtgcctttcgctgcatgaatacctttggcagttatgagtgtacttgccctatcggttacgccctgagagaagaccaaaagatgtgtaaagacctggatgaatgcgctgagggactgcacgattgtgagtctagggggatgatgtgcaagaaccttatcgggaccttcatgtgtatatgccccccaggtatggccaggagacctgatggggaaggatgcgtcgatgagaacgagtgcaggactaaaccaggtatttgtgaaaacggccgatgtgtaaacattataggatcctacaggtgtgagtgtaatgagggtttccagtcgagtagcagtggcaccgagtgccttgacaatagacaggggctctgcttcgctgaggtcctccaaacgatctgtcaaatggcatcatctagccgcaatctcgtcacaaaaagcgaatgctgttgcgacggtggacggggttgggggcatcagtgcgaactgtgtccgctgccaggtacagcccagtataagaaaatatgtcctcacgggcctggatataccaccgatggacgcgacatcgacgagtgtaaggttatgcctaacttgtgtaccaatggccagtgcattaataccatgggctctttccgatgtttctgtaaggtcggatacaccaccgatatttcaggaacatcttgcatcgatctcgatgaatgttcacagagtcccaaaccttgcaattatatttgcaaaaataccgagggaagttaccagtgctcctgcccacgaggctacgtgctgcaagaagacggtaaaacgtgtaaagatcttgacgagtgtcagactaaacaacacaactgccagtttctttgcgtgaacacactggggggtttcacatgtaagtgccctcccggattcactcagcatcacaccgcctgcatagataataatgagtgtgggtcccaaccttccctctgcggggctaaaggaatttgccaaaacactcccggaagcttcagctgtgagtgtcagagaggctttagcctcgatgcaacagggttaaactgcgaagacgttgacgaatgtgatggcaaccaccgctgtcagcatggttgtcagaacatcctggggggataccgctgcggatgcccacaaggatacatacagcattaccagtggaatcagtgtgtagacgagaatgagtgcagcaatccaaatgcatgtgggtccgcctcctgttataatactctcgggtcctataagtgtgcgtgtccttccggtttctcttttgaccagttctcttccgcgtgccacgatgttaacgagtgttcttcgagcaaaaatccctgcaattacggctgtagcaacacagagggcggttatctgtgcggatgtccacctgggtattaccgagtcgggcagggacactgcgtcagcgggatgggattcaataaaggtcagtacctgagtctagatacagaggttgatgaagagaatgctctgtcaccagaagcgtgctacgagtgcaagatcaatggttatagcaagaaagactcccgacagaaaaggagtattcacgaaccagatcccaccgccgtcgaacagatttcccttgagagcgtggacatggattcacccgtaaacatgaaatttaacctgtctcatcttggttccaaggagcatatcctcgagctccggccagccatacagcccctgaataaccacataagatacgtgataagccagggcaacgacgattcagtgtttcggattcaccagcgaaatgggctgagttacctccacactgcaaagaaaaaactaatgcccggtacatacacactggagataacctccatccccctgtacaagaaaaaggagctgaagaaattggaggagagcaatgaggatgattatctcctcggagagctgggggaggccctacgcatgcgtctgcagattcagctttactat

SEQ ID NO: 223196 - DNA, 8738 bp, Artificial Sequence
  Description of Artificial Sequence: Synthetic coding sequence
atgggcaggaggcgacgtctgtgcctccagctctattttctatggctgggttgcgtggtcttgtgggcccagggcactgcaggccagcctcagcctccccctcctaaacccccaagacctcaaccgcctccccagcaggtccggagcgcaacagctggttcagagggtgggtttctggcgcctgaatatcgggaagaaggcgcagctgtggctagccgtgtacgacggagaggtcagcaggacgtgttgaggggcccaaacgtgtgtggaagcagattccatagctactgctgccccggatggaagaccctcccaggcggaaaccaatgcattgtgcctatttgcaggaatagttgtggagatggattttgttcccggcctaatatgtgcacatgctcatctggccagatcagttccacttgcggtagtaagtccatccagcaatgcagtgtccggtgcatgaacgggggaacatgcgccgacgaccactgtcagtgccagaaaggctacatcggaacttactgtggccagcccgtatgtgagaatggctgccagaacggcggacggtgtatcgggcctaaccggtgcgcctgtgtctatggttttaccggccctcagtgtgagagagactaccgcacgggtccctgcttcacgcaggtgaataatcagatgtgccaggggcagttgacgggcatcgtttgtaccaaaaccttatgttgtgccacgattggcagagcctggggacacccttgcgaaatgtgccccgctcagccccagccatgccggaggggattcatcccaaacatccgcactggcgcatgtcaggatgtggacgaatgtcaggctatcccgggtatttgtcagggaggcaattgtatcaatactgtggggtcttttgaatgtcgatgccctgcagggcataagcaaagcgaaaccacccaaaaatgcgaggacatcgatgagtgctcaataatcccaggcatctgtgaaaccggggaatgcagcaataccgtagggtcttatttttgcgtctgccccaggggatatgttaccagcactgatggcagcaggtgtattgatcagcgtactggaatgtgcttttctggactggttaacgggcgatgtgcgcaagaactccctggaagaatgacaaaaatgcagtgttgttgcgaaccagggaggtgttgggggatcggtacgattcctgaagcctgtccagtgaggggcagcgaggaatacagaagattgtgtatggatggcctccctatgggcggtattcccggttccgcaggttcaaggccgggtgggacagggggtaacggatttgccccatccggcaacggcaacggttatggacccggaggcacgggctttatcccgatcccgggtggcaacgggttcagccccggagtcggcggtgctggcgtcggtgccggagggcagggtccgatcattaccgggctgactattctgaaccagaccatagacatctgtaaacaccacgctaatttatgtctgaatggacgctgcataccgactgtgtcatcataccggtgtgaatgtaacatggggtataagcaagacgcaaacggtgactgcattgatgtagacgagtgtactagtaacccctgtacaaacggtgattgcgtgaacacacccggatcctactactgtaagtgtcacgcgggatttcagaggacacctacgaagcaggcatgcatcgacattgatgagtgcattcaaaatggcgtgctctgcaaaaatggcaggtgcgtgaacaccgatggatcatttcagtgtatatgtaacgctggtttcgagttaacaaccgatggaaagaactgtgtggaccacgacgagtgcacaactacaaacatgtgtctaaatggcatgtgcattaatgaggacggtagctttaaatgcatctgtaagccaggatttgtgctggccccaaatggccgatattgcaccgacgtggacgagtgccagactccagggatttgcatgaacggtcactgcataaacagcgagggctcctttagatgtgactgcccgccaggcttggcagtcggaatggatggacgtgtctgcgtggacactcacatgcgctccacttgctatggcggaattaagaaaggcgtttgtgtaagaccttttcctggagccgttactaaaagcgagtgctgctgcgcgaatcctgactacgggttcggggaaccgtgccagccgtgccctgcgaagaacagtgccgaatttcacggcttatgtagctccggcgtggggatcactgtcgacggaagggacataaatgaatgtgccctcgacccagatatatgcgccaatggaatctgcgaaaacctgcggggatcttatcgttgcaattgtaacagcggatatgaacccgacgcctccggaagaaattgcatcgacatcgatgaatgtcttgtcaaccgcctattatgtgacaatggactgtgccggaacacacctggctcttactcctgtacttgccctcctggttacgtgtttcgcactgagaccgaaacatgtgaggacattaatgagtgcgagtctaatccctgcgttaatggagcctgcagaaacaaccttggaagtttcaattgtgaatgttctccagggagcaaactctctagcacaggcctcatctgcatcgatagcctgaaaggtacatgttggctgaatatccaagactcgcggtgtgaggtgaacatcaacggggctacactgaagagcgagtgctgtgctactttaggcgctgcctggggatctccctgtgaacgatgtgaactggataccgcatgtccacgaggccttgcacgtatcaaaggcgtcacatgcgaggacgtgaacgaatgtgaggtcttcccgggagtgtgtcccaacggaagatgtgtgaactcaaaaggatcattccattgtgagtgcccagagggcctgaccctcgacggaactggcagggtctgcctggatatccggatggaacagtgctaccttaaatgggacgaggatgagtgcatccatcccgtccctggcaaattcagaatggatgcctgttgctgcgccgtcggcgcagcatgggggacagaatgcgaggaatgtccgaagcctgggacgaaggagtatgagaccttgtgcccccgtggcgctggatttgctaaccgcggagatgtgctcactggacgcccattttacaaggatatcaacgagtgcaaagcttttccagggatgtgtacgtatgggaagtgtcgaaatacaattggcagctttaaatgccggtgtaactcgggattcgcgctagacatggaagagagaaactgtacagacattgatgagtgccgcatttctccggatctgtgcgggtcagggatttgcgttaacacacctggctcttttgaatgcgaatgctttgagggctacgagtctggctttatgatgatgaagaactgcatggacatcgatgagtgtgagagaaacccacttttatgtcgcggaggtacttgcgtgaacactgaagggtccttccagtgcgactgcccattaggccatgagctatcccctagcagggaagactgcgtggacataaacgagtgttcgctctctgataacttgtgcagaaatgggaaatgcgtgaacatgatcggtacctaccagtgctcatgtaaccccggataccaggccactcccgaccgacaagggtgcaccgatattgatgagtgcatgattatgaatggcggttgtgacacacagtgcactaatagcgaaggctcttacgagtgcagctgttctgagggctacgctttgatgccggatggcaggagctgcgctgacatcgacgagtgcgagaacaacccggacatttgtgacggcggtcagtgtaccaatatccctggggagtacagatgtctgtgttacgatggcttcatggcctcgatggatatgaagacttgcatcgatgtgaacgagtgcgatctcaactctaacatttgtatgtttggggaatgcgagaacaccaagggctcattcatctgtcactgccaactcggctattccgtgaagaagggaacgactgggtgcaccgatgtggatgaatgtgagattggcgcacataattgtgacatgcacgcatcttgcctcaacattccaggcagctttaagtgcagttgtagagagggatggataggcaatgggatcaagtgtatcgaccttgacgagtgtagcaacggcacccaccagtgttctatcaatgcacaatgtgttaacacgcctgggagctacaggtgcgcgtgctctgaaggctttacaggcgatggcttcacctgtagtgatgttgacgaatgcgccgagaacattaatctgtgtgagaatgggcagtgcctgaatgtacccggtgcgtatcggtgtgaatgcgaaatgggttttacaccagcctctgactcacggtcatgtcaagatattgatgagtgcagctttcagaacatttgcgtgttcggcacctgtaacaatcttcccggaatgttccactgcatatgcgacgacggatacgaattggaccgcacaggagggaactgcaccgacatcgacgaatgcgccgatccaattaactgtgtgaatggcctgtgcgtgaatactccagggcgatacgagtgcaattgtcctcccgacttccaactgaatcccactggcgtgggttgtgtcgataatagagtggggaattgttatctgaaatttggtccgcgtggagacgggtcactgagttgcaacactgagattggagtgggtgtgtctagatcttcttgttgttgtagcctcgggaaagcatgggggaacccttgtgaaacgtgtccccctgttaacagtacggagtactacaccttgtgtcctggtggcgaaggattccgccctaacccgattaccatcatcttggaggatattgatgaatgccaggaactgcctgggctctgccaaggcggaaattgtatcaacaccttcggctcattccaatgtgagtgcccacagggctattatctgagtgaagatacaagaatttgcgaagatattgacgagtgtttcgcccatcctggtgtctgtggaccgggaacatgctacaatacccttggcaattacacatgcatttgccctcccgaatacatgcaagtgaatgggggtcacaactgtatggacatgcggaagtcattttgctatcgttcctacaatgggactacctgtgaaaacgaactgccctttaacgtgaccaagcgaatgtgctgctgtacttacaatgtcggaaaggcatggaacaagccctgcgaaccatgtcctacccccggaaccgcggatttcaaaaccatttgcggaaatattccagggtttacattcgacattcacacggggaaggctgtcgacattgatgaatgtaaggaaatcccaggaatttgtgctaatggcgtgtgtattaaccagattggtagtttccgttgtgagtgtccaacaggcttctcatacaacgatctgttgctcgtatgcgaggatatagacgagtgctcaaatggcgacaatctttgtcagagaaacgccgattgcattaattctcctgggtcctatcggtgcgagtgtgctgctggttttaagcttagccccaatggtgcctgcgttgatcgaaacgagtgcctggaaataccgaacgtttgttcccatggattatgtgttgatctccagggctcataccagtgcatttgccataacggcttcaaagctagtcaggaccagaccatgtgtatggacgtggacgaatgtgagcgccatccctgtgggaacgggacctgtaaaaacacggtgggcagttacaattgcctgtgttacccaggtttcgaactgacacacaacaatgactgtctagatatcgacgagtgttcatctttctttgggcaggtttgtagaaatgggaggtgtttcaacgagatcggctcctttaagtgtctgtgtaatgaggggtacgaacttactcctgacggcaaaaattgcatcgataccaacgagtgcgtagcactgccaggctcctgtagtcccggtacttgtcaaaacctggaaggcagcttccgttgcatttgtccccctggctatgaagtgaagagtgaaaattgtatcgatataaacgagtgtgacgaagatccaaacatctgtctcttcggttcctgtactaacacccctgggggatttcagtgcctctgccccccaggctttgtgctaagtgacaatggcagaagatgtttcgatacaagacaatcattttgctttacaaacttcgaaaatggtaagtgctcagtgcctaaggcatttaacactaccaaggctaagtgctgttgtagcaagatgcccggagaaggatggggggatccatgcgaactgtgtccgaaagacgatgaagtcgcctttcaggacttgtgcccatatggacacggaaccgttccatccctgcacgatactcgggaggacgttaacgagtgcctagaatctcctgggatatgtagcaacgggcagtgcattaacaccgatggctccttccgctgcgagtgccctatgggttacaacctggactacaccggagtgcgctgcgtggacaccgacgagtgctccatcgggaacccctgtggcaatggtacttgtaccaatgtgataggctcttttgagtgcaactgcaatgaggggtttgagccaggtccaatgatgaactgtgaagacattaatgagtgtgctcagaaccctctactctgtgcctttcgatgtatgaacaccttcggctcctatgagtgcacttgtccaattggctatgcattgagagaagatcagaagatgtgtaaagaccttgacgaatgcgctgaaggcttacatgactgcgaatcccgcggaatgatgtgtaagaatctgataggtaccttcatgtgcatctgccccccaggaatggcccgaaggccggatggcgaaggttgtgtggacgagaacgaatgccggaccaaacccggtatctgtgaaaatggtcggtgtgtgaatatcatcggctcctacagatgcgaatgtaacgaagggtttcaaagtagctccagtggaacagaatgcctcgacaaccgtcagggcctgtgctttgccgaagtccttcagaccatctgccagatggcatcctcaagcaggaatctggtgacgaagtctgaatgttgctgtgatggtgggaggggatggggacatcaatgcgagctgtgtcctctgccaggcacagctcagtacaaaaagatttgccctcatggacccggatatactaccgatggaagagatattgatgagtgcaaagtgatgccaaatctgtgtaccaacggccaatgtatcaacaccatggggagcttcaggtgcttttgtaaggtcgggtacaccaccgacatttccggcacgtcatgcattgacctggacgaatgttcacagtcccccaagccatgtaattatatttgcaaaaataccgagggctcttaccagtgtagctgtcctcgtggctatgtcctgcaagaagatggcaagacctgcaaagacctggacgagtgtcaaaccaagcaacataattgccaattcctatgcgtcaacaccctgggaggctttacatgcaagtgcccccctggctttacccagcaccataccgcgtgtatcgataacaatgagtgtgggagccaaccgagcctttgcggcgcaaagggcatatgtcagaatacccccggatcattctcctgtgagtgtcaacgcggattcagtctggatgccacaggcctgaactgtgaagacgtggatgaatgtgatgggaatcacaggtgccagcatggttgccagaacatcttaggcggatatcggtgcggttgtccccagggatatattcagcactatcaatggaatcagtgcgtggacgagaatgaatgttcaaatccgaacgcttgcggaagcgctagctgttacaataccttaggctcatacaagtgcgcctgtccatcggggttctctttcgatcaattttccagtgcctgccatgacgtgaacgaatgcagttcttcgaaaaatccatgtaattacggctgctcgaacactgaaggtggctacctgtgtggttgtcctccaggctattatagggtgggtcagggccactgcgtctcaggaatgggcttcaacaagggacagtacctttccctggatactgaagttgacgaagaaaacgccctgtccccagaagcatgctacgaatgtaaaatcaatggctattctaaaaaggatagcagacaaaaaaggtcaatccacgaaccggacccaactgctgtggagcagatttctcttgagagtgtggacatggatagcccagtgaacatgaagtttaacctaagccacttgggcagcaaggaacacatactagaactgcgccctgcaattcagccactcaacaaccacatcaggtacgtcatcagccaggggaatgatgattcagtgtttcgcattcaccagcgcaatggcctcagctacctgcatacggctaagaaaaaattgatgccgggaacctacacccttgagatcacttccatcccactgtataagaaaaaggaacttaagaagttggaagagtcaaacgaagacgactacctgctgggagagctgggagaggccctaaggatgaggctgcagatacagctatatta

SEQ ID NO: 223197 - DNA, 597 bp, Artificial Sequence
  Description of Artificial Sequence: Synthetic coding sequence
atgggactgcggaaaggacacgggaccctcggacagggtctgagtgcgctgcaatccgaacaaggcaggcttatccaactcttgtccgagtctcaaggtcatatggcccatttggtcaactccgttagtgatatccttgacgctctacagcgcgacagaggattgggacggcctcgcaataaagctgaccttcagagagccccagcccgtgggacccgacccaggggctgtgccactgggtcacgtccacgcgactgtctcgacgtcctcctatctgggcagcaagacgatggcgtatactctgttttccctactcactaccctgccggatttcaggtgtattgtgatatgcgcacagacggcggtggctggaccgtctttcagaggcgcgaagatggtagtgtgaattttttcagaggatgggacgcttatagggacggcttcggcaggcttaccggggagcattggctcggcccattagactggtgcactctgtctctcgcgttactggtgcctgtggctccaagccccactcctccgcacagtttcgttaacgtcctgcatccgccagtgcctggaggacctaccctgcagtag

SEQ ID NO: 223198 - DNA, 912 bp, Artificial Sequence
  Description of Artificial Sequence: Synthetic coding sequence
atgggtttgcgcaaggggcacggcacgctggggcagggactgtctgcgctgcaatctgagcaaggacggctcatccagctgctgtcagaatcccaaggccacatggctcaccttgtgaactccgtgtcagatatcctagatgctctgcagcgcgacaggggcctgggaaggcccaggaataaggctgatcttcaacgggcaccagcgaggggtacacgtcctagaggatgtgctactgggtcccggccaagggactgtctggacgttctactgtctggccagcaggacgacggtgtctatagtgtgttccctacgcattaccctgcgggattccaggtctattgtgacatgagaacagacggaggtggatggaccgtgtttcagaggagagaggacggaagtgtgaacttcttcagaggctgggatgcttacagagacggctttggcagactcacaggcgagcattggcttgggctgaagcgaatccatgcattgacaacacaggcagcgtacgaactgcacgttgatctcgaagacttcgagaatggaacagcctatgcccgttacggtagcttcggggtgggcttatttagcgtcgaccccgaggaagatgggtatcccctcactgtggccgattattctggcaccgccggagactcacttcttaagcactctggtatgagattcaccacgaaggacagggatagcgaccactccgagaataactgcgccgcattttataggggagcttggtggtacaggaattgccatactagcaaccttaacgggcaatacttgcgtggggctcatgctagctacgccgacggtgttgagtggagctcctggactggatggcagtacagcctgaaattcagcgaaatgaagatccgaccagtgcgggaagatagatag

SEQ ID NO: 223199 - DNA, 1386 bp, Artificial Sequence
  Description of Artificial Sequence: Synthetic coding sequence
atggtgaacgatcgttggaagaccatgggcggtgctgcccaacttgaagatcggccacgggataaaccacaaaggccatcttgcggctacgtcctatgcaccgttctgttggcactcgctgtgctactggctgttgccgtcactggggctgtcctcttcctcaaccacgcccatgctcctggcactgcccctcctccagttgtgtcaacgggcgcagccagcgccaactccgccctagtaaccgtggagagggcagattcttcacacctgagcatccttattgatcccagatgccccgatctgacagacagtttcgcaagattggaaagtgcacaagcgagcgtcctccaggcgcttactgaacatcaagcacagcccagactggtgggcgatcaggaacaggaattgctcgatacacttgccgatcagcttccaaggttgctggcaagggcgagcgaacttcagaccgagtgtatggggttgcgcaaaggccacggcacccttgggcagggcctctcggcactgcaatcagaacaggggagactcatccaactcctctcagagtcgcagggccacatggcccacctcgtgaattccgtctccgacatcctcgatgccttacagcgcgatagagggctgggcagacctaggaacaaggctgacctccagagagcaccggctcgcggaacaagacccaggggatgcgctacagggtctaggcccagagactgtttggatgtcctgctttcaggacaacaggatgacggcgtttatagcgtctttcccacgcattatccggcagggtttcaagtgtattgtgatatgagaacagacggcggaggctggacggtttttcaaagaagagaggatggatccgtcaacttctttcgcggatgggacgcgtatcgagacggctttggacgcctgactggtgaacactggctggggctcaagcggatccacgctctcacaacacaggcagcttatgagctccatgtggatctggaggactttgaaaatggaacggcctacgcacggtatgggtcttttggggtaggactttttagcgttgacccagaggaggatgggtacccattgaccgtcgccgactactctggcaccgccggagattctcttcttaagcacagcggcatgagattcaccactaaggaccgcgacagcgaccacagtgaaaataactgcgccgcattctaccggggagcatggtggtatcgaaattgtcatacctccaatttgaacggccagtaccttcgcggagcgcacgccagctacgccgatggagttgagtggtcatcttggaccggatggcagtactctctgaaattttcagagatgaaaatcaggccggtccgggaagacagatag

SEQ ID NO: 223200 - DNA, 933 bp, Artificial Sequence
  Description of Artificial Sequence: Synthetic coding sequence
tgaactggcgcagttctgtttctgaaccacgcccacgcccctggtactgcccctccacctgtcgtgtccacaggagccgcatcagctaactcagcattagtcactgtggaaagggccgattcttcacatttatctatcttgattgatcccagatgtcctgatttgacagacagcttcgccagactcgaatccgcccaggcttccgtcctgcaggccttaacggaacaccaggcacaaccgcgactcgtaggcgatcaagagcaggaattgttggataccctagctgatcagctacctagactgttggctcgagctagcgaactgcagaccgagtgtatgggtctgcgtaaaggacatgggactcttggccagggactctccgccttacagtctgagcagggaagactgatccaattgttaagcgagtcccaaggccacatggcacacttggtgaactccgtgtctgatattcttgacgccctgcagagagacaggggcctcggtcgccctcggaacaaagcagatctgcagagagctcccgcacgaggaactagacccaggggttgcgctacaggctccagaccgagagactgtctggacgttctcttaagtggacagcaagatgatggtgtatacagcgtcttcccaacccattatcccgcagggttccaggtgtattgtgacatgaggactgacgggggaggatggactgtgttccaaaggagagaggacggctccgtaaacttttttagagggtgggacgcttatcgcgacgggtttggaaggttgacaggagaacactggctaggtccattggattggtgtacactgagcctcgccctgctggtcccggtggccccttcccctacgccaccgcactcctttgttaatgtgctacatccacctgtccctggcggaccaaccttgcaatag

SEQ ID NO: 223201 - DNA, 1386 bp, Artificial Sequence
  Description of Artificial Sequence: Synthetic coding sequence
atggtcaatgaccggtggaagactatgggcggagcagcccagcttgaggatagacctagagataagccacagcgcccaagctgcggctatgtattatgtacagtgctgcttgccttagcagttctcctagccgtggccgtcacaggggctgtcctgtttctcaaccacgcccacgcacctggcacagcaccacccccagtggtgagcacgggtgccgcttcggccaacagtgcactggttacagtcgaacgcgctgactcgagccacctctccattcttatcgacccgaggtgtccagacctcaccgacagctttgccagactggagtctgctcaggcatcagtcctacaggcattaacggaacatcaagcccagccacggctcgtgggagaccaggaacaggaattgttggacactctagcagatcagctgccaagactgctggccagagccagtgaactccagacagaatgcatgggtctgagaaaaggccatggcacgcttggccagggactctctgccctccagagcgagcaaggcagacttatccagttgctgtctgagagtcagggtcatatggcccaccttgtcaacagcgtgagcgatatcctggacgcgttgcaacgggacagagggctgggacgtcctcggaacaaggcagacctgcagagagccccagcccgaggaaccaggccaaggggctgcgcaacaggcagccgccctcgcgactgtctcgatgtgctcctgtctggccagcaggatgacggcgtttactccgtttttcccacccactacccagccggatttcaagtctattgcgatatgcgaactgatggaggtgggtggacagtgtttcagagacgagaagacgggtcagttaatttctttagggggtgggatgcctaccgcgatgggtttggaaggctgaccggggagcactggctcggtcttaagcgcattcacgccctgactactcaggcagcttacgaactgcacgtggacttggaggacttcgagaatggaaccgcatacgcgagatacgggagttttggggtgggtcttttcagcgtggaccccgaagaggacggataccctctcaccgtggccgattacagtggcaccgccggagacagcctactgaagcattctggcatgcgctttaccacgaaggatcgcgacagcgatcacagtgagaataactgcgccgctttctatcgcggagcatggtggtatcgtaattgccacactagtaatctcaatggccagtatctgaggggagcccacgcgtcctatgctgatggagtggagtggagctcctggacggggtggcagtactctttgaagttctcagagatgaagatcagacccgttagagaggaccgttag

SEQ ID NO: 223202 - DNA, 870 bp, Artificial Sequence
  Description of Artificial Sequence: Synthetic coding sequence
atggtgaatgatcggtggaaaaccatgggaggagccgctcagctggaggatcggcctagagacaagccgcagcgaccctcttgcggctacgtgctgtgcaccgtactacttgctctcgccgtgctgcttgcagtggccgtgacaggagctgtactgtttctgaaccatgctcatgcccctggcacagctcctccaccggttgttagcactggcgcagcttccgcgaatagcgctctcgttacagtagagcgcgctgactcctcacacctgagcatcctgatagatccccgatgtcctgacttgaccgactcattcgcgaggctcgaatcagcccaagcttctgtcctccaggccctcaccgagcatcaagcacagccccgtcttgtaggagaccaggaacaggaactcctcgatactctggccgatcagcttccgagattgttagccagagcctccgaacttcagacagagtgtatgggcctgcggaaaggccatggcactttgggccaggggttaagcgccctgcaaagtgagcagggtaggctaatacaattactctccgagagccaggggcatatggcccatttggtgaacagtgtgtccgatattctcgacgcgttacagagggatagagggctgggcagacctcggaataaggccgacttgcagcgggctcccgctagggggacacgaccccgtggatgcgctactgggtctcgaccacgggattgcctagacgttctgttatccgggcaacaggacgatggcgtatattccgtatttccgacccattatcctgcgggattccaggtgtattgcgacatgcgcacagacggcggaggttggaccgtgttccagcgcagggaatag

SEQ ID NO: 223203 - DNA, 540 bp, Artificial Sequence
  Description of Artificial Sequence: Synthetic coding sequence
atggtgaacgaccggtggaaaactatggggggagccgctcagcttgaggatcggcctcgcgacaagccccaggctcgtaagctgcgattaagagagaggccaagttgtggttacgttctctgtacggtgctgctagccctggccgtgctgctggctgtggcagtgactggtgctgtcttattcctgaaccacgcacacgcgccagggaccgcccctccacctgtcgtgtctaccggcgcagcaagcgccaattcagctctcgtgacggttgagagagccgattccagtcatctcagcattctgatagacccgagatgtccagatctgacagactcgttcgctcgactggaatccgcccaagccagcgtcctccaagcactgaccgaacatcaggcgcaacctcggctcgtgggcgaccaggagcaggagctgctcgacacattggccgatcagcttccacgcctgctggctagagccagtgaattgcagaccgaatgcatgggtctccggaagggtcatggcactcttggtcagggatag

SEQ ID NO: 223204 - DNA, 1170 bp, Artificial Sequence
  Description of Artificial Sequence: Synthetic coding sequence
atgaggagagtgactctctttctgaacggctctccaaagaacgggaaagtggtagccgtgtatggcactcttagcgacttgctgtccgtagcgtcttccaagttggggatcaaggcaactagcgtttataacgggaaggggggtttgatcgatgacatcgcactaatcagagacgacgacgtcttgtttgtctgcgagggtgaaccattcattgacccacagactgattccaaacccccagagggcctgctcgggttccacacggactggctgaccctcaatgtaggtggcaggtatttcacaactactcggtcaactctggtaaacaaggaaccagattccatgttagctcatatgttcaaggacaagggcgtgtggggaaacaaacaggatcacagaggtgcttttctcatcgaccgctcacctgagtacttcgaacccatcctcaactaccttaggcacggccaactgatcgtcaatgatggtattaacctcttgggagtcctggaagaggccagattcttcggcatcgactctctgatagaacacttggaggtcgcgattaaaaactcccaaccacctgaggatcatagtcctatatccaggaaagaatttgtcagattcctgcttgccacaccgactaaaagtgaactgaggtgtcaagggctgaacttctcaggggcagacctgagtcggctagatttacgctatattaatttcaaaatggcaaatctgagccgttgtaaccttgcgcatgccaatctctgttgtgccaatttggaaagggccgacctttctggttccgtgctggattgtgctaatttgcagggggttaaaatgctttgttcgaatgctgagggagctagtcttaaattgtgcaattttgaagacccttccgggctgaaagccaacctggagggtgctaacttaaagggcgtagacatggaggggtctcagatgacaggcataaatctccgcgtggctaccctgaagaacgcaaagctgaagaattgtaatctgcgtggagccacactggctggaacagacctagaaaactgtgacctcagcggatgcgacctgcaagaggcaaacttgcgaggatcaaacgtgaagggggcaatctttgaggagatgctcaccccactgcacatgtcacagtctgtgaggtag

SEQ ID NO: 223205 - DNA, 939 bp, Artificial Sequence
  Description of Artificial Sequence: Synthetic coding sequence
atggcgaaggtttttagtttcatcctcgtcacaacggcattgaccatgggaagggagatctctgcgcttgaagattgcgcccaggaacagatgagactgcgagcacaggttcggctcctcgagaccagggtgaaacagcagcaagtcaagatcaaacaactgctccaggagaacgaggtccaattcctcgacaagggggacgagaataccgtcatcgatctggggtccaagaggcagtatgctgattgctccgagattttcaacgacggctacaagctcagtggattctataaaattaaaccacttcagagtccagctgagtttagtgtctactgcgatatgagcgatggcggaggctggactgtaattcaacgaagatcagacggctccgagaacttcaatcgcggatggaaagattacgaaaatggctttggcaatttcgtgcagaaacatggtgagtactggctgggcaataaaaatttgcattttctgacaacgcaggaggattacactctcaaaatcgatttggcagatttcgaaaaaaattcaaggtacgctcaatacaaaaacttcaaggtcggcgacgagaagaatttctacgaactgaacattggcgaatactccggcacagcaggggacagtctggccggtaacttccacccagaggtgcaatggtgggccagccaccagagaatgaagtttagcacctgggaccgagatcacgataactacgagggcaactgtgctgaagaggaccagtcaggttggtggttcaacaggtgtcattctgccaatttgaacggcgtctactatagcgggccatacaccgcaaagacagataatggcattgtgtggtatacttggcacggctggtggtactctctcaaatccgtcgtgatgaagattcggccaaacgatttcattcccaacgtcatctag

SEQ ID NO: 223206 - DNA, 939 bp, Artificial Sequence
  Description of Artificial Sequence: Synthetic coding sequence
atggccaaggtctttagctttattctggtgacaacagccctgactatgggcagagagatatcagcattagaagattgtgcccaggagcagatgcggttgcgcgctcaagtgcggctcttggagacacgcgtgaagcagcagcaggtgaaaataaaacagctgttacaggaaaatgaagtccagtttctggataaaggcgatgagaatactgtgattgatctggggtcgaaaaggcagtatgcagattgctcagagattttcaacgatgggtacaaattgagcggcttctataaaatcaaacccctccagtctccagcagagttctccgtatactgcgacatgtctgacggcggaggatggactgtcattcagaggcggtcggacggcagcgaaaatttcaacagagggtggaaggactacgagaatggcttcgggaatttcgtgcagaagcacggtgagtattggcttgggaacaagaacctgcacttcttgacgactcaagaagactacactttgaaaattgacttagccgatttcgaaaaaaattctcggtatgcacagtataagaatttcaaggtcggggacgaaaagaatttttatgagctaaacatcggggagtacagtggcacagctggtgactctctcgcgggaaactttcaccctgaggtccagtggtgggcttcccatcagagaatgaaattcagtacatgggacagagaccacgacaactacgaaggcaattgcgcggaagaggaccaatccggatggtggtttaatcgatgccatagcgccaatttaaatggagtgtactactcaggaccctataccgccaagaccgacaacggcattgtgtggtatacatggcatgggtggtggtactcactcaaaagcgtggtcatgaaaattcgccctaacgactttattccgaatgtaatttag

SEQ ID NO: 223207 - DNA, 939 bp, Artificial Sequence
  Description of Artificial Sequence: Synthetic coding sequence
atggccaaggtattcagtttcatactggtaactaccgcattaaccatgggcagagagatcagcgcactcgaagactgcgctcaggagcagatgagacttcgcgctcaagtacgtctcctggaaacccgcgtgaaacaacagcaggtaaaaatcaaacagttgctccaggagaatgaagtgcagtttctggacaagggcgatgagaataccgtgatagaccttggatcaaaacgccagtatgccgactgctccgaaatcttcaatgatggatacaagcttagcggcttctacaaaataaagccactgcagtccccggcagaattcagcgtttattgcgacatgagcgacggagggggttggaccgtcatacaacgcaggtcggatggaagcgagaattttaaccggggatggaaagactatgaaaatgggtttggcaactttgttcaaaaacatggggagtactggctgggaaataaaaatctccatttcctgacaacgcaggaagactacacattaaagatagatctggccgactttgaaaagaactctaggtacgcccagtataagaatttcaaggtgggtgacgaaaaaaacttttatgaactaaacatcggtgaatatagtggaactgctggcgattctttagcaggcaactttcaccccgaggtgcagtggtgggcttcccatcaaaggatgaagttctcaacctgggaccgcgaccatgataattacgagggcaactgtgccgaggaggatcagagcgggtggtggtttaaccgttgccattccgccaatttgaacggggtatactactccgggccatacactgccaagaccgataatggaattgtctggtacacttggcacggatggtggtacagtctcaaatctgttgtgatgaagataagacctaacgacttcatccctaatgtcatttag

SEQ ID NO: 223208 - DNA, 939 bp, Artificial Sequence
  Description of Artificial Sequence: Synthetic coding sequence
atggccaaggtcttctcatttattctggtgaccactgccctcactatgggaagagagatcagtgccctagaagattgtgcacaggagcaaatgaggttaagagctcaggtccggttgttggagactagggtgaagcagcagcaggtgaagattaagcagcttctgcaggagaacgaagtgcaatttctggacaagggcgacgagaacacggttattgacctaggatccaaaagacagtatgcggattgctccgagatctttaacgacggttataaactaagtggtttctataagattaagcctttacaaagtcctgcggaattctctgtatactgtgatatgagtgatggaggaggatggacagtaatacagcgacgttctgatgggtctgaaaatttcaatagaggatggaaagattacgaaaatgggtttggaaactttgtgcaaaagcatggcgagtactggctgggcaataagaacttgcactttttgacaacccaggaagactatactctgaaaatcgacctggccgacttcgagaagaactcccggtacgcccaatataagaattttaaggtcggagacgagaagaacttttacgaacttaacatcggcgagtacagcggaaccgctggcgactccctggcaggcaactttcaccccgaggtgcagtggtgggcctctcatcaacggatgaaatttagtacatgggatagagaccacgacaattatgaagggaactgcgctgaggaggaccaaagtggctggtggttcaatcggtgccatagcgcaaatcttaacggggtgtattactcaggcccatatactgctaaaacagacaacggaattgtctggtatacctggcacgggtggtggtactctctcaagtccgtggttatgaagatccggccaaacgacttcattcccaatgtcatatag

SEQ ID NO: 223209 - DNA, 939 bp, Artificial Sequence
  Description of Artificial Sequence: Synthetic coding sequence
atggcaaaggtcttctcttttatcctggtgacaaccgctcttactatgggtcgcgagatttccgctctggaggattgtgcccaggaacagatgcggctccgcgcacaggtgagattgctcgagacgagagttaaacagcagcaggttaaaataaaacagctgctgcaagaaaacgaagtacaattcttagacaaaggcgatgagaacaccgtgatcgatctgggctctaagcgccagtacgctgactgttcagaaatcttcaacgacggatataagctctccggcttctataagatcaaacccctgcaatctcccgctgagttctccgtgtactgtgatatgtccgatggagggggttggacagtcattcagcgcagaagcgacgggagcgaaaacttcaaccgtgggtggaaagactatgaaaatggttttggcaatttcgtgcaaaagcacggcgagtactggctcggaaacaagaatctacattttctgacaacgcaggaggactatactcttaagatcgacctggccgacttcgagaagaattccaggtacgcacagtacaaaaattttaaggtgggagatgagaagaatttttatgaactcaatattggcgaatacagtggcacggctggagactctctggctggtaattttcacccagaggtgcagtggtgggcgtcacatcaacgcatgaagtttagtacatgggaccgggaccacgataattacgaaggaaattgtgcagaagaagatcaaagtggctggtggtttaataggtgccactccgcaaacttaaatggcgtgtactacagcgggccttacaccgctaaaaccgataacgggattgtgtggtacacctggcatggctggtggtactctctcaagagtgtcgtcatgaaaatccggcctaacgacttcatacccaacgtcatctag

SEQ ID NO: 223210 - DNA, 939 bp, Artificial Sequence
  Description of Artificial Sequence: Synthetic coding sequence
atggccaaagtgttcagttttatattagtgacgactgccctcacgatgggtcgcgagatctccgctcttgaagactgcgctcaggaacagatgcggctgagggcccaggtcaggctgttggaaactagagtgaaacaacagcaggttaagatcaagcagctcctccaagagaatgaggtccaatttttggataagggggacgagaatactgtgatcgatctagggtctaagaggcaatacgctgactgttctgaaatctttaatgacggctacaagctgtcgggcttctacaaaattaagccactgcagtctcctgcagagttcagtgtatactgcgacatgtctgatggagggggttggacagtcattcagcggcgaagtgacggctcagaaaactttaacagggggtggaaagattacgagaacggatttggtaacttcgtgcagaaacatggggagtactggttgggcaataagaacctgcactttctgacaacccaggaggactacactctaaagatcgatctggcggatttcgaaaagaactcaaggtatgcgcagtataagaactttaaagtgggcgacgagaaaaatttttacgaactgaacattggcgagtattccggaaccgcgggtgattctctcgcaggaaacttccatccagaggtccagtggtgggcaagtcatcagcgcatgaagttctccacatgggacagggaccatgataactatgaaggaaactgtgcggaggaggaccagagtggttggtggtttaatagatgccactcggctaacctgaacggagtatattacagcggtccctataccgccaaaaccgataacggcattgtgtggtacacgtggcacgggtggtggtactccctgaagagcgtggtgatgaaaataagaccaaacgatttcattcctaatgttatttag

SEQ ID NO: 223211 - DNA, 849 bp, Artificial Sequence
  Description of Artificial Sequence: Synthetic coding sequence
atgaggttgcgcgctcaagtgcggctgttagaaaccagggtgaaacagcaacaagttaaaatcaagcagttactgcaagaaaatgaagtccagttcttggacaagggagatgaaaatacagtgattgacttaggatctaagcggcaatatgccgattgcagtgaaatcttcaatgacggctataaactgtccgggttctacaaaataaagccacttcagagtccagctgagttctcagtgtattgcgatatgtctgacgggggtgggtggactgtgatccaacgtcgaagcgacgggagtgagaattttaaccgcggttggaaagattacgaaaatggcttcggcaatttcgtgcaaaagcatggcgaatactggcttggcaataagaacctgcattttcttacaacgcaggaggattatacacttaagatagatcttgccgattttgaaaaaaatagtaggtatgcccaatacaaaaactttaaagtgggagatgagaaaaacttctacgagctgaatattggcgagtacagtgggacggccggtgacagtctggccggaaactttcaccccgaggtacagtggtgggctagtcaccagaggatgaaattctcaacttgggatagagaccatgataattacgagggcaattgtgccgaggaagatcaatccggctggtggtttaaccgatgtcactcagctaacttaaatggcgtttactattcaggcccatacaccgcgaaaacagacaatggaattgtgtggtatacatggcacggatggtggtacagcctaaaaagtgtggttatgaagatacgcccaaatgactttatcccaaacgtaatctag

SEQ ID NO: 223212 - DNA, 939 bp, Artificial Sequence
  Description of Artificial Sequence: Synthetic coding sequence
atggcgaaagtgttttcatttatactggtgaccaccgccctgacaatggggcgtgaaattagtgcccttgaggactgtgcgcaagaacagatgcgtcttcgcgcacaggttcgactgctcgaaacccgagtcaaacagcaacaggtcaaaataaagcagctgctccaggagaatgaagtgcagtttctggacaagggggacgagaataccgtaatcgacctgggctctaagcgccagtacgccgattgttctgaaattttcaatgacggctacaagctctccggcttctataaaatcaaacccctgcaaagccctgctgagttctccgtgtactgtgatatgtcagacggtggcggttggactgtcatacagcgacggtcagacggaagcgagaactttaatagaggttggaaagactacgaaaatggcttcggtaatttcgtacagaagcacggggaatactggctgggaaataaaaacctccattttctgacaacccaggaggattacacgctaaaaatcgacctggctgactttgagaagaattccaggtatgctcagtataaaaatttcaaggtaggtgatgagaagaatttttatgagcttaacattggggagtacagtgggactgccggagattcactcgcagggaattttcatccagaagtgcaatggtgggcttcccatcagagaatgaagttttcaacctgggatcgggatcatgataattacgaaggcaactgcgccgaggaggaccagagtggttggtggttcaatagatgtcactccgctaaccttaatggagtatactatagtggaccgtatacagcgaaaactgacaatgggatcgtgtggtatacgtggcatggatggtggtattccctgaagtccgttgtgatgaaaattcgcccaaacgactttattcccaacgtgatctag

SEQ ID NO: 223213 - DNA, 1320 bp, Artificial Sequence
  Description of Artificial Sequence: Synthetic coding sequence
atgaagctcgctaattggtactggctaagctcagctgtgttggcaacctacggcttcctggtggtggccaataatgagacagaggaaatcaaggatgagcgcgctaaggatgtctgtcccgtgcgcctggaatcgcgaggtaagtgcgaagaggcgggagagtgtccctatcaagtgagcctccccccactgactatacagcttccaaagcaattttcaagaatcgaggaggtgttcaaagaggtgcagaatctgaaggagatcgtcaattctctgaagaagtcttgtcaggactgtaagctccaagctgatgataacggtgatcctggacgcaatggtctccttctgccgtccaccggcgcaccgggtgaagtaggagacaatcgcgtgagagagctggagtctgaagtgaataaacttagctctgagctaaaaaatgccaaggaagagattaacgtgctccacggacgtctggaaaagctcaacctggtgaatatgaataacattgaaaactacgtcgatagcaaagtcgccaacctcaccttcgtggtgaacagtctggacggtaagtgtagcaagtgcccaagccaagagcaaatacagagcagacccgtccagcacctgatctacaaagactgtagtgactactatgccatcgggaagagaagttcagaaacttacagagtgacacccgatcccaagaatagctcgtttgaagtgtactgcgatatggagacaatgggcggtggttggaccgttttgcaggccaggctggatggttcgaccaatttcactcgcacctggcaggactataaggccggttttggaaatctgagaagggagttctggttgggtaatgataagattcacctgctgactaaatctaaggaaatgatactgcggattgatcttgaagattttaatggagtggaactgtacgctctctacgaccagttttatgttgcgaatgaattccttaaatatagattacacgtggggaattacaacgggaccgccggagatgccctaaggttcaacaagcactacaaccacgatctaaagttttttacaactcctgataaggacaacgataggtatccttcaggcaactgcggtttgtactacagctcgggttggtggtttgacgcctgtcttagtgcaaacctcaatggaaaatactaccaccaaaagtaccggggagtccggaacggcatcttctggggcacctggcccggagtatctgaagcacacccgggtggctacaaaagctcattcaaagaggccaaaatgatgatccgtccaaaacactttaaaccctag

SEQ ID NO: 223214 - DNA, 1095 bp, Artificial Sequence
  Description of Artificial Sequence: Synthetic coding sequence
atgacctctgaacttgacatttttgtgggcaacactaccctcatcgacgaggacgtctataggctatggctggatggctattctgtcacggacgcagtggcgcttcgcgtccggtctggtatcttggaacagaccggcgcaaccgctgcagtgctccagagcgacactatggatcactatcgcacgtttcatatgctcgagagactcctccacgccccaccgaagctgctgcaccaacttatctttcagatcccaccatcccgacaggccctgctgatagagcgctactacgcgttcgatgaggcgtttgtcagagaggttctcgggaaaaagctctctaagggaaccaaaaaagatcttgatgacattagtaccaagacagggattacattaaaatcatgccggagacagtttgataattttaagcgggtattcaaagtggttgaggagatgagaggaagtttagtcgataacatccaacagcacttcctgctttctgataggctcgccagggactatgccgcaattgtgttttttgccaacaatcgatttgaaacgggaaaaaagaaattgcagtacctaagcttcggcgattttgccttttgcgcagaactcatgattcagaactggactttaggagccgtgggggaagctcccacggaccctgattcacagatggacgacatggacatggacctggacaaggagttcctgcaagatctcaaggagctaaaagtgttggtggccgataaggatttgcttgatttgcataagagcttggtgtgtacagctctcagaggtaagttgggggtattcagtgaaatggaggccaatttcaaaaatctatccaggggactcgtgaacgtcgccgctaaacttacccacaacaaggatgtacgtgatctgttcgttgatctggtggagaaattcgttgaaccctgccggagcgaccactggcccctaagtgacgtcaggttttttctgaatcagtactcggcctcagtgcactctctggatggattcaggcaccaggccttgtgggacaggtacatgggcacccttagaggatgtctgctcaggctttaccacgactag

SEQ ID NO: 223215 - DNA, 1074 bp, Artificial Sequence
  Description of Artificial Sequence: Synthetic coding sequence
atgacctctgagctggacatcttcgtgggcaacaccacactgatagatgaagacgtctacagactgtggctggacggctattcggtaacagacgcagtggccctgcgggttcggtcaggcattctcgagcagactggcgcaactgcggctgtgcttcaaagcgatactatggaccattaccgcacattccacatgctggaaaggctgctccacgctccgccaaagcttctgcatcagctgatcttccagatccccccatctaggcaggctctcctcatcgaacggtattacgcattcgatgaggcgttcgtgcgcgaagtgctggggaagaaactttcgaagggtaccaaaaaggacctggatgatattagcactaagaccggaattacgctaaagagttgccgccgacaatttgacaatttcaaacgcgtgtttaaggtcgtagaggaaatgcgcggtagccttgtggacaacatccagcagcatttcctgctgagcgacaggctggccagagattatgcagcgatcgtgttttttgcaaacaaccggtttgagaccggcaaaaagaagttgcaatatttaagcttcggggatttcgcgttctgcgccgaactgatgattcagaactggacgctcggtgccgtcgattcacagatggatgacatggatatggacctggacaaagagttcctgcaggatctcaaagaactgaaggttctagttgcagataaagaccttctcgatctgcataaaagccttgtctgcacagcgcttcgcggaaaactcggcgtgttctctgaaatggaagccaacttcaaaaatctgagccgaggactcgttaatgtggctgcaaagttgacacacaacaaagacgtccgggatctgttcgtggacttagtagaaaaattcgttgaaccttgtcggtccgaccactggccactcagtgacgtaagattcttcttgaatcagtacagcgcctctgttcactccctcgatggttttcgccatcaggcactgtgggaccggtacatgggcactctccgcggatgtctgctgaggctgtatcatgactag

SEQ ID NO: 223216 - DNA, 1989 bp, Artificial Sequence
  Description of Artificial Sequence: Synthetic coding sequence
atgtggagctggaaatgcctgctattctgggctgtccttgttaccgccacactgtgcaccgctcgcccaagtcccacactgccggaacaggcccagccttggggagccccagtggaggtggaatcatttctggtccatccgggagaccttctgcagctccgctgtcgtctccgggacgatgtgcagtccataaactggctaagggacggagtgcagttagctgagtctaatcggacgcgaattactggggaagaagtggaagttcaagactccgtgccggctgactccggtctgtacgcatgtgttactagtagcccctcagggtccgatactacttacttttcagtcaacgtgtccgacgccctgccatcttctgaggacgatgatgacgatgacgacagtagcagcgaggagaaggagaccgataacacgaagcccaatcggatgcctgtggccccatactggacatcacccgagaagatggagaagaagctgcacgccgtacccgctgccaagactgtcaagtttaaatgcccatcttccggaactcctaaccccacactgagatggctgaaaaatggtaaagagttcaagcctgatcatcggatcggcggttataaggtgagatatgccacttggagcataattatggacagtgttgtcccctcagacaaaggcaactacacatgcatagtggaaaatgaatatggaagtatcaaccacacgtaccagctggacgttgtggagcgttctccacacagaccaattctgcaggctggcttgcctgcgaataaaactgtggcacttgggtctaacgttgagttcatgtgtaaagtctatagcgatcctcagccccacatccagtggcttaagcacatcgaggttaacggttcaaagatcggccctgataacttaccgtacgttcagattttgaaaaccgctggtgttaatactaccgataaagagatggaagtgcttcatttgagaaacgtaagcttcgaggatgccggtgagtatacctgtctagccggaaacagcattgggcttagccatcacagcgcatggttgactgttttagaagccttggaggaacgcccagccgtcatgacatcacctttgtatttagagataataatttactgcacaggcgcttttctgatatcctgcatggtaggatctgtgatcgtgtataaaatgaagtcaggcacgaaaaaaagcgacttccactcccagatggccgtccataaacttgccaaatccattccgttgcgccgacaggttaccgtgtctgctgactcgtccgcttctatgaacagcggagtcctgctcgtacggccttccaggctctcttccagtgggactccaatgctcgccggagtaagcgagtacgagctgcctgaggatcctaggtgggaactccctagagatcgcctggtactgggcaagcccctgggagaaggctgtttcggacaggtggttctggctgaagctataggcctcgacaaggacaagccaaaccgggtcaccaaagtcgcggtcaagatgctgaagtctgatgccacagagaaggatttaagcgacctaatcagcgaaatggagatgatgaagatgatagggaagcacaagaacatcataaacctactcggagcctgcacacaggacggccctctgtatgttatcgtggaatatgcaagtaagggcaacctccgtgaatatctgcaggcccgacgccctccaggactcgagtactgctacaatccatctcacaatcctgaggagcaactttctagtaaagatttagtgtcttgcgcttatcaggttgcacgaggaatggaatatctggccagtaagaaagtgtggaatcttaaggcacctttagtacacaccccaagacccggatctcaggaatgtccgggtgatcgaggtcagtgcgatgaggactcccggctgtggcctcgaacagggcatagcccacatagactgctgtag

SEQ ID NO: 223217 - DNA, 1104 bp, Artificial Sequence
  Description of Artificial Sequence: Synthetic coding sequence
atgtggagctggaagtgcctcctgttttgggcagtactcgtgacagccacattatgtacagctaggccatcaccaaccttaccggaacaggcacagccctggggtgccccagtcgaggtggagtcttttctggtgcatcctggtgacctgctgcagctgcgctgcaggctgagagatgatgtgcagagtattaattggctgcgggatggtgtgcagctcgccgagagtaacaggacccggatcacaggggaagaggtggaagtgcaagactccgtgcccgctgactcaggcctgtatgcctgtgttacaagctccccctctggaagcgacacaacctactttagcgtgaacgtgtcagtcccaatcgatgcgttacctagcagcgaggacgacgacgatgacgacgactcgagttcggaggaaaaggagaccgacaatacaaagccgaaccccgttgccccatattggaccagccctgagaaaatggagaagaaactgcacgcagtgcctgcagcaaagactgtaaaatttaagtgtcctagctccgggaccccgaaccctactctcagatggttgaaaaacggaaaagagttcaaacctgaccaccgcattggtggatacaaggtgcggtatgctacctggtccataatcatggacagcgttgtgccatccgataagggaaactacacatgtatcgtggaaaatgagtatggcagtatcaatcacacttaccagctggacgtagtcgagagatctccgcatcgaccaattcttcaggccggtctgcccgctaataagactgtggctttaggcagcaacgttgagttcatgtgcaaggtctattccgacccgcagcctcacatacagtggctgaaacatatagaagtaaatgggagtaagattggtcctgacaaccttccttatgttcagattctgaagcactcaggaattaattcttcggacgcagaagtgctaaccctcttcaatgtgaccgaggcacagtcgggggaatacgtgtgtaaggtcagtaactacatcggggaagctaaccagtccgcgtggctcactgtgacgagacctgttgccaaggattgctggagctag

SEQ ID NO: 223218 - DNA, 2196 bp, Artificial Sequence
  Description of Artificial Sequence: Synthetic coding sequence
atgtggagctggaaatgcttgcttttctgggctgtgctggtcactgctacactctgtactgcacggccttctccaacactgcccgagcaagatgccctgcccagctctgaggacgacgacgatgatgatgattccagcagcgaagagaaggagactgacaacaccaaaccgaatccggtggccccttactggaccagtcccgagaaaatggagaaaaaactgcacgccgtgccggcagccaaaacggtgaagttcaagtgcccatctagcgggactccaaatcccactctcagatggttaaagaacggtaaggagttcaagcctgaccacaggattggaggctataaggtgcgatacgcgacctggtcaatcatcatggactctgtggtcccgtcagataaggggaactacacgtgcatagttgagaacgaatacggaagtataaaccacacttaccagcttgatgtcgttgagcggtccccgcacaggcccatcttacaggccggtctgcccgctaataagacggtggccctcgggtctaacgtggagtttatgtgcaaggtgtactcagatccgcagcctcatatccagtggctcaaacacattgaagtgaatgggagcaagatcgggcctgataacttgccgtacgtgcaaatccttaagacagcaggggttaacaccaccgataaagaaatggaagttctgcatcttcggaatgtatcgttcgaggatgcaggagaatatacttgtctggctggcaacagcatcggtttaagccaccacagcgcttggctgacagtactcgaagcccttgaggaaagacccgctgtaatgacctccccgctgtacctagaaattattatatactgtacgggcgcttttctgatcagttgcatggtggggtccgtgattgtatacaaaatgaagtccggaactaagaaatccgacttccactcacagatggctgtccacaagctcgccaagtcaataccactgagacggcaggtaaccgtctccgctgactcctccgcctcaatgaatagcggagtgctgctggtccggcctagcagactcagtagctctggcacaccaatgctggctggagtaagcgagtatgagttgcctgaggacccaaggtgggagctgcctcgggatcgccttgtcttaggtaagccactgggcgaagggtgttttggacaggttgttctcgctgaggccattgggctcgataaagataagcccaacagggtgacaaaggtggccgtaaagatgcttaagagcgacgcaacagagaaggacttaagcgaccttatcagcgagatggaaatgatgaagatgattggcaaacacaaaaatataatcaatttgttgggtgcctgtactcaggatggccctctgtatgtgattgttgagtatgccagtaagggaaacctgagggagtatttacaggcccgtcgcccacctggactcgagtattgttacaatccttcccataaccccgaggaacagcttagcagcaaggatctagttagctgcgcgtatcaggtggccagaggcatggagtacctcgcatcaaagaagtgcatacaccgtgacctggccgctagaaatgtgctggtcacagaggacaatgtaatgaagatcgcagatttcgggctggctcgtgatatacaccacatcgactattataagaagactacaaacgggaggctgccggttaagtggatggcacccgaggctctgtttgacaggatctacacccaccaaagcgacgtgtggtcgtttggggtgctattgtgggagatttttacactgggaggtagcccctatcccggagtaccagtcgaagaactgttcaagctactgaaggagggacacaggatggataaaccttctaactgtaccaacgaattgtacatgatgatgagagattgctggcacgccgttccctcccaaagacccactttcaaacagctggtggaggatttagaccgcatcgtggcgctgacatccaatcaggaatacttagacttaagcatgcctctcgaccaatacagtcccagcttcccagacacgcggtcctcaacttgctcttccggagaagactctgtgttcagccatgagccattgcccgaggaaccgtgccttccccgacacccggcacaacttgctaatggaggacttaagaggcgctag

SEQ ID NO: 223219 - DNA, 2439 bp, Artificial Sequence
  Description of Artificial Sequence: Synthetic coding sequence
atggcggctgtcacacgcgatttcggagagatgttgctgcatagcgggagagttttgccagccgaggctcagccatggggggctcccgtggaagtggagagcttcttagttcacccaggagacctgcttcagctgagatgtcgtctgcgtgatgacgtgcagagtataaactggctgagagatggcgtgcagcttgccgagtccaaccggacacgcatcaccggagaggaggtagaggtccaggacagtgtgccagctgattctggcttatacgcatgtgttacgtcttctcctagtggcagcgataccacatacttctcagtgaacgtcagtgacgccctgcccagtagcgaagacgatgacgacgatgatgactctagcagcgaagagaaggaaaccgacaacacaaaacccaatcgcatgcccgtcgccccatattggacctctcctgagaagatggaaaagaaactgcacgccgtgcctgccgctaaaaccgtaaaattcaagtgtccatcgtccgggaccccaaatcctacacttcggtggcttaaaaatggtaaggagtttaaacctgaccacagaattggaggctacaaagtccggtacgcaacgtggagtattataatggactcagttgtcccgtctgataaaggcaactacacctgcatcgtggagaacgagtatggcagtatcaaccacacctatcagctggatgtggtcgaacggtctccccatcggcctatactgcaggccggtctacccgctaataaaacagttgcactggggtcaaatgtcgagtttatgtgtaaggtttactccgatcctcagccacacattcagtggctgaagcatattgaggtaaacgggtctaagatcggccctgacaacctcccgtatgtgcagatactgaaaaccgccggagttaatacgaccgataaagaaatggaggtgctacacttgcgtaacgtcagcttcgaggacgctggcgaatacacctgcttggctggcaattcgatcggactttcacaccacagtgcctggttaacggtcttggaggctctcgaagagcgaccagctgtgatgaccagtcccctttacttggagataatcatttactgcacaggggctttcttgatttcgtgcatggtggggagcgttattgtgtacaaaatgaagtctggcacgaagaagagtgactttcactcgcagatggctgtgcataagctggctaagtccatcccactcaggcggcaggtctccgcggactcttcagcgtctatgaattctggcgtactccttgttcgaccctctcggctgtcctccagcgggacaccgatgctggctggtgtatcagaatatgagctccccgaggatcctaggtgggagctgcccagagatcggctggtgctgggcaagcccctaggagaggggtgttttggacaagttgtgctggctgaagccatcggactagataaggacaaacctaatagagtaacaaaggtcgccgtgaaaatgcttaagtccgacgcaaccgagaaggatctgtctgatctgatatccgagatggagatgatgaagatgattggaaagcataaaaacatcatcaacctactgggagcatgcactcaggacggccctctatatgtcatcgttgagtacgctagtaagggcaatttacgcgaatacctgcaggctagaagacccccaggactagaatattgttacaatccttcacacaatcccgaggagcaactgtcatctaaagatctggtgagttgcgcctatcaggttgctcggggaatggagtacctggccagcaaaaagtgcattcatcgggatctagccgctaggaatgtgttggtgactgaggataatgtgatgaagatcgctgatttcggactggccagggacatccaccatatcgattattataaaaagactacaaatggacgcctccccgttaagtggatggctcccgaggctctgttcgacagaatttacacacatcagtctgatgtttggtcatttggggtacttttatgggagattttcacacttggcggttccccctatcccggagtgccagtggaggaactgttcaagctgcttaaggagggccatagaatggataagccctccaactgcacaaatgagttatacatgatgatgcgcgattgttggcatgcagtgccctcgcagcgtccaaccttcaagcagctggtggaggacttggaccgaatagtggcccttaccagcaatcaggagtaccttgacctttctatgcctcttgatcaatattctccctctttcccagacacccggtcaagcacttgctcaagcggggaggacagtgtcttctcgcacgaaccccttcccgaggaaccgtgcctccccagacatcctgcccagctggcaaatggaggccttaagcgtagatag

SEQ ID NO: 223220 - DNA, 2469 bp, Artificial Sequence
  Description of Artificial Sequence: Synthetic coding sequence
atgtggtcatggaaatgcctcttattttgggctgtcctagtcactgcaactttgtgtacagccaggccttcacccactctgcccgagcaagcccagccctggggagctccagttgaggtggagagcttcctcgtgcaccccggagacttgctgcagctgagatgcaggcttagagacgatgtccagagcattaattggttgagggacggagtgcagctcgcagaatctaacagaactcggattaccggcgaagaagtggaggtacaggactccgtccccgcagattcgggcttatacgcatgtgtcacttcctccccatcaggatccgataccacatatttttccgtcaatgttagcgtcccaatcgacgcccttccctctagtgaagacgacgacgatgatgacgatagtagctcagaggagaaagaaaccgataacactaagccaaaccccgtggcaccctattggacaagccctgagaaaatggaaaagaagctgcatgcagtgccggcagctaagactgtgaagtttaagtgtcccagctcgggaacccccaaccccactctgagatggctgaaaaatggcaaagaatttaagccagatcaccgcatcggcggatataaagtccggtatgccacctggtcaattattatggactccgtcgtaccttctgataagggaaactacacatgcatcgtcgagaatgaatacggttctatcaaccatacctatcagcttgacgtcgtggagcggtccccccatagaccaatcctccaagctggtctccctgccaacaaaacagtggcccttggctctaacgtggagtttatgtgtaaagtgtattccgatccacagccacatatccaatggctgaaacacattgaggtcaacggctcaaagatcggcccagacaatctaccttatgtgcagatcctgaagcattctgggattaactcatcagatgcagaggtgctcacgttgttcaatgtcaccgaagctcaatcaggtgagtatgtttgcaaagtttccaactacatcggggaggcaaaccaaagcgcatggctgacggtgacacgaccagtgctagaggaaaggcctgcagtaatgacttcacccctttatctcgaaataattatctattgtactggtgctttcctaatttcttgtatggtgggctctgttatcgtctataaaatgaagagtggaacaaagaaaagtgatttccactctcagatggccgtgcacaagcttgcaaaatccattcccttaaggcgccaagtcactgtgtcagcagacagctccgcatctatgaactccggggtcctgctggtcagaccctcccgcttgtcatcttctggtactcccatgcttgctggagtgtcggagtatgagctgcccgaggatccccgttgggagttaccgagagaccgactcgtacttggtaaacccttgggggagggatgctttggtcaggtcgtgctggccgaggccattggactggacaaggacaagccaaacagagtcaccaaagtggcggtcaagatgctcaaaagtgatgccacagagaaagacctgagcgacttgatctcagagatggaaatgatgaagatgatcggcaagcacaaaaacattattaatctccttggagcttgcacacaggacggacccctgtatgtgatcgtcgagtacgcctctaagggaaacctgcgtgagtacttacaggcccgtagacctccaggcctggagtactgctataatccaagtcacaaccctgaggaacagttatcttccaaggatttagtgtcttgcgcctaccaggtggcaagaggtatggaataccttgcttccaagaaatgcatccaccgtgatctggctgcgaggaacgtcctggtgactgaggataatgtgatgaagatcgctgattttggtctcgccagggacatccaccacattgattattataagaaaactacaaacggacgcctcccagtaaagtggatggcacccgaggccctatttgacagaatttacacccaccagagcgacgtctggtctttcggcgtgctcctgtgggaaattttcactctcgggggaagcccatatcccggagtgccagttgaggagctgttcaagctccttaaggaggggcaccgcatggacaagccctctaattgcaccaatgagctgtacatgatgatgcgtgattgctggcacgccgtcccaagccagagaccaacttttaaacaactggtggaggatctcgacagaatcgttgccctgacctcaaatcaggagtatctggacttgtccatgccgctggaccaatattctcccagcttccctgacacgagaagctccacatgcagcagtggcgaggattccgttttcagtcatgagcctctgcccgaagaaccatgtctgccacgccatcctgcccagctggcaaatggcggattgaaacggaggtag

SEQ ID NO: 223221 - DNA, 2202 bp, Artificial Sequence
  Description of Artificial Sequence: Synthetic coding sequence
atgtggtcttggaagtgcctgctgttctgggccgtactggtcaccgcaaccctgtgcacagcacgcccatcgcccaccctgcccgagcaggacgccctcccttcctcagaagacgatgatgacgacgatgatagttcaagcgaagagaaagaaacagacaacactaaaccgaatcggatgcctgtggccccatattggactagccccgagaagatggagaaaaagctgcacgctgttcccgctgccaaaacagtgaaattcaaatgtccgtcaagcgggacgccaaatcctaccctgagatggctgaagaacggcaaggaattcaaaccagatcaccgtatcggtggatacaaagtccgctacgccacttggagcattataatggacagtgtagtcccaagcgataaaggaaattacacatgcatagtcgaaaatgagtatggttccattaaccacacctatcagctcgatgtcgtggaacgctctccgcatcgtccgatcttacaggcgggtctgccggcaaataagacagttgccttagggtctaatgtggagttcatgtgtaaggtctactccgacccacagcctcacatacagtggctgaaacacatcgaagtgaacgggagtaagattgggcctgataatctaccttacgttcaaatacttaagactgctggcgtaaacaccaccgataaggagatggaggtgttgcacctgaggaatgtgtccttcgaggatgcaggtgagtacacatgcctggccggaaatagcataggtctctctcatcatagcgcctggctcaccgtgttggaggcccttgaagagaggccagccgttatgactagtcccctgtacctggaaattatcatttattgcaccggcgcattcctgatttcttgcatggttggctccgtgatcgtctataagatgaagagtgggacaaaaaagtccgattttcattctcagatggctgtccacaagttggctaagagtattcctttgaggcggcaggtcactgtaagcgcggattcctcggcctccatgaatagtggcgtacttctcgtgagaccctcccgactttcatccagtggtaccccaatgttagccggtgtctccgagtacgaactgccagaggatccccgttgggagctaccacgagatcgcctcgttctagggaaacccctgggcgagggctgctttggccaggtggtactggctgaagccatcggcctggataaagacaagcctaatagggtcacaaaagtagcggttaaaatgttgaaatctgatgccactgagaaggatttgtccgatctgatctctgaaatggagatgatgaagatgatcggcaagcacaaaaatattatcaatttgctaggagcatgcacacaagatggacctctctacgttattgtggaatacgccagtaagggtaatctaagggagtatttacaagcacgtaggccacccggactcgagtactgctacaatccatcccataatccagaagagcagctgagtagcaaagatctggtcagctgcgcctaccaagtggcccgtggcatggagtacttggccagtaaaaagtgcatccaccgcgatctcgccgctaggaacgttctggtgacagaggacaacgtgatgaagattgctgactttggactggctagagatatccaccacatcgactactataagaagactactaacggacgtttgcctgtgaaatggatggccccagaagctctctttgatcggatttacacacaccagtccgatgtctggtctttcggtgtcctcctgtgggagatctttacacttgggggaagtccatatcccggagtacccgtggaggagctatttaagctgttaaaggaagggcaccggatggacaagccatcaaactgtaccaacgaactgtacatgatgatgagagattgctggcatgcagtgccatcgcagaggccaaccttcaagcagcttgtcgaggacttggaccgcatcgtggctcttacatcaaaccaggagtatctcgatctgagtatgcctttggaccagtactcaccttcgtttcccgacacaagatctagtacttgttcctccggggaggacagcgtgttttcccatgaacctctgccagaggagccatgtctccctcgccacccagcgcagctggctaacgggggtctgaaacggaggtag

SEQ ID NO: 223222 - DNA, 2463 bp, Artificial Sequence
  Description of Artificial Sequence: Synthetic coding sequence
atgtggagttggaagtgtctgctattctgggccgtcttggtgactgctactctgtgcactgcaaggccgtccccgactctgcccgagcaagcccaaccctggggtgcccctgtggaggtggaatcatttctggtgcatcctggggatctcctccagctccgctgcagactgagggacgacgtgcagtccatcaattggctgcgcgacggcgtccagttagcagaaagcaatcgcactagaatcacaggggaagaggttgaggtgcaggactccgtgccggcagattcaggcctttacgcatgcgttacctccagccccagtggatccgacactacttactttagcgtgaatgtcagcgatgccctaccgagcagcgaggacgacgacgatgacgacgactctagctcagaggagaaggaaaccgacaacaccaagccgaaccctgtggcgccatattggactagcccagagaagatggagaaaaagcttcacgcagttccagctgccaagaccgttaagttcaaatgtccctcttcagggacacctaatcccacactgagatggctgaaaaacggcaaggaattcaagcccgaccaccgcatcggtggctacaaggtcaggtacgctacatggtcaatcattatggactctgtcgtgccgagtgacaaaggcaattacacatgcatcgtggagaacgagtatggctccatcaatcacacctaccaactggatgtagtcgagcggagccctcacaggcctattctgcaggctggactgccagccaacaagaccgtggccctgggatccaatgtggaatttatgtgtaaagtctattccgacccccagccccatatccagtggctgaaacatattgaggtgaatggatccaagatcggcccagataatctcccttatgtgcagatacttaagaccgccggagtgaacaccaccgacaaagaaatggaggtgttacatctcagaaacgtgagctttgaggacgcaggtgaatatacatgcctcgcaggcaacagcattgggctgtcacaccactctgcttggctaacggtcttagaggctctggaggaaaggcccgctgtaatgacctcaccactataccttgaaatcattatttactgcaccggcgcattccttatttcttgtatggttggctccgtgattgtgtacaaaatgaagtcaggaaccaagaaatccgactttcattctcagatggccgtgcacaaactggccaagagtattccactcaggcgccaagtgactgtctccgccgatagctccgcaagcatgaattccggggttctactggtgcggccatctagactgtccagctccggcacgccaatgctcgctggggtgtcggaatacgaattgccagaagacccgaggtgggaactaccacgcgacagactggtgctggggaagcccctcggcgaagggtgttttgggcaggtcgtgctggctgaggcaattgggctcgataaggacaagcccaaccgagtgaccaaggtcgcggtaaagatgctgaaatccgatgccaccgagaaagacctctccgacctcatctctgagatggagatgatgaagatgatcggcaagcacaagaacattataaatctcctgggcgcttgcacccaggacggacccctgtatgtgatagttgagtacgctagcaagggcaacctgagagagtatttacaagcgcgtaggcctccaggccttgaatactgctacaatcccagccataatccagaagaacaactttcaagtaaagacctggtctcatgcgcttaccaagtggctcggggaatggagtacctagcctccaaaaaatgtatacaccgggatcttgccgctagaaacgtccttgtgacagaggataatgtaatgaaaatagctgatttcggcttagcacgagacatccatcacatagactactataaaaagaccacaaatgggagactgcctgtaaagtggatggctccagaggctctgttcgacagaatctacacccatcaatctgacgtttggtctttcggagtgttactttgggaaatcttcacactgggtggcagcccttaccctggggttcctgtcgaggaactgttcaagttgctgaaggaggggcatcggatggacaaaccgtctaactgcaccaatgaactgtatatgatgatgcgggattgttggcatgctgtcccctcccagaggcctactttcaagcagttagttgaagatctggacaggattgtggcactgacatccaatcaggaatatctcgacctctctatgcccctcgaccagtattccccctctttcccagatacccgtagcagtacctgtagctccggcgaagacagcgttttctcacatgaacctcttccggaggagccttgcctgcccaggcaccccgctcaactggctaacggaggactgaagcgacgctag

SEQ ID NO: 223223 - DNA, 2202 bp, Artificial Sequence
  Description of Artificial Sequence: Synthetic coding sequence
atgtggtcttggaagtgcctactgttctgggcagtgctcgtgaccgctaccctttgtacagcccgaccgtcgccgaccctacctgagcaggatgctctgcccagctccgaagatgatgatgacgatgacgacagtagtagcgaggagaaagagactgataacactaaaccaaacccggtggcgccttactggacttcccctgagaagatggagaagaagctgcacgccgtccccgcagccaagacggtgaagttcaagtgtccatcttccggtacacccaaccctaccttgagatggctcaaaaacggcaaggaattcaagcctgatcaccgcattgggggatataaagttaggtacgccacttggagcattatcatggactctgtggttccctccgataaggggaactatacttgtatcgttgagaatgagtacggcagtattaaccatacgtatcagctggatgttgtggagagaagcccccacagaccaatcctgcaggctgggctgcctgctaacaagaccgttgcacttggttctaacgtggaattcatgtgcaaggtgtacagcgatcctcagccccatatccagtggctgaaacatatcgaggtgaacgggagcaagatcgggccagacaacttgccgtacgtacagatcttgaaacactccgggatcaattctagcgacgctgaggtcttaactctgtttaatgtgaccgaggcacaaagcggcgaatacgtatgtaaggtttctaactatatcggagaagctaaccagtccgcatggctgaccgttacgaggcccgtggcaaaagccctggaggaacggccagctgtcatgaccagtcctttatacttggaaatcatcatctactgcactggggcttttctaatcagctgtatggtcggatccgtcatcgtgtacaagatgaaatctggcacaaaaaaaagtgacttccattcccagatggctgtccacaaactggctaagtcaatccccctacgcaggcaagtgacggtcagcgccgactcttcagccagcatgaactccggcgtactgctggtacggccatctcgcctctcgagctctgggactccaatgcttgccggtgtctcggagtatgagctgcccgaggaccctagatgggagttacccagggaccgactagtcctcggcaagccacttggagagggttgcttcggacaagtcgtgctagccgaagcaatcggcttggacaaagacaaacctaaccgcgtgaccaaagttgcagtgaaaatgctgaagtccgacgccaccgaaaaagacctcagtgacctgataagcgaaatggagatgatgaagatgataggcaaacacaaaaatataataaacctcctcggtgcatgcacccaggacggccctctgtatgttatcgtggaatacgctagcaagggcaacttaagggagtatttgcaggctaggaggccccctggcttagagtactgctataatccttcgcataacccagaggagcaattgtcatccaaagatctagtgagctgtgcctatcaggtggcaaggggaatggaatatctggccagtaaaaaatgtatacatagggatctggccgcaagaaatgttctcgtgaccgaagacaatgtgatgaaaattgccgatttcggtctggcacgggatatccaccacattgactactacaagaaaaccacgaatgggcgtctgccagtgaagtggatggcacccgaagccctctttgatcggatttacacacaccaatctgacgtctggtcattcggggttctgctgtgggaaatctttactctgggtggcagcccctacccaggagtgccagtggaggaactgttcaagctccttaaggagggccatcgaatggacaaaccttcaaactgcaccaacgaactgtatatgatgatgagggattgctggcacgccgtccctagtcagaggccaacattcaagcagttggtggaggacctcgatcgcattgtggctcttacaagtaaccaggagtacctcgatctcagcatgcccctggaccagtacagtccctcctttccagacacacggagcagtacatgctcatcaggcgaggattcggtcttctctcacgagccactgcccgaagagccgtgccttcccaggcaccctgctcagctggctaacgggggtttaaagcgccgttag

SEQ ID NO: 223224 - DNA, 2463 bp, Artificial Sequence
  Description of Artificial Sequence: Synthetic coding sequence
atgtggtcctggaaatgcctactgttctgggccgttctggtgactgcgactctgtgcactgcacgaccctctccaaccctgccggagcaagcacagccttggggggcacccgtggaggtggaaagtttcctcgttcaccctggcgatctgctccaactcaggtgcaggctcagggacgatgtacagagtattaactggcttagagatggagttcagttggcagaatcaaaccggacacggattaccggcgaggaagttgaggtacaggactctgttccagccgatagtgggttatacgcctgcgtaacaagcagcccgtccgggtctgacacgacctatttttccgtgaatgtgagcgacgccttgccttcctccgaagatgatgatgatgatgatgatagtagctcagaagagaaggagaccgataacaccaagccaaaccccgtggcgccttactggacatcaccagagaaaatggagaaaaaactccacgccgttccagccgcaaagactgtgaaatttaagtgcccgtccagtggcactcctaatccaactctccgatggctgaagaacgggaaagaattcaaacctgatcaccgtatcggcggatacaaagtcagatacgctacgtggagtattatcatggacagtgtggtgccttctgataagggcaattacacctgtatcgtcgagaatgagtatggatctataaaccacacctatcagcttgatgtggttgagagatctccacatagacccattttacaggccggactcccagccaataaaaccgttgcgcttggttccaatgtcgagttcatgtgcaaggtctacagcgatcctcagcctcatatccaatggctcaaacatatcgaggttaatgggagtaagattgggcctgataatctcccatacgtacagatccttaagactgccggagtcaatacgacagacaaggagatggaggttctccacctacggaatgtcagcttcgaggatgcgggagaatatacctgtcttgctgggaattcgatcgggttaagtcatcattcggcctggctaacagtgctggaagccctagaggaacggcctgcagttatgacctcccccctgtacttagagatcatcatttactgtacaggcgctttccttatctcctgcatggtggggtctgtgatcgtgtacaaaatgaaatctggcaccaaaaagagcgattttcacagccagatggccgtgcataaactggcaaagtcaattcccctgaggcgccaggtgaccgtgagtgcggattcatctgcgagtatgaactcaggcgttcttctggttaggccctcccgactctcatcctcaggaactcctatgttggccggtgtgtctgaatacgagctgcctgaggacccgaggtgggaactgcccagggacaggttggtgctagggaagcccctcggggaggggtgcttcggacaggttgttttagcagaggctattggactggataaagacaagccaaatagggttaccaaagtggcagtgaagatgctgaaatccgatgccacagagaaagacctcagcgacctgattagtgagatggaaatgatgaagatgatcggaaagcacaaaaatatcatcaatctgcttggcgcttgtacccaggacggtcccctctacgtaatcgtggaatacgctagtaaggggaatttgagagaatatctgcaggcacgccgaccgccaggtctcgaatactgctataaccccagccacaatcccgaagaacaactgagcagcaaggatctcgtatcttgtgcgtaccaggtagcacgcggaatggagtatcttgcaagcaaaaagtgtatccatcgggatcttgcagctagaaacgtgctggttacagaggataacgtgatgaagatcgctgatttcggactggctcgcgacatccaccacattgactactataagaaaacaacaaacggaagacttcctgttaagtggatggcacccgaggccctgttcgatcgaatctacacccatcagtcagatgtgtggagctttggcgttctgctgtgggagatttttacactagggggttcaccataccctggcgtcccggttgaggaactgttcaaattgctcaaggagggccatcgtatggataagccttccaactgtactaacgagttatatatgatgatgagagattgctggcatgccgtgccctctcagcggcctactttcaagcaactggttgaggatctcgaccgaatcgtcgcgctgacatccaaccaggaatacctggacctgtcaatgcccctggaccagtattcacctagttttcctgacacgcgatcatcaacgtgtagctctggcgaggattccgtcttcagtcatgagcctctgccagaggagccttgcctccctaggcaccccgctcagctcgccaacggaggcctgaagaggagatag

SEQ ID NO: 223225 - DNA, 2463 bp, Artificial Sequence
  Description of Artificial Sequence: Synthetic coding sequence
atgtggtcatggaagtgcctcttattctgggccgtgttggtgaccgctaccttatgcaccgcccgaccaagtcctactttgcccgagcaggcccaaccctggggggcaccagtggaagtggagagctttctcgttcaccccggtgatctgctccagctgcgatgcagactgagggatgatgtgcagagcattaattggctgcgtgacggcgtccagcttgcagaaagcaatagaactcggatcactggcgaagaagttgaggtccaggattccgtccccgcagatagcgggctttatgcctgcgtgactagttcgcccagcgggagcgacaccacatacttttcagtgaacgtgtcggacgcccttccttcttccgaagacgacgacgacgacgacgactctagctcagaggagaaagagaccgacaatacaaaaccaaacccagttgcaccttactggaccagcccagagaagatggaaaagaaacttcatgccgtgccagccgcaaaaacggtcaaatttaaatgccccagctccgggactcccaatcccaccctccgctggctgaagaacgggaaagagttcaaaccagatcataggattggagggtataaggttcgatatgctacatggtctattatcatggacagtgttgttcctagtgataagggaaactacacttgcatcgtggagaatgaatatgggtccattaatcacacataccagttggacgtagtggaaaggagcccgcatcgcccaatcctgcaggcagggctgcccgctaataagacagtcgctttgggctcaaacgtggaattcatgtgcaaagtctattccgaccctcagccacacatccaatggttgaagcacattgaggtaaatggatccaaaatcggtcctgataacttgccctacgttcagatcttgaaaactgctggagtcaacacaaccgataaggaaatggaggtgctccacctgagaaatgtttcgttcgaagacgccggagaatacacttgcctggctgggaatagcatcggactttctcaccattccgcctggctgacagtgttagaagcactggaggagaggccagccgtcatgacctcacccctgtacttggaaattattatctattgtactggcgcattcctgatttcatgcatggtaggcagcgtcatcgtgtacaaaatgaagtccgggaccaaaaaaagcgatttccactcccagatggccgttcacaagctggctaaatccatcccgctcaggagacaggttacagtgtctgccgactcctcagcaagcatgaattccggcgtcctgctcgttcgcccttcgaggctctcgagctccggcactcctatgctggccggtgtgtcagagtacgagctccccgaagatccccgttgggagctgcctagggaccgcctcgtgctcggcaaaccactgggcgaggggtgctttggccaggtcgtgctggccgaagcaattgggctggacaaagacaagccaaacagggtgaccaaggtggccgtgaagatgttgaagagcgatgccacagaaaaagatctgagtgacctgatctcagagatggaaatgatgaaaatgataggcaagcataaaaacataatcaatttactaggggcttgcacccaggatggccctttatatgtcatcgtggaatacgccagtaaggggaacctccgagaatatctccaggccagaaggccgcctggtttggagtattgttacaacccatctcacaaccccgaagagcaactcagctccaaggatctggtatcctgcgcctaccaagttgcacgcggtatggaatatttggcgtcgaagaaatgtatccatcgagaccttgccgcaagaaacgtgctggtgaccgaggataatgtgatgaagattgctgacttcgggctggcccgagacattcatcatatcgactattacaagaagaccaccaacggcaggctcccggttaaatggatggccccagaagccctatttgacaggatctacacgcaccaatcagacgtctggtcctttggcgtgttactgtgggagattttcactctgggtggctcaccataccctggtgtgcctgtggaggagctcttcaaactcttaaaggaggggcacagaatggacaagcctagcaactgcaccaatgaactgtacatgatgatgagggactgctggcacgctgtgcccagccagagacctactttcaaacaactggttgaggatctggatagaatcgttgcgctgacaagcaaccaagagtatctggacctgtctatgccactggatcagtattctccgtctttccctgatactaggtcatccacatgttcttccggcgaagactctgtgttttcacacgaacccctgcccgaggagccctgtctgccccgtcaccctgcacagctcgcaaacggtggactgaagcgacgctag

SEQ ID NO: 223226 - DNA, 324 bp, Artificial Sequence
  Description of Artificial Sequence: Synthetic coding sequence
atgtggagttggaagtgcctcctcttttgggccgtgttggtgacagcaacactgtgcaccgctaggccttcccccaccttgcccgaacaggcccagccatggggcgcaccggtcgaggtcgagagtttcctcgttcatccaggtgatctgcttcagttaagatgtaggctgcgagatgatgtgcagtccatcaattggctcagagacggcgtgcagctggctgagagcaaccggactagaatcaccggcgaggaagtggaagtgcaggactctgtaccagctgactctggattgtacgcatgcgtcaccagctccccatcatag

SEQ ID NO: 223227 - DNA, 2562 bp, Artificial Sequence
  Description of Artificial Sequence: Synthetic coding sequence
atggaagcccgagtgtctctgaaacgcaggatcgagctgaccgtggagtatccttggcgctgtggagccctatcccctaccagcaactgccggacaggaatgtggtcttggaagtgcctgctgttctgggccgttcttgtcaccgccactctctgtaccgcccgacccagcccgactttgccagaacaggcgcaaccatggggagctccagtcgaggtggagtcgttcctggttcaccccggtgacctgctgcagctgaggtgtcgactgcgcgatgacgtccagagcatcaactggctgcgagatggagtacagcttgctgagtctaacagaacaaggataacgggtgaggaagtggaagtccaggactctgtgccagccgacagcggcctgtatgcctgtgtgacatccagtccctccggctccgatacgacatattttagtgtaaacgtctccgacgctttgccaagttccgaagatgatgacgatgacgacgacagttcttccgaggagaaagaaaccgataatactaagccaaaccccgttgctccatactggacaagtccagaaaagatggagaagaagcttcacgcggtgccagctgcaaaaacagtaaagttcaagtgcccttcaagtggaacacctaatcccaccttgcggtggctgaaaaatgggaaggaattcaagccagaccataggatcgggggatacaaagtacgctacgctacctggtcaattattatggacagtgtggtcccatcagacaagggaaattatacatgcattgtggaaaacgagtacggctcaatcaaccacacatatcagcttgacgtggttgaacgctctccacacaggcccatcctgcaggccggattgcctgctaacaagacagtcgcgctgggctcgaacgtagagtttatgtgtaaggtctactcagatcctcagccacacatccagtggcttaaacatattgaggtgaacggctcgaagatcggacctgacaacctgccatatgtgcagattctgaaaactgcaggtgtaaacaccactgacaaggaaatggaggtgctccacctgcgcaacgtcagctttgaggacgctggggagtatacgtgcttagctggaaattcaattggcctctctcaccattctgcctggctgaccgtcctagaagcattggaggaaaggcctgcagttatgacgtcaccactgtacctcgagatcatcatttattgtacgggggctttccttatttcgtgcatggtagggagcgttattgtgtacaaaatgaagtcaggcactaagaaatccgactttcattctcaaatggccgtccacaagcttgccaaatcaatcccgctccgaagacaagtcaccgtgagtgctgattcaagcgcctcaatgaactctggcgtgctcctggttcgtccctcgcggctgtccagctccggtacaccgatgttggcaggggttagcgagtatgagctaccagaagatcccaggtgggagctgccacgggatagattagtactgggcaagcccctcggggaagggtgcttcgggcaagtggttctcgcagaagccatagggttggataaagacaaacccaatcgcgtgactaaggtggccgtaaagatgctgaagtctgatgctacggaaaaggatctttctgacctgatcagtgaaatggaaatgatgaaaatgatcgggaagcacaaaaatatcattaatttattgggcgcttgtacacaggacggaccactgtacgtgatagtggaatatgcttccaaagggaatctcagggagtaccttcaggcaagacggcctccaggtctggagtactgttacaatcctagccacaacccagaggaacaacttagtagcaaggatcttgtctcctgcgcctaccaggtggctagggggatggagtatttggcctcaaagaagtgtattcaccgggatctcgccgctcgcaacgtcctggtgacggaagacaacgtcatgaaaatcgccgacttcggtctggctcgcgatatccaccacatagattattataagaagacaaccaatggtaggttaccagtgaaatggatggccccagaggcactcttcgaccgtatttatacgcatcagtctgatgtgtggtccttcggcgtgctgttatgggagatcttcacgttgggcggatcaccgtatccaggcgttccggtcgaggaactgttcaaactgctgaaggagggccatcggatggacaagccctccaactgcacaaatgagctgtatatgatgatgcgcgactgctggcacgccgtcccctcccagcgcccaacctttaaacagcttgtcgaggatctggaccgaatagtggcactgacaagtaaccaagagtacctggacctatcaatgccactggatcaatactcaccctcttttcccgacactcgaagttccacttgtagttccggggaagattcagtcttctcccacgagcccctcccggaggagccctgtcttcctagacaccccgcacaactagccaatggcggactgaaacgcagatag

SEQ ID NO: 223228 - DNA, 168 bp, Artificial Sequence
  Description of Artificial Sequence: Synthetic coding sequence
atgtggtcctggaagtgtctgctcttttgggcagtactggtaacggccaccctgtgtaccgctaggcctagcccaaccctgccggagcaagacgcactgccgtcatccgaggatgacgacgacgacgacgacagctccagtgaggagaaagaaaccgacaatacctag

SEQ ID NO: 223229 - DNA, 6 bp, Artificial Sequence
  Description of Artificial Sequence: Synthetic coding sequence
atgtag

SEQ ID NO: 223230 - DNA, 2469 bp, Artificial Sequence
  Description of Artificial Sequence: Synthetic coding sequence
atgtggtcatggaagtgtctgcttttctgggccgtcctggttaccgcaactctatgcaccgcgagacccagccctactctgccggagcaagcccagccttggggggcacccgtggaggtggaaagctttctcgtgcaccccggtgatctgcttcaattgagatgtcgcctccgcgatgatgtacaaagtatcaactggctgagggatggtgtacaactggctgagagtaataggacccgcattacgggcgaggaagtggaagttcaggactcggttcccgcagacagcggtctgtacgcctgcgtgacgagctctcctagcggatccgacactacttactttagcgtcaacgtgagcgatgctcttccctctagcgaggacgacgatgacgatgatgactcctccagtgaagagaaagagacagataatacaaagcctaaccgtatgccagtggcgccatactggacgtctcccgaaaaaatggagaagaagctccacgcagtgccagccgctaagaccgtgaagtttaagtgtccttctagcgggacaccaaatcctacccttcgctggcttaagaatggcaaggaatttaagcctgaccatcgcattggaggatacaaagtgaggtatgctacatggagtattattatggattcggtcgtgccgtcagataaggggaattatacctgtatcgttgaaaatgaatatgggtctataaaccatacatatcaactggacgttgtagagcgatcgcctcataggcccattctgcaggctgggcttcccgcaaacaagactgtcgcactaggctcaaatgtcgagttcatgtgtaaggtttactctgacccccagccacatatccagtggctaaaacatattgaggtaaatggctctaaaatcggaccagataaccttccttatgtgcagatcctgaagactgccggagtcaacacaaccgacaaagagatggaagtgctgcatctaagaaatgtctcttttgaagacgcaggtgagtacacctgccttgcgggaaactcaatcgggttaagtcaccactctgcctggctaactgttctcgaagctctggaggagagacccgctgtcatgacatcacccctgtacctggaaattatcatctactgtaccggcgcttttctgatttcatgcatggtgggttccgtgatcgtgtacaagatgaagtctggaacaaagaaatcagactttcatagccaaatggccgtgcataagctggctaaatcaatcccattgaggagacaggtgaccgtgagcgcagactcttccgcgtccatgaacagcggtgtgctgctggtgagaccaagccgcctcagcagttccggcactcctatgctggctggcgtaagtgagtatgaactcccagaggaccccaggtgggagctccctcgagatagacttgtactcggaaaacccctgggcgaggggtgctttgggcaggtggtgctggccgaagcaataggactagataaagataaacccaatagagtgacgaaggtggcagttaagatgctcaagtccgatgcaacggagaaggatctcagtgatttgattagcgaaatggagatgatgaaaatgattgggaagcacaagaatatcataaacttgctgggagcctgcactcaggatgggcctttgtacgtcattgtcgaatatgcgagcaaagggaatctgcgtgaatacttgcaggccaggagaccgcctgggcttgaatattgctataatcctagccataaccctgaagagcagctgtcttcaaaggacctggtttcctgtgcctatcaggtggcacgagggatggaatacctggcaagtaagaaatgtatacaccgagacctggctgccagaaacgtcttagtcaccgaagacaacgttatgaagattgctgattttggcctcgcaagggacattcaccatatcgactattataagaaaacaactaacgggagactcccagtgaagtggatggcgccagaggccctcttcgatcgtatctatactcaccagtctgacgtgtggtcattcggcgtcctgctgtgggaaattttcacattaggcggaagcccttatcctggcgtgccagtcgaggagctgtttaaacttctgaaggaagggcaccggatggataagccgagtaattgcactaacgaactgtacatgatgatgagggattgctggcacgccgtgccatcccaaagaccaacatttaagcaacttgtcgaggatttggatagaattgtggcgctcacatctaaccaggagtacctggacttatcaatgcccctggatcagtacagcccttccttcccagacacgaggtcctcaacatgctctagcggtgaagatagcgttttctcgcacgaacccctccccgaagaaccctgtctcccccgacacccagcacaactcgctaatggcggtcttaagcggagatag

SEQ ID NO: 223231 - DNA, 897 bp, Artificial Sequence
  Description of Artificial Sequence: Synthetic coding sequence
atgtggagttggaagtgtcttctgttttgggctgttctagttaccgccactctctgtactgcccgacctagtcctactttgcctgaacaagctcaaccctggggagctccagtggaggtggaatctttccttgttcatcctggtgatttgttgcagctgagatgccgtctcagagatgatgtccagtcaatcaattggctgcgcgatggagtgcagttagctgagagtaataggacacggattacaggtgaagaggtagaggtgcaggattccgtcccggcagacagtggactttatgcctgtgtaacttcctcaccaagtggatctgacactacctatttcagtgtgaatgtctctgatgccctcccaagttcagaggatgacgacgacgatgatgactcgagctcagaggaaaaagagaccgataacaccaaacccaatcgcatgcccgttgccccatattggactagcccagagaaaatggagaaaaaactccatgctgtgccagctgcaaagacagtgaagttcaagtgtccgtctagcggaacacctaaccccacacttcgttggcttaaaaacggcaaggagtttaaacctgaccatagaatcggcggttataaagtaagatatgccacttggagcataatcatggatagcgttgtgccgagtgataaaggaaattatacctgtatcgtggaaaatgaatacggatccattaatcatacttaccagttggatgtggtcgaacgatccccacaccggcctattctccaggcaggactgccagcaaataagacagtcgctctgggctccaatgtggagttcatgtgtaaggtctactccgatccacagccacacatccagtggttgaagcacatcgaggttaatggctcatag

SEQ ID NO: 223232 - DNA, 438 bp, Artificial Sequence
  Description of Artificial Sequence: Synthetic coding sequence
atgtggagttggaagtgcctgctgttctgggccgttcttgtcacagctacactgtgtaccgccagaccctcccccactctccctgaacaggatgccttgccttctagcgaagatgatgatgatgacgatgatagtagttctgaggagaaagaaacagacaataccaagccaaatcctgtggctccttactggacctcccctgagaagatggagaaaaagctgcatgcagttccagcggcaaaaacggtgaaatttaaatgtccatcatccgggacgcccaatccgacccttcgatggctcaaaaatggcaaggaattcaagccagatcaccgaatcggaggatacaaagtgagatacgctacctggtcaatcatcatggactctgttgtgccgagcgacaagggcaattacacctgcatcgtcgagaacgaatactag

SEQ ID NO: 223233 - DNA, 429 bp, Artificial Sequence
  Description of Artificial Sequence: Synthetic coding sequence
atgtggagctggaaatgtctgttattctgggccgtgctggttaccgccaccttatgtacagcccgaccatcccccacgctgccagaacaagacgctctgccttccagcgaagacgacgacgatgatgatgattccagttcagaggaaaaggaaaccgataacactaagcccaatagaatgcctgttgccccatactggacaagcccagaaaagatggagaaaaaactccacgcagtgccagcagccaagaccgtcaaattcaagtgtccatcttcaggaactcccaacccgacccttagatggctgaagaacggaaaggaattcaagccggaccaccggataggaggctataaagtcaggtacgctacgtggagcatcataatggacagtgtagtcccatccgacaaaggtaattacacctgcatttag

SEQ ID NO: 223234 - DNA, 258 bp, Artificial Sequence
  Description of Artificial Sequence: Synthetic coding sequence
atgtggtcctggaagtgtctcctcttttgggccgtgctggttacagcaacgctgtgcacagcacgcccttctcccactcttccagagcaggacgctctgcccagctccgaagacgatgatgatgatgatgacagtagctcagaagagaaagaaaccgacaacacaaagccgaaccctgtggcaccttattggaccagccctgagaaaatggaaaaaaaactgcatgccgtgcccgcagccaaaaccgtcaagttctag

SEQ ID NO: 223235 - DNA, 2463 bp, Artificial Sequence
  Description of Artificial Sequence: Synthetic coding sequence
atgtggagctggaaatgcctgctgttttgggccgtcctggtcacagcaactctatgtacagcacgccctagtcccaccctccccgaacaggcacaaccatggggagcaccagttgaggtcgagagtttcctggtgcaccccggagacttgctgcagcttcggtgtcgcctgagggacgatgttcagtccataaactggctccgagatggcgtccagctagcagaatctaatcggacacgaattacgggcgaggaggtggaggtacaagactccgttcctgccgatagtggcctctatgcctgcgtgacttccagcccctcaggctctgatacaacttattttagcgtaaacgtctcagatgcgctcccttcgtccgaggacgacgatgacgatgacgattctagcagtgaggagaaagaaacagacaatacgaaacctaaccggatgcctgtggccccatattggacatctcctgaaaaaatggaaaaaaagcttcacgctgtcccggctgccaagactgttaagtttaagtgtccctcttccgggacaccgaacccgacactaaggtggctgaaaaacgggaaggagttcaagcccgatcataggatcggtggctacaaagtgcgttacgcaacatggagcatcatcatggatagtgtggtgccttctgataaagggaattacacttgtatagtggagaacgagtacggaagcataaatcacacctaccagcttgacgttgttgaacggagcccacacagacccatcctgcaggcaggccttccagcaaataaaactgtcgcgctgggctccaacgttgagtttatgtgtaaagtgtatagtgacccccaacctcacatccaatggctcaagcacatcgaggtaaatggttccaagatcggccctgacaacctcccatatgtccagattctaaagacagctggcgtgaacactacagataaggaaatggaggtcctgcacctgcgaaatgtgagtttcgaagacgccggagaatatacctgcttagctggaaattcaattggactgtcacaccatagtgcctggctgaccgtgctggaagccctggaagaacgccctgccgtgatgacatctcccctatacctggaaattattatctactgtaccggagccttcctcatttcctgtatggtgggcagcgtgattgtatacaaaatgaagtctgggactaagaagagcgacttccactctcagatggccgtccacaagcttgccaagagcatcccactcaggcgacaggtgagtgccgacagctctgcctcaatgaactctggagtgctgctggtgcggcctagcagattgagctcttccggcaccccgatgctagctggagttagcgagtatgaactgcccgaggacccgcgttgggagctgccaagagaccggttggtgttggggaagcctctcggtgagggatgtttcgggcaagtcgtcttagccgaggcgatcggcctcgacaaagacaaaccgaatagagtgacaaaggttgcagtgaaaatgctaaagtcagatgcaacagagaaagatctcagtgatctgatatctgaaatggaaatgatgaagatgattggcaagcacaaaaacataatcaatctgttgggtgcatgtacgcaggatgggccactgtacgtaatcgttgaatacgcaagcaaaggaaatctccgggaatatctccaggcacggagacccccaggccttgaatattgttacaaccccagtcataatcctgaggagcagctttcgtcaaaagatttggtttcttgcgcttaccaagtcgctcggggaatggaatatcttgcgtcgaaaaagtgcatccacagggacctagcggcaaggaacgttctggtgactgaagacaatgtgatgaagatcgccgacttcggcctcgcaagagacattcatcatatcgattattataaaaaaaccaccaatggtcggcttccagtaaagtggatggctcccgaggcccttttcgacagaatttatacacatcagtcggacgtgtggtcttttggtgtgctgctgtgggaaattttcaccctgggcggatcaccataccccggtgtgcctgtggaggagctcttcaagctcctaaaggagggtcatcgcatggataagccctctaattgcacaaacgagttgtacatgatgatgcgcgattgctggcacgccgtgcctagtcagagaccgacatttaaacagctcgtagaggacctagatagaatagtcgcgctaacgtccaatcaggaatatcttgacttatccatgccacttgatcagtactctcccagttttcccgacaccaggtcttctacctgtagctccggagaggatagtgtgttctcacacgagccactgccggaggaaccatgtctgcccaggcacccagcccagctggcgaatggcggtctgaagaggcggtag

SEQ ID NO: 223236 - DNA, 2010 bp, Artificial Sequence
  Description of Artificial Sequence: Synthetic coding sequence
atggtaagctgggggaggtttatatgtctcgtggtagtgacaatggcaacgctgtcactcgcccgtccaagcttttcacttgtggaagacaccaccttagaaccagaggacgccatctcttctggggacgacgaagatgacacagacggcgcagaggacttcgtctccgaaaattccaacaacaaacgtgccccatattggactaacactgagaagatggaaaagcggcttcatgccgttccagccgctaacaccgtgaaattcaggtgcccagccggtgggaatccgatgcccactatgcggtggctgaagaatggtaaagaattcaagcaggagcataggattggtggatataaagttcgaaatcagcattggtctctcataatggaatctgtggtccccagtgacaaggggaactatacctgcgtggttgagaatgaatacggatcgatcaatcacacttatcacctggatgtggtggagcgttctcctcacaggcctatattgcaggccggtctgccggcaaatgcgtcgaccgtcgtcggcggtgatgtagaattcgtgtgtaaagtgtactctgatgcacagccccatatccagtggatcaagcacgtggagaaaaacggctctaagtacggaccagatgggctgccgtacctcaaagtgctgaaagccgctggagtgaacactacagacaaagagatcgaggttctctacatcagaaacgtgacttttgaagacgccggtgagtatacctgtcttgctggcaacagtataggaatatcctttcattcagcatggcttacagtgttgcccgctccaggcagggagaaggagattactgcgagtcctgactatcttgagatagcgatttactgcattggagtgtttctgatagcatgcatggtggtgaccgtcatcctgtgtaggatgaaaaacactaccaaaaaaccagatttttccagccagccagctgtacataaattgaccaagcgcatccctctgagaaggcaggtcagtgccgaatcatctagtagtatgaatagcaacacacccctggtaagaattaccacacgcctgtcctcaactgcagacacacccatgctcgccggtgtgagcgaatacgaactccctgaagacccgaaatgggagttcccacgtgataaacttactcttggcaaacctctgggcgagggatgttttggccaagtggtgatggcagaagccgttgggatcgacaaagataaaccgaaggaggccgtgaccgtggctgtgaagatgcttaaggatgatgccaccgagaaagatctgtccgatctggtttcggagatggaaatgatgaaaatgattgggaagcacaagaacatcatcaatctgttgggcgcatgcactcaagacggccctttatatgtgattgtcgagtacgccagtaaaggcaacctccgcgaatacctgcgcgctcggagacctccaggaatggagtactcatatgacatcaaccgggtgcctgaagagcagatgacttttaaggatctcgtaagctgtacatatcagctcgcccgaggaatggaataccttgcaagtcagaaatgtatccaccgagatctggctgctcgaaacgtgctggtcaccgaaaacaatgttatgaaaatcgctgactttggcctggcccgagatattaataacatagactactataagaagacgaccaacggaaggttacctgtgaaatggatggctcctgaggcacttttcgatagagtttatacccatcaaagtgacgtgtggtccttcggcgtcttgatgtgggaaatttttactctcggaggatcaccatatccaggcattccagtcgaagaactgtttaaactgctgaaggaaggccacaggatggataaacctgctaattgtaccaatgaactgtacatgatgatgcgcgattgctggcacgctgttccatctcagaggcccacctttaagcaactcgtggaagacctcgaccgcatctag

SEQ ID NO: 223237 - DNA, 2460 bp, Artificial Sequence
  Description of Artificial Sequence: Synthetic coding sequence
atggtttcctgggggaggtttatatgcctggtggtagtgacaatggctactctgagcctggccaggccttccttttcactggtggaagataccacgctggagcccgaagaaccaccaaccaagtaccagatctcccagcccgaagtctatgtggctgctcccggagaaagcctggaggtgagatgcctattaaaggacgcagccgtaatctcttggactaaggacggcgtccatctgggtcctaataaccggaccgtgctcattggagaatatctacaaatcaaaggtgctacgcccagggatagcggactgtatgcttgcacagcctcaagaacagtggacagcgaaacttggtacttcatggtgaatgtgacagatgctatcagctctggtgacgacgaggatgataccgacggcgctgaagatttcgtgagtgagaatagcaataataaacgcgcaccctattggacgaatacagaaaaaatggagaaacggctccatgctgtcccagctgctaacacagtcaagttcaggtgtcccgcagggggaaatcctatgcctacgatgcgttggctcaaaaatggaaaggaattcaagcaggagcatcgtatcggaggctataaggtaagaaaccagcactggagtctgattatggaatcggtggttccttcagacaaaggaaattatacatgcgtggtggagaatgaatacggctcaattaatcacacctatcacttggatgtcgtcgagcggtcccctcatcggccaattctccaggcaggtctacctgccaatgccagtactgtggtgggaggggacgtcgagttcgtctgcaaggtttacagtgacgcccagccacatatccagtggatcaaacacgtggagaagaacggttctaagtatgggccagatgggctgccgtatctgaaggtccttaaagcagccggtgtaaatacaactgacaaggaaattgaggtcctctacataaggaatgtgacatttgaagatgctggggagtacacatgtcttgccggtaatagcataggcatatcattccatagcgcgtggctgacggtgctccccgctccagggagagaaaaggaaatcaccgcatcaccagattacctggaaatcgccatctactgtatcggagtgtttctgatagcttgcatggtagtgacagtgattctttgtcggatgaagaacacaaccaagaagcctgatttctccagccagccggctgtacacaagctgaccaagcggatacccctccgcagacaagtgagcgcggagtccagctcaagcatgaacagcaacacacctctcgtcagaatcacaacgcgcttgagtagtactgccgatactcctatgctcgcaggcgtctctgagtacgaactgcccgaagatcccaaatgggagtttccccgtgacaaattaacactcggcaaacccctgggtgagggttgtttcggccaagtggtgatggcagaagcagtcgggattgacaaagacaaacctaaggaagccgtgacagtggccgtcaaaatgcttaaggacgatgccaccgaaaaagacttgtccgacctggtgagcgaaatggaaatgatgaagatgattgggaaacacaagaatataattaatctgctaggggcttgcacgcaggacggaccactgtatgtcatagtggaatacgcttctaagggaaacctgcgggaatacctcagggcccgacgccctcctgggatggagtacagctacgatattaaccgagttcccgaggaacagatgacattcaaggacttggtgagttgcacataccagctggcgcgaggaatggaatatcttgcgtcccagaaatgcatccaccgagaccttgctgcaagaaatgtgctggtgacagagaacaatgtaatgaaaatagccgatttcggccttgccagggacataaacaatatagactactataaaaaaaccactaacggaagacttccagtaaaatggatggcgcctgaagctctgtttgatcgagtgtacacccaccagagtgacgtatggtcttttggcgttttaatgtgggaaatattcacactaggcggttccccctacccaggaatccctgtggaggagctgttcaaattactaaaagagggacacaggatggacaagccagccaactgtactaacgaactgtacatgatgatgcgcgattgctggcacgctgttccttcccaacgcccaacgttcaagcagctggtcgaagatctggacagaatcctaacactgacaaccaacgaagaatatctcgacctgagccagccattggaacagtacagcccgagctatccagatacgagatcaagttgctcatcaggcgatgactcagtatttagtccggaccccatgccctacgagccttgcctgccccagtacccccacattaatggttcggtcaaaacttag

SEQ ID NO: 223238 - DNA, 2358 bp, Artificial Sequence
  Description of Artificial Sequence: Synthetic coding sequence
atggtctcgtggggccgattcatttgtctggttgtggtaacaatggcaactctttctctcgcccgacccagtttctctctggtggaggatactaccttggagcctgaggaaccacctactaagtatcaaataagccagcctgaagtttatgttgccgctcctggtgaaagcctcgaggtccgatgtctcctgaaggacgctgccgtgatcagctggaccaaagacggggtgcacttgggcccaaataacagaactgtacttatcggcgagtacctgcaaataaagggcgctaccccgcgagattccggcctgtacgcctgcaccgcttcaaggacggtggactccgagacatggtatttcatggttaatgtaactgatgccatttcatccggggacgatgaagatgacaccgacggagccgaagacttcgtatccgaaaattctaacaataaacgtgccccatattggactaacactgaaaaaatggaaaagcggctgcacgccgtgcccgcagccaacacagttaaattcagatgtcctgctggtggtaatccaatgcccaccatgcgatggttaaaaaatgggaaggagtttaaacaggagcatagaatcgggggatataaggtgcgcaatcaacactggtccctcatcatggaaagtgttgtgccctctgataaggggaattatacgtgtgtcgtggagaacgaatacggaagtattaaccacacctaccacctggatgtagtggagagaagtcctcacagaccgatactgcaggctggactgcccgcaaatgcgtctaccgttgtcggcggagacgtagagtttgtgtgtaaggtgtacagcgatgcccagccgcatatccagtggatcaaacacgtagagaagaatggcagcaagtatggtccagatggcctgccctacctcaaggttttaaaggccgcaggtgtgaacaccactgataaggagatagaagtcctctatattagaaacgtcaccttcgaggacgcgggagaatacacttgcctggctggaaattctataggtatttcattccattccgcgtggctcacagtgcttccagccccaggcagagagaaagagatcaccgcctctcccgattacctggaaattgctatctattgtattggggtgttcctcattgcctgtatggtcgtgactgtgattctgtgccgcatgaagaacaccacaaagaaacctgactttagttctcagcctgccgtgcacaagctgacaaaacggattcctctccggagacaggtgtccgctgagtcctcctcatcaatgaactcaaatacccctctcgtgaggattaccactagacttagttcgacggctgatacacctatgctcgctggagtatcagagtacgaactgcccgaggatcccaaatgggagtttcctagagataagctgacactgggtaaacctcttggcgaaggatgtttcggacaagtagttatggccgaggccgttggcatagacaaggacaagcccaaggaagctgtgaccgtcgctgtaaagatgctcaaggatgatgcaactgaaaaagacttgagtgacctggtcagcgaaatggagatgatgaagatgataggcaagcacaagaacatcatcaatctgctgggagcatgcacgcaagacggaccactgtacgtgatcgttgagtatgcatcgaagggtaatctgagggaatatttaagagcaagaagaccgcctggaatggaatattcctatgacatcaaccgagtgcccgaggaacagatgacattcaaggatctcgtgagctgcacctatcagctagctcggggaatggagtatttggcttcccagaagtgcattcacagggatctggccgctaggaatgtgctggttacagagaataatgttatgaagatcgcagatttcgggctggctcgggacattaataacatcgactattacaagaagacaacaaacgggagactgccagtgaagtggatggctcccgaagctctcttcgaccgtgtgtatacacaccagtcagacgtgtggagcttcggcgtgcttatgtgggaaatcttcaccctcggtggctctccgtaccccggaattcccgtggaagaactctttaagcttctgaaggagggccaccgtatggacaagcccgctaactgtaccaatgaactctacatgatgatgagggattgttggcacgccgtcccatcgcaaaggccgacctttaagcagcttgttgaggacctggaccgcatactcaccctcacaaccaatgaagagtatctggacctgtcacagccactggaaccatattctccctgttaccccgaccctagatag

SEQ ID NO: 223239 - DNA, 2115 bp, Artificial Sequence
  Description of Artificial Sequence: Synthetic coding sequence
atggtgtcctggggcagattcatctgcttagtggttgtgaccatggccacccttagcctggccaggccctcattttccttggtggaggacaccacgctcgagcccgaaggggcaccatattggaccaacaccgagaagatggagaaaaggctccacgccgtccctgccgcaaacaccgtgaaatttcgatgccctgccggagggaacccaatgccgacaatgaggtggctgaagaacggcaaagaatttaaacaggaacaccgtattggcggttataaagttaggaaccagcactggagtctgatcatggaaagtgtggtccccagcgataaaggtaattatacctgtgtggtggaaaatgaatatgggagcatcaaccatacctaccatctggatgtggtcgagagatctccccatagaccaattcttcaggcaggcctgccagccaacgcaagcacagtggtggggggagatgtggagtttgtctgtaaggtctacagcgacgctcagccccacatccagtggataaaacacgtcgagaaaaacgggagtaaatacggccctgatggtctcccctacctaaaagtgctgaaggcagccggagtgaacaccaccgataaggagatagaagtgttgtatatccgcaacgtgacatttgaagacgctggcgagtatacatgcctagctggtaatagtatcggcatatccttccattctgcctggctaactgttctccccgctccaggaagagaaaaggaaattacggcgtcaccggattacttggaaatcgctatttactgcatcggcgtgtttctgatcgcctgcatggttgtgactgtgatcttgtgccgcatgaagaacaccacaaagaagcctgacttcagcagtcagccagcagtacacaagttgaccaagagaattcctctgaggcgccaggtttccgctgaaagctccagcagcatgaattctaacaccccactggtaaggattaccacacgactgtcatcaacagccgatacccctatgctggccggtgtgtctgagtatgagctcccggaggatcccaaatgggaatttccacgcgacaaacttacactcggtaagccccttggtgaaggttgcttcggccaggtggttatggctgaagccgtaggcattgacaaggataagccaaaggaggccgtaaccgtggcagtcaaaatgctaaaggacgacgccactgaaaaagacttaagtgaccttgtgagcgaaatggagatgatgaagatgatagggaagcacaagaatataatcaatttacttggtgcctgtactcaggatggaccgctgtacgtcatcgtggaatatgcttctaagggtaatctcagggagtacttaagggctcgtcgtccgcctgggatggaatacagttacgatatcaaccgggtgcccgaggagcagatgacattcaaggatctggtgtcctgtacctatcaactcgctaggggcatggaatacctggcctctcagaagtgtatccaccgggacttagccgcaagaaacgtgcttgtcaccgaaaataacgtcatgaagatcgccgacttcggccttgcaagagatatcaacaatatcgactattataaaaagaccactaatggcaggcttcccgtgaaatggatggctccagaggcattgttcgaccgggtatacacccaccaaagcgacgtgtggtctttcggtgttcttatgtgggaaatattcacccttgggggaagtccctaccccggtattcccgttgaggaactcttcaaactacttaaggagggacataggatggataaacctgccaattgtactaacgaactgtacatgatgatgagagattgttggcatgcagtcccgtctcaacgccctaccttcaaacagttagtggaagacctcgatagaattcttacgctgaccactaacgaggaatatctggacctcagtcagccacttgagcagtattccccctcttacccagacactcgctccagctgcagttccggagacgactccgtattctcaccagatcccatgccatacgagccttgtttgccacaatatcctcacatcaacggctctgtcaaaacatag

SEQ ID NO: 223240 - DNA, 2124 bp, Artificial Sequence
  Description of Artificial Sequence: Synthetic coding sequence
atggtgtcttggggccgattcatctgcctggtcgtggtcaccatggcgaccttgagtttggccagaccatccttctcactggtcgaggatacgactcttgaaccggaagatgccatttcatctggggacgacgaggatgacaccgatggcgcagaagatttcgtgtcagaaaactccaataataagagggccccttattggactaataccgaaaaaatggaaaaacgcctacatgcagtgccagccgcaaacacagtgaaatttaggtgcccagctggcggaaatccgatgcccacgatgcgttggcttaagaacgggaaggaattcaaacaagaacacagaatcgggggttacaaagtgaggaatcagcattggagcttgataatggagtccgtagtgcctagtgacaaggggaattacacttgtgtagtagagaacgaatacggctctattaaccacacctatcacctcgatgtagtggaaagaagtcctcatcggccaattctgcaggccggtttgcctgcaaatgccagtacagtcgtcggaggcgatgtggagttcgtgtgcaaagtgtactctgatgcacagccacatattcagtggattaagcacgtggaaaaaaatggcagcaagtatggccctgatggactgccctaccttaaggtgctgaaggccgctggggtgaacactacagataaggaaatcgaagtgctctacatcagaaacgtcacttttgaggacgccggagagtacacatgcctggccggaaactccatcggcatctctttccacagcgcttggcttaccgtgctccctgccccaggacgggagaaggagatcactgctagtcccgattatctagagatcgctatctactgcataggggtgttccttatcgcatgcatggttgtgacagtgatactgtgccgcatgaagaatactaccaaaaagccggatttcagtagccaaccggcagtgcacaaactgacaaagaggattccgctgagacggcaggtgacagtgtctgctgagtccagttcctctatgaatagtaatacacctcttgttagaatcactaccaggctgtccagtaccgccgatacccccatgttggccggagtttctgagtatgaactgcctgaggaccccaagtgggagtttccaagggacaagctgaccctaggcaaacccctcggtgagggctgctttggtcaggtcgtcatggcggaagctgtaggtatagataaagataagccgaaagaggctgtgaccgttgccgtgaaaatgttgaaagacgacgcgacggagaaggacctgagcgacttagtgtctgaaatggagatgatgaagatgatcggaaagcataaaaacattatcaatctgttgggagcttgtacccaggacggccctctgtacgttattgtggaatacgcaagcaaaggcaacttaagggaatacctgcgggctcggaggccgcctggaatggagtactcatacgatatcaaccgcgtgccagaggagcagatgacctttaaagacctcgtttcttgtacttaccagttggcacggggaatggagtacttagcaagtcagaaatgtatacacagagatctggccgcacggaatgtgcttgttactgagaacaatgtgatgaaaatagctgactttggtctggctcgagacatcaataacatcgactactataaaaagaccacgaatggacgactgcctgtgaaatggatggccccagaggcattgttcgacagagtctacacccatcaatccgacgtgtggtccttcggggtgctcatgtgggagatctttactcttggtggatccccatatccagggattccagtcgaggaactctttaaactcttaaaggagggccatagaatggacaagcctgcaaactgcacaaatgaactgtatatgatgatgagggattgctggcacgcagtgccttcacagcgtcccacatttaaacagctggtcgaggatctggataggattcttacactcactaccaacgaagaagaaaaaaaggtctcaggtgccgtggactgccataaacccccatgtaatccatcccacctgccgtgcgtgctcgctgtcgaccagtag

SEQ ID NO: 223241 - DNA, 2466 bp, Artificial Sequence
  Description of Artificial Sequence: Synthetic coding sequence
atggtttcgtggggtaggttcatctgtctggtggtggttaccatggccacactcagcctggccaggccttccttctccttggtagaagataccactcttgagcctgaagagccacccaccaagtatcagatttcacagccggaagtttatgtggcagcgccaggggaaagccttgaggtacgttgcttgcttaaagacgccgctgttatctcctggacgaaggacggcgtacacctcggacccaacaataggacggtactgatcggggagtatctgcaaattaagggagcgactccaagggacagcgggctctatgcgtgtacagctagcagaactgtggactccgaaacttggtacttcatggtgaacgtgactgacgcgattagttctggagatgacgaggacgataccgatggtgcagaagacttcgtgtcagagaattctaataataagagagccccatactggaccaacacagaaaaaatggagaagagattgcatgccgtcccagcagcaaacaccgttaagtttagatgcccagcaggcggaaacccaatgcccacgatgaggtggctaaaaaatggcaaggagtttaaacaggaacataggataggcggatacaaggtgcgcaatcagcattggagccttatcatggagtctgttgtaccatctgacaaaggcaactacacttgcgtggttgagaatgaatatggatcaatcaaccacacctatcatctggacgtcgtggaaaggtcccctcatcgacctattctgcaggccggtctccccgctaatgctagtactgtggtaggtggcgacgttgaatttgtgtgtaaagtctactcagatgctcagcctcatatccagtggattaaacacgttgaaaagaacggatcaaagtacgggccagacgggctcccgtatctcaaggtgttgaaggccgcaggagtgaacacaacagacaaagaaattgaggtactttacattagaaacgtcacatttgaggatgctggggaatacacatgtcttgccggaaatagcatcggtatcagctttcactctgcatggctcaccgtgctgccggcaccagggagggagaaggaaatcactgccagccccgactacctggagatcgccatatactgtatcggggtatttctgatagcctgcatggtggtgactgtgatcttatgtagaatgaagaacacaacgaagaagccagatttttctagccagcctgcagtccataaattaacgaagcgtattcctcttcgcagacaagtcaccgtgagcgcagagagttcatcttcgatgaactctaatacgcctctggtccgcataacaacccggcttagcagcacagcggacacgcccatgctagccggagtgagcgagtacgagttgccggaagatcccaaatgggagtttcccagggacaagttgaccctggggaagcctctaggagagggatgttttggccaggtggtaatggctgaggcagttggcattgacaaagacaagcccaaagaggccgtcaccgtggctgtaaagatgcttaaagatgacgctacagagaaagatttgtcagacctggtgagcgagatggagatgatgaagatgatcggcaagcataaaaatatcattaacctactaggggcttgcacccaggatgggccactgtacgtgatcgtggaatacgcgtctaagggaaacctgcgggagtacctccgtgcacgcaggccaccgggtatggagtattcttatgatataaaccgggtgcccgaagaacagatgacttttaaggacctcgtttcttgtacatatcagctggccagaggaatggaatacctggcaagtcagaagtgtatccatagggacctcgccgctcggaacgtcttggtgacagagaacaatgtgatgaaaatagccgatttcgggctcgcacgagatatcaacaatatcgactactacaaaaagacaactaacgggaggctgcctgtgaagtggatggccccagaagcactttttgatagggtgtatacacatcagagcgatgtctggtcattcggcgtactcatgtgggaaatttttactctgggaggcagcccataccctgggattccagtcgaggagcttttcaaacttctgaaggagggccatcggatggacaagccggctaactgcaccaatgaattatacatgatgatgagggattgctggcacgcagttccatcacaaagacccacttttaagcaactcgttgaggatctggataggatcctcaccctcactactaacgaagagtacttggacttatcccagcccctggaacaatatagcccttcctaccccgatactcggagttcctgtagcagtggggatgattcagttttttccccagatcccatgccctatgagccatgcttaccacaatacccccacatcaatggcagcgtgaaaacctag

SEQ ID NO: 223242 - DNA, 765 bp, Artificial Sequence
  Description of Artificial Sequence: Synthetic coding sequence
atggtgagctgggggcgatttatttgcctggtggtcgtgacaatggccacactcagccttgccagaccgtctttctctctggtggaggacaccaccctcgaaccagaagaaccccctactaagtaccagatatctcagcccgaggtgtatgtggcggctcccggtgaaagcctcgaagtcagatgtctactgaaggacgccgctgtgatttcttggacaaaggatggtgtccatctgggacctaataatcggaccgtgttaatcggggagtacctccagatcaagggggctacaccccgtgactctggactctacgcctgcactgcaagtcgcaccgttgactctgaaacatggtattttatggtcaatgtaaccgacgccatttcatccggcgatgacgaggatgacaccgatggggcagaagacttcgtgtcagaaaatagtaataataagagagcgccatattggactaacactgagaaaatggagaagcgcctgcacgccgtcccagctgcaaatacagtaaaatttaggtgccccgcagggggaaaccccatgccaacgatgcgctggttaaagaatggaaaggaattcaaacaggagcacagaattggagggtataaagtgagaaatcagcattggtcactgatcatggagagtgtggtgcccagtgacaaggggaactatacttgcgtcgtggaaaacgaatacggcagcattaatcacacctaccaccttgacgtggtcggaagccaaggactctag

SEQ ID NO: 223243 - DNA, 2043 bp, Artificial Sequence
  Description of Artificial Sequence: Synthetic coding sequence
atggtttcgtgggggaggtttatctgtctagtggttgttacgatggctacacttagtttggcgcgaccttctttctccctagtcgaggacacaacgctggaaccggaggatgcaataagcagtggtgacgacgaggacgacacagacggagcggaggacttcgtcagtgaaaattccaataataagcgggcaccttattggactaacaccgaaaaaatggaaaagcggctgcacgccgttcccgctgccaacactgtcaagttccgctgtcctgccggaggtaatccaatgcctactatgcggtggcttaagaatggcaaggagttcaagcaggagcatcggattgggggttacaaggtaagaaaccagcattggtccctcataatggagagcgtggtcccctcagacaaaggcaattacacatgtgtggtcgagaacgagtacggttctattaaccacacttaccacttggacgtggtggagcgcagcccacaccggccaattttacaagctggactacccgctaatgccagtactgtcgtgggcggtgacgtggagttcgtgtgtaaggtgtacagcgatgcccagcctcatatccagtggatcaagcacgttgagaagaatgggagtaagtacggcccagacgggttgccttatttgaaggtcttaaagcactctggaataaactcgtccaatgctgaagtgttagctctgttcaacgtcaccgaagccgatgccggagaatatatttgcaaggtctctaactacatcggtcaggcgaatcagtctgcgtggcttacagtccttccaaagcaacaggcccctggtcgtgagaaggagattaccgcctcaccagactatctggagatcgctatctactgtatcggcgtctttctgatcgcctgcatggtagtgactgtcatcctgtgtaggatgaagaacactaccaagaagcctgacttcagctcacagcctgccgtgcacaagttgactaaacggatacccctgcgaaggcaggttactgtaagtgccgaatcctcttcatctatgaactccaatacacccctcgtccgtattaccacacggctcagctccactgccgatacacccatgctggccggagtctccgagtacgagctgccagaggatcccaagtgggaattccccagggacaaattgaccctgggcaaacccctgggagaaggatgcttcggccaggtggtaatggcagaggccgtcggtatcgacaaggataagccaaaggaggcagtgactgtagcagtgaagatgctgaaagacgatgctacagaaaaagatctgtctgaccttgtgagcgaaatggagatgatgaaaatgatcgggaagcataagaacataattaaccttctgggagcctgtacacaggatggcccactctatgtgatcgtcgagtatgcttctaaggggaatctaagggaatacctgcgtgctcgaaggcctcctggtatggagtactcttacgacatcaaccgtgttccagaagaacagatgacctttaaagacctggtctcctgtacttaccagctggcccgaggtatggagtacttggcctcccagaagtgcatccaccgggatctggctgccagaaatgtactggttaccgaaaacaacgtgatgaaaattgcagattttggactggcccgagacataaacaacatcgactactataaaaagacaacgaacggacgcctccctgtgaaatggatggcaccagaggctctcttcgaccgcgtgtacacccatcaatcagatgtgtggtcattcggagtccttatgtgggagattttcactttgggcggatctccatacccgggaattcctgtcgaggaactgttcaagttgctgaaagagggccatagaatggataagcctgcaaattgcaccaatgaactctatatgatgatgcgggactgctggcacgctgtgccgtctcagagaccgactttcaaacagctcgtcgaggacctcgatcgcatcctcaccctcaccacaaacgaaatctag

SEQ ID NO: 223244 - DNA, 2310 bp, Artificial Sequence
  Description of Artificial Sequence: Synthetic coding sequence
atggtgtcgtgggggcgatttatttgtctggttgtcgtgacgatggccacactctctcttgcacggccatcatttagtttggtggaagacactactctggaacctgaagagccgcctaccaagtatcagattagccaaccagaagtgtatgtggctgccccaggtgaatccctggaagtacgatgtctgctgaaggatgctgccgtgatcagctggactaaagatggggtccatctggggcctaacaacaggaccgtcctgatcggcgagtatctgcagattaagggggctactccaagagatagtggcttgtacgcatgtaccgcctctcggacggtcgatagcgaaacatggtacttcatggtcaacgtgacggacgcaatctccagcggtgacgatgaagatgataccgacggagctgaagactttgtgtccgagaactctaataacaagcgagcaccctattggacaaatacggaaaagatggaaaaacgattacacgccgtgccagctgccaacaccgtgaagtttcgatgtcctgccggaggcaatccgatgcctacaatgagatggctgaaaaacggcaaagagttcaagcaggagcacagaatcggcggatacaaggttaggaatcagcattggtcattgataatggagagcgtggtcccgtcagacaagggcaattacacttgtgttgtggagaatgaatatgggtccatcaaccacacttaccacctagacgttgtggaaaggtcaccacatagacctattctccaggccggactcccagccaatgccagcaccgtcgtcggcggagatgtggagtttgtgtgtaaagtgtacagcgacgcacagcctcacattcagtggattaagcacgtggagaaaaatggatctaaatacggccctgatggtctcccttacctgaaagtgctgaagcactcggggattaattccagcaatgcagaagttctggccctttttaatgtgaccgaggccgacgccggtgagtatatttgtaaggtatctaattatataggacaggcaaatcaatccgcatggctgaccgtcctgcccaagcagcaggcaccgggtcgagaaaaggagataacagccagccccgattacctggaaattgccatatattgcatcggcgtgttcctgattgcctgcatggtcgtcaccgtaattttatgccgcatgaagaacacgacaaaaaagccagactttagttcccaaccagccgtccataaactgacaaagaggattccactgcgacgacaagtgactgtaagcgcagaatctagcagcagcatgaatagcaatactcccctggtacgcatcacaactagattatccagcacggcagacacgcccatgctggccggagtgtctgagtacgaactccccgaagatccaaagtgggagtttcctcgggacaagctcacactcggcaaaccactgggcgaagggtgttttggtcaggtggttatggccgaagctgtgggcattgacaaggacaaaccgaaagaggctgtaacggtcgctgttaagatgctgaaagatgacgcaacagagaaggatctatccgacctggtcagcgagatggaaatgatgaagatgattgggaagcacaagaacatcataaatctcctaggcgcatgtacacaggatggcccactatacgtgattgtcgagtacgcttccaagggcaatttgagggaatatctgagggcaagacggccaccaggaatggaatacagctatgacatcaatcgagtcccagaggagcaaatgacgtttaaggatctggtgtcctgtacataccaacttgctcgcggtatggagtatctggcctcccaaaagtgtatccatcgggatctggctgctcgcaatgtgctggtgactgaaaataacgtgatgaaaatcgctgatttcggcctcgcccgtgatattaataatattgattattacaagaaaactaccaatgggagactgccagtgaagtggatggcacctgaggcattgttcgatagagtttatacccatcagagtgacgtgtggtcgttcggggttctaatgtgggaaatattcacgctaggaggaagcccctacccaggaatacccgtggaagagctcttcaagctcctgaaggaaggccatagaatggataaacctgcgaattgcaccaatgagctttacatgatgatgcgggactgctggcacgccgtgccctcccagcggccaacatttaagcagctcgttgaagacctagacagaattttgactctgacaactaacgagatttag

SEQ ID NO: 223245 - DNA, 2307 bp, Artificial Sequence
  Description of Artificial Sequence: Synthetic coding sequence
atggtatcatggggacgttttatctgtctcgtcgttgtgacaatggccacgcttagcttagcacgaccctccttctcactcgtggaggatacaactcttgaaccagaggagccccctaccaagtaccagatatcccaacccgaggtgtatgtagctgctcctggtgaatccctggaggtgcgatgtctgctgaaggatgctgctgtaatatcctggaccaaggacggtgtgcacttaggtccgaataatcgtaccgttctgatcggcgaatacttgcagatcaagggtgccacgccgcgtgactctggactgtatgcatgcacagcttctcgcacagtcgattccgaaacctggtattttatggtgaatgtcactgatgctataagctccggcgatgatgaggatgataccgacggagctgaggattttgtttccgagaattctaataacaagcgggcaccgtactggaccaatacggaaaagatggaaaaacgtctgcacgccgtccctgcagcgaacactgtcaaatttcggtgcccagccggaggaaatcctatgcccacaatgcggtggctaaaaaacggcaaggagttcaaacaggagcacagaatcgggggatacaaagtccggaaccaacattggagcctgatcatggagtccgtcgtgccttccgacaaggggaactacacctgcgtcgtcgaaaacgaatacgggtccatcaaccatacataccacctggatgtggtggagcggagcccacataggcctatccttcaagccggtttacccgcaaatgcctctacagtggttggaggcgatgtggagttcgtgtgtaaagtttattctgacgcacaaccacacattcagtggatcaagcacgtggagaagaacggttccaaatatggacccgacgggctcccgtatttgaaagtgttgaagcattcgggaatcaattctagcaacgccgaggttctggcgctgttcaacgtgaccgaagcagatgctggagagtatatctgtaaggtttccaactacatcggccaggctaaccagagcgcatggcttacagttttgcctaaacagcaagcaccaggcagagaaaaagagattaccgctagtcctgattacctggaaatcgctatctactgtataggcgttttcctgatcgcttgtatggtcgttaccgttatcctgtgccggatgaagaacaccacgaagaagccagacttttctagccagcccgctgtgcacaagttaacaaaaagaattcctctcagacgccaggttactgtgtccgctgagtcatcatcctcaatgaatagcaataccccgctcgtacggatcaccacccgactctcctccaccgcagatactcctatgctcgcgggagtctccgaatatgaactgcccgaggatccaaaatgggagtttcccagggacaaacttaccctgggaaagccccttggcgaggggtgcttcgggcaggtcgttatggctgaggctgtgggaattgacaaggacaagcccaaagaggccgttaccgtcgccgtgaagatgcttaaggatgatgctactgagaaagatctttccgatctagtcagcgagatggaaatgatgaagatgattgggaagcataagaatatcatcaacctgttgggcgcttgtactcaagatggcccactctatgtgatcgtggagtacgcatctaagggaaacctgagggagtaccttcgcgctcgcagacctccaggaatggagtactcgtacgatattaacagggtgcccgaagagcagatgacatttaaagacctggtctcctgtacttaccaactcgccaggggcatggagtatctggcatcccaaaaatgcatccacagggatctcgcagcgcgaaacgtgttggtgaccgagaataacgtgatgaagatcgctgattttgggctcgctcgcgacattaacaatatagactactacaaaaagaccaccaatggtcgactgcctgtgaaatggatggcccctgaggccctgttcgacagggtgtacactcaccagagcgatgtatggtcgtttggagtcctgatgtgggagattttcaccttgggagggtccccctatcccggaatccccgttgaagagctcttcaagctgctcaaagagggccaccgcatggacaagccagcaaactgtaccaatgaactttacatgatgatgcgggactgttggcacgctgtgccctctcagagacccactttcaagcaacttgtggaggatctggatcggatccttactcttacaacaaacgaatag

SEQ ID NO: 223246 - DNA, 2124 bp, Artificial Sequence
  Description of Artificial Sequence: Synthetic coding sequence
atggtcagttggggtcgatttatctgcctcgttgtcgtcacgatggccacactgtcccttgcccgacccagttttagtctagtggaagatactacactggaaccagaaggtgctccttattggactaatacagaaaagatggagaaacgcctgcacgctgtgcccgcagctaatacagttaaatttcgatgtcccgctggtgggaaccccatgccgaccatgaggtggcttaagaatggcaaggagtttaaacaggaacatcgaatcgggggatacaaggttaggaaccagcactggtccttgattatggagtccgtcgtgccctcggacaaaggaaactatacctgcgtagtggaaaatgagtacggctccataaatcatacttatcacctggacgtggtggagcggagcccgcaccgtcccatcttgcaggctgggcttccggctaacgcgtcaacggtcgtgggcggagacgtggagtttgtgtgcaaagtgtacagtgatgcacagcctcatatacagtggattaagcacgtggaaaagaatggcagcaagtatggcccagacggcctgccctatctaaaggttctgaaacatagtggcatcaattcgagcaacgcagaggtcttagccctctttaacgtcaccgaagcggatgccggtgagtatatctgcaaggtctcaaactacattggtcaggccaaccagtccgcctggctgaccgtgttaccaaagcagcaagcacccggacgggaaaaagagatcacagcctcacccgactacctggaaattgccatctactgtataggagtgttcctcatcgcctgcatggtggtgaccgtcatcctttgtcgaatgaagaacaccactaagaaacccgatttttcctcccaacccgctgttcacaaactcaccaagcgcatccctctccgaaggcaagtcaccgtctctgcggagagcagctcttccatgaacagtaacacgccactagtgagaatcaccaccagactgagtagcaccgccgacacaccaatgctcgccggagtctcagaatacgagctgcccgaagatcctaagtgggagtttccaagggacaagctcaccctgggcaaacccttgggagagggctgcttcggacaagtggtgatggctgaggccgtcggcattgataaagacaaacctaaagaagcagtcacagtggccgtgaagatgctgaaagacgatgccacggagaaggatctgtccgatcttgtctccgaaatggaaatgatgaagatgattggcaaacacaaaaatatcattaaccttctcggcgcttgtacacaggacgggcctctctatgtgatcgtagagtacgcttcaaagggcaatctgcgtgaatacctacgcgctaggcggccacctgggatggagtattcatatgatatcaacagggtgccagaggagcagatgacatttaaggatctggtgagctgcacctatcagctcgccagggggatggagtatttggcatctcagaagtgtattcatcgggacctggctgccaggaacgtactggtaacagaaaacaacgttatgaaaatagccgatttcggtctggcgagggatatcaacaacatagactattacaaaaaaaccacgaacggccgactgcctgtgaaatggatggctcccgaggccctgtttgaccgcgtctatacacaccagtccgacgtgtggtctttcggcgtactcatgtgggaaatctttaccctgggcggaagcccatatcctgggatacccgtcgaggagcttttcaaactgctgaaagaggggcaccgcatggacaagccagcaaattgcacaaacgaactatacatgatgatgagagactgttggcacgctgtcccctcccagcggccaaccttcaaacaactggtagaggatcttgacaggatcctcactctgacgacaaatgaggagtatttggacctttcccaaccgctggagcagtattcacctagctatcctgacacaagaagttcttgtagctctggggacgacagcgttttttcccctgatcctatgccgtacgaaccatgcctgccacagtacccccatatcaacggctcagtcaagacctag

SEQ ID NO: 223247 - DNA, 2118 bp, Artificial Sequence
  Description of Artificial Sequence: Synthetic coding sequence
atggtcagctggggaaggttcatttgcctggtcgtggtgacgatggcgacactgagcctggcaaggcccagcttttctctggtggaagatacaacactggagcctgaggagccacctactaaatatcaaatttctcagcctgaggtatacgttgccgctcctggcgagagcctcgaggtacgctgcttactgaaagatgctgctgtgatctcctggactaaagacggagtacacctgggtcctaacaatcgtactgtgcttatcggcgaatacctgcaaatcaaaggagctacacctcgggattccgggctctatgcttgcactgcgagcagaaccgtggattccgagacatggtacttcatggtcaatgtaaccgacgctatttcatcaggggatgacgaggacgacaccgatggggctgaggatttcgtctcagagaattccaacaataagcgagcgccttactggactaataccgagaagatggaaaaacggctgcacgcagtgccagctgccaatactgtgaaatttcgatgcccagcagggggaaaccctatgccaacaatgcgttggctgaagaacggaaaggagttcaagcaggagcatcgcattgggggttacaaggttcggaatcaacactggtcattaataatggaaagcgtggtgccctccgacaaagggaactatacctgcgtagtggaaaatgagtacgggtccatcaaccacacttatcacctggacgttgtcgaaaggtcccctcaccgcccaatcttgcaagcgggattgcctgcaaacgcttccaccgtggttggcggagacgtagagtttgtctgtaaggtctattcagacgcccagccacatattcagtggatcaagcatgtggaaaagaatggtagcaaatacggtcctgacggactgccctacctgaaagtgctgaaagtgagcgccgagagttcttcaagcatgaactctaatacacctctggtgcggataacgacccgcctgtcctcgaccgctgatacacccatgcttgccggtgtgtctgagtacgaactgcccgaagaccctaaatgggagttccccagggacaaactgacgctggggaaaccattgggcgaggggtgtttcggtcaagtggtgatggcggaggccgtcgggattgataaagacaaaccaaaggaagcagtcaccgtcgcggtgaaaatgcttaaggacgatgcgacagagaaggacctgtctgatcttgtctcagagatggagatgatgaagatgattgggaaacacaaaaatatcattaacttgctgggggcttgcacccaggacggtcctctgtacgtcatcgttgaatacgcatctaaaggaaacttaagagagtacctgagggcccgaaggccccctggcatggaatatagttacgatatcaatagggtgcccgaggaacagatgacttttaaagacctcgttagctgcacctatcagctggctagggggatggagtacctcgcctctcagaagtgtattcatcgagacctggccgcacggaacgtgcttgtcacagagaataacgtaatgaaaattgctgacttcggtctggccagagatattaacaatatagactattacaagaagacaacaaatggcagactgccggtcaaatggatggcaccagaggcgttgttcgacagggtttatacacaccagagtgacgtctggtcgtttggggtcctgatgtgggagatctttacactcggcggatcaccttatcctggtatacctgtagaagagttgttcaaactgctgaaagagggacatcggatggacaagccggcaaattgtactaacgagctctatatgatgatgagagattgctggcacgccgtgccgtctcagaggcctacgttcaagcagctggtggaagacctggatcgcattttaacgctgacaaccaacgaggaatatctcgatctgagccagcctcttgagcagtattctccctcctaccccgatacaaggagttcgtgttcttccggagacgacagcgtgttttcccccgaccctatgccatacgagccatgcctcccacagtacccccacatcaacggttccgtgaaaacctag

SEQ ID NO: 223248 - DNA, 2130 bp, Artificial Sequence
  Description of Artificial Sequence: Synthetic coding sequence
atggtgtcttggggcaggtttatttgcctcgtggtcgtgacgatggccactctatctcttgcgaggccctctttctccctcgttgaggatacaacactggagccagaggaaccaccgaccaagtaccagatttcccagcctgaagtttatgtggcggcacctggggaatccctggaagtgcgatgtcttttgaaggacgccgcagttattagctggaccaaagatggagtgcacctggggcctaataatcggactgtactcattggcgagtacctgcagatcaaaggagctactcccagagatagtggcctgtatgcgtgcactgccagccggaccgtggactccgaaacctggtacttcatggtgaatgttacggatgcaatctcttcaggagatgatgaagatgatactgatggggctgaagactttgtgagcgaaaattctaataacaagcgggcaccctactggaccaatactgagaagatggaaaaacgactgcacgccgtgccggctgcaaatacagttaagtttagatgtccggctggaggcaatcccatgcccactatgaggtggctgaagaacggaaaggagttcaagcaggaacacagaattggcggttataaggtgagaaatcagcactggtcactgatcatggagagtgtggttccatctgacaagggaaactatacttgtgttgtggaaaatgagtacggctctataaatcatacctaccatctcgacgtggtcgcacctggacgcgagaaagagattacagccagcccagattacctggagatcgcaatctactgtattggcgtttttctgattgcctgtatggtcgtgacggtgattctgtgtcggatgaagaatactaccaagaaacctgattttagctctcagcctgctgttcacaagctgactaaaaggatcccccttcggaggcaggtgacggttagcgccgaatcctcaagctccatgaactctaatactccactcgtgcggattacaacccgactttcatcgactgctgatacacctatgctggctggggtgagcgaatacgagttgcctgaagaccccaagtgggagtttcctagagataagctgacactgggcaagccgctgggggagggttgttttgggcaagtcgttatggccgaagccgtcggtatcgacaaagacaagcccaaagaggcagtgacagtggccgtgaagatgttgaaagatgatgccaccgagaaagacctttcggacctggtttctgagatggaaatgatgaagatgatcggcaaacacaagaacataattaatctgctcggcgcatgcacacaggacgggccactctatgtaattgtcgagtatgccagcaaaggtaatcttcgagaatatctgagggctaggcgccctcctgggatggaatattcttatgatatcaacagggttccagaggagcagatgactttcaaggaccttgttagttgtacataccagctggcccgaggcatggaatatctcgcaagccagaagtgcattcacagagacctcgccgctcgaaacgtgctggtaacagaaaataatgtgatgaagatagcagattttggacttgcgagggacattaataatatagattactataagaagaccacgaacggaaggttacccgtgaaatggatggcccctgaggctctgttcgaccgcgtgtacacacatcagtctgatgtatggagctttggagttctaatgtgggaaattttcacattgggcggatctccatatcctgggattcccgtcgaagagctattcaaactcctgaaagaagggcaccggatggataagcctgccaattgtacaaacgaactctacatgatgatgagggactgctggcatgctgtgccttctcagaggccgacttttaaacagctggtagaagatcttgaccgcatcttaacactcacaacaaatgaagagtaccttgacctctcccagcccttagaacaatattctcccagttacccagatacaagatcctcctgtagcagcggtgatgacagcgtgttttctcctgatcctatgccctatgagccttgcctacctcagtaccctcatataaacggatccgttaagacatag

SEQ ID NO: 223249 - DNA, 2469 bp, Artificial Sequence
  Description of Artificial Sequence: Synthetic coding sequence
atggtcagctgggggcgatttatttgcttagttgtggtcactatggccacactatctttagctcggccttcctttagcctcgttgaagataccacattagaacccgaggagccccctaccaaatatcaaattagtcagcctgaggtctatgtcgcagcccctggtgaatcactagaggtacggtgtctgctgaaggatgcagccgtcatcagctggacaaaggacggagttcacttgggcccaaacaacagaactgtcctgatcggcgaatacctccagattaaaggagcaactcctagggactcggggctgtacgcctgtacagcatctaggaccgttgatagtgagacatggtacttcatggtcaacgttacagacgcaatctcgtctggcgatgatgaagatgatactgacggcgcagaggatttcgtgtccgagaattcaaataacaagcgagcaccatactggaccaataccgagaaaatggagaagcggctgcacgcagttccggcagcaaacactgtcaagttccggtgtccagccggaggcaaccctatgccaacgatgcgctggctgaagaatgggaaagaatttaaacaggagcatcgaattgggggatacaaagtccgtaatcagcactggtcgctcataatggaatccgtggtccccagtgataagggtaactacacatgtgtggtcgagaacgagtacggctccatcaaccatacgtatcatctcgatgtggtcgaaaggagccctcaccgcccaatcctccaggccggattgcctgcgaatgcttcgaccgtggttggtggggatgttgaattcgtctgtaaagtttactcagatgcccagccgcatattcagtggatcaaacacgtcgagaaaaacggcagcaagtacggccctgatgggctcccttatctgaaagtgctgaaggtgactaaggcggctggggtcaacacgacggataaagagatcgaggtgctgtacatccggaatgtgaccttcgaagacgccggtgagtatacatgtttggccggaaattctatagggatctcattccactcagcatggctgactgttctcccggctccaggtagggagaaggaaataactgcatccccagactacttagagatcgctatctactgtattggcgtgttcctaattgcttgtatggtcgtgacagtaattctgtgtaggatgaagaacaccaccaagaaacctgacttcagttcccagcctgccgtccacaagctgactaagagaattcctctcagaagacaggtcagcgctgagagcagtagcagcatgaactccaatacgcccctggtacgtatcaccactagactgtcttccacggcagatacccccatgctcgccggtgtgtccgaatatgagctgccagaggatccgaagtgggaatttccaagagacaaactaacccttggaaagcctctcggtgagggttgcttcggtcaggtggttatggctgaggccgtcgggatagacaaggacaagcctaaggaagctgtgaccgtggccgtgaagatgctgaaggatgacgctacagaaaaggatctctccgatctggttagcgagatggaaatgatgaaaatgatcggtaagcataagaatataattaacctgctgggcgcatgcacacaagacggcccactgtacgtaatcgtcgaatacgcctccaaggggaatcttagagaatacttacgggcacgacggcctccaggcatggagtactcgtatgatattaaccgcgttcctgaagaacagatgaccttcaaagacctcgtgagctgtacctatcagcttgcacgcggtatggaatatttggcgagccagaaatgtatacaccgggatcttgcagcccgaaatgtgctggtgacggaaaacaacgtcatgaaaatcgccgactttgggctggccagagatatcaataacatcgattactataagaagaccactaatggtaggctgccagttaagtggatggcccctgaggcacttttcgatcgggtgtacacccatcagtctgatgtatggtcttttggcgtgttaatgtgggagatctttactctgggaggttctccttaccccggaattccggtagaagagctattcaaactcctcaaggaaggccatcgtatggacaaacctgccaactgtaccaacgaactgtacatgatgatgcgggactgctggcacgccgtgccaagccagcgtccaacgttcaaacagttagtggaagacctagataggattctgacactgaccaccaacgaagaatacttagacctgtcacaacccttagagcagtatagtccatcttacccagataccagatcaagttgctcctccggagatgatagcgtgttctctcctgaccctatgccctacgaaccatgccttccgcaataccctcatatcaacggcagcgtgaagacttag

SEQ ID NO: 223250 - DNA, 2469 bp, Artificial Sequence
  Description of Artificial Sequence: Synthetic coding sequence
atggtctcatggggtcggtttatctgtcttgttgtggtcactatggcaaccctctctctggccaggccctctttttcactcgtggaagacacaacccttgaacctgaggaaccacccactaaataccaaatctcacagcctgaggtctatgtggccgctcccggagagagcctggaggtgagatgtctgctgaaagacgcggcagtgatctcatggacgaaagacggggttcacttgggaccaaataatagaacagtgctgatcggggaatacctgcagatcaaaggcgcaactcctcgcgatagcggcctttatgcctgcaccgcgagtcgtacagtggattcagaaacctggtactttatggtcaacgtaacagacgcgatctctagtggagacgacgaggacgacacagacggcgctgaggacttcgtgagcgaaaacagcaataacaaaagagcgccatactggaccaataccgagaagatggaaaagcggctccatgcagtgccagcagctaacacagtgaaatttaggtgccccgctgggggaaatcctatgcctactatgaggtggctaaagaatggaaaggagtttaaacaggagcaccggatcggcggatacaaagtgcgtaaccagcattggtctcttatcatggaaagcgttgtgccctcggacaaaggtaactatacttgtgtcgttgagaacgagtatgggagcataaaccacacctatcacttagatgtcgttgagaggtcgccccaccgacccattctccaagccggtctgcccgcaaacgcgtctaccgtagttggcggagatgttgaattcgtttgtaaggtgtactcggatgctcagccacacattcagtggattaagcatgtggagaaaaacggaagcaagtacgggccagacggtctcccttatctcaaggttctcaaacattctggaatcaacagttcaaacgctgaggtactcgcactgttcaacgttactgaagctgacgcaggtgagtatatctgtaaagtgtctaattacattggtcaggccaatcagagtgcatggctgaccgtcctgcccaaacagcaggccccaggcagagagaaggaaatcaccgcatcccctgactacttggagatcgctatctactgcatcggagtgtttttgattgcctgcatggtagtgactgtgatcctgtgcagaatgaagaatacaacaaagaagcccgacttttcatctcagcccgcagtgcataaactaaccaagcgaatacccctccgcaggcaggtcaccgtgtccgctgaatcttctagttctatgaactcaaacactcctctggtcaggattacaactcggctctcctccaccgccgacacacccatgctcgccggagtttcggagtacgaacttcccgaggatccaaagtgggaatttcccagggataagttaacgctcgggaagcctctgggagagggctgcttcgggcaagtggtaatggcggaagcggtgggaattgacaaagataagccaaaagaagctgtgacagtggcagtgaaaatgctgaaagacgacgctactgaaaaagatttatctgatctcgtcagcgagatggagatgatgaaaatgatcggcaaacataagaatattatcaatctccttggggcttgtactcaagatgggccactctacgtgattgtggagtacgcaagcaaggggaatctgagggagtaccttcgcgcacggagaccaccgggtatggaatatagctatgacataaatcgcgtaccagaggagcaaatgactttcaaagatctggtatcctgtacttatcagctcgcgcgaggaatggaatacttggcatcccagaagtgcatacacagggacctcgccgcacgcaacgtcctcgtgacggaaaacaacgtaatgaaaattgccgacttcggcctagccagggatatcaacaatattgattattacaagaagaccaccaatgggaggctacccgtgaagtggatggcgcctgaggcgctgttcgatcgcgtgtatacccaccaatcggacgtttggtctttcggcgtgttaatgtgggagattttcacattaggtggctcaccttatccaggtatccctgtggaggagctgtttaagctgctgaaggaagggcatcggatggacaagcccgctaattgtacaaacgagctgtatatgatgatgcgcgattgctggcatgcagtgccatcccagcgccctactttcaaacagttggtcgaggacctcgatcgaattttaacccttacaacaaatgaagaatatcttgatttatctcagcccctggagcagtacagtccatcatatcccgacacccgatcttcctgttcttctggagacgattcagttttttcacctgatcccatgccctacgagccttgcctgccccagtacccccacatcaacggctctgtgaaaacctag

SEQ ID NO: 223251 - DNA, 1515 bp, Artificial Sequence
  Description of Artificial Sequence: Synthetic coding sequence
atgaccccaagtccactgcttctgctgttgctacctcctttgctgcttggagcctttccacccgcagctgccgcaagggggcctcctaagatggccgataaggtggtgccacggcaggtagcaagactcggcaggactgtgcgactgcagtgccccgtggagggtgatccccctccccttactatgtggacaaaagacgggaggacaatccacagtggttggtccagattccgcgtgcttccgcagggccttaaagtgaaacaggttgagagagaagatgccggagtctatgtctgtaaggccacgaacgggttcggatctctgagcgtgaactacactctggttgttttagacgacatttccccaggcaaggagtcacttggcccagacagcagcagtggcggtcaggaagacccagcttcacaacagtgggcacgcccaaggttcacccagccctctaaaatgagaagacgggtgatagctaggccagtgggttcaagtgttcggttaaagtgtgtggcgagcggccatccacgccctgatattacctggatgaaagacgaccaagccctgacccgacccgaagcggctgagcccagaaagaaaaagtggactttgagtttaaagaacctgcgacccgaggattctggaaaatacacatgcagggtgtctaaccgggcaggggcaattaatgctacgtataaagttgacgtgatacagcggacacggtccaaacctgtgctgactggcacacatccagtaaatactacagtggacttcggtggtacgacaagcttccagtgtaaggtccgaagtgacgttaaacccgtcatccaatggctcaagcgcgtggaatatggggctgagggcaggcataatagcactatcgacgtgggcggacagaaattcgtggtcctccccacaggggacgtctggtctagacctgatgggtcctacttgaacaagttattgatcacccgagctagacaagacgatgcaggtatgtacatctgtctgggagctaacacaatgggctacagctttcggagcgctttcctgaccgtgctgcccgatccaaaacctccgggaccacctgtggccagttcttccagtgcgacctcactaccctggcccgtggtcataggtattcctgccggtgccgtgttcatcctcggtactctcctgctttggttgtgccaggcccagaaaaagccatgcactcccgcaccggctcccccactacccggacatcggccacccggaaccgctcgcgatcggtctggcgacaaagacctgccttccctggcggctctgtctgcaggaccaggtgtgggcctgtgcgaggagcacggctctccggctgccccacagcacctgctgggcccaggtccagtcgccggacccaaattgtatcctaagctctataccgacattcacacgcacacacacactcactcccacactcactcacatgtcgagggaaaggtccaccagcacatccactatcagtgctag

SEQ ID NO: 223252 - DNA, 1515 bp, Artificial Sequence
  Description of Artificial Sequence: Synthetic coding sequence
atgacacccagcccactgttgcttctcctgttgcctcctcttttactcggcgcatttccacccgcagctgcagctagaggccctccaaagatggccgacaaggtcgtgccccgtcaggttgccagacttggacggaccgtgagactccagtgtcctgtggaaggtgatccgccaccgctcactatgtggaccaaagatggtaggaccatccattcaggctggagccggttcagggtgctgccccagggactgaaggtcaagcaggtcgagcgggaagacgcaggtgtttatgtctgtaaagcaacaaatgggttcggatccttatccgtgaactatactctggtagtgctcgatgacatctctcccggtaaggaatccctcggtcccgattcaagtagcggcggtcaggaggaccctgcctcacaacaatgggccagacccagattcacacaaccatctaagatgagaaggagagtgatcgcacgccctgtgggcagctcagtacgtctgaaatgcgtcgcctcaggtcatccccgtccggacataacatggatgaaagatgaccaagcgttgaccaggcccgaagccgcagagccccgaaaaaagaaatggacactctccttgaaaaacttgcgccctgaagatagtggaaaatacacctgtcgcgtttccaatcgcgcaggggcaattaatgcaacgtacaaggtggatgtcatccaacggactaggtcaaagcccgtgcttaccgggacgcacccagtgaacaccaccgtcgactttggcggaacaacctcgttccagtgtaaggtgcgctccgatgtgaaacccgtgatccagtggttgaagcgtgtcgagtacggggctgagggcagacacaacagcaccatcgacgtcggtggacagaagttcgtcgtcctccctacaggggacgtgtggagtcggccagatggctcctacctgaacaagctgctgatcaccagggctaggcaagacgatgccggaatgtacatctgtctgggagcaaacactatgggctacagcttcaggtccgcattccttacagttttgccagatcccaaacctccaggccctccggtggcttctagttcttcggctacatcgctcccatggccggtggtcattgggattcccgcaggagcggtcttcatcctgggaaccttactcctgtggctgtgccaggcacagaagaaaccctgcactcctgcgccagctccgccactcccaggccacaggccaccaggcacagcgcgtgatcgctcaggcgataaggaccttccatcgctggctgcactgtccgcaggaccaggcgtggggctgtgcgaagagcatggaagccccgcagctccacagcatctcctgggcccagggccagtagccggacctaagctatatccaaaactgtacaccgatatccacactcatacacacacccactcacatacacactctcacgtcgagggcaaggtacatcagcatattcactaccagtgttag

SEQ ID NO: 223253 - DNA, 1515 bp, Artificial Sequence
  Description of Artificial Sequence: Synthetic coding sequence
atgactccatcccctctgttgctgctgttgcttcctccgctcctgctgggggcttttccacccgctgctgctgccaggggtcctccgaagatggctgacaaggttgttcccagacaggtcgcgagactcggcaggacagtcagactccagtgccccgtagagggggaccccccacctcttacaatgtggactaaggatggtagaaccatccactccggatggtcacgatttagggtgcttcctcaagggctcaaggtgaagcaagtggagagagaagatgcaggggtgtacgtgtgcaaagcaaccaatggcttcggtagcttgagtgtgaactacacattagttgtgttggatgacatctcgcctggcaaagagtcccttggacccgatagctcctctgggggacaggaggatccagcttcccagcagtgggcgagaccgcgatttacccagccaagcaaaatgcggagacgggtaatagctagacccgtcgggtcttccgtccgactcaagtgcgtcgcgtccggacacccacgacccgacatcacttggatgaaagatgaccaagccttaactaggccagaagcagccgagccacgaaaaaagaagtggactctctccctcaagaatttacggccagaggattctggcaagtatacctgcagggtgtccaacagggctggtgcaataaacgctacttacaaggttgatgttattcaacgcaccaggagcaaacccgttctgacaggaacacatcccgtgaatactactgtcgattttgggggtacgaccagcttccaatgtaaggtgagatcagacgtcaagccggtaatccagtggcttaagcgagtggaatacggcgcagaggggagacacaactccaccattgatgtcgggggacagaagttcgttgtactgcccaccggagacgtgtggtcccggcctgacggttcatatttgaataaactgctgatcacacgtgctcggcaggacgatgccggaatgtatatatgccttggcgcaaacacaatgggatactcttttagatcagccttcttgactgttctgcccgaccctaagccacccggacctccagttgcgtctagtagttctgccacttctctcccatggcccgtggtaattgggattcctgcaggggcagtgttcatcctgggtactctgctgctatggctctgtcaagcacagaagaaaccttgcactcccgctccagccccacccctgccaggccacagacctcccggtacggctcgagacaggagcggcgataaagatctgcccagtctggccgcactgtctgctggccctggtgtggggctgtgcgaggagcacggaagtcccgctgccccacagcaccttcttggcccaggaccagttgctgggccaaaactgtaccctaagctgtatacggacatccacacacatacacatacccacagtcatacgcattcgcatgttgaggggaaagtacaccagcacatacactatcagtgttag

SEQ ID NO: 223254 - DNA, 459 bp, Artificial Sequence
  Description of Artificial Sequence: Synthetic coding sequence
atgaccccctctcctctattgctgctgttgctgcccccactcctgctgggggctttcccacccgctgccgcagcaagagggcctccaaaaatggccgacaaggttgtccctcgacaggtcgcccgactggggcgtaccgtgcggctgcaatgtccggtagaaggggacccccctcccctcacaatgtggacaaaagacggacgtaccatccactccggctggtctagatttcgcgtgcttccgcaggggcttaaggtgaagcaggtcgagcgggaggacgcgggtgtctacgtgtgtaaggccacaaatgggttcggaagtctgtcggtaaattacacactggtggttttagacgatatttcacctggaaaggagagtttagggcctgattcctctagcggagggcaggaagacccagcctcacagcagtgggccagaccaaggttcactcagccgtag

SEQ ID NO: 223255 - DNA, 1515 bp, Artificial Sequence
  Description of Artificial Sequence: Synthetic coding sequence
atgaccccaagcccgttgctgctgctgctcctcccacctctgttgctgggggctttcccgccagccgcagcagccagaggcccaccaaagatggccgataaagttgtccctcgccaggtggcacgcttgggtcggaccgtccggcttcagtgtcccgtggaaggtgatcctccgcctctgactatgtggactaaggatggaagaactatccattcagggtggtctaggttccgagttctgccacagggcctgaaggttaagcaggtggagcgcgaggacgccggtgtgtacgtctgtaaagctaccaacggatttggaagcctgagtgtaaactatactctcgtggtgctagacgacattagccccggaaaagaaagcctcggccctgacagctcatccggcggacaggaggatcctgcctctcagcagtgggccaggcctcgattcacacagccaagcaagatgcgaaggagggtaatagccaggcctgtcggctcttcggtgagattaaaatgtgttgccagcggccatcccagacccgatataacatggatgaaggacgaccaggcactcaccaggcctgaagccgctgaaccaagaaaaaagaagtggacactttccctgaagaacctccgtccagaagacagcgggaaatacacgtgcagagtgtctaacagggctggcgcaattaacgctacctacaaagtcgacgtcattcagagaaccagatccaaacctgtcctgaccggcacacaccccgtgaacacgaccgtcgatttcggcggaaccacctccttccagtgtaaggtacgatcagatgtaaagcccgtgatacaatggcttaaacgagttgagtatggagccgagggtcgccataacagtaccatagatgtgggtgggcaaaaattcgtagtgcttcctacaggggatgtttggtccaggcccgacgggtcctacctgaacaagctccttataacacgtgctcgtcaagacgacgctggcatgtatatctgtctgggtgcgaatacaatgggatattccttcaggtcagcatttctgaccgtgctgccagacccaaagccacctggtccacctgtcgccagcagcagctccgccaccagcctcccttggcccgtggtgatagggattccagctggggctgttttcatccttggcaccctgctgttatggttatgtcaggcccaaaagaaaccatgcactccagcacctgcccctcctctccccggacacagacctccaggtactgcacgcgatcgttctggcgacaaggacctgccttctttggcggcattgagtgctgggccaggggtaggcttgtgcgaagaacatggaagccccgctgctcctcagcatttgctgggtcccggaccggtcgcaggtcctaagctgtacccaaagctgtatactgatatccatactcacacacacacacactcccacacacattctcatgtggagggaaaggtccaccagcatatccactatcagtgctag

SEQ ID NO: 223256 - DNA, 243 bp, Artificial Sequence
  Description of Artificial Sequence: Synthetic coding sequence
atgacaccttccccacttttgctattactacttccccctctcctcttaggagcctttcccccagctgccgctgcaagagggccaccaaagatggccgataaagtggtccctcggcaggtagccagacttggacgcacagtacgcctgcagtgtcctgtggagggggacccccctccactcacaatgtggacgaaagacggtaggacaatacactctggctggagccggttcagggtgctttag

SEQ ID NO: 223257 - DNA, 1326 bp, Artificial Sequence
  Description of Artificial Sequence: Synthetic coding sequence
atggctgataaagtcgtgccccgtcaggtggcaaggctcggcagaactgtaaggctgcagtgtccagtggaaggagaccctcccccattgaccatgtggacaaaagatggacgcaccatacattctggatggagccgcttccgtgtgcttccacagggactcaaggtaaagcaggttgaaagagaggacgccggtgtgtatgtgtgcaaggctaccaacggttttgggtctctcagtgtgaattacactctggtggtgctggacgacatctctcccggaaaggagagcttaggccctgattcctcctccggtggccaggaagatccagcctctcagcaatgggccaggccaagattcacccaaccaagtaaaatgcggcgaagggtgattgctaggccagtgggctcctctgttcgcctgaaatgcgtagccagtggacaccctcgaccagacatcacctggatgaaagacgaccaggcactcacacggccagaggccgcagaaccgagaaaaaaaaaatggactctcagcctgaaaaacttgcggccagaagattcggggaaatatacttgtagagtgtccaatcgcgcaggcgctattaatgctacttacaaagtggatgtcatacaaagaacaaggtccaagcccgtgctgaccggaacacacccagtgaataccaccgtggattttgggggaactacaagttttcagtgcaaggtgcgcagtgacgtgaaacccgtaattcagtggctgaagagagtggagtatggggcagagggcagacacaatagtaccatagacgtgggaggccagaaattcgtggtgctgccaacaggcgatgtgtggtctcggcctgacggcagttacttgaataagctgctgatcacacgagcaagacaggatgacgccggtatgtatatctgtctgggtgctaatacgatgggatattcatttagatcagcctttctcactgtattgcccgaccctaaacctccgggacctcctgtggcctcatccagctcagcgaccagtctgccctggcctgtggttattggcattcccgctggcgcagtgtttattctgggtacactactgctgtggttatgtcaggcgcagaagaagccttgcactcccgctcctgctccgccactcccaggccacagacctcctgggacagcccgtgataggtctggggataaggacttgcctagtctggccgctctaagcgcagggccaggagtcggtctctgtgaggagcacggtagccccgcagcccctcagcaccctacagtggtcgttgccccagatctatgcaactttatgtag

SEQ ID NO: 223258 - DNA, 1131 bp, Artificial Sequence
  Description of Artificial Sequence: Synthetic coding sequence
atgcagtggaccagccttctcctgctagccggattattttccctatcacaagcacaatatgaggacgacccacactggtggttccactacttgcgcagtcagcagtctacctattacgacccatatgacccttatccatacgagacatatgagccttatccctatggagtcgacgaaggtcctgcatatacatatggctccccttccccacccgaccccagggactgtcctcaggagtgcgactgtccacctaattttccaacggcaatgtattgtgacaatcggaatctgaagtatctccctttcgtcccaagtaggatgaagtacgtttacttccagaataatcaaatcactagcatccaggaaggggtctttgataatgctaccgggcttctctggattgccctgcacgggaaccagattacttccgataaggtcgggaggaaggtcttttcaaaattgcgacacttggagaggctttacttggaccacaataatttaactcggatgcccggaccactgcctcggagtctcagagagttgcacctagaccacaatcagatatctagagtccccaacaacgcccttgaagggctggaaaacctcactgcactatatcttcagcacaacgaaatccaggaagtgggtagttcaatgcggggactgagatcactgatccttctggacctgagttacaatcatcttcgaaaggtgccagacgggctgcccagtgcgctcgaacagttgtatatggaacacaacaacgtgtacaccgtcccggattcctattttcgcggagccccaaagcttctgtatgttcgactgtcacataacagcctgactaataacggtctcgccagcaacactttcaatagtagcagcctgctggaattggacctgtcttacaaccagctgcagaagatcccacctgtgaataccaacctggagaacttatatctccagggaaaccgtattaacgaattttccataagcagcttctgcacagtagtcgacgtggtcaacttttcaaagttgcaagtgcttaggctggatggcaatgaaatcaaacgctctgcgatgccagcagacgccccactctgcctccgcctggcctcactgatcgagatctag

SEQ ID NO: 223259 - DNA, 1092 bp, Artificial Sequence
  Description of Artificial Sequence: Synthetic coding sequence
atgcagtggacatcattactcctgctcgccggactgttctccttatcacaggctcagtacgaggacgacccccactggtggtttcattacttgcggtctcaacagtctacatactatgacccctatgatccctacccctacgagacatatgaaccctatccatatggcgtcgatgagggcccagcgtacacgtatggttcgccttcccctccggatccacgtgactgcccgcaggaatgtgactgccccccaaacttcccacccttcgtgcccagcaggatgaaatacgtgtacttccagaataaccagataactagtatccaagagggcgtgtttgataatgccaccggcctgctttggatcgcactacacggtaatcaaataacatccgacaaagtcgggagaaaggtgttttctaaactgcggcacttggaacggctgtacctagaccacaataacttaacacgcatgcctgggcctctgcctaggtcccttagggagttacacctagatcataatcaaatcagtcgagtcccaaacaatgcgctcgaggggctcgagaacctgaccgctctctatctgcagcataacgagatccaggaagtgggaagctccatgcgaggcttgaggagccttattctgctggacctctcgtacaatcacctacgcaaagttcctgatggtttgccaagcgccctagagcagttatacatggagcacaacaatgtgtacacagtgcctgatagctactttcgaggagcacccaagcttctatatgtccgccttagccataactctctgaccaataacggcctggcctcgaatacgttcaattcttctagtttgctggaacttgacttgtcttataatcagctgcagaagataccacctgttaatactaatttagagaacctctatctccagggcaaccgcatcaacgaattcagcatttcaagcttctgcaccgtggtagacgtagtgaacttctctaaactgcaggtgctgagacttgacggcaatgagattaaaagatcagcaatgcccgctgacgcaccgttgtgcctgcggctggcatctcttatcgagatctag

SEQ ID NO: 223260 - DNA, 594 bp, Artificial Sequence
  Description of Artificial Sequence: Synthetic coding sequence
atgaagatgaccctaataggcggttcgacgacgtcggccgcttccagtccacccactaccatccccatgacactgactagaatgagaccgaccagtctgactcccatggggtggatgaaggggcagcccaccccgactgctttgcacccccttcaaatccccgctaccgcacccaggtccgccactgcccatccaacatctaccgctatgtactgtgacaataggaatttgaaatatttgccctttgtgccctcgcgaatgaagtatgtgtactttcagaataaccagataacatccatccaagagggtgttttcgataacgctactggcttgctgtggatagcgttacatggaaatcagataactagcgataaggttggcaggaaagtgttctccaaacttagacacttggagaggttatacttggaccacaataacctgacccgcatgccgggacctctgccacgcagtttgcgcgagttacatcttgaccacaaccagatctcacgggtgccaaataacgcgttggaaggcaggacctcacggccatgcacttccaacaccatgagatctcggaagtgggcagtgccctag

SEQ ID NO: 223261 - DNA, 2025 bp, Artificial Sequence
  Description of Artificial Sequence: Synthetic coding sequence
atggtcgtggcccacccgaccgcaactgcaaccacaacgcctactgcaaccgttactgccacggtggtgatgaccacagccactatggacctgcgcgactggctgttcttgtgttacggactcatagcattcttgacagaggtgatcgactccactacctgcccatcagtgtgccggtgcgataatggttttatctactgcaacgatagaggactgacgtctatccctgccgacataccagatgatgccacgaccctctatcttcagaataaccaaattaataacgccggaatcccacaggatctaaaaaccaaggtgaacgtacaggtgatttacctgtacgagaacgacctggatgagtttcccattaatttgccccgttcccttagggagttgcatctgcaggacaataacgtcaggaccatcgcacgcgactcccttgccagaatccctctacttgaaaagctgcatttagatgataattctgtgagtactgtcagtattgaggaagacgcgttcgctgactctaagcagttaaagctgttgttcctatctcggaaccacctgagctctatccccagcggcctgccacacacactcgaagagctgagattggatgataaccgcatctctactatccctttgcatgccttcaaaggactgaactcgctgcgccgtctggttttggatggcaatcttctggccaatcaacgcatcgcggatgacactttctctcggttgcagaatctgacagagctctcactggtgcgcaattccctggccgcaccaccgctgaacctcccgagtgcccaccttcagaagctctacctacaggataatgctatatcccatataccgtataacacacttgctaagatgagagagctggaaagactggacctcagcaataacaatcttacgaccctccctcgagggctgtttgacgacctgggtaatctggcccagctcctgctaagaaacaacccttggttttgcggatgtaatctcatgtggctgagagattgggtcaaggctcgtgcagccgtcgtaaatgtgcggggactgatgtgtcaagggccagagaaggttagaggaatggccatcaaggatatcacctctgaaatggatgagtgtttcgaaaccggccctcagggaggcgtggcaaacgcggctgcgaagacaaccgcttctaaccacgcgagcgccacgactcctcagggcagtctgttcactctaaaagctaagaggcccggtctgaggctccccgactcgaacatcgactaccccatggctacaggagatggcgcaaagacactggccattcacgtaaaggctcttacagcagatagtattcggattacatggaaagccacactgcctgcgtcatccttccgcctgtcttggctgcgtttgggacattccccagcggtcgggtcaataacagagacactggtgcagggcgataaaaccgaatatttattaaccgctttggaaccgaagtcgacgtatattatctgcatggtaactatggaaacctcaaacgcatatgttgccgacgagacacccgtgtgcgcaaaggctgaaactgccgatagttacggccctaccacgactttgaaccaggaacagaacgccggaccaatggcttccctccccttggcaggaatcatcggaggggctgtggcgttagtgttcctgttccttgtcctgggcgcaatctgctggtacgtgcaccaggcaggcgaactgctcacaagagagagagcctacaatagaggatctcgaaaaaaagatgactacatggagagcgggacaaaaaaggacaattctatcttggagatccgtggcccaggactgcagatgcttccaattaatccgtacagagcaaaggaggagtacgtggttcataccatttttccctccaatgggtcttcactgtgtaaggctactcataccattgggtatggaactacccgtgggtatcgggacggcggtataccggatatcgattatagctacacttag
